United States Patent 12,644,137 (MATERIALS AND METHODS FOR TREATMENT OF HEMOGLOBINOPATHIES) - sequence listing, part 9

SEQ ID NO: 178817 - DNA, 20 bp, Artificial Sequence
  Synthetic oligonucleotide; GAG chr2 60499622 60499641 60499625 -
tggggaggtatgaggggttg

SEQ ID NO: 178818 - DNA, 20 bp, Artificial Sequence
  Synthetic oligonucleotide; AGG chr2 60499621 60499640 60499624 -
ggggaggtatgaggggttgg

SEQ ID NO: 178819 - DNA, 20 bp, Artificial Sequence
  Synthetic oligonucleotide; GGG chr2 60499620 60499639 60499623 -
gggaggtatgaggggttgga

SEQ ID NO: 178820 - DNA, 20 bp, Artificial Sequence
  Synthetic oligonucleotide; GGG chr2 60499619 60499638 60499622 -
ggaggtatgaggggttggag

SEQ ID NO: 178821 - DNA, 20 bp, Artificial Sequence
  Synthetic oligonucleotide; TAG chr2 60499607 60499626 60499610 -
ggttggaggggtctttttgc

SEQ ID NO: 178822 - DNA, 20 bp, Artificial Sequence
  Synthetic oligonucleotide; TGG chr2 60499601 60499620 60499604 -
aggggtctttttgctagccc

SEQ ID NO: 178823 - DNA, 20 bp, Artificial Sequence
  Synthetic oligonucleotide; TGG chr2 60499594 60499613 60499597 -
tttttgctagccctggcccg

SEQ ID NO: 178824 - DNA, 20 bp, Artificial Sequence
  Synthetic oligonucleotide; GAG chr2 60499578 60499597 60499581 -
cccgtggcaaacactgtctt

SEQ ID NO: 178825 - DNA, 20 bp, Artificial Sequence
  Synthetic oligonucleotide; AAG chr2 60499574 60499593 60499577 -
tggcaaacactgtcttgaga

SEQ ID NO: 178826 - DNA, 20 bp, Artificial Sequence
  Synthetic oligonucleotide; TGG chr2 60499571 60499590 60499574 -
caaacactgtcttgagaaag

SEQ ID NO: 178827 - DNA, 20 bp, Artificial Sequence
  Synthetic oligonucleotide; GGG chr2 60499570 60499589 60499573 -
aaacactgtcttgagaaagt

SEQ ID NO: 178828 - DNA, 20 bp, Artificial Sequence
  Synthetic oligonucleotide; AAG chr2 60499561 60499580 60499564 -
cttgagaaagtgggacgttg

SEQ ID NO: 178829 - DNA, 20 bp, Artificial Sequence
  Synthetic oligonucleotide; AGG chr2 60499560 60499579 60499563 -
ttgagaaagtgggacgttga

SEQ ID NO: 178830 - DNA, 20 bp, Artificial Sequence
  Synthetic oligonucleotide; GAG chr2 60499558 60499577 60499561 -
gagaaagtgggacgttgaag

SEQ ID NO: 178831 - DNA, 20 bp, Artificial Sequence
  Synthetic oligonucleotide; TGG chr2 60499553 60499572 60499556 -
agtgggacgttgaaggagct

SEQ ID NO: 178832 - DNA, 20 bp, Artificial Sequence
  Synthetic oligonucleotide; AAG chr2 60499544 60499563 60499547 -
ttgaaggagcttggactcta

SEQ ID NO: 178833 - DNA, 20 bp, Artificial Sequence
  Synthetic oligonucleotide; CAG chr2 60499540 60499559 60499543 -
aggagcttggactctaaagt

SEQ ID NO: 178834 - DNA, 20 bp, Artificial Sequence
  Synthetic oligonucleotide; GAG chr2 60499529 60499548 60499532 -
ctctaaagtcagctacacat

SEQ ID NO: 178835 - DNA, 20 bp, Artificial Sequence
  Synthetic oligonucleotide; TGG chr2 60499513 60499532 60499516 -
acatgagtcttttcacctgc

SEQ ID NO: 178836 - DNA, 20 bp, Artificial Sequence
  Synthetic oligonucleotide; TAG chr2 60499509 60499528 60499512 -
gagtcttttcacctgctggc

SEQ ID NO: 178837 - DNA, 20 bp, Artificial Sequence
  Synthetic oligonucleotide; AGG chr2 60499508 60499527 60499511 -
agtcttttcacctgctggct

SEQ ID NO: 178838 - DNA, 20 bp, Artificial Sequence
  Synthetic oligonucleotide; TGG chr2 60499505 60499524 60499508 -
cttttcacctgctggctagg

SEQ ID NO: 178839 - DNA, 20 bp, Artificial Sequence
  Synthetic oligonucleotide; CGG chr2 60499499 60499518 60499502 -
acctgctggctaggtggccc

SEQ ID NO: 178840 - DNA, 20 bp, Artificial Sequence
  Synthetic oligonucleotide; AAG chr2 60499494 60499513 60499497 -
ctggctaggtggccccggac

SEQ ID NO: 178841 - DNA, 20 bp, Artificial Sequence
  Synthetic oligonucleotide; CAG chr2 60499486 60499505 60499489 -
gtggccccggacaagtcaat

SEQ ID NO: 178842 - DNA, 20 bp, Artificial Sequence
  Synthetic oligonucleotide; TGG chr2 60499478 60499497 60499481 -
ggacaagtcaatcagcctat

SEQ ID NO: 178843 - DNA, 20 bp, Artificial Sequence
  Synthetic oligonucleotide; GGG chr2 60499477 60499496 60499480 -
gacaagtcaatcagcctatt

SEQ ID NO: 178844 - DNA, 20 bp, Artificial Sequence
  Synthetic oligonucleotide; CAG chr2 60499471 60499490 60499474 -
tcaatcagcctattgggcct

SEQ ID NO: 178845 - DNA, 20 bp, Artificial Sequence
  Synthetic oligonucleotide; AGG chr2 60499470 60499489 60499473 -
caatcagcctattgggcctc

SEQ ID NO: 178846 - DNA, 20 bp, Artificial Sequence
  Synthetic oligonucleotide; TGG chr2 60499451 60499470 60499454 -
caggctctttatctataaaa

SEQ ID NO: 178847 - DNA, 20 bp, Artificial Sequence
  Synthetic oligonucleotide; GGG chr2 60499450 60499469 60499453 -
aggctctttatctataaaat

SEQ ID NO: 178848 - DNA, 20 bp, Artificial Sequence
  Synthetic oligonucleotide; GGG chr2 60499449 60499468 60499452 -
ggctctttatctataaaatg

SEQ ID NO: 178849 - DNA, 20 bp, Artificial Sequence
  Synthetic oligonucleotide; TGG chr2 60499426 60499445 60499429 -
ctaatttccttttttgcccc

SEQ ID NO: 178850 - DNA, 20 bp, Artificial Sequence
  Synthetic oligonucleotide; GGG chr2 60499425 60499444 60499428 -
taatttccttttttgcccct

SEQ ID NO: 178851 - DNA, 20 bp, Artificial Sequence
  Synthetic oligonucleotide; AAG chr2 60499422 60499441 60499425 -
tttccttttttgcccctggg

SEQ ID NO: 178852 - DNA, 20 bp, Artificial Sequence
  Synthetic oligonucleotide; TAG chr2 60499409 60499428 60499412 -
ccctgggaagaaatatcact

SEQ ID NO: 178853 - DNA, 20 bp, Artificial Sequence
  Synthetic oligonucleotide; GAG chr2 60499407 60499426 60499410 -
ctgggaagaaatatcactta

SEQ ID NO: 178854 - DNA, 20 bp, Artificial Sequence
  Synthetic oligonucleotide; AGG chr2 60499406 60499425 60499409 -
tgggaagaaatatcacttag

SEQ ID NO: 178855 - DNA, 20 bp, Artificial Sequence
  Synthetic oligonucleotide; GAG chr2 60499404 60499423 60499407 -
ggaagaaatatcacttagag

SEQ ID NO: 178856 - DNA, 20 bp, Artificial Sequence
  Synthetic oligonucleotide; CAG chr2 60499398 60499417 60499401 -
aatatcacttagaggagtta

SEQ ID NO: 178857 - DNA, 20 bp, Artificial Sequence
  Synthetic oligonucleotide; CAG chr2 60499379 60499398 60499382 -
acagaatgtgcaacctttcc

SEQ ID NO: 178858 - DNA, 20 bp, Artificial Sequence
  Synthetic oligonucleotide; AGG chr2 60499378 60499397 60499381 -
cagaatgtgcaacctttccc

SEQ ID NO: 178859 - DNA, 20 bp, Artificial Sequence
  Synthetic oligonucleotide; GAG chr2 60499376 60499395 60499379 -
gaatgtgcaacctttcccag

SEQ ID NO: 178860 - DNA, 20 bp, Artificial Sequence
  Synthetic oligonucleotide; AAG chr2 60499362 60499381 60499365 -
tcccaggagtattgctcctg

SEQ ID NO: 178861 - DNA, 20 bp, Artificial Sequence
  Synthetic oligonucleotide; AGG chr2 60499361 60499380 60499364 -
cccaggagtattgctcctga

SEQ ID NO: 178862 - DNA, 20 bp, Artificial Sequence
  Synthetic oligonucleotide; AAG chr2 60499355 60499374 60499358 -
agtattgctcctgaaggaat

SEQ ID NO: 178863 - DNA, 20 bp, Artificial Sequence
  Synthetic oligonucleotide; AGG chr2 60499354 60499373 60499357 -
gtattgctcctgaaggaata

SEQ ID NO: 178864 - DNA, 20 bp, Artificial Sequence
  Synthetic oligonucleotide; TGG chr2 60499346 60499365 60499349 -
cctgaaggaataaggcacga

SEQ ID NO: 178865 - DNA, 20 bp, Artificial Sequence
  Synthetic oligonucleotide; GGG chr2 60499345 60499364 60499348 -
ctgaaggaataaggcacgat

SEQ ID NO: 178866 - DNA, 20 bp, Artificial Sequence
  Synthetic oligonucleotide; CAG chr2 60499333 60499352 60499336 -
ggcacgatgggctttgactt

SEQ ID NO: 178867 - DNA, 20 bp, Artificial Sequence
  Synthetic oligonucleotide; CAG chr2 60499326 60499345 60499329 -
tgggctttgacttcagcctc

SEQ ID NO: 178868 - DNA, 20 bp, Artificial Sequence
  Synthetic oligonucleotide; TGG chr2 60499318 60499337 60499321 -
gacttcagcctccagcactg

SEQ ID NO: 178869 - DNA, 20 bp, Artificial Sequence
  Synthetic oligonucleotide; CAG chr2 60499313 60499332 60499316 -
cagcctccagcactgtggcc

SEQ ID NO: 178870 - DNA, 20 bp, Artificial Sequence
  Synthetic oligonucleotide; AAG chr2 60499310 60499329 60499313 -
cctccagcactgtggcccag

SEQ ID NO: 178871 - DNA, 20 bp, Artificial Sequence
  Synthetic oligonucleotide; AGG chr2 60499309 60499328 60499312 -
ctccagcactgtggcccaga

SEQ ID NO: 178872 - DNA, 20 bp, Artificial Sequence
  Synthetic oligonucleotide; GGG chr2 60499308 60499327 60499311 -
tccagcactgtggcccagaa

SEQ ID NO: 178873 - DNA, 20 bp, Artificial Sequence
  Synthetic oligonucleotide; TGG chr2 60499303 60499322 60499306 -
cactgtggcccagaagggta

SEQ ID NO: 178874 - DNA, 20 bp, Artificial Sequence
  Synthetic oligonucleotide; TGG chr2 60499299 60499318 60499302 -
gtggcccagaagggtatggc

SEQ ID NO: 178875 - DNA, 20 bp, Artificial Sequence
  Synthetic oligonucleotide; GGG chr2 60499298 60499317 60499301 -
tggcccagaagggtatggct

SEQ ID NO: 178876 - DNA, 20 bp, Artificial Sequence
  Synthetic oligonucleotide; CAG chr2 60499295 60499314 60499298 -
cccagaagggtatggctggg

SEQ ID NO: 178877 - DNA, 20 bp, Artificial Sequence
  Synthetic oligonucleotide; AGG chr2 60499294 60499313 60499297 -
ccagaagggtatggctgggc

SEQ ID NO: 178878 - DNA, 20 bp, Artificial Sequence
  Synthetic oligonucleotide; GGG chr2 60499293 60499312 60499296 -
cagaagggtatggctgggca

SEQ ID NO: 178879 - DNA, 20 bp, Artificial Sequence
  Synthetic oligonucleotide; GGG chr2 60499292 60499311 60499295 -
agaagggtatggctgggcag

SEQ ID NO: 178880 - DNA, 20 bp, Artificial Sequence
  Synthetic oligonucleotide; CAG chr2 60499276 60499295 60499279 -
gcaggggcgtcacacccctg

SEQ ID NO: 178881 - DNA, 20 bp, Artificial Sequence
  Synthetic oligonucleotide; TGG chr2 60499268 60499287 60499271 -
gtcacacccctgcagctctg

SEQ ID NO: 178882 - DNA, 20 bp, Artificial Sequence
  Synthetic oligonucleotide; GGG chr2 60499267 60499286 60499270 -
tcacacccctgcagctctgt

SEQ ID NO: 178883 - DNA, 20 bp, Artificial Sequence
  Synthetic oligonucleotide; GAG chr2 60499265 60499284 60499268 -
acacccctgcagctctgtgg

SEQ ID NO: 178884 - DNA, 20 bp, Artificial Sequence
  Synthetic oligonucleotide; CGG chr2 60499259 60499278 60499262 -
ctgcagctctgtgggagtga

SEQ ID NO: 178885 - DNA, 20 bp, Artificial Sequence
  Synthetic oligonucleotide; AAG chr2 60499256 60499275 60499259 -
cagctctgtgggagtgacgg

SEQ ID NO: 178886 - DNA, 20 bp, Artificial Sequence
  Synthetic oligonucleotide; AGG chr2 60499255 60499274 60499258 -
agctctgtgggagtgacgga

SEQ ID NO: 178887 - DNA, 20 bp, Artificial Sequence
  Synthetic oligonucleotide; GGG chr2 60499254 60499273 60499257 -
gctctgtgggagtgacggaa

SEQ ID NO: 178888 - DNA, 20 bp, Artificial Sequence
  Synthetic oligonucleotide; TGG chr2 60499229 60499248 60499232 -
ctatccactcgccttgcaca

SEQ ID NO: 178889 - DNA, 20 bp, Artificial Sequence
  Synthetic oligonucleotide; CAG chr2 60499212 60499231 60499215 -
acatggctgtcttgctctac

SEQ ID NO: 178890 - DNA, 20 bp, Artificial Sequence
  Synthetic oligonucleotide; AGG chr2 60499211 60499230 60499214 -
catggctgtcttgctctacc

SEQ ID NO: 178891 - DNA, 20 bp, Artificial Sequence
  Synthetic oligonucleotide; TAG chr2 60499205 60499224 60499208 -
tgtcttgctctaccaggcct

SEQ ID NO: 178892 - DNA, 20 bp, Artificial Sequence
  Synthetic oligonucleotide; AGG chr2 60499204 60499223 60499207 -
gtcttgctctaccaggcctt

SEQ ID NO: 178893 - DNA, 20 bp, Artificial Sequence
  Synthetic oligonucleotide; TGG chr2 60499196 60499215 60499199 -
ctaccaggccttaggttctg

SEQ ID NO: 178894 - DNA, 20 bp, Artificial Sequence
  Synthetic oligonucleotide; CAG chr2 60499192 60499211 60499195 -
caggccttaggttctgtggc

SEQ ID NO: 178895 - DNA, 20 bp, Artificial Sequence
  Synthetic oligonucleotide; CAG chr2 60499178 60499197 60499181 -
tgtggccagatactgttctc

SEQ ID NO: 178896 - DNA, 20 bp, Artificial Sequence
  Synthetic oligonucleotide; TGG chr2 60499170 60499189 60499173 -
gatactgttctccagctctt

SEQ ID NO: 178897 - DNA, 20 bp, Artificial Sequence
  Synthetic oligonucleotide; TGG chr2 60499165 60499184 60499168 -
tgttctccagctctttggct

SEQ ID NO: 178898 - DNA, 20 bp, Artificial Sequence
  Synthetic oligonucleotide; GGG chr2 60499164 60499183 60499167 -
gttctccagctctttggctt

SEQ ID NO: 178899 - DNA, 20 bp, Artificial Sequence
  Synthetic oligonucleotide; GAG chr2 60499157 60499176 60499160 -
agctctttggcttgggcccc

SEQ ID NO: 178900 - DNA, 20 bp, Artificial Sequence
  Synthetic oligonucleotide; CAG chr2 60499152 60499171 60499155 -
tttggcttgggccccgagac

SEQ ID NO: 178901 - DNA, 20 bp, Artificial Sequence
  Synthetic oligonucleotide; GAG chr2 60499150 60499169 60499153 -
tggcttgggccccgagacca

SEQ ID NO: 178902 - DNA, 20 bp, Artificial Sequence
  Synthetic oligonucleotide; AAG chr2 60499147 60499166 60499150 -
cttgggccccgagaccagag

SEQ ID NO: 178903 - DNA, 20 bp, Artificial Sequence
  Synthetic oligonucleotide; TGG chr2 60499140 60499159 60499143 -
cccgagaccagagaagataa

SEQ ID NO: 178904 - DNA, 20 bp, Artificial Sequence
  Synthetic oligonucleotide; CAG chr2 60499137 60499156 60499140 -
gagaccagagaagataatgg

SEQ ID NO: 178905 - DNA, 20 bp, Artificial Sequence
  Synthetic oligonucleotide; CAG chr2 60499132 60499151 60499135 -
cagagaagataatggcagcc

SEQ ID NO: 178906 - DNA, 20 bp, Artificial Sequence
  Synthetic oligonucleotide; TGG chr2 60499117 60499136 60499120 -
cagcccagaaacctgaatac

SEQ ID NO: 178907 - DNA, 20 bp, Artificial Sequence
  Synthetic oligonucleotide; GGG chr2 60499116 60499135 60499119 -
agcccagaaacctgaatact

SEQ ID NO: 178908 - DNA, 20 bp, Artificial Sequence
  Synthetic oligonucleotide; GGG chr2 60499115 60499134 60499118 -
gcccagaaacctgaatactg

SEQ ID NO: 178909 - DNA, 20 bp, Artificial Sequence
  Synthetic oligonucleotide; TAG chr2 60499103 60499122 60499106 -
gaatactggggaacacattg

SEQ ID NO: 178910 - DNA, 20 bp, Artificial Sequence
  Synthetic oligonucleotide; AGG chr2 60499102 60499121 60499105 -
aatactggggaacacattgt

SEQ ID NO: 178911 - DNA, 20 bp, Artificial Sequence
  Synthetic oligonucleotide; GGG chr2 60499101 60499120 60499104 -
atactggggaacacattgta

SEQ ID NO: 178912 - DNA, 20 bp, Artificial Sequence
  Synthetic oligonucleotide; CAG chr2 60499090 60499109 60499093 -
cacattgtagggtgatctcc

SEQ ID NO: 178913 - DNA, 20 bp, Artificial Sequence
  Synthetic oligonucleotide; AAG chr2 60499085 60499104 60499088 -
tgtagggtgatctcccagaa

SEQ ID NO: 178914 - DNA, 20 bp, Artificial Sequence
  Synthetic oligonucleotide; CAG chr2 60499081 60499100 60499084 -
gggtgatctcccagaaaagc

SEQ ID NO: 178915 - DNA, 20 bp, Artificial Sequence
  Synthetic oligonucleotide; GAG chr2 60499077 60499096 60499080 -
gatctcccagaaaagccagc

SEQ ID NO: 178916 - DNA, 20 bp, Artificial Sequence
  Synthetic oligonucleotide; TGG chr2 60499071 60499090 60499074 -
ccagaaaagccagcgagaaa

SEQ ID NO: 178917 - DNA, 20 bp, Artificial Sequence
  Synthetic oligonucleotide; TAG chr2 60499064 60499083 60499067 -
agccagcgagaaatggactg

SEQ ID NO: 178918 - DNA, 20 bp, Artificial Sequence
  Synthetic oligonucleotide; TAG chr2 60499058 60499077 60499061 -
cgagaaatggactgtagctg

SEQ ID NO: 178919 - DNA, 20 bp, Artificial Sequence
  Synthetic oligonucleotide; TGG chr2 60499043 60499062 60499046 -
agctgtagcattcttccctt

SEQ ID NO: 178920 - DNA, 20 bp, Artificial Sequence
  Synthetic oligonucleotide; TGG chr2 60499031 60499050 60499034 -
cttccctttggatgcctgtg

SEQ ID NO: 178921 - DNA, 20 bp, Artificial Sequence
  Synthetic oligonucleotide; GGG chr2 60499030 60499049 60499033 -
ttccctttggatgcctgtgt

SEQ ID NO: 178922 - DNA, 20 bp, Artificial Sequence
  Synthetic oligonucleotide; GGG chr2 60499029 60499048 60499032 -
tccctttggatgcctgtgtg

SEQ ID NO: 178923 - DNA, 20 bp, Artificial Sequence
  Synthetic oligonucleotide; CAG chr2 60499025 60499044 60499028 -
tttggatgcctgtgtgggga

SEQ ID NO: 178924 - DNA, 20 bp, Artificial Sequence
  Synthetic oligonucleotide; CAG chr2 60499019 60499038 60499022 -
tgcctgtgtggggacagaat

SEQ ID NO: 178925 - DNA, 20 bp, Artificial Sequence
  Synthetic oligonucleotide; TGG chr2 60499016 60499035 60499019 -
ctgtgtggggacagaatcag

SEQ ID NO: 178926 - DNA, 20 bp, Artificial Sequence
  Synthetic oligonucleotide; TGG chr2 60499011 60499030 60499014 -
tggggacagaatcagtggaa

SEQ ID NO: 178927 - DNA, 20 bp, Artificial Sequence
  Synthetic oligonucleotide; AAG chr2 60499002 60499021 60499005 -
aatcagtggaatggaaaatg

SEQ ID NO: 178928 - DNA, 20 bp, Artificial Sequence
  Synthetic oligonucleotide; AAG chr2 60498999 60499018 60499002 -
cagtggaatggaaaatgaag

SEQ ID NO: 178929 - DNA, 20 bp, Artificial Sequence
  Synthetic oligonucleotide; TGG chr2 60498990 60499009 60498993 -
ggaaaatgaagaagaaacac

SEQ ID NO: 178930 - DNA, 20 bp, Artificial Sequence
  Synthetic oligonucleotide; TAG chr2 60498928 60498947 60498931 -
ccacctgcttcctgttctat

SEQ ID NO: 178931 - DNA, 20 bp, Artificial Sequence
  Synthetic oligonucleotide; TAG chr2 60498918 60498937 60498921 -
cctgttctattagacaaacg

SEQ ID NO: 178932 - DNA, 20 bp, Artificial Sequence
  Synthetic oligonucleotide; TGG chr2 60498911 60498930 60498914 -
tattagacaaacgtagtttc

SEQ ID NO: 178933 - DNA, 20 bp, Artificial Sequence
  Synthetic oligonucleotide; GAG chr2 60498906 60498925 60498909 -
gacaaacgtagtttctggat

SEQ ID NO: 178934 - DNA, 20 bp, Artificial Sequence
  Synthetic oligonucleotide; TGG chr2 60498902 60498921 60498905 -
aacgtagtttctggatgagt

SEQ ID NO: 178935 - DNA, 20 bp, Artificial Sequence
  Synthetic oligonucleotide; CAG chr2 60498898 60498917 60498901 -
tagtttctggatgagttgga

SEQ ID NO: 178936 - DNA, 20 bp, Artificial Sequence
  Synthetic oligonucleotide; GAG chr2 60498889 60498908 60498892 -
gatgagttggacagtcatct

SEQ ID NO: 178937 - DNA, 20 bp, Artificial Sequence
  Synthetic oligonucleotide; AAG chr2 60498879 60498898 60498882 -
acagtcatctgagtttgatc

SEQ ID NO: 178938 - DNA, 20 bp, Artificial Sequence
  Synthetic oligonucleotide; CAG chr2 60498871 60498890 60498874 -
ctgagtttgatcaagattta

SEQ ID NO: 178939 - DNA, 20 bp, Artificial Sequence
  Synthetic oligonucleotide; AGG chr2 60498870 60498889 60498873 -
tgagtttgatcaagatttac

SEQ ID NO: 178940 - DNA, 20 bp, Artificial Sequence
  Synthetic oligonucleotide; AAG chr2 60498849 60498868 60498852 -
ggtaattcaaatgtatgtat

SEQ ID NO: 178941 - DNA, 20 bp, Artificial Sequence
  Synthetic oligonucleotide; AGG chr2 60498848 60498867 60498851 -
gtaattcaaatgtatgtata

SEQ ID NO: 178942 - DNA, 20 bp, Artificial Sequence
  Synthetic oligonucleotide; TAG chr2 60498834 60498853 60498837 -
tgtataaggtacatacatat

SEQ ID NO: 178943 - DNA, 20 bp, Artificial Sequence
  Synthetic oligonucleotide; CAG chr2 60498822 60498841 60498825 -
atacatattagtacatccat

SEQ ID NO: 178944 - DNA, 20 bp, Artificial Sequence
  Synthetic oligonucleotide; GAG chr2 60498820 60498839 60498823 -
acatattagtacatccatca

SEQ ID NO: 178945 - DNA, 20 bp, Artificial Sequence
  Synthetic oligonucleotide; GAG chr2 60498818 60498837 60498821 -
atattagtacatccatcaga

SEQ ID NO: 178946 - DNA, 20 bp, Artificial Sequence
  Synthetic oligonucleotide; AGG chr2 60498817 60498836 60498820 -
tattagtacatccatcagag

SEQ ID NO: 178947 - DNA, 20 bp, Artificial Sequence
  Synthetic oligonucleotide; AAG chr2 60498807 60498826 60498810 -
tccatcagagaggcttcctt

SEQ ID NO: 178948 - DNA, 20 bp, Artificial Sequence
  Synthetic oligonucleotide; AAG chr2 60498800 60498819 60498803 -
gagaggcttccttaagccac

SEQ ID NO: 178949 - DNA, 20 bp, Artificial Sequence
  Synthetic oligonucleotide; TAG chr2 60498793 60498812 60498796 -
ttccttaagccacaagtctc

SEQ ID NO: 178950 - DNA, 20 bp, Artificial Sequence
  Synthetic oligonucleotide; CAG chr2 60498785 60498804 60498788 -
gccacaagtctctagctcct

SEQ ID NO: 178951 - DNA, 20 bp, Artificial Sequence
  Synthetic oligonucleotide; GAG chr2 60498783 60498802 60498786 -
cacaagtctctagctcctca

SEQ ID NO: 178952 - DNA, 20 bp, Artificial Sequence
  Synthetic oligonucleotide; TGG chr2 60498777 60498796 60498780 -
tctctagctcctcagagaac

SEQ ID NO: 178953 - DNA, 20 bp, Artificial Sequence
  Synthetic oligonucleotide; CAG chr2 60498774 60498793 60498777 -
ctagctcctcagagaactgg

SEQ ID NO: 178954 - DNA, 20 bp, Artificial Sequence
  Synthetic oligonucleotide; TGG chr2 60498769 60498788 60498772 -
tcctcagagaactggcagtc

SEQ ID NO: 178955 - DNA, 20 bp, Artificial Sequence
  Synthetic oligonucleotide; TGG chr2 60498765 60498784 60498768 -
cagagaactggcagtctggc

SEQ ID NO: 178956 - DNA, 20 bp, Artificial Sequence
  Synthetic oligonucleotide; GGG chr2 60498764 60498783 60498767 -
agagaactggcagtctggct

SEQ ID NO: 178957 - DNA, 20 bp, Artificial Sequence
  Synthetic oligonucleotide; TGG chr2 60498749 60498768 60498752 -
tggctgggtctgtacgaact

SEQ ID NO: 178958 - DNA, 20 bp, Artificial Sequence
  Synthetic oligonucleotide; TAG chr2 60498741 60498760 60498744 -
tctgtacgaacttggaccta

SEQ ID NO: 178959 - DNA, 20 bp, Artificial Sequence
  Synthetic oligonucleotide; TGG chr2 60498728 60498747 60498731 -
ggacctatagatgacctcac

SEQ ID NO: 178960 - DNA, 20 bp, Artificial Sequence
  Synthetic oligonucleotide; GAG chr2 60498671 60498690 60498674 -
tctctttactgatcttatgt

SEQ ID NO: 178961 - DNA, 20 bp, Artificial Sequence
  Synthetic oligonucleotide; TAG chr2 60498668 60498687 60498671 -
ctttactgatcttatgtgag

SEQ ID NO: 178962 - DNA, 20 bp, Artificial Sequence
  Synthetic oligonucleotide; AGG chr2 60498667 60498686 60498670 -
tttactgatcttatgtgagt

SEQ ID NO: 178963 - DNA, 20 bp, Artificial Sequence
  Synthetic oligonucleotide; TAG chr2 60498664 60498683 60498667 -
actgatcttatgtgagtagg

SEQ ID NO: 178964 - DNA, 20 bp, Artificial Sequence
  Synthetic oligonucleotide; GAG chr2 60498662 60498681 60498665 -
tgatcttatgtgagtaggta

SEQ ID NO: 178965 - DNA, 20 bp, Artificial Sequence
  Synthetic oligonucleotide; AGG chr2 60498661 60498680 60498664 -
gatcttatgtgagtaggtag

SEQ ID NO: 178966 - DNA, 20 bp, Artificial Sequence
  Synthetic oligonucleotide; GGG chr2 60498660 60498679 60498663 -
atcttatgtgagtaggtaga

SEQ ID NO: 178967 - DNA, 20 bp, Artificial Sequence
  Synthetic oligonucleotide; GGG chr2 60498659 60498678 60498662 -
tcttatgtgagtaggtagag

SEQ ID NO: 178968 - DNA, 20 bp, Artificial Sequence
  Synthetic oligonucleotide; CAG chr2 60498655 60498674 60498658 -
atgtgagtaggtagaggggt

SEQ ID NO: 178969 - DNA, 20 bp, Artificial Sequence
  Synthetic oligonucleotide; CAG chr2 60498640 60498659 60498643 -
ggggtcagatcacctctgct

SEQ ID NO: 178970 - DNA, 20 bp, Artificial Sequence
  Synthetic oligonucleotide; CAG chr2 60498630 60498649 60498633 -
cacctctgctcagctctgcc

SEQ ID NO: 178971 - DNA, 20 bp, Artificial Sequence
  Synthetic oligonucleotide; AAG chr2 60498621 60498640 60498624 -
tcagctctgcccagcacact

SEQ ID NO: 178972 - DNA, 20 bp, Artificial Sequence
  Synthetic oligonucleotide; CAG chr2 60498586 60498605 60498589 -
taaaatttgaaaaacaaatg

SEQ ID NO: 178973 - DNA, 20 bp, Artificial Sequence
  Synthetic oligonucleotide; AGG chr2 60498585 60498604 60498588 -
aaaatttgaaaaacaaatgc

SEQ ID NO: 178974 - DNA, 20 bp, Artificial Sequence
  Synthetic oligonucleotide; CAG chr2 60498579 60498598 60498582 -
tgaaaaacaaatgcaggtgc

SEQ ID NO: 178975 - DNA, 20 bp, Artificial Sequence
  Synthetic oligonucleotide; GAG chr2 60498577 60498596 60498580 -
aaaaacaaatgcaggtgcca

SEQ ID NO: 178976 - DNA, 20 bp, Artificial Sequence
  Synthetic oligonucleotide; AGG chr2 60498576 60498595 60498579 -
aaaacaaatgcaggtgccag

SEQ ID NO: 178977 - DNA, 20 bp, Artificial Sequence
  Synthetic oligonucleotide; TGG chr2 60498573 60498592 60498576 -
acaaatgcaggtgccagagg

SEQ ID NO: 178978 - DNA, 20 bp, Artificial Sequence
  Synthetic oligonucleotide; CAG chr2 60498553 60498572 60498556 -
tggctaaataatgaatgtcc

SEQ ID NO: 178979 - DNA, 20 bp, Artificial Sequence
  Synthetic oligonucleotide; AGG chr2 60498552 60498571 60498555 -
ggctaaataatgaatgtccc

SEQ ID NO: 178980 - DNA, 20 bp, Artificial Sequence
  Synthetic oligonucleotide; TAG chr2 60498542 60498561 60498545 -
tgaatgtcccaggccaattc

SEQ ID NO: 178981 - DNA, 20 bp, Artificial Sequence
  Synthetic oligonucleotide; AGG chr2 60498541 60498560 60498544 -
gaatgtcccaggccaattct

SEQ ID NO: 178982 - DNA, 20 bp, Artificial Sequence
  Synthetic oligonucleotide; AAG chr2 60498538 60498557 60498541 -
tgtcccaggccaattctagg

SEQ ID NO: 178983 - DNA, 20 bp, Artificial Sequence
  Synthetic oligonucleotide; AGG chr2 60498537 60498556 60498540 -
gtcccaggccaattctagga

SEQ ID NO: 178984 - DNA, 20 bp, Artificial Sequence
  Synthetic oligonucleotide; GGG chr2 60498536 60498555 60498539 -
tcccaggccaattctaggaa

SEQ ID NO: 178985 - DNA, 20 bp, Artificial Sequence
  Synthetic oligonucleotide; AAG chr2 60498533 60498552 60498536 -
caggccaattctaggaaggg

SEQ ID NO: 178986 - DNA, 20 bp, Artificial Sequence
  Synthetic oligonucleotide; TGG chr2 60498530 60498549 60498533 -
gccaattctaggaagggaag

SEQ ID NO: 178987 - DNA, 20 bp, Artificial Sequence
  Synthetic oligonucleotide; GGG chr2 60498529 60498548 60498532 -
ccaattctaggaagggaagt

SEQ ID NO: 178988 - DNA, 20 bp, Artificial Sequence
  Synthetic oligonucleotide; TGG chr2 60498524 60498543 60498527 -
tctaggaagggaagtgggta

SEQ ID NO: 178989 - DNA, 20 bp, Artificial Sequence
  Synthetic oligonucleotide; GGG chr2 60498523 60498542 60498526 -
ctaggaagggaagtgggtat

SEQ ID NO: 178990 - DNA, 20 bp, Artificial Sequence
  Synthetic oligonucleotide; GGG chr2 60498522 60498541 60498525 -
taggaagggaagtgggtatg

SEQ ID NO: 178991 - DNA, 20 bp, Artificial Sequence
  Synthetic oligonucleotide; CAG chr2 60498519 60498538 60498522 -
gaagggaagtgggtatgggg

SEQ ID NO: 178992 - DNA, 20 bp, Artificial Sequence
  Synthetic oligonucleotide; TGG chr2 60498503 60498522 60498506 -
ggggcagcccattgccttcc

SEQ ID NO: 178993 - DNA, 20 bp, Artificial Sequence
  Synthetic oligonucleotide; CAG chr2 60498497 60498516 60498500 -
gcccattgccttcctggtac

SEQ ID NO: 178994 - DNA, 20 bp, Artificial Sequence
  Synthetic oligonucleotide; AGG chr2 60498496 60498515 60498499 -
cccattgccttcctggtacc

SEQ ID NO: 178995 - DNA, 20 bp, Artificial Sequence
  Synthetic oligonucleotide; TGG chr2 60498480 60498499 60498483 -
taccaggatgatgcaatgct

SEQ ID NO: 178996 - DNA, 20 bp, Artificial Sequence
  Synthetic oligonucleotide; GAG chr2 60498478 60498497 60498481 -
ccaggatgatgcaatgcttg

SEQ ID NO: 178997 - DNA, 20 bp, Artificial Sequence
  Synthetic oligonucleotide; AGG chr2 60498477 60498496 60498480 -
caggatgatgcaatgcttgg

SEQ ID NO: 178998 - DNA, 20 bp, Artificial Sequence
  Synthetic oligonucleotide; GAG chr2 60498470 60498489 60498473 -
atgcaatgcttggaggctgt

SEQ ID NO: 178999 - DNA, 20 bp, Artificial Sequence
  Synthetic oligonucleotide; CAG chr2 60498454 60498473 60498457 -
ctgtgagctccccaccttct

SEQ ID NO: 179000 - DNA, 20 bp, Artificial Sequence
  Synthetic oligonucleotide; AGG chr2 60498453 60498472 60498456 -
tgtgagctccccaccttctc

SEQ ID NO: 179001 - DNA, 20 bp, Artificial Sequence
  Synthetic oligonucleotide; GGG chr2 60498452 60498471 60498455 -
gtgagctccccaccttctca

SEQ ID NO: 179002 - DNA, 20 bp, Artificial Sequence
  Synthetic oligonucleotide; TGG chr2 60498432 60498451 60498435 -
gggcacaccctgtgatcttg

SEQ ID NO: 179003 - DNA, 20 bp, Artificial Sequence
  Synthetic oligonucleotide; GGG chr2 60498431 60498450 60498434 -
ggcacaccctgtgatcttgt

SEQ ID NO: 179004 - DNA, 20 bp, Artificial Sequence
  Synthetic oligonucleotide; CAG chr2 60498417 60498436 60498420 -
tcttgtgggacccctctgtc

SEQ ID NO: 179005 - DNA, 20 bp, Artificial Sequence
  Synthetic oligonucleotide; CAG chr2 60498412 60498431 60498415 -
tgggacccctctgtccagcc

SEQ ID NO: 179006 - DNA, 20 bp, Artificial Sequence
  Synthetic oligonucleotide; TGG chr2 60498407 60498426 60498410 -
cccctctgtccagcccagcc

SEQ ID NO: 179007 - DNA, 20 bp, Artificial Sequence
  Synthetic oligonucleotide; GGG chr2 60498406 60498425 60498409 -
ccctctgtccagcccagcct

SEQ ID NO: 179008 - DNA, 20 bp, Artificial Sequence
  Synthetic oligonucleotide; TGG chr2 60498386 60498405 60498389 -
gggtgtgcatcttgtgtgct

SEQ ID NO: 179009 - DNA, 20 bp, Artificial Sequence
  Synthetic oligonucleotide; CGG chr2 60498382 60498401 60498385 -
gtgcatcttgtgtgcttggt

SEQ ID NO: 179010 - DNA, 20 bp, Artificial Sequence
  Synthetic oligonucleotide; TAG chr2 60498373 60498392 60498376 -
gtgtgcttggtcggcactga

SEQ ID NO: 179011 - DNA, 20 bp, Artificial Sequence
  Synthetic oligonucleotide; AGG chr2 60498372 60498391 60498375 -
tgtgcttggtcggcactgat

SEQ ID NO: 179012 - DNA, 20 bp, Artificial Sequence
  Synthetic oligonucleotide; GGG chr2 60498371 60498390 60498374 -
gtgcttggtcggcactgata

SEQ ID NO: 179013 - DNA, 20 bp, Artificial Sequence
  Synthetic oligonucleotide; GGG chr2 60498370 60498389 60498373 -
tgcttggtcggcactgatag

SEQ ID NO: 179014 - DNA, 20 bp, Artificial Sequence
  Synthetic oligonucleotide; CGG chr2 60498364 60498383 60498367 -
gtcggcactgataggggtcg

SEQ ID NO: 179015 - DNA, 20 bp, Artificial Sequence
  Synthetic oligonucleotide; TAG chr2 60498361 60498380 60498364 -
ggcactgataggggtcgcgg

SEQ ID NO: 179016 - DNA, 20 bp, Artificial Sequence
  Synthetic oligonucleotide; AGG chr2 60498360 60498379 60498363 -
gcactgataggggtcgcggt

SEQ ID NO: 179017 - DNA, 20 bp, Artificial Sequence
  Synthetic oligonucleotide; GGG chr2 60498359 60498378 60498362 -
cactgataggggtcgcggta

SEQ ID NO: 179018 - DNA, 20 bp, Artificial Sequence
  Synthetic oligonucleotide; GAG chr2 60498357 60498376 60498360 -
ctgataggggtcgcggtagg

SEQ ID NO: 179019 - DNA, 20 bp, Artificial Sequence
  Synthetic oligonucleotide; CGG chr2 60498350 60498369 60498353 -
gggtcgcggtagggagttgt

SEQ ID NO: 179020 - DNA, 20 bp, Artificial Sequence
  Synthetic oligonucleotide; GAG chr2 60498325 60498344 60498328 -
cacactgctgcatgtcctgt

SEQ ID NO: 179021 - DNA, 20 bp, Artificial Sequence
  Synthetic oligonucleotide; CGG chr2 60498322 60498341 60498325 -
actgctgcatgtcctgtgag

SEQ ID NO: 179022 - DNA, 20 bp, Artificial Sequence
  Synthetic oligonucleotide; AAG chr2 60498314 60498333 60498317 -
atgtcctgtgagcggtcccc

SEQ ID NO: 179023 - DNA, 20 bp, Artificial Sequence
  Synthetic oligonucleotide; AGG chr2 60498313 60498332 60498316 -
tgtcctgtgagcggtcccca

SEQ ID NO: 179024 - DNA, 20 bp, Artificial Sequence
  Synthetic oligonucleotide; CAG chr2 60498303 60498322 60498306 -
gcggtccccaaggctgtgcc

SEQ ID NO: 179025 - DNA, 20 bp, Artificial Sequence
  Synthetic oligonucleotide; CAG chr2 60498296 60498315 60498299 -
ccaaggctgtgcccagcctt

SEQ ID NO: 179026 - DNA, 20 bp, Artificial Sequence
  Synthetic oligonucleotide; CAG chr2 60498289 60498308 60498292 -
tgtgcccagccttcagtgtc

SEQ ID NO: 179027 - DNA, 20 bp, Artificial Sequence
  Synthetic oligonucleotide; AGG chr2 60498288 60498307 60498291 -
gtgcccagccttcagtgtcc

SEQ ID NO: 179028 - DNA, 20 bp, Artificial Sequence
  Synthetic oligonucleotide; GGG chr2 60498287 60498306 60498290 -
tgcccagccttcagtgtcca

SEQ ID NO: 179029 - DNA, 20 bp, Artificial Sequence
  Synthetic oligonucleotide; CAG chr2 60498274 60498293 60498277 -
gtgtccagggcctcttctga

SEQ ID NO: 179030 - DNA, 20 bp, Artificial Sequence
  Synthetic oligonucleotide; AGG chr2 60498273 60498292 60498276 -
tgtccagggcctcttctgac

SEQ ID NO: 179031 - DNA, 20 bp, Artificial Sequence
  Synthetic oligonucleotide; TGG chr2 60498264 60498283 60498267 -
cctcttctgacaggccctgc

SEQ ID NO: 179032 - DNA, 20 bp, Artificial Sequence
  Synthetic oligonucleotide; TGG chr2 60498251 60498270 60498254 -
gccctgctggttatcactgt

SEQ ID NO: 179033 - DNA, 20 bp, Artificial Sequence
  Synthetic oligonucleotide; CAG chr2 60498220 60498239 60498223 -
ccacgcaccacttctgtgcc

SEQ ID NO: 179034 - DNA, 20 bp, Artificial Sequence
  Synthetic oligonucleotide; AGG chr2 60498219 60498238 60498222 -
cacgcaccacttctgtgccc

SEQ ID NO: 179035 - DNA, 20 bp, Artificial Sequence
  Synthetic oligonucleotide; GGG chr2 60498218 60498237 60498221 -
acgcaccacttctgtgccca

SEQ ID NO: 179036 - DNA, 20 bp, Artificial Sequence
  Synthetic oligonucleotide; TGG chr2 60498211 60498230 60498214 -
acttctgtgcccagggctgc

SEQ ID NO: 179037 - DNA, 20 bp, Artificial Sequence
  Synthetic oligonucleotide; GGG chr2 60498210 60498229 60498213 -
cttctgtgcccagggctgct

SEQ ID NO: 179038 - DNA, 20 bp, Artificial Sequence
  Synthetic oligonucleotide; AAG chr2 60498200 60498219 60498203 -
cagggctgctgggtcacctt

SEQ ID NO: 179039 - DNA, 20 bp, Artificial Sequence
  Synthetic oligonucleotide; AGG chr2 60498199 60498218 60498202 -
agggctgctgggtcacctta

SEQ ID NO: 179040 - DNA, 20 bp, Artificial Sequence
  Synthetic oligonucleotide; GAG chr2 60498197 60498216 60498200 -
ggctgctgggtcaccttaag

SEQ ID NO: 179041 - DNA, 20 bp, Artificial Sequence
  Synthetic oligonucleotide; TAG chr2 60498177 60498196 60498180 -
gagccacacacccgtctaca

SEQ ID NO: 179042 - DNA, 20 bp, Artificial Sequence
  Synthetic oligonucleotide; GAG chr2 60498175 60498194 60498178 -
gccacacacccgtctacata

SEQ ID NO: 179043 - DNA, 20 bp, Artificial Sequence
  Synthetic oligonucleotide; AGG chr2 60498174 60498193 60498177 -
ccacacacccgtctacatag

SEQ ID NO: 179044 - DNA, 20 bp, Artificial Sequence
  Synthetic oligonucleotide; TGG chr2 60498160 60498179 60498163 -
acatagaggcccttcctgct

SEQ ID NO: 179045 - DNA, 20 bp, Artificial Sequence
  Synthetic oligonucleotide; GGG chr2 60498159 60498178 60498162 -
catagaggcccttcctgctt

SEQ ID NO: 179046 - DNA, 20 bp, Artificial Sequence
  Synthetic oligonucleotide; GGG chr2 60498158 60498177 60498161 -
atagaggcccttcctgcttg

SEQ ID NO: 179047 - DNA, 20 bp, Artificial Sequence
  Synthetic oligonucleotide; CAG chr2 60498148 60498167 60498151 -
ttcctgcttggggtctgacc

SEQ ID NO: 179048 - DNA, 20 bp, Artificial Sequence
  Synthetic oligonucleotide; CAG chr2 60498119 60498138 60498122 -
cctccacacctccattctcc

SEQ ID NO: 179049 - DNA, 20 bp, Artificial Sequence
  Synthetic oligonucleotide; CAG chr2 60498101 60498120 60498104 -
cccagacttttgactcaccc

SEQ ID NO: 179050 - DNA, 20 bp, Artificial Sequence
  Synthetic oligonucleotide; AAG chr2 60498091 60498110 60498094 -
tgactcaccccagccctgct

SEQ ID NO: 179051 - DNA, 20 bp, Artificial Sequence
  Synthetic oligonucleotide; GAG chr2 60498089 60498108 60498092 -
actcaccccagccctgctaa

SEQ ID NO: 179052 - DNA, 20 bp, Artificial Sequence
  Synthetic oligonucleotide; AAG chr2 60498071 60498090 60498074 -
aagagtgatgtcctccccca

SEQ ID NO: 179053 - DNA, 20 bp, Artificial Sequence
  Synthetic oligonucleotide; GAG chr2 60498069 60498088 60498072 -
gagtgatgtcctcccccaaa

SEQ ID NO: 179054 - DNA, 20 bp, Artificial Sequence
  Synthetic oligonucleotide; AAG chr2 60498066 60498085 60498069 -
tgatgtcctcccccaaagag

SEQ ID NO: 179055 - DNA, 20 bp, Artificial Sequence
  Synthetic oligonucleotide; GAG chr2 60498051 60498070 60498054 -
aagagaagacccctgctctt

SEQ ID NO: 179056 - DNA, 20 bp, Artificial Sequence
  Synthetic oligonucleotide; AGG chr2 60498050 60498069 60498053 -
agagaagacccctgctcttg

SEQ ID NO: 179057 - DNA, 20 bp, Artificial Sequence
  Synthetic oligonucleotide; GGG chr2 60498049 60498068 60498052 -
gagaagacccctgctcttga

SEQ ID NO: 179058 - DNA, 20 bp, Artificial Sequence
  Synthetic oligonucleotide; CAG chr2 60498041 60498060 60498044 -
ccctgctcttgagggtctgc

SEQ ID NO: 179059 - DNA, 20 bp, Artificial Sequence
  Synthetic oligonucleotide; AGG chr2 60498040 60498059 60498043 -
cctgctcttgagggtctgcc

SEQ ID NO: 179060 - DNA, 20 bp, Artificial Sequence
  Synthetic oligonucleotide; TGG chr2 60498037 60498056 60498040 -
gctcttgagggtctgccagg

SEQ ID NO: 179061 - DNA, 20 bp, Artificial Sequence
  Synthetic oligonucleotide; GGG chr2 60498036 60498055 60498039 -
ctcttgagggtctgccaggt

SEQ ID NO: 179062 - DNA, 20 bp, Artificial Sequence
  Synthetic oligonucleotide; TGG chr2 60498012 60498031 60498015 -
ccctcatctccccacctcca

SEQ ID NO: 179063 - DNA, 20 bp, Artificial Sequence
  Synthetic oligonucleotide; GGG chr2 60498011 60498030 60498014 -
cctcatctccccacctccat

SEQ ID NO: 179064 - DNA, 20 bp, Artificial Sequence
  Synthetic oligonucleotide; TGG chr2 60498003 60498022 60498006 -
ccccacctccatgggcctct

SEQ ID NO: 179065 - DNA, 20 bp, Artificial Sequence
  Synthetic oligonucleotide; TAG chr2 60497990 60498009 60497993 -
ggcctcttggattttgtgca

SEQ ID NO: 179066 - DNA, 20 bp, Artificial Sequence
  Synthetic oligonucleotide; TGG chr2 60497961 60497980 60497964 -
ctgcaacaccctgaccttta

SEQ ID NO: 179067 - DNA, 20 bp, Artificial Sequence
  Synthetic oligonucleotide; GGG chr2 60497960 60497979 60497963 -
tgcaacaccctgacctttat

SEQ ID NO: 179068 - DNA, 20 bp, Artificial Sequence
  Synthetic oligonucleotide; GGG chr2 60497959 60497978 60497962 -
gcaacaccctgacctttatg

SEQ ID NO: 179069 - DNA, 20 bp, Artificial Sequence
  Synthetic oligonucleotide; CGG chr2 60497949 60497968 60497952 -
gacctttatggggtcatcct

SEQ ID NO: 179070 - DNA, 20 bp, Artificial Sequence
  Synthetic oligonucleotide; AAG chr2 60497940 60497959 60497943 -
ggggtcatcctcggccaatg

SEQ ID NO: 179071 - DNA, 20 bp, Artificial Sequence
  Synthetic oligonucleotide; CGG chr2 60497937 60497956 60497940 -
gtcatcctcggccaatgaag

SEQ ID NO: 179072 - DNA, 20 bp, Artificial Sequence
  Synthetic oligonucleotide; TGG chr2 60497934 60497953 60497937 -
atcctcggccaatgaagcgg

SEQ ID NO: 179073 - DNA, 20 bp, Artificial Sequence
  Synthetic oligonucleotide; GGG chr2 60497933 60497952 60497936 -
tcctcggccaatgaagcggt

SEQ ID NO: 179074 - DNA, 20 bp, Artificial Sequence
  Synthetic oligonucleotide; CAG chr2 60497928 60497947 60497931 -
ggccaatgaagcggtgggtc

SEQ ID NO: 179075 - DNA, 20 bp, Artificial Sequence
  Synthetic oligonucleotide; AGG chr2 60497927 60497946 60497930 -
gccaatgaagcggtgggtcc

SEQ ID NO: 179076 - DNA, 20 bp, Artificial Sequence
  Synthetic oligonucleotide; TGG chr2 60497907 60497926 60497910 -
aggctcccccttctatcacc

SEQ ID NO: 179077 - DNA, 20 bp, Artificial Sequence
  Synthetic oligonucleotide; CAG chr2 60497889 60497908 60497892 -
cctggctcacttccatcctg

SEQ ID NO: 179078 - DNA, 20 bp, Artificial Sequence
  Synthetic oligonucleotide; GAG chr2 60497887 60497906 60497890 -
tggctcacttccatcctgca

SEQ ID NO: 179079 - DNA, 20 bp, Artificial Sequence
  Synthetic oligonucleotide; AGG chr2 60497886 60497905 60497889 -
ggctcacttccatcctgcag

SEQ ID NO: 179080 - DNA, 20 bp, Artificial Sequence
  Synthetic oligonucleotide; AAG chr2 60497883 60497902 60497886 -
tcacttccatcctgcagagg

SEQ ID NO: 179081 - DNA, 20 bp, Artificial Sequence
  Synthetic oligonucleotide; TGG chr2 60497878 60497897 60497881 -
tccatcctgcagaggaagct

SEQ ID NO: 179082 - DNA, 20 bp, Artificial Sequence
  Synthetic oligonucleotide; TAG chr2 60497868 60497887 60497871 -
agaggaagcttggtttcatt

SEQ ID NO: 179083 - DNA, 20 bp, Artificial Sequence
  Synthetic oligonucleotide; AGG chr2 60497867 60497886 60497870 -
gaggaagcttggtttcattt

SEQ ID NO: 179084 - DNA, 20 bp, Artificial Sequence
  Synthetic oligonucleotide; CAG chr2 60497856 60497875 60497859 -
gtttcatttaggacaatgtg

SEQ ID NO: 179085 - DNA, 20 bp, Artificial Sequence
  Synthetic oligonucleotide; AGG chr2 60497855 60497874 60497858 -
tttcatttaggacaatgtgc

SEQ ID NO: 179086 - DNA, 20 bp, Artificial Sequence
  Synthetic oligonucleotide; TGG chr2 60497830 60497849 60497833 -
ccttttgatcatttctctac

SEQ ID NO: 179087 - DNA, 20 bp, Artificial Sequence
  Synthetic oligonucleotide; CAG chr2 60497822 60497841 60497825 -
tcatttctctactggatcat

SEQ ID NO: 179088 - DNA, 20 bp, Artificial Sequence
  Synthetic oligonucleotide; AAG chr2 60497817 60497836 60497820 -
tctctactggatcatcagca

SEQ ID NO: 179089 - DNA, 20 bp, Artificial Sequence
  Synthetic oligonucleotide; AGG chr2 60497816 60497835 60497819 -
ctctactggatcatcagcaa

SEQ ID NO: 179090 - DNA, 20 bp, Artificial Sequence
  Synthetic oligonucleotide; GGG chr2 60497815 60497834 60497818 -
tctactggatcatcagcaaa

SEQ ID NO: 179091 - DNA, 20 bp, Artificial Sequence
  Synthetic oligonucleotide; GAG chr2 60497813 60497832 60497816 -
tactggatcatcagcaaagg

SEQ ID NO: 179092 - DNA, 20 bp, Artificial Sequence
  Synthetic oligonucleotide; GAG chr2 60497806 60497825 60497809 -
tcatcagcaaagggagaaat

SEQ ID NO: 179093 - DNA, 20 bp, Artificial Sequence
  Synthetic oligonucleotide; AAG chr2 60497799 60497818 60497802 -
caaagggagaaatgagacaa

SEQ ID NO: 179094 - DNA, 20 bp, Artificial Sequence
  Synthetic oligonucleotide; GAG chr2 60497797 60497816 60497800 -
aagggagaaatgagacaaaa

SEQ ID NO: 179095 - DNA, 20 bp, Artificial Sequence
  Synthetic oligonucleotide; AGG chr2 60497796 60497815 60497799 -
agggagaaatgagacaaaag

SEQ ID NO: 179096 - DNA, 20 bp, Artificial Sequence
  Synthetic oligonucleotide; GAG chr2 60497788 60497807 60497791 -
atgagacaaaagaggccact

SEQ ID NO: 179097 - DNA, 20 bp, Artificial Sequence
  Synthetic oligonucleotide; TGG chr2 60497780 60497799 60497783 -
aaagaggccactgagtcctt

SEQ ID NO: 179098 - DNA, 20 bp, Artificial Sequence
  Synthetic oligonucleotide; GGG chr2 60497779 60497798 60497782 -
aagaggccactgagtccttt

SEQ ID NO: 179099 - DNA, 20 bp, Artificial Sequence
  Synthetic oligonucleotide; GGG chr2 60497778 60497797 60497781 -
agaggccactgagtcctttg

SEQ ID NO: 179100 - DNA, 20 bp, Artificial Sequence
  Synthetic oligonucleotide; GGG chr2 60497777 60497796 60497780 -
gaggccactgagtcctttgg

SEQ ID NO: 179101 - DNA, 20 bp, Artificial Sequence
  Synthetic oligonucleotide; TAG chr2 60497761 60497780 60497764 -
ttgggggaaatatgtgccta

SEQ ID NO: 179102 - DNA, 20 bp, Artificial Sequence
  Synthetic oligonucleotide; AAG chr2 60497757 60497776 60497760 -
gggaaatatgtgcctatagt

SEQ ID NO: 179103 - DNA, 20 bp, Artificial Sequence
  Synthetic oligonucleotide; AGG chr2 60497756 60497775 60497759 -
ggaaatatgtgcctatagta

SEQ ID NO: 179104 - DNA, 20 bp, Artificial Sequence
  Synthetic oligonucleotide; TAG chr2 60497750 60497769 60497753 -
atgtgcctatagtaaggtga

SEQ ID NO: 179105 - DNA, 20 bp, Artificial Sequence
  Synthetic oligonucleotide; CAG chr2 60497745 60497764 60497748 -
cctatagtaaggtgatagtt

SEQ ID NO: 179106 - DNA, 20 bp, Artificial Sequence
  Synthetic oligonucleotide; GAG chr2 60497743 60497762 60497746 -
tatagtaaggtgatagttca

SEQ ID NO: 179107 - DNA, 20 bp, Artificial Sequence
  Synthetic oligonucleotide; AAG chr2 60497739 60497758 60497742 -
gtaaggtgatagttcagaga

SEQ ID NO: 179108 - DNA, 20 bp, Artificial Sequence
  Synthetic oligonucleotide; GAG chr2 60497737 60497756 60497740 -
aaggtgatagttcagagaaa

SEQ ID NO: 179109 - DNA, 20 bp, Artificial Sequence
  Synthetic oligonucleotide; AAG chr2 60497734 60497753 60497737 -
gtgatagttcagagaaagag

SEQ ID NO: 179110 - DNA, 20 bp, Artificial Sequence
  Synthetic oligonucleotide; GAG chr2 60497732 60497751 60497735 -
gatagttcagagaaagagaa

SEQ ID NO: 179111 - DNA, 20 bp, Artificial Sequence
  Synthetic oligonucleotide; TAG chr2 60497729 60497748 60497732 -
agttcagagaaagagaagag

SEQ ID NO: 179112 - DNA, 20 bp, Artificial Sequence
  Synthetic oligonucleotide; AGG chr2 60497728 60497747 60497731 -
gttcagagaaagagaagagt

SEQ ID NO: 179113 - DNA, 20 bp, Artificial Sequence
  Synthetic oligonucleotide; GAG chr2 60497726 60497745 60497729 -
tcagagaaagagaagagtag

SEQ ID NO: 179114 - DNA, 20 bp, Artificial Sequence
  Synthetic oligonucleotide; AGG chr2 60497725 60497744 60497728 -
cagagaaagagaagagtagg

SEQ ID NO: 179115 - DNA, 20 bp, Artificial Sequence
  Synthetic oligonucleotide; TGG chr2 60497721 60497740 60497724 -
gaaagagaagagtaggaggc

SEQ ID NO: 179116 - DNA, 20 bp, Artificial Sequence
  Synthetic oligonucleotide; AAG chr2 60497713 60497732 60497716 -
agagtaggaggctggacctg

SEQ ID NO: 179117 - DNA, 20 bp, Artificial Sequence
  Synthetic oligonucleotide; AGG chr2 60497712 60497731 60497715 -
gagtaggaggctggacctga

SEQ ID NO: 179118 - DNA, 20 bp, Artificial Sequence
  Synthetic oligonucleotide; AAG chr2 60497698 60497717 60497701 -
acctgaaggccttccaaaaa

SEQ ID NO: 179119 - DNA, 20 bp, Artificial Sequence
  Synthetic oligonucleotide; AAG chr2 60497693 60497712 60497696 -
aaggccttccaaaaaaagta

SEQ ID NO: 179120 - DNA, 20 bp, Artificial Sequence
  Synthetic oligonucleotide; AGG chr2 60497692 60497711 60497695 -
aggccttccaaaaaaagtaa

SEQ ID NO: 179121 - DNA, 20 bp, Artificial Sequence
  Synthetic oligonucleotide; TGG chr2 60497675 60497694 60497678 -
taaaggatgttaaattgctc

SEQ ID NO: 179122 - DNA, 20 bp, Artificial Sequence
  Synthetic oligonucleotide; AAG chr2 60497672 60497691 60497675 -
aggatgttaaattgctctgg

SEQ ID NO: 179123 - DNA, 20 bp, Artificial Sequence
  Synthetic oligonucleotide; AGG chr2 60497671 60497690 60497674 -
ggatgttaaattgctctgga

SEQ ID NO: 179124 - DNA, 20 bp, Artificial Sequence
  Synthetic oligonucleotide; AAG chr2 60497664 60497683 60497667 -
aaattgctctggaaggtgca

SEQ ID NO: 179125 - DNA, 20 bp, Artificial Sequence
  Synthetic oligonucleotide; CAG chr2 60497654 60497673 60497657 -
ggaaggtgcaaagtgccatc

SEQ ID NO: 179126 - DNA, 20 bp, Artificial Sequence
  Synthetic oligonucleotide; TGG chr2 60497651 60497670 60497654 -
aggtgcaaagtgccatccag

SEQ ID NO: 179127 - DNA, 20 bp, Artificial Sequence
  Synthetic oligonucleotide; AAG chr2 60497648 60497667 60497651 -
tgcaaagtgccatccagtgg

SEQ ID NO: 179128 - DNA, 20 bp, Artificial Sequence
  Synthetic oligonucleotide; TGG chr2 60497618 60497637 60497621 -
tattattatcatcatcataa

SEQ ID NO: 179129 - DNA, 20 bp, Artificial Sequence
  Synthetic oligonucleotide; TAG chr2 60497597 60497616 60497600 -
ggtcattatcatcaccatta

SEQ ID NO: 179130 - DNA, 20 bp, Artificial Sequence
  Synthetic oligonucleotide; AGG chr2 60497596 60497615 60497599 -
gtcattatcatcaccattat

SEQ ID NO: 179131 - DNA, 20 bp, Artificial Sequence
  Synthetic oligonucleotide; TGG chr2 60497590 60497609 60497593 -
atcatcaccattataggata

SEQ ID NO: 179132 - DNA, 20 bp, Artificial Sequence
  Synthetic oligonucleotide; TAG chr2 60497579 60497598 60497582 -
tataggatatggcactgacg

SEQ ID NO: 179133 - DNA, 20 bp, Artificial Sequence
  Synthetic oligonucleotide; AGG chr2 60497578 60497597 60497581 -
ataggatatggcactgacgt

SEQ ID NO: 179134 - DNA, 20 bp, Artificial Sequence
  Synthetic oligonucleotide; TAG chr2 60497575 60497594 60497578 -
ggatatggcactgacgtagg

SEQ ID NO: 179135 - DNA, 20 bp, Artificial Sequence
  Synthetic oligonucleotide; TGG chr2 60497568 60497587 60497571 -
gcactgacgtaggtagtgac

SEQ ID NO: 179136 - DNA, 20 bp, Artificial Sequence
  Synthetic oligonucleotide; AAG chr2 60497564 60497583 60497567 -
tgacgtaggtagtgactggt

SEQ ID NO: 179137 - DNA, 20 bp, Artificial Sequence
  Synthetic oligonucleotide; GAG chr2 60497562 60497581 60497565 -
acgtaggtagtgactggtaa

SEQ ID NO: 179138 - DNA, 20 bp, Artificial Sequence
  Synthetic oligonucleotide; GAG chr2 60497553 60497572 60497556 -
gtgactggtaagagccgatt

SEQ ID NO: 179139 - DNA, 20 bp, Artificial Sequence
  Synthetic oligonucleotide; TAG chr2 60497546 60497565 60497549 -
gtaagagccgattgagtttc

SEQ ID NO: 179140 - DNA, 20 bp, Artificial Sequence
  Synthetic oligonucleotide; TAG chr2 60497529 60497548 60497532 -
ttctagctgattcctgatgt

SEQ ID NO: 179141 - DNA, 20 bp, Artificial Sequence
  Synthetic oligonucleotide; AGG chr2 60497528 60497547 60497531 -
tctagctgattcctgatgtt

SEQ ID NO: 179142 - DNA, 20 bp, Artificial Sequence
  Synthetic oligonucleotide; GGG chr2 60497527 60497546 60497530 -
ctagctgattcctgatgtta

SEQ ID NO: 179143 - DNA, 20 bp, Artificial Sequence
  Synthetic oligonucleotide; GGG chr2 60497526 60497545 60497529 -
tagctgattcctgatgttag

SEQ ID NO: 179144 - DNA, 20 bp, Artificial Sequence
  Synthetic oligonucleotide; TGG chr2 60497506 60497525 60497509 -
gggccatgaatctgtctacc

SEQ ID NO: 179145 - DNA, 20 bp, Artificial Sequence
  Synthetic oligonucleotide; CAG chr2 60497486 60497505 60497489 -
tggaatgttctaattcaatt

SEQ ID NO: 179146 - DNA, 20 bp, Artificial Sequence
  Synthetic oligonucleotide; AGG chr2 60497485 60497504 60497488 -
ggaatgttctaattcaattc

SEQ ID NO: 179147 - DNA, 20 bp, Artificial Sequence
  Synthetic oligonucleotide; GAG chr2 60497483 60497502 60497486 -
aatgttctaattcaattcag

SEQ ID NO: 179148 - DNA, 20 bp, Artificial Sequence
  Synthetic oligonucleotide; CGG chr2 60497480 60497499 60497483 -
gttctaattcaattcaggag

SEQ ID NO: 179149 - DNA, 20 bp, Artificial Sequence
  Synthetic oligonucleotide; CAG chr2 60497477 60497496 60497480 -
ctaattcaattcaggagcgg

SEQ ID NO: 179150 - DNA, 20 bp, Artificial Sequence
  Synthetic oligonucleotide; AAG chr2 60497471 60497490 60497474 -
caattcaggagcggcagttt

SEQ ID NO: 179151 - DNA, 20 bp, Artificial Sequence
  Synthetic oligonucleotide; TAG chr2 60497466 60497485 60497469 -
caggagcggcagtttaagtc

SEQ ID NO: 179152 - DNA, 20 bp, Artificial Sequence
  Synthetic oligonucleotide; AAG chr2 60497457 60497476 60497460 -
cagtttaagtctagacttca

SEQ ID NO: 179153 - DNA, 20 bp, Artificial Sequence
  Synthetic oligonucleotide; TGG chr2 60497438 60497457 60497441 -
aaagcactctcatatatcct

SEQ ID NO: 179154 - DNA, 20 bp, Artificial Sequence
  Synthetic oligonucleotide; GAG chr2 60497424 60497443 60497427 -
tatccttggcctgctaacct

SEQ ID NO: 179155 - DNA, 20 bp, Artificial Sequence
  Synthetic oligonucleotide; AGG chr2 60497423 60497442 60497426 -
atccttggcctgctaacctg

SEQ ID NO: 179156 - DNA, 20 bp, Artificial Sequence
  Synthetic oligonucleotide; GGG chr2 60497422 60497441 60497425 -
tccttggcctgctaacctga

SEQ ID NO: 179157 - DNA, 20 bp, Artificial Sequence
  Synthetic oligonucleotide; TAG chr2 60497418 60497437 60497421 -
tggcctgctaacctgagggc

SEQ ID NO: 179158 - DNA, 20 bp, Artificial Sequence
  Synthetic oligonucleotide; TAG chr2 60497411 60497430 60497414 -
ctaacctgagggctagtttc

SEQ ID NO: 179159 - DNA, 20 bp, Artificial Sequence
  Synthetic oligonucleotide; AGG chr2 60497410 60497429 60497413 -
taacctgagggctagtttct

SEQ ID NO: 179160 - DNA, 20 bp, Artificial Sequence
  Synthetic oligonucleotide; GGG chr2 60497409 60497428 60497412 -
aacctgagggctagtttcta

SEQ ID NO: 179161 - DNA, 20 bp, Artificial Sequence
  Synthetic oligonucleotide; AAG chr2 60497393 60497412 60497396 -
tctagggattgattaactta

SEQ ID NO: 179162 - DNA, 20 bp, Artificial Sequence
  Synthetic oligonucleotide; CAG chr2 60497389 60497408 60497392 -
gggattgattaacttaaaga

SEQ ID NO: 179163 - DNA, 20 bp, Artificial Sequence
  Synthetic oligonucleotide; TAG chr2 60497367 60497386 60497370 -
gttcatatatgcttgaatac

SEQ ID NO: 179164 - DNA, 20 bp, Artificial Sequence
  Synthetic oligonucleotide; CAG chr2 60497330 60497349 60497333 -
aaaaatctgacttgatcaaa

SEQ ID NO: 179165 - DNA, 20 bp, Artificial Sequence
  Synthetic oligonucleotide; GAG chr2 60497328 60497347 60497331 -
aaatctgacttgatcaaaca

SEQ ID NO: 179166 - DNA, 20 bp, Artificial Sequence
  Synthetic oligonucleotide; CAG chr2 60497325 60497344 60497328 -
tctgacttgatcaaacagag

SEQ ID NO: 179167 - DNA, 20 bp, Artificial Sequence
  Synthetic oligonucleotide; AAG chr2 60497319 60497338 60497322 -
ttgatcaaacagagcagtta

SEQ ID NO: 179168 - DNA, 20 bp, Artificial Sequence
  Synthetic oligonucleotide; AGG chr2 60497318 60497337 60497321 -
tgatcaaacagagcagttaa

SEQ ID NO: 179169 - DNA, 20 bp, Artificial Sequence
  Synthetic oligonucleotide; AAG chr2 60497297 60497316 60497300 -
ggcgatgcttcgttttacaa

SEQ ID NO: 179170 - DNA, 20 bp, Artificial Sequence
  Synthetic oligonucleotide; AAG chr2 60497274 60497293 60497277 -
attttcccccctctttacaa

SEQ ID NO: 179171 - DNA, 20 bp, Artificial Sequence
  Synthetic oligonucleotide; AGG chr2 60497273 60497292 60497276 -
ttttcccccctctttacaaa

SEQ ID NO: 179172 - DNA, 20 bp, Artificial Sequence
  Synthetic oligonucleotide; CAG chr2 60497265 60497284 60497268 -
cctctttacaaaaggatgca

SEQ ID NO: 179173 - DNA, 20 bp, Artificial Sequence
  Synthetic oligonucleotide; TGG chr2 60497262 60497281 60497265 -
ctttacaaaaggatgcacag

SEQ ID NO: 179174 - DNA, 20 bp, Artificial Sequence
  Synthetic oligonucleotide; TGG chr2 60497247 60497266 60497250 -
cacagtggtattcctttcaa

SEQ ID NO: 179175 - DNA, 20 bp, Artificial Sequence
  Synthetic oligonucleotide; TAG chr2 60497234 60497253 60497237 -
ctttcaatggaatgtttctc

SEQ ID NO: 179176 - DNA, 20 bp, Artificial Sequence
  Synthetic oligonucleotide; AAG chr2 60497225 60497244 60497228 -
gaatgtttctctagctcatt

SEQ ID NO: 179177 - DNA, 20 bp, Artificial Sequence
  Synthetic oligonucleotide; CAG chr2 60497216 60497235 60497219 -
tctagctcattaagtgttta

SEQ ID NO: 179178 - DNA, 20 bp, Artificial Sequence
  Synthetic oligonucleotide; AGG chr2 60497215 60497234 60497218 -
ctagctcattaagtgtttac

SEQ ID NO: 179179 - DNA, 20 bp, Artificial Sequence
  Synthetic oligonucleotide; TAG chr2 60497208 60497227 60497211 -
attaagtgtttacaggtcat

SEQ ID NO: 179180 - DNA, 20 bp, Artificial Sequence
  Synthetic oligonucleotide; TGG chr2 60497197 60497216 60497200 -
acaggtcattagctactgca

SEQ ID NO: 179181 - DNA, 20 bp, Artificial Sequence
  Synthetic oligonucleotide; AAG chr2 60497194 60497213 60497197 -
ggtcattagctactgcatgg

SEQ ID NO: 179182 - DNA, 20 bp, Artificial Sequence
  Synthetic oligonucleotide; AGG chr2 60497193 60497212 60497196 -
gtcattagctactgcatgga

SEQ ID NO: 179183 - DNA, 20 bp, Artificial Sequence
  Synthetic oligonucleotide; TAG chr2 60497183 60497202 60497186 -
actgcatggaaggactttgc

SEQ ID NO: 179184 - DNA, 20 bp, Artificial Sequence
  Synthetic oligonucleotide; GAG chr2 60497181 60497200 60497184 -
tgcatggaaggactttgcta

SEQ ID NO: 179185 - DNA, 20 bp, Artificial Sequence
  Synthetic oligonucleotide; AAG chr2 60497176 60497195 60497179 -
ggaaggactttgctagagaa

SEQ ID NO: 179186 - DNA, 20 bp, Artificial Sequence
  Synthetic oligonucleotide; AGG chr2 60497175 60497194 60497178 -
gaaggactttgctagagaaa

SEQ ID NO: 179187 - DNA, 20 bp, Artificial Sequence
  Synthetic oligonucleotide; AAG chr2 60497172 60497191 60497175 -
ggactttgctagagaaaagg

SEQ ID NO: 179188 - DNA, 20 bp, Artificial Sequence
  Synthetic oligonucleotide; AGG chr2 60497171 60497190 60497174 -
gactttgctagagaaaagga

SEQ ID NO: 179189 - DNA, 20 bp, Artificial Sequence
  Synthetic oligonucleotide; AAG chr2 60497164 60497183 60497167 -
ctagagaaaaggaaggctgc

SEQ ID NO: 179190 - DNA, 20 bp, Artificial Sequence
  Synthetic oligonucleotide; AGG chr2 60497163 60497182 60497166 -
tagagaaaaggaaggctgca

SEQ ID NO: 179191 - DNA, 20 bp, Artificial Sequence
  Synthetic oligonucleotide; TAG chr2 60497157 60497176 60497160 -
aaaggaaggctgcaaggaaa

SEQ ID NO: 179192 - DNA, 20 bp, Artificial Sequence
  Synthetic oligonucleotide; TAG chr2 60497151 60497170 60497154 -
aggctgcaaggaaatagctc

SEQ ID NO: 179193 - DNA, 20 bp, Artificial Sequence
  Synthetic oligonucleotide; TAG chr2 60497145 60497164 60497148 -
caaggaaatagctctagctc

SEQ ID NO: 179194 - DNA, 20 bp, Artificial Sequence
  Synthetic oligonucleotide; TAG chr2 60497139 60497158 60497142 -
aatagctctagctctagctc

SEQ ID NO: 179195 - DNA, 20 bp, Artificial Sequence
  Synthetic oligonucleotide; TAG chr2 60497134 60497153 60497137 -
ctctagctctagctctagct

SEQ ID NO: 179196 - DNA, 20 bp, Artificial Sequence
  Synthetic oligonucleotide; AGG chr2 60497133 60497152 60497136 -
tctagctctagctctagctt

SEQ ID NO: 179197 - DNA, 20 bp, Artificial Sequence
  Synthetic oligonucleotide; GGG chr2 60497132 60497151 60497135 -
ctagctctagctctagctta

SEQ ID NO: 179198 - DNA, 20 bp, Artificial Sequence
  Synthetic oligonucleotide; GGG chr2 60497131 60497150 60497134 -
tagctctagctctagcttag

SEQ ID NO: 179199 - DNA, 20 bp, Artificial Sequence
  Synthetic oligonucleotide; TAG chr2 60497124 60497143 60497127 -
agctctagcttaggggatgc

SEQ ID NO: 179200 - DNA, 20 bp, Artificial Sequence
  Synthetic oligonucleotide; AAG chr2 60497118 60497137 60497121 -
agcttaggggatgctagcta

SEQ ID NO: 179201 - DNA, 20 bp, Artificial Sequence
  Synthetic oligonucleotide; AGG chr2 60497117 60497136 60497120 -
gcttaggggatgctagctaa

SEQ ID NO: 179202 - DNA, 20 bp, Artificial Sequence
  Synthetic oligonucleotide; GGG chr2 60497116 60497135 60497119 -
cttaggggatgctagctaaa

SEQ ID NO: 179203 - DNA, 20 bp, Artificial Sequence
  Synthetic oligonucleotide; TAG chr2 60497110 60497129 60497113 -
ggatgctagctaaagggaat

SEQ ID NO: 179204 - DNA, 20 bp, Artificial Sequence
  Synthetic oligonucleotide; TGG chr2 60497104 60497123 60497107 -
tagctaaagggaattagaat

SEQ ID NO: 179205 - DNA, 20 bp, Artificial Sequence
  Synthetic oligonucleotide; TGG chr2 60497100 60497119 60497103 -
taaagggaattagaattggt

SEQ ID NO: 179206 - DNA, 20 bp, Artificial Sequence
  Synthetic oligonucleotide; CAG chr2 60497093 60497112 60497096 -
aattagaattggttggccaa

SEQ ID NO: 179207 - DNA, 20 bp, Artificial Sequence
  Synthetic oligonucleotide; AGG chr2 60497092 60497111 60497095 -
attagaattggttggccaac

SEQ ID NO: 179208 - DNA, 20 bp, Artificial Sequence
  Synthetic oligonucleotide; CGG chr2 60497083 60497102 60497086 -
ggttggccaacaggtgtctg

SEQ ID NO: 179209 - DNA, 20 bp, Artificial Sequence
  Synthetic oligonucleotide; TGG chr2 60497057 60497076 60497060 -
actccctgtccactcaacac

SEQ ID NO: 179210 - DNA, 20 bp, Artificial Sequence
  Synthetic oligonucleotide; GGG chr2 60497056 60497075 60497059 -
ctccctgtccactcaacact

SEQ ID NO: 179211 - DNA, 20 bp, Artificial Sequence
  Synthetic oligonucleotide; GGG chr2 60497055 60497074 60497058 -
tccctgtccactcaacactg

SEQ ID NO: 179212 - DNA, 20 bp, Artificial Sequence
  Synthetic oligonucleotide; GGG chr2 60497054 60497073 60497057 -
ccctgtccactcaacactgg

SEQ ID NO: 179213 - DNA, 20 bp, Artificial Sequence
  Synthetic oligonucleotide; GAG chr2 60497052 60497071 60497055 -
ctgtccactcaacactgggg

SEQ ID NO: 179214 - DNA, 20 bp, Artificial Sequence
  Synthetic oligonucleotide; AGG chr2 60497051 60497070 60497054 -
tgtccactcaacactggggg

SEQ ID NO: 179215 - DNA, 20 bp, Artificial Sequence
  Synthetic oligonucleotide; GAG chr2 60497049 60497068 60497052 -
tccactcaacactgggggag

SEQ ID NO: 179216 - DNA, 20 bp, Artificial Sequence
  Synthetic oligonucleotide; TAG chr2 60497046 60497065 60497049 -
actcaacactgggggaggag

SEQ ID NO: 179217 - DNA, 20 bp, Artificial Sequence
  Synthetic oligonucleotide; GAG chr2 60497044 60497063 60497047 -
tcaacactgggggaggagta

SEQ ID NO: 179218 - DNA, 20 bp, Artificial Sequence
  Synthetic oligonucleotide; GAG chr2 60497022 60497041 60497025 -
gatcttgcttccttccatgt

SEQ ID NO: 179219 - DNA, 20 bp, Artificial Sequence
  Synthetic oligonucleotide; GAG chr2 60497020 60497039 60497023 -
tcttgcttccttccatgtga

SEQ ID NO: 179220 - DNA, 20 bp, Artificial Sequence
  Synthetic oligonucleotide; TAG chr2 60497013 60497032 60497016 -
tccttccatgtgagagctta

SEQ ID NO: 179221 - DNA, 20 bp, Artificial Sequence
  Synthetic oligonucleotide; TGG chr2 60497004 60497023 60497007 -
gtgagagcttatagtccctt

SEQ ID NO: 179222 - DNA, 20 bp, Artificial Sequence
  Synthetic oligonucleotide; CAG chr2 60496997 60497016 60497000 -
cttatagtccctttggaatc

SEQ ID NO: 179223 - DNA, 20 bp, Artificial Sequence
  Synthetic oligonucleotide; AAG chr2 60496984 60497003 60496987 -
tggaatccagatttatcgtg

SEQ ID NO: 179224 - DNA, 20 bp, Artificial Sequence
  Synthetic oligonucleotide; AAG chr2 60496973 60496992 60496976 -
tttatcgtgaagtaatcgtg

SEQ ID NO: 179225 - DNA, 20 bp, Artificial Sequence
  Synthetic oligonucleotide; CAG chr2 60496969 60496988 60496972 -
tcgtgaagtaatcgtgaaga

SEQ ID NO: 179226 - DNA, 20 bp, Artificial Sequence
  Synthetic oligonucleotide; AAG chr2 60496961 60496980 60496964 -
taatcgtgaagacagaaatt

SEQ ID NO: 179227 - DNA, 20 bp, Artificial Sequence
  Synthetic oligonucleotide; TGG chr2 60496921 60496940 60496924 -
tcatctcttatgactgtcca

SEQ ID NO: 179228 - DNA, 20 bp, Artificial Sequence
  Synthetic oligonucleotide; GGG chr2 60496920 60496939 60496923 -
catctcttatgactgtccat

SEQ ID NO: 179229 - DNA, 20 bp, Artificial Sequence
  Synthetic oligonucleotide; GGG chr2 60496919 60496938 60496922 -
atctcttatgactgtccatg

SEQ ID NO: 179230 - DNA, 20 bp, Artificial Sequence
  Synthetic oligonucleotide; TGG chr2 60496913 60496932 60496916 -
tatgactgtccatggggaaa

SEQ ID NO: 179231 - DNA, 20 bp, Artificial Sequence
  Synthetic oligonucleotide; GGG chr2 60496912 60496931 60496915 -
atgactgtccatggggaaat

SEQ ID NO: 179232 - DNA, 20 bp, Artificial Sequence
  Synthetic oligonucleotide; CAG chr2 60496891 60496910 60496894 -
ggtcctgctttacaaaaatt

SEQ ID NO: 179233 - DNA, 20 bp, Artificial Sequence
  Synthetic oligonucleotide; CAG chr2 60496872 60496891 60496875 -
tcagtttgcatgctgctttt

SEQ ID NO: 179234 - DNA, 20 bp, Artificial Sequence
  Synthetic oligonucleotide; AGG chr2 60496871 60496890 60496874 -
cagtttgcatgctgcttttc

SEQ ID NO: 179235 - DNA, 20 bp, Artificial Sequence
  Synthetic oligonucleotide; CAG chr2 60496851 60496870 60496854 -
aggcctatgactgtgacatc

SEQ ID NO: 179236 - DNA, 20 bp, Artificial Sequence
  Synthetic oligonucleotide; GAG chr2 60496847 60496866 60496850 -
ctatgactgtgacatccagt

SEQ ID NO: 179237 - DNA, 20 bp, Artificial Sequence
  Synthetic oligonucleotide; AGG chr2 60496846 60496865 60496849 -
tatgactgtgacatccagtg

SEQ ID NO: 179238 - DNA, 20 bp, Artificial Sequence
  Synthetic oligonucleotide; GGG chr2 60496845 60496864 60496848 -
atgactgtgacatccagtga

SEQ ID NO: 179239 - DNA, 20 bp, Artificial Sequence
  Synthetic oligonucleotide; GAG chr2 60496843 60496862 60496846 -
gactgtgacatccagtgagg

SEQ ID NO: 179240 - DNA, 20 bp, Artificial Sequence
  Synthetic oligonucleotide; GAG chr2 60496836 60496855 60496839 -
acatccagtgagggagattt

SEQ ID NO: 179241 - DNA, 20 bp, Artificial Sequence
  Synthetic oligonucleotide; AGG chr2 60496835 60496854 60496838 -
catccagtgagggagatttg

SEQ ID NO: 179242 - DNA, 20 bp, Artificial Sequence
  Synthetic oligonucleotide; AAG chr2 60496832 60496851 60496835 -
ccagtgagggagatttgagg

SEQ ID NO: 179243 - DNA, 20 bp, Artificial Sequence
  Synthetic oligonucleotide; AGG chr2 60496831 60496850 60496834 -
cagtgagggagatttgagga

SEQ ID NO: 179244 - DNA, 20 bp, Artificial Sequence
  Synthetic oligonucleotide; GGG chr2 60496830 60496849 60496833 -
agtgagggagatttgaggaa

SEQ ID NO: 179245 - DNA, 20 bp, Artificial Sequence
  Synthetic oligonucleotide; GGG chr2 60496829 60496848 60496832 -
gtgagggagatttgaggaag

SEQ ID NO: 179246 - DNA, 20 bp, Artificial Sequence
  Synthetic oligonucleotide; AAG chr2 60496819 60496838 60496822 -
tttgaggaaggggttgatgt

SEQ ID NO: 179247 - DNA, 20 bp, Artificial Sequence
  Synthetic oligonucleotide; TGG chr2 60496808 60496827 60496811 -
ggttgatgtaagactcctct

SEQ ID NO: 179248 - DNA, 20 bp, Artificial Sequence
  Synthetic oligonucleotide; GGG chr2 60496807 60496826 60496810 -
gttgatgtaagactcctctt

SEQ ID NO: 179249 - DNA, 20 bp, Artificial Sequence
  Synthetic oligonucleotide; GAG chr2 60496805 60496824 60496808 -
tgatgtaagactcctcttgg

SEQ ID NO: 179250 - DNA, 20 bp, Artificial Sequence
  Synthetic oligonucleotide; TAG chr2 60496800 60496819 60496803 -
taagactcctcttgggagca

SEQ ID NO: 179251 - DNA, 20 bp, Artificial Sequence
  Synthetic oligonucleotide; GAG chr2 60496796 60496815 60496799 -
actcctcttgggagcatagt

SEQ ID NO: 179252 - DNA, 20 bp, Artificial Sequence
  Synthetic oligonucleotide; GAG chr2 60496794 60496813 60496797 -
tcctcttgggagcatagtga

SEQ ID NO: 179253 - DNA, 20 bp, Artificial Sequence
  Synthetic oligonucleotide; GAG chr2 60496792 60496811 60496795 -
ctcttgggagcatagtgaga

SEQ ID NO: 179254 - DNA, 20 bp, Artificial Sequence
  Synthetic oligonucleotide; GAG chr2 60496790 60496809 60496793 -
cttgggagcatagtgagaga

SEQ ID NO: 179255 - DNA, 20 bp, Artificial Sequence
  Synthetic oligonucleotide; GAG chr2 60496788 60496807 60496791 -
tgggagcatagtgagagaga

SEQ ID NO: 179256 - DNA, 20 bp, Artificial Sequence
  Synthetic oligonucleotide; GAG chr2 60496786 60496805 60496789 -
ggagcatagtgagagagaga

SEQ ID NO: 179257 - DNA, 20 bp, Artificial Sequence
  Synthetic oligonucleotide; GAG chr2 60496784 60496803 60496787 -
agcatagtgagagagagaga

SEQ ID NO: 179258 - DNA, 20 bp, Artificial Sequence
  Synthetic oligonucleotide; GAG chr2 60496782 60496801 60496785 -
catagtgagagagagagaga

SEQ ID NO: 179259 - DNA, 20 bp, Artificial Sequence
  Synthetic oligonucleotide; GAG chr2 60496780 60496799 60496783 -
tagtgagagagagagagaga

SEQ ID NO: 179260 - DNA, 20 bp, Artificial Sequence
  Synthetic oligonucleotide; GAG chr2 60496778 60496797 60496781 -
gtgagagagagagagagaga

SEQ ID NO: 179261 - DNA, 20 bp, Artificial Sequence
  Synthetic oligonucleotide; CAG chr2 60496769 60496788 60496772 -
agagagagagagagcactca

SEQ ID NO: 179262 - DNA, 20 bp, Artificial Sequence
  Synthetic oligonucleotide; TGG chr2 60496766 60496785 60496769 -
gagagagagagcactcacag

SEQ ID NO: 179263 - DNA, 20 bp, Artificial Sequence
  Synthetic oligonucleotide; TAG chr2 60496759 60496778 60496762 -
agagcactcacagtggaacc

SEQ ID NO: 179264 - DNA, 20 bp, Artificial Sequence
  Synthetic oligonucleotide; GAG chr2 60496757 60496776 60496760 -
agcactcacagtggaaccta

SEQ ID NO: 179265 - DNA, 20 bp, Artificial Sequence
  Synthetic oligonucleotide; TGG chr2 60496754 60496773 60496757 -
actcacagtggaacctagag

SEQ ID NO: 179266 - DNA, 20 bp, Artificial Sequence
  Synthetic oligonucleotide; GGG chr2 60496753 60496772 60496756 -
ctcacagtggaacctagagt

SEQ ID NO: 179267 - DNA, 20 bp, Artificial Sequence
  Synthetic oligonucleotide; AAG chr2 60496749 60496768 60496752 -
cagtggaacctagagtggga

SEQ ID NO: 179268 - DNA, 20 bp, Artificial Sequence
  Synthetic oligonucleotide; AGG chr2 60496748 60496767 60496751 -
agtggaacctagagtgggaa

SEQ ID NO: 179269 - DNA, 20 bp, Artificial Sequence
  Synthetic oligonucleotide; TGG chr2 60496740 60496759 60496743 -
ctagagtgggaaaggctacc

SEQ ID NO: 179270 - DNA, 20 bp, Artificial Sequence
  Synthetic oligonucleotide; TGG chr2 60496737 60496756 60496740 -
gagtgggaaaggctacctgg

SEQ ID NO: 179271 - DNA, 20 bp, Artificial Sequence
  Synthetic oligonucleotide; TGG chr2 60496728 60496747 60496731 -
aggctacctggtggctgtcc

SEQ ID NO: 179272 - DNA, 20 bp, Artificial Sequence
  Synthetic oligonucleotide; AAG chr2 60496720 60496739 60496723 -
tggtggctgtcctggcatgt

SEQ ID NO: 179273 - DNA, 20 bp, Artificial Sequence
  Synthetic oligonucleotide; AAG chr2 60496716 60496735 60496719 -
ggctgtcctggcatgtaagt

SEQ ID NO: 179274 - DNA, 20 bp, Artificial Sequence
  Synthetic oligonucleotide; TGG chr2 60496707 60496726 60496710 -
ggcatgtaagtaagtctgtg

SEQ ID NO: 179275 - DNA, 20 bp, Artificial Sequence
  Synthetic oligonucleotide; CAG chr2 60496703 60496722 60496706 -
tgtaagtaagtctgtgtggt

SEQ ID NO: 179276 - DNA, 20 bp, Artificial Sequence
  Synthetic oligonucleotide; AGG chr2 60496702 60496721 60496705 -
gtaagtaagtctgtgtggtc

SEQ ID NO: 179277 - DNA, 20 bp, Artificial Sequence
  Synthetic oligonucleotide; GGG chr2 60496701 60496720 60496704 -
taagtaagtctgtgtggtca

SEQ ID NO: 179278 - DNA, 20 bp, Artificial Sequence
  Synthetic oligonucleotide; TGG chr2 60496683 60496702 60496686 -
cagggcttgcattccataaa

SEQ ID NO: 179279 - DNA, 20 bp, Artificial Sequence
  Synthetic oligonucleotide; CAG chr2 60496678 60496697 60496681 -
cttgcattccataaatggcc

SEQ ID NO: 179280 - DNA, 20 bp, Artificial Sequence
  Synthetic oligonucleotide; AGG chr2 60496677 60496696 60496680 -
ttgcattccataaatggccc

SEQ ID NO: 179281 - DNA, 20 bp, Artificial Sequence
  Synthetic oligonucleotide; TGG chr2 60496667 60496686 60496670 -
taaatggcccaggcccctgc

SEQ ID NO: 179282 - DNA, 20 bp, Artificial Sequence
  Synthetic oligonucleotide; TGG chr2 60496660 60496679 60496663 -
cccaggcccctgctggctgc

SEQ ID NO: 179283 - DNA, 20 bp, Artificial Sequence
  Synthetic oligonucleotide; GGG chr2 60496659 60496678 60496662 -
ccaggcccctgctggctgct

SEQ ID NO: 179284 - DNA, 20 bp, Artificial Sequence
  Synthetic oligonucleotide; GAG chr2 60496657 60496676 60496660 -
aggcccctgctggctgctgg

SEQ ID NO: 179285 - DNA, 20 bp, Artificial Sequence
  Synthetic oligonucleotide; GAG chr2 60496655 60496674 60496658 -
gcccctgctggctgctggga

SEQ ID NO: 179286 - DNA, 20 bp, Artificial Sequence
  Synthetic oligonucleotide; AAG chr2 60496651 60496670 60496654 -
ctgctggctgctgggagaga

SEQ ID NO: 179287 - DNA, 20 bp, Artificial Sequence
  Synthetic oligonucleotide; CGG chr2 60496647 60496666 60496650 -
tggctgctgggagagaaagt

SEQ ID NO: 179288 - DNA, 20 bp, Artificial Sequence
  Synthetic oligonucleotide; GAG chr2 60496643 60496662 60496646 -
tgctgggagagaaagtcggt

SEQ ID NO: 179289 - DNA, 20 bp, Artificial Sequence
  Synthetic oligonucleotide; AGG chr2 60496642 60496661 60496645 -
gctgggagagaaagtcggtg

SEQ ID NO: 179290 - DNA, 20 bp, Artificial Sequence
  Synthetic oligonucleotide; GAG chr2 60496640 60496659 60496643 -
tgggagagaaagtcggtgag

SEQ ID NO: 179291 - DNA, 20 bp, Artificial Sequence
  Synthetic oligonucleotide; GAG chr2 60496638 60496657 60496641 -
ggagagaaagtcggtgagga

SEQ ID NO: 179292 - DNA, 20 bp, Artificial Sequence
  Synthetic oligonucleotide; GAG chr2 60496636 60496655 60496639 -
agagaaagtcggtgaggaga

SEQ ID NO: 179293 - DNA, 20 bp, Artificial Sequence
  Synthetic oligonucleotide; AGG chr2 60496635 60496654 60496638 -
gagaaagtcggtgaggagag

SEQ ID NO: 179294 - DNA, 20 bp, Artificial Sequence
  Synthetic oligonucleotide; GGG chr2 60496634 60496653 60496637 -
agaaagtcggtgaggagaga

SEQ ID NO: 179295 - DNA, 20 bp, Artificial Sequence
  Synthetic oligonucleotide; AAG chr2 60496625 60496644 60496628 -
gtgaggagagagggttgtac

SEQ ID NO: 179296 - DNA, 20 bp, Artificial Sequence
  Synthetic oligonucleotide; AGG chr2 60496624 60496643 60496627 -
tgaggagagagggttgtaca

SEQ ID NO: 179297 - DNA, 20 bp, Artificial Sequence
  Synthetic oligonucleotide; CAG chr2 60496621 60496640 60496624 -
ggagagagggttgtacaagg

SEQ ID NO: 179298 - DNA, 20 bp, Artificial Sequence
  Synthetic oligonucleotide; AGG chr2 60496620 60496639 60496623 -
gagagagggttgtacaaggc

SEQ ID NO: 179299 - DNA, 20 bp, Artificial Sequence
  Synthetic oligonucleotide; GAG chr2 60496618 60496637 60496621 -
gagagggttgtacaaggcag

SEQ ID NO: 179300 - DNA, 20 bp, Artificial Sequence
  Synthetic oligonucleotide; GAG chr2 60496616 60496635 60496619 -
gagggttgtacaaggcagga

SEQ ID NO: 179301 - DNA, 20 bp, Artificial Sequence
  Synthetic oligonucleotide; CAG chr2 60496603 60496622 60496606 -
ggcaggagagatgtactcac

SEQ ID NO: 179302 - DNA, 20 bp, Artificial Sequence
  Synthetic oligonucleotide; AGG chr2 60496602 60496621 60496605 -
gcaggagagatgtactcacc

SEQ ID NO: 179303 - DNA, 20 bp, Artificial Sequence
  Synthetic oligonucleotide; CAG chr2 60496593 60496612 60496596 -
atgtactcaccaggctcttc

SEQ ID NO: 179304 - DNA, 20 bp, Artificial Sequence
  Synthetic oligonucleotide; AAG chr2 60496590 60496609 60496593 -
tactcaccaggctcttccag

SEQ ID NO: 179305 - DNA, 20 bp, Artificial Sequence
  Synthetic oligonucleotide; AGG chr2 60496589 60496608 60496592 -
actcaccaggctcttccaga

SEQ ID NO: 179306 - DNA, 20 bp, Artificial Sequence
  Synthetic oligonucleotide; GGG chr2 60496588 60496607 60496591 -
ctcaccaggctcttccagaa

SEQ ID NO: 179307 - DNA, 20 bp, Artificial Sequence
  Synthetic oligonucleotide; GGG chr2 60496587 60496606 60496590 -
tcaccaggctcttccagaag

SEQ ID NO: 179308 - DNA, 20 bp, Artificial Sequence
  Synthetic oligonucleotide; CAG chr2 60496554 60496573 60496557 -
aaatccttgccttgaacctg

SEQ ID NO: 179309 - DNA, 20 bp, Artificial Sequence
  Synthetic oligonucleotide; AAG chr2 60496549 60496568 60496552 -
cttgccttgaacctgcagca

SEQ ID NO: 179310 - DNA, 20 bp, Artificial Sequence
  Synthetic oligonucleotide; TGG chr2 60496546 60496565 60496549 -
gccttgaacctgcagcaaag

SEQ ID NO: 179311 - DNA, 20 bp, Artificial Sequence
  Synthetic oligonucleotide; AAG chr2 60496543 60496562 60496546 -
ttgaacctgcagcaaagtgg

SEQ ID NO: 179312 - DNA, 20 bp, Artificial Sequence
  Synthetic oligonucleotide; TAG chr2 60496539 60496558 60496542 -
acctgcagcaaagtggaaga

SEQ ID NO: 179313 - DNA, 20 bp, Artificial Sequence
  Synthetic oligonucleotide; AGG chr2 60496538 60496557 60496541 -
cctgcagcaaagtggaagat

SEQ ID NO: 179314 - DNA, 20 bp, Artificial Sequence
  Synthetic oligonucleotide; CAG chr2 60496503 60496522 60496506 -
ctcttccctctttcctgctt

SEQ ID NO: 179315 - DNA, 20 bp, Artificial Sequence
  Synthetic oligonucleotide; AGG chr2 60496502 60496521 60496505 -
tcttccctctttcctgcttc

SEQ ID NO: 179316 - DNA, 20 bp, Artificial Sequence
  Synthetic oligonucleotide; CAG chr2 60496470 60496489 60496473 -
actcacttttgctgtgtgtc

SEQ ID NO: 179317 - DNA, 20 bp, Artificial Sequence
  Synthetic oligonucleotide; GAG chr2 60496468 60496487 60496471 -
tcacttttgctgtgtgtcca

SEQ ID NO: 179318 - DNA, 20 bp, Artificial Sequence
  Synthetic oligonucleotide; CAG chr2 60496460 60496479 60496463 -
gctgtgtgtccagagctgac

SEQ ID NO: 179319 - DNA, 20 bp, Artificial Sequence
  Synthetic oligonucleotide; GAG chr2 60496458 60496477 60496461 -
tgtgtgtccagagctgacca

SEQ ID NO: 179320 - DNA, 20 bp, Artificial Sequence
  Synthetic oligonucleotide; AGG chr2 60496457 60496476 60496460 -
gtgtgtccagagctgaccag

SEQ ID NO: 179321 - DNA, 20 bp, Artificial Sequence
  Synthetic oligonucleotide; TGG chr2 60496450 60496469 60496453 -
cagagctgaccagaggacaa

SEQ ID NO: 179322 - DNA, 20 bp, Artificial Sequence
  Synthetic oligonucleotide; CAG chr2 60496447 60496466 60496450 -
agctgaccagaggacaatgg

SEQ ID NO: 179323 - DNA, 20 bp, Artificial Sequence
  Synthetic oligonucleotide; CAG chr2 60496435 60496454 60496438 -
gacaatggcagacttattgt

SEQ ID NO: 179324 - DNA, 20 bp, Artificial Sequence
  Synthetic oligonucleotide; TGG chr2 60496430 60496449 60496433 -
tggcagacttattgtcagac

SEQ ID NO: 179325 - DNA, 20 bp, Artificial Sequence
  Synthetic oligonucleotide; CAG chr2 60496427 60496446 60496430 -
cagacttattgtcagactgg

SEQ ID NO: 179326 - DNA, 20 bp, Artificial Sequence
  Synthetic oligonucleotide; CAG chr2 60496421 60496440 60496424 -
tattgtcagactggcagcac

SEQ ID NO: 179327 - DNA, 20 bp, Artificial Sequence
  Synthetic oligonucleotide; TAG chr2 60496416 60496435 60496419 -
tcagactggcagcaccagcc

SEQ ID NO: 179328 - DNA, 20 bp, Artificial Sequence
  Synthetic oligonucleotide; TGG chr2 60496398 60496417 60496401 -
cctagtgctctgtctctgcc

SEQ ID NO: 179329 - DNA, 20 bp, Artificial Sequence
  Synthetic oligonucleotide; GGG chr2 60496397 60496416 60496400 -
ctagtgctctgtctctgcct

SEQ ID NO: 179330 - DNA, 20 bp, Artificial Sequence
  Synthetic oligonucleotide; TGG chr2 60496391 60496410 60496394 -
ctctgtctctgcctgggaaa

SEQ ID NO: 179331 - DNA, 20 bp, Artificial Sequence
  Synthetic oligonucleotide; AAG chr2 60496381 60496400 60496384 -
gcctgggaaatggtttcaca

SEQ ID NO: 179332 - DNA, 20 bp, Artificial Sequence
  Synthetic oligonucleotide; CAG chr2 60496375 60496394 60496378 -
gaaatggtttcacaaagctc

SEQ ID NO: 179333 - DNA, 20 bp, Artificial Sequence
  Synthetic oligonucleotide; TGG chr2 60496364 60496383 60496367 -
acaaagctccagttctgccc

SEQ ID NO: 179334 - DNA, 20 bp, Artificial Sequence
  Synthetic oligonucleotide; TAG chr2 60496349 60496368 60496352 -
tgccctggacacttgcctca

SEQ ID NO: 179335 - DNA, 20 bp, Artificial Sequence
  Synthetic oligonucleotide; AGG chr2 60496348 60496367 60496351 -
gccctggacacttgcctcat

SEQ ID NO: 179336 - DNA, 20 bp, Artificial Sequence
  Synthetic oligonucleotide; GGG chr2 60496347 60496366 60496350 -
ccctggacacttgcctcata

SEQ ID NO: 179337 - DNA, 20 bp, Artificial Sequence
  Synthetic oligonucleotide; CAG chr2 60496328 60496347 60496331 -
agggctatccctttgcccct

SEQ ID NO: 179338 - DNA, 20 bp, Artificial Sequence
  Synthetic oligonucleotide; TGG chr2 60496316 60496335 60496319 -
ttgcccctcagtaacaccac

SEQ ID NO: 179339 - DNA, 20 bp, Artificial Sequence
  Synthetic oligonucleotide; GGG chr2 60496315 60496334 60496318 -
tgcccctcagtaacaccact

SEQ ID NO: 179340 - DNA, 20 bp, Artificial Sequence
  Synthetic oligonucleotide; TGG chr2 60496311 60496330 60496314 -
cctcagtaacaccactggga

SEQ ID NO: 179341 - DNA, 20 bp, Artificial Sequence
  Synthetic oligonucleotide; TGG chr2 60496282 60496301 60496285 -
cccaccctgtcccccatctg

SEQ ID NO: 179342 - DNA, 20 bp, Artificial Sequence
  Synthetic oligonucleotide; TAG chr2 60496279 60496298 60496282 -
accctgtcccccatctgtgg

SEQ ID NO: 179343 - DNA, 20 bp, Artificial Sequence
  Synthetic oligonucleotide; TGG chr2 60496262 60496281 60496265 -
tggtagcctgtgttgcctcg

SEQ ID NO: 179344 - DNA, 20 bp, Artificial Sequence
  Synthetic oligonucleotide; GGG chr2 60496261 60496280 60496264 -
ggtagcctgtgttgcctcgt

SEQ ID NO: 179345 - DNA, 20 bp, Artificial Sequence
  Synthetic oligonucleotide; AAG chr2 60496256 60496275 60496259 -
cctgtgttgcctcgtgggac

SEQ ID NO: 179346 - DNA, 20 bp, Artificial Sequence
  Synthetic oligonucleotide; AGG chr2 60496255 60496274 60496258 -
ctgtgttgcctcgtgggaca

SEQ ID NO: 179347 - DNA, 20 bp, Artificial Sequence
  Synthetic oligonucleotide; TGG chr2 60496234 60496253 60496237 -
ggcattctgtaaacgtgtat

SEQ ID NO: 179348 - DNA, 20 bp, Artificial Sequence
  Synthetic oligonucleotide; AAG chr2 60496218 60496237 60496221 -
gtattggacttccattgctt

SEQ ID NO: 179349 - DNA, 20 bp, Artificial Sequence
  Synthetic oligonucleotide; CAG chr2 60496192 60496211 60496195 -
tgatttgtttttccgacttc

SEQ ID NO: 179350 - DNA, 20 bp, Artificial Sequence
  Synthetic oligonucleotide; CGG chr2 60496181 60496200 60496184 -
tccgacttccagaactttcc

SEQ ID NO: 179351 - DNA, 20 bp, Artificial Sequence
  Synthetic oligonucleotide; TGG chr2 60496175 60496194 60496178 -
ttccagaactttcccggttc

SEQ ID NO: 179352 - DNA, 20 bp, Artificial Sequence
  Synthetic oligonucleotide; TGG chr2 60496167 60496186 60496170 -
ctttcccggttctggttttc

SEQ ID NO: 179353 - DNA, 20 bp, Artificial Sequence
  Synthetic oligonucleotide; GGG chr2 60496166 60496185 60496169 -
tttcccggttctggttttct

SEQ ID NO: 179354 - DNA, 20 bp, Artificial Sequence
  Synthetic oligonucleotide; CAG chr2 60496121 60496140 60496124 -
tccgtaatccatttcctgca

SEQ ID NO: 179355 - DNA, 20 bp, Artificial Sequence
  Synthetic oligonucleotide; AGG chr2 60496120 60496139 60496123 -
ccgtaatccatttcctgcac

SEQ ID NO: 179356 - DNA, 20 bp, Artificial Sequence
  Synthetic oligonucleotide; CGG chr2 60496091 60496110 60496094 -
gctttcaatcatctcccctc

SEQ ID NO: 179357 - DNA, 20 bp, Artificial Sequence
  Synthetic oligonucleotide; AAG chr2 60496080 60496099 60496083 -
tctcccctccggttatccta

SEQ ID NO: 179358 - DNA, 20 bp, Artificial Sequence
  Synthetic oligonucleotide; GAG chr2 60496048 60496067 60496051 -
tcaattgacttttcacatat

SEQ ID NO: 179359 - DNA, 20 bp, Artificial Sequence
  Synthetic oligonucleotide; AGG chr2 60496047 60496066 60496050 -
caattgacttttcacatatg

SEQ ID NO: 179360 - DNA, 20 bp, Artificial Sequence
  Synthetic oligonucleotide; GGG chr2 60496046 60496065 60496049 -
aattgacttttcacatatga

SEQ ID NO: 179361 - DNA, 20 bp, Artificial Sequence
  Synthetic oligonucleotide; TGG chr2 60496036 60496055 60496039 -
tcacatatgagggtgacctc

SEQ ID NO: 179362 - DNA, 20 bp, Artificial Sequence
  Synthetic oligonucleotide; TGG chr2 60496021 60496040 60496024 -
acctctggatcccttctctt

SEQ ID NO: 179363 - DNA, 20 bp, Artificial Sequence
  Synthetic oligonucleotide; CAG chr2 60496000 60496019 60496003 -
ggtttgtttgttctcttttc

SEQ ID NO: 179364 - DNA, 20 bp, Artificial Sequence
  Synthetic oligonucleotide; GAG chr2 60495998 60496017 60496001 -
tttgtttgttctcttttcca

SEQ ID NO: 179365 - DNA, 20 bp, Artificial Sequence
  Synthetic oligonucleotide; CAG chr2 60495992 60496011 60495995 -
tgttctcttttccagagctg

SEQ ID NO: 179366 - DNA, 20 bp, Artificial Sequence
  Synthetic oligonucleotide; TAG chr2 60495980 60495999 60495983 -
cagagctgcagtatgtttct

SEQ ID NO: 179367 - DNA, 20 bp, Artificial Sequence
  Synthetic oligonucleotide; AGG chr2 60495979 60495998 60495982 -
agagctgcagtatgtttctt

SEQ ID NO: 179368 - DNA, 20 bp, Artificial Sequence
  Synthetic oligonucleotide; TAG chr2 60495964 60495983 60495967 -
ttcttaggtgttttaaaaaa

SEQ ID NO: 179369 - DNA, 20 bp, Artificial Sequence
  Synthetic oligonucleotide; AAG chr2 60495959 60495978 60495962 -
aggtgttttaaaaaatagct

SEQ ID NO: 179370 - DNA, 20 bp, Artificial Sequence
  Synthetic oligonucleotide; TAG chr2 60495954 60495973 60495957 -
ttttaaaaaatagctaagaa

SEQ ID NO: 179371 - DNA, 20 bp, Artificial Sequence
  Synthetic oligonucleotide; TAG chr2 60495932 60495951 60495935 -
gtgaaaacacccttgtaatt

SEQ ID NO: 179372 - DNA, 20 bp, Artificial Sequence
  Synthetic oligonucleotide; GAG chr2 60495930 60495949 60495933 -
gaaaacacccttgtaattta

SEQ ID NO: 179373 - DNA, 20 bp, Artificial Sequence
  Synthetic oligonucleotide; CAG chr2 60495922 60495941 60495925 -
ccttgtaatttagagactct

SEQ ID NO: 179374 - DNA, 20 bp, Artificial Sequence
  Synthetic oligonucleotide; CAG chr2 60495911 60495930 60495914 -
agagactctcagaaaaatga

SEQ ID NO: 179375 - DNA, 20 bp, Artificial Sequence
  Synthetic oligonucleotide; TAG chr2 60495901 60495920 60495904 -
agaaaaatgacagcaccatt

SEQ ID NO: 179376 - DNA, 20 bp, Artificial Sequence
  Synthetic oligonucleotide; GAG chr2 60495899 60495918 60495902 -
aaaaatgacagcaccattta

SEQ ID NO: 179377 - DNA, 20 bp, Artificial Sequence
  Synthetic oligonucleotide; TGG chr2 60495894 60495913 60495897 -
tgacagcaccatttagagcc

SEQ ID NO: 179378 - DNA, 20 bp, Artificial Sequence
  Synthetic oligonucleotide; CAG chr2 60495886 60495905 60495889 -
ccatttagagcctggaatta

SEQ ID NO: 179379 - DNA, 20 bp, Artificial Sequence
  Synthetic oligonucleotide; CAG chr2 60495856 60495875 60495859 -
tcactgtgccttctctgccc

SEQ ID NO: 179380 - DNA, 20 bp, Artificial Sequence
  Synthetic oligonucleotide; AGG chr2 60495855 60495874 60495858 -
cactgtgccttctctgcccc

SEQ ID NO: 179381 - DNA, 20 bp, Artificial Sequence
  Synthetic oligonucleotide; TGG chr2 60495846 60495865 60495849 -
ttctctgccccaggctccca

SEQ ID NO: 179382 - DNA, 20 bp, Artificial Sequence
  Synthetic oligonucleotide; TGG chr2 60495843 60495862 60495846 -
tctgccccaggctcccatgg

SEQ ID NO: 179383 - DNA, 20 bp, Artificial Sequence
  Synthetic oligonucleotide; AAG chr2 60495839 60495858 60495842 -
ccccaggctcccatggtggc

SEQ ID NO: 179384 - DNA, 20 bp, Artificial Sequence
  Synthetic oligonucleotide; AGG chr2 60495838 60495857 60495841 -
cccaggctcccatggtggca

SEQ ID NO: 179385 - DNA, 20 bp, Artificial Sequence
  Synthetic oligonucleotide; GGG chr2 60495837 60495856 60495840 -
ccaggctcccatggtggcaa

SEQ ID NO: 179386 - DNA, 20 bp, Artificial Sequence
  Synthetic oligonucleotide; TGG chr2 60495830 60495849 60495833 -
cccatggtggcaagggtttt

SEQ ID NO: 179387 - DNA, 20 bp, Artificial Sequence
  Synthetic oligonucleotide; TGG chr2 60495826 60495845 60495829 -
tggtggcaagggtttttggt

SEQ ID NO: 179388 - DNA, 20 bp, Artificial Sequence
  Synthetic oligonucleotide; GGG chr2 60495825 60495844 60495828 -
ggtggcaagggtttttggtt

SEQ ID NO: 179389 - DNA, 20 bp, Artificial Sequence
  Synthetic oligonucleotide; GGG chr2 60495824 60495843 60495827 -
gtggcaagggtttttggttg

SEQ ID NO: 179390 - DNA, 20 bp, Artificial Sequence
  Synthetic oligonucleotide; GGG chr2 60495823 60495842 60495826 -
tggcaagggtttttggttgg

SEQ ID NO: 179391 - DNA, 20 bp, Artificial Sequence
  Synthetic oligonucleotide; AAG chr2 60495820 60495839 60495823 -
caagggtttttggttggggg

SEQ ID NO: 179392 - DNA, 20 bp, Artificial Sequence
  Synthetic oligonucleotide; AGG chr2 60495819 60495838 60495822 -
aagggtttttggttggggga

SEQ ID NO: 179393 - DNA, 20 bp, Artificial Sequence
  Synthetic oligonucleotide; GGG chr2 60495818 60495837 60495821 -
agggtttttggttgggggaa

SEQ ID NO: 179394 - DNA, 20 bp, Artificial Sequence
  Synthetic oligonucleotide; GGG chr2 60495817 60495836 60495820 -
gggtttttggttgggggaag

SEQ ID NO: 179395 - DNA, 20 bp, Artificial Sequence
  Synthetic oligonucleotide; GAG chr2 60495795 60495814 60495798 -
gtattgaattgcctgtcttt

SEQ ID NO: 179396 - DNA, 20 bp, Artificial Sequence
  Synthetic oligonucleotide; CAG chr2 60495792 60495811 60495795 -
ttgaattgcctgtctttgag

SEQ ID NO: 179397 - DNA, 20 bp, Artificial Sequence
  Synthetic oligonucleotide; AGG chr2 60495791 60495810 60495794 -
tgaattgcctgtctttgagc

SEQ ID NO: 179398 - DNA, 20 bp, Artificial Sequence
  Synthetic oligonucleotide; AAG chr2 60495786 60495805 60495789 -
tgcctgtctttgagcaggaa

SEQ ID NO: 179399 - DNA, 20 bp, Artificial Sequence
  Synthetic oligonucleotide; CAG chr2 60495778 60495797 60495781 -
tttgagcaggaaaagaatta

SEQ ID NO: 179400 - DNA, 20 bp, Artificial Sequence
  Synthetic oligonucleotide; CAG chr2 60495770 60495789 60495773 -
ggaaaagaattacagttttc

SEQ ID NO: 179401 - DNA, 20 bp, Artificial Sequence
  Synthetic oligonucleotide; AGG chr2 60495769 60495788 60495772 -
gaaaagaattacagttttcc

SEQ ID NO: 179402 - DNA, 20 bp, Artificial Sequence
  Synthetic oligonucleotide; GAG chr2 60495741 60495760 60495744 -
tttgtgtgtatgtgctgatt

SEQ ID NO: 179403 - DNA, 20 bp, Artificial Sequence
  Synthetic oligonucleotide; AGG chr2 60495740 60495759 60495743 -
ttgtgtgtatgtgctgattg

SEQ ID NO: 179404 - DNA, 20 bp, Artificial Sequence
  Synthetic oligonucleotide; GGG chr2 60495739 60495758 60495742 -
tgtgtgtatgtgctgattga

SEQ ID NO: 179405 - DNA, 20 bp, Artificial Sequence
  Synthetic oligonucleotide; GAG chr2 60495730 60495749 60495733 -
gtgctgattgagggcccatt

SEQ ID NO: 179406 - DNA, 20 bp, Artificial Sequence
  Synthetic oligonucleotide; TAG chr2 60495713 60495732 60495716 -
attgagaatattttgacttt

SEQ ID NO: 179407 - DNA, 20 bp, Artificial Sequence
  Synthetic oligonucleotide; AGG chr2 60495712 60495731 60495715 -
ttgagaatattttgactttt

SEQ ID NO: 179408 - DNA, 20 bp, Artificial Sequence
  Synthetic oligonucleotide; GGG chr2 60495711 60495730 60495714 -
tgagaatattttgactttta

SEQ ID NO: 179409 - DNA, 20 bp, Artificial Sequence
  Synthetic oligonucleotide; AAG chr2 60495708 60495727 60495711 -
gaatattttgacttttaggg

SEQ ID NO: 179410 - DNA, 20 bp, Artificial Sequence
  Synthetic oligonucleotide; CAG chr2 60495687 60495706 60495690 -
agctccaaactctcaaacca

SEQ ID NO: 179411 - DNA, 20 bp, Artificial Sequence
  Synthetic oligonucleotide; AGG chr2 60495686 60495705 60495689 -
gctccaaactctcaaaccac

SEQ ID NO: 179412 - DNA, 20 bp, Artificial Sequence
  Synthetic oligonucleotide; GGG chr2 60495685 60495704 60495688 -
ctccaaactctcaaaccaca

SEQ ID NO: 179413 - DNA, 20 bp, Artificial Sequence
  Synthetic oligonucleotide; AAG chr2 60495643 60495662 60495646 -
tctgttatgacgttatatgt

SEQ ID NO: 179414 - DNA, 20 bp, Artificial Sequence
  Synthetic oligonucleotide; CAG chr2 60495632 60495651 60495635 -
gttatatgtaagcatcacaa

SEQ ID NO: 179415 - DNA, 20 bp, Artificial Sequence
  Synthetic oligonucleotide; AGG chr2 60495631 60495650 60495634 -
ttatatgtaagcatcacaac

SEQ ID NO: 179416 - DNA, 20 bp, Artificial Sequence
  Synthetic oligonucleotide; CAG chr2 60495628 60495647 60495631 -
tatgtaagcatcacaacagg

SEQ ID NO: 179417 - DNA, 20 bp, Artificial Sequence
  Synthetic oligonucleotide; GAG chr2 60495626 60495645 60495629 -
tgtaagcatcacaacaggca

SEQ ID NO: 179418 - DNA, 20 bp, Artificial Sequence
  Synthetic oligonucleotide; TGG chr2 60495605 60495624 60495608 -
agaatgtctgcaccccaccc

SEQ ID NO: 179419 - DNA, 20 bp, Artificial Sequence
  Synthetic oligonucleotide; CAG chr2 60495598 60495617 60495601 -
ctgcaccccaccctggaaaa

SEQ ID NO: 179420 - DNA, 20 bp, Artificial Sequence
  Synthetic oligonucleotide; TGG chr2 60495580 60495599 60495583 -
aacagcctgactgtgcccca

SEQ ID NO: 179421 - DNA, 20 bp, Artificial Sequence
  Synthetic oligonucleotide; GGG chr2 60495579 60495598 60495582 -
acagcctgactgtgccccat

SEQ ID NO: 179422 - DNA, 20 bp, Artificial Sequence
  Synthetic oligonucleotide; CAG chr2 60495571 60495590 60495574 -
actgtgccccatgggcaaac

SEQ ID NO: 179423 - DNA, 20 bp, Artificial Sequence
  Synthetic oligonucleotide; TAG chr2 60495566 60495585 60495569 -
gccccatgggcaaaccagac

SEQ ID NO: 179424 - DNA, 20 bp, Artificial Sequence
  Synthetic oligonucleotide; TAG chr2 60495559 60495578 60495562 -
gggcaaaccagactagttta

SEQ ID NO: 179425 - DNA, 20 bp, Artificial Sequence
  Synthetic oligonucleotide; AGG chr2 60495558 60495577 60495561 -
ggcaaaccagactagtttat

SEQ ID NO: 179426 - DNA, 20 bp, Artificial Sequence
  Synthetic oligonucleotide; GGG chr2 60495557 60495576 60495560 -
gcaaaccagactagtttata

SEQ ID NO: 179427 - DNA, 20 bp, Artificial Sequence
  Synthetic oligonucleotide; GGG chr2 60495556 60495575 60495559 -
caaaccagactagtttatag

SEQ ID NO: 179428 - DNA, 20 bp, Artificial Sequence
  Synthetic oligonucleotide; GGG chr2 60495555 60495574 60495558 -
aaaccagactagtttatagg

SEQ ID NO: 179429 - DNA, 20 bp, Artificial Sequence
  Synthetic oligonucleotide; GAG chr2 60495543 60495562 60495546 -
tttatagggggttctactct

SEQ ID NO: 179430 - DNA, 20 bp, Artificial Sequence
  Synthetic oligonucleotide; AGG chr2 60495542 60495561 60495545 -
ttatagggggttctactctg

SEQ ID NO: 179431 - DNA, 20 bp, Artificial Sequence
  Synthetic oligonucleotide; TGG chr2 60495533 60495552 60495536 -
gttctactctgaggtactga

SEQ ID NO: 179432 - DNA, 20 bp, Artificial Sequence
  Synthetic oligonucleotide; TGG chr2 60495526 60495545 60495529 -
tctgaggtactgatggacct

SEQ ID NO: 179433 - DNA, 20 bp, Artificial Sequence
  Synthetic oligonucleotide; GGG chr2 60495525 60495544 60495528 -
ctgaggtactgatggacctt

SEQ ID NO: 179434 - DNA, 20 bp, Artificial Sequence
  Synthetic oligonucleotide; AAG chr2 60495507 60495526 60495510 -
ttgggtgctattcctgtgat

SEQ ID NO: 179435 - DNA, 20 bp, Artificial Sequence
  Synthetic oligonucleotide; AGG chr2 60495506 60495525 60495509 -
tgggtgctattcctgtgata

SEQ ID NO: 179436 - DNA, 20 bp, Artificial Sequence
  Synthetic oligonucleotide; AAG chr2 60495503 60495522 60495506 -
gtgctattcctgtgataagg

SEQ ID NO: 179437 - DNA, 20 bp, Artificial Sequence
  Synthetic oligonucleotide; AGG chr2 60495502 60495521 60495505 -
tgctattcctgtgataagga

SEQ ID NO: 179438 - DNA, 20 bp, Artificial Sequence
  Synthetic oligonucleotide; CAG chr2 60495499 60495518 60495502 -
tattcctgtgataaggaagg

SEQ ID NO: 179439 - DNA, 20 bp, Artificial Sequence
  Synthetic oligonucleotide; TAG chr2 60495495 60495514 60495498 -
cctgtgataaggaaggcagc

SEQ ID NO: 179440 - DNA, 20 bp, Artificial Sequence
  Synthetic oligonucleotide; CAG chr2 60495491 60495510 60495494 -
tgataaggaaggcagctaga

SEQ ID NO: 179441 - DNA, 20 bp, Artificial Sequence
  Synthetic oligonucleotide; AGG chr2 60495490 60495509 60495493 -
gataaggaaggcagctagac

SEQ ID NO: 179442 - DNA, 20 bp, Artificial Sequence
  Synthetic oligonucleotide; TGG chr2 60495484 60495503 60495487 -
gaaggcagctagacaggact

SEQ ID NO: 179443 - DNA, 20 bp, Artificial Sequence
  Synthetic oligonucleotide; GGG chr2 60495483 60495502 60495486 -
aaggcagctagacaggactt

SEQ ID NO: 179444 - DNA, 20 bp, Artificial Sequence
  Synthetic oligonucleotide; GAG chr2 60495481 60495500 60495484 -
ggcagctagacaggacttgg

SEQ ID NO: 179445 - DNA, 20 bp, Artificial Sequence
  Synthetic oligonucleotide; TAG chr2 60495471 60495490 60495474 -
caggacttgggagttatctg

SEQ ID NO: 179446 - DNA, 20 bp, Artificial Sequence
  Synthetic oligonucleotide; GAG chr2 60495467 60495486 60495470 -
acttgggagttatctgtagt

SEQ ID NO: 179447 - DNA, 20 bp, Artificial Sequence
  Synthetic oligonucleotide; TGG chr2 60495463 60495482 60495466 -
gggagttatctgtagtgaga

SEQ ID NO: 179448 - DNA, 20 bp, Artificial Sequence
  Synthetic oligonucleotide; AAG chr2 60495455 60495474 60495458 -
tctgtagtgagatggctgaa

SEQ ID NO: 179449 - DNA, 20 bp, Artificial Sequence
  Synthetic oligonucleotide; CAG chr2 60495447 60495466 60495450 -
gagatggctgaaaagcgata

SEQ ID NO: 179450 - DNA, 20 bp, Artificial Sequence
  Synthetic oligonucleotide; AGG chr2 60495446 60495465 60495449 -
agatggctgaaaagcgatac

SEQ ID NO: 179451 - DNA, 20 bp, Artificial Sequence
  Synthetic oligonucleotide; GGG chr2 60495445 60495464 60495448 -
gatggctgaaaagcgataca

SEQ ID NO: 179452 - DNA, 20 bp, Artificial Sequence
  Synthetic oligonucleotide; TGG chr2 60495441 60495460 60495444 -
gctgaaaagcgatacagggc

SEQ ID NO: 179453 - DNA, 20 bp, Artificial Sequence
  Synthetic oligonucleotide; CAG chr2 60495428 60495447 60495431 -
acagggctggctctatgccc

SEQ ID NO: 179454 - DNA, 20 bp, Artificial Sequence
  Synthetic oligonucleotide; AGG chr2 60495427 60495446 60495430 -
cagggctggctctatgcccc

SEQ ID NO: 179455 - DNA, 20 bp, Artificial Sequence
  Synthetic oligonucleotide; AAG chr2 60495417 60495436 60495420 -
tctatgccccaggtgtgcat

SEQ ID NO: 179456 - DNA, 20 bp, Artificial Sequence
  Synthetic oligonucleotide; AAG chr2 60495413 60495432 60495416 -
tgccccaggtgtgcataagt

SEQ ID NO: 179457 - DNA, 20 bp, Artificial Sequence
  Synthetic oligonucleotide; GAG chr2 60495411 60495430 60495414 -
ccccaggtgtgcataagtaa

SEQ ID NO: 179458 - DNA, 20 bp, Artificial Sequence
  Synthetic oligonucleotide; CAG chr2 60495408 60495427 60495411 -
caggtgtgcataagtaagag

SEQ ID NO: 179459 - DNA, 20 bp, Artificial Sequence
  Synthetic oligonucleotide; TAG chr2 60495404 60495423 60495407 -
tgtgcataagtaagagcaga

SEQ ID NO: 179460 - DNA, 20 bp, Artificial Sequence
  Synthetic oligonucleotide; CAG chr2 60495394 60495413 60495397 -
taagagcagatagctgattc

SEQ ID NO: 179461 - DNA, 20 bp, Artificial Sequence
  Synthetic oligonucleotide; AAG chr2 60495387 60495406 60495390 -
agatagctgattccagtgca

SEQ ID NO: 179462 - DNA, 20 bp, Artificial Sequence
  Synthetic oligonucleotide; CAG chr2 60495378 60495397 60495381 -
attccagtgcaaagtccata

SEQ ID NO: 179463 - DNA, 20 bp, Artificial Sequence
  Synthetic oligonucleotide; AGG chr2 60495377 60495396 60495380 -
ttccagtgcaaagtccatac

SEQ ID NO: 179464 - DNA, 20 bp, Artificial Sequence
  Synthetic oligonucleotide; TAG chr2 60495366 60495385 60495369 -
agtccatacaggtaataaca

SEQ ID NO: 179465 - DNA, 20 bp, Artificial Sequence
  Synthetic oligonucleotide; AGG chr2 60495365 60495384 60495368 -
gtccatacaggtaataacat

SEQ ID NO: 179466 - DNA, 20 bp, Artificial Sequence
  Synthetic oligonucleotide; CAG chr2 60495361 60495380 60495364 -
atacaggtaataacataggc

SEQ ID NO: 179467 - DNA, 20 bp, Artificial Sequence
  Synthetic oligonucleotide; AAG chr2 60495356 60495375 60495359 -
ggtaataacataggccagaa

SEQ ID NO: 179468 - DNA, 20 bp, Artificial Sequence
  Synthetic oligonucleotide; GAG chr2 60495354 60495373 60495357 -
taataacataggccagaaaa

SEQ ID NO: 179469 - DNA, 20 bp, Artificial Sequence
  Synthetic oligonucleotide; TGG chr2 60495348 60495367 60495351 -
cataggccagaaaagagata

SEQ ID NO: 179470 - DNA, 20 bp, Artificial Sequence
  Synthetic oligonucleotide; TAG chr2 60495335 60495354 60495338 -
agagatatggcatctactct

SEQ ID NO: 179471 - DNA, 20 bp, Artificial Sequence
  Synthetic oligonucleotide; CAG chr2 60495321 60495340 60495324 -
tactcttagacataacacac

SEQ ID NO: 179472 - DNA, 20 bp, Artificial Sequence
  Synthetic oligonucleotide; AGG chr2 60495320 60495339 60495323 -
actcttagacataacacacc

SEQ ID NO: 179473 - DNA, 20 bp, Artificial Sequence
  Synthetic oligonucleotide; GGG chr2 60495319 60495338 60495322 -
ctcttagacataacacacca

SEQ ID NO: 179474 - DNA, 20 bp, Artificial Sequence
  Synthetic oligonucleotide; AAG chr2 60495302 60495321 60495305 -
ccagggtcaatacaactttg

SEQ ID NO: 179475 - DNA, 20 bp, Artificial Sequence
  Synthetic oligonucleotide; TAG chr2 60495298 60495317 60495301 -
ggtcaatacaactttgaagc

SEQ ID NO: 179476 - DNA, 20 bp, Artificial Sequence
  Synthetic oligonucleotide; TAG chr2 60495293 60495312 60495296 -
atacaactttgaagctagtc

SEQ ID NO: 179477 - DNA, 20 bp, Artificial Sequence
  Synthetic oligonucleotide; AAG chr2 60495287 60495306 60495290 -
ctttgaagctagtctagtgc

SEQ ID NO: 179478 - DNA, 20 bp, Artificial Sequence
  Synthetic oligonucleotide; CAG chr2 60495280 60495299 60495283 -
gctagtctagtgcaagctaa

SEQ ID NO: 179479 - DNA, 20 bp, Artificial Sequence
  Synthetic oligonucleotide; CAG chr2 60495265 60495284 60495268 -
gctaacagttgcttttatca

SEQ ID NO: 179480 - DNA, 20 bp, Artificial Sequence
  Synthetic oligonucleotide; AGG chr2 60495264 60495283 60495267 -
ctaacagttgcttttatcac

SEQ ID NO: 179481 - DNA, 20 bp, Artificial Sequence
  Synthetic oligonucleotide; CAG chr2 60495258 60495277 60495261 -
gttgcttttatcacaggctc

SEQ ID NO: 179482 - DNA, 20 bp, Artificial Sequence
  Synthetic oligonucleotide; AGG chr2 60495257 60495276 60495260 -
ttgcttttatcacaggctcc

SEQ ID NO: 179483 - DNA, 20 bp, Artificial Sequence
  Synthetic oligonucleotide; AAG chr2 60495254 60495273 60495257 -
cttttatcacaggctccagg

SEQ ID NO: 179484 - DNA, 20 bp, Artificial Sequence
  Synthetic oligonucleotide; AGG chr2 60495253 60495272 60495256 -
ttttatcacaggctccagga

SEQ ID NO: 179485 - DNA, 20 bp, Artificial Sequence
  Synthetic oligonucleotide; GGG chr2 60495252 60495271 60495255 -
tttatcacaggctccaggaa

SEQ ID NO: 179486 - DNA, 20 bp, Artificial Sequence
  Synthetic oligonucleotide; TGG chr2 60495247 60495266 60495250 -
cacaggctccaggaagggtt

SEQ ID NO: 179487 - DNA, 20 bp, Artificial Sequence
  Synthetic oligonucleotide; TAG chr2 60495236 60495255 60495239 -
ggaagggtttggcctctgat

SEQ ID NO: 179488 - DNA, 20 bp, Artificial Sequence
  Synthetic oligonucleotide; AGG chr2 60495235 60495254 60495238 -
gaagggtttggcctctgatt

SEQ ID NO: 179489 - DNA, 20 bp, Artificial Sequence
  Synthetic oligonucleotide; GGG chr2 60495234 60495253 60495237 -
aagggtttggcctctgatta

SEQ ID NO: 179490 - DNA, 20 bp, Artificial Sequence
  Synthetic oligonucleotide; TGG chr2 60495231 60495250 60495234 -
ggtttggcctctgattaggg

SEQ ID NO: 179491 - DNA, 20 bp, Artificial Sequence
  Synthetic oligonucleotide; GGG chr2 60495230 60495249 60495233 -
gtttggcctctgattagggt

SEQ ID NO: 179492 - DNA, 20 bp, Artificial Sequence
  Synthetic oligonucleotide; GGG chr2 60495229 60495248 60495232 -
tttggcctctgattagggtg

SEQ ID NO: 179493 - DNA, 20 bp, Artificial Sequence
  Synthetic oligonucleotide; GGG chr2 60495228 60495247 60495231 -
ttggcctctgattagggtgg

SEQ ID NO: 179494 - DNA, 20 bp, Artificial Sequence
  Synthetic oligonucleotide; TGG chr2 60495223 60495242 60495226 -
ctctgattagggtgggggcg

SEQ ID NO: 179495 - DNA, 20 bp, Artificial Sequence
  Synthetic oligonucleotide; GGG chr2 60495222 60495241 60495225 -
tctgattagggtgggggcgt

SEQ ID NO: 179496 - DNA, 20 bp, Artificial Sequence
  Synthetic oligonucleotide; TGG chr2 60495219 60495238 60495222 -
gattagggtgggggcgtggg

SEQ ID NO: 179497 - DNA, 20 bp, Artificial Sequence
  Synthetic oligonucleotide; GGG chr2 60495218 60495237 60495221 -
attagggtgggggcgtgggt

SEQ ID NO: 179498 - DNA, 20 bp, Artificial Sequence
  Synthetic oligonucleotide; GGG chr2 60495217 60495236 60495220 -
ttagggtgggggcgtgggtg

SEQ ID NO: 179499 - DNA, 20 bp, Artificial Sequence
  Synthetic oligonucleotide; TAG chr2 60495214 60495233 60495217 -
gggtgggggcgtgggtgggg

SEQ ID NO: 179500 - DNA, 20 bp, Artificial Sequence
  Synthetic oligonucleotide; AAG chr2 60495211 60495230 60495214 -
tgggggcgtgggtggggtag

SEQ ID NO: 179501 - DNA, 20 bp, Artificial Sequence
  Synthetic oligonucleotide; GAG chr2 60495209 60495228 60495212 -
ggggcgtgggtggggtagaa

SEQ ID NO: 179502 - DNA, 20 bp, Artificial Sequence
  Synthetic oligonucleotide; AGG chr2 60495208 60495227 60495211 -
gggcgtgggtggggtagaag

SEQ ID NO: 179503 - DNA, 20 bp, Artificial Sequence
  Synthetic oligonucleotide; TGG chr2 60495203 60495222 60495206 -
tgggtggggtagaagaggac

SEQ ID NO: 179504 - DNA, 20 bp, Artificial Sequence
  Synthetic oligonucleotide; CAG chr2 60495200 60495219 60495203 -
gtggggtagaagaggactgg

SEQ ID NO: 179505 - DNA, 20 bp, Artificial Sequence
  Synthetic oligonucleotide; CGG chr2 60495187 60495206 60495190 -
ggactggcagacctctccat

SEQ ID NO: 179506 - DNA, 20 bp, Artificial Sequence
  Synthetic oligonucleotide; TGG chr2 60495184 60495203 60495187 -
ctggcagacctctccatcgg

SEQ ID NO: 179507 - DNA, 20 bp, Artificial Sequence
  Synthetic oligonucleotide; CAG chr2 60495172 60495191 60495175 -
tccatcggtggccgtttgcc

SEQ ID NO: 179508 - DNA, 20 bp, Artificial Sequence
  Synthetic oligonucleotide; AGG chr2 60495171 60495190 60495174 -
ccatcggtggccgtttgccc

SEQ ID NO: 179509 - DNA, 20 bp, Artificial Sequence
  Synthetic oligonucleotide; GGG chr2 60495170 60495189 60495173 -
catcggtggccgtttgccca

SEQ ID NO: 179510 - DNA, 20 bp, Artificial Sequence
  Synthetic oligonucleotide; GGG chr2 60495169 60495188 60495172 -
atcggtggccgtttgcccag

SEQ ID NO: 179511 - DNA, 20 bp, Artificial Sequence
  Synthetic oligonucleotide; GGG chr2 60495168 60495187 60495171 -
tcggtggccgtttgcccagg

SEQ ID NO: 179512 - DNA, 20 bp, Artificial Sequence
  Synthetic oligonucleotide; GGG chr2 60495167 60495186 60495170 -
cggtggccgtttgcccaggg

SEQ ID NO: 179513 - DNA, 20 bp, Artificial Sequence
  Synthetic oligonucleotide; CGG chr2 60495157 60495176 60495160 -
ttgcccaggggggcctcttt

SEQ ID NO: 179514 - DNA, 20 bp, Artificial Sequence
  Synthetic oligonucleotide; AAG chr2 60495154 60495173 60495157 -
cccaggggggcctctttcgg

SEQ ID NO: 179515 - DNA, 20 bp, Artificial Sequence
  Synthetic oligonucleotide; AGG chr2 60495153 60495172 60495156 -
ccaggggggcctctttcgga

SEQ ID NO: 179516 - DNA, 20 bp, Artificial Sequence
  Synthetic oligonucleotide; TGG chr2 60495144 60495163 60495147 -
cctctttcggaaggctctct

SEQ ID NO: 179517 - DNA, 20 bp, Artificial Sequence
  Synthetic oligonucleotide; TGG chr2 60495138 60495157 60495141 -
tcggaaggctctcttggtga

SEQ ID NO: 179518 - DNA, 20 bp, Artificial Sequence
  Synthetic oligonucleotide; GAG chr2 60495136 60495155 60495139 -
ggaaggctctcttggtgatg

SEQ ID NO: 179519 - DNA, 20 bp, Artificial Sequence
  Synthetic oligonucleotide; TGG chr2 60495130 60495149 60495133 -
ctctcttggtgatggagaat

SEQ ID NO: 179520 - DNA, 20 bp, Artificial Sequence
  Synthetic oligonucleotide; TGG chr2 60495113 60495132 60495116 -
aattggattttatttctcaa

SEQ ID NO: 179521 - DNA, 20 bp, Artificial Sequence
  Synthetic oligonucleotide; GGG chr2 60495112 60495131 60495115 -
attggattttatttctcaat

SEQ ID NO: 179522 - DNA, 20 bp, Artificial Sequence
  Synthetic oligonucleotide; TGG chr2 60495081 60495100 60495084 -
aatttgtatgccatgccgtg

SEQ ID NO: 179523 - DNA, 20 bp, Artificial Sequence
  Synthetic oligonucleotide; AAG chr2 60495063 60495082 60495066 -
tgtggactcccaaaattgta

SEQ ID NO: 179524 - DNA, 20 bp, Artificial Sequence
  Synthetic oligonucleotide; AGG chr2 60495062 60495081 60495065 -
gtggactcccaaaattgtaa

SEQ ID NO: 179525 - DNA, 20 bp, Artificial Sequence
  Synthetic oligonucleotide; GAG chr2 60495060 60495079 60495063 -
ggactcccaaaattgtaaag

SEQ ID NO: 179526 - DNA, 20 bp, Artificial Sequence
  Synthetic oligonucleotide; AGG chr2 60495059 60495078 60495062 -
gactcccaaaattgtaaagg

SEQ ID NO: 179527 - DNA, 20 bp, Artificial Sequence
  Synthetic oligonucleotide; AAG chr2 60495054 60495073 60495057 -
ccaaaattgtaaaggaggtg

SEQ ID NO: 179528 - DNA, 20 bp, Artificial Sequence
  Synthetic oligonucleotide; CGG chr2 60495000 60495019 60495003 -
attgtccatttttcatctgt

SEQ ID NO: 179529 - DNA, 20 bp, Artificial Sequence
  Synthetic oligonucleotide; GGG chr2 60494999 60495018 60495002 -
ttgtccatttttcatctgtc

SEQ ID NO: 179530 - DNA, 20 bp, Artificial Sequence
  Synthetic oligonucleotide; TAG chr2 60494974 60494993 60494977 -
gtccacccatccatcacata

SEQ ID NO: 179531 - DNA, 20 bp, Artificial Sequence
  Synthetic oligonucleotide; AGG chr2 60494973 60494992 60494976 -
tccacccatccatcacatat

SEQ ID NO: 179532 - DNA, 20 bp, Artificial Sequence
  Synthetic oligonucleotide; CAG chr2 60494963 60494982 60494966 -
catcacatataggcacctat

SEQ ID NO: 179533 - DNA, 20 bp, Artificial Sequence
  Synthetic oligonucleotide; AGG chr2 60494962 60494981 60494965 -
atcacatataggcacctatc

SEQ ID NO: 179534 - DNA, 20 bp, Artificial Sequence
  Synthetic oligonucleotide; CAG chr2 60494956 60494975 60494959 -
tataggcacctatcaggtac

SEQ ID NO: 179535 - DNA, 20 bp, Artificial Sequence
  Synthetic oligonucleotide; TAG chr2 60494944 60494963 60494947 -
tcaggtaccagctactgtgt

SEQ ID NO: 179536 - DNA, 20 bp, Artificial Sequence
  Synthetic oligonucleotide; AGG chr2 60494943 60494962 60494946 -
caggtaccagctactgtgtt

SEQ ID NO: 179537 - DNA, 20 bp, Artificial Sequence
  Synthetic oligonucleotide; TAG chr2 60494853 60494872 60494856 -
ccttttcttctgacccaaac

SEQ ID NO: 179538 - DNA, 20 bp, Artificial Sequence
  Synthetic oligonucleotide; AGG chr2 60494852 60494871 60494855 -
cttttcttctgacccaaact

SEQ ID NO: 179539 - DNA, 20 bp, Artificial Sequence
  Synthetic oligonucleotide; TGG chr2 60494846 60494865 60494849 -
ttctgacccaaactaggaat

SEQ ID NO: 179540 - DNA, 20 bp, Artificial Sequence
  Synthetic oligonucleotide; GGG chr2 60494845 60494864 60494848 -
tctgacccaaactaggaatt

SEQ ID NO: 179541 - DNA, 20 bp, Artificial Sequence
  Synthetic oligonucleotide; GGG chr2 60494844 60494863 60494847 -
ctgacccaaactaggaattg

SEQ ID NO: 179542 - DNA, 20 bp, Artificial Sequence
  Synthetic oligonucleotide; AAG chr2 60494840 60494859 60494843 -
cccaaactaggaattgggga

SEQ ID NO: 179543 - DNA, 20 bp, Artificial Sequence
  Synthetic oligonucleotide; AGG chr2 60494839 60494858 60494842 -
ccaaactaggaattggggaa

SEQ ID NO: 179544 - DNA, 20 bp, Artificial Sequence
  Synthetic oligonucleotide; GGG chr2 60494838 60494857 60494841 -
caaactaggaattggggaaa

SEQ ID NO: 179545 - DNA, 20 bp, Artificial Sequence
  Synthetic oligonucleotide; GAG chr2 60494814 60494833 60494817 -
ctgataactttgtttctgct

SEQ ID NO: 179546 - DNA, 20 bp, Artificial Sequence
  Synthetic oligonucleotide; AGG chr2 60494813 60494832 60494816 -
tgataactttgtttctgctg

SEQ ID NO: 179547 - DNA, 20 bp, Artificial Sequence
  Synthetic oligonucleotide; CAG chr2 60494794 60494813 60494797 -
gaggtgtaactaataaatac

SEQ ID NO: 179548 - DNA, 20 bp, Artificial Sequence
  Synthetic oligonucleotide; AGG chr2 60494793 60494812 60494796 -
aggtgtaactaataaatacc

SEQ ID NO: 179549 - DNA, 20 bp, Artificial Sequence
  Synthetic oligonucleotide; GAG chr2 60494791 60494810 60494794 -
gtgtaactaataaataccag

SEQ ID NO: 179550 - DNA, 20 bp, Artificial Sequence
  Synthetic oligonucleotide; AGG chr2 60494790 60494809 60494793 -
tgtaactaataaataccagg

SEQ ID NO: 179551 - DNA, 20 bp, Artificial Sequence
  Synthetic oligonucleotide; CAG chr2 60494787 60494806 60494790 -
aactaataaataccaggagg

SEQ ID NO: 179552 - DNA, 20 bp, Artificial Sequence
  Synthetic oligonucleotide; TAG chr2 60494779 60494798 60494782 -
aataccaggaggcagcattt

SEQ ID NO: 179553 - DNA, 20 bp, Artificial Sequence
  Synthetic oligonucleotide; AAG chr2 60494771 60494790 60494774 -
gaggcagcattttagttcac

SEQ ID NO: 179554 - DNA, 20 bp, Artificial Sequence
  Synthetic oligonucleotide; CGG chr2 60494766 60494785 60494769 -
agcattttagttcacaagct

SEQ ID NO: 179555 - DNA, 20 bp, Artificial Sequence
  Synthetic oligonucleotide; GAG chr2 60494764 60494783 60494767 -
cattttagttcacaagctcg

SEQ ID NO: 179556 - DNA, 20 bp, Artificial Sequence
  Synthetic oligonucleotide; TAG chr2 60494747 60494766 60494750 -
tcggagcacttactctgctc

SEQ ID NO: 179557 - DNA, 20 bp, Artificial Sequence
  Synthetic oligonucleotide; AGG chr2 60494746 60494765 60494749 -
cggagcacttactctgctct

SEQ ID NO: 179558 - DNA, 20 bp, Artificial Sequence
  Synthetic oligonucleotide; AAG chr2 60494698 60494717 60494701 -
attttcatacaaaccctatg

SEQ ID NO: 179559 - DNA, 20 bp, Artificial Sequence
  Synthetic oligonucleotide; CGG chr2 60494669 60494688 60494672 -
ctattattattcctatttta

SEQ ID NO: 179560 - DNA, 20 bp, Artificial Sequence
  Synthetic oligonucleotide; GAG chr2 60494664 60494683 60494667 -
attattcctattttacggat

SEQ ID NO: 179561 - DNA, 20 bp, Artificial Sequence
  Synthetic oligonucleotide; CAG chr2 60494645 60494664 60494648 -
tgagtccatattttaaattc

SEQ ID NO: 179562 - DNA, 20 bp, Artificial Sequence
  Synthetic oligonucleotide; AAG chr2 60494639 60494658 60494642 -
catattttaaattccagctg

SEQ ID NO: 179563 - DNA, 20 bp, Artificial Sequence
  Synthetic oligonucleotide; AAG chr2 60494635 60494654 60494638 -
ttttaaattccagctgaaga

SEQ ID NO: 179564 - DNA, 20 bp, Artificial Sequence
  Synthetic oligonucleotide; TGG chr2 60494626 60494645 60494629 -
ccagctgaagaaagaacatt

SEQ ID NO: 179565 - DNA, 20 bp, Artificial Sequence
  Synthetic oligonucleotide; TAG chr2 60494612 60494631 60494615 -
aacatttggtgataaatcat

SEQ ID NO: 179566 - DNA, 20 bp, Artificial Sequence
  Synthetic oligonucleotide; AGG chr2 60494611 60494630 60494614 -
acatttggtgataaatcatt

SEQ ID NO: 179567 - DNA, 20 bp, Artificial Sequence
  Synthetic oligonucleotide; GAG chr2 60494605 60494624 60494608 -
ggtgataaatcattaggaat

SEQ ID NO: 179568 - DNA, 20 bp, Artificial Sequence
  Synthetic oligonucleotide; TAG chr2 60494601 60494620 60494604 -
ataaatcattaggaatgagc

SEQ ID NO: 179569 - DNA, 20 bp, Artificial Sequence
  Synthetic oligonucleotide; AGG chr2 60494600 60494619 60494603 -
taaatcattaggaatgagct

SEQ ID NO: 179570 - DNA, 20 bp, Artificial Sequence
  Synthetic oligonucleotide; GAG chr2 60494598 60494617 60494601 -
aatcattaggaatgagctag

SEQ ID NO: 179571 - DNA, 20 bp, Artificial Sequence
  Synthetic oligonucleotide; CAG chr2 60494582 60494601 60494585 -
ctaggagttatttgtcatca

SEQ ID NO: 179572 - DNA, 20 bp, Artificial Sequence
  Synthetic oligonucleotide; CAG chr2 60494576 60494595 60494579 -
gttatttgtcatcacagaac

SEQ ID NO: 179573 - DNA, 20 bp, Artificial Sequence
  Synthetic oligonucleotide; AAG chr2 60494560 60494579 60494563 -
gaaccagtctgtattgcccc

SEQ ID NO: 179574 - DNA, 20 bp, Artificial Sequence
  Synthetic oligonucleotide; TGG chr2 60494555 60494574 60494558 -
agtctgtattgccccaagtc

SEQ ID NO: 179575 - DNA, 20 bp, Artificial Sequence
  Synthetic oligonucleotide; TGG chr2 60494542 60494561 60494545 -
ccaagtctggctttgccaat

SEQ ID NO: 179576 - DNA, 20 bp, Artificial Sequence
  Synthetic oligonucleotide; GAG chr2 60494540 60494559 60494543 -
aagtctggctttgccaattg

SEQ ID NO: 179577 - DNA, 20 bp, Artificial Sequence
  Synthetic oligonucleotide; TAG chr2 60494535 60494554 60494538 -
tggctttgccaattggagat

SEQ ID NO: 179578 - DNA, 20 bp, Artificial Sequence
  Synthetic oligonucleotide; AGG chr2 60494534 60494553 60494537 -
ggctttgccaattggagatt

SEQ ID NO: 179579 - DNA, 20 bp, Artificial Sequence
  Synthetic oligonucleotide; GGG chr2 60494533 60494552 60494536 -
gctttgccaattggagatta

SEQ ID NO: 179580 - DNA, 20 bp, Artificial Sequence
  Synthetic oligonucleotide; GAG chr2 60494531 60494550 60494534 -
tttgccaattggagattagg

SEQ ID NO: 179581 - DNA, 20 bp, Artificial Sequence
  Synthetic oligonucleotide; TGG chr2 60494527 60494546 60494530 -
ccaattggagattagggaga

SEQ ID NO: 179582 - DNA, 20 bp, Artificial Sequence
  Synthetic oligonucleotide; GAG chr2 60494485 60494504 60494488 -
ctttgatatctcatctcact

SEQ ID NO: 179583 - DNA, 20 bp, Artificial Sequence
  Synthetic oligonucleotide; TGG chr2 60494479 60494498 60494482 -
tatctcatctcactgagctc

SEQ ID NO: 179584 - DNA, 20 bp, Artificial Sequence
  Synthetic oligonucleotide; GGG chr2 60494478 60494497 60494481 -
atctcatctcactgagctct

SEQ ID NO: 179585 - DNA, 20 bp, Artificial Sequence
  Synthetic oligonucleotide; TGG chr2 60494441 60494460 60494444 -
ctctccccatactcccatct

SEQ ID NO: 179586 - DNA, 20 bp, Artificial Sequence
  Synthetic oligonucleotide; AAG chr2 60494426 60494445 60494429 -
catcttggcaaaaattgcat

SEQ ID NO: 179587 - DNA, 20 bp, Artificial Sequence
  Synthetic oligonucleotide; AAG chr2 60494417 60494436 60494420 -
aaaaattgcataagatttat

SEQ ID NO: 179588 - DNA, 20 bp, Artificial Sequence
  Synthetic oligonucleotide; TAG chr2 60494410 60494429 60494413 -
gcataagatttataagacat

SEQ ID NO: 179589 - DNA, 20 bp, Artificial Sequence
  Synthetic oligonucleotide; AGG chr2 60494409 60494428 60494412 -
cataagatttataagacatt

SEQ ID NO: 179590 - DNA, 20 bp, Artificial Sequence
  Synthetic oligonucleotide; GGG chr2 60494408 60494427 60494411 -
ataagatttataagacatta

SEQ ID NO: 179591 - DNA, 20 bp, Artificial Sequence
  Synthetic oligonucleotide; TGG chr2 60494402 60494421 60494405 -
tttataagacattagggtat

SEQ ID NO: 179592 - DNA, 20 bp, Artificial Sequence
  Synthetic oligonucleotide; GAG chr2 60494400 60494419 60494403 -
tataagacattagggtattg

SEQ ID NO: 179593 - DNA, 20 bp, Artificial Sequence
  Synthetic oligonucleotide; CAG chr2 60494371 60494390 60494374 -
tattacaacctccttgttta

SEQ ID NO: 179594 - DNA, 20 bp, Artificial Sequence
  Synthetic oligonucleotide; GAG chr2 60494369 60494388 60494372 -
ttacaacctccttgtttaca

SEQ ID NO: 179595 - DNA, 20 bp, Artificial Sequence
  Synthetic oligonucleotide; AGG chr2 60494368 60494387 60494371 -
tacaacctccttgtttacag

SEQ ID NO: 179596 - DNA, 20 bp, Artificial Sequence
  Synthetic oligonucleotide; GGG chr2 60494367 60494386 60494370 -
acaacctccttgtttacaga

SEQ ID NO: 179597 - DNA, 20 bp, Artificial Sequence
  Synthetic oligonucleotide; GGG chr2 60494366 60494385 60494369 -
caacctccttgtttacagag

SEQ ID NO: 179598 - DNA, 20 bp, Artificial Sequence
  Synthetic oligonucleotide; CAG chr2 60494358 60494377 60494361 -
ttgtttacagaggggcaacc

SEQ ID NO: 179599 - DNA, 20 bp, Artificial Sequence
  Synthetic oligonucleotide; AGG chr2 60494357 60494376 60494360 -
tgtttacagaggggcaaccc

SEQ ID NO: 179600 - DNA, 20 bp, Artificial Sequence
  Synthetic oligonucleotide; CAG chr2 60494352 60494371 60494355 -
acagaggggcaacccaggtc

SEQ ID NO: 179601 - DNA, 20 bp, Artificial Sequence
  Synthetic oligonucleotide; GAG chr2 60494350 60494369 60494353 -
agaggggcaacccaggtcca

SEQ ID NO: 179602 - DNA, 20 bp, Artificial Sequence
  Synthetic oligonucleotide; TGG chr2 60494347 60494366 60494350 -
ggggcaacccaggtccagag

SEQ ID NO: 179603 - DNA, 20 bp, Artificial Sequence
  Synthetic oligonucleotide; GGG chr2 60494346 60494365 60494349 -
gggcaacccaggtccagagt

SEQ ID NO: 179604 - DNA, 20 bp, Artificial Sequence
  Synthetic oligonucleotide; GGG chr2 60494345 60494364 60494348 -
ggcaacccaggtccagagtg

SEQ ID NO: 179605 - DNA, 20 bp, Artificial Sequence
  Synthetic oligonucleotide; GAG chr2 60494343 60494362 60494346 -
caacccaggtccagagtggg

SEQ ID NO: 179606 - DNA, 20 bp, Artificial Sequence
  Synthetic oligonucleotide; AGG chr2 60494342 60494361 60494345 -
aacccaggtccagagtgggg

SEQ ID NO: 179607 - DNA, 20 bp, Artificial Sequence
  Synthetic oligonucleotide; CAG chr2 60494335 60494354 60494338 -
gtccagagtggggaggtgac

SEQ ID NO: 179608 - DNA, 20 bp, Artificial Sequence
  Synthetic oligonucleotide; AGG chr2 60494334 60494353 60494337 -
tccagagtggggaggtgacc

SEQ ID NO: 179609 - DNA, 20 bp, Artificial Sequence
  Synthetic oligonucleotide; TGG chr2 60494328 60494347 60494331 -
gtggggaggtgaccaggcca

SEQ ID NO: 179610 - DNA, 20 bp, Artificial Sequence
  Synthetic oligonucleotide; CAG chr2 60494317 60494336 60494320 -
accaggccatggtcactgcc

SEQ ID NO: 179611 - DNA, 20 bp, Artificial Sequence
  Synthetic oligonucleotide; TAG chr2 60494312 60494331 60494315 -
gccatggtcactgcccagtt

SEQ ID NO: 179612 - DNA, 20 bp, Artificial Sequence
  Synthetic oligonucleotide; GAG chr2 60494310 60494329 60494313 -
catggtcactgcccagttta

SEQ ID NO: 179613 - DNA, 20 bp, Artificial Sequence
  Synthetic oligonucleotide; AGG chr2 60494309 60494328 60494312 -
atggtcactgcccagtttag

SEQ ID NO: 179614 - DNA, 20 bp, Artificial Sequence
  Synthetic oligonucleotide; CAG chr2 60494299 60494318 60494302 -
cccagtttagaggccatgca

SEQ ID NO: 179615 - DNA, 20 bp, Artificial Sequence
  Synthetic oligonucleotide; GAG chr2 60494294 60494313 60494297 -
tttagaggccatgcacagat

SEQ ID NO: 179616 - DNA, 20 bp, Artificial Sequence
  Synthetic oligonucleotide; AAG chr2 60494291 60494310 60494294 -
agaggccatgcacagatgag

SEQ ID NO: 179617 - DNA, 20 bp, Artificial Sequence
  Synthetic oligonucleotide; CAG chr2 60494279 60494298 60494282 -
cagatgagaagccaaactcc

SEQ ID NO: 179618 - DNA, 20 bp, Artificial Sequence
  Synthetic oligonucleotide; CAG chr2 60494272 60494291 60494275 -
gaagccaaactcccagctcc

SEQ ID NO: 179619 - DNA, 20 bp, Artificial Sequence
  Synthetic oligonucleotide; TGG chr2 60494245 60494264 60494248 -
cgtcttcccactctcccatg

SEQ ID NO: 179620 - DNA, 20 bp, Artificial Sequence
  Synthetic oligonucleotide; CAG chr2 60494237 60494256 60494240 -
cactctcccatgtggcctgt

SEQ ID NO: 179621 - DNA, 20 bp, Artificial Sequence
  Synthetic oligonucleotide; TAG chr2 60494211 60494230 60494214 -
caccctctctcactcttgct

SEQ ID NO: 179622 - DNA, 20 bp, Artificial Sequence
  Synthetic oligonucleotide; TAG chr2 60494202 60494221 60494205 -
tcactcttgcttagcctgtg

SEQ ID NO: 179623 - DNA, 20 bp, Artificial Sequence
  Synthetic oligonucleotide; AAG chr2 60494196 60494215 60494199 -
ttgcttagcctgtgtagctc

SEQ ID NO: 179624 - DNA, 20 bp, Artificial Sequence
  Synthetic oligonucleotide; AGG chr2 60494195 60494214 60494198 -
tgcttagcctgtgtagctca

SEQ ID NO: 179625 - DNA, 20 bp, Artificial Sequence
  Synthetic oligonucleotide; TAG chr2 60494177 60494196 60494180 -
caaggatgtatttattgccc

SEQ ID NO: 179626 - DNA, 20 bp, Artificial Sequence
  Synthetic oligonucleotide; AGG chr2 60494176 60494195 60494179 -
aaggatgtatttattgccct

SEQ ID NO: 179627 - DNA, 20 bp, Artificial Sequence
  Synthetic oligonucleotide; AAG chr2 60494170 60494189 60494173 -
gtatttattgccctaggcgt

SEQ ID NO: 179628 - DNA, 20 bp, Artificial Sequence
  Synthetic oligonucleotide; CAG chr2 60494159 60494178 60494162 -
cctaggcgtaagaatgtgct

SEQ ID NO: 179629 - DNA, 20 bp, Artificial Sequence
  Synthetic oligonucleotide; AGG chr2 60494158 60494177 60494161 -
ctaggcgtaagaatgtgctc

SEQ ID NO: 179630 - DNA, 20 bp, Artificial Sequence
  Synthetic oligonucleotide; AAG chr2 60494149 60494168 60494152 -
agaatgtgctcaggtttctt

SEQ ID NO: 179631 - DNA, 20 bp, Artificial Sequence
  Synthetic oligonucleotide; TAG chr2 60494141 60494160 60494144 -
ctcaggtttcttaagtaatg

SEQ ID NO: 179632 - DNA, 20 bp, Artificial Sequence
  Synthetic oligonucleotide; AGG chr2 60494140 60494159 60494143 -
tcaggtttcttaagtaatgt

SEQ ID NO: 179633 - DNA, 20 bp, Artificial Sequence
  Synthetic oligonucleotide; TGG chr2 60494124 60494143 60494127 -
atgtaggtgtgcctcaccca

SEQ ID NO: 179634 - DNA, 20 bp, Artificial Sequence
  Synthetic oligonucleotide; GGG chr2 60494123 60494142 60494126 -
tgtaggtgtgcctcacccat

SEQ ID NO: 179635 - DNA, 20 bp, Artificial Sequence
  Synthetic oligonucleotide; GGG chr2 60494122 60494141 60494125 -
gtaggtgtgcctcacccatg

SEQ ID NO: 179636 - DNA, 20 bp, Artificial Sequence
  Synthetic oligonucleotide; CAG chr2 60494095 60494114 60494098 -
actttctctctgtttattgc

SEQ ID NO: 179637 - DNA, 20 bp, Artificial Sequence
  Synthetic oligonucleotide; TAG chr2 60494092 60494111 60494095 -
ttctctctgtttattgccag

SEQ ID NO: 179638 - DNA, 20 bp, Artificial Sequence
  Synthetic oligonucleotide; TGG chr2 60494089 60494108 60494092 -
tctctgtttattgccagtag

SEQ ID NO: 179639 - DNA, 20 bp, Artificial Sequence
  Synthetic oligonucleotide; CAG chr2 60494068 60494087 60494071 -
ggtctctgttctgttttctt

SEQ ID NO: 179640 - DNA, 20 bp, Artificial Sequence
  Synthetic oligonucleotide; AAG chr2 60494041 60494060 60494044 -
tcccccttgcattgttgtct

SEQ ID NO: 179641 - DNA, 20 bp, Artificial Sequence
  Synthetic oligonucleotide; TGG chr2 60494037 60494056 60494040 -
ccttgcattgttgtctaaga

SEQ ID NO: 179642 - DNA, 20 bp, Artificial Sequence
  Synthetic oligonucleotide; CAG chr2 60493983 60494002 60493986 -
tccccgtaccttcctttaat

SEQ ID NO: 179643 - DNA, 20 bp, Artificial Sequence
  Synthetic oligonucleotide; GAG chr2 60493965 60493984 60493968 -
atcagcttccgccactgcct

SEQ ID NO: 179644 - DNA, 20 bp, Artificial Sequence
  Synthetic oligonucleotide; AGG chr2 60493964 60493983 60493967 -
tcagcttccgccactgcctg

SEQ ID NO: 179645 - DNA, 20 bp, Artificial Sequence
  Synthetic oligonucleotide; CAG chr2 60493956 60493975 60493959 -
cgccactgcctgaggccact

SEQ ID NO: 179646 - DNA, 20 bp, Artificial Sequence
  Synthetic oligonucleotide; TGG chr2 60493950 60493969 60493953 -
tgcctgaggccactcagctc

SEQ ID NO: 179647 - DNA, 20 bp, Artificial Sequence
  Synthetic oligonucleotide; TGG chr2 60493941 60493960 60493944 -
ccactcagctctggtcccac

SEQ ID NO: 179648 - DNA, 20 bp, Artificial Sequence
  Synthetic oligonucleotide; GAG chr2 60493939 60493958 60493942 -
actcagctctggtcccactg

SEQ ID NO: 179649 - DNA, 20 bp, Artificial Sequence
  Synthetic oligonucleotide; AGG chr2 60493938 60493957 60493941 -
ctcagctctggtcccactgg

SEQ ID NO: 179650 - DNA, 20 bp, Artificial Sequence
  Synthetic oligonucleotide; CAG chr2 60493923 60493942 60493926 -
actggaggccctgtctcccc

SEQ ID NO: 179651 - DNA, 20 bp, Artificial Sequence
  Synthetic oligonucleotide; AGG chr2 60493922 60493941 60493925 -
ctggaggccctgtctccccc

SEQ ID NO: 179652 - DNA, 20 bp, Artificial Sequence
  Synthetic oligonucleotide; GGG chr2 60493921 60493940 60493924 -
tggaggccctgtctccccca

SEQ ID NO: 179653 - DNA, 20 bp, Artificial Sequence
  Synthetic oligonucleotide; GGG chr2 60493920 60493939 60493923 -
ggaggccctgtctcccccag

SEQ ID NO: 179654 - DNA, 20 bp, Artificial Sequence
  Synthetic oligonucleotide; CAG chr2 60493886 60493905 60493889 -
cctgttcacctctgatcccc

SEQ ID NO: 179655 - DNA, 20 bp, Artificial Sequence
  Synthetic oligonucleotide; TGG chr2 60493875 60493894 60493878 -
ctgatcccccagccctgcca

SEQ ID NO: 179656 - DNA, 20 bp, Artificial Sequence
  Synthetic oligonucleotide; AAG chr2 60493870 60493889 60493873 -
cccccagccctgccatggcc

SEQ ID NO: 179657 - DNA, 20 bp, Artificial Sequence
  Synthetic oligonucleotide; GAG chr2 60493862 60493881 60493865 -
cctgccatggccaagctgat

SEQ ID NO: 179658 - DNA, 20 bp, Artificial Sequence
  Synthetic oligonucleotide; AGG chr2 60493861 60493880 60493864 -
ctgccatggccaagctgatg

SEQ ID NO: 179659 - DNA, 20 bp, Artificial Sequence
  Synthetic oligonucleotide; TGG chr2 60493857 60493876 60493860 -
catggccaagctgatgagga

SEQ ID NO: 179660 - DNA, 20 bp, Artificial Sequence
  Synthetic oligonucleotide; GGG chr2 60493856 60493875 60493859 -
atggccaagctgatgaggat

SEQ ID NO: 179661 - DNA, 20 bp, Artificial Sequence
  Synthetic oligonucleotide; GGG chr2 60493855 60493874 60493858 -
tggccaagctgatgaggatg

SEQ ID NO: 179662 - DNA, 20 bp, Artificial Sequence
  Synthetic oligonucleotide; GGG chr2 60493854 60493873 60493857 -
ggccaagctgatgaggatgg

SEQ ID NO: 179663 - DNA, 20 bp, Artificial Sequence
  Synthetic oligonucleotide; GAG chr2 60493852 60493871 60493855 -
ccaagctgatgaggatgggg

SEQ ID NO: 179664 - DNA, 20 bp, Artificial Sequence
  Synthetic oligonucleotide; AGG chr2 60493851 60493870 60493854 -
caagctgatgaggatggggg

SEQ ID NO: 179665 - DNA, 20 bp, Artificial Sequence
  Synthetic oligonucleotide; GGG chr2 60493850 60493869 60493853 -
aagctgatgaggatggggga

SEQ ID NO: 179666 - DNA, 20 bp, Artificial Sequence
  Synthetic oligonucleotide; GGG chr2 60493849 60493868 60493852 -
agctgatgaggatgggggag

SEQ ID NO: 179667 - DNA, 20 bp, Artificial Sequence
  Synthetic oligonucleotide; GGG chr2 60493848 60493867 60493851 -
gctgatgaggatgggggagg

SEQ ID NO: 179668 - DNA, 20 bp, Artificial Sequence
  Synthetic oligonucleotide; GAG chr2 60493846 60493865 60493849 -
tgatgaggatgggggagggg

SEQ ID NO: 179669 - DNA, 20 bp, Artificial Sequence
  Synthetic oligonucleotide; AGG chr2 60493845 60493864 60493848 -
gatgaggatgggggaggggg

SEQ ID NO: 179670 - DNA, 20 bp, Artificial Sequence
  Synthetic oligonucleotide; CAG chr2 60493842 60493861 60493845 -
gaggatgggggagggggagg

SEQ ID NO: 179671 - DNA, 20 bp, Artificial Sequence
  Synthetic oligonucleotide; AGG chr2 60493841 60493860 60493844 -
aggatgggggagggggaggc

SEQ ID NO: 179672 - DNA, 20 bp, Artificial Sequence
  Synthetic oligonucleotide; GGG chr2 60493840 60493859 60493843 -
ggatgggggagggggaggca

SEQ ID NO: 179673 - DNA, 20 bp, Artificial Sequence
  Synthetic oligonucleotide; GGG chr2 60493839 60493858 60493842 -
gatgggggagggggaggcag

SEQ ID NO: 179674 - DNA, 20 bp, Artificial Sequence
  Synthetic oligonucleotide; GGG chr2 60493838 60493857 60493841 -
atgggggagggggaggcagg

SEQ ID NO: 179675 - DNA, 20 bp, Artificial Sequence
  Synthetic oligonucleotide; AAG chr2 60493815 60493834 60493818 -
aatcttaatttcctgcactg

SEQ ID NO: 179676 - DNA, 20 bp, Artificial Sequence
  Synthetic oligonucleotide; CAG chr2 60493800 60493819 60493803 -
cactgaagctttgctgtcca

SEQ ID NO: 179677 - DNA, 20 bp, Artificial Sequence
  Synthetic oligonucleotide; TGG chr2 60493794 60493813 60493797 -
agctttgctgtccacagcac

SEQ ID NO: 179678 - DNA, 20 bp, Artificial Sequence
  Synthetic oligonucleotide; GGG chr2 60493793 60493812 60493796 -
gctttgctgtccacagcact

SEQ ID NO: 179679 - DNA, 20 bp, Artificial Sequence
  Synthetic oligonucleotide; CAG chr2 60493790 60493809 60493793 -
ttgctgtccacagcactggg

SEQ ID NO: 179680 - DNA, 20 bp, Artificial Sequence
  Synthetic oligonucleotide; CAG chr2 60493787 60493806 60493790 -
ctgtccacagcactgggcag

SEQ ID NO: 179681 - DNA, 20 bp, Artificial Sequence
  Synthetic oligonucleotide; TGG chr2 60493775 60493794 60493778 -
ctgggcagcagctgcctccc

SEQ ID NO: 179682 - DNA, 20 bp, Artificial Sequence
  Synthetic oligonucleotide; GAG chr2 60493773 60493792 60493776 -
gggcagcagctgcctccctg

SEQ ID NO: 179683 - DNA, 20 bp, Artificial Sequence
  Synthetic oligonucleotide; GAG chr2 60493762 60493781 60493765 -
gcctccctggagtgttgtgt

SEQ ID NO: 179684 - DNA, 20 bp, Artificial Sequence
  Synthetic oligonucleotide; AAG chr2 60493736 60493755 60493739 -
ttgatgctgtctttcttccc

SEQ ID NO: 179685 - DNA, 20 bp, Artificial Sequence
  Synthetic oligonucleotide; AGG chr2 60493735 60493754 60493738 -
tgatgctgtctttcttccca

SEQ ID NO: 179686 - DNA, 20 bp, Artificial Sequence
  Synthetic oligonucleotide; TGG chr2 60493728 60493747 60493731 -
gtctttcttcccaaggcctt

SEQ ID NO: 179687 - DNA, 20 bp, Artificial Sequence
  Synthetic oligonucleotide; AAG chr2 60493724 60493743 60493727 -
ttcttcccaaggcctttggc

SEQ ID NO: 179688 - DNA, 20 bp, Artificial Sequence
  Synthetic oligonucleotide; AGG chr2 60493723 60493742 60493726 -
tcttcccaaggcctttggca

SEQ ID NO: 179689 - DNA, 20 bp, Artificial Sequence
  Synthetic oligonucleotide; TAG chr2 60493720 60493739 60493723 -
tcccaaggcctttggcaagg

SEQ ID NO: 179690 - DNA, 20 bp, Artificial Sequence
  Synthetic oligonucleotide; AAG chr2 60493717 60493736 60493720 -
caaggcctttggcaaggtag

SEQ ID NO: 179691 - DNA, 20 bp, Artificial Sequence
  Synthetic oligonucleotide; TGG chr2 60493686 60493705 60493689 -
ttgactctccatgctgctaa

SEQ ID NO: 179692 - DNA, 20 bp, Artificial Sequence
  Synthetic oligonucleotide; GGG chr2 60493685 60493704 60493688 -
tgactctccatgctgctaat

SEQ ID NO: 179693 - DNA, 20 bp, Artificial Sequence
  Synthetic oligonucleotide; GGG chr2 60493684 60493703 60493687 -
gactctccatgctgctaatg

SEQ ID NO: 179694 - DNA, 20 bp, Artificial Sequence
  Synthetic oligonucleotide; GGG chr2 60493683 60493702 60493686 -
actctccatgctgctaatgg

SEQ ID NO: 179695 - DNA, 20 bp, Artificial Sequence
  Synthetic oligonucleotide; GAG chr2 60493681 60493700 60493684 -
tctccatgctgctaatgggg

SEQ ID NO: 179696 - DNA, 20 bp, Artificial Sequence
  Synthetic oligonucleotide; AGG chr2 60493680 60493699 60493683 -
ctccatgctgctaatggggg

SEQ ID NO: 179697 - DNA, 20 bp, Artificial Sequence
  Synthetic oligonucleotide; AAG chr2 60493671 60493690 60493674 -
gctaatgggggaggtcaact

SEQ ID NO: 179698 - DNA, 20 bp, Artificial Sequence
  Synthetic oligonucleotide; GAG chr2 60493659 60493678 60493662 -
ggtcaactaagtccatttct

SEQ ID NO: 179699 - DNA, 20 bp, Artificial Sequence
  Synthetic oligonucleotide; TAG chr2 60493655 60493674 60493658 -
aactaagtccatttctgagc

SEQ ID NO: 179700 - DNA, 20 bp, Artificial Sequence
  Synthetic oligonucleotide; TGG chr2 60493652 60493671 60493655 -
taagtccatttctgagctag

SEQ ID NO: 179701 - DNA, 20 bp, Artificial Sequence
  Synthetic oligonucleotide; GGG chr2 60493651 60493670 60493654 -
aagtccatttctgagctagt

SEQ ID NO: 179702 - DNA, 20 bp, Artificial Sequence
  Synthetic oligonucleotide; GGG chr2 60493650 60493669 60493653 -
agtccatttctgagctagtg

SEQ ID NO: 179703 - DNA, 20 bp, Artificial Sequence
  Synthetic oligonucleotide; GGG chr2 60493649 60493668 60493652 -
gtccatttctgagctagtgg

SEQ ID NO: 179704 - DNA, 20 bp, Artificial Sequence
  Synthetic oligonucleotide; TAG chr2 60493642 60493661 60493645 -
tctgagctagtgggggctct

SEQ ID NO: 179705 - DNA, 20 bp, Artificial Sequence
  Synthetic oligonucleotide; AGG chr2 60493641 60493660 60493644 -
ctgagctagtgggggctctt

SEQ ID NO: 179706 - DNA, 20 bp, Artificial Sequence
  Synthetic oligonucleotide; AAG chr2 60493620 60493639 60493623 -
ggactccgaacaccacactt

SEQ ID NO: 179707 - DNA, 20 bp, Artificial Sequence
  Synthetic oligonucleotide; CAG chr2 60493605 60493624 60493608 -
cacttaagttatctctgacc

SEQ ID NO: 179708 - DNA, 20 bp, Artificial Sequence
  Synthetic oligonucleotide; GAG chr2 60493603 60493622 60493606 -
cttaagttatctctgaccca

SEQ ID NO: 179709 - DNA, 20 bp, Artificial Sequence
  Synthetic oligonucleotide; TGG chr2 60493589 60493608 60493592 -
gacccagagtccaatttatt

SEQ ID NO: 179710 - DNA, 20 bp, Artificial Sequence
  Synthetic oligonucleotide; AAG chr2 60493561 60493580 60493564 -
ttcaaatgaatgcccatttt

SEQ ID NO: 179711 - DNA, 20 bp, Artificial Sequence
  Synthetic oligonucleotide; TGG chr2 60493551 60493570 60493554 -
tgcccattttaagaatgttt

SEQ ID NO: 179712 - DNA, 20 bp, Artificial Sequence
  Synthetic oligonucleotide; GGG chr2 60493550 60493569 60493553 -
gcccattttaagaatgtttt

SEQ ID NO: 179713 - DNA, 20 bp, Artificial Sequence
  Synthetic oligonucleotide; GGG chr2 60493549 60493568 60493552 -
cccattttaagaatgttttg

SEQ ID NO: 179714 - DNA, 20 bp, Artificial Sequence
  Synthetic oligonucleotide; TAG chr2 60493527 60493546 60493530 -
gtctcttcccatcatttcct

SEQ ID NO: 179715 - DNA, 20 bp, Artificial Sequence
  Synthetic oligonucleotide; TAG chr2 60493522 60493541 60493525 -
ttcccatcatttccttagtg

SEQ ID NO: 179716 - DNA, 20 bp, Artificial Sequence
  Synthetic oligonucleotide; TGG chr2 60493519 60493538 60493522 -
ccatcatttccttagtgtag

SEQ ID NO: 179717 - DNA, 20 bp, Artificial Sequence
  Synthetic oligonucleotide; GAG chr2 60493517 60493536 60493520 -
atcatttccttagtgtagtg

SEQ ID NO: 179718 - DNA, 20 bp, Artificial Sequence
  Synthetic oligonucleotide; GAG chr2 60493515 60493534 60493518 -
catttccttagtgtagtgga

SEQ ID NO: 179719 - DNA, 20 bp, Artificial Sequence
  Synthetic oligonucleotide; AGG chr2 60493514 60493533 60493517 -
atttccttagtgtagtggag

SEQ ID NO: 179720 - DNA, 20 bp, Artificial Sequence
  Synthetic oligonucleotide; CGG chr2 60493503 60493522 60493506 -
gtagtggagaggtttctatt

SEQ ID NO: 179721 - DNA, 20 bp, Artificial Sequence
  Synthetic oligonucleotide; TAG chr2 60493498 60493517 60493501 -
ggagaggtttctattcggaa

SEQ ID NO: 179722 - DNA, 20 bp, Artificial Sequence
  Synthetic oligonucleotide; AGG chr2 60493497 60493516 60493500 -
gagaggtttctattcggaat

SEQ ID NO: 179723 - DNA, 20 bp, Artificial Sequence
  Synthetic oligonucleotide; TGG chr2 60493486 60493505 60493489 -
attcggaataggatgacatt

SEQ ID NO: 179724 - DNA, 20 bp, Artificial Sequence
  Synthetic oligonucleotide; TAG chr2 60493483 60493502 60493486 -
cggaataggatgacatttgg

SEQ ID NO: 179725 - DNA, 20 bp, Artificial Sequence
  Synthetic oligonucleotide; GAG chr2 60493478 60493497 60493481 -
taggatgacatttggtagct

SEQ ID NO: 179726 - DNA, 20 bp, Artificial Sequence
  Synthetic oligonucleotide; CAG chr2 60493470 60493489 60493473 -
catttggtagctgagccaaa

SEQ ID NO: 179727 - DNA, 20 bp, Artificial Sequence
  Synthetic oligonucleotide; TAG chr2 60493466 60493485 60493469 -
tggtagctgagccaaacaga

SEQ ID NO: 179728 - DNA, 20 bp, Artificial Sequence
  Synthetic oligonucleotide; TGG chr2 60493462 60493481 60493465 -
agctgagccaaacagatagc

SEQ ID NO: 179729 - DNA, 20 bp, Artificial Sequence
  Synthetic oligonucleotide; GGG chr2 60493461 60493480 60493464 -
gctgagccaaacagatagct

SEQ ID NO: 179730 - DNA, 20 bp, Artificial Sequence
  Synthetic oligonucleotide; TAG chr2 60493455 60493474 60493458 -
ccaaacagatagctgggata

SEQ ID NO: 179731 - DNA, 20 bp, Artificial Sequence
  Synthetic oligonucleotide; AGG chr2 60493454 60493473 60493457 -
caaacagatagctgggatat

SEQ ID NO: 179732 - DNA, 20 bp, Artificial Sequence
  Synthetic oligonucleotide; GGG chr2 60493453 60493472 60493456 -
aaacagatagctgggatata

SEQ ID NO: 179733 - DNA, 20 bp, Artificial Sequence
  Synthetic oligonucleotide; TGG chr2 60493448 60493467 60493451 -
gatagctgggatatagggtt

SEQ ID NO: 179734 - DNA, 20 bp, Artificial Sequence
  Synthetic oligonucleotide; GAG chr2 60493446 60493465 60493449 -
tagctgggatatagggtttg

SEQ ID NO: 179735 - DNA, 20 bp, Artificial Sequence
  Synthetic oligonucleotide; CAG chr2 60493433 60493452 60493436 -
gggtttggagttgaactctc

SEQ ID NO: 179736 - DNA, 20 bp, Artificial Sequence
  Synthetic oligonucleotide; AGG chr2 60493432 60493451 60493435 -
ggtttggagttgaactctcc

SEQ ID NO: 179737 - DNA, 20 bp, Artificial Sequence
  Synthetic oligonucleotide; GGG chr2 60493431 60493450 60493434 -
gtttggagttgaactctcca

SEQ ID NO: 179738 - DNA, 20 bp, Artificial Sequence
  Synthetic oligonucleotide; TGG chr2 60493426 60493445 60493429 -
gagttgaactctccagggaa

SEQ ID NO: 179739 - DNA, 20 bp, Artificial Sequence
  Synthetic oligonucleotide; GGG chr2 60493425 60493444 60493428 -
agttgaactctccagggaat

SEQ ID NO: 179740 - DNA, 20 bp, Artificial Sequence
  Synthetic oligonucleotide; GGG chr2 60493424 60493443 60493427 -
gttgaactctccagggaatg

SEQ ID NO: 179741 - DNA, 20 bp, Artificial Sequence
  Synthetic oligonucleotide; TGG chr2 60493421 60493440 60493424 -
gaactctccagggaatgggg

SEQ ID NO: 179742 - DNA, 20 bp, Artificial Sequence
  Synthetic oligonucleotide; GGG chr2 60493420 60493439 60493423 -
aactctccagggaatggggt

SEQ ID NO: 179743 - DNA, 20 bp, Artificial Sequence
  Synthetic oligonucleotide; GAG chr2 60493418 60493437 60493421 -
ctctccagggaatggggtgg

SEQ ID NO: 179744 - DNA, 20 bp, Artificial Sequence
  Synthetic oligonucleotide; AGG chr2 60493417 60493436 60493420 -
tctccagggaatggggtggg

SEQ ID NO: 179745 - DNA, 20 bp, Artificial Sequence
  Synthetic oligonucleotide; GGG chr2 60493416 60493435 60493419 -
ctccagggaatggggtggga

SEQ ID NO: 179746 - DNA, 20 bp, Artificial Sequence
  Synthetic oligonucleotide; GGG chr2 60493415 60493434 60493418 -
tccagggaatggggtgggag

SEQ ID NO: 179747 - DNA, 20 bp, Artificial Sequence
  Synthetic oligonucleotide; GGG chr2 60493414 60493433 60493417 -
ccagggaatggggtgggagg

SEQ ID NO: 179748 - DNA, 20 bp, Artificial Sequence
  Synthetic oligonucleotide; GGG chr2 60493413 60493432 60493416 -
cagggaatggggtgggaggg

SEQ ID NO: 179749 - DNA, 20 bp, Artificial Sequence
  Synthetic oligonucleotide; CAG chr2 60493410 60493429 60493413 -
ggaatggggtgggagggggg

SEQ ID NO: 179750 - DNA, 20 bp, Artificial Sequence
  Synthetic oligonucleotide; TGG chr2 60493405 60493424 60493408 -
ggggtgggaggggggcagcc

SEQ ID NO: 179751 - DNA, 20 bp, Artificial Sequence
  Synthetic oligonucleotide; GAG chr2 60493403 60493422 60493406 -
ggtgggaggggggcagcctg

SEQ ID NO: 179752 - DNA, 20 bp, Artificial Sequence
  Synthetic oligonucleotide; AGG chr2 60493402 60493421 60493405 -
gtgggaggggggcagcctgg

SEQ ID NO: 179753 - DNA, 20 bp, Artificial Sequence
  Synthetic oligonucleotide; GAG chr2 60493389 60493408 60493392 -
agcctggaggatgacaaaat

SEQ ID NO: 179754 - DNA, 20 bp, Artificial Sequence
  Synthetic oligonucleotide; AGG chr2 60493388 60493407 60493391 -
gcctggaggatgacaaaatg

SEQ ID NO: 179755 - DNA, 20 bp, Artificial Sequence
  Synthetic oligonucleotide; GGG chr2 60493387 60493406 60493390 -
cctggaggatgacaaaatga

SEQ ID NO: 179756 - DNA, 20 bp, Artificial Sequence
  Synthetic oligonucleotide; TGG chr2 60493379 60493398 60493382 -
atgacaaaatgagggctccc

SEQ ID NO: 179757 - DNA, 20 bp, Artificial Sequence
  Synthetic oligonucleotide; TAG chr2 60493337 60493356 60493340 -
tctgtgttctcgaaatgcct

SEQ ID NO: 179758 - DNA, 20 bp, Artificial Sequence
  Synthetic oligonucleotide; AAG chr2 60493324 60493343 60493327 -
aatgccttagatgtttacct

SEQ ID NO: 179759 - DNA, 20 bp, Artificial Sequence
  Synthetic oligonucleotide; GAG chr2 60493322 60493341 60493325 -
tgccttagatgtttacctaa

SEQ ID NO: 179760 - DNA, 20 bp, Artificial Sequence
  Synthetic oligonucleotide; TAG chr2 60493314 60493333 60493317 -
atgtttacctaagagaaatg

SEQ ID NO: 179761 - DNA, 20 bp, Artificial Sequence
  Synthetic oligonucleotide; CAG chr2 60493284 60493303 60493287 -
ttcctataaacacatctaca

SEQ ID NO: 179762 - DNA, 20 bp, Artificial Sequence
  Synthetic oligonucleotide; TAG chr2 60493272 60493291 60493275 -
catctacacagtgtccattg

SEQ ID NO: 179763 - DNA, 20 bp, Artificial Sequence
  Synthetic oligonucleotide; TAG chr2 60493260 60493279 60493263 -
gtccattgtagcactgttca

SEQ ID NO: 179764 - DNA, 20 bp, Artificial Sequence
  Synthetic oligonucleotide; TGG chr2 60493257 60493276 60493260 -
cattgtagcactgttcatag

SEQ ID NO: 179765 - DNA, 20 bp, Artificial Sequence
  Synthetic oligonucleotide; AAG chr2 60493249 60493268 60493252 -
cactgttcatagtggtcaaa

SEQ ID NO: 179766 - DNA, 20 bp, Artificial Sequence
  Synthetic oligonucleotide; TGG chr2 60493246 60493265 60493249 -
tgttcatagtggtcaaaaag

SEQ ID NO: 179767 - DNA, 20 bp, Artificial Sequence
  Synthetic oligonucleotide; TGG chr2 60493231 60493250 60493234 -
aaaagtggtcacaacccaca

SEQ ID NO: 179768 - DNA, 20 bp, Artificial Sequence
  Synthetic oligonucleotide; TAG chr2 60493221 60493240 60493224 -
acaacccacatggcaaccaa

SEQ ID NO: 179769 - DNA, 20 bp, Artificial Sequence
  Synthetic oligonucleotide; AGG chr2 60493220 60493239 60493223 -
caacccacatggcaaccaat

SEQ ID NO: 179770 - DNA, 20 bp, Artificial Sequence
  Synthetic oligonucleotide; TGG chr2 60493212 60493231 60493215 -
atggcaaccaataggttgaa

SEQ ID NO: 179771 - DNA, 20 bp, Artificial Sequence
  Synthetic oligonucleotide; TGG chr2 60493197 60493216 60493200 -
ttgaatggataaacgcccta

SEQ ID NO: 179772 - DNA, 20 bp, Artificial Sequence
  Synthetic oligonucleotide; TGG chr2 60493194 60493213 60493197 -
aatggataaacgccctatgg

SEQ ID NO: 179773 - DNA, 20 bp, Artificial Sequence
  Synthetic oligonucleotide; CAG chr2 60493179 60493198 60493182 -
tatggtggaatacaactcaa

SEQ ID NO: 179774 - DNA, 20 bp, Artificial Sequence
  Synthetic oligonucleotide; TAG chr2 60493176 60493195 60493179 -
ggtggaatacaactcaacag

SEQ ID NO: 179775 - DNA, 20 bp, Artificial Sequence
  Synthetic oligonucleotide; AAG chr2 60493173 60493192 60493176 -
ggaatacaactcaacagtag

SEQ ID NO: 179776 - DNA, 20 bp, Artificial Sequence
  Synthetic oligonucleotide; AAG chr2 60493165 60493184 60493168 -
actcaacagtagaagaatga

SEQ ID NO: 179777 - DNA, 20 bp, Artificial Sequence
  Synthetic oligonucleotide; GAG chr2 60493163 60493182 60493166 -
tcaacagtagaagaatgaaa

SEQ ID NO: 179778 - DNA, 20 bp, Artificial Sequence
  Synthetic oligonucleotide; TGG chr2 60493143 60493162 60493146 -
gagtaacacactccacacca

SEQ ID NO: 179779 - DNA, 20 bp, Artificial Sequence
  Synthetic oligonucleotide; CAG chr2 60493132 60493151 60493135 -
tccacaccatggatgaatcc

SEQ ID NO: 179780 - DNA, 20 bp, Artificial Sequence
  Synthetic oligonucleotide; TGG chr2 60493114 60493133 60493117 -
cccagaatcattctgctctg

SEQ ID NO: 179781 - DNA, 20 bp, Artificial Sequence
  Synthetic oligonucleotide; AAG chr2 60493111 60493130 60493114 -
agaatcattctgctctgtgg

SEQ ID NO: 179782 - DNA, 20 bp, Artificial Sequence
  Synthetic oligonucleotide; AAG chr2 60493095 60493114 60493098 -
gtggaagaaattaaacacaa

SEQ ID NO: 179783 - DNA, 20 bp, Artificial Sequence
  Synthetic oligonucleotide; GAG chr2 60493078 60493097 60493081 -
caaaagacgatatcctgtat

SEQ ID NO: 179784 - DNA, 20 bp, Artificial Sequence
  Synthetic oligonucleotide; TAG chr2 60493057 60493076 60493060 -
agtccatttgtaacaaattc

SEQ ID NO: 179785 - DNA, 20 bp, Artificial Sequence
  Synthetic oligonucleotide; TGG chr2 60493040 60493059 60493043 -
ttctagaattctcaacactg

SEQ ID NO: 179786 - DNA, 20 bp, Artificial Sequence
  Synthetic oligonucleotide; TGG chr2 60493037 60493056 60493040 -
tagaattctcaacactgtgg

SEQ ID NO: 179787 - DNA, 20 bp, Artificial Sequence
  Synthetic oligonucleotide; TAG chr2 60493034 60493053 60493037 -
aattctcaacactgtggtgg

SEQ ID NO: 179788 - DNA, 20 bp, Artificial Sequence
  Synthetic oligonucleotide; AGG chr2 60493033 60493052 60493036 -
attctcaacactgtggtggt

SEQ ID NO: 179789 - DNA, 20 bp, Artificial Sequence
  Synthetic oligonucleotide; TGG chr2 60493030 60493049 60493033 -
ctcaacactgtggtggtagg

SEQ ID NO: 179790 - DNA, 20 bp, Artificial Sequence
  Synthetic oligonucleotide; GGG chr2 60493029 60493048 60493032 -
tcaacactgtggtggtaggt

SEQ ID NO: 179791 - DNA, 20 bp, Artificial Sequence
  Synthetic oligonucleotide; GGG chr2 60493028 60493047 60493031 -
caacactgtggtggtaggtg

SEQ ID NO: 179792 - DNA, 20 bp, Artificial Sequence
  Synthetic oligonucleotide; GGG chr2 60493027 60493046 60493030 -
aacactgtggtggtaggtgg

SEQ ID NO: 179793 - DNA, 20 bp, Artificial Sequence
  Synthetic oligonucleotide; CAG chr2 60493022 60493041 60493025 -
tgtggtggtaggtgggggtt

SEQ ID NO: 179794 - DNA, 20 bp, Artificial Sequence
  Synthetic oligonucleotide; TGG chr2 60493019 60493038 60493022 -
ggtggtaggtgggggttcag

SEQ ID NO: 179795 - DNA, 20 bp, Artificial Sequence
  Synthetic oligonucleotide; TAG chr2 60493015 60493034 60493018 -
gtaggtgggggttcagtggt

SEQ ID NO: 179796 - DNA, 20 bp, Artificial Sequence
  Synthetic oligonucleotide; AAG chr2 60493012 60493031 60493015 -
ggtgggggttcagtggttag

SEQ ID NO: 179797 - DNA, 20 bp, Artificial Sequence
  Synthetic oligonucleotide; AGG chr2 60493011 60493030 60493014 -
gtgggggttcagtggttaga

SEQ ID NO: 179798 - DNA, 20 bp, Artificial Sequence
  Synthetic oligonucleotide; AAG chr2 60493008 60493027 60493011 -
ggggttcagtggttagaagg

SEQ ID NO: 179799 - DNA, 20 bp, Artificial Sequence
  Synthetic oligonucleotide; AGG chr2 60493007 60493026 60493010 -
gggttcagtggttagaagga

SEQ ID NO: 179800 - DNA, 20 bp, Artificial Sequence
  Synthetic oligonucleotide; GGG chr2 60493006 60493025 60493009 -
ggttcagtggttagaaggaa

SEQ ID NO: 179801 - DNA, 20 bp, Artificial Sequence
  Synthetic oligonucleotide; GGG chr2 60493005 60493024 60493008 -
gttcagtggttagaaggaag

SEQ ID NO: 179802 - DNA, 20 bp, Artificial Sequence
  Synthetic oligonucleotide; CAG chr2 60493001 60493020 60493004 -
agtggttagaaggaaggggt

SEQ ID NO: 179803 - DNA, 20 bp, Artificial Sequence
  Synthetic oligonucleotide; GAG chr2 60492999 60493018 60493002 -
tggttagaaggaaggggtca

SEQ ID NO: 179804 - DNA, 20 bp, Artificial Sequence
  Synthetic oligonucleotide; AGG chr2 60492998 60493017 60493001 -
ggttagaaggaaggggtcag

SEQ ID NO: 179805 - DNA, 20 bp, Artificial Sequence
  Synthetic oligonucleotide; GGG chr2 60492997 60493016 60493000 -
gttagaaggaaggggtcaga

SEQ ID NO: 179806 - DNA, 20 bp, Artificial Sequence
  Synthetic oligonucleotide; TAG chr2 60492993 60493012 60492996 -
gaaggaaggggtcagagggt

SEQ ID NO: 179807 - DNA, 20 bp, Artificial Sequence
  Synthetic oligonucleotide; AGG chr2 60492992 60493011 60492995 -
aaggaaggggtcagagggtt

SEQ ID NO: 179808 - DNA, 20 bp, Artificial Sequence
  Synthetic oligonucleotide; GGG chr2 60492991 60493010 60492994 -
aggaaggggtcagagggtta

SEQ ID NO: 179809 - DNA, 20 bp, Artificial Sequence
  Synthetic oligonucleotide; AAG chr2 60492988 60493007 60492991 -
aaggggtcagagggttaggg

SEQ ID NO: 179810 - DNA, 20 bp, Artificial Sequence
  Synthetic oligonucleotide; AGG chr2 60492987 60493006 60492990 -
aggggtcagagggttaggga

SEQ ID NO: 179811 - DNA, 20 bp, Artificial Sequence
  Synthetic oligonucleotide; GGG chr2 60492986 60493005 60492989 -
ggggtcagagggttagggaa

SEQ ID NO: 179812 - DNA, 20 bp, Artificial Sequence
  Synthetic oligonucleotide; GGG chr2 60492985 60493004 60492988 -
gggtcagagggttagggaag

SEQ ID NO: 179813 - DNA, 20 bp, Artificial Sequence
  Synthetic oligonucleotide; CAG chr2 60492977 60492996 60492980 -
gggttagggaaggggattga

SEQ ID NO: 179814 - DNA, 20 bp, Artificial Sequence
  Synthetic oligonucleotide; AAG chr2 60492972 60492991 60492975 -
agggaaggggattgacagca

SEQ ID NO: 179815 - DNA, 20 bp, Artificial Sequence
  Synthetic oligonucleotide; AGG chr2 60492971 60492990 60492974 -
gggaaggggattgacagcaa

SEQ ID NO: 179816 - DNA, 20 bp, Artificial Sequence
  Synthetic oligonucleotide; GGG chr2 60492970 60492989 60492973 -
ggaaggggattgacagcaaa

SEQ ID NO: 179817 - DNA, 20 bp, Artificial Sequence
  Synthetic oligonucleotide; GGG chr2 60492969 60492988 60492972 -
gaaggggattgacagcaaag

SEQ ID NO: 179818 - DNA, 20 bp, Artificial Sequence
  Synthetic oligonucleotide; GAG chr2 60492963 60492982 60492966 -
gattgacagcaaaggggcat

SEQ ID NO: 179819 - DNA, 20 bp, Artificial Sequence
  Synthetic oligonucleotide; AGG chr2 60492962 60492981 60492965 -
attgacagcaaaggggcatg

SEQ ID NO: 179820 - DNA, 20 bp, Artificial Sequence
  Synthetic oligonucleotide; GGG chr2 60492961 60492980 60492964 -
ttgacagcaaaggggcatga

SEQ ID NO: 179821 - DNA, 20 bp, Artificial Sequence
  Synthetic oligonucleotide; GGG chr2 60492960 60492979 60492963 -
tgacagcaaaggggcatgag

SEQ ID NO: 179822 - DNA, 20 bp, Artificial Sequence
  Synthetic oligonucleotide; GGG chr2 60492959 60492978 60492962 -
gacagcaaaggggcatgagg

SEQ ID NO: 179823 - DNA, 20 bp, Artificial Sequence
  Synthetic oligonucleotide; TAG chr2 60492951 60492970 60492954 -
aggggcatgagggggctttc

SEQ ID NO: 179824 - DNA, 20 bp, Artificial Sequence
  Synthetic oligonucleotide; TGG chr2 60492946 60492965 60492949 -
catgagggggctttctagac

SEQ ID NO: 179825 - DNA, 20 bp, Artificial Sequence
  Synthetic oligonucleotide; TGG chr2 60492943 60492962 60492946 -
gagggggctttctagactgg

SEQ ID NO: 179826 - DNA, 20 bp, Artificial Sequence
  Synthetic oligonucleotide; TGG chr2 60492919 60492938 60492922 -
cgtgttctgtatcttgattt

SEQ ID NO: 179827 - DNA, 20 bp, Artificial Sequence
  Synthetic oligonucleotide; TGG chr2 60492916 60492935 60492919 -
gttctgtatcttgattttgg

SEQ ID NO: 179828 - DNA, 20 bp, Artificial Sequence
  Synthetic oligonucleotide; GAG chr2 60492914 60492933 60492917 -
tctgtatcttgattttggtg

SEQ ID NO: 179829 - DNA, 20 bp, Artificial Sequence
  Synthetic oligonucleotide; AGG chr2 60492913 60492932 60492916 -
ctgtatcttgattttggtgg

SEQ ID NO: 179830 - DNA, 20 bp, Artificial Sequence
  Synthetic oligonucleotide; CAG chr2 60492905 60492924 60492908 -
tgattttggtggaggccaca

SEQ ID NO: 179831 - DNA, 20 bp, Artificial Sequence
  Synthetic oligonucleotide; TGG chr2 60492891 60492910 60492894 -
gccacacagctgtatacaac

SEQ ID NO: 179832 - DNA, 20 bp, Artificial Sequence
  Synthetic oligonucleotide; AAG chr2 60492838 60492857 60492841 -
aatgacttttgttgtatgta

SEQ ID NO: 179833 - DNA, 20 bp, Artificial Sequence
  Synthetic oligonucleotide; AAG chr2 60492823 60492842 60492826 -
atgtaaagtataccttaata

SEQ ID NO: 179834 - DNA, 20 bp, Artificial Sequence
  Synthetic oligonucleotide; AAG chr2 60492817 60492836 60492820 -
agtataccttaataaagcta

SEQ ID NO: 179835 - DNA, 20 bp, Artificial Sequence
  Synthetic oligonucleotide; TGG chr2 60492789 60492808 60492792 -
caaaacaaaacacccaccac

SEQ ID NO: 179836 - DNA, 20 bp, Artificial Sequence
  Synthetic oligonucleotide; GAG chr2 60492787 60492806 60492790 -
aaacaaaacacccaccactg

SEQ ID NO: 179837 - DNA, 20 bp, Artificial Sequence
  Synthetic oligonucleotide; TGG chr2 60492784 60492803 60492787 -
caaaacacccaccactggag

SEQ ID NO: 179838 - DNA, 20 bp, Artificial Sequence
  Synthetic oligonucleotide; AAG chr2 60492777 60492796 60492780 -
cccaccactggagtggaacc

SEQ ID NO: 179839 - DNA, 20 bp, Artificial Sequence
  Synthetic oligonucleotide; TGG chr2 60492751 60492770 60492754 -
gtctgtaacctttaactgtt

SEQ ID NO: 179840 - DNA, 20 bp, Artificial Sequence
  Synthetic oligonucleotide; GGG chr2 60492750 60492769 60492753 -
tctgtaacctttaactgttt

SEQ ID NO: 179841 - DNA, 20 bp, Artificial Sequence
  Synthetic oligonucleotide; AAG chr2 60492740 60492759 60492743 -
ttaactgtttgggtctcctc

SEQ ID NO: 179842 - DNA, 20 bp, Artificial Sequence
  Synthetic oligonucleotide; TAG chr2 60492733 60492752 60492736 -
tttgggtctcctcaagactc

SEQ ID NO: 179843 - DNA, 20 bp, Artificial Sequence
  Synthetic oligonucleotide; CAG chr2 60492722 60492741 60492725 -
tcaagactctagccgtcttt

SEQ ID NO: 179844 - DNA, 20 bp, Artificial Sequence
  Synthetic oligonucleotide; AGG chr2 60492721 60492740 60492724 -
caagactctagccgtctttc

SEQ ID NO: 179845 - DNA, 20 bp, Artificial Sequence
  Synthetic oligonucleotide; GGG chr2 60492720 60492739 60492723 -
aagactctagccgtctttca

SEQ ID NO: 179846 - DNA, 20 bp, Artificial Sequence
  Synthetic oligonucleotide; TAG chr2 60492717 60492736 60492720 -
actctagccgtctttcaggg

SEQ ID NO: 179847 - DNA, 20 bp, Artificial Sequence
  Synthetic oligonucleotide; AAG chr2 60492709 60492728 60492712 -
cgtctttcagggtagcacca

SEQ ID NO: 179848 - DNA, 20 bp, Artificial Sequence
  Synthetic oligonucleotide; CAG chr2 60492699 60492718 60492702 -
ggtagcaccaaagtacattt

SEQ ID NO: 179849 - DNA, 20 bp, Artificial Sequence
  Synthetic oligonucleotide; AGG chr2 60492698 60492717 60492701 -
gtagcaccaaagtacatttc

SEQ ID NO: 179850 - DNA, 20 bp, Artificial Sequence
  Synthetic oligonucleotide; GGG chr2 60492697 60492716 60492700 -
tagcaccaaagtacatttca

SEQ ID NO: 179851 - DNA, 20 bp, Artificial Sequence
  Synthetic oligonucleotide; GAG chr2 60492690 60492709 60492693 -
aaagtacatttcagggaaat

SEQ ID NO: 179852 - DNA, 20 bp, Artificial Sequence
  Synthetic oligonucleotide; GAG chr2 60492670 60492689 60492673 -
gagaatgccctttgtattct

SEQ ID NO: 179853 - DNA, 20 bp, Artificial Sequence
  Synthetic oligonucleotide; TAG chr2 60492661 60492680 60492664 -
ctttgtattctgagatttta

SEQ ID NO: 179854 - DNA, 20 bp, Artificial Sequence
  Synthetic oligonucleotide; AAG chr2 60492658 60492677 60492661 -
tgtattctgagattttatag

SEQ ID NO: 179855 - DNA, 20 bp, Artificial Sequence
  Synthetic oligonucleotide; TGG chr2 60492654 60492673 60492657 -
ttctgagattttatagaagt

SEQ ID NO: 179856 - DNA, 20 bp, Artificial Sequence
  Synthetic oligonucleotide; CAG chr2 60492645 60492664 60492648 -
tttatagaagttggtaatga

SEQ ID NO: 179857 - DNA, 20 bp, Artificial Sequence
  Synthetic oligonucleotide; GAG chr2 60492643 60492662 60492646 -
tatagaagttggtaatgaca

SEQ ID NO: 179858 - DNA, 20 bp, Artificial Sequence
  Synthetic oligonucleotide; GAG chr2 60492641 60492660 60492644 -
tagaagttggtaatgacaga

SEQ ID NO: 179859 - DNA, 20 bp, Artificial Sequence
  Synthetic oligonucleotide; GAG chr2 60492639 60492658 60492642 -
gaagttggtaatgacagaga

SEQ ID NO: 179860 - DNA, 20 bp, Artificial Sequence
  Synthetic oligonucleotide; GAG chr2 60492637 60492656 60492640 -
agttggtaatgacagagaga

SEQ ID NO: 179861 - DNA, 20 bp, Artificial Sequence
  Synthetic oligonucleotide; GAG chr2 60492635 60492654 60492638 -
ttggtaatgacagagagaga

SEQ ID NO: 179862 - DNA, 20 bp, Artificial Sequence
  Synthetic oligonucleotide; GAG chr2 60492633 60492652 60492636 -
ggtaatgacagagagagaga

SEQ ID NO: 179863 - DNA, 20 bp, Artificial Sequence
  Synthetic oligonucleotide; GAG chr2 60492631 60492650 60492634 -
taatgacagagagagagaga

SEQ ID NO: 179864 - DNA, 20 bp, Artificial Sequence
  Synthetic oligonucleotide; GAG chr2 60492629 60492648 60492632 -
atgacagagagagagagaga

SEQ ID NO: 179865 - DNA, 20 bp, Artificial Sequence
  Synthetic oligonucleotide; GAG chr2 60492627 60492646 60492630 -
gacagagagagagagagaga

SEQ ID NO: 179866 - DNA, 20 bp, Artificial Sequence
  Synthetic oligonucleotide; GAG chr2 60492625 60492644 60492628 -
cagagagagagagagagaga

SEQ ID NO: 179867 - DNA, 20 bp, Artificial Sequence
  Synthetic oligonucleotide; GAG chr2 60492623 60492642 60492626 -
gagagagagagagagagaga

SEQ ID NO: 179868 - DNA, 20 bp, Artificial Sequence
  Synthetic oligonucleotide; GAG chr2 60492621 60492640 60492624 -
gagagagagagagagagaga

SEQ ID NO: 179869 - DNA, 20 bp, Artificial Sequence
  Synthetic oligonucleotide; GAG chr2 60492619 60492638 60492622 -
gagagagagagagagagaga

SEQ ID NO: 179870 - DNA, 20 bp, Artificial Sequence
  Synthetic oligonucleotide; AGG chr2 60492618 60492637 60492621 -
agagagagagagagagagag

SEQ ID NO: 179871 - DNA, 20 bp, Artificial Sequence
  Synthetic oligonucleotide; GGG chr2 60492617 60492636 60492620 -
gagagagagagagagagaga

SEQ ID NO: 179872 - DNA, 20 bp, Artificial Sequence
  Synthetic oligonucleotide; GAG chr2 60492615 60492634 60492618 -
gagagagagagagagagagg

SEQ ID NO: 179873 - DNA, 20 bp, Artificial Sequence
  Synthetic oligonucleotide; AGG chr2 60492614 60492633 60492617 -
agagagagagagagagaggg

SEQ ID NO: 179874 - DNA, 20 bp, Artificial Sequence
  Synthetic oligonucleotide; GAG chr2 60492605 60492624 60492608 -
gagagagagggaggcccact

SEQ ID NO: 179875 - DNA, 20 bp, Artificial Sequence
  Synthetic oligonucleotide; TGG chr2 60492601 60492620 60492604 -
gagagggaggcccactgaga

SEQ ID NO: 179876 - DNA, 20 bp, Artificial Sequence
  Synthetic oligonucleotide; GGG chr2 60492600 60492619 60492603 -
agagggaggcccactgagat

SEQ ID NO: 179877 - DNA, 20 bp, Artificial Sequence
  Synthetic oligonucleotide; GGG chr2 60492599 60492618 60492602 -
gagggaggcccactgagatg

SEQ ID NO: 179878 - DNA, 20 bp, Artificial Sequence
  Synthetic oligonucleotide; AAG chr2 60492585 60492604 60492588 -
gagatggggttatccaccat

SEQ ID NO: 179879 - DNA, 20 bp, Artificial Sequence
  Synthetic oligonucleotide; CAG chr2 60492582 60492601 60492585 -
atggggttatccaccataag

SEQ ID NO: 179880 - DNA, 20 bp, Artificial Sequence
  Synthetic oligonucleotide; GAG chr2 60492580 60492599 60492583 -
ggggttatccaccataagca

SEQ ID NO: 179881 - DNA, 20 bp, Artificial Sequence
  Synthetic oligonucleotide; TGG chr2 60492573 60492592 60492576 -
tccaccataagcagagcatt

SEQ ID NO: 179882 - DNA, 20 bp, Artificial Sequence
  Synthetic oligonucleotide; GGG chr2 60492572 60492591 60492575 -
ccaccataagcagagcattt

SEQ ID NO: 179883 - DNA, 20 bp, Artificial Sequence
  Synthetic oligonucleotide; GAG chr2 60492566 60492585 60492569 -
taagcagagcatttgggtct

SEQ ID NO: 179884 - DNA, 20 bp, Artificial Sequence
  Synthetic oligonucleotide; AAG chr2 60492563 60492582 60492566 -
gcagagcatttgggtctgag

SEQ ID NO: 179885 - DNA, 20 bp, Artificial Sequence
  Synthetic oligonucleotide; GAG chr2 60492555 60492574 60492558 -
tttgggtctgagaagcgcat

SEQ ID NO: 179886 - DNA, 20 bp, Artificial Sequence
  Synthetic oligonucleotide; TGG chr2 60492549 60492568 60492552 -
tctgagaagcgcatgagtac

SEQ ID NO: 179887 - DNA, 20 bp, Artificial Sequence
  Synthetic oligonucleotide; GAG chr2 60492545 60492564 60492548 -
agaagcgcatgagtactggt

SEQ ID NO: 179888 - DNA, 20 bp, Artificial Sequence
  Synthetic oligonucleotide; GAG chr2 60492537 60492556 60492540 -
atgagtactggtgagtatgt

SEQ ID NO: 179889 - DNA, 20 bp, Artificial Sequence
  Synthetic oligonucleotide; AGG chr2 60492536 60492555 60492539 -
tgagtactggtgagtatgtg

SEQ ID NO: 179890 - DNA, 20 bp, Artificial Sequence
  Synthetic oligonucleotide; AAG chr2 60492533 60492552 60492536 -
gtactggtgagtatgtgagg

SEQ ID NO: 179891 - DNA, 20 bp, Artificial Sequence
  Synthetic oligonucleotide; AGG chr2 60492532 60492551 60492535 -
tactggtgagtatgtgagga

SEQ ID NO: 179892 - DNA, 20 bp, Artificial Sequence
  Synthetic oligonucleotide; GAG chr2 60492530 60492549 60492533 -
ctggtgagtatgtgaggaag

SEQ ID NO: 179893 - DNA, 20 bp, Artificial Sequence
  Synthetic oligonucleotide; GAG chr2 60492528 60492547 60492531 -
ggtgagtatgtgaggaagga

SEQ ID NO: 179894 - DNA, 20 bp, Artificial Sequence
  Synthetic oligonucleotide; GAG chr2 60492526 60492545 60492529 -
tgagtatgtgaggaaggaga

SEQ ID NO: 179895 - DNA, 20 bp, Artificial Sequence
  Synthetic oligonucleotide; AAG chr2 60492522 60492541 60492525 -
tatgtgaggaaggagagagc

SEQ ID NO: 179896 - DNA, 20 bp, Artificial Sequence
  Synthetic oligonucleotide; AGG chr2 60492521 60492540 60492524 -
atgtgaggaaggagagagca

SEQ ID NO: 179897 - DNA, 20 bp, Artificial Sequence
  Synthetic oligonucleotide; GGG chr2 60492520 60492539 60492523 -
tgtgaggaaggagagagcaa

SEQ ID NO: 179898 - DNA, 20 bp, Artificial Sequence
  Synthetic oligonucleotide; GGG chr2 60492519 60492538 60492522 -
gtgaggaaggagagagcaag

SEQ ID NO: 179899 - DNA, 20 bp, Artificial Sequence
  Synthetic oligonucleotide; GAG chr2 60492517 60492536 60492520 -
gaggaaggagagagcaaggg

SEQ ID NO: 179900 - DNA, 20 bp, Artificial Sequence
  Synthetic oligonucleotide; AGG chr2 60492516 60492535 60492519 -
aggaaggagagagcaagggg

SEQ ID NO: 179901 - DNA, 20 bp, Artificial Sequence
  Synthetic oligonucleotide; TAG chr2 60492500 60492519 60492503 -
ggggaggaaatctgttttcc

SEQ ID NO: 179902 - DNA, 20 bp, Artificial Sequence
  Synthetic oligonucleotide; CAG chr2 60492492 60492511 60492495 -
aatctgttttcctagaattc

SEQ ID NO: 179903 - DNA, 20 bp, Artificial Sequence
  Synthetic oligonucleotide; CAG chr2 60492489 60492508 60492492 -
ctgttttcctagaattccag

SEQ ID NO: 179904 - DNA, 20 bp, Artificial Sequence
  Synthetic oligonucleotide; AGG chr2 60492488 60492507 60492491 -
tgttttcctagaattccagc

SEQ ID NO: 179905 - DNA, 20 bp, Artificial Sequence
  Synthetic oligonucleotide; AAG chr2 60492478 60492497 60492481 -
gaattccagcaggcttcaaa

SEQ ID NO: 179906 - DNA, 20 bp, Artificial Sequence
  Synthetic oligonucleotide; AAG chr2 60492471 60492490 60492474 -
agcaggcttcaaaaagtaaa

SEQ ID NO: 179907 - DNA, 20 bp, Artificial Sequence
  Synthetic oligonucleotide; AGG chr2 60492470 60492489 60492473 -
gcaggcttcaaaaagtaaaa

SEQ ID NO: 179908 - DNA, 20 bp, Artificial Sequence
  Synthetic oligonucleotide; GGG chr2 60492469 60492488 60492472 -
caggcttcaaaaagtaaaaa

SEQ ID NO: 179909 - DNA, 20 bp, Artificial Sequence
  Synthetic oligonucleotide; GGG chr2 60492468 60492487 60492471 -
aggcttcaaaaagtaaaaag

SEQ ID NO: 179910 - DNA, 20 bp, Artificial Sequence
  Synthetic oligonucleotide; GAG chr2 60492466 60492485 60492469 -
gcttcaaaaagtaaaaaggg

SEQ ID NO: 179911 - DNA, 20 bp, Artificial Sequence
  Synthetic oligonucleotide; AGG chr2 60492465 60492484 60492468 -
cttcaaaaagtaaaaagggg

SEQ ID NO: 179912 - DNA, 20 bp, Artificial Sequence
  Synthetic oligonucleotide; GGG chr2 60492464 60492483 60492467 -
ttcaaaaagtaaaaagggga

SEQ ID NO: 179913 - DNA, 20 bp, Artificial Sequence
  Synthetic oligonucleotide; GAG chr2 60492462 60492481 60492465 -
caaaaagtaaaaaggggagg

SEQ ID NO: 179914 - DNA, 20 bp, Artificial Sequence
  Synthetic oligonucleotide; AAG chr2 60492450 60492469 60492453 -
aggggagggagtacccaact

SEQ ID NO: 179915 - DNA, 20 bp, Artificial Sequence
  Synthetic oligonucleotide; TAG chr2 60492434 60492453 60492437 -
aactaagtttttttcttccc

SEQ ID NO: 179916 - DNA, 20 bp, Artificial Sequence
  Synthetic oligonucleotide; TAG chr2 60492410 60492429 60492413 -
aatacatttattctaaacat

SEQ ID NO: 179917 - DNA, 20 bp, Artificial Sequence
  Synthetic oligonucleotide; TAG chr2 60492401 60492420 60492404 -
attctaaacattagcccaat

SEQ ID NO: 179918 - DNA, 20 bp, Artificial Sequence
  Synthetic oligonucleotide; GAG chr2 60492367 60492386 60492370 -
ttgtttgtttgtttgttttt

SEQ ID NO: 179919 - DNA, 20 bp, Artificial Sequence
  Synthetic oligonucleotide; CAG chr2 60492363 60492382 60492366 -
ttgtttgtttgtttttgaga

SEQ ID NO: 179920 - DNA, 20 bp, Artificial Sequence
  Synthetic oligonucleotide; AGG chr2 60492362 60492381 60492365 -
tgtttgtttgtttttgagac

SEQ ID NO: 179921 - DNA, 20 bp, Artificial Sequence
  Synthetic oligonucleotide; GGG chr2 60492361 60492380 60492364 -
gtttgtttgtttttgagaca

SEQ ID NO: 179922 - DNA, 20 bp, Artificial Sequence
  Synthetic oligonucleotide; TAG chr2 60492343 60492362 60492346 -
cagggtctcgctgtgttgcc

SEQ ID NO: 179923 - DNA, 20 bp, Artificial Sequence
  Synthetic oligonucleotide; AGG chr2 60492342 60492361 60492345 -
agggtctcgctgtgttgcct

SEQ ID NO: 179924 - DNA, 20 bp, Artificial Sequence
  Synthetic oligonucleotide; TAG chr2 60492338 60492357 60492341 -
tctcgctgtgttgcctaggc

SEQ ID NO: 179925 - DNA, 20 bp, Artificial Sequence
  Synthetic oligonucleotide; GAG chr2 60492336 60492355 60492339 -
tcgctgtgttgcctaggcta

SEQ ID NO: 179926 - DNA, 20 bp, Artificial Sequence
  Synthetic oligonucleotide; TAG chr2 60492331 60492350 60492334 -
gtgttgcctaggctagagtg

SEQ ID NO: 179927 - DNA, 20 bp, Artificial Sequence
  Synthetic oligonucleotide; TGG chr2 60492328 60492347 60492331 -
ttgcctaggctagagtgtag

SEQ ID NO: 179928 - DNA, 20 bp, Artificial Sequence
  Synthetic oligonucleotide; TAG chr2 60492317 60492336 60492320 -
agagtgtagtggcatgttca

SEQ ID NO: 179929 - DNA, 20 bp, Artificial Sequence
  Synthetic oligonucleotide; CAG chr2 60492307 60492326 60492310 -
ggcatgttcatagctcactg

SEQ ID NO: 179930 - DNA, 20 bp, Artificial Sequence
  Synthetic oligonucleotide; TAG chr2 60492293 60492312 60492296 -
tcactgcagccttgatctcc

SEQ ID NO: 179931 - DNA, 20 bp, Artificial Sequence
  Synthetic oligonucleotide; AGG chr2 60492292 60492311 60492295 -
cactgcagccttgatctcct

SEQ ID NO: 179932 - DNA, 20 bp, Artificial Sequence
  Synthetic oligonucleotide; AAG chr2 60492286 60492305 60492289 -
agccttgatctcctaggctc

SEQ ID NO: 179933 - DNA, 20 bp, Artificial Sequence
  Synthetic oligonucleotide; CAG chr2 60492269 60492288 60492272 -
ctcaagccatcctgtcacct

SEQ ID NO: 179934 - DNA, 20 bp, Artificial Sequence
  Synthetic oligonucleotide; GAG chr2 60492260 60492279 60492263 -
tcctgtcacctcagcctcct

SEQ ID NO: 179935 - DNA, 20 bp, Artificial Sequence
  Synthetic oligonucleotide; TAG chr2 60492257 60492276 60492260 -
tgtcacctcagcctcctgag

SEQ ID NO: 179936 - DNA, 20 bp, Artificial Sequence
  Synthetic oligonucleotide; TGG chr2 60492253 60492272 60492256 -
acctcagcctcctgagtagc

SEQ ID NO: 179937 - DNA, 20 bp, Artificial Sequence
  Synthetic oligonucleotide; GGG chr2 60492252 60492271 60492255 -
cctcagcctcctgagtagct

SEQ ID NO: 179938 - DNA, 20 bp, Artificial Sequence
  Synthetic oligonucleotide; CAG chr2 60492245 60492264 60492248 -
ctcctgagtagctgggacga

SEQ ID NO: 179939 - DNA, 20 bp, Artificial Sequence
  Synthetic oligonucleotide; AGG chr2 60492244 60492263 60492247 -
tcctgagtagctgggacgac

SEQ ID NO: 179940 - DNA, 20 bp, Artificial Sequence
  Synthetic oligonucleotide; TGG chr2 60492225 60492244 60492228 -
caggtgcatgccaccatgcc

SEQ ID NO: 179941 - DNA, 20 bp, Artificial Sequence
  Synthetic oligonucleotide; TAG chr2 60492213 60492232 60492216 -
accatgcctggctaattttg

SEQ ID NO: 179942 - DNA, 20 bp, Artificial Sequence
  Synthetic oligonucleotide; GAG chr2 60492211 60492230 60492214 -
catgcctggctaattttgta

SEQ ID NO: 179943 - DNA, 20 bp, Artificial Sequence
  Synthetic oligonucleotide; TGG chr2 60492207 60492226 60492210 -
cctggctaattttgtagaga

SEQ ID NO: 179944 - DNA, 20 bp, Artificial Sequence
  Synthetic oligonucleotide; GAG chr2 60492205 60492224 60492208 -
tggctaattttgtagagatg

SEQ ID NO: 179945 - DNA, 20 bp, Artificial Sequence
  Synthetic oligonucleotide; CAG chr2 60492187 60492206 60492190 -
tggagtttctccctgttgcc

SEQ ID NO: 179946 - DNA, 20 bp, Artificial Sequence
  Synthetic oligonucleotide; AGG chr2 60492186 60492205 60492189 -
ggagtttctccctgttgccc

SEQ ID NO: 179947 - DNA, 20 bp, Artificial Sequence
  Synthetic oligonucleotide; TGG chr2 60492182 60492201 60492185 -
tttctccctgttgcccaggc

SEQ ID NO: 179948 - DNA, 20 bp, Artificial Sequence
  Synthetic oligonucleotide; TGG chr2 60492168 60492187 60492171 -
ccaggctggtcttgaactcc

SEQ ID NO: 179949 - DNA, 20 bp, Artificial Sequence
  Synthetic oligonucleotide; GGG chr2 60492167 60492186 60492170 -
caggctggtcttgaactcct

SEQ ID NO: 179950 - DNA, 20 bp, Artificial Sequence
  Synthetic oligonucleotide; CAG chr2 60492161 60492180 60492164 -
ggtcttgaactcctgggctc

SEQ ID NO: 179951 - DNA, 20 bp, Artificial Sequence
  Synthetic oligonucleotide; AAG chr2 60492134 60492153 60492137 -
cctcctgccttgacctccca

SEQ ID NO: 179952 - DNA, 20 bp, Artificial Sequence
  Synthetic oligonucleotide; TGG chr2 60492128 60492147 60492131 -
gccttgacctcccaaagtgc

SEQ ID NO: 179953 - DNA, 20 bp, Artificial Sequence
  Synthetic oligonucleotide; GGG chr2 60492127 60492146 60492130 -
ccttgacctcccaaagtgct

SEQ ID NO: 179954 - DNA, 20 bp, Artificial Sequence
  Synthetic oligonucleotide; CAG chr2 60492120 60492139 60492123 -
ctcccaaagtgctgggatta

SEQ ID NO: 179955 - DNA, 20 bp, Artificial Sequence
  Synthetic oligonucleotide; AGG chr2 60492119 60492138 60492122 -
tcccaaagtgctgggattac

SEQ ID NO: 179956 - DNA, 20 bp, Artificial Sequence
  Synthetic oligonucleotide; GAG chr2 60492115 60492134 60492118 -
aaagtgctgggattacaggc

SEQ ID NO: 179957 - DNA, 20 bp, Artificial Sequence
  Synthetic oligonucleotide; GAG chr2 60492113 60492132 60492116 -
agtgctgggattacaggcga

SEQ ID NO: 179958 - DNA, 20 bp, Artificial Sequence
  Synthetic oligonucleotide; CAG chr2 60492089 60492108 60492092 -
cactgtgcctgtcaccaact

SEQ ID NO: 179959 - DNA, 20 bp, Artificial Sequence
  Synthetic oligonucleotide; CAG chr2 60492076 60492095 60492079 -
accaactcagtcttattcat

SEQ ID NO: 179960 - DNA, 20 bp, Artificial Sequence
  Synthetic oligonucleotide; AAG chr2 60492059 60492078 60492062 -
catcagtatgtcttctcctt

SEQ ID NO: 179961 - DNA, 20 bp, Artificial Sequence
  Synthetic oligonucleotide; CGG chr2 60492056 60492075 60492059 -
cagtatgtcttctccttaag

SEQ ID NO: 179962 - DNA, 20 bp, Artificial Sequence
  Synthetic oligonucleotide; GAG chr2 60492054 60492073 60492057 -
gtatgtcttctccttaagcg

SEQ ID NO: 179963 - DNA, 20 bp, Artificial Sequence
  Synthetic oligonucleotide; TAG chr2 60492039 60492058 60492042 -
aagcggagatgctaacaatg

SEQ ID NO: 179964 - DNA, 20 bp, Artificial Sequence
  Synthetic oligonucleotide; AAG chr2 60492012 60492031 60492015 -
tcctgtgctgaattcctgta

SEQ ID NO: 179965 - DNA, 20 bp, Artificial Sequence
  Synthetic oligonucleotide; GAG chr2 60492008 60492027 60492011 -
gtgctgaattcctgtaaagt

SEQ ID NO: 179966 - DNA, 20 bp, Artificial Sequence
  Synthetic oligonucleotide; AGG chr2 60492007 60492026 60492010 -
tgctgaattcctgtaaagtg

SEQ ID NO: 179967 - DNA, 20 bp, Artificial Sequence
  Synthetic oligonucleotide; GGG chr2 60492006 60492025 60492009 -
gctgaattcctgtaaagtga

SEQ ID NO: 179968 - DNA, 20 bp, Artificial Sequence
  Synthetic oligonucleotide; CAG chr2 60491972 60491991 60491975 -
cctacatccatcttcctctc

SEQ ID NO: 179969 - DNA, 20 bp, Artificial Sequence
  Synthetic oligonucleotide; AAG chr2 60491952 60491971 60491955 -
cagattccctctcaatttcc

SEQ ID NO: 179970 - DNA, 20 bp, Artificial Sequence
  Synthetic oligonucleotide; AGG chr2 60491951 60491970 60491954 -
agattccctctcaatttcca

SEQ ID NO: 179971 - DNA, 20 bp, Artificial Sequence
  Synthetic oligonucleotide; TAG chr2 60491944 60491963 60491947 -
ctctcaatttccaaggtatt

SEQ ID NO: 179972 - DNA, 20 bp, Artificial Sequence
  Synthetic oligonucleotide; TGG chr2 60491911 60491930 60491914 -
atatctgaacttcatttatt

SEQ ID NO: 179973 - DNA, 20 bp, Artificial Sequence
  Synthetic oligonucleotide; CAG chr2 60491908 60491927 60491911 -
tctgaacttcatttatttgg

SEQ ID NO: 179974 - DNA, 20 bp, Artificial Sequence
  Synthetic oligonucleotide; TGG chr2 60491898 60491917 60491901 -
atttatttggcagatttgtg

SEQ ID NO: 179975 - DNA, 20 bp, Artificial Sequence
  Synthetic oligonucleotide; TGG chr2 60491874 60491893 60491877 -
ctgccttttctgaacctatt

SEQ ID NO: 179976 - DNA, 20 bp, Artificial Sequence
  Synthetic oligonucleotide; GGG chr2 60491873 60491892 60491876 -
tgccttttctgaacctattt

SEQ ID NO: 179977 - DNA, 20 bp, Artificial Sequence
  Synthetic oligonucleotide; AAG chr2 60491866 60491885 60491869 -
tctgaacctatttgggtgct

SEQ ID NO: 179978 - DNA, 20 bp, Artificial Sequence
  Synthetic oligonucleotide; AGG chr2 60491865 60491884 60491868 -
ctgaacctatttgggtgcta

SEQ ID NO: 179979 - DNA, 20 bp, Artificial Sequence
  Synthetic oligonucleotide; TGG chr2 60491856 60491875 60491859 -
tttgggtgctaaggactgta

SEQ ID NO: 179980 - DNA, 20 bp, Artificial Sequence
  Synthetic oligonucleotide; TGG chr2 60491850 60491869 60491853 -
tgctaaggactgtatggatt

SEQ ID NO: 179981 - DNA, 20 bp, Artificial Sequence
  Synthetic oligonucleotide; GGG chr2 60491849 60491868 60491852 -
gctaaggactgtatggattt

SEQ ID NO: 179982 - DNA, 20 bp, Artificial Sequence
  Synthetic oligonucleotide; TGG chr2 60491837 60491856 60491840 -
atggatttgggttcttaaca

SEQ ID NO: 179983 - DNA, 20 bp, Artificial Sequence
  Synthetic oligonucleotide; TAG chr2 60491816 60491835 60491819 -
ggaaaacgtctgtgcctgcg

SEQ ID NO: 179984 - DNA, 20 bp, Artificial Sequence
  Synthetic oligonucleotide; TGG chr2 60491810 60491829 60491813 -
cgtctgtgcctgcgtagtgt

SEQ ID NO: 179985 - DNA, 20 bp, Artificial Sequence
  Synthetic oligonucleotide; GGG chr2 60491809 60491828 60491812 -
gtctgtgcctgcgtagtgtt

SEQ ID NO: 179986 - DNA, 20 bp, Artificial Sequence
  Synthetic oligonucleotide; TGG chr2 60491799 60491818 60491802 -
gcgtagtgttgggtcctacc

SEQ ID NO: 179987 - DNA, 20 bp, Artificial Sequence
  Synthetic oligonucleotide; TGG chr2 60491791 60491810 60491794 -
ttgggtcctacctggccact

SEQ ID NO: 179988 - DNA, 20 bp, Artificial Sequence
  Synthetic oligonucleotide; CGG chr2 60491779 60491798 60491782 -
tggccacttggctctcaaca

SEQ ID NO: 179989 - DNA, 20 bp, Artificial Sequence
  Synthetic oligonucleotide; GAG chr2 60491777 60491796 60491780 -
gccacttggctctcaacacg

SEQ ID NO: 179990 - DNA, 20 bp, Artificial Sequence
  Synthetic oligonucleotide; TAG chr2 60491764 60491783 60491767 -
caacacggagtgatgatgcc

SEQ ID NO: 179991 - DNA, 20 bp, Artificial Sequence
  Synthetic oligonucleotide; AGG chr2 60491763 60491782 60491766 -
aacacggagtgatgatgcct

SEQ ID NO: 179992 - DNA, 20 bp, Artificial Sequence
  Synthetic oligonucleotide; GGG chr2 60491762 60491781 60491765 -
acacggagtgatgatgccta

SEQ ID NO: 179993 - DNA, 20 bp, Artificial Sequence
  Synthetic oligonucleotide; TGG chr2 60491749 60491768 60491752 -
atgcctagggtgttttgacg

SEQ ID NO: 179994 - DNA, 20 bp, Artificial Sequence
  Synthetic oligonucleotide; GGG chr2 60491748 60491767 60491751 -
tgcctagggtgttttgacgt

SEQ ID NO: 179995 - DNA, 20 bp, Artificial Sequence
  Synthetic oligonucleotide; CAG chr2 60491745 60491764 60491748 -
ctagggtgttttgacgtggg

SEQ ID NO: 179996 - DNA, 20 bp, Artificial Sequence
  Synthetic oligonucleotide; CAG chr2 60491741 60491760 60491744 -
ggtgttttgacgtgggcagt

SEQ ID NO: 179997 - DNA, 20 bp, Artificial Sequence
  Synthetic oligonucleotide; CAG chr2 60491736 60491755 60491739 -
tttgacgtgggcagtcagcc

SEQ ID NO: 179998 - DNA, 20 bp, Artificial Sequence
  Synthetic oligonucleotide; TGG chr2 60491731 60491750 60491734 -
cgtgggcagtcagcccagcc

SEQ ID NO: 179999 - DNA, 20 bp, Artificial Sequence
  Synthetic oligonucleotide; GAG chr2 60491729 60491748 60491732 -
tgggcagtcagcccagcctg

SEQ ID NO: 180000 - DNA, 20 bp, Artificial Sequence
  Synthetic oligonucleotide; GAG chr2 60491722 60491741 60491725 -
tcagcccagcctggagaact

SEQ ID NO: 180001 - DNA, 20 bp, Artificial Sequence
  Synthetic oligonucleotide; AGG chr2 60491721 60491740 60491724 -
cagcccagcctggagaactg

SEQ ID NO: 180002 - DNA, 20 bp, Artificial Sequence
  Synthetic oligonucleotide; GGG chr2 60491720 60491739 60491723 -
agcccagcctggagaactga

SEQ ID NO: 180003 - DNA, 20 bp, Artificial Sequence
  Synthetic oligonucleotide; GGG chr2 60491719 60491738 60491722 -
gcccagcctggagaactgag

SEQ ID NO: 180004 - DNA, 20 bp, Artificial Sequence
  Synthetic oligonucleotide; GAG chr2 60491717 60491736 60491720 -
ccagcctggagaactgaggg

SEQ ID NO: 180005 - DNA, 20 bp, Artificial Sequence
  Synthetic oligonucleotide; TGG chr2 60491676 60491695 60491679 -
ttttttcttttttctttttt

SEQ ID NO: 180006 - DNA, 20 bp, Artificial Sequence
  Synthetic oligonucleotide; GAG chr2 60491672 60491691 60491675 -
ttcttttttctttttttggt

SEQ ID NO: 180007 - DNA, 20 bp, Artificial Sequence
  Synthetic oligonucleotide; CGG chr2 60491668 60491687 60491671 -
tttttctttttttggtgaga

SEQ ID NO: 180008 - DNA, 20 bp, Artificial Sequence
  Synthetic oligonucleotide; GAG chr2 60491666 60491685 60491669 -
tttctttttttggtgagacg

SEQ ID NO: 180009 - DNA, 20 bp, Artificial Sequence
  Synthetic oligonucleotide; CGG chr2 60491647 60491666 60491650 -
ggagatttactcttgttgcc

SEQ ID NO: 180010 - DNA, 20 bp, Artificial Sequence
  Synthetic oligonucleotide; GGG chr2 60491646 60491665 60491649 -
gagatttactcttgttgccc

SEQ ID NO: 180011 - DNA, 20 bp, Artificial Sequence
  Synthetic oligonucleotide; TGG chr2 60491642 60491661 60491645 -
tttactcttgttgcccgggc

SEQ ID NO: 180012 - DNA, 20 bp, Artificial Sequence
  Synthetic oligonucleotide; TGG chr2 60491632 60491651 60491635 -
ttgcccgggctggaatgcaa

SEQ ID NO: 180013 - DNA, 20 bp, Artificial Sequence
  Synthetic oligonucleotide; CGG chr2 60491621 60491640 60491624 -
ggaatgcaatggcgcgatct

SEQ ID NO: 180014 - DNA, 20 bp, Artificial Sequence
  Synthetic oligonucleotide; CAG chr2 60491597 60491616 60491600 -
tcactgcatcttctgcctcc

SEQ ID NO: 180015 - DNA, 20 bp, Artificial Sequence
  Synthetic oligonucleotide; AGG chr2 60491596 60491615 60491599 -
cactgcatcttctgcctccc

SEQ ID NO: 180016 - DNA, 20 bp, Artificial Sequence
  Synthetic oligonucleotide; AAG chr2 60491590 60491609 60491593 -
atcttctgcctcccaggttc

SEQ ID NO: 180017 - DNA, 20 bp, Artificial Sequence
  Synthetic oligonucleotide; CAG chr2 60491574 60491593 60491577 -
gttcaagcgatctcctgcct

SEQ ID NO: 180018 - DNA, 20 bp, Artificial Sequence
  Synthetic oligonucleotide; GAG chr2 60491565 60491584 60491568 -
atctcctgcctcagcctccc

SEQ ID NO: 180019 - DNA, 20 bp, Artificial Sequence
  Synthetic oligonucleotide; TAG chr2 60491562 60491581 60491565 -
tcctgcctcagcctcccgag

SEQ ID NO: 180020 - DNA, 20 bp, Artificial Sequence
  Synthetic oligonucleotide; GAG chr2 60491557 60491576 60491560 -
cctcagcctcccgagtagct

SEQ ID NO: 180021 - DNA, 20 bp, Artificial Sequence
  Synthetic oligonucleotide; CAG chr2 60491550 60491569 60491553 -
ctcccgagtagctgagatta

SEQ ID NO: 180022 - DNA, 20 bp, Artificial Sequence
  Synthetic oligonucleotide; AGG chr2 60491549 60491568 60491552 -
tcccgagtagctgagattac

SEQ ID NO: 180023 - DNA, 20 bp, Artificial Sequence
  Synthetic oligonucleotide; CGG chr2 60491530 60491549 60491533 -
caggcatgtattaccatgcc

SEQ ID NO: 180024 - DNA, 20 bp, Artificial Sequence
  Synthetic oligonucleotide; TAG chr2 60491512 60491531 60491515 -
cccggctaattttgtatttt

SEQ ID NO: 180025 - DNA, 20 bp, Artificial Sequence
  Synthetic oligonucleotide; TAG chr2 60491509 60491528 60491512 -
ggctaattttgtatttttag

SEQ ID NO: 180026 - DNA, 20 bp, Artificial Sequence
  Synthetic oligonucleotide; GAG chr2 60491507 60491526 60491510 -
ctaattttgtatttttagta

SEQ ID NO: 180027 - DNA, 20 bp, Artificial Sequence
  Synthetic oligonucleotide; CGG chr2 60491503 60491522 60491506 -
ttttgtatttttagtagaga

SEQ ID NO: 180028 - DNA, 20 bp, Artificial Sequence
  Synthetic oligonucleotide; GGG chr2 60491502 60491521 60491505 -
tttgtatttttagtagagac

SEQ ID NO: 180029 - DNA, 20 bp, Artificial Sequence
  Synthetic oligonucleotide; GGG chr2 60491501 60491520 60491504 -
ttgtatttttagtagagacg

SEQ ID NO: 180030 - DNA, 20 bp, Artificial Sequence
  Synthetic oligonucleotide; CAG chr2 60491458 60491477 60491461 -
tgatcttgaactcctgacct

SEQ ID NO: 180031 - DNA, 20 bp, Artificial Sequence
  Synthetic oligonucleotide; AGG chr2 60491457 60491476 60491460 -
gatcttgaactcctgacctc

SEQ ID NO: 180032 - DNA, 20 bp, Artificial Sequence
  Synthetic oligonucleotide; CGG chr2 60491440 60491459 60491443 -
ctcaggtgatcctcctgccc

SEQ ID NO: 180033 - DNA, 20 bp, Artificial Sequence
  Synthetic oligonucleotide; AAG chr2 60491430 60491449 60491433 -
cctcctgccccggcctccca

SEQ ID NO: 180034 - DNA, 20 bp, Artificial Sequence
  Synthetic oligonucleotide; TGG chr2 60491424 60491443 60491427 -
gccccggcctcccaaagtgc

SEQ ID NO: 180035 - DNA, 20 bp, Artificial Sequence
  Synthetic oligonucleotide; GGG chr2 60491423 60491442 60491426 -
ccccggcctcccaaagtgct

SEQ ID NO: 180036 - DNA, 20 bp, Artificial Sequence
  Synthetic oligonucleotide; CAG chr2 60491416 60491435 60491419 -
ctcccaaagtgctgggatta

SEQ ID NO: 180037 - DNA, 20 bp, Artificial Sequence
  Synthetic oligonucleotide; AGG chr2 60491415 60491434 60491418 -
tcccaaagtgctgggattac

SEQ ID NO: 180038 - DNA, 20 bp, Artificial Sequence
  Synthetic oligonucleotide; GAG chr2 60491409 60491428 60491412 -
agtgctgggattacaggtgt

SEQ ID NO: 180039 - DNA, 20 bp, Artificial Sequence
  Synthetic oligonucleotide; CAG chr2 60491403 60491422 60491406 -
gggattacaggtgtgagcca

SEQ ID NO: 180040 - DNA, 20 bp, Artificial Sequence
  Synthetic oligonucleotide; TGG chr2 60491396 60491415 60491399 -
caggtgtgagccacagcgcc

SEQ ID NO: 180041 - DNA, 20 bp, Artificial Sequence
  Synthetic oligonucleotide; CGG chr2 60491392 60491411 60491395 -
tgtgagccacagcgcctggc

SEQ ID NO: 180042 - DNA, 20 bp, Artificial Sequence
  Synthetic oligonucleotide; GGG chr2 60491391 60491410 60491394 -
gtgagccacagcgcctggcc

SEQ ID NO: 180043 - DNA, 20 bp, Artificial Sequence
  Synthetic oligonucleotide; GAG chr2 60491389 60491408 60491392 -
gagccacagcgcctggccgg

SEQ ID NO: 180044 - DNA, 20 bp, Artificial Sequence
  Synthetic oligonucleotide; TAG chr2 60491374 60491393 60491377 -
gccgggagcatttcaaatga

SEQ ID NO: 180045 - DNA, 20 bp, Artificial Sequence
  Synthetic oligonucleotide; TAG chr2 60491370 60491389 60491373 -
ggagcatttcaaatgatagt

SEQ ID NO: 180046 - DNA, 20 bp, Artificial Sequence
  Synthetic oligonucleotide; AGG chr2 60491369 60491388 60491372 -
gagcatttcaaatgatagtt

SEQ ID NO: 180047 - DNA, 20 bp, Artificial Sequence
  Synthetic oligonucleotide; TAG chr2 60491345 60491364 60491348 -
cttccttttactgtacttaa

SEQ ID NO: 180048 - DNA, 20 bp, Artificial Sequence
  Synthetic oligonucleotide; AAG chr2 60491339 60491358 60491342 -
tttactgtacttaatagctg

SEQ ID NO: 180049 - DNA, 20 bp, Artificial Sequence
  Synthetic oligonucleotide; AGG chr2 60491338 60491357 60491341 -
ttactgtacttaatagctga

SEQ ID NO: 180050 - DNA, 20 bp, Artificial Sequence
  Synthetic oligonucleotide; GGG chr2 60491337 60491356 60491340 -
tactgtacttaatagctgaa

SEQ ID NO: 180051 - DNA, 20 bp, Artificial Sequence
  Synthetic oligonucleotide; GGG chr2 60491336 60491355 60491339 -
actgtacttaatagctgaag

SEQ ID NO: 180052 - DNA, 20 bp, Artificial Sequence
  Synthetic oligonucleotide; GGG chr2 60491335 60491354 60491338 -
ctgtacttaatagctgaagg

SEQ ID NO: 180053 - DNA, 20 bp, Artificial Sequence
  Synthetic oligonucleotide; AAG chr2 60491328 60491347 60491331 -
taatagctgaagggggccaa

SEQ ID NO: 180054 - DNA, 20 bp, Artificial Sequence
  Synthetic oligonucleotide; TGG chr2 60491305 60491324 60491308 -
tgtccatgtttgctgccctc

SEQ ID NO: 180055 - DNA, 20 bp, Artificial Sequence
  Synthetic oligonucleotide; GAG chr2 60491293 60491312 60491296 -
ctgccctctggcatcaaaat

SEQ ID NO: 180056 - DNA, 20 bp, Artificial Sequence
  Synthetic oligonucleotide; AGG chr2 60491292 60491311 60491295 -
tgccctctggcatcaaaatg

SEQ ID NO: 180057 - DNA, 20 bp, Artificial Sequence
  Synthetic oligonucleotide; TAG chr2 60491282 60491301 60491285 -
catcaaaatgaggtcctttt

SEQ ID NO: 180058 - DNA, 20 bp, Artificial Sequence
  Synthetic oligonucleotide; TAG chr2 60491279 60491298 60491282 -
caaaatgaggtcctttttag

SEQ ID NO: 180059 - DNA, 20 bp, Artificial Sequence
  Synthetic oligonucleotide; CAG chr2 60491262 60491281 60491265 -
tagtagtgctgcatttaaaa

SEQ ID NO: 180060 - DNA, 20 bp, Artificial Sequence
  Synthetic oligonucleotide; AAG chr2 60491255 60491274 60491258 -
gctgcatttaaaacagcatt

SEQ ID NO: 180061 - DNA, 20 bp, Artificial Sequence
  Synthetic oligonucleotide; TAG chr2 60491242 60491261 60491245 -
cagcattaagaatacgtttt

SEQ ID NO: 180062 - DNA, 20 bp, Artificial Sequence
  Synthetic oligonucleotide; TAG chr2 60491235 60491254 60491238 -
aagaatacgtttttagaact

SEQ ID NO: 180063 - DNA, 20 bp, Artificial Sequence
  Synthetic oligonucleotide; GAG chr2 60491221 60491240 60491224 -
agaacttagctttttgcatt

SEQ ID NO: 180064 - DNA, 20 bp, Artificial Sequence
  Synthetic oligonucleotide; AGG chr2 60491220 60491239 60491223 -
gaacttagctttttgcattg

SEQ ID NO: 180065 - DNA, 20 bp, Artificial Sequence
  Synthetic oligonucleotide; CAG chr2 60491212 60491231 60491215 -
ctttttgcattgaggatgcg

SEQ ID NO: 180066 - DNA, 20 bp, Artificial Sequence
  Synthetic oligonucleotide; AGG chr2 60491211 60491230 60491214 -
tttttgcattgaggatgcgc

SEQ ID NO: 180067 - DNA, 20 bp, Artificial Sequence
  Synthetic oligonucleotide; TGG chr2 60491208 60491227 60491211 -
ttgcattgaggatgcgcagg

SEQ ID NO: 180068 - DNA, 20 bp, Artificial Sequence
  Synthetic oligonucleotide; GAG chr2 60491203 60491222 60491206 -
ttgaggatgcgcaggtggct

SEQ ID NO: 180069 - DNA, 20 bp, Artificial Sequence
  Synthetic oligonucleotide; CAG chr2 60491187 60491206 60491190 -
ggctgagactaacttctttg

SEQ ID NO: 180070 - DNA, 20 bp, Artificial Sequence
  Synthetic oligonucleotide; TGG chr2 60491177 60491196 60491180 -
aacttctttgcagatgacca

SEQ ID NO: 180071 - DNA, 20 bp, Artificial Sequence
  Synthetic oligonucleotide; AAG chr2 60491170 60491189 60491173 -
ttgcagatgaccatggttga

SEQ ID NO: 180072 - DNA, 20 bp, Artificial Sequence
  Synthetic oligonucleotide; CAG chr2 60491166 60491185 60491169 -
agatgaccatggttgaaagt

SEQ ID NO: 180073 - DNA, 20 bp, Artificial Sequence
  Synthetic oligonucleotide; TAG chr2 60491160 60491179 60491163 -
ccatggttgaaagtcagcta

SEQ ID NO: 180074 - DNA, 20 bp, Artificial Sequence
  Synthetic oligonucleotide; GAG chr2 60491158 60491177 60491161 -
atggttgaaagtcagctata

SEQ ID NO: 180075 - DNA, 20 bp, Artificial Sequence
  Synthetic oligonucleotide; TAG chr2 60491142 60491161 60491145 -
tatagagttgcacaaccacg

SEQ ID NO: 180076 - DNA, 20 bp, Artificial Sequence
  Synthetic oligonucleotide; TGG chr2 60491138 60491157 60491141 -
gagttgcacaaccacgtagt

SEQ ID NO: 180077 - DNA, 20 bp, Artificial Sequence
  Synthetic oligonucleotide; GGG chr2 60491137 60491156 60491140 -
agttgcacaaccacgtagtt

SEQ ID NO: 180078 - DNA, 20 bp, Artificial Sequence
  Synthetic oligonucleotide; TAG chr2 60491125 60491144 60491128 -
acgtagttgggcttcacata

SEQ ID NO: 180079 - DNA, 20 bp, Artificial Sequence
  Synthetic oligonucleotide; AAG chr2 60491122 60491141 60491125 -
tagttgggcttcacatatag

SEQ ID NO: 180080 - DNA, 20 bp, Artificial Sequence
  Synthetic oligonucleotide; TGG chr2 60491105 60491124 60491108 -
tagaagatgttgtcattttt

SEQ ID NO: 180081 - DNA, 20 bp, Artificial Sequence
  Synthetic oligonucleotide; CAG chr2 60491093 60491112 60491096 -
tcattttttggtaactctgt

SEQ ID NO: 180082 - DNA, 20 bp, Artificial Sequence
  Synthetic oligonucleotide; TGG chr2 60491078 60491097 60491081 -
tctgtcagactttaccaacc

SEQ ID NO: 180083 - DNA, 20 bp, Artificial Sequence
  Synthetic oligonucleotide; CAG chr2 60491071 60491090 60491074 -
gactttaccaacctggcgca

SEQ ID NO: 180084 - DNA, 20 bp, Artificial Sequence
  Synthetic oligonucleotide; TGG chr2 60491066 60491085 60491069 -
taccaacctggcgcacagtc

SEQ ID NO: 180085 - DNA, 20 bp, Artificial Sequence
  Synthetic oligonucleotide; TGG chr2 60491062 60491081 60491065 -
aacctggcgcacagtctggt

SEQ ID NO: 180086 - DNA, 20 bp, Artificial Sequence
  Synthetic oligonucleotide; CAG chr2 60491032 60491051 60491035 -
acttcacatttgctcttctc

SEQ ID NO: 180087 - DNA, 20 bp, Artificial Sequence
  Synthetic oligonucleotide; AGG chr2 60491031 60491050 60491034 -
cttcacatttgctcttctcc

SEQ ID NO: 180088 - DNA, 20 bp, Artificial Sequence
  Synthetic oligonucleotide; GGG chr2 60491030 60491049 60491033 -
ttcacatttgctcttctcca

SEQ ID NO: 180089 - DNA, 20 bp, Artificial Sequence
  Synthetic oligonucleotide; TGG chr2 60491025 60491044 60491028 -
atttgctcttctccagggtg

SEQ ID NO: 180090 - DNA, 20 bp, Artificial Sequence
  Synthetic oligonucleotide; GGG chr2 60491024 60491043 60491027 -
tttgctcttctccagggtgt

SEQ ID NO: 180091 - DNA, 20 bp, Artificial Sequence
  Synthetic oligonucleotide; GGG chr2 60491023 60491042 60491026 -
ttgctcttctccagggtgtg

SEQ ID NO: 180092 - DNA, 20 bp, Artificial Sequence
  Synthetic oligonucleotide; TGG chr2 60491020 60491039 60491023 -
ctcttctccagggtgtgggg

SEQ ID NO: 180093 - DNA, 20 bp, Artificial Sequence
  Synthetic oligonucleotide; AAG chr2 60491010 60491029 60491013 -
gggtgtggggtggctgttta

SEQ ID NO: 180094 - DNA, 20 bp, Artificial Sequence
  Synthetic oligonucleotide; GAG chr2 60491008 60491027 60491011 -
gtgtggggtggctgtttaaa

SEQ ID NO: 180095 - DNA, 20 bp, Artificial Sequence
  Synthetic oligonucleotide; AGG chr2 60491007 60491026 60491010 -
tgtggggtggctgtttaaag

SEQ ID NO: 180096 - DNA, 20 bp, Artificial Sequence
  Synthetic oligonucleotide; GGG chr2 60491006 60491025 60491009 -
gtggggtggctgtttaaaga

SEQ ID NO: 180097 - DNA, 20 bp, Artificial Sequence
  Synthetic oligonucleotide; TGG chr2 60491003 60491022 60491006 -
gggtggctgtttaaagaggg

SEQ ID NO: 180098 - DNA, 20 bp, Artificial Sequence
  Synthetic oligonucleotide; TAG chr2 60490979 60490998 60490982 -
tattcatgctaatctttgtg

SEQ ID NO: 180099 - DNA, 20 bp, Artificial Sequence
  Synthetic oligonucleotide; AAG chr2 60490935 60490954 60490938 -
gcttttttttttttatctga

SEQ ID NO: 180100 - DNA, 20 bp, Artificial Sequence
  Synthetic oligonucleotide; AAG chr2 60490929 60490948 60490932 -
ttttttttatctgaaagttc

SEQ ID NO: 180101 - DNA, 20 bp, Artificial Sequence
  Synthetic oligonucleotide; TAG chr2 60490926 60490945 60490929 -
tttttatctgaaagttcaag

SEQ ID NO: 180102 - DNA, 20 bp, Artificial Sequence
  Synthetic oligonucleotide; CAG chr2 60490919 60490938 60490922 -
ctgaaagttcaagtagatat

SEQ ID NO: 180103 - DNA, 20 bp, Artificial Sequence
  Synthetic oligonucleotide; AAG chr2 60490916 60490935 60490919 -
aaagttcaagtagatatcag

SEQ ID NO: 180104 - DNA, 20 bp, Artificial Sequence
  Synthetic oligonucleotide; AGG chr2 60490915 60490934 60490918 -
aagttcaagtagatatcaga

SEQ ID NO: 180105 - DNA, 20 bp, Artificial Sequence
  Synthetic oligonucleotide; GGG chr2 60490914 60490933 60490917 -
agttcaagtagatatcagaa

SEQ ID NO: 180106 - DNA, 20 bp, Artificial Sequence
  Synthetic oligonucleotide; TGG chr2 60490902 60490921 60490905 -
tatcagaagggaaatgtttg

SEQ ID NO: 180107 - DNA, 20 bp, Artificial Sequence
  Synthetic oligonucleotide; GGG chr2 60490901 60490920 60490904 -
atcagaagggaaatgtttgt

SEQ ID NO: 180108 - DNA, 20 bp, Artificial Sequence
  Synthetic oligonucleotide; AAG chr2 60490894 60490913 60490897 -
gggaaatgtttgtgggtgct

SEQ ID NO: 180109 - DNA, 20 bp, Artificial Sequence
  Synthetic oligonucleotide; AAG chr2 60490891 60490910 60490894 -
aaatgtttgtgggtgctaag

SEQ ID NO: 180110 - DNA, 20 bp, Artificial Sequence
  Synthetic oligonucleotide; AGG chr2 60490890 60490909 60490893 -
aatgtttgtgggtgctaaga

SEQ ID NO: 180111 - DNA, 20 bp, Artificial Sequence
  Synthetic oligonucleotide; CAG chr2 60490868 60490887 60490871 -
gttaaaattaccattttgaa

SEQ ID NO: 180112 - DNA, 20 bp, Artificial Sequence
  Synthetic oligonucleotide; TGG chr2 60490855 60490874 60490858 -
ttttgaacagaaatgatatt

SEQ ID NO: 180113 - DNA, 20 bp, Artificial Sequence
  Synthetic oligonucleotide; TAG chr2 60490835 60490854 60490838 -
tggaaaaataacttcccttt

SEQ ID NO: 180114 - DNA, 20 bp, Artificial Sequence
  Synthetic oligonucleotide; AGG chr2 60490834 60490853 60490837 -
ggaaaaataacttccctttt

SEQ ID NO: 180115 - DNA, 20 bp, Artificial Sequence
  Synthetic oligonucleotide; AAG chr2 60490831 60490850 60490834 -
aaaataacttcccttttagg

SEQ ID NO: 180116 - DNA, 20 bp, Artificial Sequence
  Synthetic oligonucleotide; AGG chr2 60490830 60490849 60490833 -
aaataacttcccttttagga

SEQ ID NO: 180117 - DNA, 20 bp, Artificial Sequence
  Synthetic oligonucleotide; CAG chr2 60490822 60490841 60490825 -
tcccttttaggaaggtaaat

SEQ ID NO: 180118 - DNA, 20 bp, Artificial Sequence
  Synthetic oligonucleotide; TAG chr2 60490792 60490811 60490795 -
tatgctatttgttgaattcc

SEQ ID NO: 180119 - DNA, 20 bp, Artificial Sequence
  Synthetic oligonucleotide; TGG chr2 60490759 60490778 60490762 -
tatcatgtcacatgctgtgc

SEQ ID NO: 180120 - DNA, 20 bp, Artificial Sequence
  Synthetic oligonucleotide; TAG chr2 60490741 60490760 60490744 -
gctggtactttcaaatataa

SEQ ID NO: 180121 - DNA, 20 bp, Artificial Sequence
  Synthetic oligonucleotide; AAG chr2 60490738 60490757 60490741 -
ggtactttcaaatataatag

SEQ ID NO: 180122 - DNA, 20 bp, Artificial Sequence
  Synthetic oligonucleotide; AAG chr2 60490734 60490753 60490737 -
ctttcaaatataatagaagc

SEQ ID NO: 180123 - DNA, 20 bp, Artificial Sequence
  Synthetic oligonucleotide; TAG chr2 60490731 60490750 60490734 -
tcaaatataatagaagcaag

SEQ ID NO: 180124 - DNA, 20 bp, Artificial Sequence
  Synthetic oligonucleotide; AGG chr2 60490730 60490749 60490733 -
caaatataatagaagcaagt

SEQ ID NO: 180125 - DNA, 20 bp, Artificial Sequence
  Synthetic oligonucleotide; GAG chr2 60490728 60490747 60490731 -
aatataatagaagcaagtag

SEQ ID NO: 180126 - DNA, 20 bp, Artificial Sequence
  Synthetic oligonucleotide; AAG chr2 60490724 60490743 60490727 -
taatagaagcaagtaggaga

SEQ ID NO: 180127 - DNA, 20 bp, Artificial Sequence
  Synthetic oligonucleotide; GAG chr2 60490722 60490741 60490725 -
atagaagcaagtaggagaaa

SEQ ID NO: 180128 - DNA, 20 bp, Artificial Sequence
  Synthetic oligonucleotide; AAG chr2 60490708 60490727 60490711 -
gagaaagagtccctgtattg

SEQ ID NO: 180129 - DNA, 20 bp, Artificial Sequence
  Synthetic oligonucleotide; TGG chr2 60490697 60490716 60490700 -
cctgtattgaagaaactcat

SEQ ID NO: 180130 - DNA, 20 bp, Artificial Sequence
  Synthetic oligonucleotide; GGG chr2 60490696 60490715 60490699 -
ctgtattgaagaaactcatt

SEQ ID NO: 180131 - DNA, 20 bp, Artificial Sequence
  Synthetic oligonucleotide; TAG chr2 60490677 60490696 60490680 -
tgggaacacatgaaattaat

SEQ ID NO: 180132 - DNA, 20 bp, Artificial Sequence
  Synthetic oligonucleotide; GAG chr2 60490675 60490694 60490678 -
ggaacacatgaaattaatta

SEQ ID NO: 180133 - DNA, 20 bp, Artificial Sequence
  Synthetic oligonucleotide; AGG chr2 60490674 60490693 60490677 -
gaacacatgaaattaattag

SEQ ID NO: 180134 - DNA, 20 bp, Artificial Sequence
  Synthetic oligonucleotide; TAG chr2 60490669 60490688 60490672 -
catgaaattaattagaggca

SEQ ID NO: 180135 - DNA, 20 bp, Artificial Sequence
  Synthetic oligonucleotide; GAG chr2 60490667 60490686 60490670 -
tgaaattaattagaggcata

SEQ ID NO: 180136 - DNA, 20 bp, Artificial Sequence
  Synthetic oligonucleotide; AGG chr2 60490666 60490685 60490669 -
gaaattaattagaggcatag

SEQ ID NO: 180137 - DNA, 20 bp, Artificial Sequence
  Synthetic oligonucleotide; GGG chr2 60490665 60490684 60490668 -
aaattaattagaggcataga

SEQ ID NO: 180138 - DNA, 20 bp, Artificial Sequence
  Synthetic oligonucleotide; CAG chr2 60490657 60490676 60490660 -
tagaggcatagagggttaac

SEQ ID NO: 180139 - DNA, 20 bp, Artificial Sequence
  Synthetic oligonucleotide; AAG chr2 60490648 60490667 60490651 -
agagggttaaccagcaatgt

SEQ ID NO: 180140 - DNA, 20 bp, Artificial Sequence
  Synthetic oligonucleotide; AGG chr2 60490647 60490666 60490650 -
gagggttaaccagcaatgta

SEQ ID NO: 180141 - DNA, 20 bp, Artificial Sequence
  Synthetic oligonucleotide; TAG chr2 60490642 60490661 60490645 -
ttaaccagcaatgtaaggcc

SEQ ID NO: 180142 - DNA, 20 bp, Artificial Sequence
  Synthetic oligonucleotide; GAG chr2 60490635 60490654 60490638 -
gcaatgtaaggcctagatat

SEQ ID NO: 180143 - DNA, 20 bp, Artificial Sequence
  Synthetic oligonucleotide; CAG chr2 60490631 60490650 60490634 -
tgtaaggcctagatatgagt

SEQ ID NO: 180144 - DNA, 20 bp, Artificial Sequence
  Synthetic oligonucleotide; AGG chr2 60490630 60490649 60490633 -
gtaaggcctagatatgagtc

SEQ ID NO: 180145 - DNA, 20 bp, Artificial Sequence
  Synthetic oligonucleotide; GGG chr2 60490629 60490648 60490632 -
taaggcctagatatgagtca

SEQ ID NO: 180146 - DNA, 20 bp, Artificial Sequence
  Synthetic oligonucleotide; GAG chr2 60490627 60490646 60490630 -
aggcctagatatgagtcagg

SEQ ID NO: 180147 - DNA, 20 bp, Artificial Sequence
  Synthetic oligonucleotide; TGG chr2 60490624 60490643 60490627 -
cctagatatgagtcagggag

SEQ ID NO: 180148 - DNA, 20 bp, Artificial Sequence
  Synthetic oligonucleotide; TGG chr2 60490617 60490636 60490620 -
atgagtcagggagtggtgca

SEQ ID NO: 180149 - DNA, 20 bp, Artificial Sequence
  Synthetic oligonucleotide; GGG chr2 60490616 60490635 60490619 -
tgagtcagggagtggtgcat

SEQ ID NO: 180150 - DNA, 20 bp, Artificial Sequence
  Synthetic oligonucleotide; GAG chr2 60490611 60490630 60490614 -
cagggagtggtgcatgggat

SEQ ID NO: 180151 - DNA, 20 bp, Artificial Sequence
  Synthetic oligonucleotide; GAG chr2 60490600 60490619 60490603 -
gcatgggatgagtgttctat

SEQ ID NO: 180152 - DNA, 20 bp, Artificial Sequence
  Synthetic oligonucleotide; AGG chr2 60490599 60490618 60490602 -
catgggatgagtgttctatg

SEQ ID NO: 180153 - DNA, 20 bp, Artificial Sequence
  Synthetic oligonucleotide; TGG chr2 60490595 60490614 60490598 -
ggatgagtgttctatgaggt

SEQ ID NO: 180154 - DNA, 20 bp, Artificial Sequence
  Synthetic oligonucleotide; GAG chr2 60490593 60490612 60490596 -
atgagtgttctatgaggttg

SEQ ID NO: 180155 - DNA, 20 bp, Artificial Sequence
  Synthetic oligonucleotide; AAG chr2 60490590 60490609 60490593 -
agtgttctatgaggttggag

SEQ ID NO: 180156 - DNA, 20 bp, Artificial Sequence
  Synthetic oligonucleotide; AGG chr2 60490589 60490608 60490592 -
gtgttctatgaggttggaga

SEQ ID NO: 180157 - DNA, 20 bp, Artificial Sequence
  Synthetic oligonucleotide; GAG chr2 60490584 60490603 60490587 -
ctatgaggttggagaaggat

SEQ ID NO: 180158 - DNA, 20 bp, Artificial Sequence
  Synthetic oligonucleotide; AAG chr2 60490565 60490584 60490568 -
tgagattgattcttcttgct

SEQ ID NO: 180159 - DNA, 20 bp, Artificial Sequence
  Synthetic oligonucleotide; AGG chr2 60490564 60490583 60490567 -
gagattgattcttcttgcta

SEQ ID NO: 180160 - DNA, 20 bp, Artificial Sequence
  Synthetic oligonucleotide; TAG chr2 60490557 60490576 60490560 -
attcttcttgctaaggtgac

SEQ ID NO: 180161 - DNA, 20 bp, Artificial Sequence
  Synthetic oligonucleotide; AGG chr2 60490556 60490575 60490559 -
ttcttcttgctaaggtgact

SEQ ID NO: 180162 - DNA, 20 bp, Artificial Sequence
  Synthetic oligonucleotide; TAG chr2 60490553 60490572 60490556 -
ttcttgctaaggtgactagg

SEQ ID NO: 180163 - DNA, 20 bp, Artificial Sequence
  Synthetic oligonucleotide; GAG chr2 60490541 60490560 60490544 -
tgactaggtagaccttcatt

SEQ ID NO: 180164 - DNA, 20 bp, Artificial Sequence
  Synthetic oligonucleotide; AGG chr2 60490540 60490559 60490543 -
gactaggtagaccttcattg

SEQ ID NO: 180165 - DNA, 20 bp, Artificial Sequence
  Synthetic oligonucleotide; AAG chr2 60490532 60490551 60490535 -
agaccttcattgaggccttg

SEQ ID NO: 180166 - DNA, 20 bp, Artificial Sequence
  Synthetic oligonucleotide; GAG chr2 60490526 60490545 60490529 -
tcattgaggccttgaagtat

SEQ ID NO: 180167 - DNA, 20 bp, Artificial Sequence
  Synthetic oligonucleotide; CAG chr2 60490523 60490542 60490526 -
ttgaggccttgaagtatgag

SEQ ID NO: 180168 - DNA, 20 bp, Artificial Sequence
  Synthetic oligonucleotide; AGG chr2 60490522 60490541 60490525 -
tgaggccttgaagtatgagc

SEQ ID NO: 180169 - DNA, 20 bp, Artificial Sequence
  Synthetic oligonucleotide; CAG chr2 60490515 60490534 60490518 -
ttgaagtatgagcaggattc

SEQ ID NO: 180170 - DNA, 20 bp, Artificial Sequence
  Synthetic oligonucleotide; AGG chr2 60490514 60490533 60490517 -
tgaagtatgagcaggattcc

SEQ ID NO: 180171 - DNA, 20 bp, Artificial Sequence
  Synthetic oligonucleotide; GAG chr2 60490512 60490531 60490515 -
aagtatgagcaggattccag

SEQ ID NO: 180172 - DNA, 20 bp, Artificial Sequence
  Synthetic oligonucleotide; AGG chr2 60490511 60490530 60490514 -
agtatgagcaggattccagg

SEQ ID NO: 180173 - DNA, 20 bp, Artificial Sequence
  Synthetic oligonucleotide; AAG chr2 60490507 60490526 60490510 -
tgagcaggattccaggaggt

SEQ ID NO: 180174 - DNA, 20 bp, Artificial Sequence
  Synthetic oligonucleotide; GAG chr2 60490505 60490524 60490508 -
agcaggattccaggaggtaa

SEQ ID NO: 180175 - DNA, 20 bp, Artificial Sequence
  Synthetic oligonucleotide; AAG chr2 60490502 60490521 60490505 -
aggattccaggaggtaagag

SEQ ID NO: 180176 - DNA, 20 bp, Artificial Sequence
  Synthetic oligonucleotide; AAG chr2 60490499 60490518 60490502 -
attccaggaggtaagagaag

SEQ ID NO: 180177 - DNA, 20 bp, Artificial Sequence
  Synthetic oligonucleotide; AAG chr2 60490496 60490515 60490499 -
ccaggaggtaagagaagaag

SEQ ID NO: 180178 - DNA, 20 bp, Artificial Sequence
  Synthetic oligonucleotide; AAG chr2 60490491 60490510 60490494 -
aggtaagagaagaagaagaa

SEQ ID NO: 180179 - DNA, 20 bp, Artificial Sequence
  Synthetic oligonucleotide; CAG chr2 60490487 60490506 60490490 -
aagagaagaagaagaaaagc

SEQ ID NO: 180180 - DNA, 20 bp, Artificial Sequence
  Synthetic oligonucleotide; AGG chr2 60490486 60490505 60490489 -
agagaagaagaagaaaagcc

SEQ ID NO: 180181 - DNA, 20 bp, Artificial Sequence
  Synthetic oligonucleotide; AAG chr2 60490483 60490502 60490486 -
gaagaagaagaaaagccagg

SEQ ID NO: 180182 - DNA, 20 bp, Artificial Sequence
  Synthetic oligonucleotide; AGG chr2 60490482 60490501 60490485 -
aagaagaagaaaagccagga

SEQ ID NO: 180183 - DNA, 20 bp, Artificial Sequence
  Synthetic oligonucleotide; GAG chr2 60490475 60490494 60490478 -
agaaaagccaggaaggaaat

SEQ ID NO: 180184 - DNA, 20 bp, Artificial Sequence
  Synthetic oligonucleotide; CGG chr2 60490470 60490489 60490473 -
agccaggaaggaaatgagaa

SEQ ID NO: 180185 - DNA, 20 bp, Artificial Sequence
  Synthetic oligonucleotide; AAG chr2 60490467 60490486 60490470 -
caggaaggaaatgagaacgg

SEQ ID NO: 180186 - DNA, 20 bp, Artificial Sequence
  Synthetic oligonucleotide; AGG chr2 60490466 60490485 60490469 -
aggaaggaaatgagaacgga

SEQ ID NO: 180187 - DNA, 20 bp, Artificial Sequence
  Synthetic oligonucleotide; GGG chr2 60490465 60490484 60490468 -
ggaaggaaatgagaacggaa

SEQ ID NO: 180188 - DNA, 20 bp, Artificial Sequence
  Synthetic oligonucleotide; TGG chr2 60490453 60490472 60490456 -
gaacggaagggatttttact

SEQ ID NO: 180189 - DNA, 20 bp, Artificial Sequence
  Synthetic oligonucleotide; GGG chr2 60490452 60490471 60490455 -
aacggaagggatttttactt

SEQ ID NO: 180190 - DNA, 20 bp, Artificial Sequence
  Synthetic oligonucleotide; CAG chr2 60490449 60490468 60490452 -
ggaagggatttttacttggg

SEQ ID NO: 180191 - DNA, 20 bp, Artificial Sequence
  Synthetic oligonucleotide; TGG chr2 60490432 60490451 60490435 -
gggcagaatattttccttga

SEQ ID NO: 180192 - DNA, 20 bp, Artificial Sequence
  Synthetic oligonucleotide; GGG chr2 60490431 60490450 60490434 -
ggcagaatattttccttgat

SEQ ID NO: 180193 - DNA, 20 bp, Artificial Sequence
  Synthetic oligonucleotide; CGG chr2 60490426 60490445 60490429 -
aatattttccttgatgggta

SEQ ID NO: 180194 - DNA, 20 bp, Artificial Sequence
  Synthetic oligonucleotide; GGG chr2 60490425 60490444 60490428 -
atattttccttgatgggtac

SEQ ID NO: 180195 - DNA, 20 bp, Artificial Sequence
  Synthetic oligonucleotide; GGG chr2 60490424 60490443 60490427 -
tattttccttgatgggtacg

SEQ ID NO: 180196 - DNA, 20 bp, Artificial Sequence
  Synthetic oligonucleotide; AAG chr2 60490417 60490436 60490420 -
cttgatgggtacggggaact

SEQ ID NO: 180197 - DNA, 20 bp, Artificial Sequence
  Synthetic oligonucleotide; TGG chr2 60490412 60490431 60490415 -
tgggtacggggaactaagac

SEQ ID NO: 180198 - DNA, 20 bp, Artificial Sequence
  Synthetic oligonucleotide; TAG chr2 60490407 60490426 60490410 -
acggggaactaagactggaa

SEQ ID NO: 180199 - DNA, 20 bp, Artificial Sequence
  Synthetic oligonucleotide; TGG chr2 60490399 60490418 60490402 -
ctaagactggaatagaaaat

SEQ ID NO: 180200 - DNA, 20 bp, Artificial Sequence
  Synthetic oligonucleotide; GAG chr2 60490397 60490416 60490400 -
aagactggaatagaaaattg

SEQ ID NO: 180201 - DNA, 20 bp, Artificial Sequence
  Synthetic oligonucleotide; TGG chr2 60490393 60490412 60490396 -
ctggaatagaaaattggagt

SEQ ID NO: 180202 - DNA, 20 bp, Artificial Sequence
  Synthetic oligonucleotide; TGG chr2 60490386 60490405 60490389 -
agaaaattggagttggattg

SEQ ID NO: 180203 - DNA, 20 bp, Artificial Sequence
  Synthetic oligonucleotide; GAG chr2 60490384 60490403 60490387 -
aaaattggagttggattgtg

SEQ ID NO: 180204 - DNA, 20 bp, Artificial Sequence
  Synthetic oligonucleotide; TGG chr2 60490378 60490397 60490381 -
ggagttggattgtggagctc

SEQ ID NO: 180205 - DNA, 20 bp, Artificial Sequence
  Synthetic oligonucleotide; TGG chr2 60490370 60490389 60490373 -
attgtggagctctggaatga

SEQ ID NO: 180206 - DNA, 20 bp, Artificial Sequence
  Synthetic oligonucleotide; AAG chr2 60490364 60490383 60490367 -
gagctctggaatgatggctt

SEQ ID NO: 180207 - DNA, 20 bp, Artificial Sequence
  Synthetic oligonucleotide; AGG chr2 60490363 60490382 60490366 -
agctctggaatgatggctta

SEQ ID NO: 180208 - DNA, 20 bp, Artificial Sequence
  Synthetic oligonucleotide; GAG chr2 60490361 60490380 60490364 -
ctctggaatgatggcttaag

SEQ ID NO: 180209 - DNA, 20 bp, Artificial Sequence
  Synthetic oligonucleotide; TGG chr2 60490357 60490376 60490360 -
ggaatgatggcttaaggagt

SEQ ID NO: 180210 - DNA, 20 bp, Artificial Sequence
  Synthetic oligonucleotide; TAG chr2 60490343 60490362 60490346 -
aggagttggaccatatccta

SEQ ID NO: 180211 - DNA, 20 bp, Artificial Sequence
  Synthetic oligonucleotide; CAG chr2 60490336 60490355 60490339 -
ggaccatatcctatagatca

SEQ ID NO: 180212 - DNA, 20 bp, Artificial Sequence
  Synthetic oligonucleotide; GAG chr2 60490334 60490353 60490337 -
accatatcctatagatcaca

SEQ ID NO: 180213 - DNA, 20 bp, Artificial Sequence
  Synthetic oligonucleotide; AGG chr2 60490333 60490352 60490336 -
ccatatcctatagatcacag

SEQ ID NO: 180214 - DNA, 20 bp, Artificial Sequence
  Synthetic oligonucleotide; GGG chr2 60490332 60490351 60490335 -
catatcctatagatcacaga

SEQ ID NO: 180215 - DNA, 20 bp, Artificial Sequence
  Synthetic oligonucleotide; CAG chr2 60490311 60490330 60490314 -
ggctgctgaaatactctgat

SEQ ID NO: 180216 - DNA, 20 bp, Artificial Sequence
  Synthetic oligonucleotide; AAG chr2 60490308 60490327 60490311 -
tgctgaaatactctgatcag

SEQ ID NO: 180217 - DNA, 20 bp, Artificial Sequence
  Synthetic oligonucleotide; AAG chr2 60490302 60490321 60490305 -
aatactctgatcagaagaca

SEQ ID NO: 180218 - DNA, 20 bp, Artificial Sequence
  Synthetic oligonucleotide; AGG chr2 60490301 60490320 60490304 -
atactctgatcagaagacaa

SEQ ID NO: 180219 - DNA, 20 bp, Artificial Sequence
  Synthetic oligonucleotide; CAG chr2 60490298 60490317 60490301 -
ctctgatcagaagacaaagg

SEQ ID NO: 180220 - DNA, 20 bp, Artificial Sequence
  Synthetic oligonucleotide; TAG chr2 60490290 60490309 60490293 -
agaagacaaaggcagcatgc

SEQ ID NO: 180221 - DNA, 20 bp, Artificial Sequence
  Synthetic oligonucleotide; AGG chr2 60490289 60490308 60490292 -
gaagacaaaggcagcatgct

SEQ ID NO: 180222 - DNA, 20 bp, Artificial Sequence
  Synthetic oligonucleotide; GGG chr2 60490288 60490307 60490291 -
aagacaaaggcagcatgcta

SEQ ID NO: 180223 - DNA, 20 bp, Artificial Sequence
  Synthetic oligonucleotide; GGG chr2 60490287 60490306 60490290 -
agacaaaggcagcatgctag

SEQ ID NO: 180224 - DNA, 20 bp, Artificial Sequence
  Synthetic oligonucleotide; AAG chr2 60490279 60490298 60490282 -
gcagcatgctaggggatgtt

SEQ ID NO: 180225 - DNA, 20 bp, Artificial Sequence
  Synthetic oligonucleotide; GAG chr2 60490275 60490294 60490278 -
catgctaggggatgttaagt

SEQ ID NO: 180226 - DNA, 20 bp, Artificial Sequence
  Synthetic oligonucleotide; AGG chr2 60490274 60490293 60490277 -
atgctaggggatgttaagtg

SEQ ID NO: 180227 - DNA, 20 bp, Artificial Sequence
  Synthetic oligonucleotide; AAG chr2 60490263 60490282 60490266 -
tgttaagtgaggactctgca

SEQ ID NO: 180228 - DNA, 20 bp, Artificial Sequence
  Synthetic oligonucleotide; AGG chr2 60490262 60490281 60490265 -
gttaagtgaggactctgcaa

SEQ ID NO: 180229 - DNA, 20 bp, Artificial Sequence
  Synthetic oligonucleotide; GGG chr2 60490261 60490280 60490264 -
ttaagtgaggactctgcaaa

SEQ ID NO: 180230 - DNA, 20 bp, Artificial Sequence
  Synthetic oligonucleotide; GGG chr2 60490260 60490279 60490263 -
taagtgaggactctgcaaag

SEQ ID NO: 180231 - DNA, 20 bp, Artificial Sequence
  Synthetic oligonucleotide; GGG chr2 60490259 60490278 60490262 -
aagtgaggactctgcaaagg

SEQ ID NO: 180232 - DNA, 20 bp, Artificial Sequence
  Synthetic oligonucleotide; TGG chr2 60490256 60490275 60490259 -
tgaggactctgcaaaggggg

SEQ ID NO: 180233 - DNA, 20 bp, Artificial Sequence
  Synthetic oligonucleotide; GAG chr2 60490251 60490270 60490254 -
actctgcaaagggggtggat

SEQ ID NO: 180234 - DNA, 20 bp, Artificial Sequence
  Synthetic oligonucleotide; GAG chr2 60490216 60490235 60490219 -
tctgttatacccttcatgcc

SEQ ID NO: 180235 - DNA, 20 bp, Artificial Sequence
  Synthetic oligonucleotide; TAG chr2 60490188 60490207 60490191 -
ccctgttgacttatatgttc

SEQ ID NO: 180236 - DNA, 20 bp, Artificial Sequence
  Synthetic oligonucleotide; GAG chr2 60490186 60490205 60490189 -
ctgttgacttatatgttcta

SEQ ID NO: 180237 - DNA, 20 bp, Artificial Sequence
  Synthetic oligonucleotide; AGG chr2 60490185 60490204 60490188 -
tgttgacttatatgttctag

SEQ ID NO: 180238 - DNA, 20 bp, Artificial Sequence
  Synthetic oligonucleotide; TGG chr2 60490181 60490200 60490184 -
gacttatatgttctagagga

SEQ ID NO: 180239 - DNA, 20 bp, Artificial Sequence
  Synthetic oligonucleotide; GAG chr2 60490179 60490198 60490182 -
cttatatgttctagaggatg

SEQ ID NO: 180240 - DNA, 20 bp, Artificial Sequence
  Synthetic oligonucleotide; TGG chr2 60490175 60490194 60490178 -
tatgttctagaggatggagt

SEQ ID NO: 180241 - DNA, 20 bp, Artificial Sequence
  Synthetic oligonucleotide; TAG chr2 60490165 60490184 60490168 -
aggatggagttggttgaccg

SEQ ID NO: 180242 - DNA, 20 bp, Artificial Sequence
  Synthetic oligonucleotide; AGG chr2 60490164 60490183 60490167 -
ggatggagttggttgaccgt

SEQ ID NO: 180243 - DNA, 20 bp, Artificial Sequence
  Synthetic oligonucleotide; GGG chr2 60490163 60490182 60490166 -
gatggagttggttgaccgta

SEQ ID NO: 180244 - DNA, 20 bp, Artificial Sequence
  Synthetic oligonucleotide; TAG chr2 60490149 60490168 60490152 -
accgtagggtttcctttcac

SEQ ID NO: 180245 - DNA, 20 bp, Artificial Sequence
  Synthetic oligonucleotide; CAG chr2 60490146 60490165 60490149 -
gtagggtttcctttcactag

SEQ ID NO: 180246 - DNA, 20 bp, Artificial Sequence
  Synthetic oligonucleotide; TGG chr2 60490141 60490160 60490144 -
gtttcctttcactagcagaa

SEQ ID NO: 180247 - DNA, 20 bp, Artificial Sequence
  Synthetic oligonucleotide; CAG chr2 60490135 60490154 60490138 -
tttcactagcagaatggaac

SEQ ID NO: 180248 - DNA, 20 bp, Artificial Sequence
  Synthetic oligonucleotide; TAG chr2 60490126 60490145 60490129 -
cagaatggaaccagatattg

SEQ ID NO: 180249 - DNA, 20 bp, Artificial Sequence
  Synthetic oligonucleotide; AGG chr2 60490125 60490144 60490128 -
agaatggaaccagatattgt

SEQ ID NO: 180250 - DNA, 20 bp, Artificial Sequence
  Synthetic oligonucleotide; GAG chr2 60490123 60490142 60490126 -
aatggaaccagatattgtag

SEQ ID NO: 180251 - DNA, 20 bp, Artificial Sequence
  Synthetic oligonucleotide; TAG chr2 60490118 60490137 60490121 -
aaccagatattgtaggagcc

SEQ ID NO: 180252 - DNA, 20 bp, Artificial Sequence
  Synthetic oligonucleotide; TGG chr2 60490111 60490130 60490114 -
tattgtaggagcctagcaca

SEQ ID NO: 180253 - DNA, 20 bp, Artificial Sequence
  Synthetic oligonucleotide; GGG chr2 60490110 60490129 60490113 -
attgtaggagcctagcacat

SEQ ID NO: 180254 - DNA, 20 bp, Artificial Sequence
  Synthetic oligonucleotide; TAG chr2 60490094 60490113 60490097 -
acatgggtctgttactaata

SEQ ID NO: 180255 - DNA, 20 bp, Artificial Sequence
  Synthetic oligonucleotide; GAG chr2 60490092 60490111 60490095 -
atgggtctgttactaatata

SEQ ID NO: 180256 - DNA, 20 bp, Artificial Sequence
  Synthetic oligonucleotide; AGG chr2 60490091 60490110 60490094 -
tgggtctgttactaatatag

SEQ ID NO: 180257 - DNA, 20 bp, Artificial Sequence
  Synthetic oligonucleotide; TGG chr2 60490075 60490094 60490078 -
atagaggactgtttaaatct

SEQ ID NO: 180258 - DNA, 20 bp, Artificial Sequence
  Synthetic oligonucleotide; AAG chr2 60490071 60490090 60490074 -
aggactgtttaaatcttgga

SEQ ID NO: 180259 - DNA, 20 bp, Artificial Sequence
  Synthetic oligonucleotide; CAG chr2 60490042 60490061 60490045 -
ttttgcctttgcccccattg

SEQ ID NO: 180260 - DNA, 20 bp, Artificial Sequence
  Synthetic oligonucleotide; TGG chr2 60490038 60490057 60490041 -
gcctttgcccccattgcaga

SEQ ID NO: 180261 - DNA, 20 bp, Artificial Sequence
  Synthetic oligonucleotide; GGG chr2 60490037 60490056 60490040 -
cctttgcccccattgcagat

SEQ ID NO: 180262 - DNA, 20 bp, Artificial Sequence
  Synthetic oligonucleotide; GGG chr2 60490036 60490055 60490039 -
ctttgcccccattgcagatg

SEQ ID NO: 180263 - DNA, 20 bp, Artificial Sequence
  Synthetic oligonucleotide; GAG chr2 60490034 60490053 60490037 -
ttgcccccattgcagatggg

SEQ ID NO: 180264 - DNA, 20 bp, Artificial Sequence
  Synthetic oligonucleotide; TGG chr2 60490031 60490050 60490034 -
cccccattgcagatggggag

SEQ ID NO: 180265 - DNA, 20 bp, Artificial Sequence
  Synthetic oligonucleotide; GGG chr2 60490030 60490049 60490033 -
ccccattgcagatggggagt

SEQ ID NO: 180266 - DNA, 20 bp, Artificial Sequence
  Synthetic oligonucleotide; CAG chr2 60490027 60490046 60490030 -
cattgcagatggggagtggg

SEQ ID NO: 180267 - DNA, 20 bp, Artificial Sequence
  Synthetic oligonucleotide; AGG chr2 60490026 60490045 60490029 -
attgcagatggggagtgggc

SEQ ID NO: 180268 - DNA, 20 bp, Artificial Sequence
  Synthetic oligonucleotide; CAG chr2 60490014 60490033 60490017 -
gagtgggcaggaatgacgtt

SEQ ID NO: 180269 - DNA, 20 bp, Artificial Sequence
  Synthetic oligonucleotide; AAG chr2 60490007 60490026 60490010 -
caggaatgacgttcagaatc

SEQ ID NO: 180270 - DNA, 20 bp, Artificial Sequence
  Synthetic oligonucleotide; AGG chr2 60490006 60490025 60490009 -
aggaatgacgttcagaatca

SEQ ID NO: 180271 - DNA, 20 bp, Artificial Sequence
  Synthetic oligonucleotide; GGG chr2 60490005 60490024 60490008 -
ggaatgacgttcagaatcaa

SEQ ID NO: 180272 - DNA, 20 bp, Artificial Sequence
  Synthetic oligonucleotide; CAG chr2 60489997 60490016 60490000 -
gttcagaatcaagggcccat

SEQ ID NO: 180273 - DNA, 20 bp, Artificial Sequence
  Synthetic oligonucleotide; AGG chr2 60489996 60490015 60489999 -
ttcagaatcaagggcccatc

SEQ ID NO: 180274 - DNA, 20 bp, Artificial Sequence
  Synthetic oligonucleotide; GGG chr2 60489995 60490014 60489998 -
tcagaatcaagggcccatca

SEQ ID NO: 180275 - DNA, 20 bp, Artificial Sequence
  Synthetic oligonucleotide; TGG chr2 60489985 60490004 60489988 -
gggcccatcagggtctgtat

SEQ ID NO: 180276 - DNA, 20 bp, Artificial Sequence
  Synthetic oligonucleotide; CAG chr2 60489964 60489983 60489967 -
ggtcccttgtccctctcctc

SEQ ID NO: 180277 - DNA, 20 bp, Artificial Sequence
  Synthetic oligonucleotide; TGG chr2 60489950 60489969 60489953 -
ctcctccagtccatccatgt

SEQ ID NO: 180278 - DNA, 20 bp, Artificial Sequence
  Synthetic oligonucleotide; GGG chr2 60489949 60489968 60489952 -
tcctccagtccatccatgtt

SEQ ID NO: 180279 - DNA, 20 bp, Artificial Sequence
  Synthetic oligonucleotide; CAG chr2 60489941 60489960 60489944 -
tccatccatgttgggatact

SEQ ID NO: 180280 - DNA, 20 bp, Artificial Sequence
  Synthetic oligonucleotide; AGG chr2 60489940 60489959 60489943 -
ccatccatgttgggatactc

SEQ ID NO: 180281 - DNA, 20 bp, Artificial Sequence
  Synthetic oligonucleotide; GGG chr2 60489939 60489958 60489942 -
catccatgttgggatactca

SEQ ID NO: 180282 - DNA, 20 bp, Artificial Sequence
  Synthetic oligonucleotide; TGG chr2 60489934 60489953 60489937 -
atgttgggatactcagggca

SEQ ID NO: 180283 - DNA, 20 bp, Artificial Sequence
  Synthetic oligonucleotide; TGG chr2 60489930 60489949 60489933 -
tgggatactcagggcatgga

SEQ ID NO: 180284 - DNA, 20 bp, Artificial Sequence
  Synthetic oligonucleotide; TAG chr2 60489917 60489936 60489920 -
gcatggatggtgtttcatga

SEQ ID NO: 180285 - DNA, 20 bp, Artificial Sequence
  Synthetic oligonucleotide; AAG chr2 60489883 60489902 60489886 -
ttgatgatatgtgacaaaat

SEQ ID NO: 180286 - DNA, 20 bp, Artificial Sequence
  Synthetic oligonucleotide; AGG chr2 60489882 60489901 60489885 -
tgatgatatgtgacaaaata

SEQ ID NO: 180287 - DNA, 20 bp, Artificial Sequence
  Synthetic oligonucleotide; CAG chr2 60489879 60489898 60489882 -
tgatatgtgacaaaataagg

SEQ ID NO: 180288 - DNA, 20 bp, Artificial Sequence
  Synthetic oligonucleotide; AGG chr2 60489878 60489897 60489881 -
gatatgtgacaaaataaggc

SEQ ID NO: 180289 - DNA, 20 bp, Artificial Sequence
  Synthetic oligonucleotide; TAG chr2 60489841 60489860 60489844 -
tccctgtgatctctctttaa

SEQ ID NO: 180290 - DNA, 20 bp, Artificial Sequence
  Synthetic oligonucleotide; TGG chr2 60489825 60489844 60489828 -
ttaatagtgtcctcctgctt

SEQ ID NO: 180291 - DNA, 20 bp, Artificial Sequence
  Synthetic oligonucleotide; GGG chr2 60489824 60489843 60489827 -
taatagtgtcctcctgcttt

SEQ ID NO: 180292 - DNA, 20 bp, Artificial Sequence
  Synthetic oligonucleotide; GGG chr2 60489823 60489842 60489826 -
aatagtgtcctcctgctttg

SEQ ID NO: 180293 - DNA, 20 bp, Artificial Sequence
  Synthetic oligonucleotide; GGG chr2 60489822 60489841 60489825 -
atagtgtcctcctgctttgg

SEQ ID NO: 180294 - DNA, 20 bp, Artificial Sequence
  Synthetic oligonucleotide; AAG chr2 60489814 60489833 60489817 -
ctcctgctttgggggttatt

SEQ ID NO: 180295 - DNA, 20 bp, Artificial Sequence
  Synthetic oligonucleotide; TAG chr2 60489810 60489829 60489813 -
tgctttgggggttattaagc

SEQ ID NO: 180296 - DNA, 20 bp, Artificial Sequence
  Synthetic oligonucleotide; GAG chr2 60489798 60489817 60489801 -
tattaagctagcctgaactt

SEQ ID NO: 180297 - DNA, 20 bp, Artificial Sequence
  Synthetic oligonucleotide; TGG chr2 60489785 60489804 60489788 -
tgaacttgagtaaacatttt

SEQ ID NO: 180298 - DNA, 20 bp, Artificial Sequence
  Synthetic oligonucleotide; TGG chr2 60489781 60489800 60489784 -
cttgagtaaacatttttgga

SEQ ID NO: 180299 - DNA, 20 bp, Artificial Sequence
  Synthetic oligonucleotide; GGG chr2 60489780 60489799 60489783 -
ttgagtaaacatttttggat

SEQ ID NO: 180300 - DNA, 20 bp, Artificial Sequence
  Synthetic oligonucleotide; GGG chr2 60489779 60489798 60489782 -
tgagtaaacatttttggatg

SEQ ID NO: 180301 - DNA, 20 bp, Artificial Sequence
  Synthetic oligonucleotide; GAG chr2 60489775 60489794 60489778 -
taaacatttttggatggggt

SEQ ID NO: 180302 - DNA, 20 bp, Artificial Sequence
  Synthetic oligonucleotide; GAG chr2 60489773 60489792 60489776 -
aacatttttggatggggtga

SEQ ID NO: 180303 - DNA, 20 bp, Artificial Sequence
  Synthetic oligonucleotide; AGG chr2 60489772 60489791 60489775 -
acatttttggatggggtgag

SEQ ID NO: 180304 - DNA, 20 bp, Artificial Sequence
  Synthetic oligonucleotide; GGG chr2 60489771 60489790 60489774 -
catttttggatggggtgaga

SEQ ID NO: 180305 - DNA, 20 bp, Artificial Sequence
  Synthetic oligonucleotide; GGG chr2 60489770 60489789 60489773 -
atttttggatggggtgagag

SEQ ID NO: 180306 - DNA, 20 bp, Artificial Sequence
  Synthetic oligonucleotide; GGG chr2 60489769 60489788 60489772 -
tttttggatggggtgagagg

SEQ ID NO: 180307 - DNA, 20 bp, Artificial Sequence
  Synthetic oligonucleotide; GGG chr2 60489768 60489787 60489771 -
ttttggatggggtgagaggg

SEQ ID NO: 180308 - DNA, 20 bp, Artificial Sequence
  Synthetic oligonucleotide; AAG chr2 60489758 60489777 60489761 -
ggtgagaggggggctgataa

SEQ ID NO: 180309 - DNA, 20 bp, Artificial Sequence
  Synthetic oligonucleotide; TGG chr2 60489755 60489774 60489758 -
gagaggggggctgataaaag

SEQ ID NO: 180310 - DNA, 20 bp, Artificial Sequence
  Synthetic oligonucleotide; TAG chr2 60489751 60489770 60489754 -
ggggggctgataaaagtggt

SEQ ID NO: 180311 - DNA, 20 bp, Artificial Sequence
  Synthetic oligonucleotide; TAG chr2 60489744 60489763 60489747 -
tgataaaagtggttagtaaa

SEQ ID NO: 180312 - DNA, 20 bp, Artificial Sequence
  Synthetic oligonucleotide; CAG chr2 60489740 60489759 60489743 -
aaaagtggttagtaaataga

SEQ ID NO: 180313 - DNA, 20 bp, Artificial Sequence
  Synthetic oligonucleotide; TGG chr2 60489736 60489755 60489739 -
gtggttagtaaatagacagt

SEQ ID NO: 180314 - DNA, 20 bp, Artificial Sequence
  Synthetic oligonucleotide; AAG chr2 60489732 60489751 60489735 -
ttagtaaatagacagttgga

SEQ ID NO: 180315 - DNA, 20 bp, Artificial Sequence
  Synthetic oligonucleotide; AGG chr2 60489731 60489750 60489734 -
tagtaaatagacagttggaa

SEQ ID NO: 180316 - DNA, 20 bp, Artificial Sequence
  Synthetic oligonucleotide; GAG chr2 60489729 60489748 60489732 -
gtaaatagacagttggaaag

SEQ ID NO: 180317 - DNA, 20 bp, Artificial Sequence
  Synthetic oligonucleotide; CGG chr2 60489724 60489743 60489727 -
tagacagttggaaaggagaa

SEQ ID NO: 180318 - DNA, 20 bp, Artificial Sequence
  Synthetic oligonucleotide; CGG chr2 60489719 60489738 60489722 -
agttggaaaggagaacggcc

SEQ ID NO: 180319 - DNA, 20 bp, Artificial Sequence
  Synthetic oligonucleotide; GGG chr2 60489718 60489737 60489721 -
gttggaaaggagaacggccc

SEQ ID NO: 180320 - DNA, 20 bp, Artificial Sequence
  Synthetic oligonucleotide; GGG chr2 60489717 60489736 60489720 -
ttggaaaggagaacggcccg

SEQ ID NO: 180321 - DNA, 20 bp, Artificial Sequence
  Synthetic oligonucleotide; GGG chr2 60489716 60489735 60489719 -
tggaaaggagaacggcccgg

SEQ ID NO: 180322 - DNA, 20 bp, Artificial Sequence
  Synthetic oligonucleotide; CAG chr2 60489711 60489730 60489714 -
aggagaacggcccgggggct

SEQ ID NO: 180323 - DNA, 20 bp, Artificial Sequence
  Synthetic oligonucleotide; AGG chr2 60489710 60489729 60489713 -
ggagaacggcccgggggctc

SEQ ID NO: 180324 - DNA, 20 bp, Artificial Sequence
  Synthetic oligonucleotide; GAG chr2 60489708 60489727 60489711 -
agaacggcccgggggctcag

SEQ ID NO: 180325 - DNA, 20 bp, Artificial Sequence
  Synthetic oligonucleotide; GAG chr2 60489703 60489722 60489706 -
ggcccgggggctcaggagat

SEQ ID NO: 180326 - DNA, 20 bp, Artificial Sequence
  Synthetic oligonucleotide; CAG chr2 60489699 60489718 60489702 -
cgggggctcaggagatgagc

SEQ ID NO: 180327 - DNA, 20 bp, Artificial Sequence
  Synthetic oligonucleotide; AGG chr2 60489698 60489717 60489701 -
gggggctcaggagatgagcc

SEQ ID NO: 180328 - DNA, 20 bp, Artificial Sequence
  Synthetic oligonucleotide; GGG chr2 60489697 60489716 60489700 -
ggggctcaggagatgagcca

SEQ ID NO: 180329 - DNA, 20 bp, Artificial Sequence
  Synthetic oligonucleotide; AAG chr2 60489691 60489710 60489694 -
caggagatgagccagggaac

SEQ ID NO: 180330 - DNA, 20 bp, Artificial Sequence
  Synthetic oligonucleotide; AGG chr2 60489690 60489709 60489693 -
aggagatgagccagggaaca

SEQ ID NO: 180331 - DNA, 20 bp, Artificial Sequence
  Synthetic oligonucleotide; AAG chr2 60489686 60489705 60489689 -
gatgagccagggaacaagga

SEQ ID NO: 180332 - DNA, 20 bp, Artificial Sequence
  Synthetic oligonucleotide; CAG chr2 60489683 60489702 60489686 -
gagccagggaacaaggaaag

SEQ ID NO: 180333 - DNA, 20 bp, Artificial Sequence
  Synthetic oligonucleotide; GAG chr2 60489681 60489700 60489684 -
gccagggaacaaggaaagca

SEQ ID NO: 180334 - DNA, 20 bp, Artificial Sequence
  Synthetic oligonucleotide; TAG chr2 60489674 60489693 60489677 -
aacaaggaaagcagagatgc

SEQ ID NO: 180335 - DNA, 20 bp, Artificial Sequence
  Synthetic oligonucleotide; CAG chr2 60489666 60489685 60489669 -
aagcagagatgctagtgacc

SEQ ID NO: 180336 - DNA, 20 bp, Artificial Sequence
  Synthetic oligonucleotide; GAG chr2 60489664 60489683 60489667 -
gcagagatgctagtgaccca

SEQ ID NO: 180337 - DNA, 20 bp, Artificial Sequence
  Synthetic oligonucleotide; TAG chr2 60489656 60489675 60489659 -
gctagtgacccagagtgtcc

SEQ ID NO: 180338 - DNA, 20 bp, Artificial Sequence
  Synthetic oligonucleotide; GAG chr2 60489654 60489673 60489657 -
tagtgacccagagtgtccta

SEQ ID NO: 180339 - DNA, 20 bp, Artificial Sequence
  Synthetic oligonucleotide; AGG chr2 60489653 60489672 60489656 -
agtgacccagagtgtcctag

SEQ ID NO: 180340 - DNA, 20 bp, Artificial Sequence
  Synthetic oligonucleotide; GGG chr2 60489652 60489671 60489655 -
gtgacccagagtgtcctaga

SEQ ID NO: 180341 - DNA, 20 bp, Artificial Sequence
  Synthetic oligonucleotide; GGG chr2 60489651 60489670 60489654 -
tgacccagagtgtcctagag

SEQ ID NO: 180342 - DNA, 20 bp, Artificial Sequence
  Synthetic oligonucleotide; AAG chr2 60489647 60489666 60489650 -
ccagagtgtcctagagggga

SEQ ID NO: 180343 - DNA, 20 bp, Artificial Sequence
  Synthetic oligonucleotide; TAG chr2 60489635 60489654 60489638 -
agaggggaaagaacctctgt

SEQ ID NO: 180344 - DNA, 20 bp, Artificial Sequence
  Synthetic oligonucleotide; CAG chr2 60489620 60489639 60489623 -
tctgttagaatttcaaatgt

SEQ ID NO: 180345 - DNA, 20 bp, Artificial Sequence
  Synthetic oligonucleotide; CAG chr2 60489607 60489626 60489610 -
caaatgtcagactttctttt

SEQ ID NO: 180346 - DNA, 20 bp, Artificial Sequence
  Synthetic oligonucleotide; CAG chr2 60489597 60489616 60489600 -
actttcttttcagcttcctt

SEQ ID NO: 180347 - DNA, 20 bp, Artificial Sequence
  Synthetic oligonucleotide; AGG chr2 60489596 60489615 60489599 -
ctttcttttcagcttccttc

SEQ ID NO: 180348 - DNA, 20 bp, Artificial Sequence
  Synthetic oligonucleotide; CAG chr2 60489577 60489596 60489580 -
caggtgcttcctcttctact

SEQ ID NO: 180349 - DNA, 20 bp, Artificial Sequence
  Synthetic oligonucleotide; GAG chr2 60489563 60489582 60489566 -
tctactcagaattttctttt

SEQ ID NO: 180350 - DNA, 20 bp, Artificial Sequence
  Synthetic oligonucleotide; TAG chr2 60489559 60489578 60489562 -
ctcagaattttcttttgaga

SEQ ID NO: 180351 - DNA, 20 bp, Artificial Sequence
  Synthetic oligonucleotide; AGG chr2 60489558 60489577 60489561 -
tcagaattttcttttgagat

SEQ ID NO: 180352 - DNA, 20 bp, Artificial Sequence
  Synthetic oligonucleotide; TGG chr2 60489552 60489571 60489555 -
ttttcttttgagataggtgc

SEQ ID NO: 180353 - DNA, 20 bp, Artificial Sequence
  Synthetic oligonucleotide; AAG chr2 60489543 60489562 60489546 -
gagataggtgctggtcaaac

SEQ ID NO: 180354 - DNA, 20 bp, Artificial Sequence
  Synthetic oligonucleotide; TGG chr2 60489530 60489549 60489533 -
gtcaaacaagcttttgtttg

SEQ ID NO: 180355 - DNA, 20 bp, Artificial Sequence
  Synthetic oligonucleotide; TGG chr2 60489526 60489545 60489529 -
aacaagcttttgtttgtggc

SEQ ID NO: 180356 - DNA, 20 bp, Artificial Sequence
  Synthetic oligonucleotide; TGG chr2 60489518 60489537 60489521 -
tttgtttgtggctggtcact

SEQ ID NO: 180357 - DNA, 20 bp, Artificial Sequence
  Synthetic oligonucleotide; CAG chr2 60489511 60489530 60489514 -
gtggctggtcacttggcaca

SEQ ID NO: 180358 - DNA, 20 bp, Artificial Sequence
  Synthetic oligonucleotide; TGG chr2 60489506 60489525 60489509 -
tggtcacttggcacacagtg

SEQ ID NO: 180359 - DNA, 20 bp, Artificial Sequence
  Synthetic oligonucleotide; TGG chr2 60489490 60489509 60489493 -
agtgtggctgtttgtcatcc

SEQ ID NO: 180360 - DNA, 20 bp, Artificial Sequence
  Synthetic oligonucleotide; GAG chr2 60489482 60489501 60489485 -
tgtttgtcatcctggatgat

SEQ ID NO: 180361 - DNA, 20 bp, Artificial Sequence
  Synthetic oligonucleotide; AGG chr2 60489481 60489500 60489484 -
gtttgtcatcctggatgatg

SEQ ID NO: 180362 - DNA, 20 bp, Artificial Sequence
  Synthetic oligonucleotide; CAG chr2 60489478 60489497 60489481 -
tgtcatcctggatgatgagg

SEQ ID NO: 180363 - DNA, 20 bp, Artificial Sequence
  Synthetic oligonucleotide; TGG chr2 60489466 60489485 60489469 -
tgatgaggcagctattttaa

SEQ ID NO: 180364 - DNA, 20 bp, Artificial Sequence
  Synthetic oligonucleotide; CAG chr2 60489459 60489478 60489462 -
gcagctattttaatggcacg

SEQ ID NO: 180365 - DNA, 20 bp, Artificial Sequence
  Synthetic oligonucleotide; AGG chr2 60489458 60489477 60489461 -
cagctattttaatggcacgc

SEQ ID NO: 180366 - DNA, 20 bp, Artificial Sequence
  Synthetic oligonucleotide; GGG chr2 60489457 60489476 60489460 -
agctattttaatggcacgca

SEQ ID NO: 180367 - DNA, 20 bp, Artificial Sequence
  Synthetic oligonucleotide; AAG chr2 60489435 60489454 60489438 -
gccgccgtgtgtttactgcc

SEQ ID NO: 180368 - DNA, 20 bp, Artificial Sequence
  Synthetic oligonucleotide; AAG chr2 60489428 60489447 60489431 -
tgtgtttactgccaagaaat

SEQ ID NO: 180369 - DNA, 20 bp, Artificial Sequence
  Synthetic oligonucleotide; AGG chr2 60489427 60489446 60489430 -
gtgtttactgccaagaaata

SEQ ID NO: 180370 - DNA, 20 bp, Artificial Sequence
  Synthetic oligonucleotide; GGG chr2 60489426 60489445 60489429 -
tgtttactgccaagaaataa

SEQ ID NO: 180371 - DNA, 20 bp, Artificial Sequence
  Synthetic oligonucleotide; TAG chr2 60489419 60489438 60489422 -
tgccaagaaataagggcttc

SEQ ID NO: 180372 - DNA, 20 bp, Artificial Sequence
  Synthetic oligonucleotide; AGG chr2 60489418 60489437 60489421 -
gccaagaaataagggcttct

SEQ ID NO: 180373 - DNA, 20 bp, Artificial Sequence
  Synthetic oligonucleotide; GAG chr2 60489416 60489435 60489419 -
caagaaataagggcttctag

SEQ ID NO: 180374 - DNA, 20 bp, Artificial Sequence
  Synthetic oligonucleotide; TGG chr2 60489410 60489429 60489413 -
ataagggcttctaggagact

SEQ ID NO: 180375 - DNA, 20 bp, Artificial Sequence
  Synthetic oligonucleotide; TGG chr2 60489407 60489426 60489410 -
agggcttctaggagacttgg

SEQ ID NO: 180376 - DNA, 20 bp, Artificial Sequence
  Synthetic oligonucleotide; TAG chr2 60489401 60489420 60489404 -
tctaggagacttggtggctt

SEQ ID NO: 180377 - DNA, 20 bp, Artificial Sequence
  Synthetic oligonucleotide; AGG chr2 60489400 60489419 60489403 -
ctaggagacttggtggcttt

SEQ ID NO: 180378 - DNA, 20 bp, Artificial Sequence
  Synthetic oligonucleotide; CAG chr2 60489387 60489406 60489390 -
tggctttaggaacaaacttc

SEQ ID NO: 180379 - DNA, 20 bp, Artificial Sequence
  Synthetic oligonucleotide; CGG chr2 60489384 60489403 60489387 -
ctttaggaacaaacttccag

SEQ ID NO: 180380 - DNA, 20 bp, Artificial Sequence
  Synthetic oligonucleotide; CAG chr2 60489381 60489400 60489384 -
taggaacaaacttccagcgg

SEQ ID NO: 180381 - DNA, 20 bp, Artificial Sequence
  Synthetic oligonucleotide; TAG chr2 60489374 60489393 60489377 -
aaacttccagcggcagaaat

SEQ ID NO: 180382 - DNA, 20 bp, Artificial Sequence
  Synthetic oligonucleotide; TAG chr2 60489370 60489389 60489373 -
ttccagcggcagaaattagt

SEQ ID NO: 180383 - DNA, 20 bp, Artificial Sequence
  Synthetic oligonucleotide; AGG chr2 60489369 60489388 60489372 -
tccagcggcagaaattagtt

SEQ ID NO: 180384 - DNA, 20 bp, Artificial Sequence
  Synthetic oligonucleotide; AAG chr2 60489366 60489385 60489369 -
agcggcagaaattagttagg

SEQ ID NO: 180385 - DNA, 20 bp, Artificial Sequence
  Synthetic oligonucleotide; CAG chr2 60489363 60489382 60489366 -
ggcagaaattagttaggaag

SEQ ID NO: 180386 - DNA, 20 bp, Artificial Sequence
  Synthetic oligonucleotide; GAG chr2 60489361 60489380 60489364 -
cagaaattagttaggaagca

SEQ ID NO: 180387 - DNA, 20 bp, Artificial Sequence
  Synthetic oligonucleotide; TAG chr2 60489358 60489377 60489361 -
aaattagttaggaagcagag

SEQ ID NO: 180388 - DNA, 20 bp, Artificial Sequence
  Synthetic oligonucleotide; TGG chr2 60489352 60489371 60489355 -
gttaggaagcagagtagcac

SEQ ID NO: 180389 - DNA, 20 bp, Artificial Sequence
  Synthetic oligonucleotide; GGG chr2 60489351 60489370 60489354 -
ttaggaagcagagtagcact

SEQ ID NO: 180390 - DNA, 20 bp, Artificial Sequence
  Synthetic oligonucleotide; TGG chr2 60489322 60489341 60489325 -
atgcctctattgtatgaatt

SEQ ID NO: 180391 - DNA, 20 bp, Artificial Sequence
  Synthetic oligonucleotide; TGG chr2 60489311 60489330 60489314 -
gtatgaatttggatatgttg

SEQ ID NO: 180392 - DNA, 20 bp, Artificial Sequence
  Synthetic oligonucleotide; GGG chr2 60489310 60489329 60489313 -
tatgaatttggatatgttgt

SEQ ID NO: 180393 - DNA, 20 bp, Artificial Sequence
  Synthetic oligonucleotide; AAG chr2 60489294 60489313 60489297 -
ttgtgggcaaaatgacataa

SEQ ID NO: 180394 - DNA, 20 bp, Artificial Sequence
  Synthetic oligonucleotide; TGG chr2 60489288 60489307 60489291 -
gcaaaatgacataaaagaaa

SEQ ID NO: 180395 - DNA, 20 bp, Artificial Sequence
  Synthetic oligonucleotide; GAG chr2 60489282 60489301 60489285 -
tgacataaaagaaatggaat

SEQ ID NO: 180396 - DNA, 20 bp, Artificial Sequence
  Synthetic oligonucleotide; TAG chr2 60489276 60489295 60489279 -
aaaagaaatggaatgagaaa

SEQ ID NO: 180397 - DNA, 20 bp, Artificial Sequence
  Synthetic oligonucleotide; AAG chr2 60489270 60489289 60489273 -
aatggaatgagaaatagtgt

SEQ ID NO: 180398 - DNA, 20 bp, Artificial Sequence
  Synthetic oligonucleotide; AAG chr2 60489259 60489278 60489262 -
aaatagtgtaagtgactgac

SEQ ID NO: 180399 - DNA, 20 bp, Artificial Sequence
  Synthetic oligonucleotide; AGG chr2 60489258 60489277 60489261 -
aatagtgtaagtgactgaca

SEQ ID NO: 180400 - DNA, 20 bp, Artificial Sequence
  Synthetic oligonucleotide; TGG chr2 60489248 60489267 60489251 -
gtgactgacaaggaccccat

SEQ ID NO: 180401 - DNA, 20 bp, Artificial Sequence
  Synthetic oligonucleotide; TGG chr2 60489241 60489260 60489244 -
acaaggaccccattggcatg

SEQ ID NO: 180402 - DNA, 20 bp, Artificial Sequence
  Synthetic oligonucleotide; GGG chr2 60489240 60489259 60489243 -
caaggaccccattggcatgt

SEQ ID NO: 180403 - DNA, 20 bp, Artificial Sequence
  Synthetic oligonucleotide; TAG chr2 60489236 60489255 60489239 -
gaccccattggcatgtgggc

SEQ ID NO: 180404 - DNA, 20 bp, Artificial Sequence
  Synthetic oligonucleotide; TGG chr2 60489226 60489245 60489229 -
gcatgtgggctagtgttgac

SEQ ID NO: 180405 - DNA, 20 bp, Artificial Sequence
  Synthetic oligonucleotide; CAG chr2 60489217 60489236 60489220 -
ctagtgttgactggctctca

SEQ ID NO: 180406 - DNA, 20 bp, Artificial Sequence
  Synthetic oligonucleotide; TAG chr2 60489206 60489225 60489209 -
tggctctcacagtgtgaatt

SEQ ID NO: 180407 - DNA, 20 bp, Artificial Sequence
  Synthetic oligonucleotide; TAG chr2 60489202 60489221 60489205 -
tctcacagtgtgaatttagt

SEQ ID NO: 180408 - DNA, 20 bp, Artificial Sequence
  Synthetic oligonucleotide; AGG chr2 60489201 60489220 60489204 -
ctcacagtgtgaatttagtt

SEQ ID NO: 180409 - DNA, 20 bp, Artificial Sequence
  Synthetic oligonucleotide; AAG chr2 60489169 60489188 60489172 -
tttattttccccaaactcta

SEQ ID NO: 180410 - DNA, 20 bp, Artificial Sequence
  Synthetic oligonucleotide; CAG chr2 60489163 60489182 60489166 -
ttccccaaactctaaagcaa

SEQ ID NO: 180411 - DNA, 20 bp, Artificial Sequence
  Synthetic oligonucleotide; TGG chr2 60489154 60489173 60489157 -
ctctaaagcaacagtttaat

SEQ ID NO: 180412 - DNA, 20 bp, Artificial Sequence
  Synthetic oligonucleotide; GGG chr2 60489153 60489172 60489156 -
tctaaagcaacagtttaatt

SEQ ID NO: 180413 - DNA, 20 bp, Artificial Sequence
  Synthetic oligonucleotide; GGG chr2 60489152 60489171 60489155 -
ctaaagcaacagtttaattg

SEQ ID NO: 180414 - DNA, 20 bp, Artificial Sequence
  Synthetic oligonucleotide; AAG chr2 60489146 60489165 60489149 -
caacagtttaattggggtct

SEQ ID NO: 180415 - DNA, 20 bp, Artificial Sequence
  Synthetic oligonucleotide; AGG chr2 60489145 60489164 60489148 -
aacagtttaattggggtcta

SEQ ID NO: 180416 - DNA, 20 bp, Artificial Sequence
  Synthetic oligonucleotide; TAG chr2 60489135 60489154 60489138 -
ttggggtctaaggtaccctt

SEQ ID NO: 180417 - DNA, 20 bp, Artificial Sequence
  Synthetic oligonucleotide; TAG chr2 60489109 60489128 60489112 -
cattttgaccacctattatt

SEQ ID NO: 180418 - DNA, 20 bp, Artificial Sequence
  Synthetic oligonucleotide; AGG chr2 60489108 60489127 60489111 -
attttgaccacctattattt

SEQ ID NO: 180419 - DNA, 20 bp, Artificial Sequence
  Synthetic oligonucleotide; CAG chr2 60489100 60489119 60489103 -
cacctattatttaggacaca

SEQ ID NO: 180420 - DNA, 20 bp, Artificial Sequence
  Synthetic oligonucleotide; AAG chr2 60489082 60489101 60489085 -
cacagcattttttttctttg

SEQ ID NO: 180421 - DNA, 20 bp, Artificial Sequence
  Synthetic oligonucleotide; TGG chr2 60489067 60489086 60489070 -
ctttgaagataaatttgttt

SEQ ID NO: 180422 - DNA, 20 bp, Artificial Sequence
  Synthetic oligonucleotide; GGG chr2 60489066 60489085 60489069 -
tttgaagataaatttgtttt

SEQ ID NO: 180423 - DNA, 20 bp, Artificial Sequence
  Synthetic oligonucleotide; TGG chr2 60489061 60489080 60489064 -
agataaatttgttttgggta

SEQ ID NO: 180424 - DNA, 20 bp, Artificial Sequence
  Synthetic oligonucleotide; TGG chr2 60489057 60489076 60489060 -
aaatttgttttgggtatggc

SEQ ID NO: 180425 - DNA, 20 bp, Artificial Sequence
  Synthetic oligonucleotide; GGG chr2 60489056 60489075 60489059 -
aatttgttttgggtatggct

SEQ ID NO: 180426 - DNA, 20 bp, Artificial Sequence
  Synthetic oligonucleotide; TGG chr2 60489051 60489070 60489054 -
gttttgggtatggctgggtg

SEQ ID NO: 180427 - DNA, 20 bp, Artificial Sequence
  Synthetic oligonucleotide; TAG chr2 60489048 60489067 60489051 -
ttgggtatggctgggtgtgg

SEQ ID NO: 180428 - DNA, 20 bp, Artificial Sequence
  Synthetic oligonucleotide; CAG chr2 60489029 60489048 60489032 -
gtagcttatgcctataatcc

SEQ ID NO: 180429 - DNA, 20 bp, Artificial Sequence
  Synthetic oligonucleotide; TGG chr2 60489021 60489040 60489024 -
tgcctataatcccagcactt

SEQ ID NO: 180430 - DNA, 20 bp, Artificial Sequence
  Synthetic oligonucleotide; GGG chr2 60489020 60489039 60489023 -
gcctataatcccagcacttt

SEQ ID NO: 180431 - DNA, 20 bp, Artificial Sequence
  Synthetic oligonucleotide; GAG chr2 60489018 60489037 60489021 -
ctataatcccagcactttgg

SEQ ID NO: 180432 - DNA, 20 bp, Artificial Sequence
  Synthetic oligonucleotide; AGG chr2 60489017 60489036 60489020 -
tataatcccagcactttggg

SEQ ID NO: 180433 - DNA, 20 bp, Artificial Sequence
  Synthetic oligonucleotide; GAG chr2 60489012 60489031 60489015 -
tcccagcactttgggaggct

SEQ ID NO: 180434 - DNA, 20 bp, Artificial Sequence
  Synthetic oligonucleotide; AGG chr2 60489011 60489030 60489014 -
cccagcactttgggaggctg

SEQ ID NO: 180435 - DNA, 20 bp, Artificial Sequence
  Synthetic oligonucleotide; TGG chr2 60489008 60489027 60489011 -
agcactttgggaggctgagg

SEQ ID NO: 180436 - DNA, 20 bp, Artificial Sequence
  Synthetic oligonucleotide; GGG chr2 60489007 60489026 60489010 -
gcactttgggaggctgaggt

SEQ ID NO: 180437 - DNA, 20 bp, Artificial Sequence
  Synthetic oligonucleotide; TGG chr2 60489004 60489023 60489007 -
ctttgggaggctgaggtggg

SEQ ID NO: 180438 - DNA, 20 bp, Artificial Sequence
  Synthetic oligonucleotide; AAG chr2 60488994 60489013 60488997 -
ctgaggtgggtggatcacct

SEQ ID NO: 180439 - DNA, 20 bp, Artificial Sequence
  Synthetic oligonucleotide; AGG chr2 60488993 60489012 60488996 -
tgaggtgggtggatcaccta

SEQ ID NO: 180440 - DNA, 20 bp, Artificial Sequence
  Synthetic oligonucleotide; CGG chr2 60488989 60489008 60488992 -
gtgggtggatcacctaaggt

SEQ ID NO: 180441 - DNA, 20 bp, Artificial Sequence
  Synthetic oligonucleotide; GGG chr2 60488988 60489007 60488991 -
tgggtggatcacctaaggtc

SEQ ID NO: 180442 - DNA, 20 bp, Artificial Sequence
  Synthetic oligonucleotide; GAG chr2 60488986 60489005 60488989 -
ggtggatcacctaaggtcgg

SEQ ID NO: 180443 - DNA, 20 bp, Artificial Sequence
  Synthetic oligonucleotide; GAG chr2 60488980 60488999 60488983 -
tcacctaaggtcgggagttt

SEQ ID NO: 180444 - DNA, 20 bp, Artificial Sequence
  Synthetic oligonucleotide; CAG chr2 60488975 60488994 60488978 -
taaggtcgggagtttgagac

SEQ ID NO: 180445 - DNA, 20 bp, Artificial Sequence
  Synthetic oligonucleotide; TGG chr2 60488961 60488980 60488964 -
tgagaccagcctgaccaaca

SEQ ID NO: 180446 - DNA, 20 bp, Artificial Sequence
  Synthetic oligonucleotide; GAG chr2 60488959 60488978 60488962 -
agaccagcctgaccaacatg

SEQ ID NO: 180447 - DNA, 20 bp, Artificial Sequence
  Synthetic oligonucleotide; CAG chr2 60488933 60488952 60488936 -
ccccgtctctaccaaaaata

SEQ ID NO: 180448 - DNA, 20 bp, Artificial Sequence
  Synthetic oligonucleotide; TAG chr2 60488926 60488945 60488929 -
tctaccaaaaatacagaaat

SEQ ID NO: 180449 - DNA, 20 bp, Artificial Sequence
  Synthetic oligonucleotide; TGG chr2 60488916 60488935 60488919 -
atacagaaattagccgcgtg

SEQ ID NO: 180450 - DNA, 20 bp, Artificial Sequence
  Synthetic oligonucleotide; TGG chr2 60488913 60488932 60488916 -
cagaaattagccgcgtgtgg

SEQ ID NO: 180451 - DNA, 20 bp, Artificial Sequence
  Synthetic oligonucleotide; CAG chr2 60488894 60488913 60488897 -
gtggcgcatgcctataatcc

SEQ ID NO: 180452 - DNA, 20 bp, Artificial Sequence
  Synthetic oligonucleotide; TGG chr2 60488886 60488905 60488889 -
tgcctataatcccagctact

SEQ ID NO: 180453 - DNA, 20 bp, Artificial Sequence
  Synthetic oligonucleotide; GGG chr2 60488885 60488904 60488888 -
gcctataatcccagctactt

SEQ ID NO: 180454 - DNA, 20 bp, Artificial Sequence
  Synthetic oligonucleotide; GAG chr2 60488883 60488902 60488886 -
ctataatcccagctacttgg

SEQ ID NO: 180455 - DNA, 20 bp, Artificial Sequence
  Synthetic oligonucleotide; AGG chr2 60488882 60488901 60488885 -
tataatcccagctacttggg

SEQ ID NO: 180456 - DNA, 20 bp, Artificial Sequence
  Synthetic oligonucleotide; GAG chr2 60488877 60488896 60488880 -
tcccagctacttgggaggct

SEQ ID NO: 180457 - DNA, 20 bp, Artificial Sequence
  Synthetic oligonucleotide; AGG chr2 60488876 60488895 60488879 -
cccagctacttgggaggctg

SEQ ID NO: 180458 - DNA, 20 bp, Artificial Sequence
  Synthetic oligonucleotide; CAG chr2 60488873 60488892 60488876 -
agctacttgggaggctgagg

SEQ ID NO: 180459 - DNA, 20 bp, Artificial Sequence
  Synthetic oligonucleotide; AGG chr2 60488872 60488891 60488875 -
gctacttgggaggctgaggc

SEQ ID NO: 180460 - DNA, 20 bp, Artificial Sequence
  Synthetic oligonucleotide; GAG chr2 60488870 60488889 60488873 -
tacttgggaggctgaggcag

SEQ ID NO: 180461 - DNA, 20 bp, Artificial Sequence
  Synthetic oligonucleotide; CGG chr2 60488854 60488873 60488857 -
gcaggagaatcgcttgaacc

SEQ ID NO: 180462 - DNA, 20 bp, Artificial Sequence
  Synthetic oligonucleotide; GGG chr2 60488853 60488872 60488856 -
caggagaatcgcttgaaccc

SEQ ID NO: 180463 - DNA, 20 bp, Artificial Sequence
  Synthetic oligonucleotide; GAG chr2 60488851 60488870 60488854 -
ggagaatcgcttgaacccgg

SEQ ID NO: 180464 - DNA, 20 bp, Artificial Sequence
  Synthetic oligonucleotide; AGG chr2 60488850 60488869 60488853 -
gagaatcgcttgaacccggg

SEQ ID NO: 180465 - DNA, 20 bp, Artificial Sequence
  Synthetic oligonucleotide; CGG chr2 60488847 60488866 60488850 -
aatcgcttgaacccgggagg

SEQ ID NO: 180466 - DNA, 20 bp, Artificial Sequence
  Synthetic oligonucleotide; GAG chr2 60488845 60488864 60488848 -
tcgcttgaacccgggaggcg

SEQ ID NO: 180467 - DNA, 20 bp, Artificial Sequence
  Synthetic oligonucleotide; CGG chr2 60488838 60488857 60488841 -
aacccgggaggcggagattg

SEQ ID NO: 180468 - DNA, 20 bp, Artificial Sequence
  Synthetic oligonucleotide; GAG chr2 60488834 60488853 60488837 -
cgggaggcggagattgcggt

SEQ ID NO: 180469 - DNA, 20 bp, Artificial Sequence
  Synthetic oligonucleotide; GAG chr2 60488829 60488848 60488832 -
ggcggagattgcggtgagcc

SEQ ID NO: 180470 - DNA, 20 bp, Artificial Sequence
  Synthetic oligonucleotide; CAG chr2 60488809 60488828 60488812 -
gagattgcgccattgcactc

SEQ ID NO: 180471 - DNA, 20 bp, Artificial Sequence
  Synthetic oligonucleotide; CGG chr2 60488804 60488823 60488807 -
tgcgccattgcactccagcc

SEQ ID NO: 180472 - DNA, 20 bp, Artificial Sequence
  Synthetic oligonucleotide; GGG chr2 60488803 60488822 60488806 -
gcgccattgcactccagccc

SEQ ID NO: 180473 - DNA, 20 bp, Artificial Sequence
  Synthetic oligonucleotide; AAG chr2 60488796 60488815 60488799 -
tgcactccagcccgggcaac

SEQ ID NO: 180474 - DNA, 20 bp, Artificial Sequence
  Synthetic oligonucleotide; GAG chr2 60488794 60488813 60488797 -
cactccagcccgggcaacaa

SEQ ID NO: 180475 - DNA, 20 bp, Artificial Sequence
  Synthetic oligonucleotide; CAG chr2 60488778 60488797 60488781 -
acaagagcgaaactccacct

SEQ ID NO: 180476 - DNA, 20 bp, Artificial Sequence
  Synthetic oligonucleotide; TGG chr2 60488730 60488749 60488733 -
acaaacaaacaaaatcgttt

SEQ ID NO: 180477 - DNA, 20 bp, Artificial Sequence
  Synthetic oligonucleotide; GGG chr2 60488729 60488748 60488732 -
caaacaaacaaaatcgtttt

SEQ ID NO: 180478 - DNA, 20 bp, Artificial Sequence
  Synthetic oligonucleotide; TAG chr2 60488726 60488745 60488729 -
acaaacaaaatcgttttggg

SEQ ID NO: 180479 - DNA, 20 bp, Artificial Sequence
  Synthetic oligonucleotide; CAG chr2 60488723 60488742 60488726 -
aacaaaatcgttttgggtag

SEQ ID NO: 180480 - DNA, 20 bp, Artificial Sequence
  Synthetic oligonucleotide; TGG chr2 60488720 60488739 60488723 -
aaaatcgttttgggtagcag

SEQ ID NO: 180481 - DNA, 20 bp, Artificial Sequence
  Synthetic oligonucleotide; TAG chr2 60488714 60488733 60488717 -
gttttgggtagcagtggctt

SEQ ID NO: 180482 - DNA, 20 bp, Artificial Sequence
  Synthetic oligonucleotide; AGG chr2 60488713 60488732 60488716 -
ttttgggtagcagtggcttt

SEQ ID NO: 180483 - DNA, 20 bp, Artificial Sequence
  Synthetic oligonucleotide; TGG chr2 60488703 60488722 60488706 -
cagtggctttaggctgtttt

SEQ ID NO: 180484 - DNA, 20 bp, Artificial Sequence
  Synthetic oligonucleotide; TGG chr2 60488695 60488714 60488698 -
ttaggctgtttttggatctt

SEQ ID NO: 180485 - DNA, 20 bp, Artificial Sequence
  Synthetic oligonucleotide; AAG chr2 60488649 60488668 60488652 -
tttgttattattttcatgtt

SEQ ID NO: 180486 - DNA, 20 bp, Artificial Sequence
  Synthetic oligonucleotide; TAG chr2 60488640 60488659 60488643 -
attttcatgttaagcaaaac

SEQ ID NO: 180487 - DNA, 20 bp, Artificial Sequence
  Synthetic oligonucleotide; AAG chr2 60488636 60488655 60488639 -
tcatgttaagcaaaactaga

SEQ ID NO: 180488 - DNA, 20 bp, Artificial Sequence
  Synthetic oligonucleotide; CAG chr2 60488615 60488634 60488618 -
agttttaccgaattcccctg

SEQ ID NO: 180489 - DNA, 20 bp, Artificial Sequence
  Synthetic oligonucleotide; CAG chr2 60488610 60488629 60488613 -
taccgaattcccctgcagta

SEQ ID NO: 180490 - DNA, 20 bp, Artificial Sequence
  Synthetic oligonucleotide; AAG chr2 60488606 60488625 60488609 -
gaattcccctgcagtacagt

SEQ ID NO: 180491 - DNA, 20 bp, Artificial Sequence
  Synthetic oligonucleotide; TGG chr2 60488590 60488609 60488593 -
cagtaagtattttctttcat

SEQ ID NO: 180492 - DNA, 20 bp, Artificial Sequence
  Synthetic oligonucleotide; GGG chr2 60488589 60488608 60488592 -
agtaagtattttctttcatt

SEQ ID NO: 180493 - DNA, 20 bp, Artificial Sequence
  Synthetic oligonucleotide; GGG chr2 60488588 60488607 60488591 -
gtaagtattttctttcattg

SEQ ID NO: 180494 - DNA, 20 bp, Artificial Sequence
  Synthetic oligonucleotide; GGG chr2 60488587 60488606 60488590 -
taagtattttctttcattgg

SEQ ID NO: 180495 - DNA, 20 bp, Artificial Sequence
  Synthetic oligonucleotide; AAG chr2 60488584 60488603 60488587 -
gtattttctttcattggggg

SEQ ID NO: 180496 - DNA, 20 bp, Artificial Sequence
  Synthetic oligonucleotide; CAG chr2 60488570 60488589 60488573 -
tgggggaagcaaactattta

SEQ ID NO: 180497 - DNA, 20 bp, Artificial Sequence
  Synthetic oligonucleotide; CAG chr2 60488561 60488580 60488564 -
caaactatttacagccataa

SEQ ID NO: 180498 - DNA, 20 bp, Artificial Sequence
  Synthetic oligonucleotide; AGG chr2 60488560 60488579 60488563 -
aaactatttacagccataac

SEQ ID NO: 180499 - DNA, 20 bp, Artificial Sequence
  Synthetic oligonucleotide; GGG chr2 60488559 60488578 60488562 -
aactatttacagccataaca

SEQ ID NO: 180500 - DNA, 20 bp, Artificial Sequence
  Synthetic oligonucleotide; CAG chr2 60488552 60488571 60488555 -
tacagccataacagggtttc

SEQ ID NO: 180501 - DNA, 20 bp, Artificial Sequence
  Synthetic oligonucleotide; AAG chr2 60488539 60488558 60488542 -
gggtttccagtgaattgtat

SEQ ID NO: 180502 - DNA, 20 bp, Artificial Sequence
  Synthetic oligonucleotide; TAG chr2 60488536 60488555 60488539 -
tttccagtgaattgtataag

SEQ ID NO: 180503 - DNA, 20 bp, Artificial Sequence
  Synthetic oligonucleotide; GAG chr2 60488529 60488548 60488532 -
tgaattgtataagtagcact

SEQ ID NO: 180504 - DNA, 20 bp, Artificial Sequence
  Synthetic oligonucleotide; CAG chr2 60488518 60488537 60488521 -
agtagcactgagttctgtgt

SEQ ID NO: 180505 - DNA, 20 bp, Artificial Sequence
  Synthetic oligonucleotide; TAG chr2 60488490 60488509 60488493 -
aatgaaacaaaaactgatca

SEQ ID NO: 180506 - DNA, 20 bp, Artificial Sequence
  Synthetic oligonucleotide; CAG chr2 60488469 60488488 60488472 -
agatgacattacctaaatga

SEQ ID NO: 180507 - DNA, 20 bp, Artificial Sequence
  Synthetic oligonucleotide; TGG chr2 60488422 60488441 60488425 -
catttgctgtaatcctgtta

SEQ ID NO: 180508 - DNA, 20 bp, Artificial Sequence
  Synthetic oligonucleotide; AAG chr2 60488402 60488421 60488405 -
tggcattgtcctattatctc

SEQ ID NO: 180509 - DNA, 20 bp, Artificial Sequence
  Synthetic oligonucleotide; TGG chr2 60488366 60488385 60488369 -
aaatgctgtcaaattgtaac

SEQ ID NO: 180510 - DNA, 20 bp, Artificial Sequence
  Synthetic oligonucleotide; AAG chr2 60488357 60488376 60488360 -
caaattgtaactggattgcc

SEQ ID NO: 180511 - DNA, 20 bp, Artificial Sequence
  Synthetic oligonucleotide; AGG chr2 60488356 60488375 60488359 -
aaattgtaactggattgcca

SEQ ID NO: 180512 - DNA, 20 bp, Artificial Sequence
  Synthetic oligonucleotide; CAG chr2 60488352 60488371 60488355 -
tgtaactggattgccaagga

SEQ ID NO: 180513 - DNA, 20 bp, Artificial Sequence
  Synthetic oligonucleotide; GAG chr2 60488350 60488369 60488353 -
taactggattgccaaggaca

SEQ ID NO: 180514 - DNA, 20 bp, Artificial Sequence
  Synthetic oligonucleotide; AGG chr2 60488349 60488368 60488352 -
aactggattgccaaggacag

SEQ ID NO: 180515 - DNA, 20 bp, Artificial Sequence
  Synthetic oligonucleotide; GAG chr2 60488347 60488366 60488350 -
ctggattgccaaggacagag

SEQ ID NO: 180516 - DNA, 20 bp, Artificial Sequence
  Synthetic oligonucleotide; GAG chr2 60488345 60488364 60488348 -
ggattgccaaggacagagga

SEQ ID NO: 180517 - DNA, 20 bp, Artificial Sequence
  Synthetic oligonucleotide; AGG chr2 60488344 60488363 60488347 -
gattgccaaggacagaggag

SEQ ID NO: 180518 - DNA, 20 bp, Artificial Sequence
  Synthetic oligonucleotide; CAG chr2 60488338 60488357 60488341 -
caaggacagaggagaggaac

SEQ ID NO: 180519 - DNA, 20 bp, Artificial Sequence
  Synthetic oligonucleotide; AGG chr2 60488337 60488356 60488340 -
aaggacagaggagaggaacc

SEQ ID NO: 180520 - DNA, 20 bp, Artificial Sequence
  Synthetic oligonucleotide; GGG chr2 60488336 60488355 60488339 -
aggacagaggagaggaacca

SEQ ID NO: 180521 - DNA, 20 bp, Artificial Sequence
  Synthetic oligonucleotide; GAG chr2 60488334 60488353 60488337 -
gacagaggagaggaaccagg

SEQ ID NO: 180522 - DNA, 20 bp, Artificial Sequence
  Synthetic oligonucleotide; AGG chr2 60488333 60488352 60488336 -
acagaggagaggaaccaggg

SEQ ID NO: 180523 - DNA, 20 bp, Artificial Sequence
  Synthetic oligonucleotide; TGG chr2 60488324 60488343 60488327 -
aggaaccagggaggacacaa

SEQ ID NO: 180524 - DNA, 20 bp, Artificial Sequence
  Synthetic oligonucleotide; AAG chr2 60488304 60488323 60488307 -
tggcaattcccactgcacca

SEQ ID NO: 180525 - DNA, 20 bp, Artificial Sequence
  Synthetic oligonucleotide; GAG chr2 60488302 60488321 60488305 -
gcaattcccactgcaccaaa

SEQ ID NO: 180526 - DNA, 20 bp, Artificial Sequence
  Synthetic oligonucleotide; CGG chr2 60488298 60488317 60488301 -
ttcccactgcaccaaagaga

SEQ ID NO: 180527 - DNA, 20 bp, Artificial Sequence
  Synthetic oligonucleotide; CAG chr2 60488278 60488297 60488281 -
cggtcttcttccccctctca

SEQ ID NO: 180528 - DNA, 20 bp, Artificial Sequence
  Synthetic oligonucleotide; TGG chr2 60488265 60488284 60488268 -
cctctcacagtctgaattct

SEQ ID NO: 180529 - DNA, 20 bp, Artificial Sequence
  Synthetic oligonucleotide; GAG chr2 60488263 60488282 60488266 -
tctcacagtctgaattcttg

SEQ ID NO: 180530 - DNA, 20 bp, Artificial Sequence
  Synthetic oligonucleotide; CAG chr2 60488252 60488271 60488255 -
gaattcttggagacattgtt

SEQ ID NO: 180531 - DNA, 20 bp, Artificial Sequence
  Synthetic oligonucleotide; CAG chr2 60488235 60488254 60488238 -
gttcagttaaaatcatgact

SEQ ID NO: 180532 - DNA, 20 bp, Artificial Sequence
  Synthetic oligonucleotide; AGG chr2 60488234 60488253 60488237 -
ttcagttaaaatcatgactc

SEQ ID NO: 180533 - DNA, 20 bp, Artificial Sequence
  Synthetic oligonucleotide; CAG chr2 60488222 60488241 60488225 -
catgactcaggtatctttta

SEQ ID NO: 180534 - DNA, 20 bp, Artificial Sequence
  Synthetic oligonucleotide; AGG chr2 60488221 60488240 60488224 -
atgactcaggtatcttttac

SEQ ID NO: 180535 - DNA, 20 bp, Artificial Sequence
  Synthetic oligonucleotide; TAG chr2 60488207 60488226 60488210 -
ttttacaggctttgatgaaa

SEQ ID NO: 180536 - DNA, 20 bp, Artificial Sequence
  Synthetic oligonucleotide; CAG chr2 60488203 60488222 60488206 -
acaggctttgatgaaatagt

SEQ ID NO: 180537 - DNA, 20 bp, Artificial Sequence
  Synthetic oligonucleotide; TAG chr2 60488182 60488201 60488185 -
agattcactcctcatgttcc

SEQ ID NO: 180538 - DNA, 20 bp, Artificial Sequence
  Synthetic oligonucleotide; AAG chr2 60488179 60488198 60488182 -
ttcactcctcatgttcctag

SEQ ID NO: 180539 - DNA, 20 bp, Artificial Sequence
  Synthetic oligonucleotide; AGG chr2 60488178 60488197 60488181 -
tcactcctcatgttcctaga

SEQ ID NO: 180540 - DNA, 20 bp, Artificial Sequence
  Synthetic oligonucleotide; AAG chr2 60488174 60488193 60488177 -
tcctcatgttcctagaagga

SEQ ID NO: 180541 - DNA, 20 bp, Artificial Sequence
  Synthetic oligonucleotide; AGG chr2 60488173 60488192 60488176 -
cctcatgttcctagaaggaa

SEQ ID NO: 180542 - DNA, 20 bp, Artificial Sequence
  Synthetic oligonucleotide; AAG chr2 60488170 60488189 60488173 -
catgttcctagaaggaaagg

SEQ ID NO: 180543 - DNA, 20 bp, Artificial Sequence
  Synthetic oligonucleotide; CAG chr2 60488153 60488172 60488156 -
aggaagaaacactctttgaa

SEQ ID NO: 180544 - DNA, 20 bp, Artificial Sequence
  Synthetic oligonucleotide; GAG chr2 60488145 60488164 60488148 -
acactctttgaacagcccgt

SEQ ID NO: 180545 - DNA, 20 bp, Artificial Sequence
  Synthetic oligonucleotide; CAG chr2 60488131 60488150 60488134 -
gcccgtgagacaaactcttc

SEQ ID NO: 180546 - DNA, 20 bp, Artificial Sequence
  Synthetic oligonucleotide; AGG chr2 60488130 60488149 60488133 -
cccgtgagacaaactcttcc

SEQ ID NO: 180547 - DNA, 20 bp, Artificial Sequence
  Synthetic oligonucleotide; GAG chr2 60488103 60488122 60488106 -
tttaaatgtttctacataat

SEQ ID NO: 180548 - DNA, 20 bp, Artificial Sequence
  Synthetic oligonucleotide; AAG chr2 60488090 60488109 60488093 -
acataatgagaataaattgt

SEQ ID NO: 180549 - DNA, 20 bp, Artificial Sequence
  Synthetic oligonucleotide; CAG chr2 60488066 60488085 60488069 -
gttactgtgtttttaaaacc

SEQ ID NO: 180550 - DNA, 20 bp, Artificial Sequence
  Synthetic oligonucleotide; AGG chr2 60488065 60488084 60488068 -
ttactgtgtttttaaaaccc

SEQ ID NO: 180551 - DNA, 20 bp, Artificial Sequence
  Synthetic oligonucleotide; AAG chr2 60488058 60488077 60488061 -
gtttttaaaacccaggtcaa

SEQ ID NO: 180552 - DNA, 20 bp, Artificial Sequence
  Synthetic oligonucleotide; TAG chr2 60488052 60488071 60488055 -
aaaacccaggtcaaaagtaa

SEQ ID NO: 180553 - DNA, 20 bp, Artificial Sequence
  Synthetic oligonucleotide; CAG chr2 60488047 60488066 60488050 -
ccaggtcaaaagtaatagca

SEQ ID NO: 180554 - DNA, 20 bp, Artificial Sequence
  Synthetic oligonucleotide; GAG chr2 60488045 60488064 60488048 -
aggtcaaaagtaatagcaca

SEQ ID NO: 180555 - DNA, 20 bp, Artificial Sequence
  Synthetic oligonucleotide; GAG chr2 60488043 60488062 60488046 -
gtcaaaagtaatagcacaga

SEQ ID NO: 180556 - DNA, 20 bp, Artificial Sequence
  Synthetic oligonucleotide; AGG chr2 60488042 60488061 60488045 -
tcaaaagtaatagcacagag

SEQ ID NO: 180557 - DNA, 20 bp, Artificial Sequence
  Synthetic oligonucleotide; GGG chr2 60488041 60488060 60488044 -
caaaagtaatagcacagaga

SEQ ID NO: 180558 - DNA, 20 bp, Artificial Sequence
  Synthetic oligonucleotide; AAG chr2 60488032 60488051 60488035 -
tagcacagagagggatctat

SEQ ID NO: 180559 - DNA, 20 bp, Artificial Sequence
  Synthetic oligonucleotide; CAG chr2 60487995 60488014 60487998 -
ttgttcatatattgcttccc

SEQ ID NO: 180560 - DNA, 20 bp, Artificial Sequence
  Synthetic oligonucleotide; AGG chr2 60487994 60488013 60487997 -
tgttcatatattgcttcccc

SEQ ID NO: 180561 - DNA, 20 bp, Artificial Sequence
  Synthetic oligonucleotide; TAG chr2 60487989 60488008 60487992 -
atatattgcttccccaggtt

SEQ ID NO: 180562 - DNA, 20 bp, Artificial Sequence
  Synthetic oligonucleotide; GAG chr2 60487984 60488003 60487987 -
ttgcttccccaggtttagat

SEQ ID NO: 180563 - DNA, 20 bp, Artificial Sequence
  Synthetic oligonucleotide; AGG chr2 60487983 60488002 60487986 -
tgcttccccaggtttagatg

SEQ ID NO: 180564 - DNA, 20 bp, Artificial Sequence
  Synthetic oligonucleotide; GGG chr2 60487982 60488001 60487985 -
gcttccccaggtttagatga

SEQ ID NO: 180565 - DNA, 20 bp, Artificial Sequence
  Synthetic oligonucleotide; TAG chr2 60487971 60487990 60487974 -
tttagatgagggctccattc

SEQ ID NO: 180566 - DNA, 20 bp, Artificial Sequence
  Synthetic oligonucleotide; GAG chr2 60487969 60487988 60487972 -
tagatgagggctccattcta

SEQ ID NO: 180567 - DNA, 20 bp, Artificial Sequence
  Synthetic oligonucleotide; TGG chr2 60487965 60487984 60487968 -
tgagggctccattctagagt

SEQ ID NO: 180568 - DNA, 20 bp, Artificial Sequence
  Synthetic oligonucleotide; GGG chr2 60487964 60487983 60487967 -
gagggctccattctagagtt

SEQ ID NO: 180569 - DNA, 20 bp, Artificial Sequence
  Synthetic oligonucleotide; AAG chr2 60487955 60487974 60487958 -
attctagagttgggaaaacc

SEQ ID NO: 180570 - DNA, 20 bp, Artificial Sequence
  Synthetic oligonucleotide; CAG chr2 60487951 60487970 60487954 -
tagagttgggaaaaccaagt

SEQ ID NO: 180571 - DNA, 20 bp, Artificial Sequence
  Synthetic oligonucleotide; TAG chr2 60487940 60487959 60487943 -
aaaccaagtcagtaaacctt

SEQ ID NO: 180572 - DNA, 20 bp, Artificial Sequence
  Synthetic oligonucleotide; TGG chr2 60487937 60487956 60487940 -
ccaagtcagtaaacctttag

SEQ ID NO: 180573 - DNA, 20 bp, Artificial Sequence
  Synthetic oligonucleotide; CAG chr2 60487934 60487953 60487937 -
agtcagtaaacctttagtgg

SEQ ID NO: 180574 - DNA, 20 bp, Artificial Sequence
  Synthetic oligonucleotide; CAG chr2 60487924 60487943 60487927 -
cctttagtggcagatgttat

SEQ ID NO: 180575 - DNA, 20 bp, Artificial Sequence
  Synthetic oligonucleotide; AGG chr2 60487923 60487942 60487926 -
ctttagtggcagatgttatc

SEQ ID NO: 180576 - DNA, 20 bp, Artificial Sequence
  Synthetic oligonucleotide; GGG chr2 60487922 60487941 60487925 -
tttagtggcagatgttatca

SEQ ID NO: 180577 - DNA, 20 bp, Artificial Sequence
  Synthetic oligonucleotide; GAG chr2 60487920 60487939 60487923 -
tagtggcagatgttatcagg

SEQ ID NO: 180578 - DNA, 20 bp, Artificial Sequence
  Synthetic oligonucleotide; TGG chr2 60487916 60487935 60487919 -
ggcagatgttatcagggagc

SEQ ID NO: 180579 - DNA, 20 bp, Artificial Sequence
  Synthetic oligonucleotide; GAG chr2 60487914 60487933 60487917 -
cagatgttatcagggagctg

SEQ ID NO: 180580 - DNA, 20 bp, Artificial Sequence
  Synthetic oligonucleotide; TGG chr2 60487910 60487929 60487913 -
tgttatcagggagctggagt

SEQ ID NO: 180581 - DNA, 20 bp, Artificial Sequence
  Synthetic oligonucleotide; GAG chr2 60487908 60487927 60487911 -
ttatcagggagctggagttg

SEQ ID NO: 180582 - DNA, 20 bp, Artificial Sequence
  Synthetic oligonucleotide; CAG chr2 60487883 60487902 60487886 -
cttgcattttgtgtttgtgc

SEQ ID NO: 180583 - DNA, 20 bp, Artificial Sequence
  Synthetic oligonucleotide; TAG chr2 60487855 60487874 60487858 -
catgttcctcttcatatatt

SEQ ID NO: 180584 - DNA, 20 bp, Artificial Sequence
  Synthetic oligonucleotide; CAG chr2 60487838 60487857 60487841 -
atttagaccaaattcttatc

SEQ ID NO: 180585 - DNA, 20 bp, Artificial Sequence
  Synthetic oligonucleotide; AAG chr2 60487824 60487843 60487827 -
cttatccagatttcccatta

SEQ ID NO: 180586 - DNA, 20 bp, Artificial Sequence
  Synthetic oligonucleotide; AGG chr2 60487823 60487842 60487826 -
ttatccagatttcccattaa

SEQ ID NO: 180587 - DNA, 20 bp, Artificial Sequence
  Synthetic oligonucleotide; CAG chr2 60487808 60487827 60487811 -
attaaaggttcataaatttc

SEQ ID NO: 180588 - DNA, 20 bp, Artificial Sequence
  Synthetic oligonucleotide; CAG chr2 60487791 60487810 60487794 -
ttccagttttcacctttctg

SEQ ID NO: 180589 - DNA, 20 bp, Artificial Sequence
  Synthetic oligonucleotide; TAG chr2 60487782 60487801 60487785 -
tcacctttctgcagcttcct

SEQ ID NO: 180590 - DNA, 20 bp, Artificial Sequence
  Synthetic oligonucleotide; TAG chr2 60487778 60487797 60487781 -
ctttctgcagcttccttaga

SEQ ID NO: 180591 - DNA, 20 bp, Artificial Sequence
  Synthetic oligonucleotide; TGG chr2 60487773 60487792 60487776 -
tgcagcttccttagatagaa

SEQ ID NO: 180592 - DNA, 20 bp, Artificial Sequence
  Synthetic oligonucleotide; GAG chr2 60487765 60487784 60487768 -
ccttagatagaatggttgat

SEQ ID NO: 180593 - DNA, 20 bp, Artificial Sequence
  Synthetic oligonucleotide; AAG chr2 60487742 60487761 60487745 -
aaaattaccgcattaaaatt

SEQ ID NO: 180594 - DNA, 20 bp, Artificial Sequence
  Synthetic oligonucleotide; AAG chr2 60487706 60487725 60487709 -
acattctgctgctcataaat

SEQ ID NO: 180595 - DNA, 20 bp, Artificial Sequence
  Synthetic oligonucleotide; AGG chr2 60487705 60487724 60487708 -
cattctgctgctcataaata

SEQ ID NO: 180596 - DNA, 20 bp, Artificial Sequence
  Synthetic oligonucleotide; GGG chr2 60487704 60487723 60487707 -
attctgctgctcataaataa

SEQ ID NO: 180597 - DNA, 20 bp, Artificial Sequence
  Synthetic oligonucleotide; GAG chr2 60487702 60487721 60487705 -
tctgctgctcataaataagg

SEQ ID NO: 180598 - DNA, 20 bp, Artificial Sequence
  Synthetic oligonucleotide; TGG chr2 60487699 60487718 60487702 -
gctgctcataaataagggag

SEQ ID NO: 180599 - DNA, 20 bp, Artificial Sequence
  Synthetic oligonucleotide; GGG chr2 60487698 60487717 60487701 -
ctgctcataaataagggagt

SEQ ID NO: 180600 - DNA, 20 bp, Artificial Sequence
  Synthetic oligonucleotide; TGG chr2 60487692 60487711 60487695 -
ataaataagggagtgggaaa

SEQ ID NO: 180601 - DNA, 20 bp, Artificial Sequence
  Synthetic oligonucleotide; AAG chr2 60487668 60487687 60487671 -
tactttgaacaccctcgtta

SEQ ID NO: 180602 - DNA, 20 bp, Artificial Sequence
  Synthetic oligonucleotide; AGG chr2 60487667 60487686 60487670 -
actttgaacaccctcgttaa

SEQ ID NO: 180603 - DNA, 20 bp, Artificial Sequence
  Synthetic oligonucleotide; TGG chr2 60487663 60487682 60487666 -
tgaacaccctcgttaaaggc

SEQ ID NO: 180604 - DNA, 20 bp, Artificial Sequence
  Synthetic oligonucleotide; TGG chr2 60487658 60487677 60487661 -
accctcgttaaaggctggtg

SEQ ID NO: 180605 - DNA, 20 bp, Artificial Sequence
  Synthetic oligonucleotide; CAG chr2 60487651 60487670 60487654 -
ttaaaggctggtgtggttgc

SEQ ID NO: 180606 - DNA, 20 bp, Artificial Sequence
  Synthetic oligonucleotide; GAG chr2 60487649 60487668 60487652 -
aaaggctggtgtggttgcca

SEQ ID NO: 180607 - DNA, 20 bp, Artificial Sequence
  Synthetic oligonucleotide; TAG chr2 60487644 60487663 60487647 -
ctggtgtggttgccagagaa

SEQ ID NO: 180608 - DNA, 20 bp, Artificial Sequence
  Synthetic oligonucleotide; AGG chr2 60487643 60487662 60487646 -
tggtgtggttgccagagaat

SEQ ID NO: 180609 - DNA, 20 bp, Artificial Sequence
  Synthetic oligonucleotide; GGG chr2 60487642 60487661 60487645 -
ggtgtggttgccagagaata

SEQ ID NO: 180610 - DNA, 20 bp, Artificial Sequence
  Synthetic oligonucleotide; AAG chr2 60487632 60487651 60487635 -
ccagagaatagggctaactt

SEQ ID NO: 180611 - DNA, 20 bp, Artificial Sequence
  Synthetic oligonucleotide; AGG chr2 60487631 60487650 60487634 -
cagagaatagggctaactta

SEQ ID NO: 180612 - DNA, 20 bp, Artificial Sequence
  Synthetic oligonucleotide; GGG chr2 60487630 60487649 60487633 -
agagaatagggctaacttaa

SEQ ID NO: 180613 - DNA, 20 bp, Artificial Sequence
  Synthetic oligonucleotide; GGG chr2 60487629 60487648 60487632 -
gagaatagggctaacttaag

SEQ ID NO: 180614 - DNA, 20 bp, Artificial Sequence
  Synthetic oligonucleotide; GGG chr2 60487628 60487647 60487631 -
agaatagggctaacttaagg

SEQ ID NO: 180615 - DNA, 20 bp, Artificial Sequence
  Synthetic oligonucleotide; AAG chr2 60487618 60487637 60487621 -
taacttaagggggatccgct

SEQ ID NO: 180616 - DNA, 20 bp, Artificial Sequence
  Synthetic oligonucleotide; TGG chr2 60487578 60487597 60487581 -
ttttttgttttgttttgttc

SEQ ID NO: 180617 - DNA, 20 bp, Artificial Sequence
  Synthetic oligonucleotide; AAG chr2 60487567 60487586 60487570 -
gttttgttctggattttata

SEQ ID NO: 180618 - DNA, 20 bp, Artificial Sequence
  Synthetic oligonucleotide; AGG chr2 60487566 60487585 60487569 -
ttttgttctggattttataa

SEQ ID NO: 180619 - DNA, 20 bp, Artificial Sequence
  Synthetic oligonucleotide; TAG chr2 60487556 60487575 60487559 -
gattttataaaggcatcatt

SEQ ID NO: 180620 - DNA, 20 bp, Artificial Sequence
  Synthetic oligonucleotide; TAG chr2 60487504 60487523 60487507 -
tttaaatatctaatgttgat

SEQ ID NO: 180621 - DNA, 20 bp, Artificial Sequence
  Synthetic oligonucleotide; TAG chr2 60487485 60487504 60487488 -
ttagtatgttctattattta

SEQ ID NO: 180622 - DNA, 20 bp, Artificial Sequence
  Synthetic oligonucleotide; CAG chr2 60487477 60487496 60487480 -
ttctattatttatagccctc

SEQ ID NO: 180623 - DNA, 20 bp, Artificial Sequence
  Synthetic oligonucleotide; AAG chr2 60487474 60487493 60487477 -
tattatttatagccctccag

SEQ ID NO: 180624 - DNA, 20 bp, Artificial Sequence
  Synthetic oligonucleotide; AGG chr2 60487473 60487492 60487476 -
attatttatagccctccaga

SEQ ID NO: 180625 - DNA, 20 bp, Artificial Sequence
  Synthetic oligonucleotide; AAG chr2 60487465 60487484 60487468 -
tagccctccagaaggatccc

SEQ ID NO: 180626 - DNA, 20 bp, Artificial Sequence
  Synthetic oligonucleotide; AGG chr2 60487464 60487483 60487467 -
agccctccagaaggatccca

SEQ ID NO: 180627 - DNA, 20 bp, Artificial Sequence
  Synthetic oligonucleotide; GGG chr2 60487463 60487482 60487466 -
gccctccagaaggatcccaa

SEQ ID NO: 180628 - DNA, 20 bp, Artificial Sequence
  Synthetic oligonucleotide; AAG chr2 60487460 60487479 60487463 -
ctccagaaggatcccaaggg

SEQ ID NO: 180629 - DNA, 20 bp, Artificial Sequence
  Synthetic oligonucleotide; GAG chr2 60487444 60487463 60487447 -
agggaagataatctacattt

SEQ ID NO: 180630 - DNA, 20 bp, Artificial Sequence
  Synthetic oligonucleotide; AAG chr2 60487441 60487460 60487444 -
gaagataatctacatttgag

SEQ ID NO: 180631 - DNA, 20 bp, Artificial Sequence
  Synthetic oligonucleotide; CAG chr2 60487418 60487437 60487421 -
acgatttcccaatttccata

SEQ ID NO: 180632 - DNA, 20 bp, Artificial Sequence
  Synthetic oligonucleotide; CGG chr2 60487354 60487373 60487357 -
gaattttctttttccactct

SEQ ID NO: 180633 - DNA, 20 bp, Artificial Sequence
  Synthetic oligonucleotide; TGG chr2 60487347 60487366 60487350 -
ctttttccactctcggtgtg

SEQ ID NO: 180634 - DNA, 20 bp, Artificial Sequence
  Synthetic oligonucleotide; TGG chr2 60487339 60487358 60487342 -
actctcggtgtgtggcattg

SEQ ID NO: 180635 - DNA, 20 bp, Artificial Sequence
  Synthetic oligonucleotide; GGG chr2 60487338 60487357 60487341 -
ctctcggtgtgtggcattgt

SEQ ID NO: 180636 - DNA, 20 bp, Artificial Sequence
  Synthetic oligonucleotide; GGG chr2 60487337 60487356 60487340 -
tctcggtgtgtggcattgtg

SEQ ID NO: 180637 - DNA, 20 bp, Artificial Sequence
  Synthetic oligonucleotide; CAG chr2 60487332 60487351 60487335 -
gtgtgtggcattgtggggtg

SEQ ID NO: 180638 - DNA, 20 bp, Artificial Sequence
  Synthetic oligonucleotide; AAG chr2 60487321 60487340 60487324 -
tgtggggtgcagacacctga

SEQ ID NO: 180639 - DNA, 20 bp, Artificial Sequence
  Synthetic oligonucleotide; TGG chr2 60487312 60487331 60487315 -
cagacacctgaaagcctgac

SEQ ID NO: 180640 - DNA, 20 bp, Artificial Sequence
  Synthetic oligonucleotide; GAG chr2 60487310 60487329 60487313 -
gacacctgaaagcctgactg

SEQ ID NO: 180641 - DNA, 20 bp, Artificial Sequence
  Synthetic oligonucleotide; TGG chr2 60487299 60487318 60487302 -
gcctgactggagatgtaaca

SEQ ID NO: 180642 - DNA, 20 bp, Artificial Sequence
  Synthetic oligonucleotide; GGG chr2 60487298 60487317 60487301 -
cctgactggagatgtaacat

SEQ ID NO: 180643 - DNA, 20 bp, Artificial Sequence
  Synthetic oligonucleotide; TAG chr2 60487283 60487302 60487286 -
aacatgggctctgctgacat

SEQ ID NO: 180644 - DNA, 20 bp, Artificial Sequence
  Synthetic oligonucleotide; AAG chr2 60487276 60487295 60487279 -
gctctgctgacattagcatg

SEQ ID NO: 180645 - DNA, 20 bp, Artificial Sequence
  Synthetic oligonucleotide; GAG chr2 60487274 60487293 60487277 -
tctgctgacattagcatgaa

SEQ ID NO: 180646 - DNA, 20 bp, Artificial Sequence
  Synthetic oligonucleotide; TAG chr2 60487269 60487288 60487272 -
tgacattagcatgaagagct

SEQ ID NO: 180647 - DNA, 20 bp, Artificial Sequence
  Synthetic oligonucleotide; TAG chr2 60487247 60487266 60487250 -
gctaatcgacttgcaaaata

SEQ ID NO: 180648 - DNA, 20 bp, Artificial Sequence
  Synthetic oligonucleotide; AGG chr2 60487246 60487265 60487249 -
ctaatcgacttgcaaaatat

SEQ ID NO: 180649 - DNA, 20 bp, Artificial Sequence
  Synthetic oligonucleotide; TAG chr2 60487242 60487261 60487245 -
tcgacttgcaaaatataggt

SEQ ID NO: 180650 - DNA, 20 bp, Artificial Sequence
  Synthetic oligonucleotide; AGG chr2 60487241 60487260 60487244 -
cgacttgcaaaatataggtt

SEQ ID NO: 180651 - DNA, 20 bp, Artificial Sequence
  Synthetic oligonucleotide; GGG chr2 60487240 60487259 60487243 -
gacttgcaaaatataggtta

SEQ ID NO: 180652 - DNA, 20 bp, Artificial Sequence
  Synthetic oligonucleotide; GAG chr2 60487238 60487257 60487241 -
cttgcaaaatataggttagg

SEQ ID NO: 180653 - DNA, 20 bp, Artificial Sequence
  Synthetic oligonucleotide; TAG chr2 60487230 60487249 60487233 -
atataggttagggagtttta

SEQ ID NO: 180654 - DNA, 20 bp, Artificial Sequence
  Synthetic oligonucleotide; AGG chr2 60487229 60487248 60487232 -
tataggttagggagttttat

SEQ ID NO: 180655 - DNA, 20 bp, Artificial Sequence
  Synthetic oligonucleotide; AAG chr2 60487195 60487214 60487198 -
tcttactctttcattgatta

SEQ ID NO: 180656 - DNA, 20 bp, Artificial Sequence
  Synthetic oligonucleotide; AGG chr2 60487194 60487213 60487197 -
cttactctttcattgattaa

SEQ ID NO: 180657 - DNA, 20 bp, Artificial Sequence
  Synthetic oligonucleotide; TAG chr2 60487174 60487193 60487177 -
aggcaaaatattacattaac

SEQ ID NO: 180658 - DNA, 20 bp, Artificial Sequence
  Synthetic oligonucleotide; TGG chr2 60487162 60487181 60487165 -
acattaactagatcattaca

SEQ ID NO: 180659 - DNA, 20 bp, Artificial Sequence
  Synthetic oligonucleotide; GGG chr2 60487161 60487180 60487164 -
cattaactagatcattacat

SEQ ID NO: 180660 - DNA, 20 bp, Artificial Sequence
  Synthetic oligonucleotide; AAG chr2 60487155 60487174 60487158 -
ctagatcattacatgggtaa

SEQ ID NO: 180661 - DNA, 20 bp, Artificial Sequence
  Synthetic oligonucleotide; AGG chr2 60487154 60487173 60487157 -
tagatcattacatgggtaaa

SEQ ID NO: 180662 - DNA, 20 bp, Artificial Sequence
  Synthetic oligonucleotide; TAG chr2 60487150 60487169 60487153 -
tcattacatgggtaaaaggt

SEQ ID NO: 180663 - DNA, 20 bp, Artificial Sequence
  Synthetic oligonucleotide; TAG chr2 60487134 60487153 60487137 -
aggttagaacttcacacact

SEQ ID NO: 180664 - DNA, 20 bp, Artificial Sequence
  Synthetic oligonucleotide; AGG chr2 60487133 60487152 60487136 -
ggttagaacttcacacactt

SEQ ID NO: 180665 - DNA, 20 bp, Artificial Sequence
  Synthetic oligonucleotide; GGG chr2 60487132 60487151 60487135 -
gttagaacttcacacactta

SEQ ID NO: 180666 - DNA, 20 bp, Artificial Sequence
  Synthetic oligonucleotide; GGG chr2 60487131 60487150 60487134 -
ttagaacttcacacacttag

SEQ ID NO: 180667 - DNA, 20 bp, Artificial Sequence
  Synthetic oligonucleotide; TGG chr2 60487098 60487117 60487101 -
tccttccccttcctgccttg

SEQ ID NO: 180668 - DNA, 20 bp, Artificial Sequence
  Synthetic oligonucleotide; CAG chr2 60487088 60487107 60487091 -
tcctgccttgtggcaaatca

SEQ ID NO: 180669 - DNA, 20 bp, Artificial Sequence
  Synthetic oligonucleotide; AGG chr2 60487087 60487106 60487090 -
cctgccttgtggcaaatcac

SEQ ID NO: 180670 - DNA, 20 bp, Artificial Sequence
  Synthetic oligonucleotide; TGG chr2 60487083 60487102 60487086 -
ccttgtggcaaatcacaggt

SEQ ID NO: 180671 - DNA, 20 bp, Artificial Sequence
  Synthetic oligonucleotide; GAG chr2 60487081 60487100 60487084 -
ttgtggcaaatcacaggttg

SEQ ID NO: 180672 - DNA, 20 bp, Artificial Sequence
  Synthetic oligonucleotide; AGG chr2 60487080 60487099 60487083 -
tgtggcaaatcacaggttgg

SEQ ID NO: 180673 - DNA, 20 bp, Artificial Sequence
  Synthetic oligonucleotide; CAG chr2 60487077 60487096 60487080 -
ggcaaatcacaggttggagg

SEQ ID NO: 180674 - DNA, 20 bp, Artificial Sequence
  Synthetic oligonucleotide; AGG chr2 60487076 60487095 60487079 -
gcaaatcacaggttggaggc

SEQ ID NO: 180675 - DNA, 20 bp, Artificial Sequence
  Synthetic oligonucleotide; GGG chr2 60487075 60487094 60487078 -
caaatcacaggttggaggca

SEQ ID NO: 180676 - DNA, 20 bp, Artificial Sequence
  Synthetic oligonucleotide; TAG chr2 60487058 60487077 60487061 -
gcagggaaactcactgtgtc

SEQ ID NO: 180677 - DNA, 20 bp, Artificial Sequence
  Synthetic oligonucleotide; TAG chr2 60487037 60487056 60487040 -
agcgctcctaaatgcctgaa

SEQ ID NO: 180678 - DNA, 20 bp, Artificial Sequence
  Synthetic oligonucleotide; TAG chr2 60487028 60487047 60487031 -
aaatgcctgaatagcaacgt

SEQ ID NO: 180679 - DNA, 20 bp, Artificial Sequence
  Synthetic oligonucleotide; AAG chr2 60487020 60487039 60487023 -
gaatagcaacgttagactta

SEQ ID NO: 180680 - DNA, 20 bp, Artificial Sequence
  Synthetic oligonucleotide; AGG chr2 60487019 60487038 60487022 -
aatagcaacgttagacttaa

SEQ ID NO: 180681 - DNA, 20 bp, Artificial Sequence
  Synthetic oligonucleotide; GAG chr2 60487017 60487036 60487020 -
tagcaacgttagacttaaag

SEQ ID NO: 180682 - DNA, 20 bp, Artificial Sequence
  Synthetic oligonucleotide; AGG chr2 60487016 60487035 60487019 -
agcaacgttagacttaaagg

SEQ ID NO: 180683 - DNA, 20 bp, Artificial Sequence
  Synthetic oligonucleotide; GGG chr2 60487015 60487034 60487018 -
gcaacgttagacttaaagga

SEQ ID NO: 180684 - DNA, 20 bp, Artificial Sequence
  Synthetic oligonucleotide; GGG chr2 60487014 60487033 60487017 -
caacgttagacttaaaggag

SEQ ID NO: 180685 - DNA, 20 bp, Artificial Sequence
  Synthetic oligonucleotide; GAG chr2 60486986 60487005 60486989 -
gccttcgctttgaatctccc

SEQ ID NO: 180686 - DNA, 20 bp, Artificial Sequence
  Synthetic oligonucleotide; TAG chr2 60486968 60486987 60486971 -
ccgagtcttttttattctga

SEQ ID NO: 180687 - DNA, 20 bp, Artificial Sequence
  Synthetic oligonucleotide; TAG chr2 60486963 60486982 60486966 -
tcttttttattctgatagaa

SEQ ID NO: 180688 - DNA, 20 bp, Artificial Sequence
  Synthetic oligonucleotide; TAG chr2 60486916 60486935 60486919 -
tgttctgattccatttctgt

SEQ ID NO: 180689 - DNA, 20 bp, Artificial Sequence
  Synthetic oligonucleotide; CAG chr2 60486913 60486932 60486916 -
tctgattccatttctgttag

SEQ ID NO: 180690 - DNA, 20 bp, Artificial Sequence
  Synthetic oligonucleotide; AGG chr2 60486912 60486931 60486915 -
ctgattccatttctgttagc

SEQ ID NO: 180691 - DNA, 20 bp, Artificial Sequence
  Synthetic oligonucleotide; GGG chr2 60486911 60486930 60486914 -
tgattccatttctgttagca

SEQ ID NO: 180692 - DNA, 20 bp, Artificial Sequence
  Synthetic oligonucleotide; AAG chr2 60486906 60486925 60486909 -
ccatttctgttagcagggaa

SEQ ID NO: 180693 - DNA, 20 bp, Artificial Sequence
  Synthetic oligonucleotide; AGG chr2 60486905 60486924 60486908 -
catttctgttagcagggaaa

SEQ ID NO: 180694 - DNA, 20 bp, Artificial Sequence
  Synthetic oligonucleotide; GGG chr2 60486904 60486923 60486907 -
atttctgttagcagggaaaa

SEQ ID NO: 180695 - DNA, 20 bp, Artificial Sequence
  Synthetic oligonucleotide; AAG chr2 60486890 60486909 60486893 -
ggaaaagggcaaatacatga

SEQ ID NO: 180696 - DNA, 20 bp, Artificial Sequence
  Synthetic oligonucleotide; AGG chr2 60486889 60486908 60486892 -
gaaaagggcaaatacatgaa

SEQ ID NO: 180697 - DNA, 20 bp, Artificial Sequence
  Synthetic oligonucleotide; GGG chr2 60486888 60486907 60486891 -
aaaagggcaaatacatgaaa

SEQ ID NO: 180698 - DNA, 20 bp, Artificial Sequence
  Synthetic oligonucleotide; TGG chr2 60486883 60486902 60486886 -
ggcaaatacatgaaagggcg

SEQ ID NO: 180699 - DNA, 20 bp, Artificial Sequence
  Synthetic oligonucleotide; GGG chr2 60486882 60486901 60486885 -
gcaaatacatgaaagggcgt

SEQ ID NO: 180700 - DNA, 20 bp, Artificial Sequence
  Synthetic oligonucleotide; GAG chr2 60486877 60486896 60486880 -
tacatgaaagggcgtgggct

SEQ ID NO: 180701 - DNA, 20 bp, Artificial Sequence
  Synthetic oligonucleotide; TGG chr2 60486871 60486890 60486874 -
aaagggcgtgggctgagcca

SEQ ID NO: 180702 - DNA, 20 bp, Artificial Sequence
  Synthetic oligonucleotide; CAG chr2 60486867 60486886 60486870 -
ggcgtgggctgagccatggc

SEQ ID NO: 180703 - DNA, 20 bp, Artificial Sequence
  Synthetic oligonucleotide; AGG chr2 60486866 60486885 60486869 -
gcgtgggctgagccatggcc

SEQ ID NO: 180704 - DNA, 20 bp, Artificial Sequence
  Synthetic oligonucleotide; GAG chr2 60486860 60486879 60486863 -
gctgagccatggccaggttt

SEQ ID NO: 180705 - DNA, 20 bp, Artificial Sequence
  Synthetic oligonucleotide; GAG chr2 60486858 60486877 60486861 -
tgagccatggccaggtttga

SEQ ID NO: 180706 - DNA, 20 bp, Artificial Sequence
  Synthetic oligonucleotide; CAG chr2 60486854 60486873 60486857 -
ccatggccaggtttgagaga

SEQ ID NO: 180707 - DNA, 20 bp, Artificial Sequence
  Synthetic oligonucleotide; GAG chr2 60486852 60486871 60486855 -
atggccaggtttgagagaca

SEQ ID NO: 180708 - DNA, 20 bp, Artificial Sequence
  Synthetic oligonucleotide; CAG chr2 60486842 60486861 60486845 -
ttgagagacagagtgattcg

SEQ ID NO: 180709 - DNA, 20 bp, Artificial Sequence
  Synthetic oligonucleotide; TAG chr2 60486839 60486858 60486842 -
agagacagagtgattcgcag

SEQ ID NO: 180710 - DNA, 20 bp, Artificial Sequence
  Synthetic oligonucleotide; CAG chr2 60486830 60486849 60486833 -
gtgattcgcagtagtcttcc

SEQ ID NO: 180711 - DNA, 20 bp, Artificial Sequence
  Synthetic oligonucleotide; AGG chr2 60486829 60486848 60486832 -
tgattcgcagtagtcttccc

SEQ ID NO: 180712 - DNA, 20 bp, Artificial Sequence
  Synthetic oligonucleotide; GGG chr2 60486828 60486847 60486831 -
gattcgcagtagtcttccca

SEQ ID NO: 180713 - DNA, 20 bp, Artificial Sequence
  Synthetic oligonucleotide; GAG chr2 60486821 60486840 60486824 -
agtagtcttcccagggtgtt

SEQ ID NO: 180714 - DNA, 20 bp, Artificial Sequence
  Synthetic oligonucleotide; TGG chr2 60486818 60486837 60486821 -
agtcttcccagggtgttgag

SEQ ID NO: 180715 - DNA, 20 bp, Artificial Sequence
  Synthetic oligonucleotide; GGG chr2 60486817 60486836 60486820 -
gtcttcccagggtgttgagt

SEQ ID NO: 180716 - DNA, 20 bp, Artificial Sequence
  Synthetic oligonucleotide; TGG chr2 60486804 60486823 60486807 -
gttgagtgggaacgtctccc

SEQ ID NO: 180717 - DNA, 20 bp, Artificial Sequence
  Synthetic oligonucleotide; GGG chr2 60486803 60486822 60486806 -
ttgagtgggaacgtctccct

SEQ ID NO: 180718 - DNA, 20 bp, Artificial Sequence
  Synthetic oligonucleotide; AAG chr2 60486800 60486819 60486803 -
agtgggaacgtctccctggg

SEQ ID NO: 180719 - DNA, 20 bp, Artificial Sequence
  Synthetic oligonucleotide; AGG chr2 60486799 60486818 60486802 -
gtgggaacgtctccctggga

SEQ ID NO: 180720 - DNA, 20 bp, Artificial Sequence
  Synthetic oligonucleotide; GGG chr2 60486798 60486817 60486801 -
tgggaacgtctccctgggaa

SEQ ID NO: 180721 - DNA, 20 bp, Artificial Sequence
  Synthetic oligonucleotide; TGG chr2 60486792 60486811 60486795 -
cgtctccctgggaagggatg

SEQ ID NO: 180722 - DNA, 20 bp, Artificial Sequence
  Synthetic oligonucleotide; CAG chr2 60486782 60486801 60486785 -
ggaagggatgtggtcattct

SEQ ID NO: 180723 - DNA, 20 bp, Artificial Sequence
  Synthetic oligonucleotide; TGG chr2 60486775 60486794 60486778 -
atgtggtcattctcagactg

SEQ ID NO: 180724 - DNA, 20 bp, Artificial Sequence
  Synthetic oligonucleotide; GGG chr2 60486774 60486793 60486777 -
tgtggtcattctcagactgt

SEQ ID NO: 180725 - DNA, 20 bp, Artificial Sequence
  Synthetic oligonucleotide; CAG chr2 60486769 60486788 60486772 -
tcattctcagactgtgggct

SEQ ID NO: 180726 - DNA, 20 bp, Artificial Sequence
  Synthetic oligonucleotide; AAG chr2 60486722 60486741 60486725 -
gtcaaccatctaatgctatc

SEQ ID NO: 180727 - DNA, 20 bp, Artificial Sequence
  Synthetic oligonucleotide; AGG chr2 60486721 60486740 60486724 -
tcaaccatctaatgctatca

SEQ ID NO: 180728 - DNA, 20 bp, Artificial Sequence
  Synthetic oligonucleotide; GAG chr2 60486711 60486730 60486714 -
aatgctatcaaggccttcct

SEQ ID NO: 180729 - DNA, 20 bp, Artificial Sequence
  Synthetic oligonucleotide; GAG chr2 60486709 60486728 60486712 -
tgctatcaaggccttcctga

SEQ ID NO: 180730 - DNA, 20 bp, Artificial Sequence
  Synthetic oligonucleotide; AAG chr2 60486706 60486725 60486709 -
tatcaaggccttcctgagag

SEQ ID NO: 180731 - DNA, 20 bp, Artificial Sequence
  Synthetic oligonucleotide; CAG chr2 60486700 60486719 60486703 -
ggccttcctgagagaagttt

SEQ ID NO: 180732 - DNA, 20 bp, Artificial Sequence
  Synthetic oligonucleotide; AGG chr2 60486699 60486718 60486702 -
gccttcctgagagaagtttc

SEQ ID NO: 180733 - DNA, 20 bp, Artificial Sequence
  Synthetic oligonucleotide; GAG chr2 60486681 60486700 60486684 -
tcaggcccaatcctgatgtt

SEQ ID NO: 180734 - DNA, 20 bp, Artificial Sequence
  Synthetic oligonucleotide; TGG chr2 60486677 60486696 60486680 -
gcccaatcctgatgttgagt

SEQ ID NO: 180735 - DNA, 20 bp, Artificial Sequence
  Synthetic oligonucleotide; TGG chr2 60486660 60486679 60486663 -
agttggcatgttcacatgtc

SEQ ID NO: 180736 - DNA, 20 bp, Artificial Sequence
  Synthetic oligonucleotide; CAG chr2 60486646 60486665 60486649 -
catgtctggtaataatctgc

SEQ ID NO: 180737 - DNA, 20 bp, Artificial Sequence
  Synthetic oligonucleotide; AAG chr2 60486601 60486620 60486604 -
tctgtgcattattcatctca

SEQ ID NO: 180738 - DNA, 20 bp, Artificial Sequence
  Synthetic oligonucleotide; CAG chr2 60486597 60486616 60486600 -
tgcattattcatctcaaagc

SEQ ID NO: 180739 - DNA, 20 bp, Artificial Sequence
  Synthetic oligonucleotide; GAG chr2 60486595 60486614 60486598 -
cattattcatctcaaagcca

SEQ ID NO: 180740 - DNA, 20 bp, Artificial Sequence
  Synthetic oligonucleotide; AGG chr2 60486594 60486613 60486597 -
attattcatctcaaagccag

SEQ ID NO: 180741 - DNA, 20 bp, Artificial Sequence
  Synthetic oligonucleotide; CAG chr2 60486576 60486595 60486579 -
agaggatctcatgtccatca

SEQ ID NO: 180742 - DNA, 20 bp, Artificial Sequence
  Synthetic oligonucleotide; AGG chr2 60486575 60486594 60486578 -
gaggatctcatgtccatcac

SEQ ID NO: 180743 - DNA, 20 bp, Artificial Sequence
  Synthetic oligonucleotide; GGG chr2 60486574 60486593 60486577 -
aggatctcatgtccatcaca

SEQ ID NO: 180744 - DNA, 20 bp, Artificial Sequence
  Synthetic oligonucleotide; TGG chr2 60486568 60486587 60486571 -
tcatgtccatcacagggctg

SEQ ID NO: 180745 - DNA, 20 bp, Artificial Sequence
  Synthetic oligonucleotide; TGG chr2 60486561 60486580 60486564 -
catcacagggctgtggtctg

SEQ ID NO: 180746 - DNA, 20 bp, Artificial Sequence
  Synthetic oligonucleotide; TAG chr2 60486557 60486576 60486560 -
acagggctgtggtctgtgga

SEQ ID NO: 180747 - DNA, 20 bp, Artificial Sequence
  Synthetic oligonucleotide; AGG chr2 60486556 60486575 60486559 -
cagggctgtggtctgtggat

SEQ ID NO: 180748 - DNA, 20 bp, Artificial Sequence
  Synthetic oligonucleotide; GGG chr2 60486555 60486574 60486558 -
agggctgtggtctgtggata

SEQ ID NO: 180749 - DNA, 20 bp, Artificial Sequence
  Synthetic oligonucleotide; AAG chr2 60486544 60486563 60486547 -
ctgtggatagggaaaatttc

SEQ ID NO: 180750 - DNA, 20 bp, Artificial Sequence
  Synthetic oligonucleotide; AGG chr2 60486543 60486562 60486546 -
tgtggatagggaaaatttca

SEQ ID NO: 180751 - DNA, 20 bp, Artificial Sequence
  Synthetic oligonucleotide; TGG chr2 60486534 60486553 60486537 -
ggaaaatttcaaggcttttc

SEQ ID NO: 180752 - DNA, 20 bp, Artificial Sequence
  Synthetic oligonucleotide; GGG chr2 60486533 60486552 60486536 -
gaaaatttcaaggcttttct

SEQ ID NO: 180753 - DNA, 20 bp, Artificial Sequence
  Synthetic oligonucleotide; TAG chr2 60486523 60486542 60486526 -
aggcttttctgggcctgatg

SEQ ID NO: 180754 - DNA, 20 bp, Artificial Sequence
  Synthetic oligonucleotide; CAG chr2 60486509 60486528 60486512 -
ctgatgtagccattttcttt

SEQ ID NO: 180755 - DNA, 20 bp, Artificial Sequence
  Synthetic oligonucleotide; TAG chr2 60486501 60486520 60486504 -
gccattttctttcagtatct

SEQ ID NO: 180756 - DNA, 20 bp, Artificial Sequence
  Synthetic oligonucleotide; TGG chr2 60486496 60486515 60486499 -
tttctttcagtatcttagat

SEQ ID NO: 180757 - DNA, 20 bp, Artificial Sequence
  Synthetic oligonucleotide; TAG chr2 60486493 60486512 60486496 -
ctttcagtatcttagattgg

SEQ ID NO: 180758 - DNA, 20 bp, Artificial Sequence
  Synthetic oligonucleotide; AGG chr2 60486492 60486511 60486495 -
tttcagtatcttagattggt

SEQ ID NO: 180759 - DNA, 20 bp, Artificial Sequence
  Synthetic oligonucleotide; TAG chr2 60486485 60486504 60486488 -
atcttagattggtaggtctt

SEQ ID NO: 180760 - DNA, 20 bp, Artificial Sequence
  Synthetic oligonucleotide; AAG chr2 60486449 60486468 60486452 -
aaatgtgtgtgtgtgtgcct

SEQ ID NO: 180761 - DNA, 20 bp, Artificial Sequence
  Synthetic oligonucleotide; TAG chr2 60486444 60486463 60486447 -
tgtgtgtgtgtgcctaagta

SEQ ID NO: 180762 - DNA, 20 bp, Artificial Sequence
  Synthetic oligonucleotide; CAG chr2 60486421 60486440 60486424 -
ttttcttgaatttctcactt

SEQ ID NO: 180763 - DNA, 20 bp, Artificial Sequence
  Synthetic oligonucleotide; CAG chr2 60486398 60486417 60486401 -
tacttaactacacatatgtg

SEQ ID NO: 180764 - DNA, 20 bp, Artificial Sequence
  Synthetic oligonucleotide; AAG chr2 60486394 60486413 60486397 -
taactacacatatgtgcaga

SEQ ID NO: 180765 - DNA, 20 bp, Artificial Sequence
  Synthetic oligonucleotide; TAG chr2 60486383 60486402 60486386 -
atgtgcagaaagtgaactct

SEQ ID NO: 180766 - DNA, 20 bp, Artificial Sequence
  Synthetic oligonucleotide; TGG chr2 60486376 60486395 60486379 -
gaaagtgaactcttagaatt

SEQ ID NO: 180767 - DNA, 20 bp, Artificial Sequence
  Synthetic oligonucleotide; GAG chr2 60486350 60486369 60486353 -
tccgttctttctcattgtgt

SEQ ID NO: 180768 - DNA, 20 bp, Artificial Sequence
  Synthetic oligonucleotide; AAG chr2 60486347 60486366 60486350 -
gttctttctcattgtgtgag

SEQ ID NO: 180769 - DNA, 20 bp, Artificial Sequence
  Synthetic oligonucleotide; AGG chr2 60486346 60486365 60486349 -
ttctttctcattgtgtgaga

SEQ ID NO: 180770 - DNA, 20 bp, Artificial Sequence
  Synthetic oligonucleotide; GAG chr2 60486344 60486363 60486347 -
ctttctcattgtgtgagaag

SEQ ID NO: 180771 - DNA, 20 bp, Artificial Sequence
  Synthetic oligonucleotide; AGG chr2 60486343 60486362 60486346 -
tttctcattgtgtgagaagg

SEQ ID NO: 180772 - DNA, 20 bp, Artificial Sequence
  Synthetic oligonucleotide; AAG chr2 60486338 60486357 60486341 -
cattgtgtgagaaggaggca

SEQ ID NO: 180773 - DNA, 20 bp, Artificial Sequence
  Synthetic oligonucleotide; TGG chr2 60486326 60486345 60486329 -
aggaggcaaagttgccaaat

SEQ ID NO: 180774 - DNA, 20 bp, Artificial Sequence
  Synthetic oligonucleotide; GAG chr2 60486324 60486343 60486327 -
gaggcaaagttgccaaattg

SEQ ID NO: 180775 - DNA, 20 bp, Artificial Sequence
  Synthetic oligonucleotide; AGG chr2 60486323 60486342 60486326 -
aggcaaagttgccaaattgg

SEQ ID NO: 180776 - DNA, 20 bp, Artificial Sequence
  Synthetic oligonucleotide; TGG chr2 60486320 60486339 60486323 -
caaagttgccaaattggagg

SEQ ID NO: 180777 - DNA, 20 bp, Artificial Sequence
  Synthetic oligonucleotide; GGG chr2 60486319 60486338 60486322 -
aaagttgccaaattggaggt

SEQ ID NO: 180778 - DNA, 20 bp, Artificial Sequence
  Synthetic oligonucleotide; GGG chr2 60486318 60486337 60486321 -
aagttgccaaattggaggtg

SEQ ID NO: 180779 - DNA, 20 bp, Artificial Sequence
  Synthetic oligonucleotide; AAG chr2 60486314 60486333 60486317 -
tgccaaattggaggtggggc

SEQ ID NO: 180780 - DNA, 20 bp, Artificial Sequence
  Synthetic oligonucleotide; AGG chr2 60486313 60486332 60486316 -
gccaaattggaggtggggca

SEQ ID NO: 180781 - DNA, 20 bp, Artificial Sequence
  Synthetic oligonucleotide; TGG chr2 60486310 60486329 60486313 -
aaattggaggtggggcaagg

SEQ ID NO: 180782 - DNA, 20 bp, Artificial Sequence
  Synthetic oligonucleotide; GGG chr2 60486309 60486328 60486312 -
aattggaggtggggcaaggt

SEQ ID NO: 180783 - DNA, 20 bp, Artificial Sequence
  Synthetic oligonucleotide; CAG chr2 60486305 60486324 60486308 -
ggaggtggggcaaggtgggc

SEQ ID NO: 180784 - DNA, 20 bp, Artificial Sequence
  Synthetic oligonucleotide; TAG chr2 60486302 60486321 60486305 -
ggtggggcaaggtgggccag

SEQ ID NO: 180785 - DNA, 20 bp, Artificial Sequence
  Synthetic oligonucleotide; GAG chr2 60486300 60486319 60486303 -
tggggcaaggtgggccagta

SEQ ID NO: 180786 - DNA, 20 bp, Artificial Sequence
  Synthetic oligonucleotide; TGG chr2 60486290 60486309 60486293 -
tgggccagtagagctgtgat

SEQ ID NO: 180787 - DNA, 20 bp, Artificial Sequence
  Synthetic oligonucleotide; TAG chr2 60486270 60486289 60486273 -
tggtgtctcactttgatgtg

SEQ ID NO: 180788 - DNA, 20 bp, Artificial Sequence
  Synthetic oligonucleotide; AGG chr2 60486269 60486288 60486272 -
ggtgtctcactttgatgtgt

SEQ ID NO: 180789 - DNA, 20 bp, Artificial Sequence
  Synthetic oligonucleotide; GAG chr2 60486267 60486286 60486270 -
tgtctcactttgatgtgtag

SEQ ID NO: 180790 - DNA, 20 bp, Artificial Sequence
  Synthetic oligonucleotide; GAG chr2 60486265 60486284 60486268 -
tctcactttgatgtgtagga

SEQ ID NO: 180791 - DNA, 20 bp, Artificial Sequence
  Synthetic oligonucleotide; GAG chr2 60486263 60486282 60486266 -
tcactttgatgtgtaggaga

SEQ ID NO: 180792 - DNA, 20 bp, Artificial Sequence
  Synthetic oligonucleotide; AAG chr2 60486250 60486269 60486253 -
taggagagagaacaaatcac

SEQ ID NO: 180793 - DNA, 20 bp, Artificial Sequence
  Synthetic oligonucleotide; TGG chr2 60486239 60486258 60486242 -
acaaatcacaagtcattctc

SEQ ID NO: 180794 - DNA, 20 bp, Artificial Sequence
  Synthetic oligonucleotide; AAG chr2 60486235 60486254 60486238 -
atcacaagtcattctctgga

SEQ ID NO: 180795 - DNA, 20 bp, Artificial Sequence
  Synthetic oligonucleotide; AGG chr2 60486234 60486253 60486237 -
tcacaagtcattctctggaa

SEQ ID NO: 180796 - DNA, 20 bp, Artificial Sequence
  Synthetic oligonucleotide; GAG chr2 60486232 60486251 60486235 -
acaagtcattctctggaaag

SEQ ID NO: 180797 - DNA, 20 bp, Artificial Sequence
  Synthetic oligonucleotide; TGG chr2 60486226 60486245 60486229 -
cattctctggaaaggagcca

SEQ ID NO: 180798 - DNA, 20 bp, Artificial Sequence
  Synthetic oligonucleotide; CAG chr2 60486215 60486234 60486218 -
aaggagccatggtccaccca

SEQ ID NO: 180799 - DNA, 20 bp, Artificial Sequence
  Synthetic oligonucleotide; AAG chr2 60486209 60486228 60486212 -
ccatggtccacccacagaac

SEQ ID NO: 180800 - DNA, 20 bp, Artificial Sequence
  Synthetic oligonucleotide; AGG chr2 60486208 60486227 60486211 -
catggtccacccacagaaca

SEQ ID NO: 180801 - DNA, 20 bp, Artificial Sequence
  Synthetic oligonucleotide; CAG chr2 60486192 60486211 60486195 -
aacaaggaccctgaaatccc

SEQ ID NO: 180802 - DNA, 20 bp, Artificial Sequence
  Synthetic oligonucleotide; CAG chr2 60486186 60486205 60486189 -
gaccctgaaatccccagtac

SEQ ID NO: 180803 - DNA, 20 bp, Artificial Sequence
  Synthetic oligonucleotide; TAG chr2 60486177 60486196 60486180 -
atccccagtaccagtctccc

SEQ ID NO: 180804 - DNA, 20 bp, Artificial Sequence
  Synthetic oligonucleotide; AGG chr2 60486176 60486195 60486179 -
tccccagtaccagtctccct

SEQ ID NO: 180805 - DNA, 20 bp, Artificial Sequence
  Synthetic oligonucleotide; CAG chr2 60486160 60486179 60486163 -
ccctaggatgtcttgccttt

SEQ ID NO: 180806 - DNA, 20 bp, Artificial Sequence
  Synthetic oligonucleotide; CAG chr2 60486157 60486176 60486160 -
taggatgtcttgcctttcag

SEQ ID NO: 180807 - DNA, 20 bp, Artificial Sequence
  Synthetic oligonucleotide; CAG chr2 60486149 60486168 60486152 -
cttgcctttcagcagctgtt

SEQ ID NO: 180808 - DNA, 20 bp, Artificial Sequence
  Synthetic oligonucleotide; CAG chr2 60486134 60486153 60486137 -
ctgttcagtcaaatccattt

SEQ ID NO: 180809 - DNA, 20 bp, Artificial Sequence
  Synthetic oligonucleotide; TGG chr2 60486129 60486148 60486132 -
cagtcaaatccatttcagaa

SEQ ID NO: 180810 - DNA, 20 bp, Artificial Sequence
  Synthetic oligonucleotide; GAG chr2 60486127 60486146 60486130 -
gtcaaatccatttcagaatg

SEQ ID NO: 180811 - DNA, 20 bp, Artificial Sequence
  Synthetic oligonucleotide; CAG chr2 60486122 60486141 60486125 -
atccatttcagaatggagaa

SEQ ID NO: 180812 - DNA, 20 bp, Artificial Sequence
  Synthetic oligonucleotide; CAG chr2 60486112 60486131 60486115 -
gaatggagaacagcttgtca

SEQ ID NO: 180813 - DNA, 20 bp, Artificial Sequence
  Synthetic oligonucleotide; TAG chr2 60486087 60486106 60486090 -
ctctactcttgacctgctga

SEQ ID NO: 180814 - DNA, 20 bp, Artificial Sequence
  Synthetic oligonucleotide; AAG chr2 60486081 60486100 60486084 -
tcttgacctgctgatagaac

SEQ ID NO: 180815 - DNA, 20 bp, Artificial Sequence
  Synthetic oligonucleotide; AGG chr2 60486080 60486099 60486083 -
cttgacctgctgatagaaca

SEQ ID NO: 180816 - DNA, 20 bp, Artificial Sequence
  Synthetic oligonucleotide; GGG chr2 60486079 60486098 60486082 -
ttgacctgctgatagaacaa

SEQ ID NO: 180817 - DNA, 20 bp, Artificial Sequence
  Synthetic oligonucleotide; GGG chr2 60486078 60486097 60486081 -
tgacctgctgatagaacaag

SEQ ID NO: 180818 - DNA, 20 bp, Artificial Sequence
  Synthetic oligonucleotide; TGG chr2 60486073 60486092 60486076 -
tgctgatagaacaaggggct

SEQ ID NO: 180819 - DNA, 20 bp, Artificial Sequence
  Synthetic oligonucleotide; GAG chr2 60486071 60486090 60486074 -
ctgatagaacaaggggcttg

SEQ ID NO: 180820 - DNA, 20 bp, Artificial Sequence
  Synthetic oligonucleotide; TGG chr2 60486064 60486083 60486067 -
aacaaggggcttggagattt

SEQ ID NO: 180821 - DNA, 20 bp, Artificial Sequence
  Synthetic oligonucleotide; GGG chr2 60486063 60486082 60486066 -
acaaggggcttggagatttt

SEQ ID NO: 180822 - DNA, 20 bp, Artificial Sequence
  Synthetic oligonucleotide; TAG chr2 60486060 60486079 60486063 -
aggggcttggagattttggg

SEQ ID NO: 180823 - DNA, 20 bp, Artificial Sequence
  Synthetic oligonucleotide; TGG chr2 60486054 60486073 60486057 -
ttggagattttgggtagata

SEQ ID NO: 180824 - DNA, 20 bp, Artificial Sequence
  Synthetic oligonucleotide; TAG chr2 60486048 60486067 60486051 -
attttgggtagatatggaaa

SEQ ID NO: 180825 - DNA, 20 bp, Artificial Sequence
  Synthetic oligonucleotide; AAG chr2 60486027 60486046 60486030 -
agatccctaaacatactaaa

SEQ ID NO: 180826 - DNA, 20 bp, Artificial Sequence
  Synthetic oligonucleotide; TGG chr2 60486008 60486027 60486011 -
aaagattttttttgtacgtg

SEQ ID NO: 180827 - DNA, 20 bp, Artificial Sequence
  Synthetic oligonucleotide; TGG chr2 60486005 60486024 60486008 -
gattttttttgtacgtgtgg

SEQ ID NO: 180828 - DNA, 20 bp, Artificial Sequence
  Synthetic oligonucleotide; GGG chr2 60486004 60486023 60486007 -
attttttttgtacgtgtggt

SEQ ID NO: 180829 - DNA, 20 bp, Artificial Sequence
  Synthetic oligonucleotide; GGG chr2 60486003 60486022 60486006 -
ttttttttgtacgtgtggtg

SEQ ID NO: 180830 - DNA, 20 bp, Artificial Sequence
  Synthetic oligonucleotide; GGG chr2 60486002 60486021 60486005 -
tttttttgtacgtgtggtgg

SEQ ID NO: 180831 - DNA, 20 bp, Artificial Sequence
  Synthetic oligonucleotide; GAG chr2 60486000 60486019 60486003 -
tttttgtacgtgtggtgggg

SEQ ID NO: 180832 - DNA, 20 bp, Artificial Sequence
  Synthetic oligonucleotide; GAG chr2 60485998 60486017 60486001 -
tttgtacgtgtggtggggga

SEQ ID NO: 180833 - DNA, 20 bp, Artificial Sequence
  Synthetic oligonucleotide; AGG chr2 60485997 60486016 60486000 -
ttgtacgtgtggtgggggag

SEQ ID NO: 180834 - DNA, 20 bp, Artificial Sequence
  Synthetic oligonucleotide; GAG chr2 60485995 60486014 60485998 -
gtacgtgtggtgggggagag

SEQ ID NO: 180835 - DNA, 20 bp, Artificial Sequence
  Synthetic oligonucleotide; CAG chr2 60485989 60486008 60485992 -
gtggtgggggagaggagaac

SEQ ID NO: 180836 - DNA, 20 bp, Artificial Sequence
  Synthetic oligonucleotide; GAG chr2 60485987 60486006 60485990 -
ggtgggggagaggagaacca

SEQ ID NO: 180837 - DNA, 20 bp, Artificial Sequence
  Synthetic oligonucleotide; CAG chr2 60485984 60486003 60485987 -
gggggagaggagaaccagag

SEQ ID NO: 180838 - DNA, 20 bp, Artificial Sequence
  Synthetic oligonucleotide; AAG chr2 60485981 60486000 60485984 -
ggagaggagaaccagagcag

SEQ ID NO: 180839 - DNA, 20 bp, Artificial Sequence
  Synthetic oligonucleotide; AGG chr2 60485980 60485999 60485983 -
gagaggagaaccagagcaga

SEQ ID NO: 180840 - DNA, 20 bp, Artificial Sequence
  Synthetic oligonucleotide; TGG chr2 60485976 60485995 60485979 -
ggagaaccagagcagaaggt

SEQ ID NO: 180841 - DNA, 20 bp, Artificial Sequence
  Synthetic oligonucleotide; GAG chr2 60485974 60485993 60485977 -
agaaccagagcagaaggttg

SEQ ID NO: 180842 - DNA, 20 bp, Artificial Sequence
  Synthetic oligonucleotide; AAG chr2 60485970 60485989 60485973 -
ccagagcagaaggttggaga

SEQ ID NO: 180843 - DNA, 20 bp, Artificial Sequence
  Synthetic oligonucleotide; AAG chr2 60485966 60485985 60485969 -
agcagaaggttggagaaaga

SEQ ID NO: 180844 - DNA, 20 bp, Artificial Sequence
  Synthetic oligonucleotide; TGG chr2 60485962 60485981 60485965 -
gaaggttggagaaagaaagt

SEQ ID NO: 180845 - DNA, 20 bp, Artificial Sequence
  Synthetic oligonucleotide; GGG chr2 60485961 60485980 60485964 -
aaggttggagaaagaaagtt

SEQ ID NO: 180846 - DNA, 20 bp, Artificial Sequence
  Synthetic oligonucleotide; GGG chr2 60485960 60485979 60485963 -
aggttggagaaagaaagttg

SEQ ID NO: 180847 - DNA, 20 bp, Artificial Sequence
  Synthetic oligonucleotide; AAG chr2 60485957 60485976 60485960 -
ttggagaaagaaagttgggg

SEQ ID NO: 180848 - DNA, 20 bp, Artificial Sequence
  Synthetic oligonucleotide; AGG chr2 60485956 60485975 60485959 -
tggagaaagaaagttgggga

SEQ ID NO: 180849 - DNA, 20 bp, Artificial Sequence
  Synthetic oligonucleotide; CAG chr2 60485927 60485946 60485930 -
aaatgtgcaatctcattcct

SEQ ID NO: 180850 - DNA, 20 bp, Artificial Sequence
  Synthetic oligonucleotide; GAG chr2 60485908 60485927 60485911 -
tcagccttcttgttgaaaat

SEQ ID NO: 180851 - DNA, 20 bp, Artificial Sequence
  Synthetic oligonucleotide; CAG chr2 60485902 60485921 60485905 -
ttcttgttgaaaatgagaat

SEQ ID NO: 180852 - DNA, 20 bp, Artificial Sequence
  Synthetic oligonucleotide; CAG chr2 60485896 60485915 60485899 -
ttgaaaatgagaatcagatg

SEQ ID NO: 180853 - DNA, 20 bp, Artificial Sequence
  Synthetic oligonucleotide; AAG chr2 60485878 60485897 60485881 -
tgcagcaatgtattatttcc

SEQ ID NO: 180854 - DNA, 20 bp, Artificial Sequence
  Synthetic oligonucleotide; GAG chr2 60485876 60485895 60485879 -
cagcaatgtattatttccaa

SEQ ID NO: 180855 - DNA, 20 bp, Artificial Sequence
  Synthetic oligonucleotide; TGG chr2 60485868 60485887 60485871 -
tattatttccaagagctatc

SEQ ID NO: 180856 - DNA, 20 bp, Artificial Sequence
  Synthetic oligonucleotide; TGG chr2 60485862 60485881 60485865 -
ttccaagagctatctggtga

SEQ ID NO: 180857 - DNA, 20 bp, Artificial Sequence
  Synthetic oligonucleotide; GGG chr2 60485861 60485880 60485864 -
tccaagagctatctggtgat

SEQ ID NO: 180858 - DNA, 20 bp, Artificial Sequence
  Synthetic oligonucleotide; TGG chr2 60485851 60485870 60485854 -
atctggtgatgggatccatc

SEQ ID NO: 180859 - DNA, 20 bp, Artificial Sequence
  Synthetic oligonucleotide; AAG chr2 60485846 60485865 60485849 -
gtgatgggatccatctggtg

SEQ ID NO: 180860 - DNA, 20 bp, Artificial Sequence
  Synthetic oligonucleotide; AGG chr2 60485845 60485864 60485848 -
tgatgggatccatctggtga

SEQ ID NO: 180861 - DNA, 20 bp, Artificial Sequence
  Synthetic oligonucleotide; GGG chr2 60485844 60485863 60485847 -
gatgggatccatctggtgaa

SEQ ID NO: 180862 - DNA, 20 bp, Artificial Sequence
  Synthetic oligonucleotide; TGG chr2 60485834 60485853 60485837 -
atctggtgaagggctacttc

SEQ ID NO: 180863 - DNA, 20 bp, Artificial Sequence
  Synthetic oligonucleotide; GGG chr2 60485833 60485852 60485836 -
tctggtgaagggctacttct

SEQ ID NO: 180864 - DNA, 20 bp, Artificial Sequence
  Synthetic oligonucleotide; GGG chr2 60485832 60485851 60485835 -
ctggtgaagggctacttctg

SEQ ID NO: 180865 - DNA, 20 bp, Artificial Sequence
  Synthetic oligonucleotide; GGG chr2 60485831 60485850 60485834 -
tggtgaagggctacttctgg

SEQ ID NO: 180866 - DNA, 20 bp, Artificial Sequence
  Synthetic oligonucleotide; TGG chr2 60485825 60485844 60485828 -
agggctacttctgggggacc

SEQ ID NO: 180867 - DNA, 20 bp, Artificial Sequence
  Synthetic oligonucleotide; TGG chr2 60485805 60485824 60485808 -
tggaattgctgtgtgacctt

SEQ ID NO: 180868 - DNA, 20 bp, Artificial Sequence
  Synthetic oligonucleotide; GGG chr2 60485804 60485823 60485807 -
ggaattgctgtgtgaccttt

SEQ ID NO: 180869 - DNA, 20 bp, Artificial Sequence
  Synthetic oligonucleotide; TGG chr2 60485785 60485804 60485788 -
tgggaaacacttgccttctc

SEQ ID NO: 180870 - DNA, 20 bp, Artificial Sequence
  Synthetic oligonucleotide; GGG chr2 60485784 60485803 60485787 -
gggaaacacttgccttctct

SEQ ID NO: 180871 - DNA, 20 bp, Artificial Sequence
  Synthetic oligonucleotide; GAG chr2 60485779 60485798 60485782 -
acacttgccttctctgggtt

SEQ ID NO: 180872 - DNA, 20 bp, Artificial Sequence
  Synthetic oligonucleotide; CAG chr2 60485774 60485793 60485777 -
tgccttctctgggttgagct

SEQ ID NO: 180873 - DNA, 20 bp, Artificial Sequence
  Synthetic oligonucleotide; TAG chr2 60485767 60485786 60485770 -
tctgggttgagctcagcccg

SEQ ID NO: 180874 - DNA, 20 bp, Artificial Sequence
  Synthetic oligonucleotide; AAG chr2 60485759 60485778 60485762 -
gagctcagcccgtagttcac

SEQ ID NO: 180875 - DNA, 20 bp, Artificial Sequence
  Synthetic oligonucleotide; AGG chr2 60485758 60485777 60485761 -
agctcagcccgtagttcaca

SEQ ID NO: 180876 - DNA, 20 bp, Artificial Sequence
  Synthetic oligonucleotide; GGG chr2 60485757 60485776 60485760 -
gctcagcccgtagttcacaa

SEQ ID NO: 180877 - DNA, 20 bp, Artificial Sequence
  Synthetic oligonucleotide; GGG chr2 60485756 60485775 60485759 -
ctcagcccgtagttcacaag

SEQ ID NO: 180878 - DNA, 20 bp, Artificial Sequence
  Synthetic oligonucleotide; TGG chr2 60485747 60485766 60485750 -
tagttcacaaggggcattgc

SEQ ID NO: 180879 - DNA, 20 bp, Artificial Sequence
  Synthetic oligonucleotide; TAG chr2 60485738 60485757 60485741 -
aggggcattgctggtattta

SEQ ID NO: 180880 - DNA, 20 bp, Artificial Sequence
  Synthetic oligonucleotide; CAG chr2 60485724 60485743 60485727 -
tatttatagactgtgtttga

SEQ ID NO: 180881 - DNA, 20 bp, Artificial Sequence
  Synthetic oligonucleotide; GAG chr2 60485717 60485736 60485720 -
agactgtgtttgacagtccc

SEQ ID NO: 180882 - DNA, 20 bp, Artificial Sequence
  Synthetic oligonucleotide; AAG chr2 60485711 60485730 60485714 -
tgtttgacagtcccgagtga

SEQ ID NO: 180883 - DNA, 20 bp, Artificial Sequence
  Synthetic oligonucleotide; AGG chr2 60485710 60485729 60485713 -
gtttgacagtcccgagtgaa

SEQ ID NO: 180884 - DNA, 20 bp, Artificial Sequence
  Synthetic oligonucleotide; CAG chr2 60485689 60485708 60485692 -
ggcaacttcacttctcaccc

SEQ ID NO: 180885 - DNA, 20 bp, Artificial Sequence
  Synthetic oligonucleotide; TAG chr2 60485684 60485703 60485687 -
cttcacttctcaccccagaa

SEQ ID NO: 180886 - DNA, 20 bp, Artificial Sequence
  Synthetic oligonucleotide; AAG chr2 60485680 60485699 60485683 -
acttctcaccccagaatagc

SEQ ID NO: 180887 - DNA, 20 bp, Artificial Sequence
  Synthetic oligonucleotide; TAG chr2 60485661 60485680 60485664 -
caagcgttgtttctcatatc

SEQ ID NO: 180888 - DNA, 20 bp, Artificial Sequence
  Synthetic oligonucleotide; AGG chr2 60485660 60485679 60485663 -
aagcgttgtttctcatatct

SEQ ID NO: 180889 - DNA, 20 bp, Artificial Sequence
  Synthetic oligonucleotide; TGG chr2 60485653 60485672 60485656 -
gtttctcatatctaggttgc

SEQ ID NO: 180890 - DNA, 20 bp, Artificial Sequence
  Synthetic oligonucleotide; GGG chr2 60485652 60485671 60485655 -
tttctcatatctaggttgct

SEQ ID NO: 180891 - DNA, 20 bp, Artificial Sequence
  Synthetic oligonucleotide; CAG chr2 60485648 60485667 60485651 -
tcatatctaggttgctggga

SEQ ID NO: 180892 - DNA, 20 bp, Artificial Sequence
  Synthetic oligonucleotide; CAG chr2 60485640 60485659 60485643 -
aggttgctgggacagcttcc

SEQ ID NO: 180893 - DNA, 20 bp, Artificial Sequence
  Synthetic oligonucleotide; AGG chr2 60485639 60485658 60485642 -
ggttgctgggacagcttccc

SEQ ID NO: 180894 - DNA, 20 bp, Artificial Sequence
  Synthetic oligonucleotide; CAG chr2 60485625 60485644 60485628 -
cttcccaggaacctaatatt

SEQ ID NO: 180895 - DNA, 20 bp, Artificial Sequence
  Synthetic oligonucleotide; CAG chr2 60485622 60485641 60485625 -
cccaggaacctaatattcag

SEQ ID NO: 180896 - DNA, 20 bp, Artificial Sequence
  Synthetic oligonucleotide; TGG chr2 60485608 60485627 60485611 -
attcagcagcttcgtgacgt

SEQ ID NO: 180897 - DNA, 20 bp, Artificial Sequence
  Synthetic oligonucleotide; TGG chr2 60485604 60485623 60485607 -
agcagcttcgtgacgttgga

SEQ ID NO: 180898 - DNA, 20 bp, Artificial Sequence
  Synthetic oligonucleotide; GAG chr2 60485602 60485621 60485605 -
cagcttcgtgacgttggatg

SEQ ID NO: 180899 - DNA, 20 bp, Artificial Sequence
  Synthetic oligonucleotide; AGG chr2 60485601 60485620 60485604 -
agcttcgtgacgttggatgg

SEQ ID NO: 180900 - DNA, 20 bp, Artificial Sequence
  Synthetic oligonucleotide; GGG chr2 60485600 60485619 60485603 -
gcttcgtgacgttggatgga

SEQ ID NO: 180901 - DNA, 20 bp, Artificial Sequence
  Synthetic oligonucleotide; GAG chr2 60485582 60485601 60485585 -
gagggtttttctttttaaat

SEQ ID NO: 180902 - DNA, 20 bp, Artificial Sequence
  Synthetic oligonucleotide; TGG chr2 60485574 60485593 60485577 -
ttctttttaaatgagttgat

SEQ ID NO: 180903 - DNA, 20 bp, Artificial Sequence
  Synthetic oligonucleotide; CAG chr2 60485545 60485564 60485548 -
ccactttacacattgttttc

SEQ ID NO: 180904 - DNA, 20 bp, Artificial Sequence
  Synthetic oligonucleotide; AGG chr2 60485544 60485563 60485547 -
cactttacacattgttttcc

SEQ ID NO: 180905 - DNA, 20 bp, Artificial Sequence
  Synthetic oligonucleotide; TAG chr2 60485539 60485558 60485542 -
tacacattgttttccaggtc

SEQ ID NO: 180906 - DNA, 20 bp, Artificial Sequence
  Synthetic oligonucleotide; AGG chr2 60485538 60485557 60485541 -
acacattgttttccaggtct

SEQ ID NO: 180907 - DNA, 20 bp, Artificial Sequence
  Synthetic oligonucleotide; TAG chr2 60485520 60485539 60485523 -
ctaggtttatttttccctta

SEQ ID NO: 180908 - DNA, 20 bp, Artificial Sequence
  Synthetic oligonucleotide; AGG chr2 60485519 60485538 60485522 -
taggtttatttttcccttat

SEQ ID NO: 180909 - DNA, 20 bp, Artificial Sequence
  Synthetic oligonucleotide; TAG chr2 60485516 60485535 60485519 -
gtttatttttcccttatagg

SEQ ID NO: 180910 - DNA, 20 bp, Artificial Sequence
  Synthetic oligonucleotide; AAG chr2 60485506 60485525 60485509 -
cccttataggtagaatataa

SEQ ID NO: 180911 - DNA, 20 bp, Artificial Sequence
  Synthetic oligonucleotide; GAG chr2 60485504 60485523 60485507 -
cttataggtagaatataaaa

SEQ ID NO: 180912 - DNA, 20 bp, Artificial Sequence
  Synthetic oligonucleotide; TGG chr2 60485499 60485518 60485502 -
aggtagaatataaaagagta

SEQ ID NO: 180913 - DNA, 20 bp, Artificial Sequence
  Synthetic oligonucleotide; GGG chr2 60485498 60485517 60485501 -
ggtagaatataaaagagtat

SEQ ID NO: 180914 - DNA, 20 bp, Artificial Sequence
  Synthetic oligonucleotide; GGG chr2 60485497 60485516 60485500 -
gtagaatataaaagagtatg

SEQ ID NO: 180915 - DNA, 20 bp, Artificial Sequence
  Synthetic oligonucleotide; TGG chr2 60485487 60485506 60485490 -
aaagagtatggggtctgccc

SEQ ID NO: 180916 - DNA, 20 bp, Artificial Sequence
  Synthetic oligonucleotide; CAG chr2 60485464 60485483 60485467 -
ctcacaccgttctgtttttg

SEQ ID NO: 180917 - DNA, 20 bp, Artificial Sequence
  Synthetic oligonucleotide; TAG chr2 60485460 60485479 60485463 -
caccgttctgtttttgcagt

SEQ ID NO: 180918 - DNA, 20 bp, Artificial Sequence
  Synthetic oligonucleotide; AAG chr2 60485453 60485472 60485456 -
ctgtttttgcagttagctta

SEQ ID NO: 180919 - DNA, 20 bp, Artificial Sequence
  Synthetic oligonucleotide; AGG chr2 60485452 60485471 60485455 -
tgtttttgcagttagcttaa

SEQ ID NO: 180920 - DNA, 20 bp, Artificial Sequence
  Synthetic oligonucleotide; TGG chr2 60485447 60485466 60485450 -
ttgcagttagcttaaaggca

SEQ ID NO: 180921 - DNA, 20 bp, Artificial Sequence
  Synthetic oligonucleotide; GAG chr2 60485445 60485464 60485448 -
gcagttagcttaaaggcatg

SEQ ID NO: 180922 - DNA, 20 bp, Artificial Sequence
  Synthetic oligonucleotide; AGG chr2 60485444 60485463 60485447 -
cagttagcttaaaggcatgg

SEQ ID NO: 180923 - DNA, 20 bp, Artificial Sequence
  Synthetic oligonucleotide; TGG chr2 60485434 60485453 60485437 -
aaaggcatggaggacattcc

SEQ ID NO: 180924 - DNA, 20 bp, Artificial Sequence
  Synthetic oligonucleotide; GGG chr2 60485433 60485452 60485436 -
aaggcatggaggacattcct

SEQ ID NO: 180925 - DNA, 20 bp, Artificial Sequence
  Synthetic oligonucleotide; TAG chr2 60485428 60485447 60485431 -
atggaggacattcctgggac

SEQ ID NO: 180926 - DNA, 20 bp, Artificial Sequence
  Synthetic oligonucleotide; TAG chr2 60485418 60485437 60485421 -
ttcctgggactagcatctgc

SEQ ID NO: 180927 - DNA, 20 bp, Artificial Sequence
  Synthetic oligonucleotide; AAG chr2 60485413 60485432 60485416 -
gggactagcatctgctagcc

SEQ ID NO: 180928 - DNA, 20 bp, Artificial Sequence
  Synthetic oligonucleotide; AAG chr2 60485406 60485425 60485409 -
gcatctgctagccaagaacg

SEQ ID NO: 180929 - DNA, 20 bp, Artificial Sequence
  Synthetic oligonucleotide; CAG chr2 60485399 60485418 60485402 -
ctagccaagaacgaagatga

SEQ ID NO: 180930 - DNA, 20 bp, Artificial Sequence
  Synthetic oligonucleotide; TGG chr2 60485391 60485410 60485394 -
gaacgaagatgacagcaaca

SEQ ID NO: 180931 - DNA, 20 bp, Artificial Sequence
  Synthetic oligonucleotide; TAG chr2 60485385 60485404 60485388 -
agatgacagcaacatggccg

SEQ ID NO: 180932 - DNA, 20 bp, Artificial Sequence
  Synthetic oligonucleotide; GAG chr2 60485383 60485402 60485386 -
atgacagcaacatggccgta

SEQ ID NO: 180933 - DNA, 20 bp, Artificial Sequence
  Synthetic oligonucleotide; AGG chr2 60485382 60485401 60485385 -
tgacagcaacatggccgtag

SEQ ID NO: 180934 - DNA, 20 bp, Artificial Sequence
  Synthetic oligonucleotide; TGG chr2 60485377 60485396 60485380 -
gcaacatggccgtagaggca

SEQ ID NO: 180935 - DNA, 20 bp, Artificial Sequence
  Synthetic oligonucleotide; GGG chr2 60485376 60485395 60485379 -
caacatggccgtagaggcat

SEQ ID NO: 180936 - DNA, 20 bp, Artificial Sequence
  Synthetic oligonucleotide; TGG chr2 60485367 60485386 60485370 -
cgtagaggcatgggccctgc

SEQ ID NO: 180937 - DNA, 20 bp, Artificial Sequence
  Synthetic oligonucleotide; GGG chr2 60485366 60485385 60485369 -
gtagaggcatgggccctgct

SEQ ID NO: 180938 - DNA, 20 bp, Artificial Sequence
  Synthetic oligonucleotide; GGG chr2 60485365 60485384 60485368 -
tagaggcatgggccctgctg

SEQ ID NO: 180939 - DNA, 20 bp, Artificial Sequence
  Synthetic oligonucleotide; CAG chr2 60485348 60485367 60485351 -
ctggggctaataacccactg

SEQ ID NO: 180940 - DNA, 20 bp, Artificial Sequence
  Synthetic oligonucleotide; AGG chr2 60485347 60485366 60485350 -
tggggctaataacccactgc

SEQ ID NO: 180941 - DNA, 20 bp, Artificial Sequence
  Synthetic oligonucleotide; TGG chr2 60485337 60485356 60485340 -
aacccactgcaggctatcct

SEQ ID NO: 180942 - DNA, 20 bp, Artificial Sequence
  Synthetic oligonucleotide; TGG chr2 60485325 60485344 60485328 -
gctatccttggcattcttgc

SEQ ID NO: 180943 - DNA, 20 bp, Artificial Sequence
  Synthetic oligonucleotide; GAG chr2 60485323 60485342 60485326 -
tatccttggcattcttgctg

SEQ ID NO: 180944 - DNA, 20 bp, Artificial Sequence
  Synthetic oligonucleotide; TGG chr2 60485320 60485339 60485323 -
ccttggcattcttgctggag

SEQ ID NO: 180945 - DNA, 20 bp, Artificial Sequence
  Synthetic oligonucleotide; TGG chr2 60485300 60485319 60485303 -
tggccttgctccaccctacc

SEQ ID NO: 180946 - DNA, 20 bp, Artificial Sequence
  Synthetic oligonucleotide; CAG chr2 60485284 60485303 60485287 -
tacctggtcactgtgccgtt

SEQ ID NO: 180947 - DNA, 20 bp, Artificial Sequence
  Synthetic oligonucleotide; TGG chr2 60485279 60485298 60485282 -
ggtcactgtgccgttcagtc

SEQ ID NO: 180948 - DNA, 20 bp, Artificial Sequence
  Synthetic oligonucleotide; GGG chr2 60485278 60485297 60485281 -
gtcactgtgccgttcagtct

SEQ ID NO: 180949 - DNA, 20 bp, Artificial Sequence
  Synthetic oligonucleotide; TGG chr2 60485272 60485291 60485275 -
gtgccgttcagtctgggcta

SEQ ID NO: 180950 - DNA, 20 bp, Artificial Sequence
  Synthetic oligonucleotide; AAG chr2 60485236 60485255 60485239 -
ctcatcccattgcatttcat

SEQ ID NO: 180951 - DNA, 20 bp, Artificial Sequence
  Synthetic oligonucleotide; CAG chr2 60485232 60485251 60485235 -
tcccattgcatttcataagc

SEQ ID NO: 180952 - DNA, 20 bp, Artificial Sequence
  Synthetic oligonucleotide; AAG chr2 60485222 60485241 60485225 -
tttcataagccagtaactcc

SEQ ID NO: 180953 - DNA, 20 bp, Artificial Sequence
  Synthetic oligonucleotide; AGG chr2 60485221 60485240 60485224 -
ttcataagccagtaactcca

SEQ ID NO: 180954 - DNA, 20 bp, Artificial Sequence
  Synthetic oligonucleotide; CAG chr2 60485217 60485236 60485220 -
taagccagtaactccaaggc

SEQ ID NO: 180955 - DNA, 20 bp, Artificial Sequence
  Synthetic oligonucleotide; TGG chr2 60485199 60485218 60485202 -
gccagacttccattacactc

SEQ ID NO: 180956 - DNA, 20 bp, Artificial Sequence
  Synthetic oligonucleotide; CAG chr2 60485179 60485198 60485182 -
tggatgactgcatttatttg

SEQ ID NO: 180957 - DNA, 20 bp, Artificial Sequence
  Synthetic oligonucleotide; AAG chr2 60485169 60485188 60485172 -
catttatttgcagtgacttc

SEQ ID NO: 180958 - DNA, 20 bp, Artificial Sequence
  Synthetic oligonucleotide; AGG chr2 60485168 60485187 60485171 -
atttatttgcagtgacttca

SEQ ID NO: 180959 - DNA, 20 bp, Artificial Sequence
  Synthetic oligonucleotide; AAG chr2 60485165 60485184 60485168 -
tatttgcagtgacttcaagg

SEQ ID NO: 180960 - DNA, 20 bp, Artificial Sequence
  Synthetic oligonucleotide; AAG chr2 60485162 60485181 60485165 -
ttgcagtgacttcaaggaag

SEQ ID NO: 180961 - DNA, 20 bp, Artificial Sequence
  Synthetic oligonucleotide; AGG chr2 60485161 60485180 60485164 -
tgcagtgacttcaaggaaga

SEQ ID NO: 180962 - DNA, 20 bp, Artificial Sequence
  Synthetic oligonucleotide; GGG chr2 60485160 60485179 60485163 -
gcagtgacttcaaggaagaa

SEQ ID NO: 180963 - DNA, 20 bp, Artificial Sequence
  Synthetic oligonucleotide; GGG chr2 60485159 60485178 60485162 -
cagtgacttcaaggaagaag

SEQ ID NO: 180964 - DNA, 20 bp, Artificial Sequence
  Synthetic oligonucleotide; TAG chr2 60485150 60485169 60485153 -
caaggaagaaggggcctgtt

SEQ ID NO: 180965 - DNA, 20 bp, Artificial Sequence
  Synthetic oligonucleotide; AGG chr2 60485149 60485168 60485152 -
aaggaagaaggggcctgttt

SEQ ID NO: 180966 - DNA, 20 bp, Artificial Sequence
  Synthetic oligonucleotide; TAG chr2 60485142 60485161 60485145 -
aaggggcctgtttaggaaat

SEQ ID NO: 180967 - DNA, 20 bp, Artificial Sequence
  Synthetic oligonucleotide; AGG chr2 60485141 60485160 60485144 -
aggggcctgtttaggaaatt

SEQ ID NO: 180968 - DNA, 20 bp, Artificial Sequence
  Synthetic oligonucleotide; TGG chr2 60485135 60485154 60485138 -
ctgtttaggaaattaggcac

SEQ ID NO: 180969 - DNA, 20 bp, Artificial Sequence
  Synthetic oligonucleotide; TGG chr2 60485130 60485149 60485133 -
taggaaattaggcactggcc

SEQ ID NO: 180970 - DNA, 20 bp, Artificial Sequence
  Synthetic oligonucleotide; AAG chr2 60485123 60485142 60485126 -
ttaggcactggcctggtgaa

SEQ ID NO: 180971 - DNA, 20 bp, Artificial Sequence
  Synthetic oligonucleotide; AGG chr2 60485122 60485141 60485125 -
taggcactggcctggtgaaa

SEQ ID NO: 180972 - DNA, 20 bp, Artificial Sequence
  Synthetic oligonucleotide; TGG chr2 60485103 60485122 60485106 -
aaggtcaacttgcgaaattg

SEQ ID NO: 180973 - DNA, 20 bp, Artificial Sequence
  Synthetic oligonucleotide; AAG chr2 60485096 60485115 60485099 -
acttgcgaaattgtggctgc

SEQ ID NO: 180974 - DNA, 20 bp, Artificial Sequence
  Synthetic oligonucleotide; AGG chr2 60485095 60485114 60485098 -
cttgcgaaattgtggctgca

SEQ ID NO: 180975 - DNA, 20 bp, Artificial Sequence
  Synthetic oligonucleotide; GGG chr2 60485094 60485113 60485097 -
ttgcgaaattgtggctgcaa

SEQ ID NO: 180976 - DNA, 20 bp, Artificial Sequence
  Synthetic oligonucleotide; AAG chr2 60485076 60485095 60485079 -
aagggatgcctttttcttcc

SEQ ID NO: 180977 - DNA, 20 bp, Artificial Sequence
  Synthetic oligonucleotide; AGG chr2 60485075 60485094 60485078 -
agggatgcctttttcttcca

SEQ ID NO: 180978 - DNA, 20 bp, Artificial Sequence
  Synthetic oligonucleotide; TGG chr2 60485064 60485083 60485067 -
tttcttccaaggctatgcct

SEQ ID NO: 180979 - DNA, 20 bp, Artificial Sequence
  Synthetic oligonucleotide; TGG chr2 60485061 60485080 60485064 -
cttccaaggctatgccttgg

SEQ ID NO: 180980 - DNA, 20 bp, Artificial Sequence
  Synthetic oligonucleotide; TGG chr2 60485058 60485077 60485061 -
ccaaggctatgccttggtgg

SEQ ID NO: 180981 - DNA, 20 bp, Artificial Sequence
  Synthetic oligonucleotide; TGG chr2 60485055 60485074 60485058 -
aggctatgccttggtggtgg

SEQ ID NO: 180982 - DNA, 20 bp, Artificial Sequence
  Synthetic oligonucleotide; GAG chr2 60485051 60485070 60485054 -
tatgccttggtggtggtggt

SEQ ID NO: 180983 - DNA, 20 bp, Artificial Sequence
  Synthetic oligonucleotide; AGG chr2 60485050 60485069 60485053 -
atgccttggtggtggtggtg

SEQ ID NO: 180984 - DNA, 20 bp, Artificial Sequence
  Synthetic oligonucleotide; GGG chr2 60485049 60485068 60485052 -
tgccttggtggtggtggtga

SEQ ID NO: 180985 - DNA, 20 bp, Artificial Sequence
  Synthetic oligonucleotide; TGG chr2 60484993 60485012 60484996 -
tttaaatactgttttttgtt

SEQ ID NO: 180986 - DNA, 20 bp, Artificial Sequence
  Synthetic oligonucleotide; TGG chr2 60484989 60485008 60484992 -
aatactgttttttgtttggt

SEQ ID NO: 180987 - DNA, 20 bp, Artificial Sequence
  Synthetic oligonucleotide; TGG chr2 60484985 60485004 60484988 -
ctgttttttgtttggttggt

SEQ ID NO: 180988 - DNA, 20 bp, Artificial Sequence
  Synthetic oligonucleotide; AAG chr2 60484964 60484983 60484967 -
ggtttttttttttttttttt

SEQ ID NO: 180989 - DNA, 20 bp, Artificial Sequence
  Synthetic oligonucleotide; AAG chr2 60484953 60484972 60484956 -
tttttttttaagtcctaaac

SEQ ID NO: 180990 - DNA, 20 bp, Artificial Sequence
  Synthetic oligonucleotide; CAG chr2 60484945 60484964 60484948 -
taagtcctaaacaagtgcca

SEQ ID NO: 180991 - DNA, 20 bp, Artificial Sequence
  Synthetic oligonucleotide; GAG chr2 60484943 60484962 60484946 -
agtcctaaacaagtgccaca

SEQ ID NO: 180992 - DNA, 20 bp, Artificial Sequence
  Synthetic oligonucleotide; AGG chr2 60484942 60484961 60484945 -
gtcctaaacaagtgccacag

SEQ ID NO: 180993 - DNA, 20 bp, Artificial Sequence
  Synthetic oligonucleotide; TGG chr2 60484930 60484949 60484933 -
tgccacagaggatttctttt

SEQ ID NO: 180994 - DNA, 20 bp, Artificial Sequence
  Synthetic oligonucleotide; TGG chr2 60484909 60484928 60484912 -
ggcttgaacttgataaaatt

SEQ ID NO: 180995 - DNA, 20 bp, Artificial Sequence
  Synthetic oligonucleotide; GAG chr2 60484907 60484926 60484910 -
cttgaacttgataaaatttg

SEQ ID NO: 180996 - DNA, 20 bp, Artificial Sequence
  Synthetic oligonucleotide; AAG chr2 60484899 60484918 60484902 -
tgataaaatttggagcacac

SEQ ID NO: 180997 - DNA, 20 bp, Artificial Sequence
  Synthetic oligonucleotide; TGG chr2 60484886 60484905 60484889 -
agcacacaagtttacacaca

SEQ ID NO: 180998 - DNA, 20 bp, Artificial Sequence
  Synthetic oligonucleotide; CAG chr2 60484852 60484871 60484855 -
caccccttctcccatctccc

SEQ ID NO: 180999 - DNA, 20 bp, Artificial Sequence
  Synthetic oligonucleotide; CAG chr2 60484844 60484863 60484847 -
ctcccatctccccagacccc

SEQ ID NO: 181000 - DNA, 20 bp, Artificial Sequence
  Synthetic oligonucleotide; GAG chr2 60484824 60484843 60484827 -
cagcacatatgttccataat

SEQ ID NO: 181001 - DNA, 20 bp, Artificial Sequence
  Synthetic oligonucleotide; AGG chr2 60484823 60484842 60484826 -
agcacatatgttccataatg

SEQ ID NO: 181002 - DNA, 20 bp, Artificial Sequence
  Synthetic oligonucleotide; AAG chr2 60484813 60484832 60484816 -
ttccataatgaggtgttcct

SEQ ID NO: 181003 - DNA, 20 bp, Artificial Sequence
  Synthetic oligonucleotide; GAG chr2 60484809 60484828 60484812 -
ataatgaggtgttcctaagt

SEQ ID NO: 181004 - DNA, 20 bp, Artificial Sequence
  Synthetic oligonucleotide; GAG chr2 60484792 60484811 60484795 -
agtgagaattcccataattt

SEQ ID NO: 181005 - DNA, 20 bp, Artificial Sequence
  Synthetic oligonucleotide; AGG chr2 60484791 60484810 60484794 -
gtgagaattcccataatttg

SEQ ID NO: 181006 - DNA, 20 bp, Artificial Sequence
  Synthetic oligonucleotide; TGG chr2 60484780 60484799 60484783 -
cataatttgaggttttatac

SEQ ID NO: 181007 - DNA, 20 bp, Artificial Sequence
  Synthetic oligonucleotide; TGG chr2 60484775 60484794 60484778 -
tttgaggttttatactggaa

SEQ ID NO: 181008 - DNA, 20 bp, Artificial Sequence
  Synthetic oligonucleotide; AAG chr2 60484768 60484787 60484771 -
ttttatactggaatggtgat

SEQ ID NO: 181009 - DNA, 20 bp, Artificial Sequence
  Synthetic oligonucleotide; AGG chr2 60484767 60484786 60484770 -
tttatactggaatggtgata

SEQ ID NO: 181010 - DNA, 20 bp, Artificial Sequence
  Synthetic oligonucleotide; GGG chr2 60484766 60484785 60484769 -
ttatactggaatggtgataa

SEQ ID NO: 181011 - DNA, 20 bp, Artificial Sequence
  Synthetic oligonucleotide; CAG chr2 60484763 60484782 60484766 -
tactggaatggtgataaggg

SEQ ID NO: 181012 - DNA, 20 bp, Artificial Sequence
  Synthetic oligonucleotide; AGG chr2 60484762 60484781 60484765 -
actggaatggtgataagggc

SEQ ID NO: 181013 - DNA, 20 bp, Artificial Sequence
  Synthetic oligonucleotide; CAG chr2 60484753 60484772 60484756 -
gtgataagggcaggaaacct

SEQ ID NO: 181014 - DNA, 20 bp, Artificial Sequence
  Synthetic oligonucleotide; GAG chr2 60484731 60484750 60484734 -
gcccatgtgcattttttctc

SEQ ID NO: 181015 - DNA, 20 bp, Artificial Sequence
  Synthetic oligonucleotide; TGG chr2 60484728 60484747 60484731 -
catgtgcattttttctcgag

SEQ ID NO: 181016 - DNA, 20 bp, Artificial Sequence
  Synthetic oligonucleotide; AAG chr2 60484666 60484685 60484669 -
tccaaattcccccttctctt

SEQ ID NO: 181017 - DNA, 20 bp, Artificial Sequence
  Synthetic oligonucleotide; GAG chr2 60484652 60484671 60484655 -
tctcttaagaaaaaacacgt

SEQ ID NO: 181018 - DNA, 20 bp, Artificial Sequence
  Synthetic oligonucleotide; TGG chr2 60484643 60484662 60484646 -
aaaaaacacgtgagccatgt

SEQ ID NO: 181019 - DNA, 20 bp, Artificial Sequence
  Synthetic oligonucleotide; AAG chr2 60484640 60484659 60484643 -
aaacacgtgagccatgttgg

SEQ ID NO: 181020 - DNA, 20 bp, Artificial Sequence
  Synthetic oligonucleotide; CAG chr2 60484635 60484654 60484638 -
cgtgagccatgttggaagta

SEQ ID NO: 181021 - DNA, 20 bp, Artificial Sequence
  Synthetic oligonucleotide; CAG chr2 60484623 60484642 60484626 -
tggaagtacagccttgacct

SEQ ID NO: 181022 - DNA, 20 bp, Artificial Sequence
  Synthetic oligonucleotide; CAG chr2 60484614 60484633 60484617 -
agccttgacctcagcctcac

SEQ ID NO: 181023 - DNA, 20 bp, Artificial Sequence
  Synthetic oligonucleotide; AGG chr2 60484613 60484632 60484616 -
gccttgacctcagcctcacc

SEQ ID NO: 181024 - DNA, 20 bp, Artificial Sequence
  Synthetic oligonucleotide; CGG chr2 60484608 60484627 60484611 -
gacctcagcctcaccaggtg

SEQ ID NO: 181025 - DNA, 20 bp, Artificial Sequence
  Synthetic oligonucleotide; CGG chr2 60484597 60484616 60484600 -
caccaggtgcggctgctgac

SEQ ID NO: 181026 - DNA, 20 bp, Artificial Sequence
  Synthetic oligonucleotide; TAG chr2 60484584 60484603 60484587 -
tgctgaccggtgcaaaaaaa

SEQ ID NO: 181027 - DNA, 20 bp, Artificial Sequence
  Synthetic oligonucleotide; AGG chr2 60484583 60484602 60484586 -
gctgaccggtgcaaaaaaat

SEQ ID NO: 181028 - DNA, 20 bp, Artificial Sequence
  Synthetic oligonucleotide; AAG chr2 60484567 60484586 60484570 -
aaataggaaatattatttaa

SEQ ID NO: 181029 - DNA, 20 bp, Artificial Sequence
  Synthetic oligonucleotide; AGG chr2 60484566 60484585 60484569 -
aataggaaatattatttaaa

SEQ ID NO: 181030 - DNA, 20 bp, Artificial Sequence
  Synthetic oligonucleotide; CAG chr2 60484563 60484582 60484566 -
aggaaatattatttaaaagg

SEQ ID NO: 181031 - DNA, 20 bp, Artificial Sequence
  Synthetic oligonucleotide; AGG chr2 60484562 60484581 60484565 -
ggaaatattatttaaaaggc

SEQ ID NO: 181032 - DNA, 20 bp, Artificial Sequence
  Synthetic oligonucleotide; GGG chr2 60484561 60484580 60484564 -
gaaatattatttaaaaggca

SEQ ID NO: 181033 - DNA, 20 bp, Artificial Sequence
  Synthetic oligonucleotide; GAG chr2 60484559 60484578 60484562 -
aatattatttaaaaggcagg

SEQ ID NO: 181034 - DNA, 20 bp, Artificial Sequence
  Synthetic oligonucleotide; AGG chr2 60484558 60484577 60484561 -
atattatttaaaaggcaggg

SEQ ID NO: 181035 - DNA, 20 bp, Artificial Sequence
  Synthetic oligonucleotide; GGG chr2 60484557 60484576 60484560 -
tattatttaaaaggcaggga

SEQ ID NO: 181036 - DNA, 20 bp, Artificial Sequence
  Synthetic oligonucleotide; GGG chr2 60484556 60484575 60484559 -
attatttaaaaggcagggag

SEQ ID NO: 181037 - DNA, 20 bp, Artificial Sequence
  Synthetic oligonucleotide; GAG chr2 60484554 60484573 60484557 -
tatttaaaaggcagggaggg

SEQ ID NO: 181038 - DNA, 20 bp, Artificial Sequence
  Synthetic oligonucleotide; GAG chr2 60484552 60484571 60484555 -
tttaaaaggcagggagggga

SEQ ID NO: 181039 - DNA, 20 bp, Artificial Sequence
  Synthetic oligonucleotide; CAG chr2 60484523 60484542 60484526 -
ttccacaatcactgctgttt

SEQ ID NO: 181040 - DNA, 20 bp, Artificial Sequence
  Synthetic oligonucleotide; AAG chr2 60484516 60484535 60484519 -
atcactgctgtttcagtgaa

SEQ ID NO: 181041 - DNA, 20 bp, Artificial Sequence
  Synthetic oligonucleotide; CGG chr2 60484508 60484527 60484511 -
tgtttcagtgaaaagcaacc

SEQ ID NO: 181042 - DNA, 20 bp, Artificial Sequence
  Synthetic oligonucleotide; TGG chr2 60484478 60484497 60484481 -
gtaaaacctacttccctttc

SEQ ID NO: 181043 - DNA, 20 bp, Artificial Sequence
  Synthetic oligonucleotide; TGG chr2 60484469 60484488 60484472 -
acttccctttctggtgaatg

SEQ ID NO: 181044 - DNA, 20 bp, Artificial Sequence
  Synthetic oligonucleotide; CAG chr2 60484456 60484475 60484459 -
gtgaatgtggctgtttttga

SEQ ID NO: 181045 - DNA, 20 bp, Artificial Sequence
  Synthetic oligonucleotide; CAG chr2 60484453 60484472 60484456 -
aatgtggctgtttttgacag

SEQ ID NO: 181046 - DNA, 20 bp, Artificial Sequence
  Synthetic oligonucleotide; GAG chr2 60484451 60484470 60484454 -
tgtggctgtttttgacagca

SEQ ID NO: 181047 - DNA, 20 bp, Artificial Sequence
  Synthetic oligonucleotide; AGG chr2 60484450 60484469 60484453 -
gtggctgtttttgacagcag

SEQ ID NO: 181048 - DNA, 20 bp, Artificial Sequence
  Synthetic oligonucleotide; CAG chr2 60484443 60484462 60484446 -
tttttgacagcagaggaccc

SEQ ID NO: 181049 - DNA, 20 bp, Artificial Sequence
  Synthetic oligonucleotide; GAG chr2 60484435 60484454 60484438 -
agcagaggaccccagttgtt

SEQ ID NO: 181050 - DNA, 20 bp, Artificial Sequence
  Synthetic oligonucleotide; AGG chr2 60484434 60484453 60484437 -
gcagaggaccccagttgttg

SEQ ID NO: 181051 - DNA, 20 bp, Artificial Sequence
  Synthetic oligonucleotide; AAG chr2 60484427 60484446 60484430 -
accccagttgttgaggacta

SEQ ID NO: 181052 - DNA, 20 bp, Artificial Sequence
  Synthetic oligonucleotide; GAG chr2 60484425 60484444 60484428 -
cccagttgttgaggactaaa

SEQ ID NO: 181053 - DNA, 20 bp, Artificial Sequence
  Synthetic oligonucleotide; GAG chr2 60484423 60484442 60484426 -
cagttgttgaggactaaaga

SEQ ID NO: 181054 - DNA, 20 bp, Artificial Sequence
  Synthetic oligonucleotide; GAG chr2 60484421 60484440 60484424 -
gttgttgaggactaaagaga

SEQ ID NO: 181055 - DNA, 20 bp, Artificial Sequence
  Synthetic oligonucleotide; AAG chr2 60484418 60484437 60484421 -
gttgaggactaaagagagag

SEQ ID NO: 181056 - DNA, 20 bp, Artificial Sequence
  Synthetic oligonucleotide; GAG chr2 60484413 60484432 60484416 -
ggactaaagagagagaagat

SEQ ID NO: 181057 - DNA, 20 bp, Artificial Sequence
  Synthetic oligonucleotide; AAG chr2 60484409 60484428 60484412 -
taaagagagagaagatgaga

SEQ ID NO: 181058 - DNA, 20 bp, Artificial Sequence
  Synthetic oligonucleotide; AAG chr2 60484406 60484425 60484409 -
agagagagaagatgagaaag

SEQ ID NO: 181059 - DNA, 20 bp, Artificial Sequence
  Synthetic oligonucleotide; TGG chr2 60484399 60484418 60484402 -
gaagatgagaaagaagatgc

SEQ ID NO: 181060 - DNA, 20 bp, Artificial Sequence
  Synthetic oligonucleotide; CAG chr2 60484393 60484412 60484396 -
gagaaagaagatgctggaaa

SEQ ID NO: 181061 - DNA, 20 bp, Artificial Sequence
  Synthetic oligonucleotide; GAG chr2 60484391 60484410 60484394 -
gaaagaagatgctggaaaca

SEQ ID NO: 181062 - DNA, 20 bp, Artificial Sequence
  Synthetic oligonucleotide; AGG chr2 60484390 60484409 60484393 -
aaagaagatgctggaaacag

SEQ ID NO: 181063 - DNA, 20 bp, Artificial Sequence
  Synthetic oligonucleotide; TGG chr2 60484386 60484405 60484389 -
aagatgctggaaacagaggt

SEQ ID NO: 181064 - DNA, 20 bp, Artificial Sequence
  Synthetic oligonucleotide; GAG chr2 60484384 60484403 60484387 -
gatgctggaaacagaggttg

SEQ ID NO: 181065 - DNA, 20 bp, Artificial Sequence
  Synthetic oligonucleotide; AAG chr2 60484380 60484399 60484383 -
ctggaaacagaggttggaga

SEQ ID NO: 181066 - DNA, 20 bp, Artificial Sequence
  Synthetic oligonucleotide; GAG chr2 60484378 60484397 60484381 -
ggaaacagaggttggagaaa

SEQ ID NO: 181067 - DNA, 20 bp, Artificial Sequence
  Synthetic oligonucleotide; GAG chr2 60484376 60484395 60484379 -
aaacagaggttggagaaaga

SEQ ID NO: 181068 - DNA, 20 bp, Artificial Sequence
  Synthetic oligonucleotide; AGG chr2 60484375 60484394 60484378 -
aacagaggttggagaaagag

SEQ ID NO: 181069 - DNA, 20 bp, Artificial Sequence
  Synthetic oligonucleotide; AAG chr2 60484371 60484390 60484374 -
gaggttggagaaagagaggc

SEQ ID NO: 181070 - DNA, 20 bp, Artificial Sequence
  Synthetic oligonucleotide; AGG chr2 60484370 60484389 60484373 -
aggttggagaaagagaggca

SEQ ID NO: 181071 - DNA, 20 bp, Artificial Sequence
  Synthetic oligonucleotide; AAG chr2 60484367 60484386 60484370 -
ttggagaaagagaggcaagg

SEQ ID NO: 181072 - DNA, 20 bp, Artificial Sequence
  Synthetic oligonucleotide; TAG chr2 60484364 60484383 60484367 -
gagaaagagaggcaaggaag

SEQ ID NO: 181073 - DNA, 20 bp, Artificial Sequence
  Synthetic oligonucleotide; AAG chr2 60484360 60484379 60484363 -
aagagaggcaaggaagtaga

SEQ ID NO: 181074 - DNA, 20 bp, Artificial Sequence
  Synthetic oligonucleotide; AGG chr2 60484359 60484378 60484362 -
agagaggcaaggaagtagaa

SEQ ID NO: 181075 - DNA, 20 bp, Artificial Sequence
  Synthetic oligonucleotide; GAG chr2 60484357 60484376 60484360 -
agaggcaaggaagtagaaag

SEQ ID NO: 181076 - DNA, 20 bp, Artificial Sequence
  Synthetic oligonucleotide; AGG chr2 60484356 60484375 60484359 -
gaggcaaggaagtagaaagg

SEQ ID NO: 181077 - DNA, 20 bp, Artificial Sequence
  Synthetic oligonucleotide; AAG chr2 60484351 60484370 60484354 -
aaggaagtagaaaggaggaa

SEQ ID NO: 181078 - DNA, 20 bp, Artificial Sequence
  Synthetic oligonucleotide; AGG chr2 60484350 60484369 60484353 -
aggaagtagaaaggaggaaa

SEQ ID NO: 181079 - DNA, 20 bp, Artificial Sequence
  Synthetic oligonucleotide; GGG chr2 60484349 60484368 60484352 -
ggaagtagaaaggaggaaaa

SEQ ID NO: 181080 - DNA, 20 bp, Artificial Sequence
  Synthetic oligonucleotide; GGG chr2 60484348 60484367 60484351 -
gaagtagaaaggaggaaaag

SEQ ID NO: 181081 - DNA, 20 bp, Artificial Sequence
  Synthetic oligonucleotide; AAG chr2 60484345 60484364 60484348 -
gtagaaaggaggaaaagggg

SEQ ID NO: 181082 - DNA, 20 bp, Artificial Sequence
  Synthetic oligonucleotide; GAG chr2 60484343 60484362 60484346 -
agaaaggaggaaaaggggaa

SEQ ID NO: 181083 - DNA, 20 bp, Artificial Sequence
  Synthetic oligonucleotide; GAG chr2 60484341 60484360 60484344 -
aaaggaggaaaaggggaaga

SEQ ID NO: 181084 - DNA, 20 bp, Artificial Sequence
  Synthetic oligonucleotide; AGG chr2 60484340 60484359 60484343 -
aaggaggaaaaggggaagag

SEQ ID NO: 181085 - DNA, 20 bp, Artificial Sequence
  Synthetic oligonucleotide; GAG chr2 60484338 60484357 60484341 -
ggaggaaaaggggaagagag

SEQ ID NO: 181086 - DNA, 20 bp, Artificial Sequence
  Synthetic oligonucleotide; AGG chr2 60484337 60484356 60484340 -
gaggaaaaggggaagagagg

SEQ ID NO: 181087 - DNA, 20 bp, Artificial Sequence
  Synthetic oligonucleotide; CAG chr2 60484334 60484353 60484337 -
gaaaaggggaagagaggagg

SEQ ID NO: 181088 - DNA, 20 bp, Artificial Sequence
  Synthetic oligonucleotide; AGG chr2 60484333 60484352 60484336 -
aaaaggggaagagaggaggc

SEQ ID NO: 181089 - DNA, 20 bp, Artificial Sequence
  Synthetic oligonucleotide; GGG chr2 60484332 60484351 60484335 -
aaaggggaagagaggaggca

SEQ ID NO: 181090 - DNA, 20 bp, Artificial Sequence
  Synthetic oligonucleotide; GGG chr2 60484331 60484350 60484334 -
aaggggaagagaggaggcag

SEQ ID NO: 181091 - DNA, 20 bp, Artificial Sequence
  Synthetic oligonucleotide; GGG chr2 60484330 60484349 60484333 -
aggggaagagaggaggcagg

SEQ ID NO: 181092 - DNA, 20 bp, Artificial Sequence
  Synthetic oligonucleotide; GAG chr2 60484328 60484347 60484331 -
gggaagagaggaggcagggg

SEQ ID NO: 181093 - DNA, 20 bp, Artificial Sequence
  Synthetic oligonucleotide; GAG chr2 60484326 60484345 60484329 -
gaagagaggaggcaggggga

SEQ ID NO: 181094 - DNA, 20 bp, Artificial Sequence
  Synthetic oligonucleotide; GAG chr2 60484324 60484343 60484327 -
agagaggaggcagggggaga

SEQ ID NO: 181095 - DNA, 20 bp, Artificial Sequence
  Synthetic oligonucleotide; AGG chr2 60484323 60484342 60484326 -
gagaggaggcagggggagag

SEQ ID NO: 181096 - DNA, 20 bp, Artificial Sequence
  Synthetic oligonucleotide; GGG chr2 60484322 60484341 60484325 -
agaggaggcagggggagaga

SEQ ID NO: 181097 - DNA, 20 bp, Artificial Sequence
  Synthetic oligonucleotide; TGG chr2 60484318 60484337 60484321 -
gaggcagggggagagagggt

SEQ ID NO: 181098 - DNA, 20 bp, Artificial Sequence
  Synthetic oligonucleotide; GAG chr2 60484310 60484329 60484313 -
gggagagagggttggaattc

SEQ ID NO: 181099 - DNA, 20 bp, Artificial Sequence
  Synthetic oligonucleotide; CAG chr2 60484300 60484319 60484303 -
gttggaattcgagctatttt

SEQ ID NO: 181100 - DNA, 20 bp, Artificial Sequence
  Synthetic oligonucleotide; GAG chr2 60484289 60484308 60484292 -
agctattttcagctgaatgt

SEQ ID NO: 181101 - DNA, 20 bp, Artificial Sequence
  Synthetic oligonucleotide; CAG chr2 60484284 60484303 60484287 -
ttttcagctgaatgtgagtg

SEQ ID NO: 181102 - DNA, 20 bp, Artificial Sequence
  Synthetic oligonucleotide; CAG chr2 60484274 60484293 60484277 -
aatgtgagtgcagatttcat

SEQ ID NO: 181103 - DNA, 20 bp, Artificial Sequence
  Synthetic oligonucleotide; AGG chr2 60484273 60484292 60484276 -
atgtgagtgcagatttcatc

SEQ ID NO: 181104 - DNA, 20 bp, Artificial Sequence
  Synthetic oligonucleotide; TGG chr2 60484266 60484285 60484269 -
tgcagatttcatcaggcttc

SEQ ID NO: 181105 - DNA, 20 bp, Artificial Sequence
  Synthetic oligonucleotide; GGG chr2 60484265 60484284 60484268 -
gcagatttcatcaggcttct

SEQ ID NO: 181106 - DNA, 20 bp, Artificial Sequence
  Synthetic oligonucleotide; CAG chr2 60484259 60484278 60484262 -
ttcatcaggcttctgggcta

SEQ ID NO: 181107 - DNA, 20 bp, Artificial Sequence
  Synthetic oligonucleotide; AGG chr2 60484258 60484277 60484261 -
tcatcaggcttctgggctac

SEQ ID NO: 181108 - DNA, 20 bp, Artificial Sequence
  Synthetic oligonucleotide; GGG chr2 60484257 60484276 60484260 -
catcaggcttctgggctaca

SEQ ID NO: 181109 - DNA, 20 bp, Artificial Sequence
  Synthetic oligonucleotide; CGG chr2 60484240 60484259 60484243 -
acagggaaactgactgtgtg

SEQ ID NO: 181110 - DNA, 20 bp, Artificial Sequence
  Synthetic oligonucleotide; AAG chr2 60484215 60484234 60484218 -
cttgcgtgtaacttcctgtg

SEQ ID NO: 181111 - DNA, 20 bp, Artificial Sequence
  Synthetic oligonucleotide; CAG chr2 60484212 60484231 60484215 -
gcgtgtaacttcctgtgaag

SEQ ID NO: 181112 - DNA, 20 bp, Artificial Sequence
  Synthetic oligonucleotide; TGG chr2 60484206 60484225 60484209 -
aacttcctgtgaagcagccg

SEQ ID NO: 181113 - DNA, 20 bp, Artificial Sequence
  Synthetic oligonucleotide; CAG chr2 60484181 60484200 60484184 -
actgcattttctgacactgt

SEQ ID NO: 181114 - DNA, 20 bp, Artificial Sequence
  Synthetic oligonucleotide; GAG chr2 60484179 60484198 60484182 -
tgcattttctgacactgtca

SEQ ID NO: 181115 - DNA, 20 bp, Artificial Sequence
  Synthetic oligonucleotide; TGG chr2 60484174 60484193 60484177 -
tttctgacactgtcagagtc

SEQ ID NO: 181116 - DNA, 20 bp, Artificial Sequence
  Synthetic oligonucleotide; CAG chr2 60484161 60484180 60484164 -
cagagtctggacaaccctgc

SEQ ID NO: 181117 - DNA, 20 bp, Artificial Sequence
  Synthetic oligonucleotide; TAG chr2 60484154 60484173 60484157 -
tggacaaccctgccagctcc

SEQ ID NO: 181118 - DNA, 20 bp, Artificial Sequence
  Synthetic oligonucleotide; AAG chr2 60484151 60484170 60484154 -
acaaccctgccagctcctag

SEQ ID NO: 181119 - DNA, 20 bp, Artificial Sequence
  Synthetic oligonucleotide; AGG chr2 60484150 60484169 60484153 -
caaccctgccagctcctaga

SEQ ID NO: 181120 - DNA, 20 bp, Artificial Sequence
  Synthetic oligonucleotide; GGG chr2 60484149 60484168 60484152 -
aaccctgccagctcctagaa

SEQ ID NO: 181121 - DNA, 20 bp, Artificial Sequence
  Synthetic oligonucleotide; CAG chr2 60484129 60484148 60484132 -
gggcaacccaacaactgtca

SEQ ID NO: 181122 - DNA, 20 bp, Artificial Sequence
  Synthetic oligonucleotide; AAG chr2 60484123 60484142 60484126 -
cccaacaactgtcacagacg

SEQ ID NO: 181123 - DNA, 20 bp, Artificial Sequence
  Synthetic oligonucleotide; AAG chr2 60484114 60484133 60484117 -
tgtcacagacgaagcatcaa

SEQ ID NO: 181124 - DNA, 20 bp, Artificial Sequence
  Synthetic oligonucleotide; GAG chr2 60484108 60484127 60484111 -
agacgaagcatcaaaagcat

SEQ ID NO: 181125 - DNA, 20 bp, Artificial Sequence
  Synthetic oligonucleotide; TAG chr2 60484098 60484117 60484101 -
tcaaaagcatgagctgtcga

SEQ ID NO: 181126 - DNA, 20 bp, Artificial Sequence
  Synthetic oligonucleotide; CAG chr2 60484082 60484101 60484085 -
tcgatagtgacctgcatttg

SEQ ID NO: 181127 - DNA, 20 bp, Artificial Sequence
  Synthetic oligonucleotide; GAG chr2 60484072 60484091 60484075 -
cctgcatttgcagaaaatct

SEQ ID NO: 181128 - DNA, 20 bp, Artificial Sequence
  Synthetic oligonucleotide; AGG chr2 60484071 60484090 60484074 -
ctgcatttgcagaaaatctg

SEQ ID NO: 181129 - DNA, 20 bp, Artificial Sequence
  Synthetic oligonucleotide; GGG chr2 60484070 60484089 60484073 -
tgcatttgcagaaaatctga

SEQ ID NO: 181130 - DNA, 20 bp, Artificial Sequence
  Synthetic oligonucleotide; CAG chr2 60484055 60484074 60484058 -
tctgagggctttctaattaa

SEQ ID NO: 181131 - DNA, 20 bp, Artificial Sequence
  Synthetic oligonucleotide; GAG chr2 60484053 60484072 60484056 -
tgagggctttctaattaaca

SEQ ID NO: 181132 - DNA, 20 bp, Artificial Sequence
  Synthetic oligonucleotide; AGG chr2 60484052 60484071 60484055 -
gagggctttctaattaacag

SEQ ID NO: 181133 - DNA, 20 bp, Artificial Sequence
  Synthetic oligonucleotide; GAG chr2 60484050 60484069 60484053 -
gggctttctaattaacagag

SEQ ID NO: 181134 - DNA, 20 bp, Artificial Sequence
  Synthetic oligonucleotide; TAG chr2 60484039 60484058 60484042 -
ttaacagaggagctctaaat

SEQ ID NO: 181135 - DNA, 20 bp, Artificial Sequence
  Synthetic oligonucleotide; GAG chr2 60484037 60484056 60484040 -
aacagaggagctctaaatta

SEQ ID NO: 181136 - DNA, 20 bp, Artificial Sequence
  Synthetic oligonucleotide; AAG chr2 60484032 60484051 60484035 -
aggagctctaaattagagta

SEQ ID NO: 181137 - DNA, 20 bp, Artificial Sequence
  Synthetic oligonucleotide; AAG chr2 60484020 60484039 60484023 -
ttagagtaaagctgttcgac

SEQ ID NO: 181138 - DNA, 20 bp, Artificial Sequence
  Synthetic oligonucleotide; CGG chr2 60484005 60484024 60484008 -
tcgacaagacccctcatacg

SEQ ID NO: 181139 - DNA, 20 bp, Artificial Sequence
  Synthetic oligonucleotide; AAG chr2 60484001 60484020 60484004 -
caagacccctcatacgcggt

SEQ ID NO: 181140 - DNA, 20 bp, Artificial Sequence
  Synthetic oligonucleotide; CAG chr2 60483988 60484007 60483991 -
acgcggtaagtgtcacaatg

SEQ ID NO: 181141 - DNA, 20 bp, Artificial Sequence
  Synthetic oligonucleotide; AAG chr2 60483967 60483986 60483970 -
agataatcattacatctaac

SEQ ID NO: 181142 - DNA, 20 bp, Artificial Sequence
  Synthetic oligonucleotide; CAG chr2 60483950 60483969 60483953 -
aacaagcttctgatttttaa

SEQ ID NO: 181143 - DNA, 20 bp, Artificial Sequence
  Synthetic oligonucleotide; AAG chr2 60483947 60483966 60483950 -
aagcttctgatttttaacag

SEQ ID NO: 181144 - DNA, 20 bp, Artificial Sequence
  Synthetic oligonucleotide; GAG chr2 60483940 60483959 60483943 -
tgatttttaacagaagctat

SEQ ID NO: 181145 - DNA, 20 bp, Artificial Sequence
  Synthetic oligonucleotide; TGG chr2 60483921 60483940 60483924 -
tgagaccaactcatttataa

SEQ ID NO: 181146 - DNA, 20 bp, Artificial Sequence
  Synthetic oligonucleotide; CAG chr2 60483916 60483935 60483919 -
ccaactcatttataatggtt

SEQ ID NO: 181147 - DNA, 20 bp, Artificial Sequence
  Synthetic oligonucleotide; AAG chr2 60483908 60483927 60483911 -
tttataatggttcagtttca

SEQ ID NO: 181148 - DNA, 20 bp, Artificial Sequence
  Synthetic oligonucleotide; AGG chr2 60483907 60483926 60483910 -
ttataatggttcagtttcaa

SEQ ID NO: 181149 - DNA, 20 bp, Artificial Sequence
  Synthetic oligonucleotide; GGG chr2 60483906 60483925 60483909 -
tataatggttcagtttcaaa

SEQ ID NO: 181150 - DNA, 20 bp, Artificial Sequence
  Synthetic oligonucleotide; GGG chr2 60483905 60483924 60483908 -
ataatggttcagtttcaaag

SEQ ID NO: 181151 - DNA, 20 bp, Artificial Sequence
  Synthetic oligonucleotide; GGG chr2 60483904 60483923 60483907 -
taatggttcagtttcaaagg

SEQ ID NO: 181152 - DNA, 20 bp, Artificial Sequence
  Synthetic oligonucleotide; AAG chr2 60483895 60483914 60483898 -
agtttcaaagggggaaaaaa

SEQ ID NO: 181153 - DNA, 20 bp, Artificial Sequence
  Synthetic oligonucleotide; AAG chr2 60483887 60483906 60483890 -
agggggaaaaaaaagcaacc

SEQ ID NO: 181154 - DNA, 20 bp, Artificial Sequence
  Synthetic oligonucleotide; AAG chr2 60483883 60483902 60483886 -
ggaaaaaaaagcaaccaaga

SEQ ID NO: 181155 - DNA, 20 bp, Artificial Sequence
  Synthetic oligonucleotide; AAG chr2 60483877 60483896 60483880 -
aaaagcaaccaagaaagaaa

SEQ ID NO: 181156 - DNA, 20 bp, Artificial Sequence
  Synthetic oligonucleotide; AAG chr2 60483874 60483893 60483877 -
agcaaccaagaaagaaaaag

SEQ ID NO: 181157 - DNA, 20 bp, Artificial Sequence
  Synthetic oligonucleotide; AGG chr2 60483873 60483892 60483876 -
gcaaccaagaaagaaaaaga

SEQ ID NO: 181158 - DNA, 20 bp, Artificial Sequence
  Synthetic oligonucleotide; AAG chr2 60483869 60483888 60483872 -
ccaagaaagaaaaagaagga

SEQ ID NO: 181159 - DNA, 20 bp, Artificial Sequence
  Synthetic oligonucleotide; AAG chr2 60483861 60483880 60483864 -
gaaaaagaaggaaagaaaaa

SEQ ID NO: 181160 - DNA, 20 bp, Artificial Sequence
  Synthetic oligonucleotide; AGG chr2 60483860 60483879 60483863 -
aaaaagaaggaaagaaaaaa

SEQ ID NO: 181161 - DNA, 20 bp, Artificial Sequence
  Synthetic oligonucleotide; GGG chr2 60483859 60483878 60483862 -
aaaagaaggaaagaaaaaaa

SEQ ID NO: 181162 - DNA, 20 bp, Artificial Sequence
  Synthetic oligonucleotide; GAG chr2 60483857 60483876 60483860 -
aagaaggaaagaaaaaaagg

SEQ ID NO: 181163 - DNA, 20 bp, Artificial Sequence
  Synthetic oligonucleotide; AAG chr2 60483852 60483871 60483855 -
ggaaagaaaaaaagggagaa

SEQ ID NO: 181164 - DNA, 20 bp, Artificial Sequence
  Synthetic oligonucleotide; AGG chr2 60483851 60483870 60483854 -
gaaagaaaaaaagggagaaa

SEQ ID NO: 181165 - DNA, 20 bp, Artificial Sequence
  Synthetic oligonucleotide; AAG chr2 60483848 60483867 60483851 -
agaaaaaaagggagaaaagg

SEQ ID NO: 181166 - DNA, 20 bp, Artificial Sequence
  Synthetic oligonucleotide; AAG chr2 60483844 60483863 60483847 -
aaaaagggagaaaaggaaga

SEQ ID NO: 181167 - DNA, 20 bp, Artificial Sequence
  Synthetic oligonucleotide; AAG chr2 60483840 60483859 60483843 -
agggagaaaaggaagaaaga

SEQ ID NO: 181168 - DNA, 20 bp, Artificial Sequence
  Synthetic oligonucleotide; CAG chr2 60483831 60483850 60483834 -
aggaagaaagaaagaacaac

SEQ ID NO: 181169 - DNA, 20 bp, Artificial Sequence
  Synthetic oligonucleotide; AAG chr2 60483828 60483847 60483831 -
aagaaagaaagaacaaccag

SEQ ID NO: 181170 - DNA, 20 bp, Artificial Sequence
  Synthetic oligonucleotide; TAG chr2 60483817 60483836 60483820 -
aacaaccagaagaacaaaaa

SEQ ID NO: 181171 - DNA, 20 bp, Artificial Sequence
  Synthetic oligonucleotide; AGG chr2 60483816 60483835 60483819 -
acaaccagaagaacaaaaat

SEQ ID NO: 181172 - DNA, 20 bp, Artificial Sequence
  Synthetic oligonucleotide; AAG chr2 60483812 60483831 60483815 -
ccagaagaacaaaaatagga

SEQ ID NO: 181173 - DNA, 20 bp, Artificial Sequence
  Synthetic oligonucleotide; AAG chr2 60483800 60483819 60483803 -
aaataggaaagaaaaataaa

SEQ ID NO: 181174 - DNA, 20 bp, Artificial Sequence
  Synthetic oligonucleotide; TAG chr2 60483785 60483804 60483788 -
ataaaaagaaatcctccttc

SEQ ID NO: 181175 - DNA, 20 bp, Artificial Sequence
  Synthetic oligonucleotide; TGG chr2 60483777 60483796 60483780 -
aaatcctccttctagtgctt

SEQ ID NO: 181176 - DNA, 20 bp, Artificial Sequence
  Synthetic oligonucleotide; GGG chr2 60483776 60483795 60483779 -
aatcctccttctagtgcttt

SEQ ID NO: 181177 - DNA, 20 bp, Artificial Sequence
  Synthetic oligonucleotide; GAG chr2 60483772 60483791 60483775 -
ctccttctagtgctttgggc

SEQ ID NO: 181178 - DNA, 20 bp, Artificial Sequence
  Synthetic oligonucleotide; TAG chr2 60483765 60483784 60483768 -
tagtgctttgggcgagtgct

SEQ ID NO: 181179 - DNA, 20 bp, Artificial Sequence
  Synthetic oligonucleotide; CAG chr2 60483759 60483778 60483762 -
tttgggcgagtgcttagacc

SEQ ID NO: 181180 - DNA, 20 bp, Artificial Sequence
  Synthetic oligonucleotide; AAG chr2 60483727 60483746 60483730 -
tcttcctttgttgtctgctg

SEQ ID NO: 181181 - DNA, 20 bp, Artificial Sequence
  Synthetic oligonucleotide; CAG chr2 60483720 60483739 60483723 -
ttgttgtctgctgaagcatc

SEQ ID NO: 181182 - DNA, 20 bp, Artificial Sequence
  Synthetic oligonucleotide; TAG chr2 60483702 60483721 60483705 -
tccagatacatcttctgttt

SEQ ID NO: 181183 - DNA, 20 bp, Artificial Sequence
  Synthetic oligonucleotide; CAG chr2 60483664 60483683 60483667 -
atccacgtctgctaatatgc

SEQ ID NO: 181184 - DNA, 20 bp, Artificial Sequence
  Synthetic oligonucleotide; TGG chr2 60483641 60483660 60483644 -
ctcattcatttgatgtttcc

SEQ ID NO: 181185 - DNA, 20 bp, Artificial Sequence
  Synthetic oligonucleotide; GGG chr2 60483640 60483659 60483643 -
tcattcatttgatgtttcct

SEQ ID NO: 181186 - DNA, 20 bp, Artificial Sequence
  Synthetic oligonucleotide; GGG chr2 60483639 60483658 60483642 -
cattcatttgatgtttcctg

SEQ ID NO: 181187 - DNA, 20 bp, Artificial Sequence
  Synthetic oligonucleotide; GAG chr2 60483634 60483653 60483637 -
atttgatgtttcctggggac

SEQ ID NO: 181188 - DNA, 20 bp, Artificial Sequence
  Synthetic oligonucleotide; GAG chr2 60483620 60483639 60483623 -
ggggacgagcatcctctctt

SEQ ID NO: 181189 - DNA, 20 bp, Artificial Sequence
  Synthetic oligonucleotide; CAG chr2 60483601 60483620 60483604 -
tgagttatttctgacaactg

SEQ ID NO: 181190 - DNA, 20 bp, Artificial Sequence
  Synthetic oligonucleotide; CAG chr2 60483591 60483610 60483594 -
ctgacaactgcagcattcca

SEQ ID NO: 181191 - DNA, 20 bp, Artificial Sequence
  Synthetic oligonucleotide; AGG chr2 60483590 60483609 60483593 -
tgacaactgcagcattccac

SEQ ID NO: 181192 - DNA, 20 bp, Artificial Sequence
  Synthetic oligonucleotide; GGG chr2 60483589 60483608 60483592 -
gacaactgcagcattccaca

SEQ ID NO: 181193 - DNA, 20 bp, Artificial Sequence
  Synthetic oligonucleotide; GAG chr2 60483583 60483602 60483586 -
tgcagcattccacagggtct

SEQ ID NO: 181194 - DNA, 20 bp, Artificial Sequence
  Synthetic oligonucleotide; CAG chr2 60483570 60483589 60483573 -
agggtctgagttgttgaaca

SEQ ID NO: 181195 - DNA, 20 bp, Artificial Sequence
  Synthetic oligonucleotide; TAG chr2 60483530 60483549 60483533 -
tacaatcaaaacacatgaca

SEQ ID NO: 181196 - DNA, 20 bp, Artificial Sequence
  Synthetic oligonucleotide; CAG chr2 60483526 60483545 60483529 -
atcaaaacacatgacataga

SEQ ID NO: 181197 - DNA, 20 bp, Artificial Sequence
  Synthetic oligonucleotide; CAG chr2 60483523 60483542 60483526 -
aaaacacatgacatagacag

SEQ ID NO: 181198 - DNA, 20 bp, Artificial Sequence
  Synthetic oligonucleotide; TGG chr2 60483514 60483533 60483517 -
gacatagacagcagttgatt

SEQ ID NO: 181199 - DNA, 20 bp, Artificial Sequence
  Synthetic oligonucleotide; GGG chr2 60483513 60483532 60483516 -
acatagacagcagttgattt

SEQ ID NO: 181200 - DNA, 20 bp, Artificial Sequence
  Synthetic oligonucleotide; TGG chr2 60483502 60483521 60483505 -
agttgatttgggttctgcct

SEQ ID NO: 181201 - DNA, 20 bp, Artificial Sequence
  Synthetic oligonucleotide; CAG chr2 60483498 60483517 60483501 -
gatttgggttctgccttgga

SEQ ID NO: 181202 - DNA, 20 bp, Artificial Sequence
  Synthetic oligonucleotide; GAG chr2 60483496 60483515 60483499 -
tttgggttctgccttggaca

SEQ ID NO: 181203 - DNA, 20 bp, Artificial Sequence
  Synthetic oligonucleotide; CAG chr2 60483490 60483509 60483493 -
ttctgccttggacagagaaa

SEQ ID NO: 181204 - DNA, 20 bp, Artificial Sequence
  Synthetic oligonucleotide; TGG chr2 60483485 60483504 60483488 -
ccttggacagagaaacagac

SEQ ID NO: 181205 - DNA, 20 bp, Artificial Sequence
  Synthetic oligonucleotide; GGG chr2 60483484 60483503 60483487 -
cttggacagagaaacagact

SEQ ID NO: 181206 - DNA, 20 bp, Artificial Sequence
  Synthetic oligonucleotide; GGG chr2 60483483 60483502 60483486 -
ttggacagagaaacagactg

SEQ ID NO: 181207 - DNA, 20 bp, Artificial Sequence
  Synthetic oligonucleotide; AAG chr2 60483477 60483496 60483480 -
agagaaacagactggggcta

SEQ ID NO: 181208 - DNA, 20 bp, Artificial Sequence
  Synthetic oligonucleotide; AGG chr2 60483476 60483495 60483479 -
gagaaacagactggggctaa

SEQ ID NO: 181209 - DNA, 20 bp, Artificial Sequence
  Synthetic oligonucleotide; GGG chr2 60483475 60483494 60483478 -
agaaacagactggggctaaa

SEQ ID NO: 181210 - DNA, 20 bp, Artificial Sequence
  Synthetic oligonucleotide; CAG chr2 60483468 60483487 60483471 -
gactggggctaaagggactg

SEQ ID NO: 181211 - DNA, 20 bp, Artificial Sequence
  Synthetic oligonucleotide; TGG chr2 60483458 60483477 60483461 -
aaagggactgcagctatacc

SEQ ID NO: 181212 - DNA, 20 bp, Artificial Sequence
  Synthetic oligonucleotide; GGG chr2 60483457 60483476 60483460 -
aagggactgcagctatacct

SEQ ID NO: 181213 - DNA, 20 bp, Artificial Sequence
  Synthetic oligonucleotide; GGG chr2 60483456 60483475 60483459 -
agggactgcagctatacctg

SEQ ID NO: 181214 - DNA, 20 bp, Artificial Sequence
  Synthetic oligonucleotide; GAG chr2 60483445 60483464 60483448 -
ctatacctggggacttgcct

SEQ ID NO: 181215 - DNA, 20 bp, Artificial Sequence
  Synthetic oligonucleotide; TGG chr2 60483436 60483455 60483439 -
gggacttgcctgagatcatc

SEQ ID NO: 181216 - DNA, 20 bp, Artificial Sequence
  Synthetic oligonucleotide; GGG chr2 60483435 60483454 60483438 -
ggacttgcctgagatcatct

SEQ ID NO: 181217 - DNA, 20 bp, Artificial Sequence
  Synthetic oligonucleotide; TGG chr2 60483425 60483444 60483428 -
gagatcatctgggacttgcc

SEQ ID NO: 181218 - DNA, 20 bp, Artificial Sequence
  Synthetic oligonucleotide; AAG chr2 60483418 60483437 60483421 -
tctgggacttgcctggtctc

SEQ ID NO: 181219 - DNA, 20 bp, Artificial Sequence
  Synthetic oligonucleotide; TGG chr2 60483404 60483423 60483407 -
ggtctcaagtcttctgacct

SEQ ID NO: 181220 - DNA, 20 bp, Artificial Sequence
  Synthetic oligonucleotide; CAG chr2 60483400 60483419 60483403 -
tcaagtcttctgaccttggc

SEQ ID NO: 181221 - DNA, 20 bp, Artificial Sequence
  Synthetic oligonucleotide; AGG chr2 60483399 60483418 60483402 -
caagtcttctgaccttggcc

SEQ ID NO: 181222 - DNA, 20 bp, Artificial Sequence
  Synthetic oligonucleotide; GGG chr2 60483398 60483417 60483401 -
aagtcttctgaccttggcca

SEQ ID NO: 181223 - DNA, 20 bp, Artificial Sequence
  Synthetic oligonucleotide; TGG chr2 60483385 60483404 60483388 -
ttggccagggatctttgcac

SEQ ID NO: 181224 - DNA, 20 bp, Artificial Sequence
  Synthetic oligonucleotide; GGG chr2 60483384 60483403 60483387 -
tggccagggatctttgcact

SEQ ID NO: 181225 - DNA, 20 bp, Artificial Sequence
  Synthetic oligonucleotide; CAG chr2 60483381 60483400 60483384 -
ccagggatctttgcactggg

SEQ ID NO: 181226 - DNA, 20 bp, Artificial Sequence
  Synthetic oligonucleotide; AGG chr2 60483380 60483399 60483383 -
cagggatctttgcactgggc

SEQ ID NO: 181227 - DNA, 20 bp, Artificial Sequence
  Synthetic oligonucleotide; GGG chr2 60483379 60483398 60483382 -
agggatctttgcactgggca

SEQ ID NO: 181228 - DNA, 20 bp, Artificial Sequence
  Synthetic oligonucleotide; GGG chr2 60483378 60483397 60483381 -
gggatctttgcactgggcag

SEQ ID NO: 181229 - DNA, 20 bp, Artificial Sequence
  Synthetic oligonucleotide; GAG chr2 60483370 60483389 60483373 -
tgcactgggcaggggaattt

SEQ ID NO: 181230 - DNA, 20 bp, Artificial Sequence
  Synthetic oligonucleotide; GAG chr2 60483358 60483377 60483361 -
gggaatttgagtcccaattt

SEQ ID NO: 181231 - DNA, 20 bp, Artificial Sequence
  Synthetic oligonucleotide; AGG chr2 60483357 60483376 60483360 -
ggaatttgagtcccaatttg

SEQ ID NO: 181232 - DNA, 20 bp, Artificial Sequence
  Synthetic oligonucleotide; AAG chr2 60483332 60483351 60483335 -
tcgatttaaaccacttttca

SEQ ID NO: 181233 - DNA, 20 bp, Artificial Sequence
  Synthetic oligonucleotide; AGG chr2 60483331 60483350 60483334 -
cgatttaaaccacttttcaa

SEQ ID NO: 181234 - DNA, 20 bp, Artificial Sequence
  Synthetic oligonucleotide; TGG chr2 60483322 60483341 60483325 -
ccacttttcaaaggcctgaa

SEQ ID NO: 181235 - DNA, 20 bp, Artificial Sequence
  Synthetic oligonucleotide; GAG chr2 60483320 60483339 60483323 -
acttttcaaaggcctgaatg

SEQ ID NO: 181236 - DNA, 20 bp, Artificial Sequence
  Synthetic oligonucleotide; TGG chr2 60483291 60483310 60483294 -
atttgtgtgtcttcttttcc

SEQ ID NO: 181237 - DNA, 20 bp, Artificial Sequence
  Synthetic oligonucleotide; AAG chr2 60483275 60483294 60483278 -
ttcctggtcttccccttgtc

SEQ ID NO: 181238 - DNA, 20 bp, Artificial Sequence
  Synthetic oligonucleotide; CGG chr2 60483257 60483276 60483260 -
tcaagaccatttctctacca

SEQ ID NO: 181239 - DNA, 20 bp, Artificial Sequence
  Synthetic oligonucleotide; GGG chr2 60483256 60483275 60483259 -
caagaccatttctctaccac

SEQ ID NO: 181240 - DNA, 20 bp, Artificial Sequence
  Synthetic oligonucleotide; TAG chr2 60483245 60483264 60483248 -
ctctaccacgggatatatat

SEQ ID NO: 181241 - DNA, 20 bp, Artificial Sequence
  Synthetic oligonucleotide; GAG chr2 60483243 60483262 60483246 -
ctaccacgggatatatatta

SEQ ID NO: 181242 - DNA, 20 bp, Artificial Sequence
  Synthetic oligonucleotide; AGG chr2 60483242 60483261 60483245 -
taccacgggatatatattag

SEQ ID NO: 181243 - DNA, 20 bp, Artificial Sequence
  Synthetic oligonucleotide; GGG chr2 60483241 60483260 60483244 -
accacgggatatatattaga

SEQ ID NO: 181244 - DNA, 20 bp, Artificial Sequence
  Synthetic oligonucleotide; GGG chr2 60483240 60483259 60483243 -
ccacgggatatatattagag

SEQ ID NO: 181245 - DNA, 20 bp, Artificial Sequence
  Synthetic oligonucleotide; CGG chr2 60483233 60483252 60483236 -
atatatattagaggggaaaa

SEQ ID NO: 181246 - DNA, 20 bp, Artificial Sequence
  Synthetic oligonucleotide; TGG chr2 60483213 60483232 60483216 -
cggctgtaaaccctgattgt

SEQ ID NO: 181247 - DNA, 20 bp, Artificial Sequence
  Synthetic oligonucleotide; TAG chr2 60483209 60483228 60483212 -
tgtaaaccctgattgttggc

SEQ ID NO: 181248 - DNA, 20 bp, Artificial Sequence
  Synthetic oligonucleotide; CAG chr2 60483199 60483218 60483202 -
gattgttggctagcattgtt

SEQ ID NO: 181249 - DNA, 20 bp, Artificial Sequence
  Synthetic oligonucleotide; AGG chr2 60483198 60483217 60483201 -
attgttggctagcattgttc

SEQ ID NO: 181250 - DNA, 20 bp, Artificial Sequence
  Synthetic oligonucleotide; AAG chr2 60483195 60483214 60483198 -
gttggctagcattgttcagg

SEQ ID NO: 181251 - DNA, 20 bp, Artificial Sequence
  Synthetic oligonucleotide; TAG chr2 60483190 60483209 60483193 -
ctagcattgttcaggaagtg

SEQ ID NO: 181252 - DNA, 20 bp, Artificial Sequence
  Synthetic oligonucleotide; AAG chr2 60483183 60483202 60483186 -
tgttcaggaagtgtagcatt

SEQ ID NO: 181253 - DNA, 20 bp, Artificial Sequence
  Synthetic oligonucleotide; AGG chr2 60483182 60483201 60483185 -
gttcaggaagtgtagcatta

SEQ ID NO: 181254 - DNA, 20 bp, Artificial Sequence
  Synthetic oligonucleotide; GAG chr2 60483180 60483199 60483183 -
tcaggaagtgtagcattaag

SEQ ID NO: 181255 - DNA, 20 bp, Artificial Sequence
  Synthetic oligonucleotide; CAG chr2 60483124 60483143 60483127 -
aactacccacactatccttg

SEQ ID NO: 181256 - DNA, 20 bp, Artificial Sequence
  Synthetic oligonucleotide; TGG chr2 60483114 60483133 60483117 -
actatccttgcagttattca

SEQ ID NO: 181257 - DNA, 20 bp, Artificial Sequence
  Synthetic oligonucleotide; GGG chr2 60483113 60483132 60483116 -
ctatccttgcagttattcat

SEQ ID NO: 181258 - DNA, 20 bp, Artificial Sequence
  Synthetic oligonucleotide; AAG chr2 60483065 60483084 60483068 -
ttcttctcaaacatctcgca

SEQ ID NO: 181259 - DNA, 20 bp, Artificial Sequence
  Synthetic oligonucleotide; TGG chr2 60483056 60483075 60483059 -
aacatctcgcaaagtaatca

SEQ ID NO: 181260 - DNA, 20 bp, Artificial Sequence
  Synthetic oligonucleotide; GGG chr2 60483055 60483074 60483058 -
acatctcgcaaagtaatcat

SEQ ID NO: 181261 - DNA, 20 bp, Artificial Sequence
  Synthetic oligonucleotide; AAG chr2 60483049 60483068 60483052 -
cgcaaagtaatcatgggctg

SEQ ID NO: 181262 - DNA, 20 bp, Artificial Sequence
  Synthetic oligonucleotide; CAG chr2 60483044 60483063 60483047 -
agtaatcatgggctgaagtg

SEQ ID NO: 181263 - DNA, 20 bp, Artificial Sequence
  Synthetic oligonucleotide; AGG chr2 60483043 60483062 60483046 -
gtaatcatgggctgaagtgc

SEQ ID NO: 181264 - DNA, 20 bp, Artificial Sequence
  Synthetic oligonucleotide; CAG chr2 60483032 60483051 60483035 -
ctgaagtgcaggttttcttg

SEQ ID NO: 181265 - DNA, 20 bp, Artificial Sequence
  Synthetic oligonucleotide; CAG chr2 60483020 60483039 60483023 -
ttttcttgcagtgcctttat

SEQ ID NO: 181266 - DNA, 20 bp, Artificial Sequence
  Synthetic oligonucleotide; CAG chr2 60483012 60483031 60483015 -
cagtgcctttatcagtaaat

SEQ ID NO: 181267 - DNA, 20 bp, Artificial Sequence
  Synthetic oligonucleotide; GAG chr2 60483004 60483023 60483007 -
ttatcagtaaatcagatttt

SEQ ID NO: 181268 - DNA, 20 bp, Artificial Sequence
  Synthetic oligonucleotide; CAG chr2 60482994 60483013 60482997 -
atcagattttgagcatttat

SEQ ID NO: 181269 - DNA, 20 bp, Artificial Sequence
  Synthetic oligonucleotide; AAG chr2 60482988 60483007 60482991 -
ttttgagcatttatcagcaa

SEQ ID NO: 181270 - DNA, 20 bp, Artificial Sequence
  Synthetic oligonucleotide; TAG chr2 60482984 60483003 60482987 -
gagcatttatcagcaaaagt

SEQ ID NO: 181271 - DNA, 20 bp, Artificial Sequence
  Synthetic oligonucleotide; AAG chr2 60482950 60482969 60482953 -
atcatttctgtaatgtttga

SEQ ID NO: 181272 - DNA, 20 bp, Artificial Sequence
  Synthetic oligonucleotide; AAG chr2 60482946 60482965 60482949 -
tttctgtaatgtttgaaaga

SEQ ID NO: 181273 - DNA, 20 bp, Artificial Sequence
  Synthetic oligonucleotide; CAG chr2 60482935 60482954 60482938 -
tttgaaagaaagatttgttt

SEQ ID NO: 181274 - DNA, 20 bp, Artificial Sequence
  Synthetic oligonucleotide; TGG chr2 60482932 60482951 60482935 -
gaaagaaagatttgtttcag

SEQ ID NO: 181275 - DNA, 20 bp, Artificial Sequence
  Synthetic oligonucleotide; GGG chr2 60482931 60482950 60482934 -
aaagaaagatttgtttcagt

SEQ ID NO: 181276 - DNA, 20 bp, Artificial Sequence
  Synthetic oligonucleotide; GGG chr2 60482930 60482949 60482933 -
aagaaagatttgtttcagtg

SEQ ID NO: 181277 - DNA, 20 bp, Artificial Sequence
  Synthetic oligonucleotide; CAG chr2 60482905 60482924 60482908 -
tctgccaatcaatgatcttc

SEQ ID NO: 181278 - DNA, 20 bp, Artificial Sequence
  Synthetic oligonucleotide; TAG chr2 60482864 60482883 60482867 -
tattgctgcaattatttgtc

SEQ ID NO: 181279 - DNA, 20 bp, Artificial Sequence
  Synthetic oligonucleotide; TGG chr2 60482860 60482879 60482863 -
gctgcaattatttgtctagt

SEQ ID NO: 181280 - DNA, 20 bp, Artificial Sequence
  Synthetic oligonucleotide; CAG chr2 60482841 60482860 60482844 -
ttggatatttaaaatgtcat

SEQ ID NO: 181281 - DNA, 20 bp, Artificial Sequence
  Synthetic oligonucleotide; AAG chr2 60482837 60482856 60482840 -
atatttaaaatgtcatcaga

SEQ ID NO: 181282 - DNA, 20 bp, Artificial Sequence
  Synthetic oligonucleotide; GAG chr2 60482835 60482854 60482838 -
atttaaaatgtcatcagaaa

SEQ ID NO: 181283 - DNA, 20 bp, Artificial Sequence
  Synthetic oligonucleotide; TAG chr2 60482818 60482837 60482821 -
aaagagatgattacacattc

SEQ ID NO: 181284 - DNA, 20 bp, Artificial Sequence
  Synthetic oligonucleotide; AAG chr2 60482814 60482833 60482817 -
agatgattacacattctaga

SEQ ID NO: 181285 - DNA, 20 bp, Artificial Sequence
  Synthetic oligonucleotide; AAG chr2 60482810 60482829 60482813 -
gattacacattctagaaagc

SEQ ID NO: 181286 - DNA, 20 bp, Artificial Sequence
  Synthetic oligonucleotide; AGG chr2 60482809 60482828 60482812 -
attacacattctagaaagca

SEQ ID NO: 181287 - DNA, 20 bp, Artificial Sequence
  Synthetic oligonucleotide; CAG chr2 60482780 60482799 60482783 -
ataatcacatgaactgaatc

SEQ ID NO: 181288 - DNA, 20 bp, Artificial Sequence
  Synthetic oligonucleotide; TAG chr2 60482770 60482789 60482773 -
gaactgaatccagttaaatg

SEQ ID NO: 181289 - DNA, 20 bp, Artificial Sequence
  Synthetic oligonucleotide; TGG chr2 60482765 60482784 60482768 -
gaatccagttaaatgtagtg

SEQ ID NO: 181290 - DNA, 20 bp, Artificial Sequence
  Synthetic oligonucleotide; TAG chr2 60482742 60482761 60482745 -
tactaacctgtccttcaaaa

SEQ ID NO: 181291 - DNA, 20 bp, Artificial Sequence
  Synthetic oligonucleotide; GAG chr2 60482732 60482751 60482735 -
tccttcaaaatagaattttt

SEQ ID NO: 181292 - DNA, 20 bp, Artificial Sequence
  Synthetic oligonucleotide; AAG chr2 60482720 60482739 60482723 -
gaatttttgagctaccactg

SEQ ID NO: 181293 - DNA, 20 bp, Artificial Sequence
  Synthetic oligonucleotide; CAG chr2 60482717 60482736 60482720 -
tttttgagctaccactgaag

SEQ ID NO: 181294 - DNA, 20 bp, Artificial Sequence
  Synthetic oligonucleotide; CAG chr2 60482714 60482733 60482717 -
ttgagctaccactgaagcag

SEQ ID NO: 181295 - DNA, 20 bp, Artificial Sequence
  Synthetic oligonucleotide; CAG chr2 60482695 60482714 60482698 -
gcagtcttctgccctgtttt

SEQ ID NO: 181296 - DNA, 20 bp, Artificial Sequence
  Synthetic oligonucleotide; AGG chr2 60482694 60482713 60482697 -
cagtcttctgccctgttttc

SEQ ID NO: 181297 - DNA, 20 bp, Artificial Sequence
  Synthetic oligonucleotide; AAG chr2 60482691 60482710 60482694 -
tcttctgccctgttttcagg

SEQ ID NO: 181298 - DNA, 20 bp, Artificial Sequence
  Synthetic oligonucleotide; TGG chr2 60482675 60482694 60482678 -
caggaagctgatcttaacct

SEQ ID NO: 181299 - DNA, 20 bp, Artificial Sequence
  Synthetic oligonucleotide; GGG chr2 60482674 60482693 60482677 -
aggaagctgatcttaacctt

SEQ ID NO: 181300 - DNA, 20 bp, Artificial Sequence
  Synthetic oligonucleotide; CAG chr2 60482668 60482687 60482671 -
ctgatcttaaccttgggatg

SEQ ID NO: 181301 - DNA, 20 bp, Artificial Sequence
  Synthetic oligonucleotide; CAG chr2 60482657 60482676 60482660 -
cttgggatgcagtgtgcttt

SEQ ID NO: 181302 - DNA, 20 bp, Artificial Sequence
  Synthetic oligonucleotide; AGG chr2 60482656 60482675 60482659 -
ttgggatgcagtgtgctttc

SEQ ID NO: 181303 - DNA, 20 bp, Artificial Sequence
  Synthetic oligonucleotide; GGG chr2 60482655 60482674 60482658 -
tgggatgcagtgtgctttca

SEQ ID NO: 181304 - DNA, 20 bp, Artificial Sequence
  Synthetic oligonucleotide; TGG chr2 60482651 60482670 60482654 -
atgcagtgtgctttcagggt

SEQ ID NO: 181305 - DNA, 20 bp, Artificial Sequence
  Synthetic oligonucleotide; GGG chr2 60482650 60482669 60482653 -
tgcagtgtgctttcagggtt

SEQ ID NO: 181306 - DNA, 20 bp, Artificial Sequence
  Synthetic oligonucleotide; TGG chr2 60482634 60482653 60482637 -
ggttgggtgatacttaatta

SEQ ID NO: 181307 - DNA, 20 bp, Artificial Sequence
  Synthetic oligonucleotide; GAG chr2 60482632 60482651 60482635 -
ttgggtgatacttaattatg

SEQ ID NO: 181308 - DNA, 20 bp, Artificial Sequence
  Synthetic oligonucleotide; AAG chr2 60482621 60482640 60482624 -
ttaattatggagaactttcc

SEQ ID NO: 181309 - DNA, 20 bp, Artificial Sequence
  Synthetic oligonucleotide; TGG chr2 60482610 60482629 60482613 -
gaactttccaagtctgaaaa

SEQ ID NO: 181310 - DNA, 20 bp, Artificial Sequence
  Synthetic oligonucleotide; GAG chr2 60482587 60482606 60482590 -
aattgctccttcacatacgc

SEQ ID NO: 181311 - DNA, 20 bp, Artificial Sequence
  Synthetic oligonucleotide; AAG chr2 60482584 60482603 60482587 -
tgctccttcacatacgcgag

SEQ ID NO: 181312 - DNA, 20 bp, Artificial Sequence
  Synthetic oligonucleotide; TGG chr2 60482574 60482593 60482577 -
catacgcgagaagtgcattt

SEQ ID NO: 181313 - DNA, 20 bp, Artificial Sequence
  Synthetic oligonucleotide; AAG chr2 60482542 60482561 60482545 -
tcatctgcaaatctataaat

SEQ ID NO: 181314 - DNA, 20 bp, Artificial Sequence
  Synthetic oligonucleotide; CAG chr2 60482539 60482558 60482542 -
tctgcaaatctataaataag

SEQ ID NO: 181315 - DNA, 20 bp, Artificial Sequence
  Synthetic oligonucleotide; TGG chr2 60482512 60482531 60482515 -
tctattcttcttgcttcctg

SEQ ID NO: 181316 - DNA, 20 bp, Artificial Sequence
  Synthetic oligonucleotide; TGG chr2 60482485 60482504 60482488 -
aaatgccaaatcctgatttg

SEQ ID NO: 181317 - DNA, 20 bp, Artificial Sequence
  Synthetic oligonucleotide; AAG chr2 60482480 60482499 60482483 -
ccaaatcctgatttgtggca

SEQ ID NO: 181318 - DNA, 20 bp, Artificial Sequence
  Synthetic oligonucleotide; TGG chr2 60482445 60482464 60482448 -
cctttcccactctgtatgcc

SEQ ID NO: 181319 - DNA, 20 bp, Artificial Sequence
  Synthetic oligonucleotide; CAG chr2 60482438 60482457 60482441 -
cactctgtatgcctggtgcc

SEQ ID NO: 181320 - DNA, 20 bp, Artificial Sequence
  Synthetic oligonucleotide; AGG chr2 60482437 60482456 60482440 -
actctgtatgcctggtgccc

SEQ ID NO: 181321 - DNA, 20 bp, Artificial Sequence
  Synthetic oligonucleotide; AAG chr2 60482430 60482449 60482433 -
atgcctggtgcccaggaact

SEQ ID NO: 181322 - DNA, 20 bp, Artificial Sequence
  Synthetic oligonucleotide; CAG chr2 60482427 60482446 60482430 -
cctggtgcccaggaactaag

SEQ ID NO: 181323 - DNA, 20 bp, Artificial Sequence
  Synthetic oligonucleotide; TGG chr2 60482424 60482443 60482427 -
ggtgcccaggaactaagcag

SEQ ID NO: 181324 - DNA, 20 bp, Artificial Sequence
  Synthetic oligonucleotide; CAG chr2 60482421 60482440 60482424 -
gcccaggaactaagcagtgg

SEQ ID NO: 181325 - DNA, 20 bp, Artificial Sequence
  Synthetic oligonucleotide; TGG chr2 60482418 60482437 60482421 -
caggaactaagcagtggcag

SEQ ID NO: 181326 - DNA, 20 bp, Artificial Sequence
  Synthetic oligonucleotide; TGG chr2 60482401 60482420 60482404 -
cagtggaaattacaactgtt

SEQ ID NO: 181327 - DNA, 20 bp, Artificial Sequence
  Synthetic oligonucleotide; AAG chr2 60482398 60482417 60482401 -
tggaaattacaactgtttgg

SEQ ID NO: 181328 - DNA, 20 bp, Artificial Sequence
  Synthetic oligonucleotide; AAG chr2 60482393 60482412 60482396 -
attacaactgtttggaagcc

SEQ ID NO: 181329 - DNA, 20 bp, Artificial Sequence
  Synthetic oligonucleotide; AAG chr2 60482386 60482405 60482389 -
ctgtttggaagccaagaaaa

SEQ ID NO: 181330 - DNA, 20 bp, Artificial Sequence
  Synthetic oligonucleotide; CAG chr2 60482363 60482382 60482366 -
ctccatttctcacttttctc

SEQ ID NO: 181331 - DNA, 20 bp, Artificial Sequence
  Synthetic oligonucleotide; CGG chr2 60482357 60482376 60482360 -
ttctcacttttctccagttc

SEQ ID NO: 181332 - DNA, 20 bp, Artificial Sequence
  Synthetic oligonucleotide; CGG chr2 60482347 60482366 60482350 -
tctccagttccggatattct

SEQ ID NO: 181333 - DNA, 20 bp, Artificial Sequence
  Synthetic oligonucleotide; CAG chr2 60482329 60482348 60482332 -
ctcggctctgctccatgtat

SEQ ID NO: 181334 - DNA, 20 bp, Artificial Sequence
  Synthetic oligonucleotide; CAG chr2 60482271 60482290 60482274 -
ccttctgtccgctccgtgaa

SEQ ID NO: 181335 - DNA, 20 bp, Artificial Sequence
  Synthetic oligonucleotide; AGG chr2 60482270 60482289 60482273 -
cttctgtccgctccgtgaac

SEQ ID NO: 181336 - DNA, 20 bp, Artificial Sequence
  Synthetic oligonucleotide; CAG chr2 60482264 60482283 60482267 -
tccgctccgtgaacaggaaa

SEQ ID NO: 181337 - DNA, 20 bp, Artificial Sequence
  Synthetic oligonucleotide; CAG chr2 60482256 60482275 60482259 -
gtgaacaggaaacagaaata

SEQ ID NO: 181338 - DNA, 20 bp, Artificial Sequence
  Synthetic oligonucleotide; TGG chr2 60482234 60482253 60482237 -
gctccaatttttttttttaa

SEQ ID NO: 181339 - DNA, 20 bp, Artificial Sequence
  Synthetic oligonucleotide; GAG chr2 60482232 60482251 60482235 -
tccaatttttttttttaatg

SEQ ID NO: 181340 - DNA, 20 bp, Artificial Sequence
  Synthetic oligonucleotide; AGG chr2 60482231 60482250 60482234 -
ccaatttttttttttaatgg

SEQ ID NO: 181341 - DNA, 20 bp, Artificial Sequence
  Synthetic oligonucleotide; AAG chr2 60482228 60482247 60482231 -
atttttttttttaatggagg

SEQ ID NO: 181342 - DNA, 20 bp, Artificial Sequence
  Synthetic oligonucleotide; GAG chr2 60482226 60482245 60482229 -
ttttttttttaatggaggaa

SEQ ID NO: 181343 - DNA, 20 bp, Artificial Sequence
  Synthetic oligonucleotide; AAG chr2 60482167 60482186 60482170 -
tccaaccaaactaaactctc

SEQ ID NO: 181344 - DNA, 20 bp, Artificial Sequence
  Synthetic oligonucleotide; TAG chr2 60482163 60482182 60482166 -
accaaactaaactctcaaga

SEQ ID NO: 181345 - DNA, 20 bp, Artificial Sequence
  Synthetic oligonucleotide; GAG chr2 60482154 60482173 60482157 -
aactctcaagatagaatcat

SEQ ID NO: 181346 - DNA, 20 bp, Artificial Sequence
  Synthetic oligonucleotide; GAG chr2 60482152 60482171 60482155 -
ctctcaagatagaatcatga

SEQ ID NO: 181347 - DNA, 20 bp, Artificial Sequence
  Synthetic oligonucleotide; AAG chr2 60482126 60482145 60482129 -
caaaatgtccaaaatgtcct

SEQ ID NO: 181348 - DNA, 20 bp, Artificial Sequence
  Synthetic oligonucleotide; TGG chr2 60482123 60482142 60482126 -
aatgtccaaaatgtcctaag

SEQ ID NO: 181349 - DNA, 20 bp, Artificial Sequence
  Synthetic oligonucleotide; CAG chr2 60482099 60482118 60482102 -
tcaaaccacccgccccttaa

SEQ ID NO: 181350 - DNA, 20 bp, Artificial Sequence
  Synthetic oligonucleotide; AGG chr2 60482098 60482117 60482101 -
caaaccacccgccccttaac

SEQ ID NO: 181351 - DNA, 20 bp, Artificial Sequence
  Synthetic oligonucleotide; TGG chr2 60482081 60482100 60482084 -
aacaggtctgcctctcttcc

SEQ ID NO: 181352 - DNA, 20 bp, Artificial Sequence
  Synthetic oligonucleotide; GGG chr2 60482080 60482099 60482083 -
acaggtctgcctctcttcct

SEQ ID NO: 181353 - DNA, 20 bp, Artificial Sequence
  Synthetic oligonucleotide; GAG chr2 60482078 60482097 60482081 -
aggtctgcctctcttcctgg

SEQ ID NO: 181354 - DNA, 20 bp, Artificial Sequence
  Synthetic oligonucleotide; CAG chr2 60482074 60482093 60482077 -
ctgcctctcttcctgggagt

SEQ ID NO: 181355 - DNA, 20 bp, Artificial Sequence
  Synthetic oligonucleotide; AAG chr2 60482071 60482090 60482074 -
cctctcttcctgggagtcag

SEQ ID NO: 181356 - DNA, 20 bp, Artificial Sequence
  Synthetic oligonucleotide; TGG chr2 60482054 60482073 60482057 -
cagaagtgaccttgatgaac

SEQ ID NO: 181357 - DNA, 20 bp, Artificial Sequence
  Synthetic oligonucleotide; TAG chr2 60482047 60482066 60482050 -
gaccttgatgaactggatgt

SEQ ID NO: 181358 - DNA, 20 bp, Artificial Sequence
  Synthetic oligonucleotide; AGG chr2 60482046 60482065 60482049 -
accttgatgaactggatgtt

SEQ ID NO: 181359 - DNA, 20 bp, Artificial Sequence
  Synthetic oligonucleotide; AAG chr2 60482027 60482046 60482030 -
taggtccaaaaatgacaaac

SEQ ID NO: 181360 - DNA, 20 bp, Artificial Sequence
  Synthetic oligonucleotide; TGG chr2 60482016 60482035 60482019 -
atgacaaacaagccctccac

SEQ ID NO: 181361 - DNA, 20 bp, Artificial Sequence
  Synthetic oligonucleotide; GGG chr2 60482015 60482034 60482018 -
tgacaaacaagccctccact

SEQ ID NO: 181362 - DNA, 20 bp, Artificial Sequence
  Synthetic oligonucleotide; CAG chr2 60482006 60482025 60482009 -
agccctccactgggaaacat

SEQ ID NO: 181363 - DNA, 20 bp, Artificial Sequence
  Synthetic oligonucleotide; CAG chr2 60481984 60482003 60481987 -
gtccaacccctttcttttga

SEQ ID NO: 181364 - DNA, 20 bp, Artificial Sequence
  Synthetic oligonucleotide; CAG chr2 60481981 60482000 60481984 -
caacccctttcttttgacag

SEQ ID NO: 181365 - DNA, 20 bp, Artificial Sequence
  Synthetic oligonucleotide; AGG chr2 60481980 60481999 60481983 -
aacccctttcttttgacagc

SEQ ID NO: 181366 - DNA, 20 bp, Artificial Sequence
  Synthetic oligonucleotide; TAG chr2 60481975 60481994 60481978 -
ctttcttttgacagcaggac

SEQ ID NO: 181367 - DNA, 20 bp, Artificial Sequence
  Synthetic oligonucleotide; CAG chr2 60481970 60481989 60481973 -
ttttgacagcaggactagaa

SEQ ID NO: 181368 - DNA, 20 bp, Artificial Sequence
  Synthetic oligonucleotide; CAG chr2 60481965 60481984 60481968 -
acagcaggactagaacagac

SEQ ID NO: 181369 - DNA, 20 bp, Artificial Sequence
  Synthetic oligonucleotide; GAG chr2 60481963 60481982 60481966 -
agcaggactagaacagacca

SEQ ID NO: 181370 - DNA, 20 bp, Artificial Sequence
  Synthetic oligonucleotide; AGG chr2 60481962 60481981 60481965 -
gcaggactagaacagaccag

SEQ ID NO: 181371 - DNA, 20 bp, Artificial Sequence
  Synthetic oligonucleotide; CGG chr2 60481956 60481975 60481959 -
ctagaacagaccagaggttc

SEQ ID NO: 181372 - DNA, 20 bp, Artificial Sequence
  Synthetic oligonucleotide; GAG chr2 60481954 60481973 60481957 -
agaacagaccagaggttccg

SEQ ID NO: 181373 - DNA, 20 bp, Artificial Sequence
  Synthetic oligonucleotide; AAG chr2 60481951 60481970 60481954 -
acagaccagaggttccggag

SEQ ID NO: 181374 - DNA, 20 bp, Artificial Sequence
  Synthetic oligonucleotide; AGG chr2 60481950 60481969 60481953 -
cagaccagaggttccggaga

SEQ ID NO: 181375 - DNA, 20 bp, Artificial Sequence
  Synthetic oligonucleotide; TAG chr2 60481937 60481956 60481940 -
ccggagaaggtctctatacc

SEQ ID NO: 181376 - DNA, 20 bp, Artificial Sequence
  Synthetic oligonucleotide; AGG chr2 60481936 60481955 60481939 -
cggagaaggtctctatacct

SEQ ID NO: 181377 - DNA, 20 bp, Artificial Sequence
  Synthetic oligonucleotide; TGG chr2 60481933 60481952 60481936 -
agaaggtctctatacctagg

SEQ ID NO: 181378 - DNA, 20 bp, Artificial Sequence
  Synthetic oligonucleotide; GGG chr2 60481932 60481951 60481935 -
gaaggtctctatacctaggt

SEQ ID NO: 181379 - DNA, 20 bp, Artificial Sequence
  Synthetic oligonucleotide; GAG chr2 60481923 60481942 60481926 -
tatacctaggtgggtttcct

SEQ ID NO: 181380 - DNA, 20 bp, Artificial Sequence
  Synthetic oligonucleotide; TGG chr2 60481919 60481938 60481922 -
cctaggtgggtttcctgagc

SEQ ID NO: 181381 - DNA, 20 bp, Artificial Sequence
  Synthetic oligonucleotide; GAG chr2 60481917 60481936 60481920 -
taggtgggtttcctgagctg

SEQ ID NO: 181382 - DNA, 20 bp, Artificial Sequence
  Synthetic oligonucleotide; TGG chr2 60481905 60481924 60481908 -
ctgagctggagaattttcca

SEQ ID NO: 181383 - DNA, 20 bp, Artificial Sequence
  Synthetic oligonucleotide; GGG chr2 60481904 60481923 60481907 -
tgagctggagaattttccat

SEQ ID NO: 181384 - DNA, 20 bp, Artificial Sequence
  Synthetic oligonucleotide; GGG chr2 60481903 60481922 60481906 -
gagctggagaattttccatg

SEQ ID NO: 181385 - DNA, 20 bp, Artificial Sequence
  Synthetic oligonucleotide; GAG chr2 60481887 60481906 60481890 -
catggggctgtctgtgtgtt

SEQ ID NO: 181386 - DNA, 20 bp, Artificial Sequence
  Synthetic oligonucleotide; AGG chr2 60481886 60481905 60481889 -
atggggctgtctgtgtgttg

SEQ ID NO: 181387 - DNA, 20 bp, Artificial Sequence
  Synthetic oligonucleotide; CAG chr2 60481851 60481870 60481854 -
cactttcccaattcacttcc

SEQ ID NO: 181388 - DNA, 20 bp, Artificial Sequence
  Synthetic oligonucleotide; GAG chr2 60481849 60481868 60481852 -
ctttcccaattcacttccca

SEQ ID NO: 181389 - DNA, 20 bp, Artificial Sequence
  Synthetic oligonucleotide; GAG chr2 60481847 60481866 60481850 -
ttcccaattcacttcccaga

SEQ ID NO: 181390 - DNA, 20 bp, Artificial Sequence
  Synthetic oligonucleotide; GAG chr2 60481838 60481857 60481841 -
cacttcccagagagcatgct

SEQ ID NO: 181391 - DNA, 20 bp, Artificial Sequence
  Synthetic oligonucleotide; CAG chr2 60481828 60481847 60481831 -
agagcatgctgagctcattc

SEQ ID NO: 181392 - DNA, 20 bp, Artificial Sequence
  Synthetic oligonucleotide; AGG chr2 60481827 60481846 60481830 -
gagcatgctgagctcattcc

SEQ ID NO: 181393 - DNA, 20 bp, Artificial Sequence
  Synthetic oligonucleotide; TGG chr2 60481815 60481834 60481818 -
ctcattccaggacactgtga

SEQ ID NO: 181394 - DNA, 20 bp, Artificial Sequence
  Synthetic oligonucleotide; AAG chr2 60481808 60481827 60481811 -
caggacactgtgatggtcaa

SEQ ID NO: 181395 - DNA, 20 bp, Artificial Sequence
  Synthetic oligonucleotide; AGG chr2 60481807 60481826 60481810 -
aggacactgtgatggtcaaa

SEQ ID NO: 181396 - DNA, 20 bp, Artificial Sequence
  Synthetic oligonucleotide; CAG chr2 60481788 60481807 60481791 -
aaggctctcccaccatcaca

SEQ ID NO: 181397 - DNA, 20 bp, Artificial Sequence
  Synthetic oligonucleotide; TAG chr2 60481778 60481797 60481781 -
caccatcacacagaatgtac

SEQ ID NO: 181398 - DNA, 20 bp, Artificial Sequence
  Synthetic oligonucleotide; AGG chr2 60481777 60481796 60481780 -
accatcacacagaatgtact

SEQ ID NO: 181399 - DNA, 20 bp, Artificial Sequence
  Synthetic oligonucleotide; GGG chr2 60481776 60481795 60481779 -
ccatcacacagaatgtacta

SEQ ID NO: 181400 - DNA, 20 bp, Artificial Sequence
  Synthetic oligonucleotide; TAG chr2 60481767 60481786 60481770 -
agaatgtactagggttctgt

SEQ ID NO: 181401 - DNA, 20 bp, Artificial Sequence
  Synthetic oligonucleotide; TGG chr2 60481747 60481766 60481750 -
tagaaaattaatctcacttg

SEQ ID NO: 181402 - DNA, 20 bp, Artificial Sequence
  Synthetic oligonucleotide; TGG chr2 60481722 60481741 60481725 -
aaaaaatgcccttaaaacac

SEQ ID NO: 181403 - DNA, 20 bp, Artificial Sequence
  Synthetic oligonucleotide; GAG chr2 60481720 60481739 60481723 -
aaaatgcccttaaaacactg

SEQ ID NO: 181404 - DNA, 20 bp, Artificial Sequence
  Synthetic oligonucleotide; GAG chr2 60481713 60481732 60481716 -
ccttaaaacactggagccct

SEQ ID NO: 181405 - DNA, 20 bp, Artificial Sequence
  Synthetic oligonucleotide; TGG chr2 60481700 60481719 60481703 -
gagccctgagttgtatgtgc

SEQ ID NO: 181406 - DNA, 20 bp, Artificial Sequence
  Synthetic oligonucleotide; GAG chr2 60481698 60481717 60481701 -
gccctgagttgtatgtgctg

SEQ ID NO: 181407 - DNA, 20 bp, Artificial Sequence
  Synthetic oligonucleotide; TGG chr2 60481691 60481710 60481694 -
gttgtatgtgctggagcatg

SEQ ID NO: 181408 - DNA, 20 bp, Artificial Sequence
  Synthetic oligonucleotide; GGG chr2 60481690 60481709 60481693 -
ttgtatgtgctggagcatgt

SEQ ID NO: 181409 - DNA, 20 bp, Artificial Sequence
  Synthetic oligonucleotide; GGG chr2 60481689 60481708 60481692 -
tgtatgtgctggagcatgtg

SEQ ID NO: 181410 - DNA, 20 bp, Artificial Sequence
  Synthetic oligonucleotide; AAG chr2 60481684 60481703 60481687 -
gtgctggagcatgtggggaa

SEQ ID NO: 181411 - DNA, 20 bp, Artificial Sequence
  Synthetic oligonucleotide; AAG chr2 60481680 60481699 60481683 -
tggagcatgtggggaaaaga

SEQ ID NO: 181412 - DNA, 20 bp, Artificial Sequence
  Synthetic oligonucleotide; TAG chr2 60481674 60481693 60481677 -
atgtggggaaaagaaagatg

SEQ ID NO: 181413 - DNA, 20 bp, Artificial Sequence
  Synthetic oligonucleotide; AGG chr2 60481673 60481692 60481676 -
tgtggggaaaagaaagatgt

SEQ ID NO: 181414 - DNA, 20 bp, Artificial Sequence
  Synthetic oligonucleotide; GGG chr2 60481672 60481691 60481675 -
gtggggaaaagaaagatgta

SEQ ID NO: 181415 - DNA, 20 bp, Artificial Sequence
  Synthetic oligonucleotide; GGG chr2 60481671 60481690 60481674 -
tggggaaaagaaagatgtag

SEQ ID NO: 181416 - DNA, 20 bp, Artificial Sequence
  Synthetic oligonucleotide; GGG chr2 60481670 60481689 60481673 -
ggggaaaagaaagatgtagg

SEQ ID NO: 181417 - DNA, 20 bp, Artificial Sequence
  Synthetic oligonucleotide; TGG chr2 60481667 60481686 60481670 -
gaaaagaaagatgtaggggg

SEQ ID NO: 181418 - DNA, 20 bp, Artificial Sequence
  Synthetic oligonucleotide; GAG chr2 60481665 60481684 60481668 -
aaagaaagatgtagggggtg

SEQ ID NO: 181419 - DNA, 20 bp, Artificial Sequence
  Synthetic oligonucleotide; AAG chr2 60481658 60481677 60481661 -
gatgtagggggtggagcgtc

SEQ ID NO: 181420 - DNA, 20 bp, Artificial Sequence
  Synthetic oligonucleotide; AAG chr2 60481649 60481668 60481652 -
ggtggagcgtcaagaaaaac

SEQ ID NO: 181421 - DNA, 20 bp, Artificial Sequence
  Synthetic oligonucleotide; GAG chr2 60481632 60481651 60481635 -
aacaagacaaaaaaattcac

SEQ ID NO: 181422 - DNA, 20 bp, Artificial Sequence
  Synthetic oligonucleotide; TGG chr2 60481626 60481645 60481629 -
acaaaaaaattcacgagcca

SEQ ID NO: 181423 - DNA, 20 bp, Artificial Sequence
  Synthetic oligonucleotide; TGG chr2 60481620 60481639 60481623 -
aaattcacgagccatggaaa

SEQ ID NO: 181424 - DNA, 20 bp, Artificial Sequence
  Synthetic oligonucleotide; GAG chr2 60481618 60481637 60481621 -
attcacgagccatggaaatg

SEQ ID NO: 181425 - DNA, 20 bp, Artificial Sequence
  Synthetic oligonucleotide; AAG chr2 60481615 60481634 60481618 -
cacgagccatggaaatggag

SEQ ID NO: 181426 - DNA, 20 bp, Artificial Sequence
  Synthetic oligonucleotide; CAG chr2 60481595 60481614 60481598 -
aagaaacactgtttctgctg

SEQ ID NO: 181427 - DNA, 20 bp, Artificial Sequence
  Synthetic oligonucleotide; TAG chr2 60481585 60481604 60481588 -
gtttctgctgcagttgctct

SEQ ID NO: 181428 - DNA, 20 bp, Artificial Sequence
  Synthetic oligonucleotide; CAG chr2 60481581 60481600 60481584 -
ctgctgcagttgctcttagc

SEQ ID NO: 181429 - DNA, 20 bp, Artificial Sequence
  Synthetic oligonucleotide; AGG chr2 60481580 60481599 60481583 -
tgctgcagttgctcttagcc

SEQ ID NO: 181430 - DNA, 20 bp, Artificial Sequence
  Synthetic oligonucleotide; GGG chr2 60481579 60481598 60481582 -
gctgcagttgctcttagcca

SEQ ID NO: 181431 - DNA, 20 bp, Artificial Sequence
  Synthetic oligonucleotide; GGG chr2 60481578 60481597 60481581 -
ctgcagttgctcttagccag

SEQ ID NO: 181432 - DNA, 20 bp, Artificial Sequence
  Synthetic oligonucleotide; CAG chr2 60481574 60481593 60481577 -
agttgctcttagccaggggc

SEQ ID NO: 181433 - DNA, 20 bp, Artificial Sequence
  Synthetic oligonucleotide; TGG chr2 60481569 60481588 60481572 -
ctcttagccaggggccagcg

SEQ ID NO: 181434 - DNA, 20 bp, Artificial Sequence
  Synthetic oligonucleotide; CAG chr2 60481565 60481584 60481568 -
tagccaggggccagcgtgga

SEQ ID NO: 181435 - DNA, 20 bp, Artificial Sequence
  Synthetic oligonucleotide; CAG chr2 60481527 60481546 60481530 -
ccctgtcctccttcacctgc

SEQ ID NO: 181436 - DNA, 20 bp, Artificial Sequence
  Synthetic oligonucleotide; TGG chr2 60481520 60481539 60481523 -
ctccttcacctgccagcttg

SEQ ID NO: 181437 - DNA, 20 bp, Artificial Sequence
  Synthetic oligonucleotide; GGG chr2 60481519 60481538 60481522 -
tccttcacctgccagcttgt

SEQ ID NO: 181438 - DNA, 20 bp, Artificial Sequence
  Synthetic oligonucleotide; TGG chr2 60481515 60481534 60481518 -
tcacctgccagcttgtgggc

SEQ ID NO: 181439 - DNA, 20 bp, Artificial Sequence
  Synthetic oligonucleotide; GGG chr2 60481514 60481533 60481517 -
cacctgccagcttgtgggct

SEQ ID NO: 181440 - DNA, 20 bp, Artificial Sequence
  Synthetic oligonucleotide; TGG chr2 60481511 60481530 60481514 -
ctgccagcttgtgggctggg

SEQ ID NO: 181441 - DNA, 20 bp, Artificial Sequence
  Synthetic oligonucleotide; AAG chr2 60481505 60481524 60481508 -
gcttgtgggctgggtggctt

SEQ ID NO: 181442 - DNA, 20 bp, Artificial Sequence
  Synthetic oligonucleotide; TAG chr2 60481499 60481518 60481502 -
gggctgggtggcttaagttc

SEQ ID NO: 181443 - DNA, 20 bp, Artificial Sequence
  Synthetic oligonucleotide; TGG chr2 60481493 60481512 60481496 -
ggtggcttaagttctagccc

SEQ ID NO: 181444 - DNA, 20 bp, Artificial Sequence
  Synthetic oligonucleotide; GGG chr2 60481492 60481511 60481495 -
gtggcttaagttctagccct

SEQ ID NO: 181445 - DNA, 20 bp, Artificial Sequence
  Synthetic oligonucleotide; GAG chr2 60481473 60481492 60481476 -
tgggtgaccctctgactcct

SEQ ID NO: 181446 - DNA, 20 bp, Artificial Sequence
  Synthetic oligonucleotide; GAG chr2 60481471 60481490 60481474 -
ggtgaccctctgactcctga

SEQ ID NO: 181447 - DNA, 20 bp, Artificial Sequence
  Synthetic oligonucleotide; TGG chr2 60481452 60481471 60481455 -
agagcatgtgtatgtgcttg

SEQ ID NO: 181448 - DNA, 20 bp, Artificial Sequence
  Synthetic oligonucleotide; TGG chr2 60481449 60481468 60481452 -
gcatgtgtatgtgcttgtgg

SEQ ID NO: 181449 - DNA, 20 bp, Artificial Sequence
  Synthetic oligonucleotide; GGG chr2 60481448 60481467 60481451 -
catgtgtatgtgcttgtggt

SEQ ID NO: 181450 - DNA, 20 bp, Artificial Sequence
  Synthetic oligonucleotide; TGG chr2 60481445 60481464 60481448 -
gtgtatgtgcttgtggtggg

SEQ ID NO: 181451 - DNA, 20 bp, Artificial Sequence
  Synthetic oligonucleotide; GGG chr2 60481444 60481463 60481447 -
tgtatgtgcttgtggtgggt

SEQ ID NO: 181452 - DNA, 20 bp, Artificial Sequence
  Synthetic oligonucleotide; GGG chr2 60481443 60481462 60481446 -
gtatgtgcttgtggtgggtg

SEQ ID NO: 181453 - DNA, 20 bp, Artificial Sequence
  Synthetic oligonucleotide; TAG chr2 60481438 60481457 60481441 -
tgcttgtggtgggtggggtg

SEQ ID NO: 181454 - DNA, 20 bp, Artificial Sequence
  Synthetic oligonucleotide; AAG chr2 60481428 60481447 60481431 -
gggtggggtgtagtgcgtta

SEQ ID NO: 181455 - DNA, 20 bp, Artificial Sequence
  Synthetic oligonucleotide; AAG chr2 60481420 60481439 60481423 -
tgtagtgcgttaaagccgca

SEQ ID NO: 181456 - DNA, 20 bp, Artificial Sequence
  Synthetic oligonucleotide; CAG chr2 60481417 60481436 60481420 -
agtgcgttaaagccgcaaag

SEQ ID NO: 181457 - DNA, 20 bp, Artificial Sequence
  Synthetic oligonucleotide; GAG chr2 60481415 60481434 60481418 -
tgcgttaaagccgcaaagca

SEQ ID NO: 181458 - DNA, 20 bp, Artificial Sequence
  Synthetic oligonucleotide; AGG chr2 60481414 60481433 60481417 -
gcgttaaagccgcaaagcag

SEQ ID NO: 181459 - DNA, 20 bp, Artificial Sequence
  Synthetic oligonucleotide; AAG chr2 60481407 60481426 60481410 -
agccgcaaagcagaggtgcg

SEQ ID NO: 181460 - DNA, 20 bp, Artificial Sequence
  Synthetic oligonucleotide; AGG chr2 60481406 60481425 60481409 -
gccgcaaagcagaggtgcga

SEQ ID NO: 181461 - DNA, 20 bp, Artificial Sequence
  Synthetic oligonucleotide; GGG chr2 60481405 60481424 60481408 -
ccgcaaagcagaggtgcgaa

SEQ ID NO: 181462 - DNA, 20 bp, Artificial Sequence
  Synthetic oligonucleotide; TGG chr2 60481400 60481419 60481403 -
aagcagaggtgcgaagggcc

SEQ ID NO: 181463 - DNA, 20 bp, Artificial Sequence
  Synthetic oligonucleotide; TAG chr2 60481395 60481414 60481398 -
gaggtgcgaagggcctggtg

SEQ ID NO: 181464 - DNA, 20 bp, Artificial Sequence
  Synthetic oligonucleotide; AGG chr2 60481394 60481413 60481397 -
aggtgcgaagggcctggtgt

SEQ ID NO: 181465 - DNA, 20 bp, Artificial Sequence
  Synthetic oligonucleotide; TGG chr2 60481388 60481407 60481391 -
gaagggcctggtgtaggtcg

SEQ ID NO: 181466 - DNA, 20 bp, Artificial Sequence
  Synthetic oligonucleotide; GGG chr2 60481387 60481406 60481390 -
aagggcctggtgtaggtcgt

SEQ ID NO: 181467 - DNA, 20 bp, Artificial Sequence
  Synthetic oligonucleotide; GAG chr2 60481385 60481404 60481388 -
gggcctggtgtaggtcgtgg

SEQ ID NO: 181468 - DNA, 20 bp, Artificial Sequence
  Synthetic oligonucleotide; CAG chr2 60481381 60481400 60481384 -
ctggtgtaggtcgtgggaga

SEQ ID NO: 181469 - DNA, 20 bp, Artificial Sequence
  Synthetic oligonucleotide; GAG chr2 60481379 60481398 60481382 -
ggtgtaggtcgtgggagaca

SEQ ID NO: 181470 - DNA, 20 bp, Artificial Sequence
  Synthetic oligonucleotide; GAG chr2 60481377 60481396 60481380 -
tgtaggtcgtgggagacaga

SEQ ID NO: 181471 - DNA, 20 bp, Artificial Sequence
  Synthetic oligonucleotide; AAG chr2 60481374 60481393 60481377 -
aggtcgtgggagacagagag

SEQ ID NO: 181472 - DNA, 20 bp, Artificial Sequence
  Synthetic oligonucleotide; AGG chr2 60481373 60481392 60481376 -
ggtcgtgggagacagagaga

SEQ ID NO: 181473 - DNA, 20 bp, Artificial Sequence
  Synthetic oligonucleotide; TGG chr2 60481367 60481386 60481370 -
gggagacagagagaaggccc

SEQ ID NO: 181474 - DNA, 20 bp, Artificial Sequence
  Synthetic oligonucleotide; GGG chr2 60481366 60481385 60481369 -
ggagacagagagaaggccct

SEQ ID NO: 181475 - DNA, 20 bp, Artificial Sequence
  Synthetic oligonucleotide; TAG chr2 60481341 60481360 60481344 -
ctgaatgtttttacttttcc

SEQ ID NO: 181476 - DNA, 20 bp, Artificial Sequence
  Synthetic oligonucleotide; AGG chr2 60481340 60481359 60481343 -
tgaatgtttttacttttcct

SEQ ID NO: 181477 - DNA, 20 bp, Artificial Sequence
  Synthetic oligonucleotide; AAG chr2 60481314 60481333 60481317 -
cctgcttcatttttgttttc

SEQ ID NO: 181478 - DNA, 20 bp, Artificial Sequence
  Synthetic oligonucleotide; AGG chr2 60481313 60481332 60481316 -
ctgcttcatttttgttttca

SEQ ID NO: 181479 - DNA, 20 bp, Artificial Sequence
  Synthetic oligonucleotide; GAG chr2 60481311 60481330 60481314 -
gcttcatttttgttttcaag

SEQ ID NO: 181480 - DNA, 20 bp, Artificial Sequence
  Synthetic oligonucleotide; CAG chr2 60481282 60481301 60481285 -
gtttctctcttcttgccttc

SEQ ID NO: 181481 - DNA, 20 bp, Artificial Sequence
  Synthetic oligonucleotide; AAG chr2 60481271 60481290 60481274 -
cttgccttccagcatgtccc

SEQ ID NO: 181482 - DNA, 20 bp, Artificial Sequence
  Synthetic oligonucleotide; CAG chr2 60481268 60481287 60481271 -
gccttccagcatgtcccaag

SEQ ID NO: 181483 - DNA, 20 bp, Artificial Sequence
  Synthetic oligonucleotide; GAG chr2 60481266 60481285 60481269 -
cttccagcatgtcccaagca

SEQ ID NO: 181484 - DNA, 20 bp, Artificial Sequence
  Synthetic oligonucleotide; TGG chr2 60481262 60481281 60481265 -
cagcatgtcccaagcagaga

SEQ ID NO: 181485 - DNA, 20 bp, Artificial Sequence
  Synthetic oligonucleotide; GGG chr2 60481261 60481280 60481264 -
agcatgtcccaagcagagat

SEQ ID NO: 181486 - DNA, 20 bp, Artificial Sequence
  Synthetic oligonucleotide; TGG chr2 60481258 60481277 60481261 -
atgtcccaagcagagatggg

SEQ ID NO: 181487 - DNA, 20 bp, Artificial Sequence
  Synthetic oligonucleotide; TAG chr2 60481254 60481273 60481257 -
cccaagcagagatgggtggc

SEQ ID NO: 181488 - DNA, 20 bp, Artificial Sequence
  Synthetic oligonucleotide; AGG chr2 60481253 60481272 60481256 -
ccaagcagagatgggtggct

SEQ ID NO: 181489 - DNA, 20 bp, Artificial Sequence
  Synthetic oligonucleotide; TGG chr2 60481248 60481267 60481251 -
cagagatgggtggctaggtt

SEQ ID NO: 181490 - DNA, 20 bp, Artificial Sequence
  Synthetic oligonucleotide; GGG chr2 60481247 60481266 60481250 -
agagatgggtggctaggttt

SEQ ID NO: 181491 - DNA, 20 bp, Artificial Sequence
  Synthetic oligonucleotide; TGG chr2 60481242 60481261 60481245 -
tgggtggctaggtttgggaa

SEQ ID NO: 181492 - DNA, 20 bp, Artificial Sequence
  Synthetic oligonucleotide; GGG chr2 60481241 60481260 60481244 -
gggtggctaggtttgggaat

SEQ ID NO: 181493 - DNA, 20 bp, Artificial Sequence
  Synthetic oligonucleotide; GGG chr2 60481240 60481259 60481243 -
ggtggctaggtttgggaatg

SEQ ID NO: 181494 - DNA, 20 bp, Artificial Sequence
  Synthetic oligonucleotide; TGG chr2 60481234 60481253 60481237 -
taggtttgggaatggggtgc

SEQ ID NO: 181495 - DNA, 20 bp, Artificial Sequence
  Synthetic oligonucleotide; GGG chr2 60481233 60481252 60481236 -
aggtttgggaatggggtgct

SEQ ID NO: 181496 - DNA, 20 bp, Artificial Sequence
  Synthetic oligonucleotide; GAG chr2 60481231 60481250 60481234 -
gtttgggaatggggtgctgg

SEQ ID NO: 181497 - DNA, 20 bp, Artificial Sequence
  Synthetic oligonucleotide; AGG chr2 60481230 60481249 60481233 -
tttgggaatggggtgctggg

SEQ ID NO: 181498 - DNA, 20 bp, Artificial Sequence
  Synthetic oligonucleotide; GGG chr2 60481229 60481248 60481232 -
ttgggaatggggtgctggga

SEQ ID NO: 181499 - DNA, 20 bp, Artificial Sequence
  Synthetic oligonucleotide; GGG chr2 60481228 60481247 60481231 -
tgggaatggggtgctgggag

SEQ ID NO: 181500 - DNA, 20 bp, Artificial Sequence
  Synthetic oligonucleotide; GAG chr2 60481226 60481245 60481229 -
ggaatggggtgctgggaggg

SEQ ID NO: 181501 - DNA, 20 bp, Artificial Sequence
  Synthetic oligonucleotide; AGG chr2 60481225 60481244 60481228 -
gaatggggtgctgggagggg

SEQ ID NO: 181502 - DNA, 20 bp, Artificial Sequence
  Synthetic oligonucleotide; GGG chr2 60481224 60481243 60481227 -
aatggggtgctgggagggga

SEQ ID NO: 181503 - DNA, 20 bp, Artificial Sequence
  Synthetic oligonucleotide; GGG chr2 60481223 60481242 60481226 -
atggggtgctgggaggggag

SEQ ID NO: 181504 - DNA, 20 bp, Artificial Sequence
  Synthetic oligonucleotide; CAG chr2 60481209 60481228 60481212 -
ggggaggggatatcccattc

SEQ ID NO: 181505 - DNA, 20 bp, Artificial Sequence
  Synthetic oligonucleotide; AGG chr2 60481208 60481227 60481211 -
gggaggggatatcccattcc

SEQ ID NO: 181506 - DNA, 20 bp, Artificial Sequence
  Synthetic oligonucleotide; GGG chr2 60481207 60481226 60481210 -
ggaggggatatcccattcca

SEQ ID NO: 181507 - DNA, 20 bp, Artificial Sequence
  Synthetic oligonucleotide; CAG chr2 60481197 60481216 60481200 -
tcccattccagggcccttcc

SEQ ID NO: 181508 - DNA, 20 bp, Artificial Sequence
  Synthetic oligonucleotide; TGG chr2 60481191 60481210 60481194 -
tccagggcccttcccagttt

SEQ ID NO: 181509 - DNA, 20 bp, Artificial Sequence
  Synthetic oligonucleotide; GGG chr2 60481190 60481209 60481193 -
ccagggcccttcccagtttt

SEQ ID NO: 181510 - DNA, 20 bp, Artificial Sequence
  Synthetic oligonucleotide; GGG chr2 60481189 60481208 60481192 -
cagggcccttcccagttttg

SEQ ID NO: 181511 - DNA, 20 bp, Artificial Sequence
  Synthetic oligonucleotide; TGG chr2 60481185 60481204 60481188 -
gcccttcccagttttggggc

SEQ ID NO: 181512 - DNA, 20 bp, Artificial Sequence
  Synthetic oligonucleotide; GGG chr2 60481184 60481203 60481187 -
cccttcccagttttggggct

SEQ ID NO: 181513 - DNA, 20 bp, Artificial Sequence
  Synthetic oligonucleotide; AAG chr2 60481181 60481200 60481184 -
ttcccagttttggggctggg

SEQ ID NO: 181514 - DNA, 20 bp, Artificial Sequence
  Synthetic oligonucleotide; GAG chr2 60481165 60481184 60481168 -
tgggaagcctcaatctcctt

SEQ ID NO: 181515 - DNA, 20 bp, Artificial Sequence
  Synthetic oligonucleotide; CAG chr2 60481160 60481179 60481163 -
agcctcaatctccttgagca

SEQ ID NO: 181516 - DNA, 20 bp, Artificial Sequence
  Synthetic oligonucleotide; CAG chr2 60481157 60481176 60481160 -
ctcaatctccttgagcacag

SEQ ID NO: 181517 - DNA, 20 bp, Artificial Sequence
  Synthetic oligonucleotide; AGG chr2 60481156 60481175 60481159 -
tcaatctccttgagcacagc

SEQ ID NO: 181518 - DNA, 20 bp, Artificial Sequence
  Synthetic oligonucleotide; GGG chr2 60481155 60481174 60481158 -
caatctccttgagcacagca

SEQ ID NO: 181519 - DNA, 20 bp, Artificial Sequence
  Synthetic oligonucleotide; GAG chr2 60481132 60481151 60481135 -
ctttgccttctttcttccct

SEQ ID NO: 181520 - DNA, 20 bp, Artificial Sequence
  Synthetic oligonucleotide; CGG chr2 60481126 60481145 60481129 -
cttctttcttccctgagctg

SEQ ID NO: 181521 - DNA, 20 bp, Artificial Sequence
  Synthetic oligonucleotide; TGG chr2 60481116 60481135 60481119 -
ccctgagctgcggccaccac

SEQ ID NO: 181522 - DNA, 20 bp, Artificial Sequence
  Synthetic oligonucleotide; GGG chr2 60481115 60481134 60481118 -
cctgagctgcggccaccact

SEQ ID NO: 181523 - DNA, 20 bp, Artificial Sequence
  Synthetic oligonucleotide; CAG chr2 60481106 60481125 60481109 -
cggccaccactgggctgtac

SEQ ID NO: 181524 - DNA, 20 bp, Artificial Sequence
  Synthetic oligonucleotide; AGG chr2 60481105 60481124 60481108 -
ggccaccactgggctgtacc

SEQ ID NO: 181525 - DNA, 20 bp, Artificial Sequence
  Synthetic oligonucleotide; TAG chr2 60481099 60481118 60481102 -
cactgggctgtaccaggatc

SEQ ID NO: 181526 - DNA, 20 bp, Artificial Sequence
  Synthetic oligonucleotide; TGG chr2 60481089 60481108 60481092 -
taccaggatctagtgcaact

SEQ ID NO: 181527 - DNA, 20 bp, Artificial Sequence
  Synthetic oligonucleotide; GGG chr2 60481088 60481107 60481091 -
accaggatctagtgcaactt

SEQ ID NO: 181528 - DNA, 20 bp, Artificial Sequence
  Synthetic oligonucleotide; AAG chr2 60481081 60481100 60481084 -
tctagtgcaacttgggtgac

SEQ ID NO: 181529 - DNA, 20 bp, Artificial Sequence
  Synthetic oligonucleotide; AGG chr2 60481080 60481099 60481083 -
ctagtgcaacttgggtgaca

SEQ ID NO: 181530 - DNA, 20 bp, Artificial Sequence
  Synthetic oligonucleotide; TGG chr2 60481075 60481094 60481078 -
gcaacttgggtgacaaggtg

SEQ ID NO: 181531 - DNA, 20 bp, Artificial Sequence
  Synthetic oligonucleotide; GGG chr2 60481074 60481093 60481077 -
caacttgggtgacaaggtgt

SEQ ID NO: 181532 - DNA, 20 bp, Artificial Sequence
  Synthetic oligonucleotide; TGG chr2 60481071 60481090 60481074 -
cttgggtgacaaggtgtggg

SEQ ID NO: 181533 - DNA, 20 bp, Artificial Sequence
  Synthetic oligonucleotide; CAG chr2 60481065 60481084 60481068 -
tgacaaggtgtgggtggctg

SEQ ID NO: 181534 - DNA, 20 bp, Artificial Sequence
  Synthetic oligonucleotide; AGG chr2 60481064 60481083 60481067 -
gacaaggtgtgggtggctgc

SEQ ID NO: 181535 - DNA, 20 bp, Artificial Sequence
  Synthetic oligonucleotide; GAG chr2 60481045 60481064 60481048 -
caggtgttctccctgcatct

SEQ ID NO: 181536 - DNA, 20 bp, Artificial Sequence
  Synthetic oligonucleotide; AGG chr2 60481044 60481063 60481047 -
aggtgttctccctgcatctg

SEQ ID NO: 181537 - DNA, 20 bp, Artificial Sequence
  Synthetic oligonucleotide; CAG chr2 60481041 60481060 60481044 -
tgttctccctgcatctgagg

SEQ ID NO: 181538 - DNA, 20 bp, Artificial Sequence
  Synthetic oligonucleotide; AGG chr2 60481040 60481059 60481043 -
gttctccctgcatctgaggc

SEQ ID NO: 181539 - DNA, 20 bp, Artificial Sequence
  Synthetic oligonucleotide; GGG chr2 60481039 60481058 60481042 -
ttctccctgcatctgaggca

SEQ ID NO: 181540 - DNA, 20 bp, Artificial Sequence
  Synthetic oligonucleotide; GAG chr2 60481037 60481056 60481040 -
ctccctgcatctgaggcagg

SEQ ID NO: 181541 - DNA, 20 bp, Artificial Sequence
  Synthetic oligonucleotide; AGG chr2 60481036 60481055 60481039 -
tccctgcatctgaggcaggg

SEQ ID NO: 181542 - DNA, 20 bp, Artificial Sequence
  Synthetic oligonucleotide; CAG chr2 60481033 60481052 60481036 -
ctgcatctgaggcagggagg

SEQ ID NO: 181543 - DNA, 20 bp, Artificial Sequence
  Synthetic oligonucleotide; TGG chr2 60481029 60481048 60481032 -
atctgaggcagggaggcagc

SEQ ID NO: 181544 - DNA, 20 bp, Artificial Sequence
  Synthetic oligonucleotide; GGG chr2 60481028 60481047 60481031 -
tctgaggcagggaggcagct

SEQ ID NO: 181545 - DNA, 20 bp, Artificial Sequence
  Synthetic oligonucleotide; GGG chr2 60481027 60481046 60481030 -
ctgaggcagggaggcagctg

SEQ ID NO: 181546 - DNA, 20 bp, Artificial Sequence
  Synthetic oligonucleotide; GGG chr2 60481026 60481045 60481029 -
tgaggcagggaggcagctgg

SEQ ID NO: 181547 - DNA, 20 bp, Artificial Sequence
  Synthetic oligonucleotide; CAG chr2 60481019 60481038 60481022 -
gggaggcagctgggggcttc

SEQ ID NO: 181548 - DNA, 20 bp, Artificial Sequence
  Synthetic oligonucleotide; CAG chr2 60481015 60481034 60481018 -
ggcagctgggggcttccagc

SEQ ID NO: 181549 - DNA, 20 bp, Artificial Sequence
  Synthetic oligonucleotide; CAG chr2 60480996 60481015 60480999 -
ccagcctgtaatgcccctcc

SEQ ID NO: 181550 - DNA, 20 bp, Artificial Sequence
  Synthetic oligonucleotide; AGG chr2 60480995 60481014 60480998 -
cagcctgtaatgcccctccc

SEQ ID NO: 181551 - DNA, 20 bp, Artificial Sequence
  Synthetic oligonucleotide; TAG chr2 60480990 60481009 60480993 -
tgtaatgcccctcccaggtc

SEQ ID NO: 181552 - DNA, 20 bp, Artificial Sequence
  Synthetic oligonucleotide; TAG chr2 60480982 60481001 60480985 -
ccctcccaggtctagcttcc

SEQ ID NO: 181553 - DNA, 20 bp, Artificial Sequence
  Synthetic oligonucleotide; AAG chr2 60480969 60480988 60480972 -
agcttcctagccttattttt

SEQ ID NO: 181554 - DNA, 20 bp, Artificial Sequence
  Synthetic oligonucleotide; TAG chr2 60480960 60480979 60480963 -
gccttatttttaagcccttt

SEQ ID NO: 181555 - DNA, 20 bp, Artificial Sequence
  Synthetic oligonucleotide; TGG chr2 60480957 60480976 60480960 -
ttatttttaagcccttttag

SEQ ID NO: 181556 - DNA, 20 bp, Artificial Sequence
  Synthetic oligonucleotide; GAG chr2 60480955 60480974 60480958 -
atttttaagcccttttagtg

SEQ ID NO: 181557 - DNA, 20 bp, Artificial Sequence
  Synthetic oligonucleotide; TAG chr2 60480941 60480960 60480944 -
ttagtggagcaaaaactatt

SEQ ID NO: 181558 - DNA, 20 bp, Artificial Sequence
  Synthetic oligonucleotide; GAG chr2 60480932 60480951 60480935 -
caaaaactatttagaactat

SEQ ID NO: 181559 - DNA, 20 bp, Artificial Sequence
  Synthetic oligonucleotide; TAG chr2 60480921 60480940 60480924 -
tagaactatgagttcaaaaa

SEQ ID NO: 181560 - DNA, 20 bp, Artificial Sequence
  Synthetic oligonucleotide; AGG chr2 60480920 60480939 60480923 -
agaactatgagttcaaaaat

SEQ ID NO: 181561 - DNA, 20 bp, Artificial Sequence
  Synthetic oligonucleotide; AAG chr2 60480910 60480929 60480913 -
gttcaaaaataggattattc

SEQ ID NO: 181562 - DNA, 20 bp, Artificial Sequence
  Synthetic oligonucleotide; CGG chr2 60480907 60480926 60480910 -
caaaaataggattattcaag

SEQ ID NO: 181563 - DNA, 20 bp, Artificial Sequence
  Synthetic oligonucleotide; GAG chr2 60480905 60480924 60480908 -
aaaataggattattcaagcg

SEQ ID NO: 181564 - DNA, 20 bp, Artificial Sequence
  Synthetic oligonucleotide; AGG chr2 60480904 60480923 60480907 -
aaataggattattcaagcgg

SEQ ID NO: 181565 - DNA, 20 bp, Artificial Sequence
  Synthetic oligonucleotide; TGG chr2 60480879 60480898 60480882 -
cttcacactgttctttctct

SEQ ID NO: 181566 - DNA, 20 bp, Artificial Sequence
  Synthetic oligonucleotide; GGG chr2 60480878 60480897 60480881 -
ttcacactgttctttctctt

SEQ ID NO: 181567 - DNA, 20 bp, Artificial Sequence
  Synthetic oligonucleotide; CAG chr2 60480874 60480893 60480877 -
cactgttctttctcttggga

SEQ ID NO: 181568 - DNA, 20 bp, Artificial Sequence
  Synthetic oligonucleotide; GAG chr2 60480872 60480891 60480875 -
ctgttctttctcttgggaca

SEQ ID NO: 181569 - DNA, 20 bp, Artificial Sequence
  Synthetic oligonucleotide; TGG chr2 60480868 60480887 60480871 -
tctttctcttgggacagaga

SEQ ID NO: 181570 - DNA, 20 bp, Artificial Sequence
  Synthetic oligonucleotide; GGG chr2 60480867 60480886 60480870 -
ctttctcttgggacagagat

SEQ ID NO: 181571 - DNA, 20 bp, Artificial Sequence
  Synthetic oligonucleotide; GGG chr2 60480866 60480885 60480869 -
tttctcttgggacagagatg

SEQ ID NO: 181572 - DNA, 20 bp, Artificial Sequence
  Synthetic oligonucleotide; GGG chr2 60480865 60480884 60480868 -
ttctcttgggacagagatgg

SEQ ID NO: 181573 - DNA, 20 bp, Artificial Sequence
  Synthetic oligonucleotide; CAG chr2 60480860 60480879 60480863 -
ttgggacagagatgggggtg

SEQ ID NO: 181574 - DNA, 20 bp, Artificial Sequence
  Synthetic oligonucleotide; AGG chr2 60480859 60480878 60480862 -
tgggacagagatgggggtgc

SEQ ID NO: 181575 - DNA, 20 bp, Artificial Sequence
  Synthetic oligonucleotide; TAG chr2 60480856 60480875 60480859 -
gacagagatgggggtgcagg

SEQ ID NO: 181576 - DNA, 20 bp, Artificial Sequence
  Synthetic oligonucleotide; AGG chr2 60480855 60480874 60480858 -
acagagatgggggtgcaggt

SEQ ID NO: 181577 - DNA, 20 bp, Artificial Sequence
  Synthetic oligonucleotide; GGG chr2 60480854 60480873 60480857 -
cagagatgggggtgcaggta

SEQ ID NO: 181578 - DNA, 20 bp, Artificial Sequence
  Synthetic oligonucleotide; GGG chr2 60480853 60480872 60480856 -
agagatgggggtgcaggtag

SEQ ID NO: 181579 - DNA, 20 bp, Artificial Sequence
  Synthetic oligonucleotide; GAG chr2 60480848 60480867 60480851 -
tgggggtgcaggtaggggat

SEQ ID NO: 181580 - DNA, 20 bp, Artificial Sequence
  Synthetic oligonucleotide; TAG chr2 60480843 60480862 60480846 -
gtgcaggtaggggatgagaa

SEQ ID NO: 181581 - DNA, 20 bp, Artificial Sequence
  Synthetic oligonucleotide; GAG chr2 60480841 60480860 60480844 -
gcaggtaggggatgagaata

SEQ ID NO: 181582 - DNA, 20 bp, Artificial Sequence
  Synthetic oligonucleotide; AGG chr2 60480840 60480859 60480843 -
caggtaggggatgagaatag

SEQ ID NO: 181583 - DNA, 20 bp, Artificial Sequence
  Synthetic oligonucleotide; TGG chr2 60480831 60480850 60480834 -
gatgagaatagaggaaaatg

SEQ ID NO: 181584 - DNA, 20 bp, Artificial Sequence
  Synthetic oligonucleotide; GAG chr2 60480829 60480848 60480832 -
tgagaatagaggaaaatgtg

SEQ ID NO: 181585 - DNA, 20 bp, Artificial Sequence
  Synthetic oligonucleotide; AGG chr2 60480828 60480847 60480831 -
gagaatagaggaaaatgtgg

SEQ ID NO: 181586 - DNA, 20 bp, Artificial Sequence
  Synthetic oligonucleotide; GAG chr2 60480809 60480828 60480812 -
gaggattgctaaaacaaatt

SEQ ID NO: 181587 - DNA, 20 bp, Artificial Sequence
  Synthetic oligonucleotide; GAG chr2 60480807 60480826 60480810 -
ggattgctaaaacaaattga

SEQ ID NO: 181588 - DNA, 20 bp, Artificial Sequence
  Synthetic oligonucleotide; GAG chr2 60480805 60480824 60480808 -
attgctaaaacaaattgaga

SEQ ID NO: 181589 - DNA, 20 bp, Artificial Sequence
  Synthetic oligonucleotide; AGG chr2 60480804 60480823 60480807 -
ttgctaaaacaaattgagag

SEQ ID NO: 181590 - DNA, 20 bp, Artificial Sequence
  Synthetic oligonucleotide; AAG chr2 60480801 60480820 60480804 -
ctaaaacaaattgagagagg

SEQ ID NO: 181591 - DNA, 20 bp, Artificial Sequence
  Synthetic oligonucleotide; AGG chr2 60480800 60480819 60480803 -
taaaacaaattgagagagga

SEQ ID NO: 181592 - DNA, 20 bp, Artificial Sequence
  Synthetic oligonucleotide; AAG chr2 60480797 60480816 60480800 -
aacaaattgagagaggaagg

SEQ ID NO: 181593 - DNA, 20 bp, Artificial Sequence
  Synthetic oligonucleotide; AAG chr2 60480793 60480812 60480796 -
aattgagagaggaaggaaga

SEQ ID NO: 181594 - DNA, 20 bp, Artificial Sequence
  Synthetic oligonucleotide; AGG chr2 60480792 60480811 60480795 -
attgagagaggaaggaagaa

SEQ ID NO: 181595 - DNA, 20 bp, Artificial Sequence
  Synthetic oligonucleotide; GGG chr2 60480791 60480810 60480794 -
ttgagagaggaaggaagaaa

SEQ ID NO: 181596 - DNA, 20 bp, Artificial Sequence
  Synthetic oligonucleotide; CAG chr2 60480785 60480804 60480788 -
gaggaaggaagaaagggacc

SEQ ID NO: 181597 - DNA, 20 bp, Artificial Sequence
  Synthetic oligonucleotide; TAG chr2 60480780 60480799 60480783 -
aggaagaaagggacccagac

SEQ ID NO: 181598 - DNA, 20 bp, Artificial Sequence
  Synthetic oligonucleotide; GAG chr2 60480772 60480791 60480775 -
agggacccagactagtaatt

SEQ ID NO: 181599 - DNA, 20 bp, Artificial Sequence
  Synthetic oligonucleotide; CAG chr2 60480759 60480778 60480762 -
agtaattgagaccaattcac

SEQ ID NO: 181600 - DNA, 20 bp, Artificial Sequence
  Synthetic oligonucleotide; AAG chr2 60480756 60480775 60480759 -
aattgagaccaattcaccag

SEQ ID NO: 181601 - DNA, 20 bp, Artificial Sequence
  Synthetic oligonucleotide; AAG chr2 60480749 60480768 60480752 -
accaattcaccagaagactt

SEQ ID NO: 181602 - DNA, 20 bp, Artificial Sequence
  Synthetic oligonucleotide; AGG chr2 60480748 60480767 60480751 -
ccaattcaccagaagactta

SEQ ID NO: 181603 - DNA, 20 bp, Artificial Sequence
  Synthetic oligonucleotide; TAG chr2 60480728 60480747 60480731 -
aggaaatttgacatccgctg

SEQ ID NO: 181604 - DNA, 20 bp, Artificial Sequence
  Synthetic oligonucleotide; CAG chr2 60480703 60480722 60480706 -
cttttaactgtgtaattaca

SEQ ID NO: 181605 - DNA, 20 bp, Artificial Sequence
  Synthetic oligonucleotide; TGG chr2 60480696 60480715 60480699 -
ctgtgtaattacacagcatt

SEQ ID NO: 181606 - DNA, 20 bp, Artificial Sequence
  Synthetic oligonucleotide; AAG chr2 60480692 60480711 60480695 -
gtaattacacagcatttgga

SEQ ID NO: 181607 - DNA, 20 bp, Artificial Sequence
  Synthetic oligonucleotide; GAG chr2 60480655 60480674 60480658 -
gattgtccataacaaccatt

SEQ ID NO: 181608 - DNA, 20 bp, Artificial Sequence
  Synthetic oligonucleotide; CAG chr2 60480638 60480657 60480641 -
attgagtaaatacactatta

SEQ ID NO: 181609 - DNA, 20 bp, Artificial Sequence
  Synthetic oligonucleotide; TAG chr2 60480625 60480644 60480628 -
actattacagattgccaaaa

SEQ ID NO: 181610 - DNA, 20 bp, Artificial Sequence
  Synthetic oligonucleotide; CAG chr2 60480620 60480639 60480623 -
tacagattgccaaaatagta

SEQ ID NO: 181611 - DNA, 20 bp, Artificial Sequence
  Synthetic oligonucleotide; AAG chr2 60480615 60480634 60480618 -
attgccaaaatagtacagtg

SEQ ID NO: 181612 - DNA, 20 bp, Artificial Sequence
  Synthetic oligonucleotide; TGG chr2 60480609 60480628 60480612 -
aaaatagtacagtgaagcga

SEQ ID NO: 181613 - DNA, 20 bp, Artificial Sequence
  Synthetic oligonucleotide; CAG chr2 60480604 60480623 60480607 -
agtacagtgaagcgatggac

SEQ ID NO: 181614 - DNA, 20 bp, Artificial Sequence
  Synthetic oligonucleotide; CAG chr2 60480601 60480620 60480604 -
acagtgaagcgatggaccag

SEQ ID NO: 181615 - DNA, 20 bp, Artificial Sequence
  Synthetic oligonucleotide; AAG chr2 60480590 60480609 60480593 -
atggaccagcagccactttc

SEQ ID NO: 181616 - DNA, 20 bp, Artificial Sequence
  Synthetic oligonucleotide; AGG chr2 60480589 60480608 60480592 -
tggaccagcagccactttca

SEQ ID NO: 181617 - DNA, 20 bp, Artificial Sequence
  Synthetic oligonucleotide; GGG chr2 60480588 60480607 60480591 -
ggaccagcagccactttcaa

SEQ ID NO: 181618 - DNA, 20 bp, Artificial Sequence
  Synthetic oligonucleotide; GGG chr2 60480587 60480606 60480590 -
gaccagcagccactttcaag

SEQ ID NO: 181619 - DNA, 20 bp, Artificial Sequence
  Synthetic oligonucleotide; TGG chr2 60480570 60480589 60480573 -
aaggggctgtaatcctctcc

SEQ ID NO: 181620 - DNA, 20 bp, Artificial Sequence
  Synthetic oligonucleotide; GGG chr2 60480569 60480588 60480572 -
aggggctgtaatcctctcct

SEQ ID NO: 181621 - DNA, 20 bp, Artificial Sequence
  Synthetic oligonucleotide; AAG chr2 60480564 60480583 60480567 -
ctgtaatcctctcctgggtc

SEQ ID NO: 181622 - DNA, 20 bp, Artificial Sequence
  Synthetic oligonucleotide; AGG chr2 60480563 60480582 60480566 -
tgtaatcctctcctgggtca

SEQ ID NO: 181623 - DNA, 20 bp, Artificial Sequence
  Synthetic oligonucleotide; CAG chr2 60480554 60480573 60480557 -
ctcctgggtcaaggctgacc

SEQ ID NO: 181624 - DNA, 20 bp, Artificial Sequence
  Synthetic oligonucleotide; GAG chr2 60480552 60480571 60480555 -
cctgggtcaaggctgaccca

SEQ ID NO: 181625 - DNA, 20 bp, Artificial Sequence
  Synthetic oligonucleotide; AGG chr2 60480551 60480570 60480554 -
ctgggtcaaggctgacccag

SEQ ID NO: 181626 - DNA, 20 bp, Artificial Sequence
  Synthetic oligonucleotide; TGG chr2 60480543 60480562 60480546 -
aggctgacccagaggctcct

SEQ ID NO: 181627 - DNA, 20 bp, Artificial Sequence
  Synthetic oligonucleotide; TAG chr2 60480539 60480558 60480542 -
tgacccagaggctccttggt

SEQ ID NO: 181628 - DNA, 20 bp, Artificial Sequence
  Synthetic oligonucleotide; TAG chr2 60480524 60480543 60480527 -
ttggttagtgaatcatttac

SEQ ID NO: 181629 - DNA, 20 bp, Artificial Sequence
  Synthetic oligonucleotide; AGG chr2 60480523 60480542 60480526 -
tggttagtgaatcatttact

SEQ ID NO: 181630 - DNA, 20 bp, Artificial Sequence
  Synthetic oligonucleotide; GGG chr2 60480522 60480541 60480525 -
ggttagtgaatcatttacta

SEQ ID NO: 181631 - DNA, 20 bp, Artificial Sequence
  Synthetic oligonucleotide; AAG chr2 60480519 60480538 60480522 -
tagtgaatcatttactaggg

SEQ ID NO: 181632 - DNA, 20 bp, Artificial Sequence
  Synthetic oligonucleotide; AGG chr2 60480518 60480537 60480521 -
agtgaatcatttactaggga

SEQ ID NO: 181633 - DNA, 20 bp, Artificial Sequence
  Synthetic oligonucleotide; TGG chr2 60480508 60480527 60480511 -
ttactagggaaggtttcccc

SEQ ID NO: 181634 - DNA, 20 bp, Artificial Sequence
  Synthetic oligonucleotide; TGG chr2 60480498 60480517 60480501 -
aggtttcccctggtcactgc

SEQ ID NO: 181635 - DNA, 20 bp, Artificial Sequence
  Synthetic oligonucleotide; TGG chr2 60480490 60480509 60480493 -
cctggtcactgctggctcca

SEQ ID NO: 181636 - DNA, 20 bp, Artificial Sequence
  Synthetic oligonucleotide; TGG chr2 60480485 60480504 60480488 -
tcactgctggctccatggcc

SEQ ID NO: 181637 - DNA, 20 bp, Artificial Sequence
  Synthetic oligonucleotide; CAG chr2 60480476 60480495 60480479 -
gctccatggcctggtccttc

SEQ ID NO: 181638 - DNA, 20 bp, Artificial Sequence
  Synthetic oligonucleotide; CAG chr2 60480472 60480491 60480475 -
catggcctggtccttccagc

SEQ ID NO: 181639 - DNA, 20 bp, Artificial Sequence
  Synthetic oligonucleotide; AGG chr2 60480471 60480490 60480474 -
atggcctggtccttccagcc

SEQ ID NO: 181640 - DNA, 20 bp, Artificial Sequence
  Synthetic oligonucleotide; TAG chr2 60480463 60480482 60480466 -
gtccttccagccaggtcatt

SEQ ID NO: 181641 - DNA, 20 bp, Artificial Sequence
  Synthetic oligonucleotide; TGG chr2 60480458 60480477 60480461 -
tccagccaggtcatttagaa

SEQ ID NO: 181642 - DNA, 20 bp, Artificial Sequence
  Synthetic oligonucleotide; CAG chr2 60480447 60480466 60480450 -
catttagaatggctctccaa

SEQ ID NO: 181643 - DNA, 20 bp, Artificial Sequence
  Synthetic oligonucleotide; AGG chr2 60480446 60480465 60480449 -
atttagaatggctctccaac

SEQ ID NO: 181644 - DNA, 20 bp, Artificial Sequence
  Synthetic oligonucleotide; AAG chr2 60480443 60480462 60480446 -
tagaatggctctccaacagg

SEQ ID NO: 181645 - DNA, 20 bp, Artificial Sequence
  Synthetic oligonucleotide; AAG chr2 60480438 60480457 60480441 -
tggctctccaacaggaagaa

SEQ ID NO: 181646 - DNA, 20 bp, Artificial Sequence
  Synthetic oligonucleotide; CAG chr2 60480426 60480445 60480429 -
aggaagaaaagttcactgca

SEQ ID NO: 181647 - DNA, 20 bp, Artificial Sequence
  Synthetic oligonucleotide; GAG chr2 60480400 60480419 60480403 -
ttgaatcctaattatttatt

SEQ ID NO: 181648 - DNA, 20 bp, Artificial Sequence
  Synthetic oligonucleotide; AGG chr2 60480399 60480418 60480402 -
tgaatcctaattatttattg

SEQ ID NO: 181649 - DNA, 20 bp, Artificial Sequence
  Synthetic oligonucleotide; GGG chr2 60480398 60480417 60480401 -
gaatcctaattatttattga

SEQ ID NO: 181650 - DNA, 20 bp, Artificial Sequence
  Synthetic oligonucleotide; GGG chr2 60480397 60480416 60480400 -
aatcctaattatttattgag

SEQ ID NO: 181651 - DNA, 20 bp, Artificial Sequence
  Synthetic oligonucleotide; CAG chr2 60480382 60480401 60480385 -
ttgaggggctcttctttgcc

SEQ ID NO: 181652 - DNA, 20 bp, Artificial Sequence
  Synthetic oligonucleotide; TGG chr2 60480377 60480396 60480380 -
gggctcttctttgcccagca

SEQ ID NO: 181653 - DNA, 20 bp, Artificial Sequence
  Synthetic oligonucleotide; TGG chr2 60480371 60480390 60480374 -
ttctttgcccagcatggtgc

SEQ ID NO: 181654 - DNA, 20 bp, Artificial Sequence
  Synthetic oligonucleotide; CAG chr2 60480367 60480386 60480370 -
ttgcccagcatggtgctgga

SEQ ID NO: 181655 - DNA, 20 bp, Artificial Sequence
  Synthetic oligonucleotide; CAG chr2 60480363 60480382 60480366 -
ccagcatggtgctggacagt

SEQ ID NO: 181656 - DNA, 20 bp, Artificial Sequence
  Synthetic oligonucleotide; GAG chr2 60480361 60480380 60480364 -
agcatggtgctggacagtca

SEQ ID NO: 181657 - DNA, 20 bp, Artificial Sequence
  Synthetic oligonucleotide; AGG chr2 60480360 60480379 60480363 -
gcatggtgctggacagtcag

SEQ ID NO: 181658 - DNA, 20 bp, Artificial Sequence
  Synthetic oligonucleotide; TAG chr2 60480357 60480376 60480360 -
tggtgctggacagtcagagg

SEQ ID NO: 181659 - DNA, 20 bp, Artificial Sequence
  Synthetic oligonucleotide; GAG chr2 60480348 60480367 60480351 -
acagtcagaggtagaccact

SEQ ID NO: 181660 - DNA, 20 bp, Artificial Sequence
  Synthetic oligonucleotide; TGG chr2 60480342 60480361 60480345 -
agaggtagaccactgagtct

SEQ ID NO: 181661 - DNA, 20 bp, Artificial Sequence
  Synthetic oligonucleotide; TAG chr2 60480335 60480354 60480338 -
gaccactgagtcttggttct

SEQ ID NO: 181662 - DNA, 20 bp, Artificial Sequence
  Synthetic oligonucleotide; AAG chr2 60480332 60480351 60480335 -
cactgagtcttggttcttag

SEQ ID NO: 181663 - DNA, 20 bp, Artificial Sequence
  Synthetic oligonucleotide; TAG chr2 60480318 60480337 60480321 -
tcttagaagccttgaacttt

SEQ ID NO: 181664 - DNA, 20 bp, Artificial Sequence
  Synthetic oligonucleotide; TGG chr2 60480314 60480333 60480317 -
agaagccttgaacttttagt

SEQ ID NO: 181665 - DNA, 20 bp, Artificial Sequence
  Synthetic oligonucleotide; GAG chr2 60480312 60480331 60480315 -
aagccttgaacttttagttg

SEQ ID NO: 181666 - DNA, 20 bp, Artificial Sequence
  Synthetic oligonucleotide; CAG chr2 60480306 60480325 60480309 -
tgaacttttagttggagaac

SEQ ID NO: 181667 - DNA, 20 bp, Artificial Sequence
  Synthetic oligonucleotide; TGG chr2 60480303 60480322 60480306 -
acttttagttggagaaccag

SEQ ID NO: 181668 - DNA, 20 bp, Artificial Sequence
  Synthetic oligonucleotide; TAG chr2 60480300 60480319 60480303 -
tttagttggagaaccagtgg

SEQ ID NO: 181669 - DNA, 20 bp, Artificial Sequence
  Synthetic oligonucleotide; CAG chr2 60480283 60480302 60480286 -
tggtagatacatgctgatta

SEQ ID NO: 181670 - DNA, 20 bp, Artificial Sequence
  Synthetic oligonucleotide; AGG chr2 60480282 60480301 60480285 -
ggtagatacatgctgattac

SEQ ID NO: 181671 - DNA, 20 bp, Artificial Sequence
  Synthetic oligonucleotide; GGG chr2 60480281 60480300 60480284 -
gtagatacatgctgattaca

SEQ ID NO: 181672 - DNA, 20 bp, Artificial Sequence
  Synthetic oligonucleotide; GAG chr2 60480279 60480298 60480282 -
agatacatgctgattacagg

SEQ ID NO: 181673 - DNA, 20 bp, Artificial Sequence
  Synthetic oligonucleotide; TGG chr2 60480273 60480292 60480276 -
atgctgattacagggagact

SEQ ID NO: 181674 - DNA, 20 bp, Artificial Sequence
  Synthetic oligonucleotide; CAG chr2 60480267 60480286 60480270 -
attacagggagacttggatc

SEQ ID NO: 181675 - DNA, 20 bp, Artificial Sequence
  Synthetic oligonucleotide; AGG chr2 60480266 60480285 60480269 -
ttacagggagacttggatcc

SEQ ID NO: 181676 - DNA, 20 bp, Artificial Sequence
  Synthetic oligonucleotide; GAG chr2 60480264 60480283 60480267 -
acagggagacttggatccag

SEQ ID NO: 181677 - DNA, 20 bp, Artificial Sequence
  Synthetic oligonucleotide; TGG chr2 60480258 60480277 60480261 -
agacttggatccaggagaaa

SEQ ID NO: 181678 - DNA, 20 bp, Artificial Sequence
  Synthetic oligonucleotide; GAG chr2 60480256 60480275 60480259 -
acttggatccaggagaaatg

SEQ ID NO: 181679 - DNA, 20 bp, Artificial Sequence
  Synthetic oligonucleotide; TGG chr2 60480253 60480272 60480256 -
tggatccaggagaaatggag

SEQ ID NO: 181680 - DNA, 20 bp, Artificial Sequence
  Synthetic oligonucleotide; GAG chr2 60480251 60480270 60480254 -
gatccaggagaaatggagtg

SEQ ID NO: 181681 - DNA, 20 bp, Artificial Sequence
  Synthetic oligonucleotide; GAG chr2 60480249 60480268 60480252 -
tccaggagaaatggagtgga

SEQ ID NO: 181682 - DNA, 20 bp, Artificial Sequence
  Synthetic oligonucleotide; CAG chr2 60480245 60480264 60480248 -
ggagaaatggagtggagagc

SEQ ID NO: 181683 - DNA, 20 bp, Artificial Sequence
  Synthetic oligonucleotide; AGG chr2 60480244 60480263 60480247 -
gagaaatggagtggagagcc

SEQ ID NO: 181684 - DNA, 20 bp, Artificial Sequence
  Synthetic oligonucleotide; CAG chr2 60480239 60480258 60480242 -
atggagtggagagccaggtt

SEQ ID NO: 181685 - DNA, 20 bp, Artificial Sequence
  Synthetic oligonucleotide; AAG chr2 60480236 60480255 60480239 -
gagtggagagccaggttcag

SEQ ID NO: 181686 - DNA, 20 bp, Artificial Sequence
  Synthetic oligonucleotide; GAG chr2 60480234 60480253 60480237 -
gtggagagccaggttcagaa

SEQ ID NO: 181687 - DNA, 20 bp, Artificial Sequence
  Synthetic oligonucleotide; GAG chr2 60480232 60480251 60480235 -
ggagagccaggttcagaaga

SEQ ID NO: 181688 - DNA, 20 bp, Artificial Sequence
  Synthetic oligonucleotide; CAG chr2 60480217 60480236 60480220 -
gaagagagacatatccttta

SEQ ID NO: 181689 - DNA, 20 bp, Artificial Sequence
  Synthetic oligonucleotide; AGG chr2 60480216 60480235 60480219 -
aagagagacatatcctttac

SEQ ID NO: 181690 - DNA, 20 bp, Artificial Sequence
  Synthetic oligonucleotide; TAG chr2 60480200 60480219 60480203 -
ttacaggcctttgtgttacc

SEQ ID NO: 181691 - DNA, 20 bp, Artificial Sequence
  Synthetic oligonucleotide; CAG chr2 60480196 60480215 60480199 -
aggcctttgtgttacctagc

SEQ ID NO: 181692 - DNA, 20 bp, Artificial Sequence
  Synthetic oligonucleotide; CAG chr2 60480179 60480198 60480182 -
agccagtgccttcatgtccc

SEQ ID NO: 181693 - DNA, 20 bp, Artificial Sequence
  Synthetic oligonucleotide; TGG chr2 60480171 60480190 60480174 -
ccttcatgtccccagccccc

SEQ ID NO: 181694 - DNA, 20 bp, Artificial Sequence
  Synthetic oligonucleotide; CAG chr2 60480164 60480183 60480167 -
gtccccagccccctggcctc

SEQ ID NO: 181695 - DNA, 20 bp, Artificial Sequence
  Synthetic oligonucleotide; TGG chr2 60480124 60480143 60480127 -
tcccccctcctcgctgtcct

SEQ ID NO: 181696 - DNA, 20 bp, Artificial Sequence
  Synthetic oligonucleotide; CAG chr2 60480119 60480138 60480122 -
cctcctcgctgtccttggtg

SEQ ID NO: 181697 - DNA, 20 bp, Artificial Sequence
  Synthetic oligonucleotide; GAG chr2 60480117 60480136 60480120 -
tcctcgctgtccttggtgca

SEQ ID NO: 181698 - DNA, 20 bp, Artificial Sequence
  Synthetic oligonucleotide; TGG chr2 60480114 60480133 60480117 -
tcgctgtccttggtgcagag

SEQ ID NO: 181699 - DNA, 20 bp, Artificial Sequence
  Synthetic oligonucleotide; GGG chr2 60480113 60480132 60480116 -
cgctgtccttggtgcagagt

SEQ ID NO: 181700 - DNA, 20 bp, Artificial Sequence
  Synthetic oligonucleotide; GGG chr2 60480112 60480131 60480115 -
gctgtccttggtgcagagtg

SEQ ID NO: 181701 - DNA, 20 bp, Artificial Sequence
  Synthetic oligonucleotide; CAG chr2 60480109 60480128 60480112 -
gtccttggtgcagagtgggg

SEQ ID NO: 181702 - DNA, 20 bp, Artificial Sequence
  Synthetic oligonucleotide; CAG chr2 60480100 60480119 60480103 -
gcagagtggggcagtcatct

SEQ ID NO: 181703 - DNA, 20 bp, Artificial Sequence
  Synthetic oligonucleotide; TGG chr2 60480097 60480116 60480100 -
gagtggggcagtcatctcag

SEQ ID NO: 181704 - DNA, 20 bp, Artificial Sequence
  Synthetic oligonucleotide; GGG chr2 60480096 60480115 60480099 -
agtggggcagtcatctcagt

SEQ ID NO: 181705 - DNA, 20 bp, Artificial Sequence
  Synthetic oligonucleotide; GGG chr2 60480095 60480114 60480098 -
gtggggcagtcatctcagtg

SEQ ID NO: 181706 - DNA, 20 bp, Artificial Sequence
  Synthetic oligonucleotide; CGG chr2 60480084 60480103 60480087 -
atctcagtggggcctcctcc

SEQ ID NO: 181707 - DNA, 20 bp, Artificial Sequence
  Synthetic oligonucleotide; GGG chr2 60480083 60480102 60480086 -
tctcagtggggcctcctccc

SEQ ID NO: 181708 - DNA, 20 bp, Artificial Sequence
  Synthetic oligonucleotide; GGG chr2 60480082 60480101 60480085 -
ctcagtggggcctcctcccg

SEQ ID NO: 181709 - DNA, 20 bp, Artificial Sequence
  Synthetic oligonucleotide; AAG chr2 60480079 60480098 60480082 -
agtggggcctcctcccgggg

SEQ ID NO: 181710 - DNA, 20 bp, Artificial Sequence
  Synthetic oligonucleotide; CAG chr2 60480072 60480091 60480075 -
cctcctcccggggaagtcca

SEQ ID NO: 181711 - DNA, 20 bp, Artificial Sequence
  Synthetic oligonucleotide; CGG chr2 60480057 60480076 60480060 -
gtccacagcttgctccacac

SEQ ID NO: 181712 - DNA, 20 bp, Artificial Sequence
  Synthetic oligonucleotide; GAG chr2 60480055 60480074 60480058 -
ccacagcttgctccacaccg

SEQ ID NO: 181713 - DNA, 20 bp, Artificial Sequence
  Synthetic oligonucleotide; AGG chr2 60480054 60480073 60480057 -
cacagcttgctccacaccgg

SEQ ID NO: 181714 - DNA, 20 bp, Artificial Sequence
  Synthetic oligonucleotide; GAG chr2 60480052 60480071 60480055 -
cagcttgctccacaccggag

SEQ ID NO: 181715 - DNA, 20 bp, Artificial Sequence
  Synthetic oligonucleotide; AAG chr2 60480043 60480062 60480046 -
ccacaccggaggagccgcca

SEQ ID NO: 181716 - DNA, 20 bp, Artificial Sequence
  Synthetic oligonucleotide; CAG chr2 60480039 60480058 60480042 -
accggaggagccgccaaagt

SEQ ID NO: 181717 - DNA, 20 bp, Artificial Sequence
  Synthetic oligonucleotide; AAG chr2 60480034 60480053 60480037 -
aggagccgccaaagtcagcc

SEQ ID NO: 181718 - DNA, 20 bp, Artificial Sequence
  Synthetic oligonucleotide; GAG chr2 60480032 60480051 60480035 -
gagccgccaaagtcagccaa

SEQ ID NO: 181719 - DNA, 20 bp, Artificial Sequence
  Synthetic oligonucleotide; CAG chr2 60480026 60480045 60480029 -
ccaaagtcagccaagagccg

SEQ ID NO: 181720 - DNA, 20 bp, Artificial Sequence
  Synthetic oligonucleotide; AGG chr2 60480025 60480044 60480028 -
caaagtcagccaagagccgc

SEQ ID NO: 181721 - DNA, 20 bp, Artificial Sequence
  Synthetic oligonucleotide; AAG chr2 60480011 60480030 60480014 -
agccgcaggccataaatgca

SEQ ID NO: 181722 - DNA, 20 bp, Artificial Sequence
  Synthetic oligonucleotide; AAG chr2 60479995 60480014 60479998 -
tgcaaagtatgatttaacaa

SEQ ID NO: 181723 - DNA, 20 bp, Artificial Sequence
  Synthetic oligonucleotide; CAG chr2 60479992 60480011 60479995 -
aaagtatgatttaacaaaag

SEQ ID NO: 181724 - DNA, 20 bp, Artificial Sequence
  Synthetic oligonucleotide; GAG chr2 60479984 60480003 60479987 -
atttaacaaaagcagctttt

SEQ ID NO: 181725 - DNA, 20 bp, Artificial Sequence
  Synthetic oligonucleotide; GAG chr2 60479980 60479999 60479983 -
aacaaaagcagcttttgagt

SEQ ID NO: 181726 - DNA, 20 bp, Artificial Sequence
  Synthetic oligonucleotide; AAG chr2 60479976 60479995 60479979 -
aaagcagcttttgagtgaga

SEQ ID NO: 181727 - DNA, 20 bp, Artificial Sequence
  Synthetic oligonucleotide; GAG chr2 60479971 60479990 60479974 -
agcttttgagtgagaaagct

SEQ ID NO: 181728 - DNA, 20 bp, Artificial Sequence
  Synthetic oligonucleotide; TGG chr2 60479968 60479987 60479971 -
ttttgagtgagaaagctgag

SEQ ID NO: 181729 - DNA, 20 bp, Artificial Sequence
  Synthetic oligonucleotide; GAG chr2 60479966 60479985 60479969 -
ttgagtgagaaagctgagtg

SEQ ID NO: 181730 - DNA, 20 bp, Artificial Sequence
  Synthetic oligonucleotide; CAG chr2 60479943 60479962 60479946 -
ttgtcccaacctgtcaactt

SEQ ID NO: 181731 - DNA, 20 bp, Artificial Sequence
  Synthetic oligonucleotide; CGG chr2 60479909 60479928 60479912 -
cctccccataaatcaaaaaa

SEQ ID NO: 181732 - DNA, 20 bp, Artificial Sequence
  Synthetic oligonucleotide; TGG chr2 60479905 60479924 60479908 -
cccataaatcaaaaaacggt

SEQ ID NO: 181733 - DNA, 20 bp, Artificial Sequence
  Synthetic oligonucleotide; TGG chr2 60479902 60479921 60479905 -
ataaatcaaaaaacggttgg

SEQ ID NO: 181734 - DNA, 20 bp, Artificial Sequence
  Synthetic oligonucleotide; AAG chr2 60479899 60479918 60479902 -
aatcaaaaaacggttggtgg

SEQ ID NO: 181735 - DNA, 20 bp, Artificial Sequence
  Synthetic oligonucleotide; AGG chr2 60479898 60479917 60479901 -
atcaaaaaacggttggtgga

SEQ ID NO: 181736 - DNA, 20 bp, Artificial Sequence
  Synthetic oligonucleotide; GGG chr2 60479897 60479916 60479900 -
tcaaaaaacggttggtggaa

SEQ ID NO: 181737 - DNA, 20 bp, Artificial Sequence
  Synthetic oligonucleotide; GAG chr2 60479895 60479914 60479898 -
aaaaaacggttggtggaagg

SEQ ID NO: 181738 - DNA, 20 bp, Artificial Sequence
  Synthetic oligonucleotide; AGG chr2 60479894 60479913 60479897 -
aaaaacggttggtggaaggg

SEQ ID NO: 181739 - DNA, 20 bp, Artificial Sequence
  Synthetic oligonucleotide; GGG chr2 60479893 60479912 60479896 -
aaaacggttggtggaaggga

SEQ ID NO: 181740 - DNA, 20 bp, Artificial Sequence
  Synthetic oligonucleotide; CAG chr2 60479889 60479908 60479892 -
cggttggtggaagggaggga

SEQ ID NO: 181741 - DNA, 20 bp, Artificial Sequence
  Synthetic oligonucleotide; AAG chr2 60479886 60479905 60479889 -
ttggtggaagggagggacag

SEQ ID NO: 181742 - DNA, 20 bp, Artificial Sequence
  Synthetic oligonucleotide; CAG chr2 60479872 60479891 60479875 -
ggacagaagcgtttcatttt

SEQ ID NO: 181743 - DNA, 20 bp, Artificial Sequence
  Synthetic oligonucleotide; AAG chr2 60479862 60479881 60479865 -
gtttcattttcagattttgt

SEQ ID NO: 181744 - DNA, 20 bp, Artificial Sequence
  Synthetic oligonucleotide; AAG chr2 60479841 60479860 60479844 -
agaaaataaaataaaatcaa

SEQ ID NO: 181745 - DNA, 20 bp, Artificial Sequence
  Synthetic oligonucleotide; CAG chr2 60479809 60479828 60479812 -
cacgctgataccttacatgc

SEQ ID NO: 181746 - DNA, 20 bp, Artificial Sequence
  Synthetic oligonucleotide; AGG chr2 60479808 60479827 60479811 -
acgctgataccttacatgcc

SEQ ID NO: 181747 - DNA, 20 bp, Artificial Sequence
  Synthetic oligonucleotide; GAG chr2 60479802 60479821 60479805 -
ataccttacatgccaggttt

SEQ ID NO: 181748 - DNA, 20 bp, Artificial Sequence
  Synthetic oligonucleotide; GAG chr2 60479796 60479815 60479799 -
tacatgccaggtttgagcct

SEQ ID NO: 181749 - DNA, 20 bp, Artificial Sequence
  Synthetic oligonucleotide; AGG chr2 60479795 60479814 60479798 -
acatgccaggtttgagcctg

SEQ ID NO: 181750 - DNA, 20 bp, Artificial Sequence
  Synthetic oligonucleotide; TGG chr2 60479782 60479801 60479785 -
gagcctgaggcaaatttttg

SEQ ID NO: 181751 - DNA, 20 bp, Artificial Sequence
  Synthetic oligonucleotide; AAG chr2 60479770 60479789 60479773 -
aatttttgtggccatgtaat

SEQ ID NO: 181752 - DNA, 20 bp, Artificial Sequence
  Synthetic oligonucleotide; TGG chr2 60479756 60479775 60479759 -
tgtaataagcctctttaaaa

SEQ ID NO: 181753 - DNA, 20 bp, Artificial Sequence
  Synthetic oligonucleotide; CAG chr2 60479750 60479769 60479753 -
aagcctctttaaaatggtga

SEQ ID NO: 181754 - DNA, 20 bp, Artificial Sequence
  Synthetic oligonucleotide; AAG chr2 60479713 60479732 60479716 -
gccttgaattacattgataa

SEQ ID NO: 181755 - DNA, 20 bp, Artificial Sequence
  Synthetic oligonucleotide; TAG chr2 60479696 60479715 60479699 -
taaaagacattttattgcat

SEQ ID NO: 181756 - DNA, 20 bp, Artificial Sequence
  Synthetic oligonucleotide; GAG chr2 60479694 60479713 60479697 -
aaagacattttattgcatta

SEQ ID NO: 181757 - DNA, 20 bp, Artificial Sequence
  Synthetic oligonucleotide; TGG chr2 60479690 60479709 60479693 -
acattttattgcattagagc

SEQ ID NO: 181758 - DNA, 20 bp, Artificial Sequence
  Synthetic oligonucleotide; GGG chr2 60479689 60479708 60479692 -
cattttattgcattagagct

SEQ ID NO: 181759 - DNA, 20 bp, Artificial Sequence
  Synthetic oligonucleotide; GGG chr2 60479688 60479707 60479691 -
attttattgcattagagctg

SEQ ID NO: 181760 - DNA, 20 bp, Artificial Sequence
  Synthetic oligonucleotide; CAG chr2 60479685 60479704 60479688 -
ttattgcattagagctgggg

SEQ ID NO: 181761 - DNA, 20 bp, Artificial Sequence
  Synthetic oligonucleotide; AGG chr2 60479684 60479703 60479687 -
tattgcattagagctggggc

SEQ ID NO: 181762 - DNA, 20 bp, Artificial Sequence
  Synthetic oligonucleotide; GAG chr2 60479682 60479701 60479685 -
ttgcattagagctggggcag

SEQ ID NO: 181763 - DNA, 20 bp, Artificial Sequence
  Synthetic oligonucleotide; CAG chr2 60479677 60479696 60479680 -
ttagagctggggcaggagta

SEQ ID NO: 181764 - DNA, 20 bp, Artificial Sequence
  Synthetic oligonucleotide; AGG chr2 60479676 60479695 60479679 -
tagagctggggcaggagtac

SEQ ID NO: 181765 - DNA, 20 bp, Artificial Sequence
  Synthetic oligonucleotide; CGG chr2 60479672 60479691 60479675 -
gctggggcaggagtacagga

SEQ ID NO: 181766 - DNA, 20 bp, Artificial Sequence
  Synthetic oligonucleotide; TGG chr2 60479661 60479680 60479664 -
agtacaggacggttcttgcc

SEQ ID NO: 181767 - DNA, 20 bp, Artificial Sequence
  Synthetic oligonucleotide; CGG chr2 60479657 60479676 60479660 -
caggacggttcttgcctggt

SEQ ID NO: 181768 - DNA, 20 bp, Artificial Sequence
  Synthetic oligonucleotide; CAG chr2 60479637 60479656 60479640 -
cggcctctttgaaaccgcgt

SEQ ID NO: 181769 - DNA, 20 bp, Artificial Sequence
  Synthetic oligonucleotide; CAG chr2 60479606 60479625 60479609 -
ccacactctccaccgcctga

SEQ ID NO: 181770 - DNA, 20 bp, Artificial Sequence
  Synthetic oligonucleotide; AGG chr2 60479605 60479624 60479608 -
cacactctccaccgcctgac

SEQ ID NO: 181771 - DNA, 20 bp, Artificial Sequence
  Synthetic oligonucleotide; GGG chr2 60479604 60479623 60479607 -
acactctccaccgcctgaca

SEQ ID NO: 181772 - DNA, 20 bp, Artificial Sequence
  Synthetic oligonucleotide; GAG chr2 60479598 60479617 60479601 -
tccaccgcctgacagggttt

SEQ ID NO: 181773 - DNA, 20 bp, Artificial Sequence
  Synthetic oligonucleotide; TGG chr2 60479590 60479609 60479593 -
ctgacagggtttgagtgcga

SEQ ID NO: 181774 - DNA, 20 bp, Artificial Sequence
  Synthetic oligonucleotide; CAG chr2 60479587 60479606 60479590 -
acagggtttgagtgcgatgg

SEQ ID NO: 181775 - DNA, 20 bp, Artificial Sequence
  Synthetic oligonucleotide; GAG chr2 60479582 60479601 60479585 -
gtttgagtgcgatggcagct

SEQ ID NO: 181776 - DNA, 20 bp, Artificial Sequence
  Synthetic oligonucleotide; TGG chr2 60479574 60479593 60479577 -
gcgatggcagctgagatctg

SEQ ID NO: 181777 - DNA, 20 bp, Artificial Sequence
  Synthetic oligonucleotide; GGG chr2 60479573 60479592 60479576 -
cgatggcagctgagatctgt

SEQ ID NO: 181778 - DNA, 20 bp, Artificial Sequence
  Synthetic oligonucleotide; CGG chr2 60479569 60479588 60479572 -
ggcagctgagatctgtgggc

SEQ ID NO: 181779 - DNA, 20 bp, Artificial Sequence
  Synthetic oligonucleotide; CAG chr2 60479563 60479582 60479566 -
tgagatctgtgggccggtga

SEQ ID NO: 181780 - DNA, 20 bp, Artificial Sequence
  Synthetic oligonucleotide; GAG chr2 60479561 60479580 60479564 -
agatctgtgggccggtgaca

SEQ ID NO: 181781 - DNA, 20 bp, Artificial Sequence
  Synthetic oligonucleotide; AGG chr2 60479560 60479579 60479563 -
gatctgtgggccggtgacag

SEQ ID NO: 181782 - DNA, 20 bp, Artificial Sequence
  Synthetic oligonucleotide; GGG chr2 60479559 60479578 60479562 -
atctgtgggccggtgacaga

SEQ ID NO: 181783 - DNA, 20 bp, Artificial Sequence
  Synthetic oligonucleotide; GGG chr2 60479558 60479577 60479561 -
tctgtgggccggtgacagag

SEQ ID NO: 181784 - DNA, 20 bp, Artificial Sequence
  Synthetic oligonucleotide; GGG chr2 60479557 60479576 60479560 -
ctgtgggccggtgacagagg

SEQ ID NO: 181785 - DNA, 20 bp, Artificial Sequence
  Synthetic oligonucleotide; CAG chr2 60479545 60479564 60479548 -
gacagagggggctttctacc

SEQ ID NO: 181786 - DNA, 20 bp, Artificial Sequence
  Synthetic oligonucleotide; CAG chr2 60479542 60479561 60479545 -
agagggggctttctacccag

SEQ ID NO: 181787 - DNA, 20 bp, Artificial Sequence
  Synthetic oligonucleotide; TAG chr2 60479539 60479558 60479542 -
gggggctttctacccagcag

SEQ ID NO: 181788 - DNA, 20 bp, Artificial Sequence
  Synthetic oligonucleotide; AAG chr2 60479536 60479555 60479539 -
ggctttctacccagcagtag

SEQ ID NO: 181789 - DNA, 20 bp, Artificial Sequence
  Synthetic oligonucleotide; AGG chr2 60479535 60479554 60479538 -
gctttctacccagcagtaga

SEQ ID NO: 181790 - DNA, 20 bp, Artificial Sequence
  Synthetic oligonucleotide; GAG chr2 60479530 60479549 60479533 -
ctacccagcagtagaaggtt

SEQ ID NO: 181791 - DNA, 20 bp, Artificial Sequence
  Synthetic oligonucleotide; AGG chr2 60479529 60479548 60479532 -
tacccagcagtagaaggttg

SEQ ID NO: 181792 - DNA, 20 bp, Artificial Sequence
  Synthetic oligonucleotide; TGG chr2 60479523 60479542 60479526 -
gcagtagaaggttgaggccc

SEQ ID NO: 181793 - DNA, 20 bp, Artificial Sequence
  Synthetic oligonucleotide; AAG chr2 60479520 60479539 60479523 -
gtagaaggttgaggccctgg

SEQ ID NO: 181794 - DNA, 20 bp, Artificial Sequence
  Synthetic oligonucleotide; AAG chr2 60479514 60479533 60479517 -
ggttgaggccctggaagcaa

SEQ ID NO: 181795 - DNA, 20 bp, Artificial Sequence
  Synthetic oligonucleotide; AGG chr2 60479513 60479532 60479516 -
gttgaggccctggaagcaaa

SEQ ID NO: 181796 - DNA, 20 bp, Artificial Sequence
  Synthetic oligonucleotide; CAG chr2 60479506 60479525 60479509 -
ccctggaagcaaaaggattt

SEQ ID NO: 181797 - DNA, 20 bp, Artificial Sequence
  Synthetic oligonucleotide; GAG chr2 60479500 60479519 60479503 -
aagcaaaaggatttcagcct

SEQ ID NO: 181798 - DNA, 20 bp, Artificial Sequence
  Synthetic oligonucleotide; AGG chr2 60479499 60479518 60479502 -
agcaaaaggatttcagcctg

SEQ ID NO: 181799 - DNA, 20 bp, Artificial Sequence
  Synthetic oligonucleotide; GGG chr2 60479498 60479517 60479501 -
gcaaaaggatttcagcctga

SEQ ID NO: 181800 - DNA, 20 bp, Artificial Sequence
  Synthetic oligonucleotide; GGG chr2 60479497 60479516 60479500 -
caaaaggatttcagcctgag

SEQ ID NO: 181801 - DNA, 20 bp, Artificial Sequence
  Synthetic oligonucleotide; AAG chr2 60479488 60479507 60479491 -
ttcagcctgaggggcttgtt

SEQ ID NO: 181802 - DNA, 20 bp, Artificial Sequence
  Synthetic oligonucleotide; AGG chr2 60479487 60479506 60479490 -
tcagcctgaggggcttgtta

SEQ ID NO: 181803 - DNA, 20 bp, Artificial Sequence
  Synthetic oligonucleotide; GGG chr2 60479486 60479505 60479489 -
cagcctgaggggcttgttaa

SEQ ID NO: 181804 - DNA, 20 bp, Artificial Sequence
  Synthetic oligonucleotide; GAG chr2 60479484 60479503 60479487 -
gcctgaggggcttgttaagg

SEQ ID NO: 181805 - DNA, 20 bp, Artificial Sequence
  Synthetic oligonucleotide; GAG chr2 60479482 60479501 60479485 -
ctgaggggcttgttaaggga

SEQ ID NO: 181806 - DNA, 20 bp, Artificial Sequence
  Synthetic oligonucleotide; TAG chr2 60479462 60479481 60479465 -
gagttattctttcctgttcc

SEQ ID NO: 181807 - DNA, 20 bp, Artificial Sequence
  Synthetic oligonucleotide; TAG chr2 60479459 60479478 60479462 -
ttattctttcctgttcctag

SEQ ID NO: 181808 - DNA, 20 bp, Artificial Sequence
  Synthetic oligonucleotide; GAG chr2 60479452 60479471 60479455 -
ttcctgttcctagtagacct

SEQ ID NO: 181809 - DNA, 20 bp, Artificial Sequence
  Synthetic oligonucleotide; GAG chr2 60479450 60479469 60479453 -
cctgttcctagtagacctga

SEQ ID NO: 181810 - DNA, 20 bp, Artificial Sequence
  Synthetic oligonucleotide; GAG chr2 60479448 60479467 60479451 -
tgttcctagtagacctgaga

SEQ ID NO: 181811 - DNA, 20 bp, Artificial Sequence
  Synthetic oligonucleotide; TGG chr2 60479437 60479456 60479440 -
gacctgagagagcttgacgt

SEQ ID NO: 181812 - DNA, 20 bp, Artificial Sequence
  Synthetic oligonucleotide; TGG chr2 60479434 60479453 60479437 -
ctgagagagcttgacgttgg

SEQ ID NO: 181813 - DNA, 20 bp, Artificial Sequence
  Synthetic oligonucleotide; TGG chr2 60479427 60479446 60479430 -
agcttgacgttggtggcctc

SEQ ID NO: 181814 - DNA, 20 bp, Artificial Sequence
  Synthetic oligonucleotide; CAG chr2 60479423 60479442 60479426 -
tgacgttggtggcctctggt

SEQ ID NO: 181815 - DNA, 20 bp, Artificial Sequence
  Synthetic oligonucleotide; TGG chr2 60479415 60479434 60479418 -
gtggcctctggtcagcctca

SEQ ID NO: 181816 - DNA, 20 bp, Artificial Sequence
  Synthetic oligonucleotide; TGG chr2 60479411 60479430 60479414 -
cctctggtcagcctcatggt

SEQ ID NO: 181817 - DNA, 20 bp, Artificial Sequence
  Synthetic oligonucleotide; GGG chr2 60479410 60479429 60479413 -
ctctggtcagcctcatggtt

SEQ ID NO: 181818 - DNA, 20 bp, Artificial Sequence
  Synthetic oligonucleotide; TGG chr2 60479401 60479420 60479404 -
gcctcatggttgggactgcg

SEQ ID NO: 181819 - DNA, 20 bp, Artificial Sequence
  Synthetic oligonucleotide; TAG chr2 60479392 60479411 60479395 -
ttgggactgcgtggaaatgc

SEQ ID NO: 181820 - DNA, 20 bp, Artificial Sequence
  Synthetic oligonucleotide; GAG chr2 60479385 60479404 60479388 -
tgcgtggaaatgctagacct

SEQ ID NO: 181821 - DNA, 20 bp, Artificial Sequence
  Synthetic oligonucleotide; GAG chr2 60479383 60479402 60479386 -
cgtggaaatgctagacctga

SEQ ID NO: 181822 - DNA, 20 bp, Artificial Sequence
  Synthetic oligonucleotide; AAG chr2 60479368 60479387 60479371 -
cctgagagacctcatttccc

SEQ ID NO: 181823 - DNA, 20 bp, Artificial Sequence
  Synthetic oligonucleotide; CAG chr2 60479365 60479384 60479368 -
gagagacctcatttcccaag

SEQ ID NO: 181824 - DNA, 20 bp, Artificial Sequence
  Synthetic oligonucleotide; TAG chr2 60479359 60479378 60479362 -
cctcatttcccaagcagtct

SEQ ID NO: 181825 - DNA, 20 bp, Artificial Sequence
  Synthetic oligonucleotide; GAG chr2 60479357 60479376 60479360 -
tcatttcccaagcagtctta

SEQ ID NO: 181826 - DNA, 20 bp, Artificial Sequence
  Synthetic oligonucleotide; GAG chr2 60479355 60479374 60479358 -
atttcccaagcagtcttaga

SEQ ID NO: 181827 - DNA, 20 bp, Artificial Sequence
  Synthetic oligonucleotide; TGG chr2 60479337 60479356 60479340 -
gagagactcaaaacaaaaaa

SEQ ID NO: 181828 - DNA, 20 bp, Artificial Sequence
  Synthetic oligonucleotide; CGG chr2 60479330 60479349 60479333 -
tcaaaacaaaaaatggtctc

SEQ ID NO: 181829 - DNA, 20 bp, Artificial Sequence
  Synthetic oligonucleotide; GGG chr2 60479329 60479348 60479332 -
caaaacaaaaaatggtctcc

SEQ ID NO: 181830 - DNA, 20 bp, Artificial Sequence
  Synthetic oligonucleotide; TGG chr2 60479318 60479337 60479321 -
atggtctccgggtcccaccg

SEQ ID NO: 181831 - DNA, 20 bp, Artificial Sequence
  Synthetic oligonucleotide; TGG chr2 60479311 60479330 60479314 -
ccgggtcccaccgtggtgtg

SEQ ID NO: 181832 - DNA, 20 bp, Artificial Sequence
  Synthetic oligonucleotide; CAG chr2 60479296 60479315 60479299 -
gtgtgtggccgctgtgcccg

SEQ ID NO: 181833 - DNA, 20 bp, Artificial Sequence
  Synthetic oligonucleotide; GAG chr2 60479294 60479313 60479297 -
gtgtggccgctgtgcccgca

SEQ ID NO: 181834 - DNA, 20 bp, Artificial Sequence
  Synthetic oligonucleotide; AGG chr2 60479293 60479312 60479296 -
tgtggccgctgtgcccgcag

SEQ ID NO: 181835 - DNA, 20 bp, Artificial Sequence
  Synthetic oligonucleotide; CAG chr2 60479289 60479308 60479292 -
gccgctgtgcccgcagaggc

SEQ ID NO: 181836 - DNA, 20 bp, Artificial Sequence
  Synthetic oligonucleotide; AGG chr2 60479288 60479307 60479291 -
ccgctgtgcccgcagaggcc

SEQ ID NO: 181837 - DNA, 20 bp, Artificial Sequence
  Synthetic oligonucleotide; TAG chr2 60479279 60479298 60479282 -
ccgcagaggccaggtgtcca

SEQ ID NO: 181838 - DNA, 20 bp, Artificial Sequence
  Synthetic oligonucleotide; AGG chr2 60479278 60479297 60479281 -
cgcagaggccaggtgtccat

SEQ ID NO: 181839 - DNA, 20 bp, Artificial Sequence
  Synthetic oligonucleotide; GAG chr2 60479273 60479292 60479276 -
aggccaggtgtccataggct

SEQ ID NO: 181840 - DNA, 20 bp, Artificial Sequence
  Synthetic oligonucleotide; TGG chr2 60479262 60479281 60479265 -
ccataggctgagtccccacg

SEQ ID NO: 181841 - DNA, 20 bp, Artificial Sequence
  Synthetic oligonucleotide; TAG chr2 60479253 60479272 60479256 -
gagtccccacgtggacctgc

SEQ ID NO: 181842 - DNA, 20 bp, Artificial Sequence
  Synthetic oligonucleotide; AGG chr2 60479252 60479271 60479255 -
agtccccacgtggacctgct

SEQ ID NO: 181843 - DNA, 20 bp, Artificial Sequence
  Synthetic oligonucleotide; TGG chr2 60479249 60479268 60479252 -
ccccacgtggacctgctagg

SEQ ID NO: 181844 - DNA, 20 bp, Artificial Sequence
  Synthetic oligonucleotide; GGG chr2 60479248 60479267 60479251 -
cccacgtggacctgctaggt

SEQ ID NO: 181845 - DNA, 20 bp, Artificial Sequence
  Synthetic oligonucleotide; TAG chr2 60479245 60479264 60479248 -
acgtggacctgctaggtggg

SEQ ID NO: 181846 - DNA, 20 bp, Artificial Sequence
  Synthetic oligonucleotide; AAG chr2 60479241 60479260 60479244 -
ggacctgctaggtgggtaga

SEQ ID NO: 181847 - DNA, 20 bp, Artificial Sequence
  Synthetic oligonucleotide; AGG chr2 60479240 60479259 60479243 -
gacctgctaggtgggtagaa

SEQ ID NO: 181848 - DNA, 20 bp, Artificial Sequence
  Synthetic oligonucleotide; GAG chr2 60479238 60479257 60479241 -
cctgctaggtgggtagaaag

SEQ ID NO: 181849 - DNA, 20 bp, Artificial Sequence
  Synthetic oligonucleotide; AAG chr2 60479232 60479251 60479235 -
aggtgggtagaaaggagttg

SEQ ID NO: 181850 - DNA, 20 bp, Artificial Sequence
  Synthetic oligonucleotide; TGG chr2 60479217 60479236 60479220 -
agttgaagatgttgtgctgt

SEQ ID NO: 181851 - DNA, 20 bp, Artificial Sequence
  Synthetic oligonucleotide; TGG chr2 60479213 60479232 60479216 -
gaagatgttgtgctgttggt

SEQ ID NO: 181852 - DNA, 20 bp, Artificial Sequence
  Synthetic oligonucleotide; GAG chr2 60479211 60479230 60479214 -
agatgttgtgctgttggttg

SEQ ID NO: 181853 - DNA, 20 bp, Artificial Sequence
  Synthetic oligonucleotide; AGG chr2 60479210 60479229 60479213 -
gatgttgtgctgttggttgg

SEQ ID NO: 181854 - DNA, 20 bp, Artificial Sequence
  Synthetic oligonucleotide; GAG chr2 60479208 60479227 60479211 -
tgttgtgctgttggttggag

SEQ ID NO: 181855 - DNA, 20 bp, Artificial Sequence
  Synthetic oligonucleotide; TGG chr2 60479203 60479222 60479206 -
tgctgttggttggaggagct

SEQ ID NO: 181856 - DNA, 20 bp, Artificial Sequence
  Synthetic oligonucleotide; GAG chr2 60479201 60479220 60479204 -
ctgttggttggaggagcttg

SEQ ID NO: 181857 - DNA, 20 bp, Artificial Sequence
  Synthetic oligonucleotide; AGG chr2 60479200 60479219 60479203 -
tgttggttggaggagcttgg

SEQ ID NO: 181858 - DNA, 20 bp, Artificial Sequence
  Synthetic oligonucleotide; TGG chr2 60479193 60479212 60479196 -
tggaggagcttggaggtgtc

SEQ ID NO: 181859 - DNA, 20 bp, Artificial Sequence
  Synthetic oligonucleotide; GGG chr2 60479192 60479211 60479195 -
ggaggagcttggaggtgtct

SEQ ID NO: 181860 - DNA, 20 bp, Artificial Sequence
  Synthetic oligonucleotide; TGG chr2 60479184 60479203 60479187 -
ttggaggtgtctgggaacat

SEQ ID NO: 181861 - DNA, 20 bp, Artificial Sequence
  Synthetic oligonucleotide; TGG chr2 60479169 60479188 60479172 -
aacattggatgttactcata

SEQ ID NO: 181862 - DNA, 20 bp, Artificial Sequence
  Synthetic oligonucleotide; CAG chr2 60479163 60479182 60479166 -
ggatgttactcatatggaat

SEQ ID NO: 181863 - DNA, 20 bp, Artificial Sequence
  Synthetic oligonucleotide; CAG chr2 60479160 60479179 60479163 -
tgttactcatatggaatcag

SEQ ID NO: 181864 - DNA, 20 bp, Artificial Sequence
  Synthetic oligonucleotide; TAG chr2 60479154 60479173 60479157 -
tcatatggaatcagcagaat

SEQ ID NO: 181865 - DNA, 20 bp, Artificial Sequence
  Synthetic oligonucleotide; TAG chr2 60479151 60479170 60479154 -
tatggaatcagcagaattag

SEQ ID NO: 181866 - DNA, 20 bp, Artificial Sequence
  Synthetic oligonucleotide; GAG chr2 60479149 60479168 60479152 -
tggaatcagcagaattagta

SEQ ID NO: 181867 - DNA, 20 bp, Artificial Sequence
  Synthetic oligonucleotide; AAG chr2 60479144 60479163 60479147 -
tcagcagaattagtagagcc

SEQ ID NO: 181868 - DNA, 20 bp, Artificial Sequence
  Synthetic oligonucleotide; CAG chr2 60479139 60479158 60479142 -
agaattagtagagccaagaa

SEQ ID NO: 181869 - DNA, 20 bp, Artificial Sequence
  Synthetic oligonucleotide; CGG chr2 60479135 60479154 60479138 -
ttagtagagccaagaacaga

SEQ ID NO: 181870 - DNA, 20 bp, Artificial Sequence
  Synthetic oligonucleotide; CAG chr2 60479132 60479151 60479135 -
gtagagccaagaacagacgg

SEQ ID NO: 181871 - DNA, 20 bp, Artificial Sequence
  Synthetic oligonucleotide; TGG chr2 60479117 60479136 60479120 -
gacggcagtgccacacccca

SEQ ID NO: 181872 - DNA, 20 bp, Artificial Sequence
  Synthetic oligonucleotide; TGG chr2 60479113 60479132 60479116 -
gcagtgccacaccccatggc

SEQ ID NO: 181873 - DNA, 20 bp, Artificial Sequence
  Synthetic oligonucleotide; GAG chr2 60479107 60479126 60479110 -
ccacaccccatggctggact

SEQ ID NO: 181874 - DNA, 20 bp, Artificial Sequence
  Synthetic oligonucleotide; AGG chr2 60479106 60479125 60479109 -
cacaccccatggctggactg

SEQ ID NO: 181875 - DNA, 20 bp, Artificial Sequence
  Synthetic oligonucleotide; TGG chr2 60479091 60479110 60479094 -
gactgaggctgctccaatga

SEQ ID NO: 181876 - DNA, 20 bp, Artificial Sequence
  Synthetic oligonucleotide; CAG chr2 60479088 60479107 60479091 -
tgaggctgctccaatgatgg

SEQ ID NO: 181877 - DNA, 20 bp, Artificial Sequence
  Synthetic oligonucleotide; AGG chr2 60479087 60479106 60479090 -
gaggctgctccaatgatggc

SEQ ID NO: 181878 - DNA, 20 bp, Artificial Sequence
  Synthetic oligonucleotide; CGG chr2 60479075 60479094 60479078 -
atgatggcaggttgtatctg

SEQ ID NO: 181879 - DNA, 20 bp, Artificial Sequence
  Synthetic oligonucleotide; GGG chr2 60479074 60479093 60479077 -
tgatggcaggttgtatctgc

SEQ ID NO: 181880 - DNA, 20 bp, Artificial Sequence
  Synthetic oligonucleotide; CAG chr2 60479056 60479075 60479059 -
gcgggcatctccaatttgct

SEQ ID NO: 181881 - DNA, 20 bp, Artificial Sequence
  Synthetic oligonucleotide; AGG chr2 60479055 60479074 60479058 -
cgggcatctccaatttgctc

SEQ ID NO: 181882 - DNA, 20 bp, Artificial Sequence
  Synthetic oligonucleotide; GGG chr2 60479054 60479073 60479057 -
gggcatctccaatttgctca

SEQ ID NO: 181883 - DNA, 20 bp, Artificial Sequence
  Synthetic oligonucleotide; CAG chr2 60479042 60479061 60479045 -
tttgctcagggaactctttc

SEQ ID NO: 181884 - DNA, 20 bp, Artificial Sequence
  Synthetic oligonucleotide; TGG chr2 60479037 60479056 60479040 -
tcagggaactctttccagat

SEQ ID NO: 181885 - DNA, 20 bp, Artificial Sequence
  Synthetic oligonucleotide; CAG chr2 60479033 60479052 60479036 -
ggaactctttccagattggt

SEQ ID NO: 181886 - DNA, 20 bp, Artificial Sequence
  Synthetic oligonucleotide; TGG chr2 60479030 60479049 60479033 -
actctttccagattggtcag

SEQ ID NO: 181887 - DNA, 20 bp, Artificial Sequence
  Synthetic oligonucleotide; AAG chr2 60479019 60479038 60479022 -
attggtcagtggtataaatg

SEQ ID NO: 181888 - DNA, 20 bp, Artificial Sequence
  Synthetic oligonucleotide; AGG chr2 60479018 60479037 60479021 -
ttggtcagtggtataaatga

SEQ ID NO: 181889 - DNA, 20 bp, Artificial Sequence
  Synthetic oligonucleotide; TAG chr2 60479013 60479032 60479016 -
cagtggtataaatgaaggat

SEQ ID NO: 181890 - DNA, 20 bp, Artificial Sequence
  Synthetic oligonucleotide; AGG chr2 60479012 60479031 60479015 -
agtggtataaatgaaggatt

SEQ ID NO: 181891 - DNA, 20 bp, Artificial Sequence
  Synthetic oligonucleotide; TGG chr2 60479005 60479024 60479008 -
taaatgaaggattaggaaat

SEQ ID NO: 181892 - DNA, 20 bp, Artificial Sequence
  Synthetic oligonucleotide; GGG chr2 60479004 60479023 60479007 -
aaatgaaggattaggaaatt

SEQ ID NO: 181893 - DNA, 20 bp, Artificial Sequence
  Synthetic oligonucleotide; AAG chr2 60478997 60479016 60479000 -
ggattaggaaattgggtaaa

SEQ ID NO: 181894 - DNA, 20 bp, Artificial Sequence
  Synthetic oligonucleotide; CAG chr2 60478993 60479012 60478996 -
taggaaattgggtaaaaagc

SEQ ID NO: 181895 - DNA, 20 bp, Artificial Sequence
  Synthetic oligonucleotide; AGG chr2 60478992 60479011 60478995 -
aggaaattgggtaaaaagcc

SEQ ID NO: 181896 - DNA, 20 bp, Artificial Sequence
  Synthetic oligonucleotide; GGG chr2 60478991 60479010 60478994 -
ggaaattgggtaaaaagcca

SEQ ID NO: 181897 - DNA, 20 bp, Artificial Sequence
  Synthetic oligonucleotide; GAG chr2 60478989 60479008 60478992 -
aaattgggtaaaaagccagg

SEQ ID NO: 181898 - DNA, 20 bp, Artificial Sequence
  Synthetic oligonucleotide; AGG chr2 60478988 60479007 60478991 -
aattgggtaaaaagccaggg

SEQ ID NO: 181899 - DNA, 20 bp, Artificial Sequence
  Synthetic oligonucleotide; GAG chr2 60478986 60479005 60478989 -
ttgggtaaaaagccagggag

SEQ ID NO: 181900 - DNA, 20 bp, Artificial Sequence
  Synthetic oligonucleotide; AGG chr2 60478985 60479004 60478988 -
tgggtaaaaagccagggagg

SEQ ID NO: 181901 - DNA, 20 bp, Artificial Sequence
  Synthetic oligonucleotide; GGG chr2 60478984 60479003 60478987 -
gggtaaaaagccagggagga

SEQ ID NO: 181902 - DNA, 20 bp, Artificial Sequence
  Synthetic oligonucleotide; AAG chr2 60478960 60478979 60478963 -
aaaaaaaaaaacaaaaaaca

SEQ ID NO: 181903 - DNA, 20 bp, Artificial Sequence
  Synthetic oligonucleotide; AAG chr2 60478950 60478969 60478953 -
acaaaaaacaaagcacgtca

SEQ ID NO: 181904 - DNA, 20 bp, Artificial Sequence
  Synthetic oligonucleotide; AAG chr2 60478945 60478964 60478948 -
aaacaaagcacgtcaaagcc

SEQ ID NO: 181905 - DNA, 20 bp, Artificial Sequence
  Synthetic oligonucleotide; AGG chr2 60478944 60478963 60478947 -
aacaaagcacgtcaaagcca

SEQ ID NO: 181906 - DNA, 20 bp, Artificial Sequence
  Synthetic oligonucleotide; TGG chr2 60478925 60478944 60478928 -
aaggcctgtgttttgttctg

SEQ ID NO: 181907 - DNA, 20 bp, Artificial Sequence
  Synthetic oligonucleotide; GGG chr2 60478924 60478943 60478927 -
aggcctgtgttttgttctgt

SEQ ID NO: 181908 - DNA, 20 bp, Artificial Sequence
  Synthetic oligonucleotide; CAG chr2 60478914 60478933 60478917 -
tttgttctgtgggactttgc

SEQ ID NO: 181909 - DNA, 20 bp, Artificial Sequence
  Synthetic oligonucleotide; GAG chr2 60478912 60478931 60478915 -
tgttctgtgggactttgcca

SEQ ID NO: 181910 - DNA, 20 bp, Artificial Sequence
  Synthetic oligonucleotide; GAG chr2 60478910 60478929 60478913 -
ttctgtgggactttgccaga

SEQ ID NO: 181911 - DNA, 20 bp, Artificial Sequence
  Synthetic oligonucleotide; GAG chr2 60478905 60478924 60478908 -
tgggactttgccagagagat

SEQ ID NO: 181912 - DNA, 20 bp, Artificial Sequence
  Synthetic oligonucleotide; AGG chr2 60478904 60478923 60478907 -
gggactttgccagagagatg

SEQ ID NO: 181913 - DNA, 20 bp, Artificial Sequence
  Synthetic oligonucleotide; GAG chr2 60478898 60478917 60478901 -
ttgccagagagatgaggact

SEQ ID NO: 181914 - DNA, 20 bp, Artificial Sequence
  Synthetic oligonucleotide; AGG chr2 60478897 60478916 60478900 -
tgccagagagatgaggactg

SEQ ID NO: 181915 - DNA, 20 bp, Artificial Sequence
  Synthetic oligonucleotide; TGG chr2 60478893 60478912 60478896 -
agagagatgaggactgaggc

SEQ ID NO: 181916 - DNA, 20 bp, Artificial Sequence
  Synthetic oligonucleotide; GGG chr2 60478892 60478911 60478895 -
gagagatgaggactgaggct

SEQ ID NO: 181917 - DNA, 20 bp, Artificial Sequence
  Synthetic oligonucleotide; TGG chr2 60478877 60478896 60478880 -
aggctgggctgctgtgtgcc

SEQ ID NO: 181918 - DNA, 20 bp, Artificial Sequence
  Synthetic oligonucleotide; GGG chr2 60478876 60478895 60478879 -
ggctgggctgctgtgtgcct

SEQ ID NO: 181919 - DNA, 20 bp, Artificial Sequence
  Synthetic oligonucleotide; GAG chr2 60478874 60478893 60478877 -
ctgggctgctgtgtgcctgg

SEQ ID NO: 181920 - DNA, 20 bp, Artificial Sequence
  Synthetic oligonucleotide; AGG chr2 60478873 60478892 60478876 -
tgggctgctgtgtgcctggg

SEQ ID NO: 181921 - DNA, 20 bp, Artificial Sequence
  Synthetic oligonucleotide; CGG chr2 60478870 60478889 60478873 -
gctgctgtgtgcctgggagg

SEQ ID NO: 181922 - DNA, 20 bp, Artificial Sequence
  Synthetic oligonucleotide; GGG chr2 60478869 60478888 60478872 -
ctgctgtgtgcctgggaggc

SEQ ID NO: 181923 - DNA, 20 bp, Artificial Sequence
  Synthetic oligonucleotide; AAG chr2 60478866 60478885 60478869 -
ctgtgtgcctgggaggcggg

SEQ ID NO: 181924 - DNA, 20 bp, Artificial Sequence
  Synthetic oligonucleotide; AGG chr2 60478865 60478884 60478868 -
tgtgtgcctgggaggcggga

SEQ ID NO: 181925 - DNA, 20 bp, Artificial Sequence
  Synthetic oligonucleotide; GAG chr2 60478858 60478877 60478861 -
ctgggaggcgggaaggtgct

SEQ ID NO: 181926 - DNA, 20 bp, Artificial Sequence
  Synthetic oligonucleotide; AGG chr2 60478857 60478876 60478860 -
tgggaggcgggaaggtgctg

SEQ ID NO: 181927 - DNA, 20 bp, Artificial Sequence
  Synthetic oligonucleotide; CAG chr2 60478849 60478868 60478852 -
gggaaggtgctgaggcactg

SEQ ID NO: 181928 - DNA, 20 bp, Artificial Sequence
  Synthetic oligonucleotide; GAG chr2 60478847 60478866 60478850 -
gaaggtgctgaggcactgca

SEQ ID NO: 181929 - DNA, 20 bp, Artificial Sequence
  Synthetic oligonucleotide; AAG chr2 60478844 60478863 60478847 -
ggtgctgaggcactgcagag

SEQ ID NO: 181930 - DNA, 20 bp, Artificial Sequence
  Synthetic oligonucleotide; CAG chr2 60478841 60478860 60478844 -
gctgaggcactgcagagaag

SEQ ID NO: 181931 - DNA, 20 bp, Artificial Sequence
  Synthetic oligonucleotide; CAG chr2 60478835 60478854 60478838 -
gcactgcagagaagcagctg

SEQ ID NO: 181932 - DNA, 20 bp, Artificial Sequence
  Synthetic oligonucleotide; CGG chr2 60478825 60478844 60478828 -
gaagcagctgcagcatgccc

SEQ ID NO: 181933 - DNA, 20 bp, Artificial Sequence
  Synthetic oligonucleotide; GGG chr2 60478824 60478843 60478827 -
aagcagctgcagcatgcccc

SEQ ID NO: 181934 - DNA, 20 bp, Artificial Sequence
  Synthetic oligonucleotide; CAG chr2 60478821 60478840 60478824 -
cagctgcagcatgccccggg

SEQ ID NO: 181935 - DNA, 20 bp, Artificial Sequence
  Synthetic oligonucleotide; GAG chr2 60478819 60478838 60478822 -
gctgcagcatgccccgggca

SEQ ID NO: 181936 - DNA, 20 bp, Artificial Sequence
  Synthetic oligonucleotide; AGG chr2 60478818 60478837 60478821 -
ctgcagcatgccccgggcag

SEQ ID NO: 181937 - DNA, 20 bp, Artificial Sequence
  Synthetic oligonucleotide; AAG chr2 60478803 60478822 60478806 -
ggcagaggcctgttttctga

SEQ ID NO: 181938 - DNA, 20 bp, Artificial Sequence
  Synthetic oligonucleotide; AAG chr2 60478800 60478819 60478803 -
agaggcctgttttctgaaag

SEQ ID NO: 181939 - DNA, 20 bp, Artificial Sequence
  Synthetic oligonucleotide; AGG chr2 60478799 60478818 60478802 -
gaggcctgttttctgaaaga

SEQ ID NO: 181940 - DNA, 20 bp, Artificial Sequence
  Synthetic oligonucleotide; TGG chr2 60478785 60478804 60478788 -
gaaagaaggacttgccgtca

SEQ ID NO: 181941 - DNA, 20 bp, Artificial Sequence
  Synthetic oligonucleotide; GGG chr2 60478784 60478803 60478787 -
aaagaaggacttgccgtcat

SEQ ID NO: 181942 - DNA, 20 bp, Artificial Sequence
  Synthetic oligonucleotide; GAG chr2 60478782 60478801 60478785 -
agaaggacttgccgtcatgg

SEQ ID NO: 181943 - DNA, 20 bp, Artificial Sequence
  Synthetic oligonucleotide; AGG chr2 60478781 60478800 60478784 -
gaaggacttgccgtcatggg

SEQ ID NO: 181944 - DNA, 20 bp, Artificial Sequence
  Synthetic oligonucleotide; GAG chr2 60478779 60478798 60478782 -
aggacttgccgtcatgggag

SEQ ID NO: 181945 - DNA, 20 bp, Artificial Sequence
  Synthetic oligonucleotide; AGG chr2 60478778 60478797 60478781 -
ggacttgccgtcatgggagg

SEQ ID NO: 181946 - DNA, 20 bp, Artificial Sequence
  Synthetic oligonucleotide; TGG chr2 60478773 60478792 60478776 -
tgccgtcatgggaggaggcc

SEQ ID NO: 181947 - DNA, 20 bp, Artificial Sequence
  Synthetic oligonucleotide; CAG chr2 60478765 60478784 60478768 -
tgggaggaggcctggcctcg

SEQ ID NO: 181948 - DNA, 20 bp, Artificial Sequence
  Synthetic oligonucleotide; CAG chr2 60478759 60478778 60478762 -
gaggcctggcctcgcagcac

SEQ ID NO: 181949 - DNA, 20 bp, Artificial Sequence
  Synthetic oligonucleotide; GAG chr2 60478757 60478776 60478760 -
ggcctggcctcgcagcacca

SEQ ID NO: 181950 - DNA, 20 bp, Artificial Sequence
  Synthetic oligonucleotide; CAG chr2 60478742 60478761 60478745 -
caccagagcgctccttcatt

SEQ ID NO: 181951 - DNA, 20 bp, Artificial Sequence
  Synthetic oligonucleotide; CAG chr2 60478731 60478750 60478734 -
tccttcattcagcctcacct

SEQ ID NO: 181952 - DNA, 20 bp, Artificial Sequence
  Synthetic oligonucleotide; AGG chr2 60478730 60478749 60478733 -
ccttcattcagcctcacctc

SEQ ID NO: 181953 - DNA, 20 bp, Artificial Sequence
  Synthetic oligonucleotide; GAG chr2 60478726 60478745 60478729 -
cattcagcctcacctcaggc

SEQ ID NO: 181954 - DNA, 20 bp, Artificial Sequence
  Synthetic oligonucleotide; GAG chr2 60478724 60478743 60478727 -
ttcagcctcacctcaggcga

SEQ ID NO: 181955 - DNA, 20 bp, Artificial Sequence
  Synthetic oligonucleotide; AGG chr2 60478723 60478742 60478726 -
tcagcctcacctcaggcgag

SEQ ID NO: 181956 - DNA, 20 bp, Artificial Sequence
  Synthetic oligonucleotide; GGG chr2 60478722 60478741 60478725 -
cagcctcacctcaggcgaga

SEQ ID NO: 181957 - DNA, 20 bp, Artificial Sequence
  Synthetic oligonucleotide; CAG chr2 60478719 60478738 60478722 -
cctcacctcaggcgagaggg

SEQ ID NO: 181958 - DNA, 20 bp, Artificial Sequence
  Synthetic oligonucleotide; TAG chr2 60478714 60478733 60478717 -
cctcaggcgagagggcagcc

SEQ ID NO: 181959 - DNA, 20 bp, Artificial Sequence
  Synthetic oligonucleotide; AAG chr2 60478700 60478719 60478703 -
gcagcctagttttattcctg

SEQ ID NO: 181960 - DNA, 20 bp, Artificial Sequence
  Synthetic oligonucleotide; TAG chr2 60478691 60478710 60478694 -
ttttattcctgaagaaatgt

SEQ ID NO: 181961 - DNA, 20 bp, Artificial Sequence
  Synthetic oligonucleotide; GAG chr2 60478689 60478708 60478692 -
ttattcctgaagaaatgtta

SEQ ID NO: 181962 - DNA, 20 bp, Artificial Sequence
  Synthetic oligonucleotide; TAG chr2 60478676 60478695 60478679 -
aatgttagagcctgacctgc

SEQ ID NO: 181963 - DNA, 20 bp, Artificial Sequence
  Synthetic oligonucleotide; TGG chr2 60478662 60478681 60478665 -
acctgctagaccattttttt

SEQ ID NO: 181964 - DNA, 20 bp, Artificial Sequence
  Synthetic oligonucleotide; TAG chr2 60478659 60478678 60478662 -
tgctagaccattttttttgg

SEQ ID NO: 181965 - DNA, 20 bp, Artificial Sequence
  Synthetic oligonucleotide; GAG chr2 60478657 60478676 60478660 -
ctagaccattttttttggta

SEQ ID NO: 181966 - DNA, 20 bp, Artificial Sequence
  Synthetic oligonucleotide; AAG chr2 60478649 60478668 60478652 -
ttttttttggtagagctttg

SEQ ID NO: 181967 - DNA, 20 bp, Artificial Sequence
  Synthetic oligonucleotide; TAG chr2 60478638 60478657 60478641 -
agagctttgaagccttaaat

SEQ ID NO: 181968 - DNA, 20 bp, Artificial Sequence
  Synthetic oligonucleotide; GAG chr2 60478621 60478640 60478624 -
aattagttctcataatttct

SEQ ID NO: 181969 - DNA, 20 bp, Artificial Sequence
  Synthetic oligonucleotide; CAG chr2 60478618 60478637 60478621 -
tagttctcataatttctgag

SEQ ID NO: 181970 - DNA, 20 bp, Artificial Sequence
  Synthetic oligonucleotide; TAG chr2 60478601 60478620 60478604 -
gagcagctctgtgttaacca

SEQ ID NO: 181971 - DNA, 20 bp, Artificial Sequence
  Synthetic oligonucleotide; AGG chr2 60478600 60478619 60478603 -
agcagctctgtgttaaccat

SEQ ID NO: 181972 - DNA, 20 bp, Artificial Sequence
  Synthetic oligonucleotide; TAG chr2 60478591 60478610 60478594 -
gtgttaaccataggacataa

SEQ ID NO: 181973 - DNA, 20 bp, Artificial Sequence
  Synthetic oligonucleotide; AGG chr2 60478590 60478609 60478593 -
tgttaaccataggacataat

SEQ ID NO: 181974 - DNA, 20 bp, Artificial Sequence
  Synthetic oligonucleotide; TGG chr2 60478578 60478597 60478581 -
gacataataggttttaattc

SEQ ID NO: 181975 - DNA, 20 bp, Artificial Sequence
  Synthetic oligonucleotide; GAG chr2 60478576 60478595 60478579 -
cataataggttttaattctg

SEQ ID NO: 181976 - DNA, 20 bp, Artificial Sequence
  Synthetic oligonucleotide; TGG chr2 60478571 60478590 60478574 -
taggttttaattctggagaa

SEQ ID NO: 181977 - DNA, 20 bp, Artificial Sequence
  Synthetic oligonucleotide; CAG chr2 60478567 60478586 60478570 -
ttttaattctggagaatggc

SEQ ID NO: 181978 - DNA, 20 bp, Artificial Sequence
  Synthetic oligonucleotide; TGG chr2 60478561 60478580 60478564 -
ttctggagaatggccagttc

SEQ ID NO: 181979 - DNA, 20 bp, Artificial Sequence
  Synthetic oligonucleotide; CAG chr2 60478554 60478573 60478557 -
gaatggccagttctggttct

SEQ ID NO: 181980 - DNA, 20 bp, Artificial Sequence
  Synthetic oligonucleotide; TGG chr2 60478544 60478563 60478547 -
ttctggttctcagaatctct

SEQ ID NO: 181981 - DNA, 20 bp, Artificial Sequence
  Synthetic oligonucleotide; AAG chr2 60478539 60478558 60478542 -
gttctcagaatctcttggcc

SEQ ID NO: 181982 - DNA, 20 bp, Artificial Sequence
  Synthetic oligonucleotide; CAG chr2 60478529 60478548 60478532 -
tctcttggccaagactgtca

SEQ ID NO: 181983 - DNA, 20 bp, Artificial Sequence
  Synthetic oligonucleotide; GAG chr2 60478527 60478546 60478530 -
tcttggccaagactgtcaca

SEQ ID NO: 181984 - DNA, 20 bp, Artificial Sequence
  Synthetic oligonucleotide; TAG chr2 60478521 60478540 60478524 -
ccaagactgtcacagagtat

SEQ ID NO: 181985 - DNA, 20 bp, Artificial Sequence
  Synthetic oligonucleotide; AGG chr2 60478520 60478539 60478523 -
caagactgtcacagagtatt

SEQ ID NO: 181986 - DNA, 20 bp, Artificial Sequence
  Synthetic oligonucleotide; AAG chr2 60478511 60478530 60478514 -
cacagagtattaggcctgtg

SEQ ID NO: 181987 - DNA, 20 bp, Artificial Sequence
  Synthetic oligonucleotide; AAG chr2 60478488 60478507 60478491 -
tgccttccacgcttcccctg

SEQ ID NO: 181988 - DNA, 20 bp, Artificial Sequence
  Synthetic oligonucleotide; CAG chr2 60478476 60478495 60478479 -
ttcccctgaagtccacacac

SEQ ID NO: 181989 - DNA, 20 bp, Artificial Sequence
  Synthetic oligonucleotide; TAG chr2 60478465 60478484 60478468 -
tccacacaccagtcactcaa

SEQ ID NO: 181990 - DNA, 20 bp, Artificial Sequence
  Synthetic oligonucleotide; CAG chr2 60478459 60478478 60478462 -
caccagtcactcaatagtgc

SEQ ID NO: 181991 - DNA, 20 bp, Artificial Sequence
  Synthetic oligonucleotide; AAG chr2 60478455 60478474 60478458 -
agtcactcaatagtgccaga

SEQ ID NO: 181992 - DNA, 20 bp, Artificial Sequence
  Synthetic oligonucleotide; AGG chr2 60478454 60478473 60478457 -
gtcactcaatagtgccagaa

SEQ ID NO: 181993 - DNA, 20 bp, Artificial Sequence
  Synthetic oligonucleotide; AAG chr2 60478450 60478469 60478453 -
ctcaatagtgccagaaaggc

SEQ ID NO: 181994 - DNA, 20 bp, Artificial Sequence
  Synthetic oligonucleotide; GAG chr2 60478446 60478465 60478449 -
atagtgccagaaaggcaagt

SEQ ID NO: 181995 - DNA, 20 bp, Artificial Sequence
  Synthetic oligonucleotide; AGG chr2 60478445 60478464 60478448 -
tagtgccagaaaggcaagtg

SEQ ID NO: 181996 - DNA, 20 bp, Artificial Sequence
  Synthetic oligonucleotide; GAG chr2 60478443 60478462 60478446 -
gtgccagaaaggcaagtgag

SEQ ID NO: 181997 - DNA, 20 bp, Artificial Sequence
  Synthetic oligonucleotide; AAG chr2 60478431 60478450 60478434 -
caagtgaggagattgcctga

SEQ ID NO: 181998 - DNA, 20 bp, Artificial Sequence
  Synthetic oligonucleotide; AGG chr2 60478430 60478449 60478433 -
aagtgaggagattgcctgaa

SEQ ID NO: 181999 - DNA, 20 bp, Artificial Sequence
  Synthetic oligonucleotide; GGG chr2 60478429 60478448 60478432 -
agtgaggagattgcctgaaa

SEQ ID NO: 182000 - DNA, 20 bp, Artificial Sequence
  Synthetic oligonucleotide; GGG chr2 60478428 60478447 60478431 -
gtgaggagattgcctgaaag

SEQ ID NO: 182001 - DNA, 20 bp, Artificial Sequence
  Synthetic oligonucleotide; CAG chr2 60478416 60478435 60478419 -
cctgaaaggggctgtatgac

SEQ ID NO: 182002 - DNA, 20 bp, Artificial Sequence
  Synthetic oligonucleotide; CAG chr2 60478409 60478428 60478412 -
ggggctgtatgaccagtgtc

SEQ ID NO: 182003 - DNA, 20 bp, Artificial Sequence
  Synthetic oligonucleotide; CAG chr2 60478402 60478421 60478405 -
tatgaccagtgtccagacga

SEQ ID NO: 182004 - DNA, 20 bp, Artificial Sequence
  Synthetic oligonucleotide; AGG chr2 60478401 60478420 60478404 -
atgaccagtgtccagacgac

SEQ ID NO: 182005 - DNA, 20 bp, Artificial Sequence
  Synthetic oligonucleotide; CGG chr2 60478389 60478408 60478392 -
cagacgacaggtttctgccg

SEQ ID NO: 182006 - DNA, 20 bp, Artificial Sequence
  Synthetic oligonucleotide; GAG chr2 60478382 60478401 60478385 -
caggtttctgccgcggccct

SEQ ID NO: 182007 - DNA, 20 bp, Artificial Sequence
  Synthetic oligonucleotide; AGG chr2 60478381 60478400 60478384 -
aggtttctgccgcggccctg

SEQ ID NO: 182008 - DNA, 20 bp, Artificial Sequence
  Synthetic oligonucleotide; TGG chr2 60478378 60478397 60478381 -
tttctgccgcggccctgagg

SEQ ID NO: 182009 - DNA, 20 bp, Artificial Sequence
  Synthetic oligonucleotide; CAG chr2 60478375 60478394 60478378 -
ctgccgcggccctgaggtgg

SEQ ID NO: 182010 - DNA, 20 bp, Artificial Sequence
  Synthetic oligonucleotide; TGG chr2 60478372 60478391 60478375 -
ccgcggccctgaggtggcag

SEQ ID NO: 182011 - DNA, 20 bp, Artificial Sequence
  Synthetic oligonucleotide; GGG chr2 60478371 60478390 60478374 -
cgcggccctgaggtggcagt

SEQ ID NO: 182012 - DNA, 20 bp, Artificial Sequence
  Synthetic oligonucleotide; GAG chr2 60478369 60478388 60478372 -
cggccctgaggtggcagtgg

SEQ ID NO: 182013 - DNA, 20 bp, Artificial Sequence
  Synthetic oligonucleotide; AGG chr2 60478368 60478387 60478371 -
ggccctgaggtggcagtggg

SEQ ID NO: 182014 - DNA, 20 bp, Artificial Sequence
  Synthetic oligonucleotide; GGG chr2 60478367 60478386 60478370 -
gccctgaggtggcagtggga

SEQ ID NO: 182015 - DNA, 20 bp, Artificial Sequence
  Synthetic oligonucleotide; GGG chr2 60478366 60478385 60478369 -
ccctgaggtggcagtgggag

SEQ ID NO: 182016 - DNA, 20 bp, Artificial Sequence
  Synthetic oligonucleotide; CAG chr2 60478358 60478377 60478361 -
tggcagtgggaggggtttgt

SEQ ID NO: 182017 - DNA, 20 bp, Artificial Sequence
  Synthetic oligonucleotide; AAG chr2 60478355 60478374 60478358 -
cagtgggaggggtttgtcag

SEQ ID NO: 182018 - DNA, 20 bp, Artificial Sequence
  Synthetic oligonucleotide; AGG chr2 60478354 60478373 60478357 -
agtgggaggggtttgtcaga

SEQ ID NO: 182019 - DNA, 20 bp, Artificial Sequence
  Synthetic oligonucleotide; TGG chr2 60478351 60478370 60478354 -
gggaggggtttgtcagaagg

SEQ ID NO: 182020 - DNA, 20 bp, Artificial Sequence
  Synthetic oligonucleotide; GGG chr2 60478350 60478369 60478353 -
ggaggggtttgtcagaaggt

SEQ ID NO: 182021 - DNA, 20 bp, Artificial Sequence
  Synthetic oligonucleotide; CAG chr2 60478347 60478366 60478350 -
ggggtttgtcagaaggtggg

SEQ ID NO: 182022 - DNA, 20 bp, Artificial Sequence
  Synthetic oligonucleotide; AGG chr2 60478346 60478365 60478349 -
gggtttgtcagaaggtgggc

SEQ ID NO: 182023 - DNA, 20 bp, Artificial Sequence
  Synthetic oligonucleotide; GGG chr2 60478345 60478364 60478348 -
ggtttgtcagaaggtgggca

SEQ ID NO: 182024 - DNA, 20 bp, Artificial Sequence
  Synthetic oligonucleotide; AAG chr2 60478337 60478356 60478340 -
agaaggtgggcagggtcctg

SEQ ID NO: 182025 - DNA, 20 bp, Artificial Sequence
  Synthetic oligonucleotide; CAG chr2 60478332 60478351 60478335 -
gtgggcagggtcctgaagcc

SEQ ID NO: 182026 - DNA, 20 bp, Artificial Sequence
  Synthetic oligonucleotide; CAG chr2 60478311 60478330 60478314 -
agccctgtcctccctgtcca

SEQ ID NO: 182027 - DNA, 20 bp, Artificial Sequence
  Synthetic oligonucleotide; CAG chr2 60478308 60478327 60478311 -
cctgtcctccctgtccacag

SEQ ID NO: 182028 - DNA, 20 bp, Artificial Sequence
  Synthetic oligonucleotide; AGG chr2 60478307 60478326 60478310 -
ctgtcctccctgtccacagc

SEQ ID NO: 182029 - DNA, 20 bp, Artificial Sequence
  Synthetic oligonucleotide; GAG chr2 60478296 60478315 60478299 -
gtccacagcaggacacttct

SEQ ID NO: 182030 - DNA, 20 bp, Artificial Sequence
  Synthetic oligonucleotide; GAG chr2 60478287 60478306 60478290 -
aggacacttctgagatcttc

SEQ ID NO: 182031 - DNA, 20 bp, Artificial Sequence
  Synthetic oligonucleotide; TGG chr2 60478276 60478295 60478279 -
gagatcttcgagttcctcac

SEQ ID NO: 182032 - DNA, 20 bp, Artificial Sequence
  Synthetic oligonucleotide; GGG chr2 60478275 60478294 60478278 -
agatcttcgagttcctcact

SEQ ID NO: 182033 - DNA, 20 bp, Artificial Sequence
  Synthetic oligonucleotide; GAG chr2 60478273 60478292 60478276 -
atcttcgagttcctcactgg

SEQ ID NO: 182034 - DNA, 20 bp, Artificial Sequence
  Synthetic oligonucleotide; AGG chr2 60478272 60478291 60478275 -
tcttcgagttcctcactggg

SEQ ID NO: 182035 - DNA, 20 bp, Artificial Sequence
  Synthetic oligonucleotide; GAG chr2 60478268 60478287 60478271 -
cgagttcctcactgggaggt

SEQ ID NO: 182036 - DNA, 20 bp, Artificial Sequence
  Synthetic oligonucleotide; AGG chr2 60478267 60478286 60478270 -
gagttcctcactgggaggtg

SEQ ID NO: 182037 - DNA, 20 bp, Artificial Sequence
  Synthetic oligonucleotide; CAG chr2 60478243 60478262 60478246 -
taataccttccctcattcca

SEQ ID NO: 182038 - DNA, 20 bp, Artificial Sequence
  Synthetic oligonucleotide; AGG chr2 60478242 60478261 60478245 -
aataccttccctcattccac

SEQ ID NO: 182039 - DNA, 20 bp, Artificial Sequence
  Synthetic oligonucleotide; GGG chr2 60478241 60478260 60478244 -
ataccttccctcattccaca

SEQ ID NO: 182040 - DNA, 20 bp, Artificial Sequence
  Synthetic oligonucleotide; TGG chr2 60478231 60478250 60478234 -
tcattccacagggcgactgt

SEQ ID NO: 182041 - DNA, 20 bp, Artificial Sequence
  Synthetic oligonucleotide; GGG chr2 60478230 60478249 60478233 -
cattccacagggcgactgtt

SEQ ID NO: 182042 - DNA, 20 bp, Artificial Sequence
  Synthetic oligonucleotide; GGG chr2 60478229 60478248 60478232 -
attccacagggcgactgttg

SEQ ID NO: 182043 - DNA, 20 bp, Artificial Sequence
  Synthetic oligonucleotide; CAG chr2 60478226 60478245 60478229 -
ccacagggcgactgttgggg

SEQ ID NO: 182044 - DNA, 20 bp, Artificial Sequence
  Synthetic oligonucleotide; AGG chr2 60478225 60478244 60478228 -
cacagggcgactgttggggc

SEQ ID NO: 182045 - DNA, 20 bp, Artificial Sequence
  Synthetic oligonucleotide; GAG chr2 60478218 60478237 60478221 -
cgactgttggggcaggatgt

SEQ ID NO: 182046 - DNA, 20 bp, Artificial Sequence
  Synthetic oligonucleotide; AGG chr2 60478217 60478236 60478220 -
gactgttggggcaggatgtg

SEQ ID NO: 182047 - DNA, 20 bp, Artificial Sequence
  Synthetic oligonucleotide; GAG chr2 60478215 60478234 60478218 -
ctgttggggcaggatgtgag

SEQ ID NO: 182048 - DNA, 20 bp, Artificial Sequence
  Synthetic oligonucleotide; GAG chr2 60478213 60478232 60478216 -
gttggggcaggatgtgagga

SEQ ID NO: 182049 - DNA, 20 bp, Artificial Sequence
  Synthetic oligonucleotide; TGG chr2 60478205 60478224 60478208 -
aggatgtgaggagagtactt

SEQ ID NO: 182050 - DNA, 20 bp, Artificial Sequence
  Synthetic oligonucleotide; GGG chr2 60478204 60478223 60478207 -
ggatgtgaggagagtacttt

SEQ ID NO: 182051 - DNA, 20 bp, Artificial Sequence
  Synthetic oligonucleotide; AAG chr2 60478201 60478220 60478204 -
tgtgaggagagtactttggg

SEQ ID NO: 182052 - DNA, 20 bp, Artificial Sequence
  Synthetic oligonucleotide; CAG chr2 60478180 60478199 60478183 -
agaacataacactttccacc

SEQ ID NO: 182053 - DNA, 20 bp, Artificial Sequence
  Synthetic oligonucleotide; TGG chr2 60478175 60478194 60478178 -
ataacactttccacccagcc

SEQ ID NO: 182054 - DNA, 20 bp, Artificial Sequence
  Synthetic oligonucleotide; GGG chr2 60478174 60478193 60478177 -
taacactttccacccagcct

SEQ ID NO: 182055 - DNA, 20 bp, Artificial Sequence
  Synthetic oligonucleotide; TGG chr2 60478166 60478185 60478169 -
tccacccagcctgggcaaca

SEQ ID NO: 182056 - DNA, 20 bp, Artificial Sequence
  Synthetic oligonucleotide; GAG chr2 60478162 60478181 60478165 -
cccagcctgggcaacatggt

SEQ ID NO: 182057 - DNA, 20 bp, Artificial Sequence
  Synthetic oligonucleotide; TAG chr2 60478131 60478150 60478134 -
tctacaaaaaatacaaaaat

SEQ ID NO: 182058 - DNA, 20 bp, Artificial Sequence
  Synthetic oligonucleotide; CAG chr2 60478127 60478146 60478130 -
caaaaaatacaaaaattagc

SEQ ID NO: 182059 - DNA, 20 bp, Artificial Sequence
  Synthetic oligonucleotide; AGG chr2 60478126 60478145 60478129 -
aaaaaatacaaaaattagcc

SEQ ID NO: 182060 - DNA, 20 bp, Artificial Sequence
  Synthetic oligonucleotide; TGG chr2 60478121 60478140 60478124 -
atacaaaaattagccaggtg

SEQ ID NO: 182061 - DNA, 20 bp, Artificial Sequence
  Synthetic oligonucleotide; TGG chr2 60478118 60478137 60478121 -
caaaaattagccaggtgtgg

SEQ ID NO: 182062 - DNA, 20 bp, Artificial Sequence
  Synthetic oligonucleotide; TGG chr2 60478115 60478134 60478118 -
aaattagccaggtgtggtgg

SEQ ID NO: 182063 - DNA, 20 bp, Artificial Sequence
  Synthetic oligonucleotide; TAG chr2 60478102 60478121 60478105 -
gtggtggtggcgcatgcctg

SEQ ID NO: 182064 - DNA, 20 bp, Artificial Sequence
  Synthetic oligonucleotide; TAG chr2 60478096 60478115 60478099 -
gtggcgcatgcctgtagtcc

SEQ ID NO: 182065 - DNA, 20 bp, Artificial Sequence
  Synthetic oligonucleotide; GAG chr2 60478087 60478106 60478090 -
gcctgtagtcctagctactt

SEQ ID NO: 182066 - DNA, 20 bp, Artificial Sequence
  Synthetic oligonucleotide; GAG chr2 60478085 60478104 60478088 -
ctgtagtcctagctacttga

SEQ ID NO: 182067 - DNA, 20 bp, Artificial Sequence
  Synthetic oligonucleotide; GAG chr2 60478080 60478099 60478083 -
gtcctagctacttgagagct

SEQ ID NO: 182068 - DNA, 20 bp, Artificial Sequence
  Synthetic oligonucleotide; AGG chr2 60478079 60478098 60478082 -
tcctagctacttgagagctg

SEQ ID NO: 182069 - DNA, 20 bp, Artificial Sequence
  Synthetic oligonucleotide; CAG chr2 60478076 60478095 60478079 -
tagctacttgagagctgagg

SEQ ID NO: 182070 - DNA, 20 bp, Artificial Sequence
  Synthetic oligonucleotide; AGG chr2 60478075 60478094 60478078 -
agctacttgagagctgaggc

SEQ ID NO: 182071 - DNA, 20 bp, Artificial Sequence
  Synthetic oligonucleotide; GAG chr2 60478073 60478092 60478076 -
ctacttgagagctgaggcag

SEQ ID NO: 182072 - DNA, 20 bp, Artificial Sequence
  Synthetic oligonucleotide; AGG chr2 60478072 60478091 60478075 -
tacttgagagctgaggcagg

SEQ ID NO: 182073 - DNA, 20 bp, Artificial Sequence
  Synthetic oligonucleotide; CGG chr2 60478057 60478076 60478060 -
gcaggaggactgcttgaact

SEQ ID NO: 182074 - DNA, 20 bp, Artificial Sequence
  Synthetic oligonucleotide; GGG chr2 60478056 60478075 60478059 -
caggaggactgcttgaactc

SEQ ID NO: 182075 - DNA, 20 bp, Artificial Sequence
  Synthetic oligonucleotide; GAG chr2 60478054 60478073 60478057 -
ggaggactgcttgaactcgg

SEQ ID NO: 182076 - DNA, 20 bp, Artificial Sequence
  Synthetic oligonucleotide; AGG chr2 60478053 60478072 60478056 -
gaggactgcttgaactcggg

SEQ ID NO: 182077 - DNA, 20 bp, Artificial Sequence
  Synthetic oligonucleotide; CGG chr2 60478050 60478069 60478053 -
gactgcttgaactcgggagg

SEQ ID NO: 182078 - DNA, 20 bp, Artificial Sequence
  Synthetic oligonucleotide; GAG chr2 60478048 60478067 60478051 -
ctgcttgaactcgggaggcg

SEQ ID NO: 182079 - DNA, 20 bp, Artificial Sequence
  Synthetic oligonucleotide; AGG chr2 60478047 60478066 60478050 -
tgcttgaactcgggaggcgg

SEQ ID NO: 182080 - DNA, 20 bp, Artificial Sequence
  Synthetic oligonucleotide; CAG chr2 60478041 60478060 60478044 -
aactcgggaggcggaggttg

SEQ ID NO: 182081 - DNA, 20 bp, Artificial Sequence
  Synthetic oligonucleotide; GAG chr2 60478037 60478056 60478040 -
cgggaggcggaggttgcagt

SEQ ID NO: 182082 - DNA, 20 bp, Artificial Sequence
  Synthetic oligonucleotide; AAG chr2 60478032 60478051 60478035 -
ggcggaggttgcagtgagcc

SEQ ID NO: 182083 - DNA, 20 bp, Artificial Sequence
  Synthetic oligonucleotide; CAG chr2 60478012 60478031 60478015 -
aagattgcaccactgcactc

SEQ ID NO: 182084 - DNA, 20 bp, Artificial Sequence
  Synthetic oligonucleotide; TGG chr2 60478007 60478026 60478010 -
tgcaccactgcactccagcc

SEQ ID NO: 182085 - DNA, 20 bp, Artificial Sequence
  Synthetic oligonucleotide; GGG chr2 60478006 60478025 60478009 -
gcaccactgcactccagcct

SEQ ID NO: 182086 - DNA, 20 bp, Artificial Sequence
  Synthetic oligonucleotide; CAG chr2 60478000 60478019 60478003 -
ctgcactccagcctgggcaa

SEQ ID NO: 182087 - DNA, 20 bp, Artificial Sequence
  Synthetic oligonucleotide; GAG chr2 60477998 60478017 60478001 -
gcactccagcctgggcaaca

SEQ ID NO: 182088 - DNA, 20 bp, Artificial Sequence
  Synthetic oligonucleotide; GAG chr2 60477994 60478013 60477997 -
tccagcctgggcaacagagt

SEQ ID NO: 182089 - DNA, 20 bp, Artificial Sequence
  Synthetic oligonucleotide; AAG chr2 60477961 60477980 60477964 -
aattaaaaaaaaaaaaaaaa

SEQ ID NO: 182090 - DNA, 20 bp, Artificial Sequence
  Synthetic oligonucleotide; AAG chr2 60477949 60477968 60477952 -
aaaaaaaaaagctttccata

SEQ ID NO: 182091 - DNA, 20 bp, Artificial Sequence
  Synthetic oligonucleotide; AGG chr2 60477948 60477967 60477951 -
aaaaaaaaagctttccataa

SEQ ID NO: 182092 - DNA, 20 bp, Artificial Sequence
  Synthetic oligonucleotide; CAG chr2 60477944 60477963 60477947 -
aaaaagctttccataaaggc

SEQ ID NO: 182093 - DNA, 20 bp, Artificial Sequence
  Synthetic oligonucleotide; AGG chr2 60477943 60477962 60477946 -
aaaagctttccataaaggcc

SEQ ID NO: 182094 - DNA, 20 bp, Artificial Sequence
  Synthetic oligonucleotide; CAG chr2 60477939 60477958 60477942 -
gctttccataaaggccagga

SEQ ID NO: 182095 - DNA, 20 bp, Artificial Sequence
  Synthetic oligonucleotide; AAG chr2 60477924 60477943 60477927 -
caggacagatgtgcttcctt

SEQ ID NO: 182096 - DNA, 20 bp, Artificial Sequence
  Synthetic oligonucleotide; AAG chr2 60477921 60477940 60477924 -
gacagatgtgcttccttaag

SEQ ID NO: 182097 - DNA, 20 bp, Artificial Sequence
  Synthetic oligonucleotide; AGG chr2 60477920 60477939 60477923 -
acagatgtgcttccttaaga

SEQ ID NO: 182098 - DNA, 20 bp, Artificial Sequence
  Synthetic oligonucleotide; GGG chr2 60477919 60477938 60477922 -
cagatgtgcttccttaagaa

SEQ ID NO: 182099 - DNA, 20 bp, Artificial Sequence
  Synthetic oligonucleotide; TAG chr2 60477915 60477934 60477918 -
tgtgcttccttaagaagggc

SEQ ID NO: 182100 - DNA, 20 bp, Artificial Sequence
  Synthetic oligonucleotide; GAG chr2 60477913 60477932 60477916 -
tgcttccttaagaagggcta

SEQ ID NO: 182101 - DNA, 20 bp, Artificial Sequence
  Synthetic oligonucleotide; TGG chr2 60477909 60477928 60477912 -
tccttaagaagggctagagt

SEQ ID NO: 182102 - DNA, 20 bp, Artificial Sequence
  Synthetic oligonucleotide; GAG chr2 60477907 60477926 60477910 -
cttaagaagggctagagttg

SEQ ID NO: 182103 - DNA, 20 bp, Artificial Sequence
  Synthetic oligonucleotide; AGG chr2 60477906 60477925 60477909 -
ttaagaagggctagagttgg

SEQ ID NO: 182104 - DNA, 20 bp, Artificial Sequence
  Synthetic oligonucleotide; TGG chr2 60477890 60477909 60477893 -
ttggaggccttgccctcctc

SEQ ID NO: 182105 - DNA, 20 bp, Artificial Sequence
  Synthetic oligonucleotide; GGG chr2 60477889 60477908 60477892 -
tggaggccttgccctcctct

SEQ ID NO: 182106 - DNA, 20 bp, Artificial Sequence
  Synthetic oligonucleotide; TGG chr2 60477881 60477900 60477884 -
ttgccctcctctgggcttgt

SEQ ID NO: 182107 - DNA, 20 bp, Artificial Sequence
  Synthetic oligonucleotide; TGG chr2 60477875 60477894 60477878 -
tcctctgggcttgttggcct

SEQ ID NO: 182108 - DNA, 20 bp, Artificial Sequence
  Synthetic oligonucleotide; GGG chr2 60477874 60477893 60477877 -
cctctgggcttgttggcctt

SEQ ID NO: 182109 - DNA, 20 bp, Artificial Sequence
  Synthetic oligonucleotide; GGG chr2 60477873 60477892 60477876 -
ctctgggcttgttggccttg

SEQ ID NO: 182110 - DNA, 20 bp, Artificial Sequence
  Synthetic oligonucleotide; GGG chr2 60477872 60477891 60477875 -
tctgggcttgttggccttgg

SEQ ID NO: 182111 - DNA, 20 bp, Artificial Sequence
  Synthetic oligonucleotide; GAG chr2 60477870 60477889 60477873 -
tgggcttgttggccttgggg

SEQ ID NO: 182112 - DNA, 20 bp, Artificial Sequence
  Synthetic oligonucleotide; AGG chr2 60477869 60477888 60477872 -
gggcttgttggccttggggg

SEQ ID NO: 182113 - DNA, 20 bp, Artificial Sequence
  Synthetic oligonucleotide; CAG chr2 60477861 60477880 60477864 -
tggccttgggggaggcctga

SEQ ID NO: 182114 - DNA, 20 bp, Artificial Sequence
  Synthetic oligonucleotide; GAG chr2 60477859 60477878 60477862 -
gccttgggggaggcctgaca

SEQ ID NO: 182115 - DNA, 20 bp, Artificial Sequence
  Synthetic oligonucleotide; TGG chr2 60477850 60477869 60477853 -
gaggcctgacagagccttcc

SEQ ID NO: 182116 - DNA, 20 bp, Artificial Sequence
  Synthetic oligonucleotide; GGG chr2 60477849 60477868 60477852 -
aggcctgacagagccttcct

SEQ ID NO: 182117 - DNA, 20 bp, Artificial Sequence
  Synthetic oligonucleotide; GGG chr2 60477848 60477867 60477851 -
ggcctgacagagccttcctg

SEQ ID NO: 182118 - DNA, 20 bp, Artificial Sequence
  Synthetic oligonucleotide; TGG chr2 60477832 60477851 60477835 -
cctggggctgcctgttcttc

SEQ ID NO: 182119 - DNA, 20 bp, Artificial Sequence
  Synthetic oligonucleotide; CAG chr2 60477814 60477833 60477817 -
tctggccccttctccgtgca

SEQ ID NO: 182120 - DNA, 20 bp, Artificial Sequence
  Synthetic oligonucleotide; CAG chr2 60477809 60477828 60477812 -
ccccttctccgtgcacagac

SEQ ID NO: 182121 - DNA, 20 bp, Artificial Sequence
  Synthetic oligonucleotide; TGG chr2 60477803 60477822 60477806 -
ctccgtgcacagaccagtct

SEQ ID NO: 182122 - DNA, 20 bp, Artificial Sequence
  Synthetic oligonucleotide; AAG chr2 60477795 60477814 60477798 -
acagaccagtcttggatgat

SEQ ID NO: 182123 - DNA, 20 bp, Artificial Sequence
  Synthetic oligonucleotide; CAG chr2 60477791 60477810 60477794 -
accagtcttggatgataagt

SEQ ID NO: 182124 - DNA, 20 bp, Artificial Sequence
  Synthetic oligonucleotide; AGG chr2 60477790 60477809 60477793 -
ccagtcttggatgataagtc

SEQ ID NO: 182125 - DNA, 20 bp, Artificial Sequence
  Synthetic oligonucleotide; AAG chr2 60477786 60477805 60477789 -
tcttggatgataagtcagga

SEQ ID NO: 182126 - DNA, 20 bp, Artificial Sequence
  Synthetic oligonucleotide; TGG chr2 60477774 60477793 60477777 -
agtcaggaaagccctccacc

SEQ ID NO: 182127 - DNA, 20 bp, Artificial Sequence
  Synthetic oligonucleotide; CGG chr2 60477770 60477789 60477773 -
aggaaagccctccacctggc

SEQ ID NO: 182128 - DNA, 20 bp, Artificial Sequence
  Synthetic oligonucleotide; GGG chr2 60477769 60477788 60477772 -
ggaaagccctccacctggcc

SEQ ID NO: 182129 - DNA, 20 bp, Artificial Sequence
  Synthetic oligonucleotide; CAG chr2 60477763 60477782 60477766 -
ccctccacctggccgggctg

SEQ ID NO: 182130 - DNA, 20 bp, Artificial Sequence
  Synthetic oligonucleotide; TGG chr2 60477754 60477773 60477757 -
tggccgggctgcagtgtcgc

SEQ ID NO: 182131 - DNA, 20 bp, Artificial Sequence
  Synthetic oligonucleotide; GGG chr2 60477753 60477772 60477756 -
ggccgggctgcagtgtcgct

SEQ ID NO: 182132 - DNA, 20 bp, Artificial Sequence
  Synthetic oligonucleotide; GGG chr2 60477752 60477771 60477755 -
gccgggctgcagtgtcgctg

SEQ ID NO: 182133 - DNA, 20 bp, Artificial Sequence
  Synthetic oligonucleotide; TGG chr2 60477729 60477748 60477732 -
ctgcccacacttgctgacca

SEQ ID NO: 182134 - DNA, 20 bp, Artificial Sequence
  Synthetic oligonucleotide; CAG chr2 60477704 60477723 60477707 -
ccccactcccttgtctctca

SEQ ID NO: 182135 - DNA, 20 bp, Artificial Sequence
  Synthetic oligonucleotide; CAG chr2 60477681 60477700 60477684 -
caccactgcccctgtttcca

SEQ ID NO: 182136 - DNA, 20 bp, Artificial Sequence
  Synthetic oligonucleotide; CAG chr2 60477660 60477679 60477663 -
agtgcccacgaacaaaacat

SEQ ID NO: 182137 - DNA, 20 bp, Artificial Sequence
  Synthetic oligonucleotide; AGG chr2 60477659 60477678 60477662 -
gtgcccacgaacaaaacatc

SEQ ID NO: 182138 - DNA, 20 bp, Artificial Sequence
  Synthetic oligonucleotide; GAG chr2 60477657 60477676 60477660 -
gcccacgaacaaaacatcag

SEQ ID NO: 182139 - DNA, 20 bp, Artificial Sequence
  Synthetic oligonucleotide; TGG chr2 60477649 60477668 60477652 -
acaaaacatcaggagtctct

SEQ ID NO: 182140 - DNA, 20 bp, Artificial Sequence
  Synthetic oligonucleotide; AAG chr2 60477591 60477610 60477594 -
ttctttatttattttactct

SEQ ID NO: 182141 - DNA, 20 bp, Artificial Sequence
  Synthetic oligonucleotide; TGG chr2 60477585 60477604 60477588 -
atttattttactctaagttc

SEQ ID NO: 182142 - DNA, 20 bp, Artificial Sequence
  Synthetic oligonucleotide; GGG chr2 60477584 60477603 60477587 -
tttattttactctaagttct

SEQ ID NO: 182143 - DNA, 20 bp, Artificial Sequence
  Synthetic oligonucleotide; CAG chr2 60477572 60477591 60477575 -
taagttctgggatacatgtg

SEQ ID NO: 182144 - DNA, 20 bp, Artificial Sequence
  Synthetic oligonucleotide; CAG chr2 60477563 60477582 60477566 -
ggatacatgtgcagaatgtg

SEQ ID NO: 182145 - DNA, 20 bp, Artificial Sequence
  Synthetic oligonucleotide; AGG chr2 60477562 60477581 60477565 -
gatacatgtgcagaatgtgc

SEQ ID NO: 182146 - DNA, 20 bp, Artificial Sequence
  Synthetic oligonucleotide; AAG chr2 60477549 60477568 60477552 -
aatgtgcaggtttgttacat

SEQ ID NO: 182147 - DNA, 20 bp, Artificial Sequence
  Synthetic oligonucleotide; TGG chr2 60477533 60477552 60477536 -
acataagtatacatgtacca

SEQ ID NO: 182148 - DNA, 20 bp, Artificial Sequence
  Synthetic oligonucleotide; TGG chr2 60477530 60477549 60477533 -
taagtatacatgtaccatgg

SEQ ID NO: 182149 - DNA, 20 bp, Artificial Sequence
  Synthetic oligonucleotide; TAG chr2 60477496 60477515 60477499 -
tatcaacccatcatctacat

SEQ ID NO: 182150 - DNA, 20 bp, Artificial Sequence
  Synthetic oligonucleotide; AGG chr2 60477495 60477514 60477498 -
atcaacccatcatctacatt

SEQ ID NO: 182151 - DNA, 20 bp, Artificial Sequence
  Synthetic oligonucleotide; TGG chr2 60477447 60477466 60477450 -
cttgcccctccacccatgtt

SEQ ID NO: 182152 - DNA, 20 bp, Artificial Sequence
  Synthetic oligonucleotide; TAG chr2 60477437 60477456 60477440 -
cacccatgtttggttttctt

SEQ ID NO: 182153 - DNA, 20 bp, Artificial Sequence
  Synthetic oligonucleotide; TAG chr2 60477427 60477446 60477430 -
tggttttctttagcttattc

SEQ ID NO: 182154 - DNA, 20 bp, Artificial Sequence
  Synthetic oligonucleotide; AAG chr2 60477415 60477434 60477418 -
gcttattctagtattttctc

SEQ ID NO: 182155 - DNA, 20 bp, Artificial Sequence
  Synthetic oligonucleotide; TAG chr2 60477393 60477412 60477396 -
gaccgatcgaaatgataata

SEQ ID NO: 182156 - DNA, 20 bp, Artificial Sequence
  Synthetic oligonucleotide; GAG chr2 60477391 60477410 60477394 -
ccgatcgaaatgataatata

SEQ ID NO: 182157 - DNA, 20 bp, Artificial Sequence
  Synthetic oligonucleotide; AGG chr2 60477390 60477409 60477393 -
cgatcgaaatgataatatag

SEQ ID NO: 182158 - DNA, 20 bp, Artificial Sequence
  Synthetic oligonucleotide; AAG chr2 60477383 60477402 60477386 -
aatgataatatagaggcata

SEQ ID NO: 182159 - DNA, 20 bp, Artificial Sequence
  Synthetic oligonucleotide; GAG chr2 60477368 60477387 60477371 -
gcataaagcacatttgttgt

SEQ ID NO: 182160 - DNA, 20 bp, Artificial Sequence
  Synthetic oligonucleotide; CAG chr2 60477359 60477378 60477362 -
acatttgttgtgagttgatg

SEQ ID NO: 182161 - DNA, 20 bp, Artificial Sequence
  Synthetic oligonucleotide; AAG chr2 60477351 60477370 60477354 -
tgtgagttgatgcagataaa

SEQ ID NO: 182162 - DNA, 20 bp, Artificial Sequence
  Synthetic oligonucleotide; AGG chr2 60477350 60477369 60477353 -
gtgagttgatgcagataaaa

SEQ ID NO: 182163 - DNA, 20 bp, Artificial Sequence
  Synthetic oligonucleotide; TGG chr2 60477345 60477364 60477348 -
ttgatgcagataaaaaggct

SEQ ID NO: 182164 - DNA, 20 bp, Artificial Sequence
  Synthetic oligonucleotide; GGG chr2 60477344 60477363 60477347 -
tgatgcagataaaaaggctt

SEQ ID NO: 182165 - DNA, 20 bp, Artificial Sequence
  Synthetic oligonucleotide; GGG chr2 60477343 60477362 60477346 -
gatgcagataaaaaggcttg

SEQ ID NO: 182166 - DNA, 20 bp, Artificial Sequence
  Synthetic oligonucleotide; TGG chr2 60477340 60477359 60477343 -
gcagataaaaaggcttgggg

SEQ ID NO: 182167 - DNA, 20 bp, Artificial Sequence
  Synthetic oligonucleotide; CAG chr2 60477333 60477352 60477336 -
aaaaggcttggggtggtctt

SEQ ID NO: 182168 - DNA, 20 bp, Artificial Sequence
  Synthetic oligonucleotide; GAG chr2 60477331 60477350 60477334 -
aaggcttggggtggtcttca

SEQ ID NO: 182169 - DNA, 20 bp, Artificial Sequence
  Synthetic oligonucleotide; TGG chr2 60477323 60477342 60477326 -
gggtggtcttcagagtaatt

SEQ ID NO: 182170 - DNA, 20 bp, Artificial Sequence
  Synthetic oligonucleotide; GGG chr2 60477322 60477341 60477325 -
ggtggtcttcagagtaattt

SEQ ID NO: 182171 - DNA, 20 bp, Artificial Sequence
  Synthetic oligonucleotide; GAG chr2 60477320 60477339 60477323 -
tggtcttcagagtaatttgg

SEQ ID NO: 182172 - DNA, 20 bp, Artificial Sequence
  Synthetic oligonucleotide; TGG chr2 60477304 60477323 60477307 -
ttgggagttgtgtgttctgc

SEQ ID NO: 182173 - DNA, 20 bp, Artificial Sequence
  Synthetic oligonucleotide; TAG chr2 60477295 60477314 60477298 -
gtgtgttctgctggctttga

SEQ ID NO: 182174 - DNA, 20 bp, Artificial Sequence
  Synthetic oligonucleotide; AAG chr2 60477290 60477309 60477293 -
ttctgctggctttgatagac

SEQ ID NO: 182175 - DNA, 20 bp, Artificial Sequence
  Synthetic oligonucleotide; TGG chr2 60477274 60477293 60477277 -
agacaagcccttctctgctc

SEQ ID NO: 182176 - DNA, 20 bp, Artificial Sequence
  Synthetic oligonucleotide; CAG chr2 60477271 60477290 60477274 -
caagcccttctctgctctgg

SEQ ID NO: 182177 - DNA, 20 bp, Artificial Sequence
  Synthetic oligonucleotide; AGG chr2 60477270 60477289 60477273 -
aagcccttctctgctctggc

SEQ ID NO: 182178 - DNA, 20 bp, Artificial Sequence
  Synthetic oligonucleotide; CAG chr2 60477261 60477280 60477264 -
tctgctctggcaggtgttat

SEQ ID NO: 182179 - DNA, 20 bp, Artificial Sequence
  Synthetic oligonucleotide; CAG chr2 60477214 60477233 60477217 -
tctcatcgcatccatcttca

SEQ ID NO: 182180 - DNA, 20 bp, Artificial Sequence
  Synthetic oligonucleotide; CAG chr2 60477188 60477207 60477191 -
catgcctcttcctgaatgct

SEQ ID NO: 182181 - DNA, 20 bp, Artificial Sequence
  Synthetic oligonucleotide; CAG chr2 60477160 60477179 60477163 -
aatgcgtatttcaccttcct

SEQ ID NO: 182182 - DNA, 20 bp, Artificial Sequence
  Synthetic oligonucleotide; AGG chr2 60477159 60477178 60477162 -
atgcgtatttcaccttcctc

SEQ ID NO: 182183 - DNA, 20 bp, Artificial Sequence
  Synthetic oligonucleotide; TGG chr2 60477140 60477159 60477143 -
caggtatctaatacttaacc

SEQ ID NO: 182184 - DNA, 20 bp, Artificial Sequence
  Synthetic oligonucleotide; GGG chr2 60477139 60477158 60477142 -
aggtatctaatacttaacct

SEQ ID NO: 182185 - DNA, 20 bp, Artificial Sequence
  Synthetic oligonucleotide; GAG chr2 60477137 60477156 60477140 -
gtatctaatacttaacctgg

SEQ ID NO: 182186 - DNA, 20 bp, Artificial Sequence
  Synthetic oligonucleotide; AAG chr2 60477128 60477147 60477131 -
acttaacctgggagaaacgc

SEQ ID NO: 182187 - DNA, 20 bp, Artificial Sequence
  Synthetic oligonucleotide; TGG chr2 60477123 60477142 60477126 -
acctgggagaaacgcaagtg

SEQ ID NO: 182188 - DNA, 20 bp, Artificial Sequence
  Synthetic oligonucleotide; AAG chr2 60477115 60477134 60477118 -
gaaacgcaagtgtggtttgc

SEQ ID NO: 182189 - DNA, 20 bp, Artificial Sequence
  Synthetic oligonucleotide; AGG chr2 60477114 60477133 60477117 -
aaacgcaagtgtggtttgca

SEQ ID NO: 182190 - DNA, 20 bp, Artificial Sequence
  Synthetic oligonucleotide; CAG chr2 60477106 60477125 60477109 -
gtgtggtttgcaaggctttc

SEQ ID NO: 182191 - DNA, 20 bp, Artificial Sequence
  Synthetic oligonucleotide; AGG chr2 60477105 60477124 60477108 -
tgtggtttgcaaggctttcc

SEQ ID NO: 182192 - DNA, 20 bp, Artificial Sequence
  Synthetic oligonucleotide; GAG chr2 60477063 60477082 60477066 -
catccttttcttcatttctc

SEQ ID NO: 182193 - DNA, 20 bp, Artificial Sequence
  Synthetic oligonucleotide; TGG chr2 60477060 60477079 60477063 -
ccttttcttcatttctcgag

SEQ ID NO: 182194 - DNA, 20 bp, Artificial Sequence
  Synthetic oligonucleotide; GGG chr2 60477059 60477078 60477062 -
cttttcttcatttctcgagt

SEQ ID NO: 182195 - DNA, 20 bp, Artificial Sequence
  Synthetic oligonucleotide; GGG chr2 60477058 60477077 60477061 -
ttttcttcatttctcgagtg

SEQ ID NO: 182196 - DNA, 20 bp, Artificial Sequence
  Synthetic oligonucleotide; CAG chr2 60477055 60477074 60477058 -
tcttcatttctcgagtgggg

SEQ ID NO: 182197 - DNA, 20 bp, Artificial Sequence
  Synthetic oligonucleotide; AGG chr2 60477054 60477073 60477057 -
cttcatttctcgagtggggc

SEQ ID NO: 182198 - DNA, 20 bp, Artificial Sequence
  Synthetic oligonucleotide; GGG chr2 60477053 60477072 60477056 -
ttcatttctcgagtggggca

SEQ ID NO: 182199 - DNA, 20 bp, Artificial Sequence
  Synthetic oligonucleotide; GAG chr2 60477051 60477070 60477054 -
catttctcgagtggggcagg

SEQ ID NO: 182200 - DNA, 20 bp, Artificial Sequence
  Synthetic oligonucleotide; AGG chr2 60477050 60477069 60477053 -
atttctcgagtggggcaggg

SEQ ID NO: 182201 - DNA, 20 bp, Artificial Sequence
  Synthetic oligonucleotide; CGG chr2 60477044 60477063 60477047 -
cgagtggggcagggaggcat

SEQ ID NO: 182202 - DNA, 20 bp, Artificial Sequence
  Synthetic oligonucleotide; GGG chr2 60477043 60477062 60477046 -
gagtggggcagggaggcatc

SEQ ID NO: 182203 - DNA, 20 bp, Artificial Sequence
  Synthetic oligonucleotide; GGG chr2 60477042 60477061 60477045 -
agtggggcagggaggcatcg

SEQ ID NO: 182204 - DNA, 20 bp, Artificial Sequence
  Synthetic oligonucleotide; AAG chr2 60477018 60477037 60477021 -
gtttgtgatacgtttgtgtg

SEQ ID NO: 182205 - DNA, 20 bp, Artificial Sequence
  Synthetic oligonucleotide; TGG chr2 60477014 60477033 60477017 -
gtgatacgtttgtgtgaagc

SEQ ID NO: 182206 - DNA, 20 bp, Artificial Sequence
  Synthetic oligonucleotide; CGG chr2 60477005 60477024 60477008 -
ttgtgtgaagctggacaatt

SEQ ID NO: 182207 - DNA, 20 bp, Artificial Sequence
  Synthetic oligonucleotide; GGG chr2 60477004 60477023 60477007 -
tgtgtgaagctggacaattc

SEQ ID NO: 182208 - DNA, 20 bp, Artificial Sequence
  Synthetic oligonucleotide; CAG chr2 60476998 60477017 60477001 -
aagctggacaattcgggtga

SEQ ID NO: 182209 - DNA, 20 bp, Artificial Sequence
  Synthetic oligonucleotide; CAG chr2 60476986 60477005 60476989 -
tcgggtgacagaaatatgtt

SEQ ID NO: 182210 - DNA, 20 bp, Artificial Sequence
  Synthetic oligonucleotide; AGG chr2 60476985 60477004 60476988 -
cgggtgacagaaatatgttc

SEQ ID NO: 182211 - DNA, 20 bp, Artificial Sequence
  Synthetic oligonucleotide; GGG chr2 60476984 60477003 60476987 -
gggtgacagaaatatgttca

SEQ ID NO: 182212 - DNA, 20 bp, Artificial Sequence
  Synthetic oligonucleotide; CAG chr2 60476981 60477000 60476984 -
tgacagaaatatgttcaggg

SEQ ID NO: 182213 - DNA, 20 bp, Artificial Sequence
  Synthetic oligonucleotide; AAG chr2 60476951 60476970 60476954 -
tatcgtcccttctaactaca

SEQ ID NO: 182214 - DNA, 20 bp, Artificial Sequence
  Synthetic oligonucleotide; AGG chr2 60476950 60476969 60476953 -
atcgtcccttctaactacaa

SEQ ID NO: 182215 - DNA, 20 bp, Artificial Sequence
  Synthetic oligonucleotide; TGG chr2 60476945 60476964 60476948 -
cccttctaactacaaaggca

SEQ ID NO: 182216 - DNA, 20 bp, Artificial Sequence
  Synthetic oligonucleotide; CAG chr2 60476938 60476957 60476941 -
aactacaaaggcatggattg

SEQ ID NO: 182217 - DNA, 20 bp, Artificial Sequence
  Synthetic oligonucleotide; GAG chr2 60476933 60476952 60476936 -
caaaggcatggattgcagtt

SEQ ID NO: 182218 - DNA, 20 bp, Artificial Sequence
  Synthetic oligonucleotide; CAG chr2 60476921 60476940 60476924 -
ttgcagttgagccccacttt

SEQ ID NO: 182219 - DNA, 20 bp, Artificial Sequence
  Synthetic oligonucleotide; AAG chr2 60476918 60476937 60476921 -
cagttgagccccactttcag

SEQ ID NO: 182220 - DNA, 20 bp, Artificial Sequence
  Synthetic oligonucleotide; AGG chr2 60476917 60476936 60476920 -
agttgagccccactttcaga

SEQ ID NO: 182221 - DNA, 20 bp, Artificial Sequence
  Synthetic oligonucleotide; TGG chr2 60476888 60476907 60476891 -
acacacaaaaatctcattaa

SEQ ID NO: 182222 - DNA, 20 bp, Artificial Sequence
  Synthetic oligonucleotide; TAG chr2 60476873 60476892 60476876 -
attaatggaaactgataaat

SEQ ID NO: 182223 - DNA, 20 bp, Artificial Sequence
  Synthetic oligonucleotide; GAG chr2 60476871 60476890 60476874 -
taatggaaactgataaatta

SEQ ID NO: 182224 - DNA, 20 bp, Artificial Sequence
  Synthetic oligonucleotide; GAG chr2 60476869 60476888 60476872 -
atggaaactgataaattaga

SEQ ID NO: 182225 - DNA, 20 bp, Artificial Sequence
  Synthetic oligonucleotide; CAG chr2 60476851 60476870 60476854 -
gagagtgatttttcacatta

SEQ ID NO: 182226 - DNA, 20 bp, Artificial Sequence
  Synthetic oligonucleotide; AAG chr2 60476847 60476866 60476850 -
gtgatttttcacattacaga

SEQ ID NO: 182227 - DNA, 20 bp, Artificial Sequence
  Synthetic oligonucleotide; AAG chr2 60476828 60476847 60476831 -
aaagattgttaacttttcaa

SEQ ID NO: 182228 - DNA, 20 bp, Artificial Sequence
  Synthetic oligonucleotide; AGG chr2 60476827 60476846 60476830 -
aagattgttaacttttcaaa

SEQ ID NO: 182229 - DNA, 20 bp, Artificial Sequence
  Synthetic oligonucleotide; CAG chr2 60476816 60476835 60476819 -
cttttcaaaaggtttcacca

SEQ ID NO: 182230 - DNA, 20 bp, Artificial Sequence
  Synthetic oligonucleotide; AGG chr2 60476815 60476834 60476818 -
ttttcaaaaggtttcaccac

SEQ ID NO: 182231 - DNA, 20 bp, Artificial Sequence
  Synthetic oligonucleotide; GGG chr2 60476814 60476833 60476817 -
tttcaaaaggtttcaccaca

SEQ ID NO: 182232 - DNA, 20 bp, Artificial Sequence
  Synthetic oligonucleotide; TAG chr2 60476801 60476820 60476804 -
caccacagggtttctttaaa

SEQ ID NO: 182233 - DNA, 20 bp, Artificial Sequence
  Synthetic oligonucleotide; GAG chr2 60476797 60476816 60476800 -
acagggtttctttaaatagt

SEQ ID NO: 182234 - DNA, 20 bp, Artificial Sequence
  Synthetic oligonucleotide; AAG chr2 60476777 60476796 60476780 -
gagctcccccactgaattta

SEQ ID NO: 182235 - DNA, 20 bp, Artificial Sequence
  Synthetic oligonucleotide; CAG chr2 60476764 60476783 60476767 -
gaatttaaagtgtttgttta

SEQ ID NO: 182236 - DNA, 20 bp, Artificial Sequence
  Synthetic oligonucleotide; CAG chr2 60476745 60476764 60476748 -
acagatcattaactacttga

SEQ ID NO: 182237 - DNA, 20 bp, Artificial Sequence
  Synthetic oligonucleotide; GAG chr2 60476743 60476762 60476746 -
agatcattaactacttgaca

SEQ ID NO: 182238 - DNA, 20 bp, Artificial Sequence
  Synthetic oligonucleotide; GAG chr2 60476741 60476760 60476744 -
atcattaactacttgacaga

SEQ ID NO: 182239 - DNA, 20 bp, Artificial Sequence
  Synthetic oligonucleotide; AGG chr2 60476740 60476759 60476743 -
tcattaactacttgacagag

SEQ ID NO: 182240 - DNA, 20 bp, Artificial Sequence
  Synthetic oligonucleotide; TGG chr2 60476733 60476752 60476736 -
ctacttgacagagaggatat

SEQ ID NO: 182241 - DNA, 20 bp, Artificial Sequence
  Synthetic oligonucleotide; GGG chr2 60476732 60476751 60476735 -
tacttgacagagaggatatt

SEQ ID NO: 182242 - DNA, 20 bp, Artificial Sequence
  Synthetic oligonucleotide; GGG chr2 60476731 60476750 60476734 -
acttgacagagaggatattg

SEQ ID NO: 182243 - DNA, 20 bp, Artificial Sequence
  Synthetic oligonucleotide; GGG chr2 60476730 60476749 60476733 -
cttgacagagaggatattgg

SEQ ID NO: 182244 - DNA, 20 bp, Artificial Sequence
  Synthetic oligonucleotide; TGG chr2 60476726 60476745 60476729 -
acagagaggatattgggggt

SEQ ID NO: 182245 - DNA, 20 bp, Artificial Sequence
  Synthetic oligonucleotide; GGG chr2 60476725 60476744 60476728 -
cagagaggatattgggggtt

SEQ ID NO: 182246 - DNA, 20 bp, Artificial Sequence
  Synthetic oligonucleotide; GGG chr2 60476724 60476743 60476727 -
agagaggatattgggggttg

SEQ ID NO: 182247 - DNA, 20 bp, Artificial Sequence
  Synthetic oligonucleotide; GGG chr2 60476723 60476742 60476726 -
gagaggatattgggggttgg

SEQ ID NO: 182248 - DNA, 20 bp, Artificial Sequence
  Synthetic oligonucleotide; AAG chr2 60476720 60476739 60476723 -
aggatattgggggttggggg

SEQ ID NO: 182249 - DNA, 20 bp, Artificial Sequence
  Synthetic oligonucleotide; AGG chr2 60476719 60476738 60476722 -
ggatattgggggttggggga

SEQ ID NO: 182250 - DNA, 20 bp, Artificial Sequence
  Synthetic oligonucleotide; AAG chr2 60476716 60476735 60476719 -
tattgggggttgggggaagg

SEQ ID NO: 182251 - DNA, 20 bp, Artificial Sequence
  Synthetic oligonucleotide; AAG chr2 60476703 60476722 60476706 -
gggaaggaagacacacttaa

SEQ ID NO: 182252 - DNA, 20 bp, Artificial Sequence
  Synthetic oligonucleotide; AGG chr2 60476702 60476721 60476705 -
ggaaggaagacacacttaaa

SEQ ID NO: 182253 - DNA, 20 bp, Artificial Sequence
  Synthetic oligonucleotide; TAG chr2 60476691 60476710 60476694 -
acacttaaaaggtaaaatgt

SEQ ID NO: 182254 - DNA, 20 bp, Artificial Sequence
  Synthetic oligonucleotide; AAG chr2 60476688 60476707 60476691 -
cttaaaaggtaaaatgttag

SEQ ID NO: 182255 - DNA, 20 bp, Artificial Sequence
  Synthetic oligonucleotide; GAG chr2 60476668 60476687 60476671 -
aagccctgccaattttcaat

SEQ ID NO: 182256 - DNA, 20 bp, Artificial Sequence
  Synthetic oligonucleotide; TGG chr2 60476663 60476682 60476666 -
ctgccaattttcaatgagcc

SEQ ID NO: 182257 - DNA, 20 bp, Artificial Sequence
  Synthetic oligonucleotide; AAG chr2 60476660 60476679 60476663 -
ccaattttcaatgagcctgg

SEQ ID NO: 182258 - DNA, 20 bp, Artificial Sequence
  Synthetic oligonucleotide; AGG chr2 60476659 60476678 60476662 -
caattttcaatgagcctgga

SEQ ID NO: 182259 - DNA, 20 bp, Artificial Sequence
  Synthetic oligonucleotide; GGG chr2 60476658 60476677 60476661 -
aattttcaatgagcctggaa

SEQ ID NO: 182260 - DNA, 20 bp, Artificial Sequence
  Synthetic oligonucleotide; TGG chr2 60476630 60476649 60476633 -
aaacatctctgaaattatgt

SEQ ID NO: 182261 - DNA, 20 bp, Artificial Sequence
  Synthetic oligonucleotide; TAG chr2 60476626 60476645 60476629 -
atctctgaaattatgttggt

SEQ ID NO: 182262 - DNA, 20 bp, Artificial Sequence
  Synthetic oligonucleotide; CAG chr2 60476605 60476624 60476608 -
agcaaatatgatttatttta

SEQ ID NO: 182263 - DNA, 20 bp, Artificial Sequence
  Synthetic oligonucleotide; TGG chr2 60476586 60476605 60476589 -
acagaaattcattttacaca

SEQ ID NO: 182264 - DNA, 20 bp, Artificial Sequence
  Synthetic oligonucleotide; AAG chr2 60476577 60476596 60476580 -
cattttacacatggctttcc

SEQ ID NO: 182265 - DNA, 20 bp, Artificial Sequence
  Synthetic oligonucleotide; TGG chr2 60476559 60476578 60476562 -
ccaagaaccctccatgctga

SEQ ID NO: 182266 - DNA, 20 bp, Artificial Sequence
  Synthetic oligonucleotide; GGG chr2 60476558 60476577 60476561 -
caagaaccctccatgctgat

SEQ ID NO: 182267 - DNA, 20 bp, Artificial Sequence
  Synthetic oligonucleotide; GGG chr2 60476557 60476576 60476560 -
aagaaccctccatgctgatg

SEQ ID NO: 182268 - DNA, 20 bp, Artificial Sequence
  Synthetic oligonucleotide; TGG chr2 60476552 60476571 60476555 -
ccctccatgctgatggggtg

SEQ ID NO: 182269 - DNA, 20 bp, Artificial Sequence
  Synthetic oligonucleotide; TGG chr2 60476549 60476568 60476552 -
tccatgctgatggggtgtgg

SEQ ID NO: 182270 - DNA, 20 bp, Artificial Sequence
  Synthetic oligonucleotide; GGG chr2 60476548 60476567 60476551 -
ccatgctgatggggtgtggt

SEQ ID NO: 182271 - DNA, 20 bp, Artificial Sequence
  Synthetic oligonucleotide; GAG chr2 60476546 60476565 60476549 -
atgctgatggggtgtggtgg

SEQ ID NO: 182272 - DNA, 20 bp, Artificial Sequence
  Synthetic oligonucleotide; AGG chr2 60476545 60476564 60476548 -
tgctgatggggtgtggtggg

SEQ ID NO: 182273 - DNA, 20 bp, Artificial Sequence
  Synthetic oligonucleotide; AAG chr2 60476540 60476559 60476543 -
atggggtgtggtgggaggtc

SEQ ID NO: 182274 - DNA, 20 bp, Artificial Sequence
  Synthetic oligonucleotide; AGG chr2 60476539 60476558 60476542 -
tggggtgtggtgggaggtca

SEQ ID NO: 182275 - DNA, 20 bp, Artificial Sequence
  Synthetic oligonucleotide; CAG chr2 60476532 60476551 60476535 -
tggtgggaggtcaaggacca

SEQ ID NO: 182276 - DNA, 20 bp, Artificial Sequence
  Synthetic oligonucleotide; AGG chr2 60476531 60476550 60476534 -
ggtgggaggtcaaggaccac

SEQ ID NO: 182277 - DNA, 20 bp, Artificial Sequence
  Synthetic oligonucleotide; GGG chr2 60476530 60476549 60476533 -
gtgggaggtcaaggaccaca

SEQ ID NO: 182278 - DNA, 20 bp, Artificial Sequence
  Synthetic oligonucleotide; TGG chr2 60476524 60476543 60476527 -
ggtcaaggaccacagggtgc

SEQ ID NO: 182279 - DNA, 20 bp, Artificial Sequence
  Synthetic oligonucleotide; GGG chr2 60476523 60476542 60476526 -
gtcaaggaccacagggtgct

SEQ ID NO: 182280 - DNA, 20 bp, Artificial Sequence
  Synthetic oligonucleotide; TGG chr2 60476509 60476528 60476512 -
ggtgctgggctttgctgtcc

SEQ ID NO: 182281 - DNA, 20 bp, Artificial Sequence
  Synthetic oligonucleotide; TGG chr2 60476502 60476521 60476505 -
ggctttgctgtcctggtttg

SEQ ID NO: 182282 - DNA, 20 bp, Artificial Sequence
  Synthetic oligonucleotide; TGG chr2 60476499 60476518 60476502 -
tttgctgtcctggtttgtgg

SEQ ID NO: 182283 - DNA, 20 bp, Artificial Sequence
  Synthetic oligonucleotide; TGG chr2 60476495 60476514 60476498 -
ctgtcctggtttgtggtggc

SEQ ID NO: 182284 - DNA, 20 bp, Artificial Sequence
  Synthetic oligonucleotide; GGG chr2 60476494 60476513 60476497 -
tgtcctggtttgtggtggct

SEQ ID NO: 182285 - DNA, 20 bp, Artificial Sequence
  Synthetic oligonucleotide; GGG chr2 60476493 60476512 60476496 -
gtcctggtttgtggtggctg

SEQ ID NO: 182286 - DNA, 20 bp, Artificial Sequence
  Synthetic oligonucleotide; GAG chr2 60476491 60476510 60476494 -
cctggtttgtggtggctggg

SEQ ID NO: 182287 - DNA, 20 bp, Artificial Sequence
  Synthetic oligonucleotide; GAG chr2 60476489 60476508 60476492 -
tggtttgtggtggctgggga

SEQ ID NO: 182288 - DNA, 20 bp, Artificial Sequence
  Synthetic oligonucleotide; AGG chr2 60476488 60476507 60476491 -
ggtttgtggtggctggggag

SEQ ID NO: 182289 - DNA, 20 bp, Artificial Sequence
  Synthetic oligonucleotide; TAG chr2 60476473 60476492 60476476 -
gggagaggactcccttttct

SEQ ID NO: 182290 - DNA, 20 bp, Artificial Sequence
  Synthetic oligonucleotide; GAG chr2 60476471 60476490 60476474 -
gagaggactcccttttctta

SEQ ID NO: 182291 - DNA, 20 bp, Artificial Sequence
  Synthetic oligonucleotide; GAG chr2 60476450 60476469 60476453 -
agtcctgtgtgtgcctttgt

SEQ ID NO: 182292 - DNA, 20 bp, Artificial Sequence
  Synthetic oligonucleotide; TGG chr2 60476444 60476463 60476447 -
gtgtgtgcctttgtgagcaa

SEQ ID NO: 182293 - DNA, 20 bp, Artificial Sequence
  Synthetic oligonucleotide; GGG chr2 60476443 60476462 60476446 -
tgtgtgcctttgtgagcaat

SEQ ID NO: 182294 - DNA, 20 bp, Artificial Sequence
  Synthetic oligonucleotide; CAG chr2 60476437 60476456 60476440 -
cctttgtgagcaatgggtgc

SEQ ID NO: 182295 - DNA, 20 bp, Artificial Sequence
  Synthetic oligonucleotide; AGG chr2 60476436 60476455 60476439 -
ctttgtgagcaatgggtgcc

SEQ ID NO: 182296 - DNA, 20 bp, Artificial Sequence
  Synthetic oligonucleotide; TGG chr2 60476430 60476449 60476433 -
gagcaatgggtgccaggctc

SEQ ID NO: 182297 - DNA, 20 bp, Artificial Sequence
  Synthetic oligonucleotide; GAG chr2 60476424 60476443 60476427 -
tgggtgccaggctctggcat

SEQ ID NO: 182298 - DNA, 20 bp, Artificial Sequence
  Synthetic oligonucleotide; AGG chr2 60476423 60476442 60476426 -
gggtgccaggctctggcatg

SEQ ID NO: 182299 - DNA, 20 bp, Artificial Sequence
  Synthetic oligonucleotide; GAG chr2 60476418 60476437 60476421 -
ccaggctctggcatgaggcc

SEQ ID NO: 182300 - DNA, 20 bp, Artificial Sequence
  Synthetic oligonucleotide; TGG chr2 60476406 60476425 60476409 -
atgaggccgagctttgctac

SEQ ID NO: 182301 - DNA, 20 bp, Artificial Sequence
  Synthetic oligonucleotide; TGG chr2 60476398 60476417 60476401 -
gagctttgctactggacttc

SEQ ID NO: 182302 - DNA, 20 bp, Artificial Sequence
  Synthetic oligonucleotide; GAG chr2 60476392 60476411 60476395 -
tgctactggacttctggcat

SEQ ID NO: 182303 - DNA, 20 bp, Artificial Sequence
  Synthetic oligonucleotide; GAG chr2 60476384 60476403 60476387 -
gacttctggcatgagccact

SEQ ID NO: 182304 - DNA, 20 bp, Artificial Sequence
  Synthetic oligonucleotide; TAG chr2 60476363 60476382 60476366 -
agaccttttcccttgacatt

SEQ ID NO: 182305 - DNA, 20 bp, Artificial Sequence
  Synthetic oligonucleotide; TGG chr2 60476358 60476377 60476361 -
ttttcccttgacatttagcc

SEQ ID NO: 182306 - DNA, 20 bp, Artificial Sequence
  Synthetic oligonucleotide; GGG chr2 60476357 60476376 60476360 -
tttcccttgacatttagcct

SEQ ID NO: 182307 - DNA, 20 bp, Artificial Sequence
  Synthetic oligonucleotide; TGG chr2 60476352 60476371 60476355 -
cttgacatttagcctgggtt

SEQ ID NO: 182308 - DNA, 20 bp, Artificial Sequence
  Synthetic oligonucleotide; GGG chr2 60476351 60476370 60476354 -
ttgacatttagcctgggttt

SEQ ID NO: 182309 - DNA, 20 bp, Artificial Sequence
  Synthetic oligonucleotide; GGG chr2 60476350 60476369 60476353 -
tgacatttagcctgggtttg

SEQ ID NO: 182310 - DNA, 20 bp, Artificial Sequence
  Synthetic oligonucleotide; AAG chr2 60476347 60476366 60476350 -
catttagcctgggtttgggg

SEQ ID NO: 182311 - DNA, 20 bp, Artificial Sequence
  Synthetic oligonucleotide; TGG chr2 60476336 60476355 60476339 -
ggtttggggaagtttcttcc

SEQ ID NO: 182312 - DNA, 20 bp, Artificial Sequence
  Synthetic oligonucleotide; CAG chr2 60476321 60476340 60476324 -
cttcctggttctctgacctt

SEQ ID NO: 182313 - DNA, 20 bp, Artificial Sequence
  Synthetic oligonucleotide; TGG chr2 60476312 60476331 60476315 -
tctctgaccttcagtctcat

SEQ ID NO: 182314 - DNA, 20 bp, Artificial Sequence
  Synthetic oligonucleotide; CAG chr2 60476307 60476326 60476310 -
gaccttcagtctcattggct

SEQ ID NO: 182315 - DNA, 20 bp, Artificial Sequence
  Synthetic oligonucleotide; AGG chr2 60476306 60476325 60476309 -
accttcagtctcattggctc

SEQ ID NO: 182316 - DNA, 20 bp, Artificial Sequence
  Synthetic oligonucleotide; TAG chr2 60476296 60476315 60476299 -
tcattggctcaggacacacc

SEQ ID NO: 182317 - DNA, 20 bp, Artificial Sequence
  Synthetic oligonucleotide; AGG chr2 60476295 60476314 60476298 -
cattggctcaggacacacct

SEQ ID NO: 182318 - DNA, 20 bp, Artificial Sequence
  Synthetic oligonucleotide; AAG chr2 60476281 60476300 60476284 -
acacctaggtttcctccttg

SEQ ID NO: 182319 - DNA, 20 bp, Artificial Sequence
  Synthetic oligonucleotide; CAG chr2 60476276 60476295 60476279 -
taggtttcctccttgaagct

SEQ ID NO: 182320 - DNA, 20 bp, Artificial Sequence
  Synthetic oligonucleotide; AAG chr2 60476258 60476277 60476261 -
ctcagacatgtaaactttgc

SEQ ID NO: 182321 - DNA, 20 bp, Artificial Sequence
  Synthetic oligonucleotide; CAG chr2 60476246 60476265 60476249 -
aactttgcaagactgtgtcc

SEQ ID NO: 182322 - DNA, 20 bp, Artificial Sequence
  Synthetic oligonucleotide; AGG chr2 60476245 60476264 60476248 -
actttgcaagactgtgtccc

SEQ ID NO: 182323 - DNA, 20 bp, Artificial Sequence
  Synthetic oligonucleotide; GAG chr2 60476243 60476262 60476246 -
tttgcaagactgtgtcccag

SEQ ID NO: 182324 - DNA, 20 bp, Artificial Sequence
  Synthetic oligonucleotide; AGG chr2 60476242 60476261 60476245 -
ttgcaagactgtgtcccagg

SEQ ID NO: 182325 - DNA, 20 bp, Artificial Sequence
  Synthetic oligonucleotide; CAG chr2 60476225 60476244 60476228 -
aggaggttgaaatccatcat

SEQ ID NO: 182326 - DNA, 20 bp, Artificial Sequence
  Synthetic oligonucleotide; AGG chr2 60476224 60476243 60476227 -
ggaggttgaaatccatcatc

SEQ ID NO: 182327 - DNA, 20 bp, Artificial Sequence
  Synthetic oligonucleotide; AAG chr2 60476211 60476230 60476214 -
catcatcaggctcactctct

SEQ ID NO: 182328 - DNA, 20 bp, Artificial Sequence
  Synthetic oligonucleotide; AAG chr2 60476205 60476224 60476208 -
caggctcactctctaagcct

SEQ ID NO: 182329 - DNA, 20 bp, Artificial Sequence
  Synthetic oligonucleotide; AGG chr2 60476204 60476223 60476207 -
aggctcactctctaagccta

SEQ ID NO: 182330 - DNA, 20 bp, Artificial Sequence
  Synthetic oligonucleotide; TAG chr2 60476199 60476218 60476202 -
cactctctaagcctaaggat

SEQ ID NO: 182331 - DNA, 20 bp, Artificial Sequence
  Synthetic oligonucleotide; TGG chr2 60476194 60476213 60476197 -
tctaagcctaaggattagcc

SEQ ID NO: 182332 - DNA, 20 bp, Artificial Sequence
  Synthetic oligonucleotide; GGG chr2 60476193 60476212 60476196 -
ctaagcctaaggattagcct

SEQ ID NO: 182333 - DNA, 20 bp, Artificial Sequence
  Synthetic oligonucleotide; GGG chr2 60476192 60476211 60476195 -
taagcctaaggattagcctg

SEQ ID NO: 182334 - DNA, 20 bp, Artificial Sequence
  Synthetic oligonucleotide; AAG chr2 60476186 60476205 60476189 -
taaggattagcctggggacc

SEQ ID NO: 182335 - DNA, 20 bp, Artificial Sequence
  Synthetic oligonucleotide; CAG chr2 60476181 60476200 60476184 -
attagcctggggaccaagcc

SEQ ID NO: 182336 - DNA, 20 bp, Artificial Sequence
  Synthetic oligonucleotide; AAG chr2 60476162 60476181 60476165 -
ccagccctgaactctcctat

SEQ ID NO: 182337 - DNA, 20 bp, Artificial Sequence
  Synthetic oligonucleotide; AGG chr2 60476161 60476180 60476164 -
cagccctgaactctcctata

SEQ ID NO: 182338 - DNA, 20 bp, Artificial Sequence
  Synthetic oligonucleotide; CAG chr2 60476147 60476166 60476150 -
cctataaggccctcctcatc

SEQ ID NO: 182339 - DNA, 20 bp, Artificial Sequence
  Synthetic oligonucleotide; AGG chr2 60476146 60476165 60476149 -
ctataaggccctcctcatcc

SEQ ID NO: 182340 - DNA, 20 bp, Artificial Sequence
  Synthetic oligonucleotide; AAG chr2 60476141 60476160 60476144 -
aggccctcctcatccaggtc

SEQ ID NO: 182341 - DNA, 20 bp, Artificial Sequence
  Synthetic oligonucleotide; AGG chr2 60476140 60476159 60476143 -
ggccctcctcatccaggtca

SEQ ID NO: 182342 - DNA, 20 bp, Artificial Sequence
  Synthetic oligonucleotide; GAG chr2 60476133 60476152 60476136 -
ctcatccaggtcaaggtcat

SEQ ID NO: 182343 - DNA, 20 bp, Artificial Sequence
  Synthetic oligonucleotide; AGG chr2 60476132 60476151 60476135 -
tcatccaggtcaaggtcatg

SEQ ID NO: 182344 - DNA, 20 bp, Artificial Sequence
  Synthetic oligonucleotide; GGG chr2 60476131 60476150 60476134 -
catccaggtcaaggtcatga

SEQ ID NO: 182345 - DNA, 20 bp, Artificial Sequence
  Synthetic oligonucleotide; GGG chr2 60476130 60476149 60476133 -
atccaggtcaaggtcatgag

SEQ ID NO: 182346 - DNA, 20 bp, Artificial Sequence
  Synthetic oligonucleotide; CAG chr2 60476125 60476144 60476128 -
ggtcaaggtcatgaggggaa

SEQ ID NO: 182347 - DNA, 20 bp, Artificial Sequence
  Synthetic oligonucleotide; AGG chr2 60476124 60476143 60476127 -
gtcaaggtcatgaggggaac

SEQ ID NO: 182348 - DNA, 20 bp, Artificial Sequence
  Synthetic oligonucleotide; TGG chr2 60476114 60476133 60476117 -
tgaggggaacaggtgtatcc

SEQ ID NO: 182349 - DNA, 20 bp, Artificial Sequence
  Synthetic oligonucleotide; CAG chr2 60476110 60476129 60476113 -
gggaacaggtgtatcctggc

SEQ ID NO: 182350 - DNA, 20 bp, Artificial Sequence
  Synthetic oligonucleotide; TAG chr2 60476103 60476122 60476106 -
ggtgtatcctggccagcttc

SEQ ID NO: 182351 - DNA, 20 bp, Artificial Sequence
  Synthetic oligonucleotide; CGG chr2 60476098 60476117 60476101 -
atcctggccagcttctagca

SEQ ID NO: 182352 - DNA, 20 bp, Artificial Sequence
  Synthetic oligonucleotide; TAG chr2 60476091 60476110 60476094 -
ccagcttctagcacggccta

SEQ ID NO: 182353 - DNA, 20 bp, Artificial Sequence
  Synthetic oligonucleotide; TAG chr2 60476088 60476107 60476091 -
gcttctagcacggcctatag

SEQ ID NO: 182354 - DNA, 20 bp, Artificial Sequence
  Synthetic oligonucleotide; AGG chr2 60476087 60476106 60476090 -
cttctagcacggcctatagt

SEQ ID NO: 182355 - DNA, 20 bp, Artificial Sequence
  Synthetic oligonucleotide; TGG chr2 60476079 60476098 60476082 -
acggcctatagtaggtctct

SEQ ID NO: 182356 - DNA, 20 bp, Artificial Sequence
  Synthetic oligonucleotide; TGG chr2 60476075 60476094 60476078 -
cctatagtaggtctcttggt

SEQ ID NO: 182357 - DNA, 20 bp, Artificial Sequence
  Synthetic oligonucleotide; AAG chr2 60476068 60476087 60476071 -
taggtctcttggttggtcca

SEQ ID NO: 182358 - DNA, 20 bp, Artificial Sequence
  Synthetic oligonucleotide; AGG chr2 60476067 60476086 60476070 -
aggtctcttggttggtccaa

SEQ ID NO: 182359 - DNA, 20 bp, Artificial Sequence
  Synthetic oligonucleotide; GAG chr2 60476065 60476084 60476068 -
gtctcttggttggtccaaag

SEQ ID NO: 182360 - DNA, 20 bp, Artificial Sequence
  Synthetic oligonucleotide; AGG chr2 60476064 60476083 60476067 -
tctcttggttggtccaaagg

SEQ ID NO: 182361 - DNA, 20 bp, Artificial Sequence
  Synthetic oligonucleotide; TGG chr2 60476059 60476078 60476062 -
tggttggtccaaaggaggcc

SEQ ID NO: 182362 - DNA, 20 bp, Artificial Sequence
  Synthetic oligonucleotide; TGG chr2 60476049 60476068 60476052 -
aaaggaggcctggacttgca

SEQ ID NO: 182363 - DNA, 20 bp, Artificial Sequence
  Synthetic oligonucleotide; GGG chr2 60476048 60476067 60476051 -
aaggaggcctggacttgcat

SEQ ID NO: 182364 - DNA, 20 bp, Artificial Sequence
  Synthetic oligonucleotide; GAG chr2 60476046 60476065 60476049 -
ggaggcctggacttgcatgg

SEQ ID NO: 182365 - DNA, 20 bp, Artificial Sequence
  Synthetic oligonucleotide; AGG chr2 60476045 60476064 60476048 -
gaggcctggacttgcatggg

SEQ ID NO: 182366 - DNA, 20 bp, Artificial Sequence
  Synthetic oligonucleotide; CAG chr2 60476042 60476061 60476045 -
gcctggacttgcatgggagg

SEQ ID NO: 182367 - DNA, 20 bp, Artificial Sequence
  Synthetic oligonucleotide; AGG chr2 60476041 60476060 60476044 -
cctggacttgcatgggaggc

SEQ ID NO: 182368 - DNA, 20 bp, Artificial Sequence
  Synthetic oligonucleotide; GAG chr2 60476039 60476058 60476042 -
tggacttgcatgggaggcag

SEQ ID NO: 182369 - DNA, 20 bp, Artificial Sequence
  Synthetic oligonucleotide; GAG chr2 60476037 60476056 60476040 -
gacttgcatgggaggcagga

SEQ ID NO: 182370 - DNA, 20 bp, Artificial Sequence
  Synthetic oligonucleotide; GAG chr2 60476035 60476054 60476038 -
cttgcatgggaggcaggaga

SEQ ID NO: 182371 - DNA, 20 bp, Artificial Sequence
  Synthetic oligonucleotide; AAG chr2 60476032 60476051 60476035 -
gcatgggaggcaggagagag

SEQ ID NO: 182372 - DNA, 20 bp, Artificial Sequence
  Synthetic oligonucleotide; CAG chr2 60476014 60476033 60476017 -
agaagccaccccatctaatc

SEQ ID NO: 182373 - DNA, 20 bp, Artificial Sequence
  Synthetic oligonucleotide; AAG chr2 60475998 60476017 60476001 -
aatccagtcttctcctttta

SEQ ID NO: 182374 - DNA, 20 bp, Artificial Sequence
  Synthetic oligonucleotide; TGG chr2 60475994 60476013 60475997 -
cagtcttctccttttaaaga

SEQ ID NO: 182375 - DNA, 20 bp, Artificial Sequence
  Synthetic oligonucleotide; TAG chr2 60475984 60476003 60475987 -
cttttaaagatggaaacact

SEQ ID NO: 182376 - DNA, 20 bp, Artificial Sequence
  Synthetic oligonucleotide; AGG chr2 60475983 60476002 60475986 -
ttttaaagatggaaacactt

SEQ ID NO: 182377 - DNA, 20 bp, Artificial Sequence
  Synthetic oligonucleotide; GGG chr2 60475982 60476001 60475985 -
tttaaagatggaaacactta

SEQ ID NO: 182378 - DNA, 20 bp, Artificial Sequence
  Synthetic oligonucleotide; CAG chr2 60475978 60475997 60475981 -
aagatggaaacacttagggc

SEQ ID NO: 182379 - DNA, 20 bp, Artificial Sequence
  Synthetic oligonucleotide; AAG chr2 60475974 60475993 60475977 -
tggaaacacttagggccaga

SEQ ID NO: 182380 - DNA, 20 bp, Artificial Sequence
  Synthetic oligonucleotide; AAG chr2 60475970 60475989 60475973 -
aacacttagggccagaaaga

SEQ ID NO: 182381 - DNA, 20 bp, Artificial Sequence
  Synthetic oligonucleotide; AGG chr2 60475969 60475988 60475972 -
acacttagggccagaaagaa

SEQ ID NO: 182382 - DNA, 20 bp, Artificial Sequence
  Synthetic oligonucleotide; AAG chr2 60475957 60475976 60475960 -
agaaagaaaggatttattca

SEQ ID NO: 182383 - DNA, 20 bp, Artificial Sequence
  Synthetic oligonucleotide; CAG chr2 60475946 60475965 60475949 -
atttattcaaagtcacgaaa

SEQ ID NO: 182384 - DNA, 20 bp, Artificial Sequence
  Synthetic oligonucleotide; TGG chr2 60475942 60475961 60475945 -
attcaaagtcacgaaacagc

SEQ ID NO: 182385 - DNA, 20 bp, Artificial Sequence
  Synthetic oligonucleotide; GAG chr2 60475938 60475957 60475941 -
aaagtcacgaaacagctggt

SEQ ID NO: 182386 - DNA, 20 bp, Artificial Sequence
  Synthetic oligonucleotide; TGG chr2 60475935 60475954 60475938 -
gtcacgaaacagctggtgag

SEQ ID NO: 182387 - DNA, 20 bp, Artificial Sequence
  Synthetic oligonucleotide; CAG chr2 60475932 60475951 60475935 -
acgaaacagctggtgagtgg

SEQ ID NO: 182388 - DNA, 20 bp, Artificial Sequence
  Synthetic oligonucleotide; GAG chr2 60475930 60475949 60475933 -
gaaacagctggtgagtggca

SEQ ID NO: 182389 - DNA, 20 bp, Artificial Sequence
  Synthetic oligonucleotide; TGG chr2 60475926 60475945 60475929 -
cagctggtgagtggcagagt

SEQ ID NO: 182390 - DNA, 20 bp, Artificial Sequence
  Synthetic oligonucleotide; GGG chr2 60475925 60475944 60475928 -
agctggtgagtggcagagtt

SEQ ID NO: 182391 - DNA, 20 bp, Artificial Sequence
  Synthetic oligonucleotide; GGG chr2 60475924 60475943 60475927 -
gctggtgagtggcagagttg

SEQ ID NO: 182392 - DNA, 20 bp, Artificial Sequence
  Synthetic oligonucleotide; CAG chr2 60475918 60475937 60475921 -
gagtggcagagttggggttg

SEQ ID NO: 182393 - DNA, 20 bp, Artificial Sequence
  Synthetic oligonucleotide; TAG chr2 60475911 60475930 60475914 -
agagttggggttgcagaact

SEQ ID NO: 182394 - DNA, 20 bp, Artificial Sequence
  Synthetic oligonucleotide; AGG chr2 60475910 60475929 60475913 -
gagttggggttgcagaactt

SEQ ID NO: 182395 - DNA, 20 bp, Artificial Sequence
  Synthetic oligonucleotide; TAG chr2 60475892 60475911 60475895 -
ttaggttcctgactttcctc

SEQ ID NO: 182396 - DNA, 20 bp, Artificial Sequence
  Synthetic oligonucleotide; CAG chr2 60475889 60475908 60475892 -
ggttcctgactttcctctag

SEQ ID NO: 182397 - DNA, 20 bp, Artificial Sequence
  Synthetic oligonucleotide; CAG chr2 60475880 60475899 60475883 -
ctttcctctagcagtctctc

SEQ ID NO: 182398 - DNA, 20 bp, Artificial Sequence
  Synthetic oligonucleotide; GAG chr2 60475878 60475897 60475881 -
ttcctctagcagtctctcca

SEQ ID NO: 182399 - DNA, 20 bp, Artificial Sequence
  Synthetic oligonucleotide; AGG chr2 60475877 60475896 60475880 -
tcctctagcagtctctccag

SEQ ID NO: 182400 - DNA, 20 bp, Artificial Sequence
  Synthetic oligonucleotide; AAG chr2 60475871 60475890 60475874 -
agcagtctctccagaggaac

SEQ ID NO: 182401 - DNA, 20 bp, Artificial Sequence
  Synthetic oligonucleotide; AAG chr2 60475855 60475874 60475858 -
gaacaagtccctgcttccta

SEQ ID NO: 182402 - DNA, 20 bp, Artificial Sequence
  Synthetic oligonucleotide; AGG chr2 60475854 60475873 60475857 -
aacaagtccctgcttcctaa

SEQ ID NO: 182403 - DNA, 20 bp, Artificial Sequence
  Synthetic oligonucleotide; AAG chr2 60475851 60475870 60475854 -
aagtccctgcttcctaaagg

SEQ ID NO: 182404 - DNA, 20 bp, Artificial Sequence
  Synthetic oligonucleotide; AAG chr2 60475846 60475865 60475849 -
cctgcttcctaaaggaagaa

SEQ ID NO: 182405 - DNA, 20 bp, Artificial Sequence
  Synthetic oligonucleotide; CGG chr2 60475839 60475858 60475842 -
cctaaaggaagaaaagaatc

SEQ ID NO: 182406 - DNA, 20 bp, Artificial Sequence
  Synthetic oligonucleotide; GGG chr2 60475838 60475857 60475841 -
ctaaaggaagaaaagaatcc

SEQ ID NO: 182407 - DNA, 20 bp, Artificial Sequence
  Synthetic oligonucleotide; GGG chr2 60475837 60475856 60475840 -
taaaggaagaaaagaatccg

SEQ ID NO: 182408 - DNA, 20 bp, Artificial Sequence
  Synthetic oligonucleotide; GAG chr2 60475835 60475854 60475838 -
aaggaagaaaagaatccggg

SEQ ID NO: 182409 - DNA, 20 bp, Artificial Sequence
  Synthetic oligonucleotide; TGG chr2 60475832 60475851 60475835 -
gaagaaaagaatccggggag

SEQ ID NO: 182410 - DNA, 20 bp, Artificial Sequence
  Synthetic oligonucleotide; TGG chr2 60475829 60475848 60475832 -
gaaaagaatccggggagtgg

SEQ ID NO: 182411 - DNA, 20 bp, Artificial Sequence
  Synthetic oligonucleotide; CAG chr2 60475826 60475845 60475829 -
aagaatccggggagtggtgg

SEQ ID NO: 182412 - DNA, 20 bp, Artificial Sequence
  Synthetic oligonucleotide; TGG chr2 60475823 60475842 60475826 -
aatccggggagtggtggcag

SEQ ID NO: 182413 - DNA, 20 bp, Artificial Sequence
  Synthetic oligonucleotide; GGG chr2 60475822 60475841 60475825 -
atccggggagtggtggcagt

SEQ ID NO: 182414 - DNA, 20 bp, Artificial Sequence
  Synthetic oligonucleotide; TAG chr2 60475813 60475832 60475816 -
gtggtggcagtgggaataca

SEQ ID NO: 182415 - DNA, 20 bp, Artificial Sequence
  Synthetic oligonucleotide; GAG chr2 60475811 60475830 60475814 -
ggtggcagtgggaatacata

SEQ ID NO: 182416 - DNA, 20 bp, Artificial Sequence
  Synthetic oligonucleotide; AAG chr2 60475807 60475826 60475810 -
gcagtgggaatacatagagc

SEQ ID NO: 182417 - DNA, 20 bp, Artificial Sequence
  Synthetic oligonucleotide; AGG chr2 60475806 60475825 60475809 -
cagtgggaatacatagagca

SEQ ID NO: 182418 - DNA, 20 bp, Artificial Sequence
  Synthetic oligonucleotide; GGG chr2 60475805 60475824 60475808 -
agtgggaatacatagagcaa

SEQ ID NO: 182419 - DNA, 20 bp, Artificial Sequence
  Synthetic oligonucleotide; AAG chr2 60475793 60475812 60475796 -
tagagcaagggcatctctga

SEQ ID NO: 182420 - DNA, 20 bp, Artificial Sequence
  Synthetic oligonucleotide; TAG chr2 60475790 60475809 60475793 -
agcaagggcatctctgaaag

SEQ ID NO: 182421 - DNA, 20 bp, Artificial Sequence
  Synthetic oligonucleotide; CGG chr2 60475762 60475781 60475765 -
aaataacctgataaatacct

SEQ ID NO: 182422 - DNA, 20 bp, Artificial Sequence
  Synthetic oligonucleotide; TAG chr2 60475758 60475777 60475761 -
aacctgataaatacctcgga

SEQ ID NO: 182423 - DNA, 20 bp, Artificial Sequence
  Synthetic oligonucleotide; GAG chr2 60475756 60475775 60475759 -
cctgataaatacctcggata

SEQ ID NO: 182424 - DNA, 20 bp, Artificial Sequence
  Synthetic oligonucleotide; AGG chr2 60475755 60475774 60475758 -
ctgataaatacctcggatag

SEQ ID NO: 182425 - DNA, 20 bp, Artificial Sequence
  Synthetic oligonucleotide; AAG chr2 60475751 60475770 60475754 -
taaatacctcggatagaggc

SEQ ID NO: 182426 - DNA, 20 bp, Artificial Sequence
  Synthetic oligonucleotide; AGG chr2 60475750 60475769 60475753 -
aaatacctcggatagaggca

SEQ ID NO: 182427 - DNA, 20 bp, Artificial Sequence
  Synthetic oligonucleotide; AAG chr2 60475712 60475731 60475715 -
tgcccccactacacacaaac

SEQ ID NO: 182428 - DNA, 20 bp, Artificial Sequence
  Synthetic oligonucleotide; CAG chr2 60475704 60475723 60475707 -
ctacacacaaacaagatcct

SEQ ID NO: 182429 - DNA, 20 bp, Artificial Sequence
  Synthetic oligonucleotide; GAG chr2 60475699 60475718 60475702 -
cacaaacaagatcctcagct

SEQ ID NO: 182430 - DNA, 20 bp, Artificial Sequence
  Synthetic oligonucleotide; AGG chr2 60475698 60475717 60475701 -
acaaacaagatcctcagctg

SEQ ID NO: 182431 - DNA, 20 bp, Artificial Sequence
  Synthetic oligonucleotide; CAG chr2 60475692 60475711 60475695 -
aagatcctcagctgaggact

SEQ ID NO: 182432 - DNA, 20 bp, Artificial Sequence
  Synthetic oligonucleotide; GAG chr2 60475690 60475709 60475693 -
gatcctcagctgaggactca

SEQ ID NO: 182433 - DNA, 20 bp, Artificial Sequence
  Synthetic oligonucleotide; CAG chr2 60475687 60475706 60475690 -
cctcagctgaggactcagag

SEQ ID NO: 182434 - DNA, 20 bp, Artificial Sequence
  Synthetic oligonucleotide; AGG chr2 60475686 60475705 60475689 -
ctcagctgaggactcagagc

SEQ ID NO: 182435 - DNA, 20 bp, Artificial Sequence
  Synthetic oligonucleotide; GAG chr2 60475684 60475703 60475687 -
cagctgaggactcagagcag

SEQ ID NO: 182436 - DNA, 20 bp, Artificial Sequence
  Synthetic oligonucleotide; AAG chr2 60475680 60475699 60475683 -
tgaggactcagagcaggagt

SEQ ID NO: 182437 - DNA, 20 bp, Artificial Sequence
  Synthetic oligonucleotide; AGG chr2 60475679 60475698 60475682 -
gaggactcagagcaggagta

SEQ ID NO: 182438 - DNA, 20 bp, Artificial Sequence
  Synthetic oligonucleotide; GGG chr2 60475678 60475697 60475681 -
aggactcagagcaggagtaa

SEQ ID NO: 182439 - DNA, 20 bp, Artificial Sequence
  Synthetic oligonucleotide; TGG chr2 60475658 60475677 60475661 -
gggcacccctatcctcccca

SEQ ID NO: 182440 - DNA, 20 bp, Artificial Sequence
  Synthetic oligonucleotide; AAG chr2 60475648 60475667 60475651 -
atcctccccatggctttgaa

SEQ ID NO: 182441 - DNA, 20 bp, Artificial Sequence
  Synthetic oligonucleotide; AAG chr2 60475645 60475664 60475648 -
ctccccatggctttgaaaag

SEQ ID NO: 182442 - DNA, 20 bp, Artificial Sequence
  Synthetic oligonucleotide; AAG chr2 60475641 60475660 60475644 -
ccatggctttgaaaagaaga

SEQ ID NO: 182443 - DNA, 20 bp, Artificial Sequence
  Synthetic oligonucleotide; GAG chr2 60475639 60475658 60475642 -
atggctttgaaaagaagaaa

SEQ ID NO: 182444 - DNA, 20 bp, Artificial Sequence
  Synthetic oligonucleotide; AGG chr2 60475638 60475657 60475641 -
tggctttgaaaagaagaaag

SEQ ID NO: 182445 - DNA, 20 bp, Artificial Sequence
  Synthetic oligonucleotide; GGG chr2 60475637 60475656 60475640 -
ggctttgaaaagaagaaaga

SEQ ID NO: 182446 - DNA, 20 bp, Artificial Sequence
  Synthetic oligonucleotide; GGG chr2 60475636 60475655 60475639 -
gctttgaaaagaagaaagag

SEQ ID NO: 182447 - DNA, 20 bp, Artificial Sequence
  Synthetic oligonucleotide; TGG chr2 60475628 60475647 60475631 -
aagaagaaagaggggaaatt

SEQ ID NO: 182448 - DNA, 20 bp, Artificial Sequence
  Synthetic oligonucleotide; GAG chr2 60475626 60475645 60475629 -
gaagaaagaggggaaatttg

SEQ ID NO: 182449 - DNA, 20 bp, Artificial Sequence
  Synthetic oligonucleotide; AGG chr2 60475625 60475644 60475628 -
aagaaagaggggaaatttgg

SEQ ID NO: 182450 - DNA, 20 bp, Artificial Sequence
  Synthetic oligonucleotide; GGG chr2 60475624 60475643 60475627 -
agaaagaggggaaatttgga

SEQ ID NO: 182451 - DNA, 20 bp, Artificial Sequence
  Synthetic oligonucleotide; TGG chr2 60475620 60475639 60475623 -
agaggggaaatttggaggga

SEQ ID NO: 182452 - DNA, 20 bp, Artificial Sequence
  Synthetic oligonucleotide; AAG chr2 60475615 60475634 60475618 -
ggaaatttggagggatggtc

SEQ ID NO: 182453 - DNA, 20 bp, Artificial Sequence
  Synthetic oligonucleotide; AAG chr2 60475602 60475621 60475605 -
gatggtcaagttgatgattg

SEQ ID NO: 182454 - DNA, 20 bp, Artificial Sequence
  Synthetic oligonucleotide; GAG chr2 60475600 60475619 60475603 -
tggtcaagttgatgattgaa

SEQ ID NO: 182455 - DNA, 20 bp, Artificial Sequence
  Synthetic oligonucleotide; AAG chr2 60475594 60475613 60475597 -
agttgatgattgaagagaca

SEQ ID NO: 182456 - DNA, 20 bp, Artificial Sequence
  Synthetic oligonucleotide; TAG chr2 60475591 60475610 60475594 -
tgatgattgaagagacaaag

SEQ ID NO: 182457 - DNA, 20 bp, Artificial Sequence
  Synthetic oligonucleotide; TAG chr2 60475586 60475605 60475589 -
attgaagagacaaagtagtg

SEQ ID NO: 182458 - DNA, 20 bp, Artificial Sequence
  Synthetic oligonucleotide; AGG chr2 60475585 60475604 60475588 -
ttgaagagacaaagtagtgt

SEQ ID NO: 182459 - DNA, 20 bp, Artificial Sequence
  Synthetic oligonucleotide; CAG chr2 60475561 60475580 60475564 -
aaatctcaatgtttcttgca

SEQ ID NO: 182460 - DNA, 20 bp, Artificial Sequence
  Synthetic oligonucleotide; CAG chr2 60475539 60475558 60475542 -
gtcatttgttgaaaatgtgt

SEQ ID NO: 182461 - DNA, 20 bp, Artificial Sequence
  Synthetic oligonucleotide; AAG chr2 60475535 60475554 60475538 -
tttgttgaaaatgtgtcagc

SEQ ID NO: 182462 - DNA, 20 bp, Artificial Sequence
  Synthetic oligonucleotide; AAG chr2 60475529 60475548 60475532 -
gaaaatgtgtcagcaagtac

SEQ ID NO: 182463 - DNA, 20 bp, Artificial Sequence
  Synthetic oligonucleotide; TGG chr2 60475514 60475533 60475517 -
agtacaagcccatcttaaac

SEQ ID NO: 182464 - DNA, 20 bp, Artificial Sequence
  Synthetic oligonucleotide; GAG chr2 60475507 60475526 60475510 -
gcccatcttaaactggcaat

SEQ ID NO: 182465 - DNA, 20 bp, Artificial Sequence
  Synthetic oligonucleotide; TAG chr2 60475494 60475513 60475497 -
tggcaatgagacatctgaaa

SEQ ID NO: 182466 - DNA, 20 bp, Artificial Sequence
  Synthetic oligonucleotide; AAG chr2 60475484 60475503 60475487 -
acatctgaaatagattattt

SEQ ID NO: 182467 - DNA, 20 bp, Artificial Sequence
  Synthetic oligonucleotide; CAG chr2 60475480 60475499 60475483 -
ctgaaatagattatttaagc

SEQ ID NO: 182468 - DNA, 20 bp, Artificial Sequence
  Synthetic oligonucleotide; AGG chr2 60475479 60475498 60475482 -
tgaaatagattatttaagcc

SEQ ID NO: 182469 - DNA, 20 bp, Artificial Sequence
  Synthetic oligonucleotide; GGG chr2 60475478 60475497 60475481 -
gaaatagattatttaagcca

SEQ ID NO: 182470 - DNA, 20 bp, Artificial Sequence
  Synthetic oligonucleotide; GAG chr2 60475476 60475495 60475479 -
aatagattatttaagccagg

SEQ ID NO: 182471 - DNA, 20 bp, Artificial Sequence
  Synthetic oligonucleotide; AGG chr2 60475475 60475494 60475478 -
atagattatttaagccaggg

SEQ ID NO: 182472 - DNA, 20 bp, Artificial Sequence
  Synthetic oligonucleotide; CAG chr2 60475472 60475491 60475475 -
gattatttaagccagggagg

SEQ ID NO: 182473 - DNA, 20 bp, Artificial Sequence
  Synthetic oligonucleotide; AAG chr2 60475463 60475482 60475466 -
agccagggaggcagtattgc

SEQ ID NO: 182474 - DNA, 20 bp, Artificial Sequence
  Synthetic oligonucleotide; AGG chr2 60475462 60475481 60475465 -
gccagggaggcagtattgca

SEQ ID NO: 182475 - DNA, 20 bp, Artificial Sequence
  Synthetic oligonucleotide; AAG chr2 60475459 60475478 60475462 -
agggaggcagtattgcaagg

SEQ ID NO: 182476 - DNA, 20 bp, Artificial Sequence
  Synthetic oligonucleotide; TGG chr2 60475452 60475471 60475455 -
cagtattgcaaggaagaaca

SEQ ID NO: 182477 - DNA, 20 bp, Artificial Sequence
  Synthetic oligonucleotide; CAG chr2 60475425 60475444 60475428 -
caacacttgtttgtctgact

SEQ ID NO: 182478 - DNA, 20 bp, Artificial Sequence
  Synthetic oligonucleotide; GAG chr2 60475423 60475442 60475426 -
acacttgtttgtctgactca

SEQ ID NO: 182479 - DNA, 20 bp, Artificial Sequence
  Synthetic oligonucleotide; AGG chr2 60475422 60475441 60475425 -
cacttgtttgtctgactcag

SEQ ID NO: 182480 - DNA, 20 bp, Artificial Sequence
  Synthetic oligonucleotide; TAG chr2 60475410 60475429 60475413 -
tgactcagaggaataaaaca

SEQ ID NO: 182481 - DNA, 20 bp, Artificial Sequence
  Synthetic oligonucleotide; TAG chr2 60475395 60475414 60475398 -
aaacatagtaaattttgcct

SEQ ID NO: 182482 - DNA, 20 bp, Artificial Sequence
  Synthetic oligonucleotide; CGG chr2 60475392 60475411 60475395 -
catagtaaattttgccttag

SEQ ID NO: 182483 - DNA, 20 bp, Artificial Sequence
  Synthetic oligonucleotide; GGG chr2 60475391 60475410 60475394 -
atagtaaattttgccttagc

SEQ ID NO: 182484 - DNA, 20 bp, Artificial Sequence
  Synthetic oligonucleotide; TGG chr2 60475374 60475393 60475377 -
agcgggccacccacattcat

SEQ ID NO: 182485 - DNA, 20 bp, Artificial Sequence
  Synthetic oligonucleotide; GGG chr2 60475373 60475392 60475376 -
gcgggccacccacattcatt

SEQ ID NO: 182486 - DNA, 20 bp, Artificial Sequence
  Synthetic oligonucleotide; GGG chr2 60475372 60475391 60475375 -
cgggccacccacattcattg

SEQ ID NO: 182487 - DNA, 20 bp, Artificial Sequence
  Synthetic oligonucleotide; GGG chr2 60475371 60475390 60475374 -
gggccacccacattcattgg

SEQ ID NO: 182488 - DNA, 20 bp, Artificial Sequence
  Synthetic oligonucleotide; AAG chr2 60475368 60475387 60475371 -
ccacccacattcattggggg

SEQ ID NO: 182489 - DNA, 20 bp, Artificial Sequence
  Synthetic oligonucleotide; GAG chr2 60475357 60475376 60475360 -
cattgggggaagaaacaatt

SEQ ID NO: 182490 - DNA, 20 bp, Artificial Sequence
  Synthetic oligonucleotide; AGG chr2 60475356 60475375 60475359 -
attgggggaagaaacaattg

SEQ ID NO: 182491 - DNA, 20 bp, Artificial Sequence
  Synthetic oligonucleotide; TGG chr2 60475353 60475372 60475356 -
gggggaagaaacaattgagg

SEQ ID NO: 182492 - DNA, 20 bp, Artificial Sequence
  Synthetic oligonucleotide; GGG chr2 60475352 60475371 60475355 -
ggggaagaaacaattgaggt

SEQ ID NO: 182493 - DNA, 20 bp, Artificial Sequence
  Synthetic oligonucleotide; GGG chr2 60475351 60475370 60475354 -
gggaagaaacaattgaggtg

SEQ ID NO: 182494 - DNA, 20 bp, Artificial Sequence
  Synthetic oligonucleotide; GGG chr2 60475350 60475369 60475353 -
ggaagaaacaattgaggtgg

SEQ ID NO: 182495 - DNA, 20 bp, Artificial Sequence
  Synthetic oligonucleotide; GGG chr2 60475349 60475368 60475352 -
gaagaaacaattgaggtggg

SEQ ID NO: 182496 - DNA, 20 bp, Artificial Sequence
  Synthetic oligonucleotide; CAG chr2 60475342 60475361 60475345 -
caattgaggtggggggaaaa

SEQ ID NO: 182497 - DNA, 20 bp, Artificial Sequence
  Synthetic oligonucleotide; CAG chr2 60475337 60475356 60475340 -
gaggtggggggaaaacagaa

SEQ ID NO: 182498 - DNA, 20 bp, Artificial Sequence
  Synthetic oligonucleotide; TGG chr2 60475323 60475342 60475326 -
acagaacagatgaaccttca

SEQ ID NO: 182499 - DNA, 20 bp, Artificial Sequence
  Synthetic oligonucleotide; GAG chr2 60475321 60475340 60475324 -
agaacagatgaaccttcatg

SEQ ID NO: 182500 - DNA, 20 bp, Artificial Sequence
  Synthetic oligonucleotide; AAG chr2 60475312 60475331 60475315 -
gaaccttcatggagtttcac

SEQ ID NO: 182501 - DNA, 20 bp, Artificial Sequence
  Synthetic oligonucleotide; GAG chr2 60475310 60475329 60475313 -
accttcatggagtttcacaa

SEQ ID NO: 182502 - DNA, 20 bp, Artificial Sequence
  Synthetic oligonucleotide; TGG chr2 60475301 60475320 60475304 -
gagtttcacaagagtccaca

SEQ ID NO: 182503 - DNA, 20 bp, Artificial Sequence
  Synthetic oligonucleotide; CAG chr2 60475282 60475301 60475285 -
atggttgtgtcccttatttt

SEQ ID NO: 182504 - DNA, 20 bp, Artificial Sequence
  Synthetic oligonucleotide; TGG chr2 60475267 60475286 60475270 -
attttcagaaaatgtgaaat

SEQ ID NO: 182505 - DNA, 20 bp, Artificial Sequence
  Synthetic oligonucleotide; AAG chr2 60475247 60475266 60475250 -
tggaaaatacgcacttgtga

SEQ ID NO: 182506 - DNA, 20 bp, Artificial Sequence
  Synthetic oligonucleotide; AAG chr2 60475241 60475260 60475244 -
atacgcacttgtgaaagctg

SEQ ID NO: 182507 - DNA, 20 bp, Artificial Sequence
  Synthetic oligonucleotide; CAG chr2 60475232 60475251 60475235 -
tgtgaaagctgaagatgtca

SEQ ID NO: 182508 - DNA, 20 bp, Artificial Sequence
  Synthetic oligonucleotide; CAG chr2 60475222 60475241 60475225 -
gaagatgtcacagaaatctt

SEQ ID NO: 182509 - DNA, 20 bp, Artificial Sequence
  Synthetic oligonucleotide; GAG chr2 60475220 60475239 60475223 -
agatgtcacagaaatcttca

SEQ ID NO: 182510 - DNA, 20 bp, Artificial Sequence
  Synthetic oligonucleotide; AGG chr2 60475219 60475238 60475222 -
gatgtcacagaaatcttcag

SEQ ID NO: 182511 - DNA, 20 bp, Artificial Sequence
  Synthetic oligonucleotide; TAG chr2 60475209 60475228 60475212 -
aaatcttcagaggatttatt

SEQ ID NO: 182512 - DNA, 20 bp, Artificial Sequence
  Synthetic oligonucleotide; TGG chr2 60475205 60475224 60475208 -
cttcagaggatttatttaga

SEQ ID NO: 182513 - DNA, 20 bp, Artificial Sequence
  Synthetic oligonucleotide; TGG chr2 60475182 60475201 60475185 -
tcgtatcctccgctgtcaac

SEQ ID NO: 182514 - DNA, 20 bp, Artificial Sequence
  Synthetic oligonucleotide; CAG chr2 60475173 60475192 60475176 -
ccgctgtcaactggatgaat

SEQ ID NO: 182515 - DNA, 20 bp, Artificial Sequence
  Synthetic oligonucleotide; TGG chr2 60475136 60475155 60475139 -
atgtgaatgtaaccgcctat

SEQ ID NO: 182516 - DNA, 20 bp, Artificial Sequence
  Synthetic oligonucleotide; GGG chr2 60475135 60475154 60475138 -
tgtgaatgtaaccgcctatt

SEQ ID NO: 182517 - DNA, 20 bp, Artificial Sequence
  Synthetic oligonucleotide; TGG chr2 60475109 60475128 60475112 -
catttactctgtgcccacct

SEQ ID NO: 182518 - DNA, 20 bp, Artificial Sequence
  Synthetic oligonucleotide; GGG chr2 60475108 60475127 60475111 -
atttactctgtgcccacctt

SEQ ID NO: 182519 - DNA, 20 bp, Artificial Sequence
  Synthetic oligonucleotide; AAG chr2 60475091 60475110 60475094 -
cttgggctttgcttctctct

SEQ ID NO: 182520 - DNA, 20 bp, Artificial Sequence
  Synthetic oligonucleotide; TAG chr2 60475061 60475080 60475064 -
acctgctttttctttttatc

SEQ ID NO: 182521 - DNA, 20 bp, Artificial Sequence
  Synthetic oligonucleotide; AGG chr2 60475060 60475079 60475063 -
cctgctttttctttttatct

SEQ ID NO: 182522 - DNA, 20 bp, Artificial Sequence
  Synthetic oligonucleotide; TGG chr2 60475044 60475063 60475047 -
atctaggatatcctttctct

SEQ ID NO: 182523 - DNA, 20 bp, Artificial Sequence
  Synthetic oligonucleotide; CAG chr2 60475036 60475055 60475039 -
tatcctttctcttggctctc

SEQ ID NO: 182524 - DNA, 20 bp, Artificial Sequence
  Synthetic oligonucleotide; AGG chr2 60475035 60475054 60475038 -
atcctttctcttggctctcc

SEQ ID NO: 182525 - DNA, 20 bp, Artificial Sequence
  Synthetic oligonucleotide; AAG chr2 60475022 60475041 60475025 -
gctctccaggtttaactcat

SEQ ID NO: 182526 - DNA, 20 bp, Artificial Sequence
  Synthetic oligonucleotide; AAG chr2 60475004 60475023 60475007 -
ataagttttcctctttccca

SEQ ID NO: 182527 - DNA, 20 bp, Artificial Sequence
  Synthetic oligonucleotide; TGG chr2 60474980 60474999 60474983 -
ctctctccctcccttccaaa

SEQ ID NO: 182528 - DNA, 20 bp, Artificial Sequence
  Synthetic oligonucleotide; TAG chr2 60474949 60474968 60474952 -
tctcttcctttgaatttcca

SEQ ID NO: 182529 - DNA, 20 bp, Artificial Sequence
  Synthetic oligonucleotide; CAG chr2 60474946 60474965 60474949 -
cttcctttgaatttccatag

SEQ ID NO: 182530 - DNA, 20 bp, Artificial Sequence
  Synthetic oligonucleotide; TGG chr2 60474908 60474927 60474911 -
ctcatgacacactttctaca

SEQ ID NO: 182531 - DNA, 20 bp, Artificial Sequence
  Synthetic oligonucleotide; GGG chr2 60474907 60474926 60474910 -
tcatgacacactttctacat

SEQ ID NO: 182532 - DNA, 20 bp, Artificial Sequence
  Synthetic oligonucleotide; GGG chr2 60474906 60474925 60474909 -
catgacacactttctacatg

SEQ ID NO: 182533 - DNA, 20 bp, Artificial Sequence
  Synthetic oligonucleotide; GGG chr2 60474905 60474924 60474908 -
atgacacactttctacatgg

SEQ ID NO: 182534 - DNA, 20 bp, Artificial Sequence
  Synthetic oligonucleotide; TAG chr2 60474902 60474921 60474905 -
acacactttctacatggggg

SEQ ID NO: 182535 - DNA, 20 bp, Artificial Sequence
  Synthetic oligonucleotide; GAG chr2 60474900 60474919 60474903 -
acactttctacatgggggta

SEQ ID NO: 182536 - DNA, 20 bp, Artificial Sequence
  Synthetic oligonucleotide; CAG chr2 60474886 60474905 60474889 -
ggggtagagcaatttctgtg

SEQ ID NO: 182537 - DNA, 20 bp, Artificial Sequence
  Synthetic oligonucleotide; AGG chr2 60474885 60474904 60474888 -
gggtagagcaatttctgtgc

SEQ ID NO: 182538 - DNA, 20 bp, Artificial Sequence
  Synthetic oligonucleotide; AAG chr2 60474861 60474880 60474864 -
cttaccttttctactaaatg

SEQ ID NO: 182539 - DNA, 20 bp, Artificial Sequence
  Synthetic oligonucleotide; TGG chr2 60474851 60474870 60474854 -
ctactaaatgaagcctgctg

SEQ ID NO: 182540 - DNA, 20 bp, Artificial Sequence
  Synthetic oligonucleotide; GGG chr2 60474850 60474869 60474853 -
tactaaatgaagcctgctgt

SEQ ID NO: 182541 - DNA, 20 bp, Artificial Sequence
  Synthetic oligonucleotide; GAG chr2 60474848 60474867 60474851 -
ctaaatgaagcctgctgtgg

SEQ ID NO: 182542 - DNA, 20 bp, Artificial Sequence
  Synthetic oligonucleotide; CAG chr2 60474812 60474831 60474815 -
tgttttctttgtactgccca

SEQ ID NO: 182543 - DNA, 20 bp, Artificial Sequence
  Synthetic oligonucleotide; CGG chr2 60474809 60474828 60474812 -
tttctttgtactgcccacag

SEQ ID NO: 182544 - DNA, 20 bp, Artificial Sequence
  Synthetic oligonucleotide; TAG chr2 60474805 60474824 60474808 -
tttgtactgcccacagcggc

SEQ ID NO: 182545 - DNA, 20 bp, Artificial Sequence
  Synthetic oligonucleotide; TGG chr2 60474792 60474811 60474795 -
cagcggctagcccattgctt

SEQ ID NO: 182546 - DNA, 20 bp, Artificial Sequence
  Synthetic oligonucleotide; GGG chr2 60474791 60474810 60474794 -
agcggctagcccattgcttt

SEQ ID NO: 182547 - DNA, 20 bp, Artificial Sequence
  Synthetic oligonucleotide; TAG chr2 60474783 60474802 60474786 -
gcccattgctttgggcattg

SEQ ID NO: 182548 - DNA, 20 bp, Artificial Sequence
  Synthetic oligonucleotide; AGG chr2 60474782 60474801 60474785 -
cccattgctttgggcattgt

SEQ ID NO: 182549 - DNA, 20 bp, Artificial Sequence
  Synthetic oligonucleotide; CGG chr2 60474775 60474794 60474778 -
ctttgggcattgtaggcact

SEQ ID NO: 182550 - DNA, 20 bp, Artificial Sequence
  Synthetic oligonucleotide; GAG chr2 60474748 60474767 60474751 -
tatttgttgaatgaatgcat

SEQ ID NO: 182551 - DNA, 20 bp, Artificial Sequence
  Synthetic oligonucleotide; GAG chr2 60474746 60474765 60474749 -
tttgttgaatgaatgcatga

SEQ ID NO: 182552 - DNA, 20 bp, Artificial Sequence
  Synthetic oligonucleotide; AGG chr2 60474745 60474764 60474748 -
ttgttgaatgaatgcatgag

SEQ ID NO: 182553 - DNA, 20 bp, Artificial Sequence
  Synthetic oligonucleotide; GAG chr2 60474728 60474747 60474731 -
gagaggttgaatgaatgcat

SEQ ID NO: 182554 - DNA, 20 bp, Artificial Sequence
  Synthetic oligonucleotide; GAG chr2 60474726 60474745 60474729 -
gaggttgaatgaatgcatga

SEQ ID NO: 182555 - DNA, 20 bp, Artificial Sequence
  Synthetic oligonucleotide; TGG chr2 60474713 60474732 60474716 -
tgcatgagagaatgaatgaa

SEQ ID NO: 182556 - DNA, 20 bp, Artificial Sequence
  Synthetic oligonucleotide; TGG chr2 60474701 60474720 60474704 -
tgaatgaatggaatttatcc

SEQ ID NO: 182557 - DNA, 20 bp, Artificial Sequence
  Synthetic oligonucleotide; GGG chr2 60474700 60474719 60474703 -
gaatgaatggaatttatcct

SEQ ID NO: 182558 - DNA, 20 bp, Artificial Sequence
  Synthetic oligonucleotide; TAG chr2 60474682 60474701 60474685 -
ctgggaacacacattttgca

SEQ ID NO: 182559 - DNA, 20 bp, Artificial Sequence
  Synthetic oligonucleotide; GAG chr2 60474678 60474697 60474681 -
gaacacacattttgcatagt

SEQ ID NO: 182560 - DNA, 20 bp, Artificial Sequence
  Synthetic oligonucleotide; AGG chr2 60474677 60474696 60474680 -
aacacacattttgcatagtg

SEQ ID NO: 182561 - DNA, 20 bp, Artificial Sequence
  Synthetic oligonucleotide; AAG chr2 60474641 60474660 60474644 -
aaacaaaaaaaaattgtcct

SEQ ID NO: 182562 - DNA, 20 bp, Artificial Sequence
  Synthetic oligonucleotide; CAG chr2 60474620 60474639 60474623 -
agacaatttgtctttttatg

SEQ ID NO: 182563 - DNA, 20 bp, Artificial Sequence
  Synthetic oligonucleotide; CAG chr2 60474608 60474627 60474611 -
tttttatgcagctgccctct

SEQ ID NO: 182564 - DNA, 20 bp, Artificial Sequence
  Synthetic oligonucleotide; TAG chr2 60474600 60474619 60474603 -
cagctgccctctcagtctcc

SEQ ID NO: 182565 - DNA, 20 bp, Artificial Sequence
  Synthetic oligonucleotide; AAG chr2 60474595 60474614 60474598 -
gccctctcagtctcctagat

SEQ ID NO: 182566 - DNA, 20 bp, Artificial Sequence
  Synthetic oligonucleotide; AAG chr2 60474580 60474599 60474583 -
tagataagttccgccattct

SEQ ID NO: 182567 - DNA, 20 bp, Artificial Sequence
  Synthetic oligonucleotide; AGG chr2 60474579 60474598 60474582 -
agataagttccgccattcta

SEQ ID NO: 182568 - DNA, 20 bp, Artificial Sequence
  Synthetic oligonucleotide; AAG chr2 60474573 60474592 60474576 -
gttccgccattctaaggcaa

SEQ ID NO: 182569 - DNA, 20 bp, Artificial Sequence
  Synthetic oligonucleotide; AAG chr2 60474566 60474585 60474569 -
cattctaaggcaaaagctta

SEQ ID NO: 182570 - DNA, 20 bp, Artificial Sequence
  Synthetic oligonucleotide; AAG chr2 60474534 60474553 60474537 -
aatttatctaattcacgatc

SEQ ID NO: 182571 - DNA, 20 bp, Artificial Sequence
  Synthetic oligonucleotide; TGG chr2 60474520 60474539 60474523 -
acgatcaagtgaaaatactt

SEQ ID NO: 182572 - DNA, 20 bp, Artificial Sequence
  Synthetic oligonucleotide; GGG chr2 60474519 60474538 60474522 -
cgatcaagtgaaaatacttt

SEQ ID NO: 182573 - DNA, 20 bp, Artificial Sequence
  Synthetic oligonucleotide; CAG chr2 60474514 60474533 60474517 -
aagtgaaaatactttgggcc

SEQ ID NO: 182574 - DNA, 20 bp, Artificial Sequence
  Synthetic oligonucleotide; GAG chr2 60474512 60474531 60474515 -
gtgaaaatactttgggccca

SEQ ID NO: 182575 - DNA, 20 bp, Artificial Sequence
  Synthetic oligonucleotide; AAG chr2 60474506 60474525 60474509 -
atactttgggcccagagcca

SEQ ID NO: 182576 - DNA, 20 bp, Artificial Sequence
  Synthetic oligonucleotide; TGG chr2 60474495 60474514 60474498 -
ccagagccaaagaatattat

SEQ ID NO: 182577 - DNA, 20 bp, Artificial Sequence
  Synthetic oligonucleotide; GAG chr2 60474493 60474512 60474496 -
agagccaaagaatattattg

SEQ ID NO: 182578 - DNA, 20 bp, Artificial Sequence
  Synthetic oligonucleotide; CAG chr2 60474461 60474480 60474464 -
tttaacaccctaaatttaac

SEQ ID NO: 182579 - DNA, 20 bp, Artificial Sequence
  Synthetic oligonucleotide; TGG chr2 60474457 60474476 60474460 -
acaccctaaatttaaccagc

SEQ ID NO: 182580 - DNA, 20 bp, Artificial Sequence
  Synthetic oligonucleotide; AAG chr2 60474442 60474461 60474445 -
ccagctggaattcttttttt

SEQ ID NO: 182581 - DNA, 20 bp, Artificial Sequence
  Synthetic oligonucleotide; AAG chr2 60474412 60474431 60474415 -
ctattcaaccttttgaaatg

SEQ ID NO: 182582 - DNA, 20 bp, Artificial Sequence
  Synthetic oligonucleotide; AGG chr2 60474411 60474430 60474414 -
tattcaaccttttgaaatga

SEQ ID NO: 182583 - DNA, 20 bp, Artificial Sequence
  Synthetic oligonucleotide; TAG chr2 60474398 60474417 60474401 -
gaaatgaaggatttgccttt

SEQ ID NO: 182584 - DNA, 20 bp, Artificial Sequence
  Synthetic oligonucleotide; TGG chr2 60474395 60474414 60474398 -
atgaaggatttgccttttag

SEQ ID NO: 182585 - DNA, 20 bp, Artificial Sequence
  Synthetic oligonucleotide; GGG chr2 60474394 60474413 60474397 -
tgaaggatttgccttttagt

SEQ ID NO: 182586 - DNA, 20 bp, Artificial Sequence
  Synthetic oligonucleotide; AAG chr2 60474372 60474391 60474375 -
gaaatctgcatttcaacaca

SEQ ID NO: 182587 - DNA, 20 bp, Artificial Sequence
  Synthetic oligonucleotide; TGG chr2 60474368 60474387 60474371 -
tctgcatttcaacacaaaga

SEQ ID NO: 182588 - DNA, 20 bp, Artificial Sequence
  Synthetic oligonucleotide; TGG chr2 60474352 60474371 60474355 -
aagatggaacacaatgtctt

SEQ ID NO: 182589 - DNA, 20 bp, Artificial Sequence
  Synthetic oligonucleotide; TAG chr2 60474347 60474366 60474350 -
ggaacacaatgtctttggct

SEQ ID NO: 182590 - DNA, 20 bp, Artificial Sequence
  Synthetic oligonucleotide; CAG chr2 60474336 60474355 60474339 -
tctttggcttagttgctttt

SEQ ID NO: 182591 - DNA, 20 bp, Artificial Sequence
  Synthetic oligonucleotide; AAG chr2 60474331 60474350 60474334 -
ggcttagttgcttttcagaa

SEQ ID NO: 182592 - DNA, 20 bp, Artificial Sequence
  Synthetic oligonucleotide; AAG chr2 60474327 60474346 60474330 -
tagttgcttttcagaaaagc

SEQ ID NO: 182593 - DNA, 20 bp, Artificial Sequence
  Synthetic oligonucleotide; TGG chr2 60474312 60474331 60474315 -
aaagcaagattttttttttt

SEQ ID NO: 182594 - DNA, 20 bp, Artificial Sequence
  Synthetic oligonucleotide; AAG chr2 60474286 60474305 60474289 -
tatatgctttgcttatgtta

SEQ ID NO: 182595 - DNA, 20 bp, Artificial Sequence
  Synthetic oligonucleotide; CAG chr2 60474280 60474299 60474283 -
ctttgcttatgttaaagaca

SEQ ID NO: 182596 - DNA, 20 bp, Artificial Sequence
  Synthetic oligonucleotide; CAG chr2 60474273 60474292 60474276 -
tatgttaaagacacagcttg

SEQ ID NO: 182597 - DNA, 20 bp, Artificial Sequence
  Synthetic oligonucleotide; TAG chr2 60474258 60474277 60474261 -
gcttgcagaaaaattttgtt

SEQ ID NO: 182598 - DNA, 20 bp, Artificial Sequence
  Synthetic oligonucleotide; AGG chr2 60474257 60474276 60474260 -
cttgcagaaaaattttgttt

SEQ ID NO: 182599 - DNA, 20 bp, Artificial Sequence
  Synthetic oligonucleotide; CAG chr2 60474249 60474268 60474252 -
aaaattttgtttaggcctga

SEQ ID NO: 182600 - DNA, 20 bp, Artificial Sequence
  Synthetic oligonucleotide; TGG chr2 60474244 60474263 60474247 -
tttgtttaggcctgacagat

SEQ ID NO: 182601 - DNA, 20 bp, Artificial Sequence
  Synthetic oligonucleotide; TGG chr2 60474241 60474260 60474244 -
gtttaggcctgacagattgg

SEQ ID NO: 182602 - DNA, 20 bp, Artificial Sequence
  Synthetic oligonucleotide; TGG chr2 60474237 60474256 60474240 -
aggcctgacagattggtggc

SEQ ID NO: 182603 - DNA, 20 bp, Artificial Sequence
  Synthetic oligonucleotide; TAG chr2 60474226 60474245 60474229 -
attggtggctggcattttta

SEQ ID NO: 182604 - DNA, 20 bp, Artificial Sequence
  Synthetic oligonucleotide; AAG chr2 60474220 60474239 60474223 -
ggctggcatttttatagata

SEQ ID NO: 182605 - DNA, 20 bp, Artificial Sequence
  Synthetic oligonucleotide; AGG chr2 60474219 60474238 60474222 -
gctggcatttttatagataa

SEQ ID NO: 182606 - DNA, 20 bp, Artificial Sequence
  Synthetic oligonucleotide; GGG chr2 60474218 60474237 60474221 -
ctggcatttttatagataaa

SEQ ID NO: 182607 - DNA, 20 bp, Artificial Sequence
  Synthetic oligonucleotide; GGG chr2 60474217 60474236 60474220 -
tggcatttttatagataaag

SEQ ID NO: 182608 - DNA, 20 bp, Artificial Sequence
  Synthetic oligonucleotide; GAG chr2 60474179 60474198 60474182 -
ctctacttcctccctttatt

SEQ ID NO: 182609 - DNA, 20 bp, Artificial Sequence
  Synthetic oligonucleotide; AAG chr2 60474173 60474192 60474176 -
ttcctccctttattgagaaa

SEQ ID NO: 182610 - DNA, 20 bp, Artificial Sequence
  Synthetic oligonucleotide; TAG chr2 60474168 60474187 60474171 -
ccctttattgagaaaaagcc

SEQ ID NO: 182611 - DNA, 20 bp, Artificial Sequence
  Synthetic oligonucleotide; AGG chr2 60474167 60474186 60474170 -
cctttattgagaaaaagcct

SEQ ID NO: 182612 - DNA, 20 bp, Artificial Sequence
  Synthetic oligonucleotide; GAG chr2 60474165 60474184 60474168 -
tttattgagaaaaagcctag

SEQ ID NO: 182613 - DNA, 20 bp, Artificial Sequence
  Synthetic oligonucleotide; AGG chr2 60474164 60474183 60474167 -
ttattgagaaaaagcctagg

SEQ ID NO: 182614 - DNA, 20 bp, Artificial Sequence
  Synthetic oligonucleotide; GAG chr2 60474162 60474181 60474165 -
attgagaaaaagcctaggag

SEQ ID NO: 182615 - DNA, 20 bp, Artificial Sequence
  Synthetic oligonucleotide; AAG chr2 60474150 60474169 60474153 -
cctaggaggagaactcttaa

SEQ ID NO: 182616 - DNA, 20 bp, Artificial Sequence
  Synthetic oligonucleotide; AGG chr2 60474149 60474168 60474152 -
ctaggaggagaactcttaaa

SEQ ID NO: 182617 - DNA, 20 bp, Artificial Sequence
  Synthetic oligonucleotide; AAG chr2 60474144 60474163 60474147 -
aggagaactcttaaaaggtg

SEQ ID NO: 182618 - DNA, 20 bp, Artificial Sequence
  Synthetic oligonucleotide; TAG chr2 60474140 60474159 60474143 -
gaactcttaaaaggtgaagt

SEQ ID NO: 182619 - DNA, 20 bp, Artificial Sequence
  Synthetic oligonucleotide; GAG chr2 60474124 60474143 60474127 -
aagttagtaacctgttgttt

SEQ ID NO: 182620 - DNA, 20 bp, Artificial Sequence
  Synthetic oligonucleotide; AAG chr2 60474116 60474135 60474119 -
aacctgttgtttgagtaatc

SEQ ID NO: 182621 - DNA, 20 bp, Artificial Sequence
  Synthetic oligonucleotide; AGG chr2 60474115 60474134 60474118 -
acctgttgtttgagtaatca

SEQ ID NO: 182622 - DNA, 20 bp, Artificial Sequence
  Synthetic oligonucleotide; AAG chr2 60474108 60474127 60474111 -
gtttgagtaatcaaggctct

SEQ ID NO: 182623 - DNA, 20 bp, Artificial Sequence
  Synthetic oligonucleotide; GAG chr2 60474106 60474125 60474109 -
ttgagtaatcaaggctctaa

SEQ ID NO: 182624 - DNA, 20 bp, Artificial Sequence
  Synthetic oligonucleotide; AGG chr2 60474105 60474124 60474108 -
tgagtaatcaaggctctaag

SEQ ID NO: 182625 - DNA, 20 bp, Artificial Sequence
  Synthetic oligonucleotide; TAG chr2 60474101 60474120 60474104 -
taatcaaggctctaagagga

SEQ ID NO: 182626 - DNA, 20 bp, Artificial Sequence
  Synthetic oligonucleotide; AAG chr2 60474086 60474105 60474089 -
gaggatagcattgatcaaaa

SEQ ID NO: 182627 - DNA, 20 bp, Artificial Sequence
  Synthetic oligonucleotide; GAG chr2 60474084 60474103 60474087 -
ggatagcattgatcaaaaaa

SEQ ID NO: 182628 - DNA, 20 bp, Artificial Sequence
  Synthetic oligonucleotide; GAG chr2 60474072 60474091 60474075 -
tcaaaaaagagttttaaaat

SEQ ID NO: 182629 - DNA, 20 bp, Artificial Sequence
  Synthetic oligonucleotide; AAG chr2 60474054 60474073 60474057 -
atgagtgattgatgttatta

SEQ ID NO: 182630 - DNA, 20 bp, Artificial Sequence
  Synthetic oligonucleotide; TGG chr2 60474047 60474066 60474050 -
attgatgttattaaagtcac

SEQ ID NO: 182631 - DNA, 20 bp, Artificial Sequence
  Synthetic oligonucleotide; AAG chr2 60474042 60474061 60474045 -
tgttattaaagtcactggtg

SEQ ID NO: 182632 - DNA, 20 bp, Artificial Sequence
  Synthetic oligonucleotide; AAG chr2 60474035 60474054 60474038 -
aaagtcactggtgaagtatc

SEQ ID NO: 182633 - DNA, 20 bp, Artificial Sequence
  Synthetic oligonucleotide; AGG chr2 60474034 60474053 60474037 -
aagtcactggtgaagtatca

SEQ ID NO: 182634 - DNA, 20 bp, Artificial Sequence
  Synthetic oligonucleotide; AAG chr2 60474026 60474045 60474029 -
ggtgaagtatcaaggaatct

SEQ ID NO: 182635 - DNA, 20 bp, Artificial Sequence
  Synthetic oligonucleotide; AGG chr2 60474025 60474044 60474028 -
gtgaagtatcaaggaatcta

SEQ ID NO: 182636 - DNA, 20 bp, Artificial Sequence
  Synthetic oligonucleotide; GAG chr2 60474017 60474036 60474020 -
tcaaggaatctaaggaccat

SEQ ID NO: 182637 - DNA, 20 bp, Artificial Sequence
  Synthetic oligonucleotide; GAG chr2 60474015 60474034 60474018 -
aaggaatctaaggaccatga

SEQ ID NO: 182638 - DNA, 20 bp, Artificial Sequence
  Synthetic oligonucleotide; GAG chr2 60474013 60474032 60474016 -
ggaatctaaggaccatgaga

SEQ ID NO: 182639 - DNA, 20 bp, Artificial Sequence
  Synthetic oligonucleotide; CAG chr2 60474007 60474026 60474010 -
taaggaccatgagagagttt

SEQ ID NO: 182640 - DNA, 20 bp, Artificial Sequence
  Synthetic oligonucleotide; AGG chr2 60474006 60474025 60474009 -
aaggaccatgagagagtttc

SEQ ID NO: 182641 - DNA, 20 bp, Artificial Sequence
  Synthetic oligonucleotide; GGG chr2 60474005 60474024 60474008 -
aggaccatgagagagtttca

SEQ ID NO: 182642 - DNA, 20 bp, Artificial Sequence
  Synthetic oligonucleotide; AAG chr2 60474002 60474021 60474005 -
accatgagagagtttcaggg

SEQ ID NO: 182643 - DNA, 20 bp, Artificial Sequence
  Synthetic oligonucleotide; TAG chr2 60473986 60474005 60473989 -
agggaagaaattctatattg

SEQ ID NO: 182644 - DNA, 20 bp, Artificial Sequence
  Synthetic oligonucleotide; CAG chr2 60473952 60473971 60473955 -
attgctttcttttgtttttg

SEQ ID NO: 182645 - DNA, 20 bp, Artificial Sequence
  Synthetic oligonucleotide; AAG chr2 60473936 60473955 60473939 -
tttgcagaatacacttttta

SEQ ID NO: 182646 - DNA, 20 bp, Artificial Sequence
  Synthetic oligonucleotide; CAG chr2 60473928 60473947 60473931 -
atacactttttaaagaacat

SEQ ID NO: 182647 - DNA, 20 bp, Artificial Sequence
  Synthetic oligonucleotide; AGG chr2 60473927 60473946 60473930 -
tacactttttaaagaacatc

SEQ ID NO: 182648 - DNA, 20 bp, Artificial Sequence
  Synthetic oligonucleotide; TGG chr2 60473921 60473940 60473924 -
ttttaaagaacatcaggatt

SEQ ID NO: 182649 - DNA, 20 bp, Artificial Sequence
  Synthetic oligonucleotide; CAG chr2 60473913 60473932 60473916 -
aacatcaggatttggtaaaa

SEQ ID NO: 182650 - DNA, 20 bp, Artificial Sequence
  Synthetic oligonucleotide; CAG chr2 60473909 60473928 60473912 -
tcaggatttggtaaaacagc

SEQ ID NO: 182651 - DNA, 20 bp, Artificial Sequence
  Synthetic oligonucleotide; AAG chr2 60473901 60473920 60473904 -
tggtaaaacagccagtaaaa

SEQ ID NO: 182652 - DNA, 20 bp, Artificial Sequence
  Synthetic oligonucleotide; AAG chr2 60473893 60473912 60473896 -
cagccagtaaaaaagcaatg

SEQ ID NO: 182653 - DNA, 20 bp, Artificial Sequence
  Synthetic oligonucleotide; AGG chr2 60473892 60473911 60473895 -
agccagtaaaaaagcaatga

SEQ ID NO: 182654 - DNA, 20 bp, Artificial Sequence
  Synthetic oligonucleotide; TAG chr2 60473859 60473878 60473862 -
cacatgtaaatgctcatttc

SEQ ID NO: 182655 - DNA, 20 bp, Artificial Sequence
  Synthetic oligonucleotide; AAG chr2 60473851 60473870 60473854 -
aatgctcatttctagaacaa

SEQ ID NO: 182656 - DNA, 20 bp, Artificial Sequence
  Synthetic oligonucleotide; GAG chr2 60473849 60473868 60473852 -
tgctcatttctagaacaaaa

SEQ ID NO: 182657 - DNA, 20 bp, Artificial Sequence
  Synthetic oligonucleotide; GAG chr2 60473847 60473866 60473850 -
ctcatttctagaacaaaaga

SEQ ID NO: 182658 - DNA, 20 bp, Artificial Sequence
  Synthetic oligonucleotide; CAG chr2 60473827 60473846 60473830 -
gagtgcgattttgacaatat

SEQ ID NO: 182659 - DNA, 20 bp, Artificial Sequence
  Synthetic oligonucleotide; AAG chr2 60473824 60473843 60473827 -
tgcgattttgacaatatcag

SEQ ID NO: 182660 - DNA, 20 bp, Artificial Sequence
  Synthetic oligonucleotide; AGG chr2 60473823 60473842 60473826 -
gcgattttgacaatatcaga

SEQ ID NO: 182661 - DNA, 20 bp, Artificial Sequence
  Synthetic oligonucleotide; AAG chr2 60473814 60473833 60473817 -
acaatatcagaaggttaatt

SEQ ID NO: 182662 - DNA, 20 bp, Artificial Sequence
  Synthetic oligonucleotide; AAG chr2 60473811 60473830 60473814 -
atatcagaaggttaattaag

SEQ ID NO: 182663 - DNA, 20 bp, Artificial Sequence
  Synthetic oligonucleotide; GAG chr2 60473803 60473822 60473806 -
aggttaattaagaagtctgt

SEQ ID NO: 182664 - DNA, 20 bp, Artificial Sequence
  Synthetic oligonucleotide; AAG chr2 60473792 60473811 60473795 -
gaagtctgtgagtgatgata

SEQ ID NO: 182665 - DNA, 20 bp, Artificial Sequence
  Synthetic oligonucleotide; TGG chr2 60473788 60473807 60473791 -
tctgtgagtgatgataaagc

SEQ ID NO: 182666 - DNA, 20 bp, Artificial Sequence
  Synthetic oligonucleotide; CAG chr2 60473772 60473791 60473775 -
aagctggcacattttcatta

SEQ ID NO: 182667 - DNA, 20 bp, Artificial Sequence
  Synthetic oligonucleotide; AAG chr2 60473756 60473775 60473759 -
attacagattgacacaactc

SEQ ID NO: 182668 - DNA, 20 bp, Artificial Sequence
  Synthetic oligonucleotide; CAG chr2 60473750 60473769 60473753 -
gattgacacaactcaagtca

SEQ ID NO: 182669 - DNA, 20 bp, Artificial Sequence
  Synthetic oligonucleotide; AGG chr2 60473749 60473768 60473752 -
attgacacaactcaagtcac

SEQ ID NO: 182670 - DNA, 20 bp, Artificial Sequence
  Synthetic oligonucleotide; TAG chr2 60473744 60473763 60473747 -
cacaactcaagtcacaggca

SEQ ID NO: 182671 - DNA, 20 bp, Artificial Sequence
  Synthetic oligonucleotide; AAG chr2 60473714 60473733 60473717 -
ttgctctataatactctgat

SEQ ID NO: 182672 - DNA, 20 bp, Artificial Sequence
  Synthetic oligonucleotide; CAG chr2 60473710 60473729 60473713 -
tctataatactctgataagt

SEQ ID NO: 182673 - DNA, 20 bp, Artificial Sequence
  Synthetic oligonucleotide; GAG chr2 60473708 60473727 60473711 -
tataatactctgataagtca

SEQ ID NO: 182674 - DNA, 20 bp, Artificial Sequence
  Synthetic oligonucleotide; AAG chr2 60473700 60473719 60473703 -
tctgataagtcagagaatct

SEQ ID NO: 182675 - DNA, 20 bp, Artificial Sequence
  Synthetic oligonucleotide; GAG chr2 60473696 60473715 60473699 -
ataagtcagagaatctaagt

SEQ ID NO: 182676 - DNA, 20 bp, Artificial Sequence
  Synthetic oligonucleotide; AAG chr2 60473693 60473712 60473696 -
agtcagagaatctaagtgag

SEQ ID NO: 182677 - DNA, 20 bp, Artificial Sequence
  Synthetic oligonucleotide; TGG chr2 60473687 60473706 60473690 -
agaatctaagtgagaagaac

SEQ ID NO: 182678 - DNA, 20 bp, Artificial Sequence
  Synthetic oligonucleotide; TGG chr2 60473678 60473697 60473681 -
gtgagaagaactggtatcta

SEQ ID NO: 182679 - DNA, 20 bp, Artificial Sequence
  Synthetic oligonucleotide; TAG chr2 60473669 60473688 60473672 -
actggtatctatggtaaaca

SEQ ID NO: 182680 - DNA, 20 bp, Artificial Sequence
  Synthetic oligonucleotide; AGG chr2 60473668 60473687 60473671 -
ctggtatctatggtaaacat

SEQ ID NO: 182681 - DNA, 20 bp, Artificial Sequence
  Synthetic oligonucleotide; GGG chr2 60473667 60473686 60473670 -
tggtatctatggtaaacata

SEQ ID NO: 182682 - DNA, 20 bp, Artificial Sequence
  Synthetic oligonucleotide; AAG chr2 60473662 60473681 60473665 -
tctatggtaaacatagggtc

SEQ ID NO: 182683 - DNA, 20 bp, Artificial Sequence
  Synthetic oligonucleotide; GAG chr2 60473660 60473679 60473663 -
tatggtaaacatagggtcaa

SEQ ID NO: 182684 - DNA, 20 bp, Artificial Sequence
  Synthetic oligonucleotide; TAG chr2 60473656 60473675 60473659 -
gtaaacatagggtcaagagc

SEQ ID NO: 182685 - DNA, 20 bp, Artificial Sequence
  Synthetic oligonucleotide; CGG chr2 60473650 60473669 60473653 -
atagggtcaagagctagatg

SEQ ID NO: 182686 - DNA, 20 bp, Artificial Sequence
  Synthetic oligonucleotide; TAG chr2 60473642 60473661 60473645 -
aagagctagatgcggctgaa

SEQ ID NO: 182687 - DNA, 20 bp, Artificial Sequence
  Synthetic oligonucleotide; AAG chr2 60473638 60473657 60473641 -
gctagatgcggctgaataga

SEQ ID NO: 182688 - DNA, 20 bp, Artificial Sequence
  Synthetic oligonucleotide; AGG chr2 60473637 60473656 60473640 -
ctagatgcggctgaatagaa

SEQ ID NO: 182689 - DNA, 20 bp, Artificial Sequence
  Synthetic oligonucleotide; CAG chr2 60473622 60473641 60473625 -
tagaaaggacatttactttg

SEQ ID NO: 182690 - DNA, 20 bp, Artificial Sequence
  Synthetic oligonucleotide; TAG chr2 60473618 60473637 60473621 -
aaggacatttactttgcagt

SEQ ID NO: 182691 - DNA, 20 bp, Artificial Sequence
  Synthetic oligonucleotide; AGG chr2 60473617 60473636 60473620 -
aggacatttactttgcagtt

SEQ ID NO: 182692 - DNA, 20 bp, Artificial Sequence
  Synthetic oligonucleotide; AAG chr2 60473612 60473631 60473615 -
atttactttgcagttaggta

SEQ ID NO: 182693 - DNA, 20 bp, Artificial Sequence
  Synthetic oligonucleotide; AAG chr2 60473609 60473628 60473612 -
tactttgcagttaggtaaag

SEQ ID NO: 182694 - DNA, 20 bp, Artificial Sequence
  Synthetic oligonucleotide; TAG chr2 60473602 60473621 60473605 -
cagttaggtaaagaagcctc

SEQ ID NO: 182695 - DNA, 20 bp, Artificial Sequence
  Synthetic oligonucleotide; CAG chr2 60473597 60473616 60473600 -
aggtaaagaagcctctagct

SEQ ID NO: 182696 - DNA, 20 bp, Artificial Sequence
  Synthetic oligonucleotide; TAG chr2 60473592 60473611 60473595 -
aagaagcctctagctcagac

SEQ ID NO: 182697 - DNA, 20 bp, Artificial Sequence
  Synthetic oligonucleotide; TGG chr2 60473569 60473588 60473572 -
ctgcactgttgttatttgtg

SEQ ID NO: 182698 - DNA, 20 bp, Artificial Sequence
  Synthetic oligonucleotide; TAG chr2 60473558 60473577 60473561 -
ttatttgtgtggcttgaacc

SEQ ID NO: 182699 - DNA, 20 bp, Artificial Sequence
  Synthetic oligonucleotide; CGG chr2 60473551 60473570 60473554 -
tgtggcttgaacctagtaat

SEQ ID NO: 182700 - DNA, 20 bp, Artificial Sequence
  Synthetic oligonucleotide; CAG chr2 60473545 60473564 60473548 -
ttgaacctagtaatcggatt

SEQ ID NO: 182701 - DNA, 20 bp, Artificial Sequence
  Synthetic oligonucleotide; TGG chr2 60473539 60473558 60473542 -
ctagtaatcggattcagaac

SEQ ID NO: 182702 - DNA, 20 bp, Artificial Sequence
  Synthetic oligonucleotide; TGG chr2 60473534 60473553 60473537 -
aatcggattcagaactggaa

SEQ ID NO: 182703 - DNA, 20 bp, Artificial Sequence
  Synthetic oligonucleotide; GGG chr2 60473533 60473552 60473536 -
atcggattcagaactggaat

SEQ ID NO: 182704 - DNA, 20 bp, Artificial Sequence
  Synthetic oligonucleotide; CAG chr2 60473524 60473543 60473527 -
agaactggaatgggttcctt

SEQ ID NO: 182705 - DNA, 20 bp, Artificial Sequence
  Synthetic oligonucleotide; AGG chr2 60473523 60473542 60473526 -
gaactggaatgggttccttc

SEQ ID NO: 182706 - DNA, 20 bp, Artificial Sequence
  Synthetic oligonucleotide; GGG chr2 60473522 60473541 60473525 -
aactggaatgggttccttca

SEQ ID NO: 182707 - DNA, 20 bp, Artificial Sequence
  Synthetic oligonucleotide; CAG chr2 60473504 60473523 60473507 -
cagggtactttacaaacgtt

SEQ ID NO: 182708 - DNA, 20 bp, Artificial Sequence
  Synthetic oligonucleotide; AGG chr2 60473503 60473522 60473506 -
agggtactttacaaacgttc

SEQ ID NO: 182709 - DNA, 20 bp, Artificial Sequence
  Synthetic oligonucleotide; AAG chr2 60473491 60473510 60473494 -
aaacgttcaggatgcatttt

SEQ ID NO: 182710 - DNA, 20 bp, Artificial Sequence
  Synthetic oligonucleotide; TAG chr2 60473486 60473505 60473489 -
ttcaggatgcattttaagtg

SEQ ID NO: 182711 - DNA, 20 bp, Artificial Sequence
  Synthetic oligonucleotide; TAG chr2 60473481 60473500 60473484 -
gatgcattttaagtgtagtc

SEQ ID NO: 182712 - DNA, 20 bp, Artificial Sequence
  Synthetic oligonucleotide; AAG chr2 60473478 60473497 60473481 -
gcattttaagtgtagtctag

SEQ ID NO: 182713 - DNA, 20 bp, Artificial Sequence
  Synthetic oligonucleotide; AGG chr2 60473477 60473496 60473480 -
cattttaagtgtagtctaga

SEQ ID NO: 182714 - DNA, 20 bp, Artificial Sequence
  Synthetic oligonucleotide; TGG chr2 60473474 60473493 60473477 -
tttaagtgtagtctagaagg

SEQ ID NO: 182715 - DNA, 20 bp, Artificial Sequence
  Synthetic oligonucleotide; TGG chr2 60473467 60473486 60473470 -
gtagtctagaaggtggtaca

SEQ ID NO: 182716 - DNA, 20 bp, Artificial Sequence
  Synthetic oligonucleotide; AAG chr2 60473464 60473483 60473467 -
gtctagaaggtggtacatgg

SEQ ID NO: 182717 - DNA, 20 bp, Artificial Sequence
  Synthetic oligonucleotide; GAG chr2 60473462 60473481 60473465 -
ctagaaggtggtacatggaa

SEQ ID NO: 182718 - DNA, 20 bp, Artificial Sequence
  Synthetic oligonucleotide; GAG chr2 60473457 60473476 60473460 -
aggtggtacatggaagagct

SEQ ID NO: 182719 - DNA, 20 bp, Artificial Sequence
  Synthetic oligonucleotide; AGG chr2 60473456 60473475 60473459 -
ggtggtacatggaagagctg

SEQ ID NO: 182720 - DNA, 20 bp, Artificial Sequence
  Synthetic oligonucleotide; GGG chr2 60473455 60473474 60473458 -
gtggtacatggaagagctga

SEQ ID NO: 182721 - DNA, 20 bp, Artificial Sequence
  Synthetic oligonucleotide; GAG chr2 60473448 60473467 60473451 -
atggaagagctgagggactt

SEQ ID NO: 182722 - DNA, 20 bp, Artificial Sequence
  Synthetic oligonucleotide; AGG chr2 60473447 60473466 60473450 -
tggaagagctgagggacttg

SEQ ID NO: 182723 - DNA, 20 bp, Artificial Sequence
  Synthetic oligonucleotide; TGG chr2 60473440 60473459 60473443 -
gctgagggacttgaggatta

SEQ ID NO: 182724 - DNA, 20 bp, Artificial Sequence
  Synthetic oligonucleotide; AAG chr2 60473430 60473449 60473433 -
ttgaggattatggactgcga

SEQ ID NO: 182725 - DNA, 20 bp, Artificial Sequence
  Synthetic oligonucleotide; AGG chr2 60473429 60473448 60473432 -
tgaggattatggactgcgaa

SEQ ID NO: 182726 - DNA, 20 bp, Artificial Sequence
  Synthetic oligonucleotide; TAG chr2 60473422 60473441 60473425 -
tatggactgcgaaaggactg

SEQ ID NO: 182727 - DNA, 20 bp, Artificial Sequence
  Synthetic oligonucleotide; AGG chr2 60473421 60473440 60473424 -
atggactgcgaaaggactgt

SEQ ID NO: 182728 - DNA, 20 bp, Artificial Sequence
  Synthetic oligonucleotide; TAG chr2 60473418 60473437 60473421 -
gactgcgaaaggactgtagg

SEQ ID NO: 182729 - DNA, 20 bp, Artificial Sequence
  Synthetic oligonucleotide; TGG chr2 60473405 60473424 60473408 -
ctgtaggtagtcctgtattt

SEQ ID NO: 182730 - DNA, 20 bp, Artificial Sequence
  Synthetic oligonucleotide; TAG chr2 60473389 60473408 60473392 -
attttggcctgtcaccaata

SEQ ID NO: 182731 - DNA, 20 bp, Artificial Sequence
  Synthetic oligonucleotide; GAG chr2 60473387 60473406 60473390 -
tttggcctgtcaccaatata

SEQ ID NO: 182732 - DNA, 20 bp, Artificial Sequence
  Synthetic oligonucleotide; TAG chr2 60473370 60473389 60473373 -
atagagacccctcctcatca

SEQ ID NO: 182733 - DNA, 20 bp, Artificial Sequence
  Synthetic oligonucleotide; AAG chr2 60473347 60473366 60473350 -
tgtcatccattctctttttg

SEQ ID NO: 182734 - DNA, 20 bp, Artificial Sequence
  Synthetic oligonucleotide; CAG chr2 60473341 60473360 60473344 -
ccattctctttttgaagacc

SEQ ID NO: 182735 - DNA, 20 bp, Artificial Sequence
  Synthetic oligonucleotide; AGG chr2 60473340 60473359 60473343 -
cattctctttttgaagaccc

SEQ ID NO: 182736 - DNA, 20 bp, Artificial Sequence
  Synthetic oligonucleotide; GGG chr2 60473339 60473358 60473342 -
attctctttttgaagaccca

SEQ ID NO: 182737 - DNA, 20 bp, Artificial Sequence
  Synthetic oligonucleotide; AAG chr2 60473333 60473352 60473336 -
tttttgaagacccagggtga

SEQ ID NO: 182738 - DNA, 20 bp, Artificial Sequence
  Synthetic oligonucleotide; AAG chr2 60473329 60473348 60473332 -
tgaagacccagggtgaaaga

SEQ ID NO: 182739 - DNA, 20 bp, Artificial Sequence
  Synthetic oligonucleotide; AGG chr2 60473328 60473347 60473331 -
gaagacccagggtgaaagaa

SEQ ID NO: 182740 - DNA, 20 bp, Artificial Sequence
  Synthetic oligonucleotide; GGG chr2 60473327 60473346 60473330 -
aagacccagggtgaaagaaa

SEQ ID NO: 182741 - DNA, 20 bp, Artificial Sequence
  Synthetic oligonucleotide; GGG chr2 60473326 60473345 60473329 -
agacccagggtgaaagaaag

SEQ ID NO: 182742 - DNA, 20 bp, Artificial Sequence
  Synthetic oligonucleotide; GGG chr2 60473325 60473344 60473328 -
gacccagggtgaaagaaagg

SEQ ID NO: 182743 - DNA, 20 bp, Artificial Sequence
  Synthetic oligonucleotide; CAG chr2 60473319 60473338 60473322 -
gggtgaaagaaagggggtca

SEQ ID NO: 182744 - DNA, 20 bp, Artificial Sequence
  Synthetic oligonucleotide; GAG chr2 60473310 60473329 60473313 -
aaagggggtcacagtgtcac

SEQ ID NO: 182745 - DNA, 20 bp, Artificial Sequence
  Synthetic oligonucleotide; TAG chr2 60473306 60473325 60473309 -
ggggtcacagtgtcacgaga

SEQ ID NO: 182746 - DNA, 20 bp, Artificial Sequence
  Synthetic oligonucleotide; TGG chr2 60473292 60473311 60473295 -
acgagatagcccattccacg

SEQ ID NO: 182747 - DNA, 20 bp, Artificial Sequence
  Synthetic oligonucleotide; GGG chr2 60473291 60473310 60473294 -
cgagatagcccattccacgt

SEQ ID NO: 182748 - DNA, 20 bp, Artificial Sequence
  Synthetic oligonucleotide; CAG chr2 60473287 60473306 60473290 -
atagcccattccacgtggga

SEQ ID NO: 182749 - DNA, 20 bp, Artificial Sequence
  Synthetic oligonucleotide; CAG chr2 60473241 60473260 60473244 -
cactgaaaaaaaaaaaaaaa

SEQ ID NO: 182750 - DNA, 20 bp, Artificial Sequence
  Synthetic oligonucleotide; AGG chr2 60473240 60473259 60473243 -
actgaaaaaaaaaaaaaaac

SEQ ID NO: 182751 - DNA, 20 bp, Artificial Sequence
  Synthetic oligonucleotide; GGG chr2 60473239 60473258 60473242 -
ctgaaaaaaaaaaaaaaaca

SEQ ID NO: 182752 - DNA, 20 bp, Artificial Sequence
  Synthetic oligonucleotide; TAG chr2 60473214 60473233 60473217 -
attatctaaaaacatatgtt

SEQ ID NO: 182753 - DNA, 20 bp, Artificial Sequence
  Synthetic oligonucleotide; AGG chr2 60473213 60473232 60473216 -
ttatctaaaaacatatgttt

SEQ ID NO: 182754 - DNA, 20 bp, Artificial Sequence
  Synthetic oligonucleotide; CAG chr2 60473183 60473202 60473186 -
cacacattcacacacgtaca

SEQ ID NO: 182755 - DNA, 20 bp, Artificial Sequence
  Synthetic oligonucleotide; AAG chr2 60473102 60473121 60473105 -
gcacatgctaacacatgcac

SEQ ID NO: 182756 - DNA, 20 bp, Artificial Sequence
  Synthetic oligonucleotide; CAG chr2 60473081 60473100 60473084 -
agcatacacacacatgcaca

SEQ ID NO: 182757 - DNA, 20 bp, Artificial Sequence
  Synthetic oligonucleotide; TAG chr2 60472975 60472994 60472978 -
acacacacacacgtacattt

SEQ ID NO: 182758 - DNA, 20 bp, Artificial Sequence
  Synthetic oligonucleotide; TAG chr2 60472968 60472987 60472971 -
cacacgtacattttagtgaa

SEQ ID NO: 182759 - DNA, 20 bp, Artificial Sequence
  Synthetic oligonucleotide; TGG chr2 60472945 60472964 60472948 -
cacacatctatgtactcctg

SEQ ID NO: 182760 - DNA, 20 bp, Artificial Sequence
  Synthetic oligonucleotide; GAG chr2 60472943 60472962 60472946 -
cacatctatgtactcctgtg

SEQ ID NO: 182761 - DNA, 20 bp, Artificial Sequence
  Synthetic oligonucleotide; GAG chr2 60472941 60472960 60472944 -
catctatgtactcctgtgga

SEQ ID NO: 182762 - DNA, 20 bp, Artificial Sequence
  Synthetic oligonucleotide; TGG chr2 60472933 60472952 60472936 -
tactcctgtggagagtcctg

SEQ ID NO: 182763 - DNA, 20 bp, Artificial Sequence
  Synthetic oligonucleotide; AAG chr2 60472915 60472934 60472918 -
tgtggttttaatacctgtta

SEQ ID NO: 182764 - DNA, 20 bp, Artificial Sequence
  Synthetic oligonucleotide; TGG chr2 60472911 60472930 60472914 -
gttttaatacctgttaaagt

SEQ ID NO: 182765 - DNA, 20 bp, Artificial Sequence
  Synthetic oligonucleotide; GGG chr2 60472910 60472929 60472913 -
ttttaatacctgttaaagtt

SEQ ID NO: 182766 - DNA, 20 bp, Artificial Sequence
  Synthetic oligonucleotide; AAG chr2 60472901 60472920 60472904 -
ctgttaaagttgggctccca

SEQ ID NO: 182767 - DNA, 20 bp, Artificial Sequence
  Synthetic oligonucleotide; CAG chr2 60472898 60472917 60472901 -
ttaaagttgggctcccaaag

SEQ ID NO: 182768 - DNA, 20 bp, Artificial Sequence
  Synthetic oligonucleotide; TGG chr2 60472882 60472901 60472885 -
aaagcagtcattaaacgtgt

SEQ ID NO: 182769 - DNA, 20 bp, Artificial Sequence
  Synthetic oligonucleotide; TAG chr2 60472863 60472882 60472866 -
ttggaatgatgctttttgct

SEQ ID NO: 182770 - DNA, 20 bp, Artificial Sequence
  Synthetic oligonucleotide; TGG chr2 60472854 60472873 60472857 -
tgctttttgcttagctgttt

SEQ ID NO: 182771 - DNA, 20 bp, Artificial Sequence
  Synthetic oligonucleotide; TGG chr2 60472845 60472864 60472848 -
cttagctgttttggcacatt

SEQ ID NO: 182772 - DNA, 20 bp, Artificial Sequence
  Synthetic oligonucleotide; CAG chr2 60472835 60472854 60472838 -
ttggcacatttggaaatctg

SEQ ID NO: 182773 - DNA, 20 bp, Artificial Sequence
  Synthetic oligonucleotide; TAG chr2 60472818 60472837 60472821 -
ctgcagtattacctgttgat

SEQ ID NO: 182774 - DNA, 20 bp, Artificial Sequence
  Synthetic oligonucleotide; TAG chr2 60472815 60472834 60472818 -
cagtattacctgttgattag

SEQ ID NO: 182775 - DNA, 20 bp, Artificial Sequence
  Synthetic oligonucleotide; CAG chr2 60472811 60472830 60472814 -
attacctgttgattagtaga

SEQ ID NO: 182776 - DNA, 20 bp, Artificial Sequence
  Synthetic oligonucleotide; TGG chr2 60472803 60472822 60472806 -
ttgattagtagacagtaatg

SEQ ID NO: 182777 - DNA, 20 bp, Artificial Sequence
  Synthetic oligonucleotide; CAG chr2 60472786 60472805 60472789 -
atgtggctgtattacacacc

SEQ ID NO: 182778 - DNA, 20 bp, Artificial Sequence
  Synthetic oligonucleotide; TAG chr2 60472779 60472798 60472782 -
tgtattacacacccagtgat

SEQ ID NO: 182779 - DNA, 20 bp, Artificial Sequence
  Synthetic oligonucleotide; CAG chr2 60472773 60472792 60472776 -
acacacccagtgattagttt

SEQ ID NO: 182780 - DNA, 20 bp, Artificial Sequence
  Synthetic oligonucleotide; TAG chr2 60472763 60472782 60472766 -
tgattagtttcagaaacaaa

SEQ ID NO: 182781 - DNA, 20 bp, Artificial Sequence
  Synthetic oligonucleotide; TAG chr2 60472752 60472771 60472755 -
agaaacaaatagcatgttaa

SEQ ID NO: 182782 - DNA, 20 bp, Artificial Sequence
  Synthetic oligonucleotide; AAG chr2 60472747 60472766 60472750 -
caaatagcatgttaatagtc

SEQ ID NO: 182783 - DNA, 20 bp, Artificial Sequence
  Synthetic oligonucleotide; AGG chr2 60472746 60472765 60472749 -
aaatagcatgttaatagtca

SEQ ID NO: 182784 - DNA, 20 bp, Artificial Sequence
  Synthetic oligonucleotide; GAG chr2 60472736 60472755 60472739 -
ttaatagtcaaggaatcttt

SEQ ID NO: 182785 - DNA, 20 bp, Artificial Sequence
  Synthetic oligonucleotide; GAG chr2 60472725 60472744 60472728 -
ggaatctttgagatgttctt

SEQ ID NO: 182786 - DNA, 20 bp, Artificial Sequence
  Synthetic oligonucleotide; AGG chr2 60472724 60472743 60472727 -
gaatctttgagatgttcttg

SEQ ID NO: 182787 - DNA, 20 bp, Artificial Sequence
  Synthetic oligonucleotide; CAG chr2 60472688 60472707 60472691 -
tgatttaatgacttaaattc

SEQ ID NO: 182788 - DNA, 20 bp, Artificial Sequence
  Synthetic oligonucleotide; AGG chr2 60472687 60472706 60472690 -
gatttaatgacttaaattcc

SEQ ID NO: 182789 - DNA, 20 bp, Artificial Sequence
  Synthetic oligonucleotide; TGG chr2 60472674 60472693 60472677 -
aaattccaggaacatcccac

SEQ ID NO: 182790 - DNA, 20 bp, Artificial Sequence
  Synthetic oligonucleotide; GGG chr2 60472673 60472692 60472676 -
aattccaggaacatcccact

SEQ ID NO: 182791 - DNA, 20 bp, Artificial Sequence
  Synthetic oligonucleotide; TAG chr2 60472668 60472687 60472671 -
caggaacatcccactgggct

SEQ ID NO: 182792 - DNA, 20 bp, Artificial Sequence
  Synthetic oligonucleotide; GAG chr2 60472666 60472685 60472669 -
ggaacatcccactgggctta

SEQ ID NO: 182793 - DNA, 20 bp, Artificial Sequence
  Synthetic oligonucleotide; AAG chr2 60472652 60472671 60472655 -
ggcttagagctctttgtcaa

SEQ ID NO: 182794 - DNA, 20 bp, Artificial Sequence
  Synthetic oligonucleotide; TGG chr2 60472648 60472667 60472651 -
tagagctctttgtcaaaagt

SEQ ID NO: 182795 - DNA, 20 bp, Artificial Sequence
  Synthetic oligonucleotide; TAG chr2 60472632 60472651 60472635 -
aagttggtacccaatatatg

SEQ ID NO: 182796 - DNA, 20 bp, Artificial Sequence
  Synthetic oligonucleotide; AAG chr2 60472622 60472641 60472625 -
ccaatatatgtagaaatgta

SEQ ID NO: 182797 - DNA, 20 bp, Artificial Sequence
  Synthetic oligonucleotide; AAG chr2 60472594 60472613 60472597 -
aaatgtataacattaaatca

SEQ ID NO: 182798 - DNA, 20 bp, Artificial Sequence
  Synthetic oligonucleotide; CAG chr2 60472584 60472603 60472587 -
cattaaatcaaagccattcc

SEQ ID NO: 182799 - DNA, 20 bp, Artificial Sequence
  Synthetic oligonucleotide; AAG chr2 60472547 60472566 60472550 -
tttaatgaaacctgaaaaat

SEQ ID NO: 182800 - DNA, 20 bp, Artificial Sequence
  Synthetic oligonucleotide; GAG chr2 60472545 60472564 60472548 -
taatgaaacctgaaaaataa

SEQ ID NO: 182801 - DNA, 20 bp, Artificial Sequence
  Synthetic oligonucleotide; CAG chr2 60472526 60472545 60472529 -
agagtcactatttttaaatt

SEQ ID NO: 182802 - DNA, 20 bp, Artificial Sequence
  Synthetic oligonucleotide; AAG chr2 60472519 60472538 60472522 -
ctatttttaaattcagccat

SEQ ID NO: 182803 - DNA, 20 bp, Artificial Sequence
  Synthetic oligonucleotide; AGG chr2 60472518 60472537 60472521 -
tatttttaaattcagccata

SEQ ID NO: 182804 - DNA, 20 bp, Artificial Sequence
  Synthetic oligonucleotide; AAG chr2 60472491 60472510 60472494 -
tttgcaacctaataatgtgt

SEQ ID NO: 182805 - DNA, 20 bp, Artificial Sequence
  Synthetic oligonucleotide; AGG chr2 60472490 60472509 60472493 -
ttgcaacctaataatgtgta

SEQ ID NO: 182806 - DNA, 20 bp, Artificial Sequence
  Synthetic oligonucleotide; GAG chr2 60472480 60472499 60472483 -
ataatgtgtaaggcatttct

SEQ ID NO: 182807 - DNA, 20 bp, Artificial Sequence
  Synthetic oligonucleotide; AGG chr2 60472479 60472498 60472482 -
taatgtgtaaggcatttctg

SEQ ID NO: 182808 - DNA, 20 bp, Artificial Sequence
  Synthetic oligonucleotide; AAG chr2 60472472 60472491 60472475 -
taaggcatttctgaggcccc

SEQ ID NO: 182809 - DNA, 20 bp, Artificial Sequence
  Synthetic oligonucleotide; TGG chr2 60472469 60472488 60472472 -
ggcatttctgaggccccaag

SEQ ID NO: 182810 - DNA, 20 bp, Artificial Sequence
  Synthetic oligonucleotide; TGG chr2 60472460 60472479 60472463 -
gaggccccaagtggaaatac

SEQ ID NO: 182811 - DNA, 20 bp, Artificial Sequence
  Synthetic oligonucleotide; GGG chr2 60472459 60472478 60472462 -
aggccccaagtggaaatact

SEQ ID NO: 182812 - DNA, 20 bp, Artificial Sequence
  Synthetic oligonucleotide; TAG chr2 60472454 60472473 60472457 -
ccaagtggaaatactgggtc

SEQ ID NO: 182813 - DNA, 20 bp, Artificial Sequence
  Synthetic oligonucleotide; GAG chr2 60472452 60472471 60472455 -
aagtggaaatactgggtcta

SEQ ID NO: 182814 - DNA, 20 bp, Artificial Sequence
  Synthetic oligonucleotide; GAG chr2 60472450 60472469 60472453 -
gtggaaatactgggtctaga

SEQ ID NO: 182815 - DNA, 20 bp, Artificial Sequence
  Synthetic oligonucleotide; TAG chr2 60472435 60472454 60472438 -
ctagagagacctttatgaaa

SEQ ID NO: 182816 - DNA, 20 bp, Artificial Sequence
  Synthetic oligonucleotide; CAG chr2 60472430 60472449 60472433 -
gagacctttatgaaatagaa

SEQ ID NO: 182817 - DNA, 20 bp, Artificial Sequence
  Synthetic oligonucleotide; AGG chr2 60472429 60472448 60472432 -
agacctttatgaaatagaac

SEQ ID NO: 182818 - DNA, 20 bp, Artificial Sequence
  Synthetic oligonucleotide; CAG chr2 60472410 60472429 60472413 -
caggttgaaacaccttccac

SEQ ID NO: 182819 - DNA, 20 bp, Artificial Sequence
  Synthetic oligonucleotide; AAG chr2 60472405 60472424 60472408 -
tgaaacaccttccaccagaa

SEQ ID NO: 182820 - DNA, 20 bp, Artificial Sequence
  Synthetic oligonucleotide; AAG chr2 60472399 60472418 60472402 -
accttccaccagaaaagtgt

SEQ ID NO: 182821 - DNA, 20 bp, Artificial Sequence
  Synthetic oligonucleotide; AAG chr2 60472385 60472404 60472388 -
aagtgtaagacatttgaaaa

SEQ ID NO: 182822 - DNA, 20 bp, Artificial Sequence
  Synthetic oligonucleotide; GAG chr2 60472379 60472398 60472382 -
aagacatttgaaaaaagatt

SEQ ID NO: 182823 - DNA, 20 bp, Artificial Sequence
  Synthetic oligonucleotide; CAG chr2 60472375 60472394 60472378 -
catttgaaaaaagattgagt

SEQ ID NO: 182824 - DNA, 20 bp, Artificial Sequence
  Synthetic oligonucleotide; AAG chr2 60472370 60472389 60472373 -
gaaaaaagattgagtcagaa

SEQ ID NO: 182825 - DNA, 20 bp, Artificial Sequence
  Synthetic oligonucleotide; AGG chr2 60472369 60472388 60472372 -
aaaaaagattgagtcagaaa

SEQ ID NO: 182826 - DNA, 20 bp, Artificial Sequence
  Synthetic oligonucleotide; GGG chr2 60472368 60472387 60472371 -
aaaaagattgagtcagaaaa

SEQ ID NO: 182827 - DNA, 20 bp, Artificial Sequence
  Synthetic oligonucleotide; GAG chr2 60472350 60472369 60472353 -
aagggaaatgtgtcccattt

SEQ ID NO: 182828 - DNA, 20 bp, Artificial Sequence
  Synthetic oligonucleotide; GAG chr2 60472348 60472367 60472351 -
gggaaatgtgtcccatttga

SEQ ID NO: 182829 - DNA, 20 bp, Artificial Sequence
  Synthetic oligonucleotide; CAG chr2 60472343 60472362 60472346 -
atgtgtcccatttgagagac

SEQ ID NO: 182830 - DNA, 20 bp, Artificial Sequence
  Synthetic oligonucleotide; AAG chr2 60472339 60472358 60472342 -
gtcccatttgagagaccaga

SEQ ID NO: 182831 - DNA, 20 bp, Artificial Sequence
  Synthetic oligonucleotide; AGG chr2 60472338 60472357 60472341 -
tcccatttgagagaccagaa

SEQ ID NO: 182832 - DNA, 20 bp, Artificial Sequence
  Synthetic oligonucleotide; GGG chr2 60472337 60472356 60472340 -
cccatttgagagaccagaaa

SEQ ID NO: 182833 - DNA, 20 bp, Artificial Sequence
  Synthetic oligonucleotide; AAG chr2 60472330 60472349 60472333 -
gagagaccagaaagggaaac

SEQ ID NO: 182834 - DNA, 20 bp, Artificial Sequence
  Synthetic oligonucleotide; GAG chr2 60472328 60472347 60472331 -
gagaccagaaagggaaacaa

SEQ ID NO: 182835 - DNA, 20 bp, Artificial Sequence
  Synthetic oligonucleotide; CAG chr2 60472323 60472342 60472326 -
cagaaagggaaacaagagtc

SEQ ID NO: 182836 - DNA, 20 bp, Artificial Sequence
  Synthetic oligonucleotide; CAG chr2 60472303 60472322 60472306 -
cagttcctgctgtgtccgtg

SEQ ID NO: 182837 - DNA, 20 bp, Artificial Sequence
  Synthetic oligonucleotide; CAG chr2 60472294 60472313 60472297 -
ctgtgtccgtgcagttgcca

SEQ ID NO: 182838 - DNA, 20 bp, Artificial Sequence
  Synthetic oligonucleotide; CGG chr2 60472273 60472292 60472276 -
agctgcgttcgctgacatgt

SEQ ID NO: 182839 - DNA, 20 bp, Artificial Sequence
  Synthetic oligonucleotide; TGG chr2 60472264 60472283 60472267 -
cgctgacatgtcggctttaa

SEQ ID NO: 182840 - DNA, 20 bp, Artificial Sequence
  Synthetic oligonucleotide; AAG chr2 60472261 60472280 60472264 -
tgacatgtcggctttaatgg

SEQ ID NO: 182841 - DNA, 20 bp, Artificial Sequence
  Synthetic oligonucleotide; CAG chr2 60472258 60472277 60472261 -
catgtcggctttaatggaag

SEQ ID NO: 182842 - DNA, 20 bp, Artificial Sequence
  Synthetic oligonucleotide; GAG chr2 60472254 60472273 60472257 -
tcggctttaatggaagcagt

SEQ ID NO: 182843 - DNA, 20 bp, Artificial Sequence
  Synthetic oligonucleotide; AGG chr2 60472253 60472272 60472256 -
cggctttaatggaagcagtg

SEQ ID NO: 182844 - DNA, 20 bp, Artificial Sequence
  Synthetic oligonucleotide; TGG chr2 60472238 60472257 60472241 -
cagtgaggacacaatctgtc

SEQ ID NO: 182845 - DNA, 20 bp, Artificial Sequence
  Synthetic oligonucleotide; AAG chr2 60472232 60472251 60472235 -
ggacacaatctgtctggcac

SEQ ID NO: 182846 - DNA, 20 bp, Artificial Sequence
  Synthetic oligonucleotide; TGG chr2 60472228 60472247 60472231 -
acaatctgtctggcacaagc

SEQ ID NO: 182847 - DNA, 20 bp, Artificial Sequence
  Synthetic oligonucleotide; TGG chr2 60472223 60472242 60472226 -
ctgtctggcacaagctggtt

SEQ ID NO: 182848 - DNA, 20 bp, Artificial Sequence
  Synthetic oligonucleotide; GGG chr2 60472222 60472241 60472225 -
tgtctggcacaagctggttt

SEQ ID NO: 182849 - DNA, 20 bp, Artificial Sequence
  Synthetic oligonucleotide; AAG chr2 60472205 60472224 60472208 -
tttgggtgttgtctcatgct

SEQ ID NO: 182850 - DNA, 20 bp, Artificial Sequence
  Synthetic oligonucleotide; AAG chr2 60472202 60472221 60472205 -
gggtgttgtctcatgctaag

SEQ ID NO: 182851 - DNA, 20 bp, Artificial Sequence
  Synthetic oligonucleotide; AGG chr2 60472201 60472220 60472204 -
ggtgttgtctcatgctaaga

SEQ ID NO: 182852 - DNA, 20 bp, Artificial Sequence
  Synthetic oligonucleotide; TGG chr2 60472195 60472214 60472198 -
gtctcatgctaagaaggccc

SEQ ID NO: 182853 - DNA, 20 bp, Artificial Sequence
  Synthetic oligonucleotide; TGG chr2 60472186 60472205 60472189 -
taagaaggccctggacctga

SEQ ID NO: 182854 - DNA, 20 bp, Artificial Sequence
  Synthetic oligonucleotide; GAG chr2 60472184 60472203 60472187 -
agaaggccctggacctgatg

SEQ ID NO: 182855 - DNA, 20 bp, Artificial Sequence
  Synthetic oligonucleotide; GAG chr2 60472182 60472201 60472185 -
aaggccctggacctgatgga

SEQ ID NO: 182856 - DNA, 20 bp, Artificial Sequence
  Synthetic oligonucleotide; TGG chr2 60472177 60472196 60472180 -
cctggacctgatggagagcc

SEQ ID NO: 182857 - DNA, 20 bp, Artificial Sequence
  Synthetic oligonucleotide; CAG chr2 60472149 60472168 60472152 -
ttccctgtccttatcaatga

SEQ ID NO: 182858 - DNA, 20 bp, Artificial Sequence
  Synthetic oligonucleotide; CGG chr2 60472145 60472164 60472148 -
ctgtccttatcaatgacaga

SEQ ID NO: 182859 - DNA, 20 bp, Artificial Sequence
  Synthetic oligonucleotide; GAG chr2 60472143 60472162 60472146 -
gtccttatcaatgacagacg

SEQ ID NO: 182860 - DNA, 20 bp, Artificial Sequence
  Synthetic oligonucleotide; AGG chr2 60472142 60472161 60472145 -
tccttatcaatgacagacgg

SEQ ID NO: 182861 - DNA, 20 bp, Artificial Sequence
  Synthetic oligonucleotide; GGG chr2 60472141 60472160 60472144 -
ccttatcaatgacagacgga

SEQ ID NO: 182862 - DNA, 20 bp, Artificial Sequence
  Synthetic oligonucleotide; TGG chr2 60472138 60472157 60472141 -
tatcaatgacagacggaggg

SEQ ID NO: 182863 - DNA, 20 bp, Artificial Sequence
  Synthetic oligonucleotide; TGG chr2 60472119 60472138 60472122 -
gtggaacctgaatttcctaa

SEQ ID NO: 182864 - DNA, 20 bp, Artificial Sequence
  Synthetic oligonucleotide; GAG chr2 60472117 60472136 60472120 -
ggaacctgaatttcctaatg

SEQ ID NO: 182865 - DNA, 20 bp, Artificial Sequence
  Synthetic oligonucleotide; AGG chr2 60472116 60472135 60472119 -
gaacctgaatttcctaatgg

SEQ ID NO: 182866 - DNA, 20 bp, Artificial Sequence
  Synthetic oligonucleotide; GGG chr2 60472115 60472134 60472118 -
aacctgaatttcctaatgga

SEQ ID NO: 182867 - DNA, 20 bp, Artificial Sequence
  Synthetic oligonucleotide; TAG chr2 60472107 60472126 60472110 -
tttcctaatggagggatcct

SEQ ID NO: 182868 - DNA, 20 bp, Artificial Sequence
  Synthetic oligonucleotide; AGG chr2 60472106 60472125 60472109 -
ttcctaatggagggatcctt

SEQ ID NO: 182869 - DNA, 20 bp, Artificial Sequence
  Synthetic oligonucleotide; GGG chr2 60472105 60472124 60472108 -
tcctaatggagggatcctta

SEQ ID NO: 182870 - DNA, 20 bp, Artificial Sequence
  Synthetic oligonucleotide; AAG chr2 60472095 60472114 60472098 -
gggatccttagggattccct

SEQ ID NO: 182871 - DNA, 20 bp, Artificial Sequence
  Synthetic oligonucleotide; CAG chr2 60472070 60472089 60472073 -
taatttgtttttgactgttc

SEQ ID NO: 182872 - DNA, 20 bp, Artificial Sequence
  Synthetic oligonucleotide; AAG chr2 60472062 60472081 60472065 -
ttttgactgttccagtccta

SEQ ID NO: 182873 - DNA, 20 bp, Artificial Sequence
  Synthetic oligonucleotide; AGG chr2 60472061 60472080 60472064 -
tttgactgttccagtcctaa

SEQ ID NO: 182874 - DNA, 20 bp, Artificial Sequence
  Synthetic oligonucleotide; GAG chr2 60472059 60472078 60472062 -
tgactgttccagtcctaaag

SEQ ID NO: 182875 - DNA, 20 bp, Artificial Sequence
  Synthetic oligonucleotide; AGG chr2 60472058 60472077 60472061 -
gactgttccagtcctaaagg

SEQ ID NO: 182876 - DNA, 20 bp, Artificial Sequence
  Synthetic oligonucleotide; TGG chr2 60472055 60472074 60472058 -
tgttccagtcctaaaggagg

SEQ ID NO: 182877 - DNA, 20 bp, Artificial Sequence
  Synthetic oligonucleotide; GGG chr2 60472054 60472073 60472057 -
gttccagtcctaaaggaggt

SEQ ID NO: 182878 - DNA, 20 bp, Artificial Sequence
  Synthetic oligonucleotide; TGG chr2 60472048 60472067 60472051 -
gtcctaaaggaggtgggtcc

SEQ ID NO: 182879 - DNA, 20 bp, Artificial Sequence
  Synthetic oligonucleotide; CAG chr2 60472044 60472063 60472047 -
taaaggaggtgggtcctgga

SEQ ID NO: 182880 - DNA, 20 bp, Artificial Sequence
  Synthetic oligonucleotide; AGG chr2 60472043 60472062 60472046 -
aaaggaggtgggtcctggac

SEQ ID NO: 182881 - DNA, 20 bp, Artificial Sequence
  Synthetic oligonucleotide; GAG chr2 60472041 60472060 60472044 -
aggaggtgggtcctggacag

SEQ ID NO: 182882 - DNA, 20 bp, Artificial Sequence
  Synthetic oligonucleotide; AGG chr2 60472040 60472059 60472043 -
ggaggtgggtcctggacagg

SEQ ID NO: 182883 - DNA, 20 bp, Artificial Sequence
  Synthetic oligonucleotide; GGG chr2 60472039 60472058 60472042 -
gaggtgggtcctggacagga

SEQ ID NO: 182884 - DNA, 20 bp, Artificial Sequence
  Synthetic oligonucleotide; CAG chr2 60472032 60472051 60472035 -
gtcctggacaggagggaaaa

SEQ ID NO: 182885 - DNA, 20 bp, Artificial Sequence
  Synthetic oligonucleotide; TGG chr2 60472024 60472043 60472027 -
caggagggaaaacagcctca

SEQ ID NO: 182886 - DNA, 20 bp, Artificial Sequence
  Synthetic oligonucleotide; TGG chr2 60472017 60472036 60472020 -
gaaaacagcctcatggccca

SEQ ID NO: 182887 - DNA, 20 bp, Artificial Sequence
  Synthetic oligonucleotide; GGG chr2 60472016 60472035 60472019 -
aaaacagcctcatggcccat

SEQ ID NO: 182888 - DNA, 20 bp, Artificial Sequence
  Synthetic oligonucleotide; CAG chr2 60472005 60472024 60472008 -
atggcccatgggtctctgcc

SEQ ID NO: 182889 - DNA, 20 bp, Artificial Sequence
  Synthetic oligonucleotide; AGG chr2 60472004 60472023 60472007 -
tggcccatgggtctctgccc

SEQ ID NO: 182890 - DNA, 20 bp, Artificial Sequence
  Synthetic oligonucleotide; GGG chr2 60472003 60472022 60472006 -
ggcccatgggtctctgccca

SEQ ID NO: 182891 - DNA, 20 bp, Artificial Sequence
  Synthetic oligonucleotide; AAG chr2 60471993 60472012 60471996 -
tctctgcccagggaatttca

SEQ ID NO: 182892 - DNA, 20 bp, Artificial Sequence
  Synthetic oligonucleotide; CAG chr2 60471986 60472005 60471989 -
ccagggaatttcaaagcttc

SEQ ID NO: 182893 - DNA, 20 bp, Artificial Sequence
  Synthetic oligonucleotide; AAG chr2 60471962 60471981 60471965 -
gttcatacttcccttaccct

SEQ ID NO: 182894 - DNA, 20 bp, Artificial Sequence
  Synthetic oligonucleotide; CAG chr2 60471958 60471977 60471961 -
atacttcccttaccctaaga

SEQ ID NO: 182895 - DNA, 20 bp, Artificial Sequence
  Synthetic oligonucleotide; CAG chr2 60471955 60471974 60471958 -
cttcccttaccctaagacag

SEQ ID NO: 182896 - DNA, 20 bp, Artificial Sequence
  Synthetic oligonucleotide; CAG chr2 60471944 60471963 60471947 -
ctaagacagcagtgctgatt

SEQ ID NO: 182897 - DNA, 20 bp, Artificial Sequence
  Synthetic oligonucleotide; GAG chr2 60471938 60471957 60471941 -
cagcagtgctgattcagctt

SEQ ID NO: 182898 - DNA, 20 bp, Artificial Sequence
  Synthetic oligonucleotide; GAG chr2 60471928 60471947 60471931 -
gattcagcttgagtgtgcat

SEQ ID NO: 182899 - DNA, 20 bp, Artificial Sequence
  Synthetic oligonucleotide; TGG chr2 60471918 60471937 60471921 -
gagtgtgcatgagaatcacc

SEQ ID NO: 182900 - DNA, 20 bp, Artificial Sequence
  Synthetic oligonucleotide; GAG chr2 60471916 60471935 60471919 -
gtgtgcatgagaatcacctg

SEQ ID NO: 182901 - DNA, 20 bp, Artificial Sequence
  Synthetic oligonucleotide; TAG chr2 60471900 60471919 60471903 -
cctggagaatttattcaaca

SEQ ID NO: 182902 - DNA, 20 bp, Artificial Sequence
  Synthetic oligonucleotide; AAG chr2 60471897 60471916 60471900 -
ggagaatttattcaacatag

SEQ ID NO: 182903 - DNA, 20 bp, Artificial Sequence
  Synthetic oligonucleotide; AGG chr2 60471896 60471915 60471899 -
gagaatttattcaacataga

SEQ ID NO: 182904 - DNA, 20 bp, Artificial Sequence
  Synthetic oligonucleotide; CAG chr2 60471866 60471885 60471869 -
cccaccctcaatttctgatt

SEQ ID NO: 182905 - DNA, 20 bp, Artificial Sequence
  Synthetic oligonucleotide; AAG chr2 60471862 60471881 60471865 -
ccctcaatttctgattcagt

SEQ ID NO: 182906 - DNA, 20 bp, Artificial Sequence
  Synthetic oligonucleotide; GAG chr2 60471856 60471875 60471859 -
atttctgattcagtaagtct

SEQ ID NO: 182907 - DNA, 20 bp, Artificial Sequence
  Synthetic oligonucleotide; AGG chr2 60471855 60471874 60471858 -
tttctgattcagtaagtctg

SEQ ID NO: 182908 - DNA, 20 bp, Artificial Sequence
  Synthetic oligonucleotide; TGG chr2 60471852 60471871 60471855 -
ctgattcagtaagtctgagg

SEQ ID NO: 182909 - DNA, 20 bp, Artificial Sequence
  Synthetic oligonucleotide; AAG chr2 60471844 60471863 60471847 -
gtaagtctgaggtggtgccc

SEQ ID NO: 182910 - DNA, 20 bp, Artificial Sequence
  Synthetic oligonucleotide; CAG chr2 60471818 60471837 60471821 -
ttgcattttgaacaaactcc

SEQ ID NO: 182911 - DNA, 20 bp, Artificial Sequence
  Synthetic oligonucleotide; AGG chr2 60471817 60471836 60471820 -
tgcattttgaacaaactccc

SEQ ID NO: 182912 - DNA, 20 bp, Artificial Sequence
  Synthetic oligonucleotide; CGG chr2 60471804 60471823 60471807 -
aactcccaggtgatgctgat

SEQ ID NO: 182913 - DNA, 20 bp, Artificial Sequence
  Synthetic oligonucleotide; GGG chr2 60471803 60471822 60471806 -
actcccaggtgatgctgatc

SEQ ID NO: 182914 - DNA, 20 bp, Artificial Sequence
  Synthetic oligonucleotide; GGG chr2 60471802 60471821 60471805 -
ctcccaggtgatgctgatcg

SEQ ID NO: 182915 - DNA, 20 bp, Artificial Sequence
  Synthetic oligonucleotide; GGG chr2 60471801 60471820 60471804 -
tcccaggtgatgctgatcgg

SEQ ID NO: 182916 - DNA, 20 bp, Artificial Sequence
  Synthetic oligonucleotide; TGG chr2 60471798 60471817 60471801 -
caggtgatgctgatcggggg

SEQ ID NO: 182917 - DNA, 20 bp, Artificial Sequence
  Synthetic oligonucleotide; GGG chr2 60471797 60471816 60471800 -
aggtgatgctgatcgggggt

SEQ ID NO: 182918 - DNA, 20 bp, Artificial Sequence
  Synthetic oligonucleotide; TGG chr2 60471792 60471811 60471795 -
atgctgatcgggggtgggcc

SEQ ID NO: 182919 - DNA, 20 bp, Artificial Sequence
  Synthetic oligonucleotide; GGG chr2 60471791 60471810 60471794 -
tgctgatcgggggtgggcct

SEQ ID NO: 182920 - DNA, 20 bp, Artificial Sequence
  Synthetic oligonucleotide; GAG chr2 60471778 60471797 60471781 -
tgggcctgggtctgcgctgt

SEQ ID NO: 182921 - DNA, 20 bp, Artificial Sequence
  Synthetic oligonucleotide; AAG chr2 60471763 60471782 60471766 -
gctgtgagaatcacttgcct

SEQ ID NO: 182922 - DNA, 20 bp, Artificial Sequence
  Synthetic oligonucleotide; GAG chr2 60471761 60471780 60471764 -
tgtgagaatcacttgcctaa

SEQ ID NO: 182923 - DNA, 20 bp, Artificial Sequence
  Synthetic oligonucleotide; AAG chr2 60471750 60471769 60471753 -
cttgcctaagagcactaaca

SEQ ID NO: 182924 - DNA, 20 bp, Artificial Sequence
  Synthetic oligonucleotide; AAG chr2 60471742 60471761 60471745 -
agagcactaacaaagaaaaa

SEQ ID NO: 182925 - DNA, 20 bp, Artificial Sequence
  Synthetic oligonucleotide; GAG chr2 60471740 60471759 60471743 -
agcactaacaaagaaaaaaa

SEQ ID NO: 182926 - DNA, 20 bp, Artificial Sequence
  Synthetic oligonucleotide; AGG chr2 60471739 60471758 60471742 -
gcactaacaaagaaaaaaag

SEQ ID NO: 182927 - DNA, 20 bp, Artificial Sequence
  Synthetic oligonucleotide; TAG chr2 60471729 60471748 60471732 -
agaaaaaaagaggacataac

SEQ ID NO: 182928 - DNA, 20 bp, Artificial Sequence
  Synthetic oligonucleotide; TAG chr2 60471713 60471732 60471716 -
taactagatcacccacttcc

SEQ ID NO: 182929 - DNA, 20 bp, Artificial Sequence
  Synthetic oligonucleotide; CAG chr2 60471709 60471728 60471712 -
tagatcacccacttcctagc

SEQ ID NO: 182930 - DNA, 20 bp, Artificial Sequence
  Synthetic oligonucleotide; CAG chr2 60471702 60471721 60471705 -
cccacttcctagccagcaac

SEQ ID NO: 182931 - DNA, 20 bp, Artificial Sequence
  Synthetic oligonucleotide; GAG chr2 60471700 60471719 60471703 -
cacttcctagccagcaacca

SEQ ID NO: 182932 - DNA, 20 bp, Artificial Sequence
  Synthetic oligonucleotide; TGG chr2 60471689 60471708 60471692 -
cagcaaccagagcccatctc

SEQ ID NO: 182933 - DNA, 20 bp, Artificial Sequence
  Synthetic oligonucleotide; TGG chr2 60471685 60471704 60471688 -
aaccagagcccatctctggc

SEQ ID NO: 182934 - DNA, 20 bp, Artificial Sequence
  Synthetic oligonucleotide; GGG chr2 60471684 60471703 60471687 -
accagagcccatctctggct

SEQ ID NO: 182935 - DNA, 20 bp, Artificial Sequence
  Synthetic oligonucleotide; GGG chr2 60471683 60471702 60471686 -
ccagagcccatctctggctg

SEQ ID NO: 182936 - DNA, 20 bp, Artificial Sequence
  Synthetic oligonucleotide; GAG chr2 60471681 60471700 60471684 -
agagcccatctctggctggg

SEQ ID NO: 182937 - DNA, 20 bp, Artificial Sequence
  Synthetic oligonucleotide; AAG chr2 60471673 60471692 60471676 -
tctctggctggggagaatga

SEQ ID NO: 182938 - DNA, 20 bp, Artificial Sequence
  Synthetic oligonucleotide; AAG chr2 60471668 60471687 60471671 -
ggctggggagaatgaaagcg

SEQ ID NO: 182939 - DNA, 20 bp, Artificial Sequence
  Synthetic oligonucleotide; AGG chr2 60471667 60471686 60471670 -
gctggggagaatgaaagcga

SEQ ID NO: 182940 - DNA, 20 bp, Artificial Sequence
  Synthetic oligonucleotide; TGG chr2 60471664 60471683 60471667 -
ggggagaatgaaagcgaagg

SEQ ID NO: 182941 - DNA, 20 bp, Artificial Sequence
  Synthetic oligonucleotide; GGG chr2 60471663 60471682 60471666 -
gggagaatgaaagcgaaggt

SEQ ID NO: 182942 - DNA, 20 bp, Artificial Sequence
  Synthetic oligonucleotide; AAG chr2 60471658 60471677 60471661 -
aatgaaagcgaaggtgggaa

SEQ ID NO: 182943 - DNA, 20 bp, Artificial Sequence
  Synthetic oligonucleotide; AAG chr2 60471655 60471674 60471658 -
gaaagcgaaggtgggaaaag

SEQ ID NO: 182944 - DNA, 20 bp, Artificial Sequence
  Synthetic oligonucleotide; GAG chr2 60471653 60471672 60471656 -
aagcgaaggtgggaaaagaa

SEQ ID NO: 182945 - DNA, 20 bp, Artificial Sequence
  Synthetic oligonucleotide; AGG chr2 60471652 60471671 60471655 -
agcgaaggtgggaaaagaag

SEQ ID NO: 182946 - DNA, 20 bp, Artificial Sequence
  Synthetic oligonucleotide; CAG chr2 60471641 60471660 60471644 -
gaaaagaagaggccctcaac

SEQ ID NO: 182947 - DNA, 20 bp, Artificial Sequence
  Synthetic oligonucleotide; AGG chr2 60471640 60471659 60471643 -
aaaagaagaggccctcaacc

SEQ ID NO: 182948 - DNA, 20 bp, Artificial Sequence
  Synthetic oligonucleotide; GGG chr2 60471639 60471658 60471642 -
aaagaagaggccctcaacca

SEQ ID NO: 182949 - DNA, 20 bp, Artificial Sequence
  Synthetic oligonucleotide; GGG chr2 60471638 60471657 60471641 -
aagaagaggccctcaaccag

SEQ ID NO: 182950 - DNA, 20 bp, Artificial Sequence
  Synthetic oligonucleotide; CAG chr2 60471635 60471654 60471638 -
aagaggccctcaaccagggg

SEQ ID NO: 182951 - DNA, 20 bp, Artificial Sequence
  Synthetic oligonucleotide; TGG chr2 60471616 60471635 60471619 -
gcagctccttttccccacct

SEQ ID NO: 182952 - DNA, 20 bp, Artificial Sequence
  Synthetic oligonucleotide; TGG chr2 60471611 60471630 60471614 -
tccttttccccaccttggcc

SEQ ID NO: 182953 - DNA, 20 bp, Artificial Sequence
  Synthetic oligonucleotide; GGG chr2 60471610 60471629 60471613 -
ccttttccccaccttggcct

SEQ ID NO: 182954 - DNA, 20 bp, Artificial Sequence
  Synthetic oligonucleotide; AAG chr2 60471607 60471626 60471610 -
tttccccaccttggcctggg

SEQ ID NO: 182955 - DNA, 20 bp, Artificial Sequence
  Synthetic oligonucleotide; AGG chr2 60471606 60471625 60471609 -
ttccccaccttggcctggga

SEQ ID NO: 182956 - DNA, 20 bp, Artificial Sequence
  Synthetic oligonucleotide; CAG chr2 60471603 60471622 60471606 -
cccaccttggcctgggaagg

SEQ ID NO: 182957 - DNA, 20 bp, Artificial Sequence
  Synthetic oligonucleotide; GAG chr2 60471601 60471620 60471604 -
caccttggcctgggaaggca

SEQ ID NO: 182958 - DNA, 20 bp, Artificial Sequence
  Synthetic oligonucleotide; GAG chr2 60471589 60471608 60471592 -
ggaaggcagagctgctcctc

SEQ ID NO: 182959 - DNA, 20 bp, Artificial Sequence
  Synthetic oligonucleotide; CAG chr2 60471577 60471596 60471580 -
tgctcctcgagtttgacgct

SEQ ID NO: 182960 - DNA, 20 bp, Artificial Sequence
  Synthetic oligonucleotide; AAG chr2 60471574 60471593 60471577 -
tcctcgagtttgacgctcag

SEQ ID NO: 182961 - DNA, 20 bp, Artificial Sequence
  Synthetic oligonucleotide; AAG chr2 60471544 60471563 60471547 -
tgtgatactttactttgcct

SEQ ID NO: 182962 - DNA, 20 bp, Artificial Sequence
  Synthetic oligonucleotide; AAG chr2 60471524 60471543 60471527 -
aagccgtgatgaaataattg

SEQ ID NO: 182963 - DNA, 20 bp, Artificial Sequence
  Synthetic oligonucleotide; AGG chr2 60471523 60471542 60471526 -
agccgtgatgaaataattga

SEQ ID NO: 182964 - DNA, 20 bp, Artificial Sequence
  Synthetic oligonucleotide; TAG chr2 60471515 60471534 60471518 -
tgaaataattgaaggcatca

SEQ ID NO: 182965 - DNA, 20 bp, Artificial Sequence
  Synthetic oligonucleotide; AAG chr2 60471511 60471530 60471514 -
ataattgaaggcatcatagc

SEQ ID NO: 182966 - DNA, 20 bp, Artificial Sequence
  Synthetic oligonucleotide; AAG chr2 60471508 60471527 60471511 -
attgaaggcatcatagcaag

SEQ ID NO: 182967 - DNA, 20 bp, Artificial Sequence
  Synthetic oligonucleotide; AAG chr2 60471503 60471522 60471506 -
aggcatcatagcaagaagtt

SEQ ID NO: 182968 - DNA, 20 bp, Artificial Sequence
  Synthetic oligonucleotide; TAG chr2 60471497 60471516 60471500 -
catagcaagaagttaagccc

SEQ ID NO: 182969 - DNA, 20 bp, Artificial Sequence
  Synthetic oligonucleotide; AGG chr2 60471496 60471515 60471499 -
atagcaagaagttaagccct

SEQ ID NO: 182970 - DNA, 20 bp, Artificial Sequence
  Synthetic oligonucleotide; GGG chr2 60471495 60471514 60471498 -
tagcaagaagttaagcccta

SEQ ID NO: 182971 - DNA, 20 bp, Artificial Sequence
  Synthetic oligonucleotide; GAG chr2 60471493 60471512 60471496 -
gcaagaagttaagccctagg

SEQ ID NO: 182972 - DNA, 20 bp, Artificial Sequence
  Synthetic oligonucleotide; AGG chr2 60471492 60471511 60471495 -
caagaagttaagccctaggg

SEQ ID NO: 182973 - DNA, 20 bp, Artificial Sequence
  Synthetic oligonucleotide; TAG chr2 60471477 60471496 60471480 -
tagggaggctattaacaatt

SEQ ID NO: 182974 - DNA, 20 bp, Artificial Sequence
  Synthetic oligonucleotide; CAG chr2 60471468 60471487 60471471 -
tattaacaatttagcatttc

SEQ ID NO: 182975 - DNA, 20 bp, Artificial Sequence
  Synthetic oligonucleotide; TGG chr2 60471459 60471478 60471462 -
tttagcatttccagttcatg

SEQ ID NO: 182976 - DNA, 20 bp, Artificial Sequence
  Synthetic oligonucleotide; GGG chr2 60471458 60471477 60471461 -
ttagcatttccagttcatgt

SEQ ID NO: 182977 - DNA, 20 bp, Artificial Sequence
  Synthetic oligonucleotide; AAG chr2 60471435 60471454 60471438 -
aatgtcgattttacttacca

SEQ ID NO: 182978 - DNA, 20 bp, Artificial Sequence
  Synthetic oligonucleotide; GAG chr2 60471433 60471452 60471436 -
tgtcgattttacttaccaaa

SEQ ID NO: 182979 - DNA, 20 bp, Artificial Sequence
  Synthetic oligonucleotide; TGG chr2 60471423 60471442 60471426 -
acttaccaaagagaatatta

SEQ ID NO: 182980 - DNA, 20 bp, Artificial Sequence
  Synthetic oligonucleotide; TAG chr2 60471413 60471432 60471416 -
gagaatattatggatgtgtt

SEQ ID NO: 182981 - DNA, 20 bp, Artificial Sequence
  Synthetic oligonucleotide; TGG chr2 60471410 60471429 60471413 -
aatattatggatgtgtttag

SEQ ID NO: 182982 - DNA, 20 bp, Artificial Sequence
  Synthetic oligonucleotide; AAG chr2 60471407 60471426 60471410 -
attatggatgtgtttagtgg

SEQ ID NO: 182983 - DNA, 20 bp, Artificial Sequence
  Synthetic oligonucleotide; AAG chr2 60471404 60471423 60471407 -
atggatgtgtttagtggaag

SEQ ID NO: 182984 - DNA, 20 bp, Artificial Sequence
  Synthetic oligonucleotide; CAG chr2 60471401 60471420 60471404 -
gatgtgtttagtggaagaag

SEQ ID NO: 182985 - DNA, 20 bp, Artificial Sequence
  Synthetic oligonucleotide; CAG chr2 60471398 60471417 60471401 -
gtgtttagtggaagaagcag

SEQ ID NO: 182986 - DNA, 20 bp, Artificial Sequence
  Synthetic oligonucleotide; CAG chr2 60471392 60471411 60471395 -
agtggaagaagcagcagaat

SEQ ID NO: 182987 - DNA, 20 bp, Artificial Sequence
  Synthetic oligonucleotide; TGG chr2 60471388 60471407 60471391 -
gaagaagcagcagaatcagc

SEQ ID NO: 182988 - DNA, 20 bp, Artificial Sequence
  Synthetic oligonucleotide; GGG chr2 60471387 60471406 60471390 -
aagaagcagcagaatcagct

SEQ ID NO: 182989 - DNA, 20 bp, Artificial Sequence
  Synthetic oligonucleotide; GGG chr2 60471386 60471405 60471389 -
agaagcagcagaatcagctg

SEQ ID NO: 182990 - DNA, 20 bp, Artificial Sequence
  Synthetic oligonucleotide; CAG chr2 60471379 60471398 60471382 -
gcagaatcagctggggtccc

SEQ ID NO: 182991 - DNA, 20 bp, Artificial Sequence
  Synthetic oligonucleotide; TGG chr2 60471375 60471394 60471378 -
aatcagctggggtccccagt

SEQ ID NO: 182992 - DNA, 20 bp, Artificial Sequence
  Synthetic oligonucleotide; AAG chr2 60471350 60471369 60471353 -
ttgctttgaccctcttcctg

SEQ ID NO: 182993 - DNA, 20 bp, Artificial Sequence
  Synthetic oligonucleotide; AGG chr2 60471349 60471368 60471352 -
tgctttgaccctcttcctga

SEQ ID NO: 182994 - DNA, 20 bp, Artificial Sequence
  Synthetic oligonucleotide; AAG chr2 60471346 60471365 60471349 -
tttgaccctcttcctgaagg

SEQ ID NO: 182995 - DNA, 20 bp, Artificial Sequence
  Synthetic oligonucleotide; AAG chr2 60471335 60471354 60471338 -
tcctgaaggaagataaatgc

SEQ ID NO: 182996 - DNA, 20 bp, Artificial Sequence
  Synthetic oligonucleotide; AGG chr2 60471334 60471353 60471337 -
cctgaaggaagataaatgca

SEQ ID NO: 182997 - DNA, 20 bp, Artificial Sequence
  Synthetic oligonucleotide; GGG chr2 60471333 60471352 60471336 -
ctgaaggaagataaatgcaa

SEQ ID NO: 182998 - DNA, 20 bp, Artificial Sequence
  Synthetic oligonucleotide; GAG chr2 60471329 60471348 60471332 -
aggaagataaatgcaagggt

SEQ ID NO: 182999 - DNA, 20 bp, Artificial Sequence
  Synthetic oligonucleotide; AAG chr2 60471319 60471338 60471322 -
atgcaagggtgagtctcaca

SEQ ID NO: 183000 - DNA, 20 bp, Artificial Sequence
  Synthetic oligonucleotide; CAG chr2 60471315 60471334 60471318 -
aagggtgagtctcacaaaga

SEQ ID NO: 183001 - DNA, 20 bp, Artificial Sequence
  Synthetic oligonucleotide; AAG chr2 60471297 60471316 60471300 -
gacagtgtgctttttttcta

SEQ ID NO: 183002 - DNA, 20 bp, Artificial Sequence
  Synthetic oligonucleotide; TAG chr2 60471290 60471309 60471293 -
tgctttttttctaaagtaaa

SEQ ID NO: 183003 - DNA, 20 bp, Artificial Sequence
  Synthetic oligonucleotide; TAG chr2 60471282 60471301 60471285 -
ttctaaagtaaatagcttct

SEQ ID NO: 183004 - DNA, 20 bp, Artificial Sequence
  Synthetic oligonucleotide; AGG chr2 60471281 60471300 60471284 -
tctaaagtaaatagcttctt

SEQ ID NO: 183005 - DNA, 20 bp, Artificial Sequence
  Synthetic oligonucleotide; TAG chr2 60471274 60471293 60471277 -
taaatagcttcttaggctga

SEQ ID NO: 183006 - DNA, 20 bp, Artificial Sequence
  Synthetic oligonucleotide; TAG chr2 60471262 60471281 60471265 -
taggctgatagaaatgtttt

SEQ ID NO: 183007 - DNA, 20 bp, Artificial Sequence
  Synthetic oligonucleotide; CAG chr2 60471246 60471265 60471249 -
tttttagctgtctaattctg

SEQ ID NO: 183008 - DNA, 20 bp, Artificial Sequence
  Synthetic oligonucleotide; AGG chr2 60471245 60471264 60471248 -
ttttagctgtctaattctgc

SEQ ID NO: 183009 - DNA, 20 bp, Artificial Sequence
  Synthetic oligonucleotide; GGG chr2 60471244 60471263 60471247 -
tttagctgtctaattctgca

SEQ ID NO: 183010 - DNA, 20 bp, Artificial Sequence
  Synthetic oligonucleotide; GGG chr2 60471243 60471262 60471246 -
ttagctgtctaattctgcag

SEQ ID NO: 183011 - DNA, 20 bp, Artificial Sequence
  Synthetic oligonucleotide; AAG chr2 60471240 60471259 60471243 -
gctgtctaattctgcagggg

SEQ ID NO: 183012 - DNA, 20 bp, Artificial Sequence
  Synthetic oligonucleotide; CAG chr2 60471237 60471256 60471240 -
gtctaattctgcaggggaag

SEQ ID NO: 183013 - DNA, 20 bp, Artificial Sequence
  Synthetic oligonucleotide; GAG chr2 60471235 60471254 60471238 -
ctaattctgcaggggaagca

SEQ ID NO: 183014 - DNA, 20 bp, Artificial Sequence
  Synthetic oligonucleotide; AGG chr2 60471234 60471253 60471237 -
taattctgcaggggaagcag

SEQ ID NO: 183015 - DNA, 20 bp, Artificial Sequence
  Synthetic oligonucleotide; TAG chr2 60471231 60471250 60471234 -
ttctgcaggggaagcagagg

SEQ ID NO: 183016 - DNA, 20 bp, Artificial Sequence
  Synthetic oligonucleotide; GAG chr2 60471229 60471248 60471232 -
ctgcaggggaagcagaggta

SEQ ID NO: 183017 - DNA, 20 bp, Artificial Sequence
  Synthetic oligonucleotide; AGG chr2 60471228 60471247 60471231 -
tgcaggggaagcagaggtag

SEQ ID NO: 183018 - DNA, 20 bp, Artificial Sequence
  Synthetic oligonucleotide; GGG chr2 60471227 60471246 60471230 -
gcaggggaagcagaggtaga

SEQ ID NO: 183019 - DNA, 20 bp, Artificial Sequence
  Synthetic oligonucleotide; CAG chr2 60471218 60471237 60471221 -
gcagaggtagagggtgaaca

SEQ ID NO: 183020 - DNA, 20 bp, Artificial Sequence
  Synthetic oligonucleotide; AAG chr2 60471213 60471232 60471216 -
ggtagagggtgaacacagca

SEQ ID NO: 183021 - DNA, 20 bp, Artificial Sequence
  Synthetic oligonucleotide; AGG chr2 60471212 60471231 60471215 -
gtagagggtgaacacagcaa

SEQ ID NO: 183022 - DNA, 20 bp, Artificial Sequence
  Synthetic oligonucleotide; GAG chr2 60471208 60471227 60471211 -
agggtgaacacagcaaaggt

SEQ ID NO: 183023 - DNA, 20 bp, Artificial Sequence
  Synthetic oligonucleotide; AGG chr2 60471207 60471226 60471210 -
gggtgaacacagcaaaggtg

SEQ ID NO: 183024 - DNA, 20 bp, Artificial Sequence
  Synthetic oligonucleotide; CAG chr2 60471203 60471222 60471206 -
gaacacagcaaaggtgaggc

SEQ ID NO: 183025 - DNA, 20 bp, Artificial Sequence
  Synthetic oligonucleotide; AGG chr2 60471202 60471221 60471205 -
aacacagcaaaggtgaggcc

SEQ ID NO: 183026 - DNA, 20 bp, Artificial Sequence
  Synthetic oligonucleotide; GAG chr2 60471200 60471219 60471203 -
cacagcaaaggtgaggccag

SEQ ID NO: 183027 - DNA, 20 bp, Artificial Sequence
  Synthetic oligonucleotide; AGG chr2 60471199 60471218 60471202 -
acagcaaaggtgaggccagg

SEQ ID NO: 183028 - DNA, 20 bp, Artificial Sequence
  Synthetic oligonucleotide; CAG chr2 60471194 60471213 60471197 -
aaaggtgaggccaggaggcc

SEQ ID NO: 183029 - DNA, 20 bp, Artificial Sequence
  Synthetic oligonucleotide; AGG chr2 60471193 60471212 60471196 -
aaggtgaggccaggaggccc

SEQ ID NO: 183030 - DNA, 20 bp, Artificial Sequence
  Synthetic oligonucleotide; CAG chr2 60471190 60471209 60471193 -
gtgaggccaggaggcccagg

SEQ ID NO: 183031 - DNA, 20 bp, Artificial Sequence
  Synthetic oligonucleotide; CAG chr2 60471187 60471206 60471190 -
aggccaggaggcccaggcag

SEQ ID NO: 183032 - DNA, 20 bp, Artificial Sequence
  Synthetic oligonucleotide; GAG chr2 60471185 60471204 60471188 -
gccaggaggcccaggcagca

SEQ ID NO: 183033 - DNA, 20 bp, Artificial Sequence
  Synthetic oligonucleotide; CAG chr2 60471182 60471201 60471185 -
aggaggcccaggcagcagag

SEQ ID NO: 183034 - DNA, 20 bp, Artificial Sequence
  Synthetic oligonucleotide; AGG chr2 60471181 60471200 60471184 -
ggaggcccaggcagcagagc

SEQ ID NO: 183035 - DNA, 20 bp, Artificial Sequence
  Synthetic oligonucleotide; GAG chr2 60471161 60471180 60471164 -
aggccttgttttccaattgt

SEQ ID NO: 183036 - DNA, 20 bp, Artificial Sequence
  Synthetic oligonucleotide; AAG chr2 60471155 60471174 60471158 -
tgttttccaattgtgagacc

SEQ ID NO: 183037 - DNA, 20 bp, Artificial Sequence
  Synthetic oligonucleotide; CAG chr2 60471151 60471170 60471154 -
ttccaattgtgagaccaagt

SEQ ID NO: 183038 - DNA, 20 bp, Artificial Sequence
  Synthetic oligonucleotide; TGG chr2 60471143 60471162 60471146 -
gtgagaccaagtcagttcat

SEQ ID NO: 183039 - DNA, 20 bp, Artificial Sequence
  Synthetic oligonucleotide; AAG chr2 60471130 60471149 60471133 -
agttcattggcacctttcga

SEQ ID NO: 183040 - DNA, 20 bp, Artificial Sequence
  Synthetic oligonucleotide; TAG chr2 60471120 60471139 60471123 -
cacctttcgaaagccccatg

SEQ ID NO: 183041 - DNA, 20 bp, Artificial Sequence
  Synthetic oligonucleotide; TGG chr2 60471111 60471130 60471114 -
aaagccccatgtagcgctgc

SEQ ID NO: 183042 - DNA, 20 bp, Artificial Sequence
  Synthetic oligonucleotide; GGG chr2 60471110 60471129 60471113 -
aagccccatgtagcgctgct

SEQ ID NO: 183043 - DNA, 20 bp, Artificial Sequence
  Synthetic oligonucleotide; TGG chr2 60471106 60471125 60471109 -
cccatgtagcgctgctgggc

SEQ ID NO: 183044 - DNA, 20 bp, Artificial Sequence
  Synthetic oligonucleotide; AAG chr2 60471093 60471112 60471096 -
gctgggctggaccctccccc

SEQ ID NO: 183045 - DNA, 20 bp, Artificial Sequence
  Synthetic oligonucleotide; CGG chr2 60471089 60471108 60471092 -
ggctggaccctcccccaaga

SEQ ID NO: 183046 - DNA, 20 bp, Artificial Sequence
  Synthetic oligonucleotide; AAG chr2 60471084 60471103 60471087 -
gaccctcccccaagacggtt

SEQ ID NO: 183047 - DNA, 20 bp, Artificial Sequence
  Synthetic oligonucleotide; TGG chr2 60471071 60471090 60471074 -
gacggttaagtactgcttaa

SEQ ID NO: 183048 - DNA, 20 bp, Artificial Sequence
  Synthetic oligonucleotide; CAG chr2 60471066 60471085 60471069 -
ttaagtactgcttaatggat

SEQ ID NO: 183049 - DNA, 20 bp, Artificial Sequence
  Synthetic oligonucleotide; TAG chr2 60471063 60471082 60471066 -
agtactgcttaatggatcag

SEQ ID NO: 183050 - DNA, 20 bp, Artificial Sequence
  Synthetic oligonucleotide; CAG chr2 60471057 60471076 60471060 -
gcttaatggatcagtagaaa

SEQ ID NO: 183051 - DNA, 20 bp, Artificial Sequence
  Synthetic oligonucleotide; AGG chr2 60471056 60471075 60471059 -
cttaatggatcagtagaaac

SEQ ID NO: 183052 - DNA, 20 bp, Artificial Sequence
  Synthetic oligonucleotide; TGG chr2 60471043 60471062 60471046 -
tagaaacaggaccttcttgt

SEQ ID NO: 183053 - DNA, 20 bp, Artificial Sequence
  Synthetic oligonucleotide; GGG chr2 60471042 60471061 60471045 -
agaaacaggaccttcttgtt

SEQ ID NO: 183054 - DNA, 20 bp, Artificial Sequence
  Synthetic oligonucleotide; CAG chr2 60471039 60471058 60471042 -
aacaggaccttcttgttggg

SEQ ID NO: 183055 - DNA, 20 bp, Artificial Sequence
  Synthetic oligonucleotide; AAG chr2 60471034 60471053 60471037 -
gaccttcttgttgggcagtg

SEQ ID NO: 183056 - DNA, 20 bp, Artificial Sequence
  Synthetic oligonucleotide; CGG chr2 60471027 60471046 60471030 -
ttgttgggcagtgaagacca

SEQ ID NO: 183057 - DNA, 20 bp, Artificial Sequence
  Synthetic oligonucleotide; CAG chr2 60471024 60471043 60471027 -
ttgggcagtgaagaccacgg

SEQ ID NO: 183058 - DNA, 20 bp, Artificial Sequence
  Synthetic oligonucleotide; AGG chr2 60471023 60471042 60471026 -
tgggcagtgaagaccacggc

SEQ ID NO: 183059 - DNA, 20 bp, Artificial Sequence
  Synthetic oligonucleotide; GAG chr2 60471021 60471040 60471024 -
ggcagtgaagaccacggcag

SEQ ID NO: 183060 - DNA, 20 bp, Artificial Sequence
  Synthetic oligonucleotide; CAG chr2 60471018 60471037 60471021 -
agtgaagaccacggcaggag

SEQ ID NO: 183061 - DNA, 20 bp, Artificial Sequence
  Synthetic oligonucleotide; CAG chr2 60471015 60471034 60471018 -
gaagaccacggcaggagcag

SEQ ID NO: 183062 - DNA, 20 bp, Artificial Sequence
  Synthetic oligonucleotide; AGG chr2 60471014 60471033 60471017 -
aagaccacggcaggagcagc

SEQ ID NO: 183063 - DNA, 20 bp, Artificial Sequence
  Synthetic oligonucleotide; GGG chr2 60471013 60471032 60471016 -
agaccacggcaggagcagca

SEQ ID NO: 183064 - DNA, 20 bp, Artificial Sequence
  Synthetic oligonucleotide; GGG chr2 60471012 60471031 60471015 -
gaccacggcaggagcagcag

SEQ ID NO: 183065 - DNA, 20 bp, Artificial Sequence
  Synthetic oligonucleotide; GGG chr2 60471011 60471030 60471014 -
accacggcaggagcagcagg

SEQ ID NO: 183066 - DNA, 20 bp, Artificial Sequence
  Synthetic oligonucleotide; GGG chr2 60471010 60471029 60471013 -
ccacggcaggagcagcaggg

SEQ ID NO: 183067 - DNA, 20 bp, Artificial Sequence
  Synthetic oligonucleotide; AAG chr2 60471007 60471026 60471010 -
cggcaggagcagcagggggg

SEQ ID NO: 183068 - DNA, 20 bp, Artificial Sequence
  Synthetic oligonucleotide; GAG chr2 60471005 60471024 60471008 -
gcaggagcagcaggggggaa

SEQ ID NO: 183069 - DNA, 20 bp, Artificial Sequence
  Synthetic oligonucleotide; CAG chr2 60470993 60471012 60470996 -
ggggggaagagacaaattcc

SEQ ID NO: 183070 - DNA, 20 bp, Artificial Sequence
  Synthetic oligonucleotide; AGG chr2 60470992 60471011 60470995 -
gggggaagagacaaattccc

SEQ ID NO: 183071 - DNA, 20 bp, Artificial Sequence
  Synthetic oligonucleotide; AAG chr2 60470988 60471007 60470991 -
gaagagacaaattcccagga

SEQ ID NO: 183072 - DNA, 20 bp, Artificial Sequence
  Synthetic oligonucleotide; TGG chr2 60470980 60470999 60470983 -
aaattcccaggaaagaccac

SEQ ID NO: 183073 - DNA, 20 bp, Artificial Sequence
  Synthetic oligonucleotide; CAG chr2 60470975 60470994 60470978 -
cccaggaaagaccactggat

SEQ ID NO: 183074 - DNA, 20 bp, Artificial Sequence
  Synthetic oligonucleotide; AGG chr2 60470974 60470993 60470977 -
ccaggaaagaccactggatc

SEQ ID NO: 183075 - DNA, 20 bp, Artificial Sequence
  Synthetic oligonucleotide; GAG chr2 60470972 60470991 60470975 -
aggaaagaccactggatcag

SEQ ID NO: 183076 - DNA, 20 bp, Artificial Sequence
  Synthetic oligonucleotide; CAG chr2 60470968 60470987 60470971 -
aagaccactggatcaggagt

SEQ ID NO: 183077 - DNA, 20 bp, Artificial Sequence
  Synthetic oligonucleotide; AGG chr2 60470967 60470986 60470970 -
agaccactggatcaggagtc

SEQ ID NO: 183078 - DNA, 20 bp, Artificial Sequence
  Synthetic oligonucleotide; GAG chr2 60470965 60470984 60470968 -
accactggatcaggagtcag

SEQ ID NO: 183079 - DNA, 20 bp, Artificial Sequence
  Synthetic oligonucleotide; TGG chr2 60470940 60470959 60470943 -
taattctaatcttcacattg

SEQ ID NO: 183080 - DNA, 20 bp, Artificial Sequence
  Synthetic oligonucleotide; CAG chr2 60470929 60470948 60470932 -
ttcacattgtggttaatcat

SEQ ID NO: 183081 - DNA, 20 bp, Artificial Sequence
  Synthetic oligonucleotide; TAG chr2 60470924 60470943 60470927 -
attgtggttaatcatcagtg

SEQ ID NO: 183082 - DNA, 20 bp, Artificial Sequence
  Synthetic oligonucleotide; TGG chr2 60470918 60470937 60470921 -
gttaatcatcagtgtagcca

SEQ ID NO: 183083 - DNA, 20 bp, Artificial Sequence
  Synthetic oligonucleotide; GGG chr2 60470917 60470936 60470920 -
ttaatcatcagtgtagccat

SEQ ID NO: 183084 - DNA, 20 bp, Artificial Sequence
  Synthetic oligonucleotide; AAG chr2 60470913 60470932 60470916 -
tcatcagtgtagccatgggc

SEQ ID NO: 183085 - DNA, 20 bp, Artificial Sequence
  Synthetic oligonucleotide; TGG chr2 60470895 60470914 60470898 -
gcaagtcacttaatttctca

SEQ ID NO: 183086 - DNA, 20 bp, Artificial Sequence
  Synthetic oligonucleotide; CAG chr2 60470889 60470908 60470892 -
cacttaatttctcatggcct

SEQ ID NO: 183087 - DNA, 20 bp, Artificial Sequence
  Synthetic oligonucleotide; AAG chr2 60470867 60470886 60470870 -
gtttccccatctgtaaaatg

SEQ ID NO: 183088 - DNA, 20 bp, Artificial Sequence
  Synthetic oligonucleotide; AGG chr2 60470866 60470885 60470869 -
tttccccatctgtaaaatga

SEQ ID NO: 183089 - DNA, 20 bp, Artificial Sequence
  Synthetic oligonucleotide; GGG chr2 60470865 60470884 60470868 -
ttccccatctgtaaaatgaa

SEQ ID NO: 183090 - DNA, 20 bp, Artificial Sequence
  Synthetic oligonucleotide; CAG chr2 60470861 60470880 60470864 -
ccatctgtaaaatgaaggga

SEQ ID NO: 183091 - DNA, 20 bp, Artificial Sequence
  Synthetic oligonucleotide; TAG chr2 60470849 60470868 60470852 -
tgaagggacagacttgatga

SEQ ID NO: 183092 - DNA, 20 bp, Artificial Sequence
  Synthetic oligonucleotide; TAG chr2 60470845 60470864 60470848 -
gggacagacttgatgatagc

SEQ ID NO: 183093 - DNA, 20 bp, Artificial Sequence
  Synthetic oligonucleotide; AGG chr2 60470844 60470863 60470847 -
ggacagacttgatgatagct

SEQ ID NO: 183094 - DNA, 20 bp, Artificial Sequence
  Synthetic oligonucleotide; GGG chr2 60470843 60470862 60470846 -
gacagacttgatgatagcta

SEQ ID NO: 183095 - DNA, 20 bp, Artificial Sequence
  Synthetic oligonucleotide; TAG chr2 60470828 60470847 60470831 -
agctagggttttttacaact

SEQ ID NO: 183096 - DNA, 20 bp, Artificial Sequence
  Synthetic oligonucleotide; CAG chr2 60470784 60470803 60470787 -
acaaaaacaaactatgctgc

SEQ ID NO: 183097 - DNA, 20 bp, Artificial Sequence
  Synthetic oligonucleotide; TAG chr2 60470780 60470799 60470783 -
aaacaaactatgctgccaga

SEQ ID NO: 183098 - DNA, 20 bp, Artificial Sequence
  Synthetic oligonucleotide; CAG chr2 60470776 60470795 60470779 -
aaactatgctgccagatagt

SEQ ID NO: 183099 - DNA, 20 bp, Artificial Sequence
  Synthetic oligonucleotide; GAG chr2 60470771 60470790 60470774 -
atgctgccagatagtcagat

SEQ ID NO: 183100 - DNA, 20 bp, Artificial Sequence
  Synthetic oligonucleotide; CGG chr2 60470752 60470771 60470755 -
tgagacctcactttgccaca

SEQ ID NO: 183101 - DNA, 20 bp, Artificial Sequence
  Synthetic oligonucleotide; CAG chr2 60470748 60470767 60470751 -
acctcactttgccacacggc

SEQ ID NO: 183102 - DNA, 20 bp, Artificial Sequence
  Synthetic oligonucleotide; TAG chr2 60470739 60470758 60470742 -
tgccacacggccagacactg

SEQ ID NO: 183103 - DNA, 20 bp, Artificial Sequence
  Synthetic oligonucleotide; GAG chr2 60470737 60470756 60470740 -
ccacacggccagacactgta

SEQ ID NO: 183104 - DNA, 20 bp, Artificial Sequence
  Synthetic oligonucleotide; TGG chr2 60470731 60470750 60470734 -
ggccagacactgtagagatc

SEQ ID NO: 183105 - DNA, 20 bp, Artificial Sequence
  Synthetic oligonucleotide; CAG chr2 60470719 60470738 60470722 -
tagagatctggtcctgccgt

SEQ ID NO: 183106 - DNA, 20 bp, Artificial Sequence
  Synthetic oligonucleotide; TAG chr2 60470710 60470729 60470713 -
ggtcctgccgtcagcttgtt

SEQ ID NO: 183107 - DNA, 20 bp, Artificial Sequence
  Synthetic oligonucleotide; AGG chr2 60470709 60470728 60470712 -
gtcctgccgtcagcttgttt

SEQ ID NO: 183108 - DNA, 20 bp, Artificial Sequence
  Synthetic oligonucleotide; GGG chr2 60470708 60470727 60470711 -
tcctgccgtcagcttgttta

SEQ ID NO: 183109 - DNA, 20 bp, Artificial Sequence
  Synthetic oligonucleotide; TGG chr2 60470701 60470720 60470704 -
gtcagcttgtttagggctaa

SEQ ID NO: 183110 - DNA, 20 bp, Artificial Sequence
  Synthetic oligonucleotide; GGG chr2 60470700 60470719 60470703 -
tcagcttgtttagggctaat

SEQ ID NO: 183111 - DNA, 20 bp, Artificial Sequence
  Synthetic oligonucleotide; TAG chr2 60470693 60470712 60470696 -
gtttagggctaatgggtttg

SEQ ID NO: 183112 - DNA, 20 bp, Artificial Sequence
  Synthetic oligonucleotide; AAG chr2 60470688 60470707 60470691 -
gggctaatgggtttgtagac

SEQ ID NO: 183113 - DNA, 20 bp, Artificial Sequence
  Synthetic oligonucleotide; AAG chr2 60470676 60470695 60470679 -
ttgtagacaagtttgccaac

SEQ ID NO: 183114 - DNA, 20 bp, Artificial Sequence
  Synthetic oligonucleotide; GAG chr2 60470674 60470693 60470677 -
gtagacaagtttgccaacaa

SEQ ID NO: 183115 - DNA, 20 bp, Artificial Sequence
  Synthetic oligonucleotide; GAG chr2 60470663 60470682 60470666 -
tgccaacaagagattcatgc

SEQ ID NO: 183116 - DNA, 20 bp, Artificial Sequence
  Synthetic oligonucleotide; AGG chr2 60470662 60470681 60470665 -
gccaacaagagattcatgcg

SEQ ID NO: 183117 - DNA, 20 bp, Artificial Sequence
  Synthetic oligonucleotide; GGG chr2 60470661 60470680 60470664 -
ccaacaagagattcatgcga

SEQ ID NO: 183118 - DNA, 20 bp, Artificial Sequence
  Synthetic oligonucleotide; GGG chr2 60470660 60470679 60470663 -
caacaagagattcatgcgag

SEQ ID NO: 183119 - DNA, 20 bp, Artificial Sequence
  Synthetic oligonucleotide; TAG chr2 60470656 60470675 60470659 -
aagagattcatgcgaggggc

SEQ ID NO: 183120 - DNA, 20 bp, Artificial Sequence
  Synthetic oligonucleotide; AGG chr2 60470655 60470674 60470658 -
agagattcatgcgaggggct

SEQ ID NO: 183121 - DNA, 20 bp, Artificial Sequence
  Synthetic oligonucleotide; TGG chr2 60470650 60470669 60470653 -
ttcatgcgaggggctaggca

SEQ ID NO: 183122 - DNA, 20 bp, Artificial Sequence
  Synthetic oligonucleotide; TAG chr2 60470645 60470664 60470648 -
gcgaggggctaggcatggat

SEQ ID NO: 183123 - DNA, 20 bp, Artificial Sequence
  Synthetic oligonucleotide; AGG chr2 60470644 60470663 60470647 -
cgaggggctaggcatggatt

SEQ ID NO: 183124 - DNA, 20 bp, Artificial Sequence
  Synthetic oligonucleotide; TAG chr2 60470640 60470659 60470643 -
gggctaggcatggattaggt

SEQ ID NO: 183125 - DNA, 20 bp, Artificial Sequence
  Synthetic oligonucleotide; CAG chr2 60470637 60470656 60470640 -
ctaggcatggattaggttag

SEQ ID NO: 183126 - DNA, 20 bp, Artificial Sequence
  Synthetic oligonucleotide; TGG chr2 60470618 60470637 60470621 -
gcagttctcccatttcttgc

SEQ ID NO: 183127 - DNA, 20 bp, Artificial Sequence
  Synthetic oligonucleotide; GAG chr2 60470616 60470635 60470619 -
agttctcccatttcttgctg

SEQ ID NO: 183128 - DNA, 20 bp, Artificial Sequence
  Synthetic oligonucleotide; AGG chr2 60470615 60470634 60470618 -
gttctcccatttcttgctgg

SEQ ID NO: 183129 - DNA, 20 bp, Artificial Sequence
  Synthetic oligonucleotide; AAG chr2 60470605 60470624 60470608 -
ttcttgctggaggcctgctg

SEQ ID NO: 183130 - DNA, 20 bp, Artificial Sequence
  Synthetic oligonucleotide; CAG chr2 60470597 60470616 60470600 -
ggaggcctgctgaagcactt

SEQ ID NO: 183131 - DNA, 20 bp, Artificial Sequence
  Synthetic oligonucleotide; AGG chr2 60470596 60470615 60470599 -
gaggcctgctgaagcacttc

SEQ ID NO: 183132 - DNA, 20 bp, Artificial Sequence
  Synthetic oligonucleotide; GGG chr2 60470595 60470614 60470598 -
aggcctgctgaagcacttca

SEQ ID NO: 183133 - DNA, 20 bp, Artificial Sequence
  Synthetic oligonucleotide; CAG chr2 60470584 60470603 60470587 -
agcacttcagggtctcttcc

SEQ ID NO: 183134 - DNA, 20 bp, Artificial Sequence
  Synthetic oligonucleotide; GAG chr2 60470582 60470601 60470585 -
cacttcagggtctcttccca

SEQ ID NO: 183135 - DNA, 20 bp, Artificial Sequence
  Synthetic oligonucleotide; AAG chr2 60470578 60470597 60470581 -
tcagggtctcttcccagagt

SEQ ID NO: 183136 - DNA, 20 bp, Artificial Sequence
  Synthetic oligonucleotide; TGG chr2 60470575 60470594 60470578 -
gggtctcttcccagagtaag

SEQ ID NO: 183137 - DNA, 20 bp, Artificial Sequence
  Synthetic oligonucleotide; CAG chr2 60470572 60470591 60470575 -
tctcttcccagagtaagtgg

SEQ ID NO: 183138 - DNA, 20 bp, Artificial Sequence
  Synthetic oligonucleotide; GAG chr2 60470570 60470589 60470573 -
tcttcccagagtaagtggca

SEQ ID NO: 183139 - DNA, 20 bp, Artificial Sequence
  Synthetic oligonucleotide; AAG chr2 60470541 60470560 60470544 -
aaatttgatactccccatac

SEQ ID NO: 183140 - DNA, 20 bp, Artificial Sequence
  Synthetic oligonucleotide; AGG chr2 60470540 60470559 60470543 -
aatttgatactccccataca

SEQ ID NO: 183141 - DNA, 20 bp, Artificial Sequence
  Synthetic oligonucleotide; AAG chr2 60470533 60470552 60470536 -
tactccccatacaaggatcc

SEQ ID NO: 183142 - DNA, 20 bp, Artificial Sequence
  Synthetic oligonucleotide; TGG chr2 60470512 60470531 60470515 -
agtacctgttgcgtttatgc

SEQ ID NO: 183143 - DNA, 20 bp, Artificial Sequence
  Synthetic oligonucleotide; GGG chr2 60470511 60470530 60470514 -
gtacctgttgcgtttatgct

SEQ ID NO: 183144 - DNA, 20 bp, Artificial Sequence
  Synthetic oligonucleotide; CAG chr2 60470504 60470523 60470507 -
ttgcgtttatgctgggatca

SEQ ID NO: 183145 - DNA, 20 bp, Artificial Sequence
  Synthetic oligonucleotide; GAG chr2 60470502 60470521 60470505 -
gcgtttatgctgggatcaca

SEQ ID NO: 183146 - DNA, 20 bp, Artificial Sequence
  Synthetic oligonucleotide; TGG chr2 60470494 60470513 60470497 -
gctgggatcacagagatacc

SEQ ID NO: 183147 - DNA, 20 bp, Artificial Sequence
  Synthetic oligonucleotide; GGG chr2 60470493 60470512 60470496 -
ctgggatcacagagatacct

SEQ ID NO: 183148 - DNA, 20 bp, Artificial Sequence
  Synthetic oligonucleotide; AAG chr2 60470475 60470494 60470478 -
ctgggttgcctgtgtttcct

SEQ ID NO: 183149 - DNA, 20 bp, Artificial Sequence
  Synthetic oligonucleotide; AAG chr2 60470470 60470489 60470473 -
ttgcctgtgtttcctaagaa

SEQ ID NO: 183150 - DNA, 20 bp, Artificial Sequence
  Synthetic oligonucleotide; AGG chr2 60470469 60470488 60470472 -
tgcctgtgtttcctaagaaa

SEQ ID NO: 183151 - DNA, 20 bp, Artificial Sequence
  Synthetic oligonucleotide; TGG chr2 60470456 60470475 60470459 -
taagaaaaggatgtctgttt

SEQ ID NO: 183152 - DNA, 20 bp, Artificial Sequence
  Synthetic oligonucleotide; CAG chr2 60470453 60470472 60470456 -
gaaaaggatgtctgttttgg

SEQ ID NO: 183153 - DNA, 20 bp, Artificial Sequence
  Synthetic oligonucleotide; TAG chr2 60470444 60470463 60470447 -
gtctgttttggcagcaaact

SEQ ID NO: 183154 - DNA, 20 bp, Artificial Sequence
  Synthetic oligonucleotide; CGG chr2 60470437 60470456 60470440 -
ttggcagcaaacttagtgaa

SEQ ID NO: 183155 - DNA, 20 bp, Artificial Sequence
  Synthetic oligonucleotide; GAG chr2 60470432 60470451 60470435 -
agcaaacttagtgaacggct

SEQ ID NO: 183156 - DNA, 20 bp, Artificial Sequence
  Synthetic oligonucleotide; AGG chr2 60470431 60470450 60470434 -
gcaaacttagtgaacggctg

SEQ ID NO: 183157 - DNA, 20 bp, Artificial Sequence
  Synthetic oligonucleotide; AAG chr2 60470421 60470440 60470424 -
tgaacggctgaggcaaaaac

SEQ ID NO: 183158 - DNA, 20 bp, Artificial Sequence
  Synthetic oligonucleotide; AAG chr2 60470414 60470433 60470417 -
ctgaggcaaaaacaagtgca

SEQ ID NO: 183159 - DNA, 20 bp, Artificial Sequence
  Synthetic oligonucleotide; TGG chr2 60470410 60470429 60470413 -
ggcaaaaacaagtgcaaaga

SEQ ID NO: 183160 - DNA, 20 bp, Artificial Sequence
  Synthetic oligonucleotide; CAG chr2 60470402 60470421 60470405 -
caagtgcaaagatggattct

SEQ ID NO: 183161 - DNA, 20 bp, Artificial Sequence
  Synthetic oligonucleotide; TAG chr2 60470366 60470385 60470369 -
aaataccatgacaaaatctg

SEQ ID NO: 183162 - DNA, 20 bp, Artificial Sequence
  Synthetic oligonucleotide; CAG chr2 60470326 60470345 60470329 -
ctcaattcacttgacgtaaa

SEQ ID NO: 183163 - DNA, 20 bp, Artificial Sequence
  Synthetic oligonucleotide; TAG chr2 60470316 60470335 60470319 -
ttgacgtaaacagtcaaatg

SEQ ID NO: 183164 - DNA, 20 bp, Artificial Sequence
  Synthetic oligonucleotide; AAG chr2 60470298 60470317 60470301 -
tgtagacatacttgtttgtt

SEQ ID NO: 183165 - DNA, 20 bp, Artificial Sequence
  Synthetic oligonucleotide; CGG chr2 60470293 60470312 60470296 -
acatacttgtttgttaagtc

SEQ ID NO: 183166 - DNA, 20 bp, Artificial Sequence
  Synthetic oligonucleotide; TGG chr2 60470275 60470294 60470278 -
tccggtcttcctgcttgtgt

SEQ ID NO: 183167 - DNA, 20 bp, Artificial Sequence
  Synthetic oligonucleotide; TGG chr2 60470263 60470282 60470266 -
gcttgtgttggttcactttg

SEQ ID NO: 183168 - DNA, 20 bp, Artificial Sequence
  Synthetic oligonucleotide; TGG chr2 60470246 60470265 60470249 -
ttgtggtgtttattttgttt

SEQ ID NO: 183169 - DNA, 20 bp, Artificial Sequence
  Synthetic oligonucleotide; GGG chr2 60470245 60470264 60470248 -
tgtggtgtttattttgtttt

SEQ ID NO: 183170 - DNA, 20 bp, Artificial Sequence
  Synthetic oligonucleotide; CAG chr2 60470241 60470260 60470244 -
gtgtttattttgttttgggt

SEQ ID NO: 183171 - DNA, 20 bp, Artificial Sequence
  Synthetic oligonucleotide; GAG chr2 60470239 60470258 60470242 -
gtttattttgttttgggtca

SEQ ID NO: 183172 - DNA, 20 bp, Artificial Sequence
  Synthetic oligonucleotide; GAG chr2 60470237 60470256 60470240 -
ttattttgttttgggtcaga

SEQ ID NO: 183173 - DNA, 20 bp, Artificial Sequence
  Synthetic oligonucleotide; AGG chr2 60470236 60470255 60470239 -
tattttgttttgggtcagag

SEQ ID NO: 183174 - DNA, 20 bp, Artificial Sequence
  Synthetic oligonucleotide; TAG chr2 60470219 60470238 60470222 -
gagaggatgaaatgtctctg

SEQ ID NO: 183175 - DNA, 20 bp, Artificial Sequence
  Synthetic oligonucleotide; CAG chr2 60470209 60470228 60470212 -
aatgtctctgtagatgttct

SEQ ID NO: 183176 - DNA, 20 bp, Artificial Sequence
  Synthetic oligonucleotide; AGG chr2 60470208 60470227 60470211 -
atgtctctgtagatgttctc

SEQ ID NO: 183177 - DNA, 20 bp, Artificial Sequence
  Synthetic oligonucleotide; TAG chr2 60470204 60470223 60470207 -
ctctgtagatgttctcaggc

SEQ ID NO: 183178 - DNA, 20 bp, Artificial Sequence
  Synthetic oligonucleotide; AGG chr2 60470203 60470222 60470206 -
tctgtagatgttctcaggct

SEQ ID NO: 183179 - DNA, 20 bp, Artificial Sequence
  Synthetic oligonucleotide; TGG chr2 60470200 60470219 60470203 -
gtagatgttctcaggctagg

SEQ ID NO: 183180 - DNA, 20 bp, Artificial Sequence
  Synthetic oligonucleotide; CAG chr2 60470188 60470207 60470191 -
aggctaggtggtgcttccac

SEQ ID NO: 183181 - DNA, 20 bp, Artificial Sequence
  Synthetic oligonucleotide; AGG chr2 60470187 60470206 60470190 -
ggctaggtggtgcttccacc

SEQ ID NO: 183182 - DNA, 20 bp, Artificial Sequence
  Synthetic oligonucleotide; GGG chr2 60470186 60470205 60470189 -
gctaggtggtgcttccacca

SEQ ID NO: 183183 - DNA, 20 bp, Artificial Sequence
  Synthetic oligonucleotide; CAG chr2 60470173 60470192 60470176 -
tccaccagggcttccctctg

SEQ ID NO: 183184 - DNA, 20 bp, Artificial Sequence
  Synthetic oligonucleotide; AGG chr2 60470172 60470191 60470175 -
ccaccagggcttccctctgc

SEQ ID NO: 183185 - DNA, 20 bp, Artificial Sequence
  Synthetic oligonucleotide; TGG chr2 60470167 60470186 60470170 -
agggcttccctctgcaggcc

SEQ ID NO: 183186 - DNA, 20 bp, Artificial Sequence
  Synthetic oligonucleotide; CAG chr2 60470161 60470180 60470164 -
tccctctgcaggcctggtaa

SEQ ID NO: 183187 - DNA, 20 bp, Artificial Sequence
  Synthetic oligonucleotide; CAG chr2 60470158 60470177 60470161 -
ctctgcaggcctggtaacag

SEQ ID NO: 183188 - DNA, 20 bp, Artificial Sequence
  Synthetic oligonucleotide; AAG chr2 60470138 60470157 60470141 -
cagacctatgctgtctgtgt

SEQ ID NO: 183189 - DNA, 20 bp, Artificial Sequence
  Synthetic oligonucleotide; GAG chr2 60470136 60470155 60470139 -
gacctatgctgtctgtgtaa

SEQ ID NO: 183190 - DNA, 20 bp, Artificial Sequence
  Synthetic oligonucleotide; CAG chr2 60470127 60470146 60470130 -
tgtctgtgtaagagccttct

SEQ ID NO: 183191 - DNA, 20 bp, Artificial Sequence
  Synthetic oligonucleotide; CAG chr2 60470124 60470143 60470127 -
ctgtgtaagagccttctcag

SEQ ID NO: 183192 - DNA, 20 bp, Artificial Sequence
  Synthetic oligonucleotide; CAG chr2 60470103 60470122 60470106 -
agcacaccatcgttacccac

SEQ ID NO: 183193 - DNA, 20 bp, Artificial Sequence
  Synthetic oligonucleotide; AGG chr2 60470102 60470121 60470105 -
gcacaccatcgttacccacc

SEQ ID NO: 183194 - DNA, 20 bp, Artificial Sequence
  Synthetic oligonucleotide; AAG chr2 60470089 60470108 60470092 -
acccaccaggctccttgcga

SEQ ID NO: 183195 - DNA, 20 bp, Artificial Sequence
  Synthetic oligonucleotide; AGG chr2 60470088 60470107 60470091 -
cccaccaggctccttgcgaa

SEQ ID NO: 183196 - DNA, 20 bp, Artificial Sequence
  Synthetic oligonucleotide; TGG chr2 60470065 60470084 60470068 -
aaatcttgtcccaactgcct

SEQ ID NO: 183197 - DNA, 20 bp, Artificial Sequence
  Synthetic oligonucleotide; TGG chr2 60470055 60470074 60470058 -
ccaactgccttggctgtgct

SEQ ID NO: 183198 - DNA, 20 bp, Artificial Sequence
  Synthetic oligonucleotide; CAG chr2 60470052 60470071 60470055 -
actgccttggctgtgcttgg

SEQ ID NO: 183199 - DNA, 20 bp, Artificial Sequence
  Synthetic oligonucleotide; AAG chr2 60470037 60470056 60470040 -
cttggcagtgtgctctatat

SEQ ID NO: 183200 - DNA, 20 bp, Artificial Sequence
  Synthetic oligonucleotide; AGG chr2 60470036 60470055 60470039 -
ttggcagtgtgctctatata

SEQ ID NO: 183201 - DNA, 20 bp, Artificial Sequence
  Synthetic oligonucleotide; GAG chr2 60470034 60470053 60470037 -
ggcagtgtgctctatataag

SEQ ID NO: 183202 - DNA, 20 bp, Artificial Sequence
  Synthetic oligonucleotide; CAG chr2 60470029 60470048 60470032 -
tgtgctctatataaggagaa

SEQ ID NO: 183203 - DNA, 20 bp, Artificial Sequence
  Synthetic oligonucleotide; AGG chr2 60470028 60470047 60470031 -
gtgctctatataaggagaac

SEQ ID NO: 183204 - DNA, 20 bp, Artificial Sequence
  Synthetic oligonucleotide; GAG chr2 60470010 60470029 60470013 -
acaggatgtattttacactt

SEQ ID NO: 183205 - DNA, 20 bp, Artificial Sequence
  Synthetic oligonucleotide; TAG chr2 60469996 60470015 60469999 -
acacttgagacctgctatcc

SEQ ID NO: 183206 - DNA, 20 bp, Artificial Sequence
  Synthetic oligonucleotide; GAG chr2 60469994 60470013 60469997 -
acttgagacctgctatccta

SEQ ID NO: 183207 - DNA, 20 bp, Artificial Sequence
  Synthetic oligonucleotide; AAG chr2 60469973 60469992 60469976 -
agtacaacaacaacacttct

SEQ ID NO: 183208 - DNA, 20 bp, Artificial Sequence
  Synthetic oligonucleotide; AAG chr2 60469957 60469976 60469960 -
ttctaagtgctcttaatatt

SEQ ID NO: 183209 - DNA, 20 bp, Artificial Sequence
  Synthetic oligonucleotide; TGG chr2 60469950 60469969 60469953 -
tgctcttaatattaagctaa

SEQ ID NO: 183210 - DNA, 20 bp, Artificial Sequence
  Synthetic oligonucleotide; AAG chr2 60469922 60469941 60469925 -
atactgtttgttcaccatca

SEQ ID NO: 183211 - DNA, 20 bp, Artificial Sequence
  Synthetic oligonucleotide; TAG chr2 60469868 60469887 60469871 -
catcatgaactccaaacctc

SEQ ID NO: 183212 - DNA, 20 bp, Artificial Sequence
  Synthetic oligonucleotide; CAG chr2 60469859 60469878 60469862 -
ctccaaacctctagaacaca

SEQ ID NO: 183213 - DNA, 20 bp, Artificial Sequence
  Synthetic oligonucleotide; GAG chr2 60469857 60469876 60469860 -
ccaaacctctagaacacaca

SEQ ID NO: 183214 - DNA, 20 bp, Artificial Sequence
  Synthetic oligonucleotide; CAG chr2 60469831 60469850 60469834 -
ctcctgcaccatctatcctc

SEQ ID NO: 183215 - DNA, 20 bp, Artificial Sequence
  Synthetic oligonucleotide; AAG chr2 60469820 60469839 60469823 -
tctatcctccagtctgtctc

SEQ ID NO: 183216 - DNA, 20 bp, Artificial Sequence
  Synthetic oligonucleotide; TGG chr2 60469816 60469835 60469819 -
tcctccagtctgtctcaaga

SEQ ID NO: 183217 - DNA, 20 bp, Artificial Sequence
  Synthetic oligonucleotide; CAG chr2 60469812 60469831 60469815 -
ccagtctgtctcaagatgga

SEQ ID NO: 183218 - DNA, 20 bp, Artificial Sequence
  Synthetic oligonucleotide; TGG chr2 60469804 60469823 60469807 -
tctcaagatggacagctaca

SEQ ID NO: 183219 - DNA, 20 bp, Artificial Sequence
  Synthetic oligonucleotide; TAG chr2 60469800 60469819 60469803 -
aagatggacagctacatggt

SEQ ID NO: 183220 - DNA, 20 bp, Artificial Sequence
  Synthetic oligonucleotide; TAG chr2 60469796 60469815 60469799 -
tggacagctacatggttagt

SEQ ID NO: 183221 - DNA, 20 bp, Artificial Sequence
  Synthetic oligonucleotide; TAG chr2 60469792 60469811 60469795 -
cagctacatggttagttagc

SEQ ID NO: 183222 - DNA, 20 bp, Artificial Sequence
  Synthetic oligonucleotide; GAG chr2 60469790 60469809 60469793 -
gctacatggttagttagcta

SEQ ID NO: 183223 - DNA, 20 bp, Artificial Sequence
  Synthetic oligonucleotide; AGG chr2 60469789 60469808 60469792 -
ctacatggttagttagctag

SEQ ID NO: 183224 - DNA, 20 bp, Artificial Sequence
  Synthetic oligonucleotide; GAG chr2 60469787 60469806 60469790 -
acatggttagttagctagag

SEQ ID NO: 183225 - DNA, 20 bp, Artificial Sequence
  Synthetic oligonucleotide; AGG chr2 60469786 60469805 60469789 -
catggttagttagctagagg

SEQ ID NO: 183226 - DNA, 20 bp, Artificial Sequence
  Synthetic oligonucleotide; TGG chr2 60469780 60469799 60469783 -
tagttagctagaggaggact

SEQ ID NO: 183227 - DNA, 20 bp, Artificial Sequence
  Synthetic oligonucleotide; AAG chr2 60469775 60469794 60469778 -
agctagaggaggacttggaa

SEQ ID NO: 183228 - DNA, 20 bp, Artificial Sequence
  Synthetic oligonucleotide; TAG chr2 60469771 60469790 60469774 -
agaggaggacttggaaaagc

SEQ ID NO: 183229 - DNA, 20 bp, Artificial Sequence
  Synthetic oligonucleotide; AGG chr2 60469770 60469789 60469773 -
gaggaggacttggaaaagct

SEQ ID NO: 183230 - DNA, 20 bp, Artificial Sequence
  Synthetic oligonucleotide; CAG chr2 60469740 60469759 60469743 -
cacataaaccgtaaaatccc

SEQ ID NO: 183231 - DNA, 20 bp, Artificial Sequence
  Synthetic oligonucleotide; CAG chr2 60469699 60469718 60469702 -
tcctcttctcaaaaaaatct

SEQ ID NO: 183232 - DNA, 20 bp, Artificial Sequence
  Synthetic oligonucleotide; TAG chr2 60469672 60469691 60469675 -
acaaatgtttcattgactat

SEQ ID NO: 183233 - DNA, 20 bp, Artificial Sequence
  Synthetic oligonucleotide; TAG chr2 60469658 60469677 60469661 -
gactattagattcattttat

SEQ ID NO: 183234 - DNA, 20 bp, Artificial Sequence
  Synthetic oligonucleotide; GAG chr2 60469652 60469671 60469655 -
tagattcattttattagtgt

SEQ ID NO: 183235 - DNA, 20 bp, Artificial Sequence
  Synthetic oligonucleotide; AAG chr2 60469649 60469668 60469652 -
attcattttattagtgtgag

SEQ ID NO: 183236 - DNA, 20 bp, Artificial Sequence
  Synthetic oligonucleotide; CAG chr2 60469632 60469651 60469635 -
gagaagtcacttgtcttcac

SEQ ID NO: 183237 - DNA, 20 bp, Artificial Sequence
  Synthetic oligonucleotide; GAG chr2 60469630 60469649 60469633 -
gaagtcacttgtcttcacca

SEQ ID NO: 183238 - DNA, 20 bp, Artificial Sequence
  Synthetic oligonucleotide; AAG chr2 60469620 60469639 60469623 -
gtcttcaccagagtacaaca

SEQ ID NO: 183239 - DNA, 20 bp, Artificial Sequence
  Synthetic oligonucleotide; CAG chr2 60469615 60469634 60469618 -
caccagagtacaacaaagtg

SEQ ID NO: 183240 - DNA, 20 bp, Artificial Sequence
  Synthetic oligonucleotide; TGG chr2 60469607 60469626 60469610 -
tacaacaaagtgcagtaaaa

SEQ ID NO: 183241 - DNA, 20 bp, Artificial Sequence
  Synthetic oligonucleotide; AAG chr2 60469602 60469621 60469605 -
caaagtgcagtaaaatggtg

SEQ ID NO: 183242 - DNA, 20 bp, Artificial Sequence
  Synthetic oligonucleotide; TGG chr2 60469598 60469617 60469601 -
gtgcagtaaaatggtgaaga

SEQ ID NO: 183243 - DNA, 20 bp, Artificial Sequence
  Synthetic oligonucleotide; GGG chr2 60469597 60469616 60469600 -
tgcagtaaaatggtgaagat

SEQ ID NO: 183244 - DNA, 20 bp, Artificial Sequence
  Synthetic oligonucleotide; CAG chr2 60469593 60469612 60469596 -
gtaaaatggtgaagatgggt

SEQ ID NO: 183245 - DNA, 20 bp, Artificial Sequence
  Synthetic oligonucleotide; AGG chr2 60469592 60469611 60469595 -
taaaatggtgaagatgggtc

SEQ ID NO: 183246 - DNA, 20 bp, Artificial Sequence
  Synthetic oligonucleotide; GGG chr2 60469591 60469610 60469594 -
aaaatggtgaagatgggtca

SEQ ID NO: 183247 - DNA, 20 bp, Artificial Sequence
  Synthetic oligonucleotide; TGG chr2 60469584 60469603 60469587 -
tgaagatgggtcagggtttc

SEQ ID NO: 183248 - DNA, 20 bp, Artificial Sequence
  Synthetic oligonucleotide; GGG chr2 60469583 60469602 60469586 -
gaagatgggtcagggtttct

SEQ ID NO: 183249 - DNA, 20 bp, Artificial Sequence
  Synthetic oligonucleotide; TGG chr2 60469577 60469596 60469580 -
gggtcagggtttctgggtgc

SEQ ID NO: 183250 - DNA, 20 bp, Artificial Sequence
  Synthetic oligonucleotide; TGG chr2 60469568 60469587 60469571 -
tttctgggtgctggcattat

SEQ ID NO: 183251 - DNA, 20 bp, Artificial Sequence
  Synthetic oligonucleotide; TGG chr2 60469560 60469579 60469563 -
tgctggcattattggaatgc

SEQ ID NO: 183252 - DNA, 20 bp, Artificial Sequence
  Synthetic oligonucleotide; TGG chr2 60469538 60469557 60469541 -
gttctttccttgtcatttaa

SEQ ID NO: 183253 - DNA, 20 bp, Artificial Sequence
  Synthetic oligonucleotide; AAG chr2 60469532 60469551 60469535 -
tccttgtcatttaatggtca

SEQ ID NO: 183254 - DNA, 20 bp, Artificial Sequence
  Synthetic oligonucleotide; TGG chr2 60469524 60469543 60469527 -
atttaatggtcaaagttatt

SEQ ID NO: 183255 - DNA, 20 bp, Artificial Sequence
  Synthetic oligonucleotide; CAG chr2 60469517 60469536 60469520 -
ggtcaaagttatttggaccc

SEQ ID NO: 183256 - DNA, 20 bp, Artificial Sequence
  Synthetic oligonucleotide; AAG chr2 60469514 60469533 60469517 -
caaagttatttggaccccag

SEQ ID NO: 183257 - DNA, 20 bp, Artificial Sequence
  Synthetic oligonucleotide; GAG chr2 60469479 60469498 60469482 -
cttccattgctttgtattgt

SEQ ID NO: 183258 - DNA, 20 bp, Artificial Sequence
  Synthetic oligonucleotide; AAG chr2 60469476 60469495 60469479 -
ccattgctttgtattgtgag

SEQ ID NO: 183259 - DNA, 20 bp, Artificial Sequence
  Synthetic oligonucleotide; AAG chr2 60469461 60469480 60469464 -
gtgagaagccacatctgtgt

SEQ ID NO: 183260 - DNA, 20 bp, Artificial Sequence
  Synthetic oligonucleotide; AGG chr2 60469460 60469479 60469463 -
tgagaagccacatctgtgta

SEQ ID NO: 183261 - DNA, 20 bp, Artificial Sequence
  Synthetic oligonucleotide; CAG chr2 60469453 60469472 60469456 -
ccacatctgtgtaaggtttc

SEQ ID NO: 183262 - DNA, 20 bp, Artificial Sequence
  Synthetic oligonucleotide; CAG chr2 60469446 60469465 60469449 -
tgtgtaaggtttccagttga

SEQ ID NO: 183263 - DNA, 20 bp, Artificial Sequence
  Synthetic oligonucleotide; AGG chr2 60469445 60469464 60469448 -
gtgtaaggtttccagttgac

SEQ ID NO: 183264 - DNA, 20 bp, Artificial Sequence
  Synthetic oligonucleotide; TAG chr2 60469438 60469457 60469441 -
gtttccagttgacaggattc

SEQ ID NO: 183265 - DNA, 20 bp, Artificial Sequence
  Synthetic oligonucleotide; GAG chr2 60469436 60469455 60469439 -
ttccagttgacaggattcta

SEQ ID NO: 183266 - DNA, 20 bp, Artificial Sequence
  Synthetic oligonucleotide; TGG chr2 60469431 60469450 60469434 -
gttgacaggattctagagta

SEQ ID NO: 183267 - DNA, 20 bp, Artificial Sequence
  Synthetic oligonucleotide; CAG chr2 60469426 60469445 60469429 -
caggattctagagtatggcc

SEQ ID NO: 183268 - DNA, 20 bp, Artificial Sequence
  Synthetic oligonucleotide; CAG chr2 60469421 60469440 60469424 -
ttctagagtatggcccagct

SEQ ID NO: 183269 - DNA, 20 bp, Artificial Sequence
  Synthetic oligonucleotide; CAG chr2 60469416 60469435 60469419 -
gagtatggcccagctcagtc

SEQ ID NO: 183270 - DNA, 20 bp, Artificial Sequence
  Synthetic oligonucleotide; CAG chr2 60469406 60469425 60469409 -
cagctcagtccagaaatgcc

SEQ ID NO: 183271 - DNA, 20 bp, Artificial Sequence
  Synthetic oligonucleotide; AGG chr2 60469405 60469424 60469408 -
agctcagtccagaaatgccc

SEQ ID NO: 183272 - DNA, 20 bp, Artificial Sequence
  Synthetic oligonucleotide; AAG chr2 60469387 60469406 60469390 -
ccaggtttcccctatcactg

SEQ ID NO: 183273 - DNA, 20 bp, Artificial Sequence
  Synthetic oligonucleotide; AGG chr2 60469386 60469405 60469389 -
caggtttcccctatcactga

SEQ ID NO: 183274 - DNA, 20 bp, Artificial Sequence
  Synthetic oligonucleotide; TAG chr2 60469369 60469388 60469372 -
tgaaggcgctatcataaata

SEQ ID NO: 183275 - DNA, 20 bp, Artificial Sequence
  Synthetic oligonucleotide; TGG chr2 60469364 60469383 60469367 -
gcgctatcataaatatagca

SEQ ID NO: 183276 - DNA, 20 bp, Artificial Sequence
  Synthetic oligonucleotide; GGG chr2 60469363 60469382 60469366 -
cgctatcataaatatagcat

SEQ ID NO: 183277 - DNA, 20 bp, Artificial Sequence
  Synthetic oligonucleotide; AAG chr2 60469360 60469379 60469363 -
tatcataaatatagcatggg

SEQ ID NO: 183278 - DNA, 20 bp, Artificial Sequence
  Synthetic oligonucleotide; GAG chr2 60469358 60469377 60469361 -
tcataaatatagcatgggaa

SEQ ID NO: 183279 - DNA, 20 bp, Artificial Sequence
  Synthetic oligonucleotide; AGG chr2 60469357 60469376 60469360 -
cataaatatagcatgggaag

SEQ ID NO: 183280 - DNA, 20 bp, Artificial Sequence
  Synthetic oligonucleotide; GGG chr2 60469356 60469375 60469359 -
ataaatatagcatgggaaga

SEQ ID NO: 183281 - DNA, 20 bp, Artificial Sequence
  Synthetic oligonucleotide; GGG chr2 60469355 60469374 60469358 -
taaatatagcatgggaagag

SEQ ID NO: 183282 - DNA, 20 bp, Artificial Sequence
  Synthetic oligonucleotide; GGG chr2 60469354 60469373 60469357 -
aaatatagcatgggaagagg

SEQ ID NO: 183283 - DNA, 20 bp, Artificial Sequence
  Synthetic oligonucleotide; GGG chr2 60469353 60469372 60469356 -
aatatagcatgggaagaggg

SEQ ID NO: 183284 - DNA, 20 bp, Artificial Sequence
  Synthetic oligonucleotide; CAG chr2 60469350 60469369 60469353 -
atagcatgggaagagggggg

SEQ ID NO: 183285 - DNA, 20 bp, Artificial Sequence
  Synthetic oligonucleotide; GAG chr2 60469348 60469367 60469351 -
agcatgggaagaggggggca

SEQ ID NO: 183286 - DNA, 20 bp, Artificial Sequence
  Synthetic oligonucleotide; AGG chr2 60469347 60469366 60469350 -
gcatgggaagaggggggcag

SEQ ID NO: 183287 - DNA, 20 bp, Artificial Sequence
  Synthetic oligonucleotide; GGG chr2 60469346 60469365 60469349 -
catgggaagaggggggcaga

SEQ ID NO: 183288 - DNA, 20 bp, Artificial Sequence
  Synthetic oligonucleotide; CAG chr2 60469342 60469361 60469345 -
ggaagaggggggcagaggga

SEQ ID NO: 183289 - DNA, 20 bp, Artificial Sequence
  Synthetic oligonucleotide; GAG chr2 60469340 60469359 60469343 -
aagaggggggcagagggaca

SEQ ID NO: 183290 - DNA, 20 bp, Artificial Sequence
  Synthetic oligonucleotide; AAG chr2 60469336 60469355 60469339 -
ggggggcagagggacagaga

SEQ ID NO: 183291 - DNA, 20 bp, Artificial Sequence
  Synthetic oligonucleotide; AAG chr2 60469331 60469350 60469334 -
gcagagggacagagaaagca

SEQ ID NO: 183292 - DNA, 20 bp, Artificial Sequence
  Synthetic oligonucleotide; TGG chr2 60469328 60469347 60469331 -
gagggacagagaaagcaaag

SEQ ID NO: 183293 - DNA, 20 bp, Artificial Sequence
  Synthetic oligonucleotide; GGG chr2 60469327 60469346 60469330 -
agggacagagaaagcaaagt

SEQ ID NO: 183294 - DNA, 20 bp, Artificial Sequence
  Synthetic oligonucleotide; CAG chr2 60469279 60469298 60469282 -
caaatctactcatttcctat

SEQ ID NO: 183295 - DNA, 20 bp, Artificial Sequence
  Synthetic oligonucleotide; TGG chr2 60469260 60469279 60469263 -
tcagcattttgctttttgct

SEQ ID NO: 183296 - DNA, 20 bp, Artificial Sequence
  Synthetic oligonucleotide; GGG chr2 60469259 60469278 60469262 -
cagcattttgctttttgctt

SEQ ID NO: 183297 - DNA, 20 bp, Artificial Sequence
  Synthetic oligonucleotide; AAG chr2 60469246 60469265 60469249 -
tttgcttgggtttgtctata

SEQ ID NO: 183298 - DNA, 20 bp, Artificial Sequence
  Synthetic oligonucleotide; AAG chr2 60469241 60469260 60469244 -
ttgggtttgtctataaagta

SEQ ID NO: 183299 - DNA, 20 bp, Artificial Sequence
  Synthetic oligonucleotide; CAG chr2 60469219 60469238 60469222 -
gttaatgtatgcatgtaaac

SEQ ID NO: 183300 - DNA, 20 bp, Artificial Sequence
  Synthetic oligonucleotide; CAG chr2 60469211 60469230 60469214 -
atgcatgtaaaccagccttg

SEQ ID NO: 183301 - DNA, 20 bp, Artificial Sequence
  Synthetic oligonucleotide; CAG chr2 60469188 60469207 60469191 -
ataaaatccccccatgtttc

SEQ ID NO: 183302 - DNA, 20 bp, Artificial Sequence
  Synthetic oligonucleotide; AGG chr2 60469187 60469206 60469190 -
taaaatccccccatgtttcc

SEQ ID NO: 183303 - DNA, 20 bp, Artificial Sequence
  Synthetic oligonucleotide; CAG chr2 60469168 60469187 60469171 -
caggctacccacaatattac

SEQ ID NO: 183304 - DNA, 20 bp, Artificial Sequence
  Synthetic oligonucleotide; AAG chr2 60469131 60469150 60469134 -
cttacacatcttctttccac

SEQ ID NO: 183305 - DNA, 20 bp, Artificial Sequence
  Synthetic oligonucleotide; AAG chr2 60469101 60469120 60469104 -
tcaaacaacaacaaataaat

SEQ ID NO: 183306 - DNA, 20 bp, Artificial Sequence
  Synthetic oligonucleotide; AAG chr2 60469087 60469106 60469090 -
ataaataagcaaatgaacca

SEQ ID NO: 183307 - DNA, 20 bp, Artificial Sequence
  Synthetic oligonucleotide; AAG chr2 60469038 60469057 60469041 -
accctttcacttttgtcaaa

SEQ ID NO: 183308 - DNA, 20 bp, Artificial Sequence
  Synthetic oligonucleotide; CAG chr2 60469016 60469035 60469019 -
gaccgaaattgaaaacaaaa

SEQ ID NO: 183309 - DNA, 20 bp, Artificial Sequence
  Synthetic oligonucleotide; TGG chr2 60469007 60469026 60469010 -
tgaaaacaaaacagaaactc

SEQ ID NO: 183310 - DNA, 20 bp, Artificial Sequence
  Synthetic oligonucleotide; GGG chr2 60469006 60469025 60469009 -
gaaaacaaaacagaaactct

SEQ ID NO: 183311 - DNA, 20 bp, Artificial Sequence
  Synthetic oligonucleotide; CAG chr2 60468976 60468995 60468979 -
tcaccactcttcttttgttt

SEQ ID NO: 183312 - DNA, 20 bp, Artificial Sequence
  Synthetic oligonucleotide; AGG chr2 60468975 60468994 60468978 -
caccactcttcttttgtttc

SEQ ID NO: 183313 - DNA, 20 bp, Artificial Sequence
  Synthetic oligonucleotide; TGG chr2 60468969 60468988 60468972 -
tcttcttttgtttcaggcct

SEQ ID NO: 183314 - DNA, 20 bp, Artificial Sequence
  Synthetic oligonucleotide; GGG chr2 60468968 60468987 60468971 -
cttcttttgtttcaggcctt

SEQ ID NO: 183315 - DNA, 20 bp, Artificial Sequence
  Synthetic oligonucleotide; AAG chr2 60468949 60468968 60468952 -
tgggcctgttaactatctgc

SEQ ID NO: 183316 - DNA, 20 bp, Artificial Sequence
  Synthetic oligonucleotide; AGG chr2 60468948 60468967 60468951 -
gggcctgttaactatctgca

SEQ ID NO: 183317 - DNA, 20 bp, Artificial Sequence
  Synthetic oligonucleotide; TGG chr2 60468915 60468934 60468918 -
gatgttgtaatctattttaa

SEQ ID NO: 183318 - DNA, 20 bp, Artificial Sequence
  Synthetic oligonucleotide; TGG chr2 60468892 60468911 60468895 -
aattgaaatgtgatatcctg

SEQ ID NO: 183319 - DNA, 20 bp, Artificial Sequence
  Synthetic oligonucleotide; TAG chr2 60468869 60468888 60468872 -
tttatgatgcacgttgtttg

SEQ ID NO: 183320 - DNA, 20 bp, Artificial Sequence
  Synthetic oligonucleotide; TAG chr2 60468863 60468882 60468866 -
atgcacgttgtttgtagctg

SEQ ID NO: 183321 - DNA, 20 bp, Artificial Sequence
  Synthetic oligonucleotide; TGG chr2 60468850 60468869 60468853 -
gtagctgtagtgcttgattt

SEQ ID NO: 183322 - DNA, 20 bp, Artificial Sequence
  Synthetic oligonucleotide; GGG chr2 60468849 60468868 60468852 -
tagctgtagtgcttgatttt

SEQ ID NO: 183323 - DNA, 20 bp, Artificial Sequence
  Synthetic oligonucleotide; CAG chr2 60468837 60468856 60468840 -
ttgattttgggtttctttca

SEQ ID NO: 183324 - DNA, 20 bp, Artificial Sequence
  Synthetic oligonucleotide; TGG chr2 60468820 60468839 60468823 -
tcacagataaacttctgcac

SEQ ID NO: 183325 - DNA, 20 bp, Artificial Sequence
  Synthetic oligonucleotide; GAG chr2 60468818 60468837 60468821 -
acagataaacttctgcactg

SEQ ID NO: 183326 - DNA, 20 bp, Artificial Sequence
  Synthetic oligonucleotide; AGG chr2 60468817 60468836 60468820 -
cagataaacttctgcactgg

SEQ ID NO: 183327 - DNA, 20 bp, Artificial Sequence
  Synthetic oligonucleotide; GGG chr2 60468816 60468835 60468819 -
agataaacttctgcactgga

SEQ ID NO: 183328 - DNA, 20 bp, Artificial Sequence
  Synthetic oligonucleotide; GGG chr2 60468815 60468834 60468818 -
gataaacttctgcactggag

SEQ ID NO: 183329 - DNA, 20 bp, Artificial Sequence
  Synthetic oligonucleotide; TGG chr2 60468788 60468807 60468791 -
tcctcccctcgttctgcaca

SEQ ID NO: 183330 - DNA, 20 bp, Artificial Sequence
  Synthetic oligonucleotide; GAG chr2 60468786 60468805 60468789 -
ctcccctcgttctgcacatg

SEQ ID NO: 183331 - DNA, 20 bp, Artificial Sequence
  Synthetic oligonucleotide; TGG chr2 60468767 60468786 60468770 -
ggagctctaatccccacgcc

SEQ ID NO: 183332 - DNA, 20 bp, Artificial Sequence
  Synthetic oligonucleotide; GGG chr2 60468766 60468785 60468769 -
gagctctaatccccacgcct

SEQ ID NO: 183333 - DNA, 20 bp, Artificial Sequence
  Synthetic oligonucleotide; GAG chr2 60468761 60468780 60468764 -
ctaatccccacgcctgggat

SEQ ID NO: 183334 - DNA, 20 bp, Artificial Sequence
  Synthetic oligonucleotide; CAG chr2 60468756 60468775 60468759 -
ccccacgcctgggatgagtg

SEQ ID NO: 183335 - DNA, 20 bp, Artificial Sequence
  Synthetic oligonucleotide; CAG chr2 60468742 60468761 60468745 -
tgagtgcagaatatgccccg

SEQ ID NO: 183336 - DNA, 20 bp, Artificial Sequence
  Synthetic oligonucleotide; AGG chr2 60468741 60468760 60468744 -
gagtgcagaatatgccccgc

SEQ ID NO: 183337 - DNA, 20 bp, Artificial Sequence
  Synthetic oligonucleotide; GGG chr2 60468740 60468759 60468743 -
agtgcagaatatgccccgca

SEQ ID NO: 183338 - DNA, 20 bp, Artificial Sequence
  Synthetic oligonucleotide; AAG chr2 60468730 60468749 60468733 -
atgccccgcagggtatttgt

SEQ ID NO: 183339 - DNA, 20 bp, Artificial Sequence
  Synthetic oligonucleotide; GAG chr2 60468725 60468744 60468728 -
ccgcagggtatttgtaagtt

SEQ ID NO: 183340 - DNA, 20 bp, Artificial Sequence
  Synthetic oligonucleotide; TAG chr2 60468692 60468711 60468695 -
tctacaaatgtccatgtgta

SEQ ID NO: 183341 - DNA, 20 bp, Artificial Sequence
  Synthetic oligonucleotide; GAG chr2 60468690 60468709 60468693 -
tacaaatgtccatgtgtata

SEQ ID NO: 183342 - DNA, 20 bp, Artificial Sequence
  Synthetic oligonucleotide; GAG chr2 60468685 60468704 60468688 -
atgtccatgtgtatagagat

SEQ ID NO: 183343 - DNA, 20 bp, Artificial Sequence
  Synthetic oligonucleotide; TGG chr2 60468676 60468695 60468679 -
tgtatagagatgagaatttc

SEQ ID NO: 183344 - DNA, 20 bp, Artificial Sequence
  Synthetic oligonucleotide; AAG chr2 60468655 60468674 60468658 -
ggaaattgcccttacttttt

SEQ ID NO: 183345 - DNA, 20 bp, Artificial Sequence
  Synthetic oligonucleotide; AAG chr2 60468647 60468666 60468650 -
cccttactttttaagtactg

SEQ ID NO: 183346 - DNA, 20 bp, Artificial Sequence
  Synthetic oligonucleotide; AGG chr2 60468646 60468665 60468649 -
ccttactttttaagtactga

SEQ ID NO: 183347 - DNA, 20 bp, Artificial Sequence
  Synthetic oligonucleotide; GAG chr2 60468644 60468663 60468647 -
ttactttttaagtactgaag

SEQ ID NO: 183348 - DNA, 20 bp, Artificial Sequence
  Synthetic oligonucleotide; TAG chr2 60468629 60468648 60468632 -
tgaaggagttacttccaaaa

SEQ ID NO: 183349 - DNA, 20 bp, Artificial Sequence
  Synthetic oligonucleotide; TGG chr2 60468596 60468615 60468599 -
gtattattccattactcact

SEQ ID NO: 183350 - DNA, 20 bp, Artificial Sequence
  Synthetic oligonucleotide; CAG chr2 60468593 60468612 60468596 -
ttattccattactcacttgg

SEQ ID NO: 183351 - DNA, 20 bp, Artificial Sequence
  Synthetic oligonucleotide; CAG chr2 60468573 60468592 60468576 -
cagccgctccccactccact

SEQ ID NO: 183352 - DNA, 20 bp, Artificial Sequence
  Synthetic oligonucleotide; CAG chr2 60468567 60468586 60468570 -
ctccccactccactcagccc

SEQ ID NO: 183353 - DNA, 20 bp, Artificial Sequence
  Synthetic oligonucleotide; GAG chr2 60468565 60468584 60468568 -
ccccactccactcagcccca

SEQ ID NO: 183354 - DNA, 20 bp, Artificial Sequence
  Synthetic oligonucleotide; AGG chr2 60468564 60468583 60468567 -
cccactccactcagccccag

SEQ ID NO: 183355 - DNA, 20 bp, Artificial Sequence
  Synthetic oligonucleotide; GGG chr2 60468563 60468582 60468566 -
ccactccactcagccccaga

SEQ ID NO: 183356 - DNA, 20 bp, Artificial Sequence
  Synthetic oligonucleotide; TGG chr2 60468530 60468549 60468533 -
tcccctttttctttcctcac

SEQ ID NO: 183357 - DNA, 20 bp, Artificial Sequence
  Synthetic oligonucleotide; GAG chr2 60468528 60468547 60468531 -
ccctttttctttcctcactg

SEQ ID NO: 183358 - DNA, 20 bp, Artificial Sequence
  Synthetic oligonucleotide; AGG chr2 60468527 60468546 60468530 -
cctttttctttcctcactgg

SEQ ID NO: 183359 - DNA, 20 bp, Artificial Sequence
  Synthetic oligonucleotide; TGG chr2 60468523 60468542 60468526 -
tttctttcctcactggaggc

SEQ ID NO: 183360 - DNA, 20 bp, Artificial Sequence
  Synthetic oligonucleotide; GGG chr2 60468522 60468541 60468525 -
ttctttcctcactggaggct

SEQ ID NO: 183361 - DNA, 20 bp, Artificial Sequence
  Synthetic oligonucleotide; GAG chr2 60468520 60468539 60468523 -
ctttcctcactggaggctgg

SEQ ID NO: 183362 - DNA, 20 bp, Artificial Sequence
  Synthetic oligonucleotide; TAG chr2 60468513 60468532 60468516 -
cactggaggctgggagctga

SEQ ID NO: 183363 - DNA, 20 bp, Artificial Sequence
  Synthetic oligonucleotide; TAG chr2 60468510 60468529 60468513 -
tggaggctgggagctgatag

SEQ ID NO: 183364 - DNA, 20 bp, Artificial Sequence
  Synthetic oligonucleotide; TGG chr2 60468497 60468516 60468500 -
ctgatagtagctcatccctg

SEQ ID NO: 183365 - DNA, 20 bp, Artificial Sequence
  Synthetic oligonucleotide; GGG chr2 60468496 60468515 60468499 -
tgatagtagctcatccctgt

SEQ ID NO: 183366 - DNA, 20 bp, Artificial Sequence
  Synthetic oligonucleotide; CAG chr2 60468484 60468503 60468487 -
atccctgtgggtcttctccc

SEQ ID NO: 183367 - DNA, 20 bp, Artificial Sequence
  Synthetic oligonucleotide; AGG chr2 60468483 60468502 60468486 -
tccctgtgggtcttctcccc

SEQ ID NO: 183368 - DNA, 20 bp, Artificial Sequence
  Synthetic oligonucleotide; GGG chr2 60468482 60468501 60468485 -
ccctgtgggtcttctcccca

SEQ ID NO: 183369 - DNA, 20 bp, Artificial Sequence
  Synthetic oligonucleotide; TGG chr2 60468464 60468483 60468467 -
cagggtcttgtcttgctccg

SEQ ID NO: 183370 - DNA, 20 bp, Artificial Sequence
  Synthetic oligonucleotide; TAG chr2 60468460 60468479 60468463 -
gtcttgtcttgctccgtggc

SEQ ID NO: 183371 - DNA, 20 bp, Artificial Sequence
  Synthetic oligonucleotide; AAG chr2 60468451 60468470 60468454 -
tgctccgtggctagtgattg

SEQ ID NO: 183372 - DNA, 20 bp, Artificial Sequence
  Synthetic oligonucleotide; TGG chr2 60468435 60468454 60468438 -
attgaagatgcctgtgcctc

SEQ ID NO: 183373 - DNA, 20 bp, Artificial Sequence
  Synthetic oligonucleotide; GAG chr2 60468433 60468452 60468436 -
tgaagatgcctgtgcctctg

SEQ ID NO: 183374 - DNA, 20 bp, Artificial Sequence
  Synthetic oligonucleotide; TGG chr2 60468417 60468436 60468420 -
tctggagcccattttattac

SEQ ID NO: 183375 - DNA, 20 bp, Artificial Sequence
  Synthetic oligonucleotide; TGG chr2 60468401 60468420 60468404 -
ttactggacattcactcctg

SEQ ID NO: 183376 - DNA, 20 bp, Artificial Sequence
  Synthetic oligonucleotide; TAG chr2 60468391 60468410 60468394 -
ttcactcctgtggcctcatt

SEQ ID NO: 183377 - DNA, 20 bp, Artificial Sequence
  Synthetic oligonucleotide; AGG chr2 60468390 60468409 60468393 -
tcactcctgtggcctcattt

SEQ ID NO: 183378 - DNA, 20 bp, Artificial Sequence
  Synthetic oligonucleotide; TGG chr2 60468383 60468402 60468386 -
tgtggcctcatttaggactt

SEQ ID NO: 183379 - DNA, 20 bp, Artificial Sequence
  Synthetic oligonucleotide; GGG chr2 60468382 60468401 60468385 -
gtggcctcatttaggacttt

SEQ ID NO: 183380 - DNA, 20 bp, Artificial Sequence
  Synthetic oligonucleotide; TAG chr2 60468377 60468396 60468380 -
ctcatttaggactttgggta

SEQ ID NO: 183381 - DNA, 20 bp, Artificial Sequence
  Synthetic oligonucleotide; TGG chr2 60468370 60468389 60468373 -
aggactttgggtatagtcca

SEQ ID NO: 183382 - DNA, 20 bp, Artificial Sequence
  Synthetic oligonucleotide; TAG chr2 60468357 60468376 60468360 -
tagtccatggcacacatctt

SEQ ID NO: 183383 - DNA, 20 bp, Artificial Sequence
  Synthetic oligonucleotide; AAG chr2 60468352 60468371 60468355 -
catggcacacatctttagcc

SEQ ID NO: 183384 - DNA, 20 bp, Artificial Sequence
  Synthetic oligonucleotide; AGG chr2 60468351 60468370 60468354 -
atggcacacatctttagcca

SEQ ID NO: 183385 - DNA, 20 bp, Artificial Sequence
  Synthetic oligonucleotide; CAG chr2 60468347 60468366 60468350 -
cacacatctttagccaaggc

SEQ ID NO: 183386 - DNA, 20 bp, Artificial Sequence
  Synthetic oligonucleotide; AAG chr2 60468338 60468357 60468341 -
ttagccaaggccagaatcaa

SEQ ID NO: 183387 - DNA, 20 bp, Artificial Sequence
  Synthetic oligonucleotide; AGG chr2 60468337 60468356 60468340 -
tagccaaggccagaatcaaa

SEQ ID NO: 183388 - DNA, 20 bp, Artificial Sequence
  Synthetic oligonucleotide; GAG chr2 60468335 60468354 60468338 -
gccaaggccagaatcaaaag

SEQ ID NO: 183389 - DNA, 20 bp, Artificial Sequence
  Synthetic oligonucleotide; CAG chr2 60468331 60468350 60468334 -
aggccagaatcaaaaggagt

SEQ ID NO: 183390 - DNA, 20 bp, Artificial Sequence
  Synthetic oligonucleotide; TAG chr2 60468326 60468345 60468329 -
agaatcaaaaggagtcagtt

SEQ ID NO: 183391 - DNA, 20 bp, Artificial Sequence
  Synthetic oligonucleotide; AGG chr2 60468325 60468344 60468328 -
gaatcaaaaggagtcagttt

SEQ ID NO: 183392 - DNA, 20 bp, Artificial Sequence
  Synthetic oligonucleotide; GGG chr2 60468324 60468343 60468327 -
aatcaaaaggagtcagttta

SEQ ID NO: 183393 - DNA, 20 bp, Artificial Sequence
  Synthetic oligonucleotide; CAG chr2 60468315 60468334 60468318 -
gagtcagtttagggttattc

SEQ ID NO: 183394 - DNA, 20 bp, Artificial Sequence
  Synthetic oligonucleotide; GAG chr2 60468313 60468332 60468316 -
gtcagtttagggttattcca

SEQ ID NO: 183395 - DNA, 20 bp, Artificial Sequence
  Synthetic oligonucleotide; TAG chr2 60468264 60468283 60468267 -
tttacatgtgtatttgaaca

SEQ ID NO: 183396 - DNA, 20 bp, Artificial Sequence
  Synthetic oligonucleotide; TGG chr2 60468212 60468231 60468215 -
attttgactaatttttctcc

SEQ ID NO: 183397 - DNA, 20 bp, Artificial Sequence
  Synthetic oligonucleotide; TAG chr2 60468206 60468225 60468209 -
actaatttttctcctggttt

SEQ ID NO: 183398 - DNA, 20 bp, Artificial Sequence
  Synthetic oligonucleotide; GAG chr2 60468204 60468223 60468207 -
taatttttctcctggtttta

SEQ ID NO: 183399 - DNA, 20 bp, Artificial Sequence
  Synthetic oligonucleotide; TAG chr2 60468184 60468203 60468187 -
gagaaaaatgcacatcattg

SEQ ID NO: 183400 - DNA, 20 bp, Artificial Sequence
  Synthetic oligonucleotide; AAG chr2 60468171 60468190 60468174 -
atcattgtagttaaaatgtg

SEQ ID NO: 183401 - DNA, 20 bp, Artificial Sequence
  Synthetic oligonucleotide; AGG chr2 60468170 60468189 60468173 -
tcattgtagttaaaatgtga

SEQ ID NO: 183402 - DNA, 20 bp, Artificial Sequence
  Synthetic oligonucleotide; CAG chr2 60468053 60468072 60468056 -
accaccaccaccatcaccac

SEQ ID NO: 183403 - DNA, 20 bp, Artificial Sequence
  Synthetic oligonucleotide; CAG chr2 60467957 60467976 60467960 -
accaccaccaccatcaccac

SEQ ID NO: 183404 - DNA, 20 bp, Artificial Sequence
  Synthetic oligonucleotide; CAG chr2 60467870 60467889 60467873 -
accaccaccaccatcaccac

SEQ ID NO: 183405 - DNA, 20 bp, Artificial Sequence
  Synthetic oligonucleotide; CAG chr2 60467855 60467874 60467858 -
accaccagtaccatcaccac

SEQ ID NO: 183406 - DNA, 20 bp, Artificial Sequence
  Synthetic oligonucleotide; TAG chr2 60467852 60467871 60467855 -
accagtaccatcaccaccag

SEQ ID NO: 183407 - DNA, 20 bp, Artificial Sequence
  Synthetic oligonucleotide; CAG chr2 60467816 60467835 60467819 -
accaccatcaccatcaccac

SEQ ID NO: 183408 - DNA, 20 bp, Artificial Sequence
  Synthetic oligonucleotide; CAG chr2 60467801 60467820 60467804 -
accaccagtaccatcaccac

SEQ ID NO: 183409 - DNA, 20 bp, Artificial Sequence
  Synthetic oligonucleotide; CAG chr2 60467723 60467742 60467726 -
accaccaccaccatcaccac

SEQ ID NO: 183410 - DNA, 20 bp, Artificial Sequence
  Synthetic oligonucleotide; CAG chr2 60467708 60467727 60467711 -
accaccagtaccatcaccac

SEQ ID NO: 183411 - DNA, 20 bp, Artificial Sequence
  Synthetic oligonucleotide; CAG chr2 60467669 60467688 60467672 -
accaccatcaccatcaccac

SEQ ID NO: 183412 - DNA, 20 bp, Artificial Sequence
  Synthetic oligonucleotide; CAG chr2 60467546 60467565 60467549 -
actaccaccaccaccatcac

SEQ ID NO: 183413 - DNA, 20 bp, Artificial Sequence
  Synthetic oligonucleotide; CAG chr2 60467519 60467538 60467522 -
atcaccatcaccatcaccac

SEQ ID NO: 183414 - DNA, 20 bp, Artificial Sequence
  Synthetic oligonucleotide; CAG chr2 60467417 60467436 60467420 -
actaccaccaccaccatcac

SEQ ID NO: 183415 - DNA, 20 bp, Artificial Sequence
  Synthetic oligonucleotide; CAG chr2 60467390 60467409 60467393 -
atcaccatcaccatcaccac

SEQ ID NO: 183416 - DNA, 20 bp, Artificial Sequence
  Synthetic oligonucleotide; CAG chr2 60467219 60467238 60467222 -
actaccaccaccaccatcac

SEQ ID NO: 183417 - DNA, 20 bp, Artificial Sequence
  Synthetic oligonucleotide; AAG chr2 60467050 60467069 60467053 -
ccaccaccatttacttgttc

SEQ ID NO: 183418 - DNA, 20 bp, Artificial Sequence
  Synthetic oligonucleotide; GAG chr2 60467046 60467065 60467049 -
caccatttacttgttcaagt

SEQ ID NO: 183419 - DNA, 20 bp, Artificial Sequence
  Synthetic oligonucleotide; TAG chr2 60467037 60467056 60467040 -
cttgttcaagtgagctttta

SEQ ID NO: 183420 - DNA, 20 bp, Artificial Sequence
  Synthetic oligonucleotide; TAG chr2 60467034 60467053 60467037 -
gttcaagtgagcttttatag

SEQ ID NO: 183421 - DNA, 20 bp, Artificial Sequence
  Synthetic oligonucleotide; AGG chr2 60467033 60467052 60467036 -
ttcaagtgagcttttatagt

SEQ ID NO: 183422 - DNA, 20 bp, Artificial Sequence
  Synthetic oligonucleotide; GGG chr2 60467032 60467051 60467035 -
tcaagtgagcttttatagta

SEQ ID NO: 183423 - DNA, 20 bp, Artificial Sequence
  Synthetic oligonucleotide; AAG chr2 60466981 60467000 60466984 -
tttatacaaatgttttctga

SEQ ID NO: 183424 - DNA, 20 bp, Artificial Sequence
  Synthetic oligonucleotide; TAG chr2 60466969 60466988 60466972 -
ttttctgaaagatactgttt

SEQ ID NO: 183425 - DNA, 20 bp, Artificial Sequence
  Synthetic oligonucleotide; CAG chr2 60466957 60466976 60466960 -
tactgttttagaaaataata

SEQ ID NO: 183426 - DNA, 20 bp, Artificial Sequence
  Synthetic oligonucleotide; TAG chr2 60466940 60466959 60466943 -
atacagtttgcttctctgtg

SEQ ID NO: 183427 - DNA, 20 bp, Artificial Sequence
  Synthetic oligonucleotide; AGG chr2 60466939 60466958 60466942 -
tacagtttgcttctctgtgt

SEQ ID NO: 183428 - DNA, 20 bp, Artificial Sequence
  Synthetic oligonucleotide; TGG chr2 60466930 60466949 60466933 -
cttctctgtgtaggaacaca

SEQ ID NO: 183429 - DNA, 20 bp, Artificial Sequence
  Synthetic oligonucleotide; TGG chr2 60466914 60466933 60466917 -
cacatggtatgaatcatgca

SEQ ID NO: 183430 - DNA, 20 bp, Artificial Sequence
  Synthetic oligonucleotide; AAG chr2 60466907 60466926 60466910 -
tatgaatcatgcatggctaa

SEQ ID NO: 183431 - DNA, 20 bp, Artificial Sequence
  Synthetic oligonucleotide; AGG chr2 60466906 60466925 60466909 -
atgaatcatgcatggctaaa

SEQ ID NO: 183432 - DNA, 20 bp, Artificial Sequence
  Synthetic oligonucleotide; TAG chr2 60466902 60466921 60466905 -
atcatgcatggctaaaaggt

SEQ ID NO: 183433 - DNA, 20 bp, Artificial Sequence
  Synthetic oligonucleotide; AGG chr2 60466901 60466920 60466904 -
tcatgcatggctaaaaggtt

SEQ ID NO: 183434 - DNA, 20 bp, Artificial Sequence
  Synthetic oligonucleotide; GGG chr2 60466900 60466919 60466903 -
catgcatggctaaaaggtta

SEQ ID NO: 183435 - DNA, 20 bp, Artificial Sequence
  Synthetic oligonucleotide; GGG chr2 60466899 60466918 60466902 -
atgcatggctaaaaggttag

SEQ ID NO: 183436 - DNA, 20 bp, Artificial Sequence
  Synthetic oligonucleotide; GGG chr2 60466898 60466917 60466901 -
tgcatggctaaaaggttagg

SEQ ID NO: 183437 - DNA, 20 bp, Artificial Sequence
  Synthetic oligonucleotide; TGG chr2 60466895 60466914 60466898 -
atggctaaaaggttaggggg

SEQ ID NO: 183438 - DNA, 20 bp, Artificial Sequence
  Synthetic oligonucleotide; GGG chr2 60466894 60466913 60466897 -
tggctaaaaggttagggggt

SEQ ID NO: 183439 - DNA, 20 bp, Artificial Sequence
  Synthetic oligonucleotide; CAG chr2 60466891 60466910 60466894 -
ctaaaaggttagggggtggg

SEQ ID NO: 183440 - DNA, 20 bp, Artificial Sequence
  Synthetic oligonucleotide; AAG chr2 60466866 60466885 60466869 -
attccaccctaaacacaaaa

SEQ ID NO: 183441 - DNA, 20 bp, Artificial Sequence
  Synthetic oligonucleotide; CAG chr2 60466863 60466882 60466866 -
ccaccctaaacacaaaaaag

SEQ ID NO: 183442 - DNA, 20 bp, Artificial Sequence
  Synthetic oligonucleotide; AGG chr2 60466862 60466881 60466865 -
caccctaaacacaaaaaagc

SEQ ID NO: 183443 - DNA, 20 bp, Artificial Sequence
  Synthetic oligonucleotide; AAG chr2 60466856 60466875 60466859 -
aaacacaaaaaagcaggttc

SEQ ID NO: 183444 - DNA, 20 bp, Artificial Sequence
  Synthetic oligonucleotide; AAG chr2 60466853 60466872 60466856 -
cacaaaaaagcaggttcaag

SEQ ID NO: 183445 - DNA, 20 bp, Artificial Sequence
  Synthetic oligonucleotide; AAG chr2 60466848 60466867 60466851 -
aaaagcaggttcaagaagaa

SEQ ID NO: 183446 - DNA, 20 bp, Artificial Sequence
  Synthetic oligonucleotide; AAG chr2 60466845 60466864 60466848 -
agcaggttcaagaagaaaag

SEQ ID NO: 183447 - DNA, 20 bp, Artificial Sequence
  Synthetic oligonucleotide; AAG chr2 60466819 60466838 60466822 -
gacatctaatttttatttga

SEQ ID NO: 183448 - DNA, 20 bp, Artificial Sequence
  Synthetic oligonucleotide; TGG chr2 60466795 60466814 60466798 -
aaatgaaaaataacctgctg

SEQ ID NO: 183449 - DNA, 20 bp, Artificial Sequence
  Synthetic oligonucleotide; AAG chr2 60466791 60466810 60466794 -
gaaaaataacctgctgtgga

SEQ ID NO: 183450 - DNA, 20 bp, Artificial Sequence
  Synthetic oligonucleotide; AAG chr2 60466781 60466800 60466784 -
ctgctgtggaaagaaaaaaa

SEQ ID NO: 183451 - DNA, 20 bp, Artificial Sequence
  Synthetic oligonucleotide; AAG chr2 60466776 60466795 60466779 -
gtggaaagaaaaaaaaagaa

SEQ ID NO: 183452 - DNA, 20 bp, Artificial Sequence
  Synthetic oligonucleotide; AGG chr2 60466775 60466794 60466778 -
tggaaagaaaaaaaaagaaa

SEQ ID NO: 183453 - DNA, 20 bp, Artificial Sequence
  Synthetic oligonucleotide; AAG chr2 60466769 60466788 60466772 -
gaaaaaaaaagaaaaggaaa

SEQ ID NO: 183454 - DNA, 20 bp, Artificial Sequence
  Synthetic oligonucleotide; AGG chr2 60466768 60466787 60466771 -
aaaaaaaaagaaaaggaaaa

SEQ ID NO: 183455 - DNA, 20 bp, Artificial Sequence
  Synthetic oligonucleotide; TGG chr2 60466762 60466781 60466765 -
aaagaaaaggaaaaaggtca

SEQ ID NO: 183456 - DNA, 20 bp, Artificial Sequence
  Synthetic oligonucleotide; GAG chr2 60466760 60466779 60466763 -
agaaaaggaaaaaggtcatg

SEQ ID NO: 183457 - DNA, 20 bp, Artificial Sequence
  Synthetic oligonucleotide; GAG chr2 60466758 60466777 60466761 -
aaaaggaaaaaggtcatgga

SEQ ID NO: 183458 - DNA, 20 bp, Artificial Sequence
  Synthetic oligonucleotide; GAG chr2 60466756 60466775 60466759 -
aaggaaaaaggtcatggaga

SEQ ID NO: 183459 - DNA, 20 bp, Artificial Sequence
  Synthetic oligonucleotide; AAG chr2 60466746 60466765 60466749 -
gtcatggagagagaataaca

SEQ ID NO: 183460 - DNA, 20 bp, Artificial Sequence
  Synthetic oligonucleotide; GAG chr2 60466744 60466763 60466747 -
catggagagagaataacaaa

SEQ ID NO: 183461 - DNA, 20 bp, Artificial Sequence
  Synthetic oligonucleotide; AAG chr2 60466740 60466759 60466743 -
gagagagaataacaaagagc

SEQ ID NO: 183462 - DNA, 20 bp, Artificial Sequence
  Synthetic oligonucleotide; CAG chr2 60466733 60466752 60466736 -
aataacaaagagcaagatgc

SEQ ID NO: 183463 - DNA, 20 bp, Artificial Sequence
  Synthetic oligonucleotide; GAG chr2 60466731 60466750 60466734 -
taacaaagagcaagatgcca

SEQ ID NO: 183464 - DNA, 20 bp, Artificial Sequence
  Synthetic oligonucleotide; AAG chr2 60466726 60466745 60466729 -
aagagcaagatgccagagtt

SEQ ID NO: 183465 - DNA, 20 bp, Artificial Sequence
  Synthetic oligonucleotide; AGG chr2 60466725 60466744 60466728 -
agagcaagatgccagagtta

SEQ ID NO: 183466 - DNA, 20 bp, Artificial Sequence
  Synthetic oligonucleotide; AAG chr2 60466718 60466737 60466721 -
gatgccagagttaaggctct

SEQ ID NO: 183467 - DNA, 20 bp, Artificial Sequence
  Synthetic oligonucleotide; AGG chr2 60466717 60466736 60466720 -
atgccagagttaaggctcta

SEQ ID NO: 183468 - DNA, 20 bp, Artificial Sequence
  Synthetic oligonucleotide; GGG chr2 60466716 60466735 60466719 -
tgccagagttaaggctctaa

SEQ ID NO: 183469 - DNA, 20 bp, Artificial Sequence
  Synthetic oligonucleotide; GGG chr2 60466715 60466734 60466718 -
gccagagttaaggctctaag

SEQ ID NO: 183470 - DNA, 20 bp, Artificial Sequence
  Synthetic oligonucleotide; GGG chr2 60466714 60466733 60466717 -
ccagagttaaggctctaagg

SEQ ID NO: 183471 - DNA, 20 bp, Artificial Sequence
  Synthetic oligonucleotide; TAG chr2 60466703 60466722 60466706 -
gctctaagggggactgtttt

SEQ ID NO: 183472 - DNA, 20 bp, Artificial Sequence
  Synthetic oligonucleotide; TGG chr2 60466699 60466718 60466702 -
taagggggactgtttttaga

SEQ ID NO: 183473 - DNA, 20 bp, Artificial Sequence
  Synthetic oligonucleotide; GGG chr2 60466698 60466717 60466701 -
aagggggactgtttttagat

SEQ ID NO: 183474 - DNA, 20 bp, Artificial Sequence
  Synthetic oligonucleotide; GAG chr2 60466696 60466715 60466699 -
gggggactgtttttagatgg

SEQ ID NO: 183475 - DNA, 20 bp, Artificial Sequence
  Synthetic oligonucleotide; AGG chr2 60466695 60466714 60466698 -
ggggactgtttttagatggg

SEQ ID NO: 183476 - DNA, 20 bp, Artificial Sequence
  Synthetic oligonucleotide; GGG chr2 60466694 60466713 60466697 -
gggactgtttttagatggga

SEQ ID NO: 183477 - DNA, 20 bp, Artificial Sequence
  Synthetic oligonucleotide; GAG chr2 60466692 60466711 60466695 -
gactgtttttagatgggagg

SEQ ID NO: 183478 - DNA, 20 bp, Artificial Sequence
  Synthetic oligonucleotide; TGG chr2 60466666 60466685 60466669 -
acacttacccatcttgtaaa

SEQ ID NO: 183479 - DNA, 20 bp, Artificial Sequence
  Synthetic oligonucleotide; AAG chr2 60466657 60466676 60466660 -
catcttgtaaatggtatctg

SEQ ID NO: 183480 - DNA, 20 bp, Artificial Sequence
  Synthetic oligonucleotide; GAG chr2 60466655 60466674 60466658 -
tcttgtaaatggtatctgaa

SEQ ID NO: 183481 - DNA, 20 bp, Artificial Sequence
  Synthetic oligonucleotide; CAG chr2 60466652 60466671 60466655 -
tgtaaatggtatctgaagag

SEQ ID NO: 183482 - DNA, 20 bp, Artificial Sequence
  Synthetic oligonucleotide; AGG chr2 60466651 60466670 60466654 -
gtaaatggtatctgaagagc

SEQ ID NO: 183483 - DNA, 20 bp, Artificial Sequence
  Synthetic oligonucleotide; GGG chr2 60466650 60466669 60466653 -
taaatggtatctgaagagca

SEQ ID NO: 183484 - DNA, 20 bp, Artificial Sequence
  Synthetic oligonucleotide; GAG chr2 60466637 60466656 60466640 -
aagagcagggcatgcaccct

SEQ ID NO: 183485 - DNA, 20 bp, Artificial Sequence
  Synthetic oligonucleotide; CAG chr2 60466632 60466651 60466635 -
cagggcatgcaccctgagac

SEQ ID NO: 183486 - DNA, 20 bp, Artificial Sequence
  Synthetic oligonucleotide; AAG chr2 60466624 60466643 60466627 -
gcaccctgagaccagattca

SEQ ID NO: 183487 - DNA, 20 bp, Artificial Sequence
  Synthetic oligonucleotide; CAG chr2 60466620 60466639 60466623 -
cctgagaccagattcaaagc

SEQ ID NO: 183488 - DNA, 20 bp, Artificial Sequence
  Synthetic oligonucleotide; TAG chr2 60466596 60466615 60466599 -
tgtttatttttgttaactcc

SEQ ID NO: 183489 - DNA, 20 bp, Artificial Sequence
  Synthetic oligonucleotide; AGG chr2 60466595 60466614 60466598 -
gtttatttttgttaactcct

SEQ ID NO: 183490 - DNA, 20 bp, Artificial Sequence
  Synthetic oligonucleotide; TAG chr2 60466586 60466605 60466589 -
tgttaactcctaggtaatcc

SEQ ID NO: 183491 - DNA, 20 bp, Artificial Sequence
  Synthetic oligonucleotide; AGG chr2 60466585 60466604 60466588 -
gttaactcctaggtaatcct

SEQ ID NO: 183492 - DNA, 20 bp, Artificial Sequence
  Synthetic oligonucleotide; AAG chr2 60466577 60466596 60466580 -
ctaggtaatcctaggtaaca

SEQ ID NO: 183493 - DNA, 20 bp, Artificial Sequence
  Synthetic oligonucleotide; GAG chr2 60466575 60466594 60466578 -
aggtaatcctaggtaacaaa

SEQ ID NO: 183494 - DNA, 20 bp, Artificial Sequence
  Synthetic oligonucleotide; AAG chr2 60466554 60466573 60466557 -
agttattgtgtgaatttcat

SEQ ID NO: 183495 - DNA, 20 bp, Artificial Sequence
  Synthetic oligonucleotide; CAG chr2 60466547 60466566 60466550 -
gtgtgaatttcataagccct

SEQ ID NO: 183496 - DNA, 20 bp, Artificial Sequence
  Synthetic oligonucleotide; AGG chr2 60466546 60466565 60466549 -
tgtgaatttcataagccctc

SEQ ID NO: 183497 - DNA, 20 bp, Artificial Sequence
  Synthetic oligonucleotide; GAG chr2 60466539 60466558 60466542 -
ttcataagccctcaggtcct

SEQ ID NO: 183498 - DNA, 20 bp, Artificial Sequence
  Synthetic oligonucleotide; AGG chr2 60466538 60466557 60466541 -
tcataagccctcaggtcctg

SEQ ID NO: 183499 - DNA, 20 bp, Artificial Sequence
  Synthetic oligonucleotide; GGG chr2 60466537 60466556 60466540 -
cataagccctcaggtcctga

SEQ ID NO: 183500 - DNA, 20 bp, Artificial Sequence
  Synthetic oligonucleotide; TGG chr2 60466533 60466552 60466536 -
agccctcaggtcctgagggc

SEQ ID NO: 183501 - DNA, 20 bp, Artificial Sequence
  Synthetic oligonucleotide; GGG chr2 60466532 60466551 60466535 -
gccctcaggtcctgagggct

SEQ ID NO: 183502 - DNA, 20 bp, Artificial Sequence
  Synthetic oligonucleotide; TGG chr2 60466529 60466548 60466532 -
ctcaggtcctgagggctggg

SEQ ID NO: 183503 - DNA, 20 bp, Artificial Sequence
  Synthetic oligonucleotide; CAG chr2 60466524 60466543 60466527 -
gtcctgagggctgggtggtt

SEQ ID NO: 183504 - DNA, 20 bp, Artificial Sequence
  Synthetic oligonucleotide; AGG chr2 60466523 60466542 60466526 -
tcctgagggctgggtggttc

SEQ ID NO: 183505 - DNA, 20 bp, Artificial Sequence
  Synthetic oligonucleotide; GGG chr2 60466522 60466541 60466525 -
cctgagggctgggtggttca

SEQ ID NO: 183506 - DNA, 20 bp, Artificial Sequence
  Synthetic oligonucleotide; GGG chr2 60466521 60466540 60466524 -
ctgagggctgggtggttcag

SEQ ID NO: 183507 - DNA, 20 bp, Artificial Sequence
  Synthetic oligonucleotide; AAG chr2 60466514 60466533 60466517 -
ctgggtggttcaggggttaa

SEQ ID NO: 183508 - DNA, 20 bp, Artificial Sequence
  Synthetic oligonucleotide; AAG chr2 60466488 60466507 60466491 -
ctcatctgctcccttccccc

SEQ ID NO: 183509 - DNA, 20 bp, Artificial Sequence
  Synthetic oligonucleotide; TGG chr2 60466484 60466503 60466487 -
tctgctcccttcccccaagc

SEQ ID NO: 183510 - DNA, 20 bp, Artificial Sequence
  Synthetic oligonucleotide; GGG chr2 60466483 60466502 60466486 -
ctgctcccttcccccaagct

SEQ ID NO: 183511 - DNA, 20 bp, Artificial Sequence
  Synthetic oligonucleotide; AAG chr2 60466477 60466496 60466480 -
ccttcccccaagctgggcct

SEQ ID NO: 183512 - DNA, 20 bp, Artificial Sequence
  Synthetic oligonucleotide; TGG chr2 60466472 60466491 60466475 -
ccccaagctgggcctaagcc

SEQ ID NO: 183513 - DNA, 20 bp, Artificial Sequence
  Synthetic oligonucleotide; GGG chr2 60466471 60466490 60466474 -
cccaagctgggcctaagcct

SEQ ID NO: 183514 - DNA, 20 bp, Artificial Sequence
  Synthetic oligonucleotide; TAG chr2 60466467 60466486 60466470 -
agctgggcctaagcctgggt

SEQ ID NO: 183515 - DNA, 20 bp, Artificial Sequence
  Synthetic oligonucleotide; AGG chr2 60466466 60466485 60466469 -
gctgggcctaagcctgggtt

SEQ ID NO: 183516 - DNA, 20 bp, Artificial Sequence
  Synthetic oligonucleotide; CAG chr2 60466460 60466479 60466463 -
cctaagcctgggttaggtca

SEQ ID NO: 183517 - DNA, 20 bp, Artificial Sequence
  Synthetic oligonucleotide; CAG chr2 60466453 60466472 60466456 -
ctgggttaggtcacagattg

SEQ ID NO: 183518 - DNA, 20 bp, Artificial Sequence
  Synthetic oligonucleotide; AAG chr2 60466450 60466469 60466453 -
ggttaggtcacagattgcag

SEQ ID NO: 183519 - DNA, 20 bp, Artificial Sequence
  Synthetic oligonucleotide; AGG chr2 60466449 60466468 60466452 -
gttaggtcacagattgcaga

SEQ ID NO: 183520 - DNA, 20 bp, Artificial Sequence
  Synthetic oligonucleotide; TAG chr2 60466444 60466463 60466447 -
gtcacagattgcagaaggtt

SEQ ID NO: 183521 - DNA, 20 bp, Artificial Sequence
  Synthetic oligonucleotide; AGG chr2 60466443 60466462 60466446 -
tcacagattgcagaaggttt

SEQ ID NO: 183522 - DNA, 20 bp, Artificial Sequence
  Synthetic oligonucleotide; GAG chr2 60466441 60466460 60466444 -
acagattgcagaaggtttag

SEQ ID NO: 183523 - DNA, 20 bp, Artificial Sequence
  Synthetic oligonucleotide; AGG chr2 60466440 60466459 60466443 -
cagattgcagaaggtttagg

SEQ ID NO: 183524 - DNA, 20 bp, Artificial Sequence
  Synthetic oligonucleotide; TGG chr2 60466436 60466455 60466439 -
ttgcagaaggtttaggaggt

SEQ ID NO: 183525 - DNA, 20 bp, Artificial Sequence
  Synthetic oligonucleotide; GGG chr2 60466435 60466454 60466438 -
tgcagaaggtttaggaggtt

SEQ ID NO: 183526 - DNA, 20 bp, Artificial Sequence
  Synthetic oligonucleotide; CGG chr2 60466428 60466447 60466431 -
ggtttaggaggttgggctca

SEQ ID NO: 183527 - DNA, 20 bp, Artificial Sequence
  Synthetic oligonucleotide; TAG chr2 60466421 60466440 60466424 -
gaggttgggctcacggtttc

SEQ ID NO: 183528 - DNA, 20 bp, Artificial Sequence
  Synthetic oligonucleotide; TGG chr2 60466407 60466426 60466410 -
ggtttctagtccctgcatgc

SEQ ID NO: 183529 - DNA, 20 bp, Artificial Sequence
  Synthetic oligonucleotide; TGG chr2 60466403 60466422 60466406 -
tctagtccctgcatgctggc

SEQ ID NO: 183530 - DNA, 20 bp, Artificial Sequence
  Synthetic oligonucleotide; GGG chr2 60466402 60466421 60466405 -
ctagtccctgcatgctggct

SEQ ID NO: 183531 - DNA, 20 bp, Artificial Sequence
  Synthetic oligonucleotide; TGG chr2 60466399 60466418 60466402 -
gtccctgcatgctggctggg

SEQ ID NO: 183532 - DNA, 20 bp, Artificial Sequence
  Synthetic oligonucleotide; GGG chr2 60466398 60466417 60466401 -
tccctgcatgctggctgggt

SEQ ID NO: 183533 - DNA, 20 bp, Artificial Sequence
  Synthetic oligonucleotide; GGG chr2 60466397 60466416 60466400 -
ccctgcatgctggctgggtg

SEQ ID NO: 183534 - DNA, 20 bp, Artificial Sequence
  Synthetic oligonucleotide; GAG chr2 60466395 60466414 60466398 -
ctgcatgctggctgggtggg

SEQ ID NO: 183535 - DNA, 20 bp, Artificial Sequence
  Synthetic oligonucleotide; GAG chr2 60466393 60466412 60466396 -
gcatgctggctgggtgggga

SEQ ID NO: 183536 - DNA, 20 bp, Artificial Sequence
  Synthetic oligonucleotide; TGG chr2 60466378 60466397 60466381 -
ggggagagctctcctgttgc

SEQ ID NO: 183537 - DNA, 20 bp, Artificial Sequence
  Synthetic oligonucleotide; GGG chr2 60466377 60466396 60466380 -
gggagagctctcctgttgct

SEQ ID NO: 183538 - DNA, 20 bp, Artificial Sequence
  Synthetic oligonucleotide; GGG chr2 60466376 60466395 60466379 -
ggagagctctcctgttgctg

SEQ ID NO: 183539 - DNA, 20 bp, Artificial Sequence
  Synthetic oligonucleotide; GGG chr2 60466375 60466394 60466378 -
gagagctctcctgttgctgg

SEQ ID NO: 183540 - DNA, 20 bp, Artificial Sequence
  Synthetic oligonucleotide; TGG chr2 60466368 60466387 60466371 -
ctcctgttgctgggggcatc

SEQ ID NO: 183541 - DNA, 20 bp, Artificial Sequence
  Synthetic oligonucleotide; GGG chr2 60466367 60466386 60466370 -
tcctgttgctgggggcatct

SEQ ID NO: 183542 - DNA, 20 bp, Artificial Sequence
  Synthetic oligonucleotide; GGG chr2 60466366 60466385 60466369 -
cctgttgctgggggcatctg

SEQ ID NO: 183543 - DNA, 20 bp, Artificial Sequence
  Synthetic oligonucleotide; TGG chr2 60466357 60466376 60466360 -
gggggcatctggggcctgca

SEQ ID NO: 183544 - DNA, 20 bp, Artificial Sequence
  Synthetic oligonucleotide; GGG chr2 60466356 60466375 60466359 -
ggggcatctggggcctgcat

SEQ ID NO: 183545 - DNA, 20 bp, Artificial Sequence
  Synthetic oligonucleotide; GGG chr2 60466355 60466374 60466358 -
gggcatctggggcctgcatg

SEQ ID NO: 183546 - DNA, 20 bp, Artificial Sequence
  Synthetic oligonucleotide; TGG chr2 60466349 60466368 60466352 -
ctggggcctgcatggggctg

SEQ ID NO: 183547 - DNA, 20 bp, Artificial Sequence
  Synthetic oligonucleotide; CGG chr2 60466343 60466362 60466346 -
cctgcatggggctgtggaaa

SEQ ID NO: 183548 - DNA, 20 bp, Artificial Sequence
  Synthetic oligonucleotide; GAG chr2 60466341 60466360 60466344 -
tgcatggggctgtggaaacg

SEQ ID NO: 183549 - DNA, 20 bp, Artificial Sequence
  Synthetic oligonucleotide; TGG chr2 60466331 60466350 60466334 -
tgtggaaacggagccacttt

SEQ ID NO: 183550 - DNA, 20 bp, Artificial Sequence
  Synthetic oligonucleotide; GAG chr2 60466329 60466348 60466332 -
tggaaacggagccacttttg

SEQ ID NO: 183551 - DNA, 20 bp, Artificial Sequence
  Synthetic oligonucleotide; AGG chr2 60466328 60466347 60466331 -
ggaaacggagccacttttgg

SEQ ID NO: 183552 - DNA, 20 bp, Artificial Sequence
  Synthetic oligonucleotide; GGG chr2 60466327 60466346 60466330 -
gaaacggagccacttttgga

SEQ ID NO: 183553 - DNA, 20 bp, Artificial Sequence
  Synthetic oligonucleotide; AAG chr2 60466324 60466343 60466327 -
acggagccacttttggaggg

SEQ ID NO: 183554 - DNA, 20 bp, Artificial Sequence
  Synthetic oligonucleotide; AGG chr2 60466323 60466342 60466326 -
cggagccacttttggaggga

SEQ ID NO: 183555 - DNA, 20 bp, Artificial Sequence
  Synthetic oligonucleotide; GGG chr2 60466322 60466341 60466325 -
ggagccacttttggagggaa

SEQ ID NO: 183556 - DNA, 20 bp, Artificial Sequence
  Synthetic oligonucleotide; TAG chr2 60466318 60466337 60466321 -
ccacttttggagggaaggga

SEQ ID NO: 183557 - DNA, 20 bp, Artificial Sequence
  Synthetic oligonucleotide; AAG chr2 60466315 60466334 60466318 -
cttttggagggaagggatag

SEQ ID NO: 183558 - DNA, 20 bp, Artificial Sequence
  Synthetic oligonucleotide; AGG chr2 60466314 60466333 60466317 -
ttttggagggaagggataga

SEQ ID NO: 183559 - DNA, 20 bp, Artificial Sequence
  Synthetic oligonucleotide; GGG chr2 60466313 60466332 60466316 -
tttggagggaagggatagaa

SEQ ID NO: 183560 - DNA, 20 bp, Artificial Sequence
  Synthetic oligonucleotide; GAG chr2 60466311 60466330 60466314 -
tggagggaagggatagaagg

SEQ ID NO: 183561 - DNA, 20 bp, Artificial Sequence
  Synthetic oligonucleotide; GAG chr2 60466306 60466325 60466309 -
ggaagggatagaagggagtt

SEQ ID NO: 183562 - DNA, 20 bp, Artificial Sequence
  Synthetic oligonucleotide; CAG chr2 60466303 60466322 60466306 -
agggatagaagggagttgag

SEQ ID NO: 183563 - DNA, 20 bp, Artificial Sequence
  Synthetic oligonucleotide; CAG chr2 60466298 60466317 60466301 -
tagaagggagttgagcagtt

SEQ ID NO: 183564 - DNA, 20 bp, Artificial Sequence
  Synthetic oligonucleotide; GAG chr2 60466296 60466315 60466299 -
gaagggagttgagcagttca

SEQ ID NO: 183565 - DNA, 20 bp, Artificial Sequence
  Synthetic oligonucleotide; AGG chr2 60466295 60466314 60466298 -
aagggagttgagcagttcag

SEQ ID NO: 183566 - DNA, 20 bp, Artificial Sequence
  Synthetic oligonucleotide; GAG chr2 60466293 60466312 60466296 -
gggagttgagcagttcagag

SEQ ID NO: 183567 - DNA, 20 bp, Artificial Sequence
  Synthetic oligonucleotide; AGG chr2 60466292 60466311 60466295 -
ggagttgagcagttcagagg

SEQ ID NO: 183568 - DNA, 20 bp, Artificial Sequence
  Synthetic oligonucleotide; GGG chr2 60466291 60466310 60466294 -
gagttgagcagttcagagga

SEQ ID NO: 183569 - DNA, 20 bp, Artificial Sequence
  Synthetic oligonucleotide; TGG chr2 60466288 60466307 60466291 -
ttgagcagttcagaggaggg

SEQ ID NO: 183570 - DNA, 20 bp, Artificial Sequence
  Synthetic oligonucleotide; GAG chr2 60466286 60466305 60466289 -
gagcagttcagaggagggtg

SEQ ID NO: 183571 - DNA, 20 bp, Artificial Sequence
  Synthetic oligonucleotide; GAG chr2 60466281 60466300 60466284 -
gttcagaggagggtggagtt

SEQ ID NO: 183572 - DNA, 20 bp, Artificial Sequence
  Synthetic oligonucleotide; GAG chr2 60466279 60466298 60466282 -
tcagaggagggtggagttga

SEQ ID NO: 183573 - DNA, 20 bp, Artificial Sequence
  Synthetic oligonucleotide; AGG chr2 60466278 60466297 60466281 -
cagaggagggtggagttgag

SEQ ID NO: 183574 - DNA, 20 bp, Artificial Sequence
  Synthetic oligonucleotide; AAG chr2 60466273 60466292 60466276 -
gagggtggagttgagaggcc

SEQ ID NO: 183575 - DNA, 20 bp, Artificial Sequence
  Synthetic oligonucleotide; AGG chr2 60466272 60466291 60466275 -
agggtggagttgagaggcca

SEQ ID NO: 183576 - DNA, 20 bp, Artificial Sequence
  Synthetic oligonucleotide; GGG chr2 60466271 60466290 60466274 -
gggtggagttgagaggccaa

SEQ ID NO: 183577 - DNA, 20 bp, Artificial Sequence
  Synthetic oligonucleotide; CAG chr2 60466261 60466280 60466264 -
gagaggccaagggctgttgc

SEQ ID NO: 183578 - DNA, 20 bp, Artificial Sequence
  Synthetic oligonucleotide; AGG chr2 60466260 60466279 60466263 -
agaggccaagggctgttgcc

SEQ ID NO: 183579 - DNA, 20 bp, Artificial Sequence
  Synthetic oligonucleotide; GGG chr2 60466259 60466278 60466262 -
gaggccaagggctgttgcca

SEQ ID NO: 183580 - DNA, 20 bp, Artificial Sequence
  Synthetic oligonucleotide; TAG chr2 60466251 60466270 60466254 -
gggctgttgccagggaaaca

SEQ ID NO: 183581 - DNA, 20 bp, Artificial Sequence
  Synthetic oligonucleotide; CGG chr2 60466244 60466263 60466247 -
tgccagggaaacatagttct

SEQ ID NO: 183582 - DNA, 20 bp, Artificial Sequence
  Synthetic oligonucleotide; CAG chr2 60466237 60466256 60466240 -
gaaacatagttctcggtctt

SEQ ID NO: 183583 - DNA, 20 bp, Artificial Sequence
  Synthetic oligonucleotide; TGG chr2 60466232 60466251 60466235 -
atagttctcggtcttcagcc

SEQ ID NO: 183584 - DNA, 20 bp, Artificial Sequence
  Synthetic oligonucleotide; GAG chr2 60466222 60466241 60466225 -
gtcttcagcctggtcttcct

SEQ ID NO: 183585 - DNA, 20 bp, Artificial Sequence
  Synthetic oligonucleotide; AGG chr2 60466221 60466240 60466224 -
tcttcagcctggtcttcctg

SEQ ID NO: 183586 - DNA, 20 bp, Artificial Sequence
  Synthetic oligonucleotide; GGG chr2 60466220 60466239 60466223 -
cttcagcctggtcttcctga

SEQ ID NO: 183587 - DNA, 20 bp, Artificial Sequence
  Synthetic oligonucleotide; TGG chr2 60466216 60466235 60466219 -
agcctggtcttcctgagggc

SEQ ID NO: 183588 - DNA, 20 bp, Artificial Sequence
  Synthetic oligonucleotide; GGG chr2 60466215 60466234 60466218 -
gcctggtcttcctgagggct

SEQ ID NO: 183589 - DNA, 20 bp, Artificial Sequence
  Synthetic oligonucleotide; GAG chr2 60466213 60466232 60466216 -
ctggtcttcctgagggctgg

SEQ ID NO: 183590 - DNA, 20 bp, Artificial Sequence
  Synthetic oligonucleotide; TGG chr2 60466199 60466218 60466202 -
ggctgggagtttgatttgac

SEQ ID NO: 183591 - DNA, 20 bp, Artificial Sequence
  Synthetic oligonucleotide; TAG chr2 60466196 60466215 60466199 -
tgggagtttgatttgactgg

SEQ ID NO: 183592 - DNA, 20 bp, Artificial Sequence
  Synthetic oligonucleotide; AGG chr2 60466195 60466214 60466198 -
gggagtttgatttgactggt

SEQ ID NO: 183593 - DNA, 20 bp, Artificial Sequence
  Synthetic oligonucleotide; AAG chr2 60466191 60466210 60466194 -
gtttgatttgactggtagga

SEQ ID NO: 183594 - DNA, 20 bp, Artificial Sequence
  Synthetic oligonucleotide; GAG chr2 60466185 60466204 60466188 -
tttgactggtaggaaagtct

SEQ ID NO: 183595 - DNA, 20 bp, Artificial Sequence
  Synthetic oligonucleotide; TAG chr2 60466177 60466196 60466180 -
gtaggaaagtctgagcttga

SEQ ID NO: 183596 - DNA, 20 bp, Artificial Sequence
  Synthetic oligonucleotide; AGG chr2 60466176 60466195 60466179 -
taggaaagtctgagcttgat

SEQ ID NO: 183597 - DNA, 20 bp, Artificial Sequence
  Synthetic oligonucleotide; GGG chr2 60466175 60466194 60466178 -
aggaaagtctgagcttgata

SEQ ID NO: 183598 - DNA, 20 bp, Artificial Sequence
  Synthetic oligonucleotide; AAG chr2 60466144 60466163 60466147 -
tcctctcccaccttcccaca

SEQ ID NO: 183599 - DNA, 20 bp, Artificial Sequence
  Synthetic oligonucleotide; AGG chr2 60466143 60466162 60466146 -
cctctcccaccttcccacaa

SEQ ID NO: 183600 - DNA, 20 bp, Artificial Sequence
  Synthetic oligonucleotide; GGG chr2 60466142 60466161 60466145 -
ctctcccaccttcccacaaa

SEQ ID NO: 183601 - DNA, 20 bp, Artificial Sequence
  Synthetic oligonucleotide; GAG chr2 60466140 60466159 60466143 -
ctcccaccttcccacaaagg

SEQ ID NO: 183602 - DNA, 20 bp, Artificial Sequence
  Synthetic oligonucleotide; AGG chr2 60466139 60466158 60466142 -
tcccaccttcccacaaaggg

SEQ ID NO: 183603 - DNA, 20 bp, Artificial Sequence
  Synthetic oligonucleotide; GGG chr2 60466138 60466157 60466141 -
cccaccttcccacaaaggga

SEQ ID NO: 183604 - DNA, 20 bp, Artificial Sequence
  Synthetic oligonucleotide; TAG chr2 60466131 60466150 60466134 -
tcccacaaagggagggtaca

SEQ ID NO: 183605 - DNA, 20 bp, Artificial Sequence
  Synthetic oligonucleotide; TGG chr2 60466123 60466142 60466126 -
agggagggtacatagtttgc

SEQ ID NO: 183606 - DNA, 20 bp, Artificial Sequence
  Synthetic oligonucleotide; TGG chr2 60466111 60466130 60466114 -
tagtttgctggtgcccctgc

SEQ ID NO: 183607 - DNA, 20 bp, Artificial Sequence
  Synthetic oligonucleotide; CAG chr2 60466108 60466127 60466111 -
tttgctggtgcccctgctgg

SEQ ID NO: 183608 - DNA, 20 bp, Artificial Sequence
  Synthetic oligonucleotide; AGG chr2 60466107 60466126 60466110 -
ttgctggtgcccctgctggc

SEQ ID NO: 183609 - DNA, 20 bp, Artificial Sequence
  Synthetic oligonucleotide; TAG chr2 60466097 60466116 60466100 -
ccctgctggcaggaccaatt

SEQ ID NO: 183610 - DNA, 20 bp, Artificial Sequence
  Synthetic oligonucleotide; AGG chr2 60466096 60466115 60466099 -
cctgctggcaggaccaattt

SEQ ID NO: 183611 - DNA, 20 bp, Artificial Sequence
  Synthetic oligonucleotide; GAG chr2 60466094 60466113 60466097 -
tgctggcaggaccaatttag

SEQ ID NO: 183612 - DNA, 20 bp, Artificial Sequence
  Synthetic oligonucleotide; CAG chr2 60466087 60466106 60466090 -
aggaccaatttaggagtgac

SEQ ID NO: 183613 - DNA, 20 bp, Artificial Sequence
  Synthetic oligonucleotide; AAG chr2 60466081 60466100 60466084 -
aatttaggagtgaccagaac

SEQ ID NO: 183614 - DNA, 20 bp, Artificial Sequence
  Synthetic oligonucleotide; AGG chr2 60466080 60466099 60466083 -
atttaggagtgaccagaaca

SEQ ID NO: 183615 - DNA, 20 bp, Artificial Sequence
  Synthetic oligonucleotide; TGG chr2 60466073 60466092 60466076 -
agtgaccagaacaaggtatg

SEQ ID NO: 183616 - DNA, 20 bp, Artificial Sequence
  Synthetic oligonucleotide; AAG chr2 60466070 60466089 60466073 -
gaccagaacaaggtatgtgg

SEQ ID NO: 183617 - DNA, 20 bp, Artificial Sequence
  Synthetic oligonucleotide; TGG chr2 60466067 60466086 60466070 -
cagaacaaggtatgtggaag

SEQ ID NO: 183618 - DNA, 20 bp, Artificial Sequence
  Synthetic oligonucleotide; GGG chr2 60466066 60466085 60466069 -
agaacaaggtatgtggaagt

SEQ ID NO: 183619 - DNA, 20 bp, Artificial Sequence
  Synthetic oligonucleotide; TGG chr2 60466060 60466079 60466063 -
aggtatgtggaagtgggttg

SEQ ID NO: 183620 - DNA, 20 bp, Artificial Sequence
  Synthetic oligonucleotide; GGG chr2 60466059 60466078 60466062 -
ggtatgtggaagtgggttgt

SEQ ID NO: 183621 - DNA, 20 bp, Artificial Sequence
  Synthetic oligonucleotide; GGG chr2 60466058 60466077 60466061 -
gtatgtggaagtgggttgtg

SEQ ID NO: 183622 - DNA, 20 bp, Artificial Sequence
  Synthetic oligonucleotide; GGG chr2 60466057 60466076 60466060 -
tatgtggaagtgggttgtgg

SEQ ID NO: 183623 - DNA, 20 bp, Artificial Sequence
  Synthetic oligonucleotide; CAG chr2 60466052 60466071 60466055 -
ggaagtgggttgtgggggtc

SEQ ID NO: 183624 - DNA, 20 bp, Artificial Sequence
  Synthetic oligonucleotide; AAG chr2 60466048 60466067 60466051 -
gtgggttgtgggggtccaga

SEQ ID NO: 183625 - DNA, 20 bp, Artificial Sequence
  Synthetic oligonucleotide; TAG chr2 60466042 60466061 60466045 -
tgtgggggtccagaaagctc

SEQ ID NO: 183626 - DNA, 20 bp, Artificial Sequence
  Synthetic oligonucleotide; TGG chr2 60466015 60466034 60466018 -
aacctgatgcccattccact

SEQ ID NO: 183627 - DNA, 20 bp, Artificial Sequence
  Synthetic oligonucleotide; CGG chr2 60466012 60466031 60466015 -
ctgatgcccattccacttgg

SEQ ID NO: 183628 - DNA, 20 bp, Artificial Sequence
  Synthetic oligonucleotide; TGG chr2 60465992 60466011 60465995 -
cggcattaacctgctgcccc

SEQ ID NO: 183629 - DNA, 20 bp, Artificial Sequence
  Synthetic oligonucleotide; CAG chr2 60465985 60466004 60465988 -
aacctgctgcccctggcttc

SEQ ID NO: 183630 - DNA, 20 bp, Artificial Sequence
  Synthetic oligonucleotide; GAG chr2 60465983 60466002 60465986 -
cctgctgcccctggcttcca

SEQ ID NO: 183631 - DNA, 20 bp, Artificial Sequence
  Synthetic oligonucleotide; TAG chr2 60465976 60465995 60465979 -
cccctggcttccagagctca

SEQ ID NO: 183632 - DNA, 20 bp, Artificial Sequence
  Synthetic oligonucleotide; TGG chr2 60465963 60465982 60465966 -
gagctcatagcacttccctg

SEQ ID NO: 183633 - DNA, 20 bp, Artificial Sequence
  Synthetic oligonucleotide; CAG chr2 60465944 60465963 60465947 -
gtggccactctgctgtgtgc

SEQ ID NO: 183634 - DNA, 20 bp, Artificial Sequence
  Synthetic oligonucleotide; TAG chr2 60465923 60465942 60465926 -
agtcacccctgctctttaac

SEQ ID NO: 183635 - DNA, 20 bp, Artificial Sequence
  Synthetic oligonucleotide; GAG chr2 60465921 60465940 60465924 -
tcacccctgctctttaacta

SEQ ID NO: 183636 - DNA, 20 bp, Artificial Sequence
  Synthetic oligonucleotide; TGG chr2 60465910 60465929 60465913 -
ctttaactagagcctccttt

SEQ ID NO: 183637 - DNA, 20 bp, Artificial Sequence
  Synthetic oligonucleotide; TGG chr2 60465905 60465924 60465908 -
actagagcctccttttggcc

SEQ ID NO: 183638 - DNA, 20 bp, Artificial Sequence
  Synthetic oligonucleotide; GGG chr2 60465904 60465923 60465907 -
ctagagcctccttttggcct

SEQ ID NO: 183639 - DNA, 20 bp, Artificial Sequence
  Synthetic oligonucleotide; AAG chr2 60465899 60465918 60465902 -
gcctccttttggcctgggtt

SEQ ID NO: 183640 - DNA, 20 bp, Artificial Sequence
  Synthetic oligonucleotide; AGG chr2 60465898 60465917 60465901 -
cctccttttggcctgggtta

SEQ ID NO: 183641 - DNA, 20 bp, Artificial Sequence
  Synthetic oligonucleotide; TGG chr2 60465893 60465912 60465896 -
ttttggcctgggttaaggcc

SEQ ID NO: 183642 - DNA, 20 bp, Artificial Sequence
  Synthetic oligonucleotide; TGG chr2 60465888 60465907 60465891 -
gcctgggttaaggcctggac

SEQ ID NO: 183643 - DNA, 20 bp, Artificial Sequence
  Synthetic oligonucleotide; GGG chr2 60465887 60465906 60465890 -
cctgggttaaggcctggact

SEQ ID NO: 183644 - DNA, 20 bp, Artificial Sequence
  Synthetic oligonucleotide; TGG chr2 60465875 60465894 60465878 -
cctggactgggaccttcctc

SEQ ID NO: 183645 - DNA, 20 bp, Artificial Sequence
  Synthetic oligonucleotide; AAG chr2 60465872 60465891 60465875 -
ggactgggaccttcctctgg

SEQ ID NO: 183646 - DNA, 20 bp, Artificial Sequence
  Synthetic oligonucleotide; CGG chr2 60465864 60465883 60465867 -
accttcctctggaagccgtt

SEQ ID NO: 183647 - DNA, 20 bp, Artificial Sequence
  Synthetic oligonucleotide; GGG chr2 60465863 60465882 60465866 -
ccttcctctggaagccgttc

SEQ ID NO: 183648 - DNA, 20 bp, Artificial Sequence
  Synthetic oligonucleotide; GGG chr2 60465862 60465881 60465865 -
cttcctctggaagccgttcg

SEQ ID NO: 183649 - DNA, 20 bp, Artificial Sequence
  Synthetic oligonucleotide; TGG chr2 60465850 60465869 60465853 -
gccgttcggggtgtgtaatg

SEQ ID NO: 183650 - DNA, 20 bp, Artificial Sequence
  Synthetic oligonucleotide; TAG chr2 60465846 60465865 60465849 -
ttcggggtgtgtaatgtggt

SEQ ID NO: 183651 - DNA, 20 bp, Artificial Sequence
  Synthetic oligonucleotide; CAG chr2 60465833 60465852 60465836 -
atgtggttagtcattaccct

SEQ ID NO: 183652 - DNA, 20 bp, Artificial Sequence
  Synthetic oligonucleotide; TGG chr2 60465816 60465835 60465819 -
cctcagtaattaatcacccc

SEQ ID NO: 183653 - DNA, 20 bp, Artificial Sequence
  Synthetic oligonucleotide; TAG chr2 60465813 60465832 60465816 -
cagtaattaatcacccctgg

SEQ ID NO: 183654 - DNA, 20 bp, Artificial Sequence
  Synthetic oligonucleotide; TAG chr2 60465779 60465798 60465782 -
cacattcacattcgacctga

SEQ ID NO: 183655 - DNA, 20 bp, Artificial Sequence
  Synthetic oligonucleotide; CAG chr2 60465772 60465791 60465775 -
acattcgacctgatagttta

SEQ ID NO: 183656 - DNA, 20 bp, Artificial Sequence
  Synthetic oligonucleotide; GAG chr2 60465770 60465789 60465773 -
attcgacctgatagtttaca

SEQ ID NO: 183657 - DNA, 20 bp, Artificial Sequence
  Synthetic oligonucleotide; AGG chr2 60465769 60465788 60465772 -
ttcgacctgatagtttacag

SEQ ID NO: 183658 - DNA, 20 bp, Artificial Sequence
  Synthetic oligonucleotide; GGG chr2 60465768 60465787 60465771 -
tcgacctgatagtttacaga

SEQ ID NO: 183659 - DNA, 20 bp, Artificial Sequence
  Synthetic oligonucleotide; CAG chr2 60465723 60465742 60465726 -
gaacttcccaacaattctta

SEQ ID NO: 183660 - DNA, 20 bp, Artificial Sequence
  Synthetic oligonucleotide; AGG chr2 60465722 60465741 60465725 -
aacttcccaacaattcttac

SEQ ID NO: 183661 - DNA, 20 bp, Artificial Sequence
  Synthetic oligonucleotide; CAG chr2 60465697 60465716 60465700 -
ctgtttttatgctcatttta

SEQ ID NO: 183662 - DNA, 20 bp, Artificial Sequence
  Synthetic oligonucleotide; TAG chr2 60465693 60465712 60465696 -
ttttatgctcattttacaga

SEQ ID NO: 183663 - DNA, 20 bp, Artificial Sequence
  Synthetic oligonucleotide; AGG chr2 60465692 60465711 60465695 -
tttatgctcattttacagat

SEQ ID NO: 183664 - DNA, 20 bp, Artificial Sequence
  Synthetic oligonucleotide; AAG chr2 60465683 60465702 60465686 -
attttacagataggaattcc

SEQ ID NO: 183665 - DNA, 20 bp, Artificial Sequence
  Synthetic oligonucleotide; CAG chr2 60465677 60465696 60465680 -
cagataggaattccaagact

SEQ ID NO: 183666 - DNA, 20 bp, Artificial Sequence
  Synthetic oligonucleotide; GAG chr2 60465675 60465694 60465678 -
gataggaattccaagactca

SEQ ID NO: 183667 - DNA, 20 bp, Artificial Sequence
  Synthetic oligonucleotide; CAG chr2 60465655 60465674 60465658 -
gagaaatcaaatgactatcc

SEQ ID NO: 183668 - DNA, 20 bp, Artificial Sequence
  Synthetic oligonucleotide; GAG chr2 60465653 60465672 60465656 -
gaaatcaaatgactatccca

SEQ ID NO: 183669 - DNA, 20 bp, Artificial Sequence
  Synthetic oligonucleotide; TAG chr2 60465642 60465661 60465645 -
actatcccagagttacaatc

SEQ ID NO: 183670 - DNA, 20 bp, Artificial Sequence
  Synthetic oligonucleotide; TGG chr2 60465639 60465658 60465642 -
atcccagagttacaatctag

SEQ ID NO: 183671 - DNA, 20 bp, Artificial Sequence
  Synthetic oligonucleotide; TAG chr2 60465632 60465651 60465635 -
agttacaatctagtggataa

SEQ ID NO: 183672 - DNA, 20 bp, Artificial Sequence
  Synthetic oligonucleotide; GAG chr2 60465630 60465649 60465633 -
ttacaatctagtggataata

SEQ ID NO: 183673 - DNA, 20 bp, Artificial Sequence
  Synthetic oligonucleotide; TAG chr2 60465626 60465645 60465629 -
aatctagtggataatagagc

SEQ ID NO: 183674 - DNA, 20 bp, Artificial Sequence
  Synthetic oligonucleotide; AGG chr2 60465625 60465644 60465628 -
atctagtggataatagagct

SEQ ID NO: 183675 - DNA, 20 bp, Artificial Sequence
  Synthetic oligonucleotide; CAG chr2 60465618 60465637 60465621 -
ggataatagagctaggcctc

SEQ ID NO: 183676 - DNA, 20 bp, Artificial Sequence
  Synthetic oligonucleotide; CAG chr2 60465612 60465631 60465615 -
tagagctaggcctccagtct

SEQ ID NO: 183677 - DNA, 20 bp, Artificial Sequence
  Synthetic oligonucleotide; GAG chr2 60465586 60465605 60465589 -
tccttgttcttctgaatctt

SEQ ID NO: 183678 - DNA, 20 bp, Artificial Sequence
  Synthetic oligonucleotide; AGG chr2 60465585 60465604 60465588 -
ccttgttcttctgaatcttg

SEQ ID NO: 183679 - DNA, 20 bp, Artificial Sequence
  Synthetic oligonucleotide; TAG chr2 60465580 60465599 60465583 -
ttcttctgaatcttgaggct

SEQ ID NO: 183680 - DNA, 20 bp, Artificial Sequence
  Synthetic oligonucleotide; TGG chr2 60465557 60465576 60465560 -
atcacatgactttttcacat

SEQ ID NO: 183681 - DNA, 20 bp, Artificial Sequence
  Synthetic oligonucleotide; TAG chr2 60465546 60465565 60465549 -
ttttcacattggtgacatac

SEQ ID NO: 183682 - DNA, 20 bp, Artificial Sequence
  Synthetic oligonucleotide; TGG chr2 60465540 60465559 60465543 -
cattggtgacatactagaaa

SEQ ID NO: 183683 - DNA, 20 bp, Artificial Sequence
  Synthetic oligonucleotide; GGG chr2 60465539 60465558 60465542 -
attggtgacatactagaaat

SEQ ID NO: 183684 - DNA, 20 bp, Artificial Sequence
  Synthetic oligonucleotide; GGG chr2 60465538 60465557 60465541 -
ttggtgacatactagaaatg

SEQ ID NO: 183685 - DNA, 20 bp, Artificial Sequence
  Synthetic oligonucleotide; GGG chr2 60465537 60465556 60465540 -
tggtgacatactagaaatgg

SEQ ID NO: 183686 - DNA, 20 bp, Artificial Sequence
  Synthetic oligonucleotide; AAG chr2 60465519 60465538 60465522 -
gggggtcattccttcccata

SEQ ID NO: 183687 - DNA, 20 bp, Artificial Sequence
  Synthetic oligonucleotide; AAG chr2 60465498 60465517 60465501 -
agtaaaatgaaataaaataa

SEQ ID NO: 183688 - DNA, 20 bp, Artificial Sequence
  Synthetic oligonucleotide; CAG chr2 60465494 60465513 60465497 -
aaatgaaataaaataaaagc

SEQ ID NO: 183689 - DNA, 20 bp, Artificial Sequence
  Synthetic oligonucleotide; TAG chr2 60465491 60465510 60465494 -
tgaaataaaataaaagccag

SEQ ID NO: 183690 - DNA, 20 bp, Artificial Sequence
  Synthetic oligonucleotide; AGG chr2 60465490 60465509 60465493 -
gaaataaaataaaagccagt

SEQ ID NO: 183691 - DNA, 20 bp, Artificial Sequence
  Synthetic oligonucleotide; TGG chr2 60465487 60465506 60465490 -
ataaaataaaagccagtagg

SEQ ID NO: 183692 - DNA, 20 bp, Artificial Sequence
  Synthetic oligonucleotide; GGG chr2 60465486 60465505 60465489 -
taaaataaaagccagtaggt

SEQ ID NO: 183693 - DNA, 20 bp, Artificial Sequence
  Synthetic oligonucleotide; TAG chr2 60465479 60465498 60465482 -
aaagccagtaggtgggctaa

SEQ ID NO: 183694 - DNA, 20 bp, Artificial Sequence
  Synthetic oligonucleotide; AAG chr2 60465451 60465470 60465454 -
tttaacccttttgatgtctc

SEQ ID NO: 183695 - DNA, 20 bp, Artificial Sequence
  Synthetic oligonucleotide; TAG chr2 60465438 60465457 60465441 -
atgtctcaagttcctatgct

SEQ ID NO: 183696 - DNA, 20 bp, Artificial Sequence
  Synthetic oligonucleotide; AGG chr2 60465437 60465456 60465440 -
tgtctcaagttcctatgctt

SEQ ID NO: 183697 - DNA, 20 bp, Artificial Sequence
  Synthetic oligonucleotide; GGG chr2 60465436 60465455 60465439 -
gtctcaagttcctatgctta

SEQ ID NO: 183698 - DNA, 20 bp, Artificial Sequence
  Synthetic oligonucleotide; GGG chr2 60465435 60465454 60465438 -
tctcaagttcctatgcttag

SEQ ID NO: 183699 - DNA, 20 bp, Artificial Sequence
  Synthetic oligonucleotide; CAG chr2 60465431 60465450 60465434 -
aagttcctatgcttaggggc

SEQ ID NO: 183700 - DNA, 20 bp, Artificial Sequence
  Synthetic oligonucleotide; AGG chr2 60465430 60465449 60465433 -
agttcctatgcttaggggcc

SEQ ID NO: 183701 - DNA, 20 bp, Artificial Sequence
  Synthetic oligonucleotide; CAG chr2 60465424 60465443 60465427 -
tatgcttaggggccaggtgt

SEQ ID NO: 183702 - DNA, 20 bp, Artificial Sequence
  Synthetic oligonucleotide; GAG chr2 60465380 60465399 60465383 -
aatccccgtaaatgcccaat

SEQ ID NO: 183703 - DNA, 20 bp, Artificial Sequence
  Synthetic oligonucleotide; AGG chr2 60465379 60465398 60465382 -
atccccgtaaatgcccaatg

SEQ ID NO: 183704 - DNA, 20 bp, Artificial Sequence
  Synthetic oligonucleotide; GAG chr2 60465366 60465385 60465369 -
cccaatgaggctctcaaatt

SEQ ID NO: 183705 - DNA, 20 bp, Artificial Sequence
  Synthetic oligonucleotide; AAG chr2 60465363 60465382 60465366 -
aatgaggctctcaaattgag

SEQ ID NO: 183706 - DNA, 20 bp, Artificial Sequence
  Synthetic oligonucleotide; CAG chr2 60465349 60465368 60465352 -
attgagaagttgattttcat

SEQ ID NO: 183707 - DNA, 20 bp, Artificial Sequence
  Synthetic oligonucleotide; GAG chr2 60465347 60465366 60465350 -
tgagaagttgattttcatca

SEQ ID NO: 183708 - DNA, 20 bp, Artificial Sequence
  Synthetic oligonucleotide; AAG chr2 60465338 60465357 60465341 -
gattttcatcagagtaaatg

SEQ ID NO: 183709 - DNA, 20 bp, Artificial Sequence
  Synthetic oligonucleotide; TAG chr2 60465300 60465319 60465303 -
tacacatcaataaatcaatg

SEQ ID NO: 183710 - DNA, 20 bp, Artificial Sequence
  Synthetic oligonucleotide; CAG chr2 60465281 60465300 60465284 -
gtagccctaattttgccaca

SEQ ID NO: 183711 - DNA, 20 bp, Artificial Sequence
  Synthetic oligonucleotide; AGG chr2 60465280 60465299 60465283 -
tagccctaattttgccacac

SEQ ID NO: 183712 - DNA, 20 bp, Artificial Sequence
  Synthetic oligonucleotide; CAG chr2 60465267 60465286 60465270 -
gccacacaggaaatcaattc

SEQ ID NO: 183713 - DNA, 20 bp, Artificial Sequence
  Synthetic oligonucleotide; AAG chr2 60465248 60465267 60465251 -
ccagtctttctaaatcatca

SEQ ID NO: 183714 - DNA, 20 bp, Artificial Sequence
  Synthetic oligonucleotide; AAG chr2 60465233 60465252 60465236 -
catcaaagatgttatgaaca

SEQ ID NO: 183715 - DNA, 20 bp, Artificial Sequence
  Synthetic oligonucleotide; TGG chr2 60465215 60465234 60465218 -
caaagtaatttcacaaatta

SEQ ID NO: 183716 - DNA, 20 bp, Artificial Sequence
  Synthetic oligonucleotide; AAG chr2 60465211 60465230 60465214 -
gtaatttcacaaattatggc

SEQ ID NO: 183717 - DNA, 20 bp, Artificial Sequence
  Synthetic oligonucleotide; CAG chr2 60465187 60465206 60465190 -
aacacatttattgatgactg

SEQ ID NO: 183718 - DNA, 20 bp, Artificial Sequence
  Synthetic oligonucleotide; TAG chr2 60465182 60465201 60465185 -
atttattgatgactgcagtt

SEQ ID NO: 183719 - DNA, 20 bp, Artificial Sequence
  Synthetic oligonucleotide; AGG chr2 60465181 60465200 60465184 -
tttattgatgactgcagttt

SEQ ID NO: 183720 - DNA, 20 bp, Artificial Sequence
  Synthetic oligonucleotide; TAG chr2 60465174 60465193 60465177 -
atgactgcagtttaggaatt

SEQ ID NO: 183721 - DNA, 20 bp, Artificial Sequence
  Synthetic oligonucleotide; GAG chr2 60465164 60465183 60465167 -
tttaggaatttagaatctgt

SEQ ID NO: 183722 - DNA, 20 bp, Artificial Sequence
  Synthetic oligonucleotide; TGG chr2 60465146 60465165 60465149 -
gtgagcactgtaatataata

SEQ ID NO: 183723 - DNA, 20 bp, Artificial Sequence
  Synthetic oligonucleotide; CGG chr2 60465138 60465157 60465141 -
tgtaatataatatggtacac

SEQ ID NO: 183724 - DNA, 20 bp, Artificial Sequence
  Synthetic oligonucleotide; GAG chr2 60465132 60465151 60465135 -
ataatatggtacaccggcat

SEQ ID NO: 183725 - DNA, 20 bp, Artificial Sequence
  Synthetic oligonucleotide; GAG chr2 60465127 60465146 60465130 -
atggtacaccggcatgagct

SEQ ID NO: 183726 - DNA, 20 bp, Artificial Sequence
  Synthetic oligonucleotide; CAG chr2 60465117 60465136 60465120 -
ggcatgagctgagtgaaata

SEQ ID NO: 183727 - DNA, 20 bp, Artificial Sequence
  Synthetic oligonucleotide; TGG chr2 60465108 60465127 60465111 -
tgagtgaaatacagattata

SEQ ID NO: 183728 - DNA, 20 bp, Artificial Sequence
  Synthetic oligonucleotide; TAG chr2 60465079 60465098 60465082 -
tgtaatgcatcatttgctat

SEQ ID NO: 183729 - DNA, 20 bp, Artificial Sequence
  Synthetic oligonucleotide; TGG chr2 60465076 60465095 60465079 -
aatgcatcatttgctattag

SEQ ID NO: 183730 - DNA, 20 bp, Artificial Sequence
  Synthetic oligonucleotide; TGG chr2 60465071 60465090 60465074 -
atcatttgctattagtggac

SEQ ID NO: 183731 - DNA, 20 bp, Artificial Sequence
  Synthetic oligonucleotide; CAG chr2 60465058 60465077 60465061 -
agtggactggtaataattac

SEQ ID NO: 183732 - DNA, 20 bp, Artificial Sequence
  Synthetic oligonucleotide; AAG chr2 60465050 60465069 60465053 -
ggtaataattaccagtttca

SEQ ID NO: 183733 - DNA, 20 bp, Artificial Sequence
  Synthetic oligonucleotide; CAG chr2 60465047 60465066 60465050 -
aataattaccagtttcaaag

SEQ ID NO: 183734 - DNA, 20 bp, Artificial Sequence
  Synthetic oligonucleotide; TAG chr2 60465026 60465045 60465029 -
agctctctccatgtaatctt

SEQ ID NO: 183735 - DNA, 20 bp, Artificial Sequence
  Synthetic oligonucleotide; CAG chr2 60465011 60465030 60465014 -
atctttagtctcaatcgtaa

SEQ ID NO: 183736 - DNA, 20 bp, Artificial Sequence
  Synthetic oligonucleotide; TAG chr2 60464981 60465000 60464984 -
cattgacattatgattacac

SEQ ID NO: 183737 - DNA, 20 bp, Artificial Sequence
  Synthetic oligonucleotide; TAG chr2 60464964 60464983 60464967 -
cactagctgccctcatgatc

SEQ ID NO: 183738 - DNA, 20 bp, Artificial Sequence
  Synthetic oligonucleotide; TAG chr2 60464955 60464974 60464958 -
ccctcatgatctagaatatc

SEQ ID NO: 183739 - DNA, 20 bp, Artificial Sequence
  Synthetic oligonucleotide; TGG chr2 60464948 60464967 60464951 -
gatctagaatatctagttga

SEQ ID NO: 183740 - DNA, 20 bp, Artificial Sequence
  Synthetic oligonucleotide; GGG chr2 60464947 60464966 60464950 -
atctagaatatctagttgat

SEQ ID NO: 183741 - DNA, 20 bp, Artificial Sequence
  Synthetic oligonucleotide; TAG chr2 60464929 60464948 60464932 -
atgggaatactaaaatgcga

SEQ ID NO: 183742 - DNA, 20 bp, Artificial Sequence
  Synthetic oligonucleotide; AAG chr2 60464898 60464917 60464901 -
gtatgttgtatgctcattat

SEQ ID NO: 183743 - DNA, 20 bp, Artificial Sequence
  Synthetic oligonucleotide; GAG chr2 60464864 60464883 60464867 -
ttttctctgacctgatgtat

SEQ ID NO: 183744 - DNA, 20 bp, Artificial Sequence
  Synthetic oligonucleotide; GAG chr2 60464862 60464881 60464865 -
ttctctgacctgatgtatga

SEQ ID NO: 183745 - DNA, 20 bp, Artificial Sequence
  Synthetic oligonucleotide; GAG chr2 60464860 60464879 60464863 -
ctctgacctgatgtatgaga

SEQ ID NO: 183746 - DNA, 20 bp, Artificial Sequence
  Synthetic oligonucleotide; GAG chr2 60464858 60464877 60464861 -
ctgacctgatgtatgagaga

SEQ ID NO: 183747 - DNA, 20 bp, Artificial Sequence
  Synthetic oligonucleotide; AGG chr2 60464857 60464876 60464860 -
tgacctgatgtatgagagag

SEQ ID NO: 183748 - DNA, 20 bp, Artificial Sequence
  Synthetic oligonucleotide; GGG chr2 60464856 60464875 60464859 -
gacctgatgtatgagagaga

SEQ ID NO: 183749 - DNA, 20 bp, Artificial Sequence
  Synthetic oligonucleotide; GGG chr2 60464855 60464874 60464858 -
acctgatgtatgagagagag

SEQ ID NO: 183750 - DNA, 20 bp, Artificial Sequence
  Synthetic oligonucleotide; GAG chr2 60464853 60464872 60464856 -
ctgatgtatgagagagaggg

SEQ ID NO: 183751 - DNA, 20 bp, Artificial Sequence
  Synthetic oligonucleotide; AGG chr2 60464852 60464871 60464855 -
tgatgtatgagagagagggg

SEQ ID NO: 183752 - DNA, 20 bp, Artificial Sequence
  Synthetic oligonucleotide; CAG chr2 60464840 60464859 60464843 -
gagaggggaggataacatca

SEQ ID NO: 183753 - DNA, 20 bp, Artificial Sequence
  Synthetic oligonucleotide; TAG chr2 60464824 60464843 60464827 -
atcacagtgttaacatactg

SEQ ID NO: 183754 - DNA, 20 bp, Artificial Sequence
  Synthetic oligonucleotide; TGG chr2 60464807 60464826 60464810 -
ctgtagcatgatcacataac

SEQ ID NO: 183755 - DNA, 20 bp, Artificial Sequence
  Synthetic oligonucleotide; AAG chr2 60464794 60464813 60464797 -
acataactggctctgaaaaa

SEQ ID NO: 183756 - DNA, 20 bp, Artificial Sequence
  Synthetic oligonucleotide; TAG chr2 60464789 60464808 60464792 -
actggctctgaaaaaaagtt

SEQ ID NO: 183757 - DNA, 20 bp, Artificial Sequence
  Synthetic oligonucleotide; AGG chr2 60464788 60464807 60464791 -
ctggctctgaaaaaaagttt

SEQ ID NO: 183758 - DNA, 20 bp, Artificial Sequence
  Synthetic oligonucleotide; CAG chr2 60464780 60464799 60464783 -
gaaaaaaagtttaggatgct

SEQ ID NO: 183759 - DNA, 20 bp, Artificial Sequence
  Synthetic oligonucleotide; AGG chr2 60464779 60464798 60464782 -
aaaaaaagtttaggatgctc

SEQ ID NO: 183760 - DNA, 20 bp, Artificial Sequence
  Synthetic oligonucleotide; GGG chr2 60464778 60464797 60464781 -
aaaaaagtttaggatgctca

SEQ ID NO: 183761 - DNA, 20 bp, Artificial Sequence
  Synthetic oligonucleotide; CAG chr2 60464775 60464794 60464778 -
aaagtttaggatgctcaggg

SEQ ID NO: 183762 - DNA, 20 bp, Artificial Sequence
  Synthetic oligonucleotide; TGG chr2 60464762 60464781 60464765 -
ctcagggcagcaaaataaaa

SEQ ID NO: 183763 - DNA, 20 bp, Artificial Sequence
  Synthetic oligonucleotide; AAG chr2 60464746 60464765 60464749 -
aaaatggacttttctcattt

SEQ ID NO: 183764 - DNA, 20 bp, Artificial Sequence
  Synthetic oligonucleotide; AAG chr2 60464734 60464753 60464737 -
tctcatttaagcctttttga

SEQ ID NO: 183765 - DNA, 20 bp, Artificial Sequence
  Synthetic oligonucleotide; AGG chr2 60464733 60464752 60464736 -
ctcatttaagcctttttgaa

SEQ ID NO: 183766 - DNA, 20 bp, Artificial Sequence
  Synthetic oligonucleotide; GAG chr2 60464722 60464741 60464725 -
ctttttgaaaggatacaaat

SEQ ID NO: 183767 - DNA, 20 bp, Artificial Sequence
  Synthetic oligonucleotide; TAG chr2 60464709 60464728 60464712 -
tacaaatgagatccttgatg

SEQ ID NO: 183768 - DNA, 20 bp, Artificial Sequence
  Synthetic oligonucleotide; CAG chr2 60464694 60464713 60464697 -
tgatgtagtgctgtatgcca

SEQ ID NO: 183769 - DNA, 20 bp, Artificial Sequence
  Synthetic oligonucleotide; TGG chr2 60464687 60464706 60464690 -
gtgctgtatgccacagattt

SEQ ID NO: 183770 - DNA, 20 bp, Artificial Sequence
  Synthetic oligonucleotide; TGG chr2 60464661 60464680 60464664 -
ttatcaatgactacaattca

SEQ ID NO: 183771 - DNA, 20 bp, Artificial Sequence
  Synthetic oligonucleotide; CAG chr2 60464646 60464665 60464649 -
attcatggcacatgtgaaac

SEQ ID NO: 183772 - DNA, 20 bp, Artificial Sequence
  Synthetic oligonucleotide; GAG chr2 60464630 60464649 60464633 -
aaaccagcaccactaattat

SEQ ID NO: 183773 - DNA, 20 bp, Artificial Sequence
  Synthetic oligonucleotide; TAG chr2 60464625 60464644 60464628 -
agcaccactaattatgagtc

SEQ ID NO: 183774 - DNA, 20 bp, Artificial Sequence
  Synthetic oligonucleotide; TGG chr2 60464619 60464638 60464622 -
actaattatgagtctagtcc

SEQ ID NO: 183775 - DNA, 20 bp, Artificial Sequence
  Synthetic oligonucleotide; AAG chr2 60464597 60464616 60464600 -
gatttcaatcgatgttttat

SEQ ID NO: 183776 - DNA, 20 bp, Artificial Sequence
  Synthetic oligonucleotide; AGG chr2 60464596 60464615 60464599 -
atttcaatcgatgttttata

SEQ ID NO: 183777 - DNA, 20 bp, Artificial Sequence
  Synthetic oligonucleotide; AAG chr2 60464579 60464598 60464582 -
ataaggtaaaatataatttt

SEQ ID NO: 183778 - DNA, 20 bp, Artificial Sequence
  Synthetic oligonucleotide; AGG chr2 60464578 60464597 60464581 -
taaggtaaaatataatttta

SEQ ID NO: 183779 - DNA, 20 bp, Artificial Sequence
  Synthetic oligonucleotide; TGG chr2 60464571 60464590 60464574 -
aaatataattttaaggcatt

SEQ ID NO: 183780 - DNA, 20 bp, Artificial Sequence
  Synthetic oligonucleotide; GAG chr2 60464569 60464588 60464572 -
atataattttaaggcatttg

SEQ ID NO: 183781 - DNA, 20 bp, Artificial Sequence
  Synthetic oligonucleotide; AAG chr2 60464553 60464572 60464556 -
tttggagtgatgaacgtgtt

SEQ ID NO: 183782 - DNA, 20 bp, Artificial Sequence
  Synthetic oligonucleotide; AGG chr2 60464552 60464571 60464555 -
ttggagtgatgaacgtgtta

SEQ ID NO: 183783 - DNA, 20 bp, Artificial Sequence
  Synthetic oligonucleotide; TGG chr2 60464546 60464565 60464549 -
tgatgaacgtgttaaggact

SEQ ID NO: 183784 - DNA, 20 bp, Artificial Sequence
  Synthetic oligonucleotide; CAG chr2 60464538 60464557 60464541 -
gtgttaaggacttggattat

SEQ ID NO: 183785 - DNA, 20 bp, Artificial Sequence
  Synthetic oligonucleotide; CAG chr2 60464511 60464530 60464514 -
atctttttacttgcccaact

SEQ ID NO: 183786 - DNA, 20 bp, Artificial Sequence
  Synthetic oligonucleotide; CAG chr2 60464503 60464522 60464506 -
acttgcccaactcagatcgt

SEQ ID NO: 183787 - DNA, 20 bp, Artificial Sequence
  Synthetic oligonucleotide; AGG chr2 60464502 60464521 60464505 -
cttgcccaactcagatcgtc

SEQ ID NO: 183788 - DNA, 20 bp, Artificial Sequence
  Synthetic oligonucleotide; TAG chr2 60464494 60464513 60464497 -
actcagatcgtcaggctaaa

SEQ ID NO: 183789 - DNA, 20 bp, Artificial Sequence
  Synthetic oligonucleotide; AGG chr2 60464493 60464512 60464496 -
ctcagatcgtcaggctaaat

SEQ ID NO: 183790 - DNA, 20 bp, Artificial Sequence
  Synthetic oligonucleotide; TAG chr2 60464485 60464504 60464488 -
gtcaggctaaataggaatga

SEQ ID NO: 183791 - DNA, 20 bp, Artificial Sequence
  Synthetic oligonucleotide; CAG chr2 60464477 60464496 60464480 -
aaataggaatgatagtcacc

SEQ ID NO: 183792 - DNA, 20 bp, Artificial Sequence
  Synthetic oligonucleotide; GAG chr2 60464475 60464494 60464478 -
ataggaatgatagtcaccca

SEQ ID NO: 183793 - DNA, 20 bp, Artificial Sequence
  Synthetic oligonucleotide; TAG chr2 60464469 60464488 60464472 -
atgatagtcacccagagatc

SEQ ID NO: 183794 - DNA, 20 bp, Artificial Sequence
  Synthetic oligonucleotide; AGG chr2 60464468 60464487 60464471 -
tgatagtcacccagagatct

SEQ ID NO: 183795 - DNA, 20 bp, Artificial Sequence
  Synthetic oligonucleotide; GGG chr2 60464467 60464486 60464470 -
gatagtcacccagagatcta

SEQ ID NO: 183796 - DNA, 20 bp, Artificial Sequence
  Synthetic oligonucleotide; GAG chr2 60464465 60464484 60464468 -
tagtcacccagagatctagg

SEQ ID NO: 183797 - DNA, 20 bp, Artificial Sequence
  Synthetic oligonucleotide; AGG chr2 60464464 60464483 60464467 -
agtcacccagagatctaggg

SEQ ID NO: 183798 - DNA, 20 bp, Artificial Sequence
  Synthetic oligonucleotide; AAG chr2 60464459 60464478 60464462 -
cccagagatctagggaggac

SEQ ID NO: 183799 - DNA, 20 bp, Artificial Sequence
  Synthetic oligonucleotide; AGG chr2 60464458 60464477 60464461 -
ccagagatctagggaggaca

SEQ ID NO: 183800 - DNA, 20 bp, Artificial Sequence
  Synthetic oligonucleotide; GAG chr2 60464456 60464475 60464459 -
agagatctagggaggacaag

SEQ ID NO: 183801 - DNA, 20 bp, Artificial Sequence
  Synthetic oligonucleotide; AGG chr2 60464455 60464474 60464458 -
gagatctagggaggacaagg

SEQ ID NO: 183802 - DNA, 20 bp, Artificial Sequence
  Synthetic oligonucleotide; AAG chr2 60464452 60464471 60464455 -
atctagggaggacaaggagg

SEQ ID NO: 183803 - DNA, 20 bp, Artificial Sequence
  Synthetic oligonucleotide; CAG chr2 60464446 60464465 60464449 -
ggaggacaaggaggaagcca

SEQ ID NO: 183804 - DNA, 20 bp, Artificial Sequence
  Synthetic oligonucleotide; GAG chr2 60464444 60464463 60464447 -
aggacaaggaggaagccaca

SEQ ID NO: 183805 - DNA, 20 bp, Artificial Sequence
  Synthetic oligonucleotide; AGG chr2 60464443 60464462 60464446 -
ggacaaggaggaagccacag

SEQ ID NO: 183806 - DNA, 20 bp, Artificial Sequence
  Synthetic oligonucleotide; TAG chr2 60464434 60464453 60464437 -
ggaagccacagaggatcatg

SEQ ID NO: 183807 - DNA, 20 bp, Artificial Sequence
  Synthetic oligonucleotide; TGG chr2 60464430 60464449 60464433 -
gccacagaggatcatgtagt

SEQ ID NO: 183808 - DNA, 20 bp, Artificial Sequence
  Synthetic oligonucleotide; CAG chr2 60464424 60464443 60464427 -
gaggatcatgtagttggaac

SEQ ID NO: 183809 - DNA, 20 bp, Artificial Sequence
  Synthetic oligonucleotide; TAG chr2 60464420 60464439 60464423 -
atcatgtagttggaaccaga

SEQ ID NO: 183810 - DNA, 20 bp, Artificial Sequence
  Synthetic oligonucleotide; CAG chr2 60464408 60464427 60464411 -
gaaccagatagttttttttc

SEQ ID NO: 183811 - DNA, 20 bp, Artificial Sequence
  Synthetic oligonucleotide; TGG chr2 60464399 60464418 60464402 -
agttttttttccagcctatt

SEQ ID NO: 183812 - DNA, 20 bp, Artificial Sequence
  Synthetic oligonucleotide; GGG chr2 60464398 60464417 60464401 -
gttttttttccagcctattt

SEQ ID NO: 183813 - DNA, 20 bp, Artificial Sequence
  Synthetic oligonucleotide; AAG chr2 60464391 60464410 60464394 -
ttccagcctatttgggaccc

SEQ ID NO: 183814 - DNA, 20 bp, Artificial Sequence
  Synthetic oligonucleotide; AAG chr2 60464343 60464362 60464346 -
ttataaaaatgttctcaatg

SEQ ID NO: 183815 - DNA, 20 bp, Artificial Sequence
  Synthetic oligonucleotide; AAG chr2 60464323 60464342 60464326 -
aagctttttatttccctttg

SEQ ID NO: 183816 - DNA, 20 bp, Artificial Sequence
  Synthetic oligonucleotide; GAG chr2 60464321 60464340 60464324 -
gctttttatttccctttgaa

SEQ ID NO: 183817 - DNA, 20 bp, Artificial Sequence
  Synthetic oligonucleotide; GAG chr2 60464319 60464338 60464322 -
tttttatttccctttgaaga

SEQ ID NO: 183818 - DNA, 20 bp, Artificial Sequence
  Synthetic oligonucleotide; AGG chr2 60464318 60464337 60464321 -
ttttatttccctttgaagag

SEQ ID NO: 183819 - DNA, 20 bp, Artificial Sequence
  Synthetic oligonucleotide; GAG chr2 60464316 60464335 60464319 -
ttatttccctttgaagagag

SEQ ID NO: 183820 - DNA, 20 bp, Artificial Sequence
  Synthetic oligonucleotide; AGG chr2 60464315 60464334 60464318 -
tatttccctttgaagagagg

SEQ ID NO: 183821 - DNA, 20 bp, Artificial Sequence
  Synthetic oligonucleotide; TAG chr2 60464302 60464321 60464305 -
agagaggaggcaaacaaaaa

SEQ ID NO: 183822 - DNA, 20 bp, Artificial Sequence
  Synthetic oligonucleotide; AGG chr2 60464301 60464320 60464304 -
gagaggaggcaaacaaaaat

SEQ ID NO: 183823 - DNA, 20 bp, Artificial Sequence
  Synthetic oligonucleotide; CAG chr2 60464298 60464317 60464301 -
aggaggcaaacaaaaatagg

SEQ ID NO: 183824 - DNA, 20 bp, Artificial Sequence
  Synthetic oligonucleotide; CAG chr2 60464277 60464296 60464280 -
agataatgtgatactaatgt

SEQ ID NO: 183825 - DNA, 20 bp, Artificial Sequence
  Synthetic oligonucleotide; TAG chr2 60464230 60464249 60464233 -
cttttttcccccttccacat

SEQ ID NO: 183826 - DNA, 20 bp, Artificial Sequence
  Synthetic oligonucleotide; TGG chr2 60464205 60464224 60464208 -
aaatgtttgaaacctaattt

SEQ ID NO: 183827 - DNA, 20 bp, Artificial Sequence
  Synthetic oligonucleotide; AAG chr2 60464179 60464198 60464182 -
cttaccatctaatcttgttt

SEQ ID NO: 183828 - DNA, 20 bp, Artificial Sequence
  Synthetic oligonucleotide; GAG chr2 60464177 60464196 60464180 -
taccatctaatcttgtttaa

SEQ ID NO: 183829 - DNA, 20 bp, Artificial Sequence
  Synthetic oligonucleotide; CAG chr2 60464167 60464186 60464170 -
tcttgtttaagagatttacc

SEQ ID NO: 183830 - DNA, 20 bp, Artificial Sequence
  Synthetic oligonucleotide; AGG chr2 60464166 60464185 60464169 -
cttgtttaagagatttaccc

SEQ ID NO: 183831 - DNA, 20 bp, Artificial Sequence
  Synthetic oligonucleotide; GAG chr2 60464164 60464183 60464167 -
tgtttaagagatttacccag

SEQ ID NO: 183832 - DNA, 20 bp, Artificial Sequence
  Synthetic oligonucleotide; GAG chr2 60464160 60464179 60464163 -
taagagatttacccaggagt

SEQ ID NO: 183833 - DNA, 20 bp, Artificial Sequence
  Synthetic oligonucleotide; GAG chr2 60464150 60464169 60464153 -
acccaggagtgagatatatt

SEQ ID NO: 183834 - DNA, 20 bp, Artificial Sequence
  Synthetic oligonucleotide; TGG chr2 60464147 60464166 60464150 -
caggagtgagatatattgag

SEQ ID NO: 183835 - DNA, 20 bp, Artificial Sequence
  Synthetic oligonucleotide; GGG chr2 60464146 60464165 60464149 -
aggagtgagatatattgagt

SEQ ID NO: 183836 - DNA, 20 bp, Artificial Sequence
  Synthetic oligonucleotide; AAG chr2 60464126 60464145 60464129 -
gggattataaatgcgttgta

SEQ ID NO: 183837 - DNA, 20 bp, Artificial Sequence
  Synthetic oligonucleotide; AAG chr2 60464115 60464134 60464118 -
tgcgttgtaaagtaaattac

SEQ ID NO: 183838 - DNA, 20 bp, Artificial Sequence
  Synthetic oligonucleotide; AGG chr2 60464114 60464133 60464117 -
gcgttgtaaagtaaattaca

SEQ ID NO: 183839 - DNA, 20 bp, Artificial Sequence
  Synthetic oligonucleotide; CAG chr2 60464110 60464129 60464113 -
tgtaaagtaaattacaaggt

SEQ ID NO: 183840 - DNA, 20 bp, Artificial Sequence
  Synthetic oligonucleotide; AGG chr2 60464109 60464128 60464112 -
gtaaagtaaattacaaggtc

SEQ ID NO: 183841 - DNA, 20 bp, Artificial Sequence
  Synthetic oligonucleotide; GGG chr2 60464108 60464127 60464111 -
taaagtaaattacaaggtca

SEQ ID NO: 183842 - DNA, 20 bp, Artificial Sequence
  Synthetic oligonucleotide; CAG chr2 60464105 60464124 60464108 -
agtaaattacaaggtcaggg

SEQ ID NO: 183843 - DNA, 20 bp, Artificial Sequence
  Synthetic oligonucleotide; AGG chr2 60464104 60464123 60464107 -
gtaaattacaaggtcagggc

SEQ ID NO: 183844 - DNA, 20 bp, Artificial Sequence
  Synthetic oligonucleotide; GAG chr2 60464102 60464121 60464105 -
aaattacaaggtcagggcag

SEQ ID NO: 183845 - DNA, 20 bp, Artificial Sequence
  Synthetic oligonucleotide; TAG chr2 60464090 60464109 60464093 -
cagggcaggagtccattatt

SEQ ID NO: 183846 - DNA, 20 bp, Artificial Sequence
  Synthetic oligonucleotide; AAG chr2 60464085 60464104 60464088 -
caggagtccattatttagac

SEQ ID NO: 183847 - DNA, 20 bp, Artificial Sequence
  Synthetic oligonucleotide; GAG chr2 60464077 60464096 60464080 -
cattatttagacaagtgctt

SEQ ID NO: 183848 - DNA, 20 bp, Artificial Sequence
  Synthetic oligonucleotide; GAG chr2 60464073 60464092 60464076 -
atttagacaagtgcttgagc

SEQ ID NO: 183849 - DNA, 20 bp, Artificial Sequence
  Synthetic oligonucleotide; AGG chr2 60464072 60464091 60464075 -
tttagacaagtgcttgagcg

SEQ ID NO: 183850 - DNA, 20 bp, Artificial Sequence
  Synthetic oligonucleotide; TGG chr2 60464068 60464087 60464071 -
gacaagtgcttgagcgaggc

SEQ ID NO: 183851 - DNA, 20 bp, Artificial Sequence
  Synthetic oligonucleotide; TGG chr2 60464058 60464077 60464061 -
tgagcgaggctggcttattt

SEQ ID NO: 183852 - DNA, 20 bp, Artificial Sequence
  Synthetic oligonucleotide; CAG chr2 60464050 60464069 60464053 -
gctggcttattttggaatac

SEQ ID NO: 183853 - DNA, 20 bp, Artificial Sequence
  Synthetic oligonucleotide; TGG chr2 60464043 60464062 60464046 -
tattttggaataccagtgtt

SEQ ID NO: 183854 - DNA, 20 bp, Artificial Sequence
  Synthetic oligonucleotide; GGG chr2 60464042 60464061 60464045 -
attttggaataccagtgttt

SEQ ID NO: 183855 - DNA, 20 bp, Artificial Sequence
  Synthetic oligonucleotide; GGG chr2 60464041 60464060 60464044 -
ttttggaataccagtgtttg

SEQ ID NO: 183856 - DNA, 20 bp, Artificial Sequence
  Synthetic oligonucleotide; GGG chr2 60464040 60464059 60464043 -
tttggaataccagtgtttgg

SEQ ID NO: 183857 - DNA, 20 bp, Artificial Sequence
  Synthetic oligonucleotide; GAG chr2 60464032 60464051 60464035 -
accagtgtttgggggctcct

SEQ ID NO: 183858 - DNA, 20 bp, Artificial Sequence
  Synthetic oligonucleotide; AAG chr2 60464029 60464048 60464032 -
agtgtttgggggctcctgag

SEQ ID NO: 183859 - DNA, 20 bp, Artificial Sequence
  Synthetic oligonucleotide; CGG chr2 60464019 60464038 60464022 -
ggctcctgagaagaccctgc

SEQ ID NO: 183860 - DNA, 20 bp, Artificial Sequence
  Synthetic oligonucleotide; TGG chr2 60463994 60464013 60463997 -
tttctttctgacttgctaaa

SEQ ID NO: 183861 - DNA, 20 bp, Artificial Sequence
  Synthetic oligonucleotide; GAG chr2 60463992 60464011 60463995 -
tctttctgacttgctaaatg

SEQ ID NO: 183862 - DNA, 20 bp, Artificial Sequence
  Synthetic oligonucleotide; AGG chr2 60463991 60464010 60463994 -
ctttctgacttgctaaatgg

SEQ ID NO: 183863 - DNA, 20 bp, Artificial Sequence
  Synthetic oligonucleotide; TGG chr2 60463944 60463963 60463947 -
attctcactcttaacctccc

SEQ ID NO: 183864 - DNA, 20 bp, Artificial Sequence
  Synthetic oligonucleotide; TAG chr2 60463941 60463960 60463944 -
ctcactcttaacctccctgg

SEQ ID NO: 183865 - DNA, 20 bp, Artificial Sequence
  Synthetic oligonucleotide; TAG chr2 60463917 60463936 60463920 -
ttttttttttttttccttct

SEQ ID NO: 183866 - DNA, 20 bp, Artificial Sequence
  Synthetic oligonucleotide; AAG chr2 60463913 60463932 60463916 -
ttttttttttccttcttaga

SEQ ID NO: 183867 - DNA, 20 bp, Artificial Sequence
  Synthetic oligonucleotide; TAG chr2 60463896 60463915 60463899 -
agaaagttactgacaaatac

SEQ ID NO: 183868 - DNA, 20 bp, Artificial Sequence
  Synthetic oligonucleotide; TGG chr2 60463890 60463909 60463893 -
ttactgacaaatactagctg

SEQ ID NO: 183869 - DNA, 20 bp, Artificial Sequence
  Synthetic oligonucleotide; AAG chr2 60463882 60463901 60463885 -
aaatactagctgtggcctta

SEQ ID NO: 183870 - DNA, 20 bp, Artificial Sequence
  Synthetic oligonucleotide; CAG chr2 60463871 60463890 60463874 -
gtggccttaaagaactcttg

SEQ ID NO: 183871 - DNA, 20 bp, Artificial Sequence
  Synthetic oligonucleotide; AAG chr2 60463856 60463875 60463859 -
tcttgcagcccttcttttaa

SEQ ID NO: 183872 - DNA, 20 bp, Artificial Sequence
  Synthetic oligonucleotide; AAG chr2 60463853 60463872 60463856 -
tgcagcccttcttttaaaag

SEQ ID NO: 183873 - DNA, 20 bp, Artificial Sequence
  Synthetic oligonucleotide; AGG chr2 60463852 60463871 60463855 -
gcagcccttcttttaaaaga

SEQ ID NO: 183874 - DNA, 20 bp, Artificial Sequence
  Synthetic oligonucleotide; GAG chr2 60463850 60463869 60463853 -
agcccttcttttaaaagaag

SEQ ID NO: 183875 - DNA, 20 bp, Artificial Sequence
  Synthetic oligonucleotide; AAG chr2 60463845 60463864 60463848 -
ttcttttaaaagaaggagaa

SEQ ID NO: 183876 - DNA, 20 bp, Artificial Sequence
  Synthetic oligonucleotide; CAG chr2 60463830 60463849 60463833 -
gagaaaagtttgttatttct

SEQ ID NO: 183877 - DNA, 20 bp, Artificial Sequence
  Synthetic oligonucleotide; AAG chr2 60463818 60463837 60463821 -
ttatttctcagttatatttt

SEQ ID NO: 183878 - DNA, 20 bp, Artificial Sequence
  Synthetic oligonucleotide; AGG chr2 60463817 60463836 60463820 -
tatttctcagttatatttta

SEQ ID NO: 183879 - DNA, 20 bp, Artificial Sequence
  Synthetic oligonucleotide; CAG chr2 60463804 60463823 60463807 -
tattttaaggcttttttttt

SEQ ID NO: 183880 - DNA, 20 bp, Artificial Sequence
  Synthetic oligonucleotide; TGG chr2 60463795 60463814 60463798 -
gctttttttttcagaatctc

SEQ ID NO: 183881 - DNA, 20 bp, Artificial Sequence
  Synthetic oligonucleotide; GGG chr2 60463794 60463813 60463797 -
ctttttttttcagaatctct

SEQ ID NO: 183882 - DNA, 20 bp, Artificial Sequence
  Synthetic oligonucleotide; AAG chr2 60463791 60463810 60463794 -
tttttttcagaatctctggg

SEQ ID NO: 183883 - DNA, 20 bp, Artificial Sequence
  Synthetic oligonucleotide; TGG chr2 60463763 60463782 60463766 -
tttttctcatcctcgtcctt

SEQ ID NO: 183884 - DNA, 20 bp, Artificial Sequence
  Synthetic oligonucleotide; CAG chr2 60463730 60463749 60463733 -
ttctgccctttttaatgttg

SEQ ID NO: 183885 - DNA, 20 bp, Artificial Sequence
  Synthetic oligonucleotide; TAG chr2 60463722 60463741 60463725 -
tttttaatgttgcagttgac

SEQ ID NO: 183886 - DNA, 20 bp, Artificial Sequence
  Synthetic oligonucleotide; TGG chr2 60463711 60463730 60463714 -
gcagttgactagtaaactgt

SEQ ID NO: 183887 - DNA, 20 bp, Artificial Sequence
  Synthetic oligonucleotide; CAG chr2 60463707 60463726 60463710 -
ttgactagtaaactgttggt

SEQ ID NO: 183888 - DNA, 20 bp, Artificial Sequence
  Synthetic oligonucleotide; TAG chr2 60463677 60463696 60463680 -
atatatatatatatttaatg

SEQ ID NO: 183889 - DNA, 20 bp, Artificial Sequence
  Synthetic oligonucleotide; TAG chr2 60463650 60463669 60463653 -
ctccccatatatatttaatt

SEQ ID NO: 183890 - DNA, 20 bp, Artificial Sequence
  Synthetic oligonucleotide; AAG chr2 60463620 60463639 60463623 -
cccaaatgaaatattttgtg

SEQ ID NO: 183891 - DNA, 20 bp, Artificial Sequence
  Synthetic oligonucleotide; AAG chr2 60463615 60463634 60463618 -
atgaaatattttgtgaagtc

SEQ ID NO: 183892 - DNA, 20 bp, Artificial Sequence
  Synthetic oligonucleotide; TGG chr2 60463611 60463630 60463614 -
aatattttgtgaagtcaagc

SEQ ID NO: 183893 - DNA, 20 bp, Artificial Sequence
  Synthetic oligonucleotide; AAG chr2 60463595 60463614 60463598 -
aagctggcccttctttgcca

SEQ ID NO: 183894 - DNA, 20 bp, Artificial Sequence
  Synthetic oligonucleotide; TGG chr2 60463592 60463611 60463595 -
ctggcccttctttgccaaag

SEQ ID NO: 183895 - DNA, 20 bp, Artificial Sequence
  Synthetic oligonucleotide; TGG chr2 60463576 60463595 60463579 -
aaagtggcatttaccactct

SEQ ID NO: 183896 - DNA, 20 bp, Artificial Sequence
  Synthetic oligonucleotide; GGG chr2 60463575 60463594 60463578 -
aagtggcatttaccactctt

SEQ ID NO: 183897 - DNA, 20 bp, Artificial Sequence
  Synthetic oligonucleotide; CAG chr2 60463565 60463584 60463568 -
taccactcttgggttctttt

SEQ ID NO: 183898 - DNA, 20 bp, Artificial Sequence
  Synthetic oligonucleotide; AAG chr2 60463561 60463580 60463564 -
actcttgggttcttttcagc

SEQ ID NO: 183899 - DNA, 20 bp, Artificial Sequence
  Synthetic oligonucleotide; AGG chr2 60463560 60463579 60463563 -
ctcttgggttcttttcagca

SEQ ID NO: 183900 - DNA, 20 bp, Artificial Sequence
  Synthetic oligonucleotide; GGG chr2 60463559 60463578 60463562 -
tcttgggttcttttcagcaa

SEQ ID NO: 183901 - DNA, 20 bp, Artificial Sequence
  Synthetic oligonucleotide; AAG chr2 60463542 60463561 60463545 -
caagggaaataatgtgactt

SEQ ID NO: 183902 - DNA, 20 bp, Artificial Sequence
  Synthetic oligonucleotide; CAG chr2 60463539 60463558 60463542 -
gggaaataatgtgacttaag

SEQ ID NO: 183903 - DNA, 20 bp, Artificial Sequence
  Synthetic oligonucleotide; AGG chr2 60463538 60463557 60463541 -
ggaaataatgtgacttaagc

SEQ ID NO: 183904 - DNA, 20 bp, Artificial Sequence
  Synthetic oligonucleotide; GGG chr2 60463537 60463556 60463540 -
gaaataatgtgacttaagca

SEQ ID NO: 183905 - DNA, 20 bp, Artificial Sequence
  Synthetic oligonucleotide; CAG chr2 60463526 60463545 60463529 -
acttaagcagggcccctctc

SEQ ID NO: 183906 - DNA, 20 bp, Artificial Sequence
  Synthetic oligonucleotide; CGG chr2 60463522 60463541 60463525 -
aagcagggcccctctccaga

SEQ ID NO: 183907 - DNA, 20 bp, Artificial Sequence
  Synthetic oligonucleotide; TGG chr2 60463517 60463536 60463520 -
gggcccctctccagacggct

SEQ ID NO: 183908 - DNA, 20 bp, Artificial Sequence
  Synthetic oligonucleotide; TGG chr2 60463510 60463529 60463513 -
tctccagacggcttggctac

SEQ ID NO: 183909 - DNA, 20 bp, Artificial Sequence
  Synthetic oligonucleotide; CAG chr2 60463506 60463525 60463509 -
cagacggcttggctactggc

SEQ ID NO: 183910 - DNA, 20 bp, Artificial Sequence
  Synthetic oligonucleotide; GAG chr2 60463504 60463523 60463507 -
gacggcttggctactggcca

SEQ ID NO: 183911 - DNA, 20 bp, Artificial Sequence
  Synthetic oligonucleotide; TAG chr2 60463496 60463515 60463499 -
ggctactggccagagttgac

SEQ ID NO: 183912 - DNA, 20 bp, Artificial Sequence
  Synthetic oligonucleotide; TGG chr2 60463462 60463481 60463465 -
ctttctgtttctttctcaac

SEQ ID NO: 183913 - DNA, 20 bp, Artificial Sequence
  Synthetic oligonucleotide; GAG chr2 60463460 60463479 60463463 -
ttctgtttctttctcaactg

SEQ ID NO: 183914 - DNA, 20 bp, Artificial Sequence
  Synthetic oligonucleotide; GAG chr2 60463455 60463474 60463458 -
tttctttctcaactggagct

SEQ ID NO: 183915 - DNA, 20 bp, Artificial Sequence
  Synthetic oligonucleotide; CAG chr2 60463449 60463468 60463452 -
tctcaactggagctgagtcc

SEQ ID NO: 183916 - DNA, 20 bp, Artificial Sequence
  Synthetic oligonucleotide; GAG chr2 60463444 60463463 60463447 -
actggagctgagtcccagcc

SEQ ID NO: 183917 - DNA, 20 bp, Artificial Sequence
  Synthetic oligonucleotide; AGG chr2 60463443 60463462 60463446 -
ctggagctgagtcccagccg

SEQ ID NO: 183918 - DNA, 20 bp, Artificial Sequence
  Synthetic oligonucleotide; GGG chr2 60463442 60463461 60463445 -
tggagctgagtcccagccga

SEQ ID NO: 183919 - DNA, 20 bp, Artificial Sequence
  Synthetic oligonucleotide; CAG chr2 60463437 60463456 60463440 -
ctgagtcccagccgagggcg

SEQ ID NO: 183920 - DNA, 20 bp, Artificial Sequence
  Synthetic oligonucleotide; AGG chr2 60463436 60463455 60463439 -
tgagtcccagccgagggcgc

SEQ ID NO: 183921 - DNA, 20 bp, Artificial Sequence
  Synthetic oligonucleotide; TGG chr2 60463420 60463439 60463423 -
gcgcaggatgttgtataatt

SEQ ID NO: 183922 - DNA, 20 bp, Artificial Sequence
  Synthetic oligonucleotide; TAG chr2 60463407 60463426 60463410 -
tataatttggttcacgttgt

SEQ ID NO: 183923 - DNA, 20 bp, Artificial Sequence
  Synthetic oligonucleotide; GAG chr2 60463390 60463409 60463393 -
tgttagcctctcaaaacaat

SEQ ID NO: 183924 - DNA, 20 bp, Artificial Sequence
  Synthetic oligonucleotide; AGG chr2 60463389 60463408 60463392 -
gttagcctctcaaaacaatg

SEQ ID NO: 183925 - DNA, 20 bp, Artificial Sequence
  Synthetic oligonucleotide; GAG chr2 60463387 60463406 60463390 -
tagcctctcaaaacaatgag

SEQ ID NO: 183926 - DNA, 20 bp, Artificial Sequence
  Synthetic oligonucleotide; AGG chr2 60463386 60463405 60463389 -
agcctctcaaaacaatgagg

SEQ ID NO: 183927 - DNA, 20 bp, Artificial Sequence
  Synthetic oligonucleotide; GAG chr2 60463384 60463403 60463387 -
cctctcaaaacaatgaggag

SEQ ID NO: 183928 - DNA, 20 bp, Artificial Sequence
  Synthetic oligonucleotide; AGG chr2 60463383 60463402 60463386 -
ctctcaaaacaatgaggagg

SEQ ID NO: 183929 - DNA, 20 bp, Artificial Sequence
  Synthetic oligonucleotide; TAG chr2 60463379 60463398 60463382 -
caaaacaatgaggaggagga

SEQ ID NO: 183930 - DNA, 20 bp, Artificial Sequence
  Synthetic oligonucleotide; TAG chr2 60463374 60463393 60463377 -
caatgaggaggaggatagtg

SEQ ID NO: 183931 - DNA, 20 bp, Artificial Sequence
  Synthetic oligonucleotide; CAG chr2 60463364 60463383 60463367 -
gaggatagtgtagcatttct

SEQ ID NO: 183932 - DNA, 20 bp, Artificial Sequence
  Synthetic oligonucleotide; TGG chr2 60463347 60463366 60463350 -
tctcagcctgctgcctgtca

SEQ ID NO: 183933 - DNA, 20 bp, Artificial Sequence
  Synthetic oligonucleotide; TGG chr2 60463341 60463360 60463344 -
cctgctgcctgtcatggcgc

SEQ ID NO: 183934 - DNA, 20 bp, Artificial Sequence
  Synthetic oligonucleotide; TAG chr2 60463316 60463335 60463319 -
gttttaactgttccttaaac

SEQ ID NO: 183935 - DNA, 20 bp, Artificial Sequence
  Synthetic oligonucleotide; AGG chr2 60463315 60463334 60463318 -
ttttaactgttccttaaact

SEQ ID NO: 183936 - DNA, 20 bp, Artificial Sequence
  Synthetic oligonucleotide; AAG chr2 60463297 60463316 60463300 -
ctaggatgctgtgtctgctt

SEQ ID NO: 183937 - DNA, 20 bp, Artificial Sequence
  Synthetic oligonucleotide; CGG chr2 60463293 60463312 60463296 -
gatgctgtgtctgcttaagt

SEQ ID NO: 183938 - DNA, 20 bp, Artificial Sequence
  Synthetic oligonucleotide; CAG chr2 60463287 60463306 60463290 -
gtgtctgcttaagtcggcac

SEQ ID NO: 183939 - DNA, 20 bp, Artificial Sequence
  Synthetic oligonucleotide; CAG chr2 60463265 60463284 60463268 -
gccactcctcctaacttttc

SEQ ID NO: 183940 - DNA, 20 bp, Artificial Sequence
  Synthetic oligonucleotide; CGG chr2 60463245 60463264 60463248 -
cagacttgcatttgtctgac

SEQ ID NO: 183941 - DNA, 20 bp, Artificial Sequence
  Synthetic oligonucleotide; GGG chr2 60463244 60463263 60463247 -
agacttgcatttgtctgacc

SEQ ID NO: 183942 - DNA, 20 bp, Artificial Sequence
  Synthetic oligonucleotide; GGG chr2 60463243 60463262 60463246 -
gacttgcatttgtctgaccg

SEQ ID NO: 183943 - DNA, 20 bp, Artificial Sequence
  Synthetic oligonucleotide; GGG chr2 60463242 60463261 60463245 -
acttgcatttgtctgaccgg

SEQ ID NO: 183944 - DNA, 20 bp, Artificial Sequence
  Synthetic oligonucleotide; AAG chr2 60463229 60463248 60463232 -
tgaccgggggacaactccta

SEQ ID NO: 183945 - DNA, 20 bp, Artificial Sequence
  Synthetic oligonucleotide; TGG chr2 60463224 60463243 60463227 -
gggggacaactcctaaagat

SEQ ID NO: 183946 - DNA, 20 bp, Artificial Sequence
  Synthetic oligonucleotide; CAG chr2 60463218 60463237 60463221 -
caactcctaaagattggata

SEQ ID NO: 183947 - DNA, 20 bp, Artificial Sequence
  Synthetic oligonucleotide; AAG chr2 60463194 60463213 60463197 -
ctatccgttaaatctgaatg

SEQ ID NO: 183948 - DNA, 20 bp, Artificial Sequence
  Synthetic oligonucleotide; CAG chr2 60463182 60463201 60463185 -
tctgaatgaagtttttcttt

SEQ ID NO: 183949 - DNA, 20 bp, Artificial Sequence
  Synthetic oligonucleotide; GAG chr2 60463161 60463180 60463164 -
agattttttaaacattcttt

SEQ ID NO: 183950 - DNA, 20 bp, Artificial Sequence
  Synthetic oligonucleotide; TGG chr2 60463151 60463170 60463154 -
aacattctttgagataaaaa

SEQ ID NO: 183951 - DNA, 20 bp, Artificial Sequence
  Synthetic oligonucleotide; TGG chr2 60463139 60463158 60463142 -
gataaaaatggacgtcccca

SEQ ID NO: 183952 - DNA, 20 bp, Artificial Sequence
  Synthetic oligonucleotide; GGG chr2 60463138 60463157 60463141 -
ataaaaatggacgtccccat

SEQ ID NO: 183953 - DNA, 20 bp, Artificial Sequence
  Synthetic oligonucleotide; GGG chr2 60463137 60463156 60463140 -
taaaaatggacgtccccatg

SEQ ID NO: 183954 - DNA, 20 bp, Artificial Sequence
  Synthetic oligonucleotide; TGG chr2 60463129 60463148 60463132 -
gacgtccccatggggtgttg

SEQ ID NO: 183955 - DNA, 20 bp, Artificial Sequence
  Synthetic oligonucleotide; TGG chr2 60463117 60463136 60463120 -
gggtgttgtggaaccaaaat

SEQ ID NO: 183956 - DNA, 20 bp, Artificial Sequence
  Synthetic oligonucleotide; GGG chr2 60463116 60463135 60463119 -
ggtgttgtggaaccaaaatt

SEQ ID NO: 183957 - DNA, 20 bp, Artificial Sequence
  Synthetic oligonucleotide; CAG chr2 60463096 60463115 60463099 -
gggactcactgatcctccca

SEQ ID NO: 183958 - DNA, 20 bp, Artificial Sequence
  Synthetic oligonucleotide; TGG chr2 60463091 60463110 60463094 -
tcactgatcctcccacagtc

SEQ ID NO: 183959 - DNA, 20 bp, Artificial Sequence
  Synthetic oligonucleotide; GGG chr2 60463090 60463109 60463093 -
cactgatcctcccacagtct

SEQ ID NO: 183960 - DNA, 20 bp, Artificial Sequence
  Synthetic oligonucleotide; GGG chr2 60463089 60463108 60463092 -
actgatcctcccacagtctg

SEQ ID NO: 183961 - DNA, 20 bp, Artificial Sequence
  Synthetic oligonucleotide; GAG chr2 60463083 60463102 60463086 -
cctcccacagtctggggtgt

SEQ ID NO: 183962 - DNA, 20 bp, Artificial Sequence
  Synthetic oligonucleotide; TAG chr2 60463072 60463091 60463075 -
ctggggtgtgagaatgttgc

SEQ ID NO: 183963 - DNA, 20 bp, Artificial Sequence
  Synthetic oligonucleotide; CGG chr2 60463058 60463077 60463061 -
tgttgctagtcttttttcca

SEQ ID NO: 183964 - DNA, 20 bp, Artificial Sequence
  Synthetic oligonucleotide; AAG chr2 60463055 60463074 60463058 -
tgctagtcttttttccacgg

SEQ ID NO: 183965 - DNA, 20 bp, Artificial Sequence
  Synthetic oligonucleotide; GAG chr2 60463044 60463063 60463047 -
tttccacggaagtattttat

SEQ ID NO: 183966 - DNA, 20 bp, Artificial Sequence
  Synthetic oligonucleotide; TAG chr2 60463012 60463031 60463015 -
attttaacaatatcaacaat

SEQ ID NO: 183967 - DNA, 20 bp, Artificial Sequence
  Synthetic oligonucleotide; CAG chr2 60463002 60463021 60463005 -
tatcaacaattagtgtgttt

SEQ ID NO: 183968 - DNA, 20 bp, Artificial Sequence
  Synthetic oligonucleotide; AGG chr2 60463001 60463020 60463004 -
atcaacaattagtgtgtttc

SEQ ID NO: 183969 - DNA, 20 bp, Artificial Sequence
  Synthetic oligonucleotide; AAG chr2 60462988 60463007 60462991 -
gtgtttcaggctaatgctga

SEQ ID NO: 183970 - DNA, 20 bp, Artificial Sequence
  Synthetic oligonucleotide; TAG chr2 60462979 60462998 60462982 -
gctaatgctgaaagcatctt

SEQ ID NO: 183971 - DNA, 20 bp, Artificial Sequence
  Synthetic oligonucleotide; AGG chr2 60462978 60462997 60462981 -
ctaatgctgaaagcatcttt

SEQ ID NO: 183972 - DNA, 20 bp, Artificial Sequence
  Synthetic oligonucleotide; GGG chr2 60462977 60462996 60462980 -
taatgctgaaagcatcttta

SEQ ID NO: 183973 - DNA, 20 bp, Artificial Sequence
  Synthetic oligonucleotide; TAG chr2 60462971 60462990 60462974 -
tgaaagcatctttagggcca

SEQ ID NO: 183974 - DNA, 20 bp, Artificial Sequence
  Synthetic oligonucleotide; TAG chr2 60462961 60462980 60462964 -
tttagggccatagaacattg

SEQ ID NO: 183975 - DNA, 20 bp, Artificial Sequence
  Synthetic oligonucleotide; GAG chr2 60462957 60462976 60462960 -
gggccatagaacattgtagt

SEQ ID NO: 183976 - DNA, 20 bp, Artificial Sequence
  Synthetic oligonucleotide; TAG chr2 60462906 60462925 60462909 -
ctatgaaatgtttgcctatt

SEQ ID NO: 183977 - DNA, 20 bp, Artificial Sequence
  Synthetic oligonucleotide; AAG chr2 60462902 60462921 60462905 -
gaaatgtttgcctatttaga

SEQ ID NO: 183978 - DNA, 20 bp, Artificial Sequence
  Synthetic oligonucleotide; CAG chr2 60462886 60462905 60462889 -
tagaaagttcacctgtcacc

SEQ ID NO: 183979 - DNA, 20 bp, Artificial Sequence
  Synthetic oligonucleotide; AGG chr2 60462885 60462904 60462888 -
agaaagttcacctgtcaccc

SEQ ID NO: 183980 - DNA, 20 bp, Artificial Sequence
  Synthetic oligonucleotide; GGG chr2 60462884 60462903 60462887 -
gaaagttcacctgtcaccca

SEQ ID NO: 183981 - DNA, 20 bp, Artificial Sequence
  Synthetic oligonucleotide; GGG chr2 60462883 60462902 60462886 -
aaagttcacctgtcacccag

SEQ ID NO: 183982 - DNA, 20 bp, Artificial Sequence
  Synthetic oligonucleotide; GGG chr2 60462882 60462901 60462885 -
aagttcacctgtcacccagg

SEQ ID NO: 183983 - DNA, 20 bp, Artificial Sequence
  Synthetic oligonucleotide; GGG chr2 60462881 60462900 60462884 -
agttcacctgtcacccaggg

SEQ ID NO: 183984 - DNA, 20 bp, Artificial Sequence
  Synthetic oligonucleotide; TAG chr2 60462876 60462895 60462879 -
acctgtcacccaggggggaa

SEQ ID NO: 183985 - DNA, 20 bp, Artificial Sequence
  Synthetic oligonucleotide; AAG chr2 60462872 60462891 60462875 -
gtcacccaggggggaataga

SEQ ID NO: 183986 - DNA, 20 bp, Artificial Sequence
  Synthetic oligonucleotide; TGG chr2 60462868 60462887 60462871 -
cccaggggggaatagaaagc

SEQ ID NO: 183987 - DNA, 20 bp, Artificial Sequence
  Synthetic oligonucleotide; GGG chr2 60462867 60462886 60462870 -
ccaggggggaatagaaagct

SEQ ID NO: 183988 - DNA, 20 bp, Artificial Sequence
  Synthetic oligonucleotide; TAG chr2 60462861 60462880 60462864 -
gggaatagaaagctgggatt

SEQ ID NO: 183989 - DNA, 20 bp, Artificial Sequence
  Synthetic oligonucleotide; AGG chr2 60462860 60462879 60462863 -
ggaatagaaagctgggattt

SEQ ID NO: 183990 - DNA, 20 bp, Artificial Sequence
  Synthetic oligonucleotide; AAG chr2 60462857 60462876 60462860 -
atagaaagctgggatttagg

SEQ ID NO: 183991 - DNA, 20 bp, Artificial Sequence
  Synthetic oligonucleotide; AAG chr2 60462849 60462868 60462852 -
ctgggatttaggaagccaaa

SEQ ID NO: 183992 - DNA, 20 bp, Artificial Sequence
  Synthetic oligonucleotide; TGG chr2 60462840 60462859 60462843 -
aggaagccaaaaagtttcct

SEQ ID NO: 183993 - DNA, 20 bp, Artificial Sequence
  Synthetic oligonucleotide; GGG chr2 60462839 60462858 60462842 -
ggaagccaaaaagtttcctt

SEQ ID NO: 183994 - DNA, 20 bp, Artificial Sequence
  Synthetic oligonucleotide; AAG chr2 60462825 60462844 60462828 -
ttccttgggtcaccttgtcc

SEQ ID NO: 183995 - DNA, 20 bp, Artificial Sequence
  Synthetic oligonucleotide; AAG chr2 60462809 60462828 60462812 -
gtccaagtttctcacttaac

SEQ ID NO: 183996 - DNA, 20 bp, Artificial Sequence
  Synthetic oligonucleotide; AGG chr2 60462808 60462827 60462811 -
tccaagtttctcacttaaca

SEQ ID NO: 183997 - DNA, 20 bp, Artificial Sequence
  Synthetic oligonucleotide; GAG chr2 60462806 60462825 60462809 -
caagtttctcacttaacaag

SEQ ID NO: 183998 - DNA, 20 bp, Artificial Sequence
  Synthetic oligonucleotide; AGG chr2 60462805 60462824 60462808 -
aagtttctcacttaacaagg

SEQ ID NO: 183999 - DNA, 20 bp, Artificial Sequence
  Synthetic oligonucleotide; CAG chr2 60462799 60462818 60462802 -
ctcacttaacaaggaggaaa

SEQ ID NO: 184000 - DNA, 20 bp, Artificial Sequence
  Synthetic oligonucleotide; GAG chr2 60462797 60462816 60462800 -
cacttaacaaggaggaaaca

SEQ ID NO: 184001 - DNA, 20 bp, Artificial Sequence
  Synthetic oligonucleotide; AGG chr2 60462796 60462815 60462799 -
acttaacaaggaggaaacag

SEQ ID NO: 184002 - DNA, 20 bp, Artificial Sequence
  Synthetic oligonucleotide; TGG chr2 60462789 60462808 60462792 -
aaggaggaaacagaggcaca

SEQ ID NO: 184003 - DNA, 20 bp, Artificial Sequence
  Synthetic oligonucleotide; GAG chr2 60462787 60462806 60462790 -
ggaggaaacagaggcacatg

SEQ ID NO: 184004 - DNA, 20 bp, Artificial Sequence
  Synthetic oligonucleotide; GAG chr2 60462782 60462801 60462785 -
aaacagaggcacatggagat

SEQ ID NO: 184005 - DNA, 20 bp, Artificial Sequence
  Synthetic oligonucleotide; TGG chr2 60462778 60462797 60462781 -
agaggcacatggagatgaga

SEQ ID NO: 184006 - DNA, 20 bp, Artificial Sequence
  Synthetic oligonucleotide; CAG chr2 60462761 60462780 60462764 -
agatggcttgccccaaacta

SEQ ID NO: 184007 - DNA, 20 bp, Artificial Sequence
  Synthetic oligonucleotide; TGG chr2 60462754 60462773 60462757 -
ttgccccaaactacagctga

SEQ ID NO: 184008 - DNA, 20 bp, Artificial Sequence
  Synthetic oligonucleotide; TGG chr2 60462748 60462767 60462751 -
caaactacagctgatggaac

SEQ ID NO: 184009 - DNA, 20 bp, Artificial Sequence
  Synthetic oligonucleotide; AAG chr2 60462744 60462763 60462747 -
ctacagctgatggaactgga

SEQ ID NO: 184010 - DNA, 20 bp, Artificial Sequence
  Synthetic oligonucleotide; TAG chr2 60462739 60462758 60462742 -
gctgatggaactggaaagtt

SEQ ID NO: 184011 - DNA, 20 bp, Artificial Sequence
  Synthetic oligonucleotide; AAG chr2 60462736 60462755 60462739 -
gatggaactggaaagtttag

SEQ ID NO: 184012 - DNA, 20 bp, Artificial Sequence
  Synthetic oligonucleotide; GAG chr2 60462724 60462743 60462727 -
aagtttagaagacatttgtt

SEQ ID NO: 184013 - DNA, 20 bp, Artificial Sequence
  Synthetic oligonucleotide; AGG chr2 60462723 60462742 60462726 -
agtttagaagacatttgttg

SEQ ID NO: 184014 - DNA, 20 bp, Artificial Sequence
  Synthetic oligonucleotide; TAG chr2 60462716 60462735 60462719 -
aagacatttgttgaggtgcc

SEQ ID NO: 184015 - DNA, 20 bp, Artificial Sequence
  Synthetic oligonucleotide; TAG chr2 60462709 60462728 60462712 -
ttgttgaggtgcctagaatg

SEQ ID NO: 184016 - DNA, 20 bp, Artificial Sequence
  Synthetic oligonucleotide; AGG chr2 60462708 60462727 60462711 -
tgttgaggtgcctagaatgt

SEQ ID NO: 184017 - DNA, 20 bp, Artificial Sequence
  Synthetic oligonucleotide; GGG chr2 60462707 60462726 60462710 -
gttgaggtgcctagaatgta

SEQ ID NO: 184018 - DNA, 20 bp, Artificial Sequence
  Synthetic oligonucleotide; AAG chr2 60462692 60462711 60462695 -
atgtagggaccttcatcctc

SEQ ID NO: 184019 - DNA, 20 bp, Artificial Sequence
  Synthetic oligonucleotide; CAG chr2 60462688 60462707 60462691 -
agggaccttcatcctcaagc

SEQ ID NO: 184020 - DNA, 20 bp, Artificial Sequence
  Synthetic oligonucleotide; TGG chr2 60462682 60462701 60462685 -
cttcatcctcaagccagaac

SEQ ID NO: 184021 - DNA, 20 bp, Artificial Sequence
  Synthetic oligonucleotide; CAG chr2 60462678 60462697 60462681 -
atcctcaagccagaactggt

SEQ ID NO: 184022 - DNA, 20 bp, Artificial Sequence
  Synthetic oligonucleotide; AGG chr2 60462677 60462696 60462680 -
tcctcaagccagaactggtc

SEQ ID NO: 184023 - DNA, 20 bp, Artificial Sequence
  Synthetic oligonucleotide; TGG chr2 60462662 60462681 60462665 -
tggtcaggatttttctgctt

SEQ ID NO: 184024 - DNA, 20 bp, Artificial Sequence
  Synthetic oligonucleotide; GGG chr2 60462661 60462680 60462664 -
ggtcaggatttttctgcttt

SEQ ID NO: 184025 - DNA, 20 bp, Artificial Sequence
  Synthetic oligonucleotide; GGG chr2 60462660 60462679 60462663 -
gtcaggatttttctgctttg

SEQ ID NO: 184026 - DNA, 20 bp, Artificial Sequence
  Synthetic oligonucleotide; TGG chr2 60462655 60462674 60462658 -
gatttttctgctttggggat

SEQ ID NO: 184027 - DNA, 20 bp, Artificial Sequence
  Synthetic oligonucleotide; TAG chr2 60462640 60462659 60462643 -
gggattggatataaaatttc

SEQ ID NO: 184028 - DNA, 20 bp, Artificial Sequence
  Synthetic oligonucleotide; GAG chr2 60462633 60462652 60462636 -
gatataaaatttctagaact

SEQ ID NO: 184029 - DNA, 20 bp, Artificial Sequence
  Synthetic oligonucleotide; TGG chr2 60462625 60462644 60462628 -
atttctagaactgagtttaa

SEQ ID NO: 184030 - DNA, 20 bp, Artificial Sequence
  Synthetic oligonucleotide; CAG chr2 60462622 60462641 60462625 -
tctagaactgagtttaatgg

SEQ ID NO: 184031 - DNA, 20 bp, Artificial Sequence
  Synthetic oligonucleotide; AGG chr2 60462621 60462640 60462624 -
ctagaactgagtttaatggc

SEQ ID NO: 184032 - DNA, 20 bp, Artificial Sequence
  Synthetic oligonucleotide; AAG chr2 60462618 60462637 60462621 -
gaactgagtttaatggcagg

SEQ ID NO: 184033 - DNA, 20 bp, Artificial Sequence
  Synthetic oligonucleotide; TGG chr2 60462609 60462628 60462612 -
ttaatggcaggaagatcaat

SEQ ID NO: 184034 - DNA, 20 bp, Artificial Sequence
  Synthetic oligonucleotide; TGG chr2 60462594 60462613 60462597 -
tcaattggaccaatatttac

SEQ ID NO: 184035 - DNA, 20 bp, Artificial Sequence
  Synthetic oligonucleotide; GGG chr2 60462593 60462612 60462596 -
caattggaccaatatttact

SEQ ID NO: 184036 - DNA, 20 bp, Artificial Sequence
  Synthetic oligonucleotide; CAG chr2 60462580 60462599 60462583 -
atttactgggtacccatgct

SEQ ID NO: 184037 - DNA, 20 bp, Artificial Sequence
  Synthetic oligonucleotide; CAG chr2 60462571 60462590 60462574 -
gtacccatgctcagacgtgc

SEQ ID NO: 184038 - DNA, 20 bp, Artificial Sequence
  Synthetic oligonucleotide; AGG chr2 60462570 60462589 60462573 -
tacccatgctcagacgtgcc

SEQ ID NO: 184039 - DNA, 20 bp, Artificial Sequence
  Synthetic oligonucleotide; CAG chr2 60462565 60462584 60462568 -
atgctcagacgtgccaggca

SEQ ID NO: 184040 - DNA, 20 bp, Artificial Sequence
  Synthetic oligonucleotide; AGG chr2 60462564 60462583 60462567 -
tgctcagacgtgccaggcac

SEQ ID NO: 184041 - DNA, 20 bp, Artificial Sequence
  Synthetic oligonucleotide; GGG chr2 60462563 60462582 60462566 -
gctcagacgtgccaggcaca

SEQ ID NO: 184042 - DNA, 20 bp, Artificial Sequence
  Synthetic oligonucleotide; GGG chr2 60462562 60462581 60462565 -
ctcagacgtgccaggcacag

SEQ ID NO: 184043 - DNA, 20 bp, Artificial Sequence
  Synthetic oligonucleotide; GGG chr2 60462561 60462580 60462564 -
tcagacgtgccaggcacagg

SEQ ID NO: 184044 - DNA, 20 bp, Artificial Sequence
  Synthetic oligonucleotide; TAG chr2 60462558 60462577 60462561 -
gacgtgccaggcacaggggg

SEQ ID NO: 184045 - DNA, 20 bp, Artificial Sequence
  Synthetic oligonucleotide; AGG chr2 60462557 60462576 60462560 -
acgtgccaggcacagggggt

SEQ ID NO: 184046 - DNA, 20 bp, Artificial Sequence
  Synthetic oligonucleotide; CAG chr2 60462553 60462572 60462556 -
gccaggcacagggggtaggt

SEQ ID NO: 184047 - DNA, 20 bp, Artificial Sequence
  Synthetic oligonucleotide; GAG chr2 60462549 60462568 60462552 -
ggcacagggggtaggtcagt

SEQ ID NO: 184048 - DNA, 20 bp, Artificial Sequence
  Synthetic oligonucleotide; AGG chr2 60462548 60462567 60462551 -
gcacagggggtaggtcagtg

SEQ ID NO: 184049 - DNA, 20 bp, Artificial Sequence
  Synthetic oligonucleotide; GGG chr2 60462547 60462566 60462550 -
cacagggggtaggtcagtga

SEQ ID NO: 184050 - DNA, 20 bp, Artificial Sequence
  Synthetic oligonucleotide; TAG chr2 60462542 60462561 60462545 -
ggggtaggtcagtgagggct

SEQ ID NO: 184051 - DNA, 20 bp, Artificial Sequence
  Synthetic oligonucleotide; AGG chr2 60462541 60462560 60462544 -
gggtaggtcagtgagggctt

SEQ ID NO: 184052 - DNA, 20 bp, Artificial Sequence
  Synthetic oligonucleotide; TGG chr2 60462535 60462554 60462538 -
gtcagtgagggcttaggcct

SEQ ID NO: 184053 - DNA, 20 bp, Artificial Sequence
  Synthetic oligonucleotide; GGG chr2 60462534 60462553 60462537 -
tcagtgagggcttaggcctt

SEQ ID NO: 184054 - DNA, 20 bp, Artificial Sequence
  Synthetic oligonucleotide; GGG chr2 60462533 60462552 60462536 -
cagtgagggcttaggccttg

SEQ ID NO: 184055 - DNA, 20 bp, Artificial Sequence
  Synthetic oligonucleotide; GAG chr2 60462528 60462547 60462531 -
agggcttaggccttggggtt

SEQ ID NO: 184056 - DNA, 20 bp, Artificial Sequence
  Synthetic oligonucleotide; AGG chr2 60462527 60462546 60462530 -
gggcttaggccttggggttg

SEQ ID NO: 184057 - DNA, 20 bp, Artificial Sequence
  Synthetic oligonucleotide; GGG chr2 60462526 60462545 60462529 -
ggcttaggccttggggttga

SEQ ID NO: 184058 - DNA, 20 bp, Artificial Sequence
  Synthetic oligonucleotide; GGG chr2 60462525 60462544 60462528 -
gcttaggccttggggttgag

SEQ ID NO: 184059 - DNA, 20 bp, Artificial Sequence
  Synthetic oligonucleotide; TGG chr2 60462522 60462541 60462525 -
taggccttggggttgagggg

SEQ ID NO: 184060 - DNA, 20 bp, Artificial Sequence
  Synthetic oligonucleotide; GGG chr2 60462521 60462540 60462524 -
aggccttggggttgaggggt

SEQ ID NO: 184061 - DNA, 20 bp, Artificial Sequence
  Synthetic oligonucleotide; GGG chr2 60462520 60462539 60462523 -
ggccttggggttgaggggtg

SEQ ID NO: 184062 - DNA, 20 bp, Artificial Sequence
  Synthetic oligonucleotide; GGG chr2 60462519 60462538 60462522 -
gccttggggttgaggggtgg

SEQ ID NO: 184063 - DNA, 20 bp, Artificial Sequence
  Synthetic oligonucleotide; CAG chr2 60462516 60462535 60462519 -
ttggggttgaggggtggggg

SEQ ID NO: 184064 - DNA, 20 bp, Artificial Sequence
  Synthetic oligonucleotide; AGG chr2 60462515 60462534 60462518 -
tggggttgaggggtgggggc

SEQ ID NO: 184065 - DNA, 20 bp, Artificial Sequence
  Synthetic oligonucleotide; GGG chr2 60462514 60462533 60462517 -
ggggttgaggggtgggggca

SEQ ID NO: 184066 - DNA, 20 bp, Artificial Sequence
  Synthetic oligonucleotide; AAG chr2 60462511 60462530 60462514 -
gttgaggggtgggggcaggg

SEQ ID NO: 184067 - DNA, 20 bp, Artificial Sequence
  Synthetic oligonucleotide; AGG chr2 60462510 60462529 60462513 -
ttgaggggtgggggcaggga

SEQ ID NO: 184068 - DNA, 20 bp, Artificial Sequence
  Synthetic oligonucleotide; TGG chr2 60462506 60462525 60462509 -
ggggtgggggcagggaaggc

SEQ ID NO: 184069 - DNA, 20 bp, Artificial Sequence
  Synthetic oligonucleotide; GAG chr2 60462504 60462523 60462507 -
ggtgggggcagggaaggctg

SEQ ID NO: 184070 - DNA, 20 bp, Artificial Sequence
  Synthetic oligonucleotide; AGG chr2 60462503 60462522 60462506 -
gtgggggcagggaaggctgg

SEQ ID NO: 184071 - DNA, 20 bp, Artificial Sequence
  Synthetic oligonucleotide; TGG chr2 60462500 60462519 60462503 -
ggggcagggaaggctggagg

SEQ ID NO: 184072 - DNA, 20 bp, Artificial Sequence
  Synthetic oligonucleotide; AAG chr2 60462488 60462507 60462491 -
gctggaggtggaacataaat

SEQ ID NO: 184073 - DNA, 20 bp, Artificial Sequence
  Synthetic oligonucleotide; CAG chr2 60462466 60462485 60462469 -
gcaattgctgatgcccgcct

SEQ ID NO: 184074 - DNA, 20 bp, Artificial Sequence
  Synthetic oligonucleotide; TGG chr2 60462446 60462465 60462449 -
cagtgattaaacattgatgt

SEQ ID NO: 184075 - DNA, 20 bp, Artificial Sequence
  Synthetic oligonucleotide; CAG chr2 60462428 60462447 60462431 -
gttggtgttgtattattttg

SEQ ID NO: 184076 - DNA, 20 bp, Artificial Sequence
  Synthetic oligonucleotide; AGG chr2 60462427 60462446 60462430 -
ttggtgttgtattattttgc

SEQ ID NO: 184077 - DNA, 20 bp, Artificial Sequence
  Synthetic oligonucleotide; AAG chr2 60462422 60462441 60462425 -
gttgtattattttgcaggta

SEQ ID NO: 184078 - DNA, 20 bp, Artificial Sequence
  Synthetic oligonucleotide; GAG chr2 60462417 60462436 60462420 -
attattttgcaggtaaagat

SEQ ID NO: 184079 - DNA, 20 bp, Artificial Sequence
  Synthetic oligonucleotide; CAG chr2 60462412 60462431 60462415 -
tttgcaggtaaagatgagcc

SEQ ID NO: 184080 - DNA, 20 bp, Artificial Sequence
  Synthetic oligonucleotide; CAG chr2 60462409 60462428 60462412 -
gcaggtaaagatgagcccag

SEQ ID NO: 184081 - DNA, 20 bp, Artificial Sequence
  Synthetic oligonucleotide; CAG chr2 60462384 60462403 60462387 -
acacatgtacaacttgcaaa

SEQ ID NO: 184082 - DNA, 20 bp, Artificial Sequence
  Synthetic oligonucleotide; CAG chr2 60462373 60462392 60462376 -
acttgcaaacagccattcac

SEQ ID NO: 184083 - DNA, 20 bp, Artificial Sequence
  Synthetic oligonucleotide; TGG chr2 60462366 60462385 60462369 -
aacagccattcaccagtgca

SEQ ID NO: 184084 - DNA, 20 bp, Artificial Sequence
  Synthetic oligonucleotide; CAG chr2 60462345 60462364 60462348 -
ggtttctcttgcaacacgca

SEQ ID NO: 184085 - DNA, 20 bp, Artificial Sequence
  Synthetic oligonucleotide; TGG chr2 60462334 60462353 60462337 -
caacacgcacagaacactca

SEQ ID NO: 184086 - DNA, 20 bp, Artificial Sequence
  Synthetic oligonucleotide; AAG chr2 60462328 60462347 60462331 -
gcacagaacactcatggatt

SEQ ID NO: 184087 - DNA, 20 bp, Artificial Sequence
  Synthetic oligonucleotide; TAG chr2 60462317 60462336 60462320 -
tcatggattaagaatctact

SEQ ID NO: 184088 - DNA, 20 bp, Artificial Sequence
  Synthetic oligonucleotide; AAG chr2 60462313 60462332 60462316 -
ggattaagaatctacttaga

SEQ ID NO: 184089 - DNA, 20 bp, Artificial Sequence
  Synthetic oligonucleotide; CGG chr2 60462304 60462323 60462307 -
atctacttagaaagcgaaca

SEQ ID NO: 184090 - DNA, 20 bp, Artificial Sequence
  Synthetic oligonucleotide; AAG chr2 60462301 60462320 60462304 -
tacttagaaagcgaacacgg

SEQ ID NO: 184091 - DNA, 20 bp, Artificial Sequence
  Synthetic oligonucleotide; CGG chr2 60462285 60462304 60462288 -
acggaagtcccctgaccccg

SEQ ID NO: 184092 - DNA, 20 bp, Artificial Sequence
  Synthetic oligonucleotide; GGG chr2 60462284 60462303 60462287 -
cggaagtcccctgaccccgc

SEQ ID NO: 184093 - DNA, 20 bp, Artificial Sequence
  Synthetic oligonucleotide; TGG chr2 60462280 60462299 60462283 -
agtcccctgaccccgcgggt

SEQ ID NO: 184094 - DNA, 20 bp, Artificial Sequence
  Synthetic oligonucleotide; CAG chr2 60462269 60462288 60462272 -
cccgcgggttggtatccctt

SEQ ID NO: 184095 - DNA, 20 bp, Artificial Sequence
  Synthetic oligonucleotide; AGG chr2 60462268 60462287 60462271 -
ccgcgggttggtatcccttc

SEQ ID NO: 184096 - DNA, 20 bp, Artificial Sequence
  Synthetic oligonucleotide; TAG chr2 60462263 60462282 60462266 -
ggttggtatcccttcaggac

SEQ ID NO: 184097 - DNA, 20 bp, Artificial Sequence
  Synthetic oligonucleotide; AGG chr2 60462262 60462281 60462265 -
gttggtatcccttcaggact

SEQ ID NO: 184098 - DNA, 20 bp, Artificial Sequence
  Synthetic oligonucleotide; CAG chr2 60462257 60462276 60462260 -
tatcccttcaggactaggtg

SEQ ID NO: 184099 - DNA, 20 bp, Artificial Sequence
  Synthetic oligonucleotide; CAG chr2 60462243 60462262 60462246 -
taggtgcagaatgtccttcc

SEQ ID NO: 184100 - DNA, 20 bp, Artificial Sequence
  Synthetic oligonucleotide; TGG chr2 60462229 60462248 60462232 -
ccttcccagccacctctcca

SEQ ID NO: 184101 - DNA, 20 bp, Artificial Sequence
  Synthetic oligonucleotide; GGG chr2 60462228 60462247 60462231 -
cttcccagccacctctccat

SEQ ID NO: 184102 - DNA, 20 bp, Artificial Sequence
  Synthetic oligonucleotide; CAG chr2 60462215 60462234 60462218 -
tctccatgggattcatattg

SEQ ID NO: 184103 - DNA, 20 bp, Artificial Sequence
  Synthetic oligonucleotide; AAG chr2 60462190 60462209 60462193 -
aataacccctttaacctgct

SEQ ID NO: 184104 - DNA, 20 bp, Artificial Sequence
  Synthetic oligonucleotide; CAG chr2 60462182 60462201 60462185 -
ctttaacctgctaagaatac

SEQ ID NO: 184105 - DNA, 20 bp, Artificial Sequence
  Synthetic oligonucleotide; AGG chr2 60462181 60462200 60462184 -
tttaacctgctaagaatacc

SEQ ID NO: 184106 - DNA, 20 bp, Artificial Sequence
  Synthetic oligonucleotide; CAG chr2 60462176 60462195 60462179 -
cctgctaagaataccaggat

SEQ ID NO: 184107 - DNA, 20 bp, Artificial Sequence
  Synthetic oligonucleotide; GAG chr2 60462169 60462188 60462172 -
agaataccaggatcagtatc

SEQ ID NO: 184108 - DNA, 20 bp, Artificial Sequence
  Synthetic oligonucleotide; GAG chr2 60462167 60462186 60462170 -
aataccaggatcagtatcga

SEQ ID NO: 184109 - DNA, 20 bp, Artificial Sequence
  Synthetic oligonucleotide; GAG chr2 60462165 60462184 60462168 -
taccaggatcagtatcgaga

SEQ ID NO: 184110 - DNA, 20 bp, Artificial Sequence
  Synthetic oligonucleotide; AGG chr2 60462164 60462183 60462167 -
accaggatcagtatcgagag

SEQ ID NO: 184111 - DNA, 20 bp, Artificial Sequence
  Synthetic oligonucleotide; CGG chr2 60462157 60462176 60462160 -
tcagtatcgagagaggcttc

SEQ ID NO: 184112 - DNA, 20 bp, Artificial Sequence
  Synthetic oligonucleotide; TGG chr2 60462152 60462171 60462155 -
atcgagagaggcttccggcc

SEQ ID NO: 184113 - DNA, 20 bp, Artificial Sequence
  Synthetic oligonucleotide; CAG chr2 60462149 60462168 60462152 -
gagagaggcttccggcctgg

SEQ ID NO: 184114 - DNA, 20 bp, Artificial Sequence
  Synthetic oligonucleotide; AAG chr2 60462146 60462165 60462149 -
agaggcttccggcctggcag

SEQ ID NO: 184115 - DNA, 20 bp, Artificial Sequence
  Synthetic oligonucleotide; AGG chr2 60462145 60462164 60462148 -
gaggcttccggcctggcaga

SEQ ID NO: 184116 - DNA, 20 bp, Artificial Sequence
  Synthetic oligonucleotide; GGG chr2 60462144 60462163 60462147 -
aggcttccggcctggcagaa

SEQ ID NO: 184117 - DNA, 20 bp, Artificial Sequence
  Synthetic oligonucleotide; TAG chr2 60462115 60462134 60462118 -
ccacccactccccccctgtt

SEQ ID NO: 184118 - DNA, 20 bp, Artificial Sequence
  Synthetic oligonucleotide; GAG chr2 60462103 60462122 60462106 -
cccctgtttagtccaccacc

SEQ ID NO: 184119 - DNA, 20 bp, Artificial Sequence
  Synthetic oligonucleotide; TGG chr2 60462092 60462111 60462095 -
tccaccaccgagacatcact

SEQ ID NO: 184120 - DNA, 20 bp, Artificial Sequence
  Synthetic oligonucleotide; TAG chr2 60462077 60462096 60462080 -
tcacttggacccccaccgca

SEQ ID NO: 184121 - DNA, 20 bp, Artificial Sequence
  Synthetic oligonucleotide; GAG chr2 60462075 60462094 60462078 -
acttggacccccaccgcata

SEQ ID NO: 184122 - DNA, 20 bp, Artificial Sequence
  Synthetic oligonucleotide; TGG chr2 60462068 60462087 60462071 -
cccccaccgcatagagcgcc

SEQ ID NO: 184123 - DNA, 20 bp, Artificial Sequence
  Synthetic oligonucleotide; GGG chr2 60462067 60462086 60462070 -
ccccaccgcatagagcgcct

SEQ ID NO: 184124 - DNA, 20 bp, Artificial Sequence
  Synthetic oligonucleotide; GGG chr2 60462066 60462085 60462069 -
cccaccgcatagagcgcctg

SEQ ID NO: 184125 - DNA, 20 bp, Artificial Sequence
  Synthetic oligonucleotide; GGG chr2 60462065 60462084 60462068 -
ccaccgcatagagcgcctgg

SEQ ID NO: 184126 - DNA, 20 bp, Artificial Sequence
  Synthetic oligonucleotide; CGG chr2 60462062 60462081 60462065 -
ccgcatagagcgcctggggg

SEQ ID NO: 184127 - DNA, 20 bp, Artificial Sequence
  Synthetic oligonucleotide; AAG chr2 60462059 60462078 60462062 -
catagagcgcctgggggcgg

SEQ ID NO: 184128 - DNA, 20 bp, Artificial Sequence
  Synthetic oligonucleotide; GAG chr2 60462057 60462076 60462060 -
tagagcgcctgggggcggaa

SEQ ID NO: 184129 - DNA, 20 bp, Artificial Sequence
  Synthetic oligonucleotide; TGG chr2 60462053 60462072 60462056 -
gcgcctgggggcggaagaga

SEQ ID NO: 184130 - DNA, 20 bp, Artificial Sequence
  Synthetic oligonucleotide; TGG chr2 60462047 60462066 60462050 -
gggggcggaagagatggccc

SEQ ID NO: 184131 - DNA, 20 bp, Artificial Sequence
  Synthetic oligonucleotide; GAG chr2 60462031 60462050 60462034 -
gccctggccacccatcaccc

SEQ ID NO: 184132 - DNA, 20 bp, Artificial Sequence
  Synthetic oligonucleotide; CAG chr2 60462019 60462038 60462022 -
catcacccgagtgcctttga

SEQ ID NO: 184133 - DNA, 20 bp, Artificial Sequence
  Synthetic oligonucleotide; AGG chr2 60462018 60462037 60462021 -
atcacccgagtgcctttgac

SEQ ID NO: 184134 - DNA, 20 bp, Artificial Sequence
  Synthetic oligonucleotide; GGG chr2 60462017 60462036 60462020 -
tcacccgagtgcctttgaca

SEQ ID NO: 184135 - DNA, 20 bp, Artificial Sequence
  Synthetic oligonucleotide; CGG chr2 60462009 60462028 60462012 -
gtgcctttgacagggtgctg

SEQ ID NO: 184136 - DNA, 20 bp, Artificial Sequence
  Synthetic oligonucleotide; TGG chr2 60461996 60462015 60461999 -
ggtgctgcggttgaatccaa

SEQ ID NO: 184137 - DNA, 20 bp, Artificial Sequence
  Synthetic oligonucleotide; TGG chr2 60461990 60462009 60461993 -
gcggttgaatccaatggcta

SEQ ID NO: 184138 - DNA, 20 bp, Artificial Sequence
  Synthetic oligonucleotide; GAG chr2 60461988 60462007 60461991 -
ggttgaatccaatggctatg

SEQ ID NO: 184139 - DNA, 20 bp, Artificial Sequence
  Synthetic oligonucleotide; TGG chr2 60461975 60461994 60461978 -
ggctatggagcctcccgcca

SEQ ID NO: 184140 - DNA, 20 bp, Artificial Sequence
  Synthetic oligonucleotide; TAG chr2 60461965 60461984 60461968 -
cctcccgccatggatttctc

SEQ ID NO: 184141 - DNA, 20 bp, Artificial Sequence
  Synthetic oligonucleotide; AGG chr2 60461964 60461983 60461967 -
ctcccgccatggatttctct

SEQ ID NO: 184142 - DNA, 20 bp, Artificial Sequence
  Synthetic oligonucleotide; GAG chr2 60461962 60461981 60461965 -
cccgccatggatttctctag

SEQ ID NO: 184143 - DNA, 20 bp, Artificial Sequence
  Synthetic oligonucleotide; TAG chr2 60461956 60461975 60461959 -
atggatttctctaggagact

SEQ ID NO: 184144 - DNA, 20 bp, Artificial Sequence
  Synthetic oligonucleotide; GAG chr2 60461954 60461973 60461957 -
ggatttctctaggagactta

SEQ ID NO: 184145 - DNA, 20 bp, Artificial Sequence
  Synthetic oligonucleotide; GAG chr2 60461952 60461971 60461955 -
atttctctaggagacttaga

SEQ ID NO: 184146 - DNA, 20 bp, Artificial Sequence
  Synthetic oligonucleotide; TGG chr2 60461948 60461967 60461951 -
ctctaggagacttagagagc

SEQ ID NO: 184147 - DNA, 20 bp, Artificial Sequence
  Synthetic oligonucleotide; CAG chr2 60461945 60461964 60461948 -
taggagacttagagagctgg

SEQ ID NO: 184148 - DNA, 20 bp, Artificial Sequence
  Synthetic oligonucleotide; AGG chr2 60461944 60461963 60461947 -
aggagacttagagagctggc

SEQ ID NO: 184149 - DNA, 20 bp, Artificial Sequence
  Synthetic oligonucleotide; GGG chr2 60461943 60461962 60461946 -
ggagacttagagagctggca

SEQ ID NO: 184150 - DNA, 20 bp, Artificial Sequence
  Synthetic oligonucleotide; TAG chr2 60461932 60461951 60461935 -
gagctggcagggaacacgtc

SEQ ID NO: 184151 - DNA, 20 bp, Artificial Sequence
  Synthetic oligonucleotide; CAG chr2 60461915 60461934 60461918 -
gtctagcccaccgctgtccc

SEQ ID NO: 184152 - DNA, 20 bp, Artificial Sequence
  Synthetic oligonucleotide; AGG chr2 60461914 60461933 60461917 -
tctagcccaccgctgtcccc

SEQ ID NO: 184153 - DNA, 20 bp, Artificial Sequence
  Synthetic oligonucleotide; CGG chr2 60461910 60461929 60461913 -
gcccaccgctgtccccaggc

SEQ ID NO: 184154 - DNA, 20 bp, Artificial Sequence
  Synthetic oligonucleotide; CAG chr2 60461905 60461924 60461908 -
ccgctgtccccaggccggcc

SEQ ID NO: 184155 - DNA, 20 bp, Artificial Sequence
  Synthetic oligonucleotide; AAG chr2 60461893 60461912 60461896 -
ggccggcccagccctatgca

SEQ ID NO: 184156 - DNA, 20 bp, Artificial Sequence
  Synthetic oligonucleotide; AGG chr2 60461892 60461911 60461895 -
gccggcccagccctatgcaa

SEQ ID NO: 184157 - DNA, 20 bp, Artificial Sequence
  Synthetic oligonucleotide; CAG chr2 60461874 60461893 60461877 -
aaaggttactgcaaccattc

SEQ ID NO: 184158 - DNA, 20 bp, Artificial Sequence
  Synthetic oligonucleotide; CAG chr2 60461870 60461889 60461873 -
gttactgcaaccattccagc

SEQ ID NO: 184159 - DNA, 20 bp, Artificial Sequence
  Synthetic oligonucleotide; AGG chr2 60461869 60461888 60461872 -
ttactgcaaccattccagcc

SEQ ID NO: 184160 - DNA, 20 bp, Artificial Sequence
  Synthetic oligonucleotide; TAG chr2 60461866 60461885 60461869 -
ctgcaaccattccagccagg

SEQ ID NO: 184161 - DNA, 20 bp, Artificial Sequence
  Synthetic oligonucleotide; AAG chr2 60461862 60461881 60461865 -
aaccattccagccaggtagc

SEQ ID NO: 184162 - DNA, 20 bp, Artificial Sequence
  Synthetic oligonucleotide; TGG chr2 60461849 60461868 60461852 -
aggtagcaagccgcccttcc

SEQ ID NO: 184163 - DNA, 20 bp, Artificial Sequence
  Synthetic oligonucleotide; CAG chr2 60461802 60461821 60461805 -
aatccgcccctcctccctcc

SEQ ID NO: 184164 - DNA, 20 bp, Artificial Sequence
  Synthetic oligonucleotide; CGG chr2 60461795 60461814 60461798 -
ccctcctccctcccagcccc

SEQ ID NO: 184165 - DNA, 20 bp, Artificial Sequence
  Synthetic oligonucleotide; AAG chr2 60461790 60461809 60461793 -
ctccctcccagcccccggtc

SEQ ID NO: 184166 - DNA, 20 bp, Artificial Sequence
  Synthetic oligonucleotide; AAG chr2 60461784 60461803 60461787 -
cccagcccccggtcaagtcc

SEQ ID NO: 184167 - DNA, 20 bp, Artificial Sequence
  Synthetic oligonucleotide; GAG chr2 60461775 60461794 60461778 -
cggtcaagtccaagtcatgc

SEQ ID NO: 184168 - DNA, 20 bp, Artificial Sequence
  Synthetic oligonucleotide; CGG chr2 60461767 60461786 60461770 -
tccaagtcatgcgagttctg

SEQ ID NO: 184169 - DNA, 20 bp, Artificial Sequence
  Synthetic oligonucleotide; AAG chr2 60461763 60461782 60461766 -
agtcatgcgagttctgcggc

SEQ ID NO: 184170 - DNA, 20 bp, Artificial Sequence
  Synthetic oligonucleotide; CAG chr2 60461748 60461767 60461751 -
gcggcaagacgttcaaattt

SEQ ID NO: 184171 - DNA, 20 bp, Artificial Sequence
  Synthetic oligonucleotide; GAG chr2 60461746 60461765 60461749 -
ggcaagacgttcaaatttca

SEQ ID NO: 184172 - DNA, 20 bp, Artificial Sequence
  Synthetic oligonucleotide; TGG chr2 60461738 60461757 60461741 -
gttcaaatttcagagcaacc

SEQ ID NO: 184173 - DNA, 20 bp, Artificial Sequence
  Synthetic oligonucleotide; TGG chr2 60461735 60461754 60461738 -
caaatttcagagcaacctgg

SEQ ID NO: 184174 - DNA, 20 bp, Artificial Sequence
  Synthetic oligonucleotide; CGG chr2 60461727 60461746 60461730 -
agagcaacctggtggtgcac

SEQ ID NO: 184175 - DNA, 20 bp, Artificial Sequence
  Synthetic oligonucleotide; CAG chr2 60461722 60461741 60461725 -
aacctggtggtgcaccggcg

SEQ ID NO: 184176 - DNA, 20 bp, Artificial Sequence
  Synthetic oligonucleotide; CGG chr2 60461714 60461733 60461717 -
ggtgcaccggcgcagccaca

SEQ ID NO: 184177 - DNA, 20 bp, Artificial Sequence
  Synthetic oligonucleotide; GGG chr2 60461713 60461732 60461716 -
gtgcaccggcgcagccacac

SEQ ID NO: 184178 - DNA, 20 bp, Artificial Sequence
  Synthetic oligonucleotide; GAG chr2 60461709 60461728 60461712 -
accggcgcagccacacgggc

SEQ ID NO: 184179 - DNA, 20 bp, Artificial Sequence
  Synthetic oligonucleotide; AAG chr2 60461706 60461725 60461709 -
ggcgcagccacacgggcgag

SEQ ID NO: 184180 - DNA, 20 bp, Artificial Sequence
  Synthetic oligonucleotide; AAG chr2 60461697 60461716 60461700 -
acacgggcgagaagccctac

SEQ ID NO: 184181 - DNA, 20 bp, Artificial Sequence
  Synthetic oligonucleotide; CAG chr2 60461667 60461686 60461670 -
tgtgcgaccacgcgtgcacc

SEQ ID NO: 184182 - DNA, 20 bp, Artificial Sequence
  Synthetic oligonucleotide; AGG chr2 60461666 60461685 60461669 -
gtgcgaccacgcgtgcaccc

SEQ ID NO: 184183 - DNA, 20 bp, Artificial Sequence
  Synthetic oligonucleotide; CAG chr2 60461662 60461681 60461665 -
gaccacgcgtgcacccaggc

SEQ ID NO: 184184 - DNA, 20 bp, Artificial Sequence
  Synthetic oligonucleotide; AAG chr2 60461658 60461677 60461661 -
acgcgtgcacccaggccagc

SEQ ID NO: 184185 - DNA, 20 bp, Artificial Sequence
  Synthetic oligonucleotide; AAG chr2 60461652 60461671 60461655 -
gcacccaggccagcaagctg

SEQ ID NO: 184186 - DNA, 20 bp, Artificial Sequence
  Synthetic oligonucleotide; AAG chr2 60461640 60461659 60461643 -
gcaagctgaagcgccacatg

SEQ ID NO: 184187 - DNA, 20 bp, Artificial Sequence
  Synthetic oligonucleotide; CGG chr2 60461609 60461628 60461612 -
gcacaaatcgtcccccatga

SEQ ID NO: 184188 - DNA, 20 bp, Artificial Sequence
  Synthetic oligonucleotide; AAG chr2 60461604 60461623 60461607 -
aatcgtcccccatgacggtc

SEQ ID NO: 184189 - DNA, 20 bp, Artificial Sequence
  Synthetic oligonucleotide; CGG chr2 60461593 60461612 60461596 -
atgacggtcaagtccgacga

SEQ ID NO: 184190 - DNA, 20 bp, Artificial Sequence
  Synthetic oligonucleotide; CAG chr2 60461578 60461597 60461581 -
gacgacggtctctccaccgc

SEQ ID NO: 184191 - DNA, 20 bp, Artificial Sequence
  Synthetic oligonucleotide; CGG chr2 60461570 60461589 60461573 -
tctctccaccgccagctccc

SEQ ID NO: 184192 - DNA, 20 bp, Artificial Sequence
  Synthetic oligonucleotide; CGG chr2 60461563 60461582 60461566 -
accgccagctccccggaacc

SEQ ID NO: 184193 - DNA, 20 bp, Artificial Sequence
  Synthetic oligonucleotide; CAG chr2 60461557 60461576 60461560 -
agctccccggaacccggcac

SEQ ID NO: 184194 - DNA, 20 bp, Artificial Sequence
  Synthetic oligonucleotide; TGG chr2 60461549 60461568 60461552 -
ggaacccggcaccagcgact

SEQ ID NO: 184195 - DNA, 20 bp, Artificial Sequence
  Synthetic oligonucleotide; TGG chr2 60461546 60461565 60461549 -
acccggcaccagcgacttgg

SEQ ID NO: 184196 - DNA, 20 bp, Artificial Sequence
  Synthetic oligonucleotide; GGG chr2 60461545 60461564 60461548 -
cccggcaccagcgacttggt

SEQ ID NO: 184197 - DNA, 20 bp, Artificial Sequence
  Synthetic oligonucleotide; CAG chr2 60461542 60461561 60461545 -
ggcaccagcgacttggtggg

SEQ ID NO: 184198 - DNA, 20 bp, Artificial Sequence
  Synthetic oligonucleotide; CAG chr2 60461536 60461555 60461539 -
agcgacttggtgggcagcgc

SEQ ID NO: 184199 - DNA, 20 bp, Artificial Sequence
  Synthetic oligonucleotide; CAG chr2 60461533 60461552 60461536 -
gacttggtgggcagcgccag

SEQ ID NO: 184200 - DNA, 20 bp, Artificial Sequence
  Synthetic oligonucleotide; AAG chr2 60461523 60461542 60461526 -
gcagcgccagcagcgcgctc

SEQ ID NO: 184201 - DNA, 20 bp, Artificial Sequence
  Synthetic oligonucleotide; TGG chr2 60461516 60461535 60461519 -
cagcagcgcgctcaagtccg

SEQ ID NO: 184202 - DNA, 20 bp, Artificial Sequence
  Synthetic oligonucleotide; TGG chr2 60461513 60461532 60461516 -
cagcgcgctcaagtccgtgg

SEQ ID NO: 184203 - DNA, 20 bp, Artificial Sequence
  Synthetic oligonucleotide; AAG chr2 60461508 60461527 60461511 -
cgctcaagtccgtggtggcc

SEQ ID NO: 184204 - DNA, 20 bp, Artificial Sequence
  Synthetic oligonucleotide; AAG chr2 60461502 60461521 60461505 -
agtccgtggtggccaagttc

SEQ ID NO: 184205 - DNA, 20 bp, Artificial Sequence
  Synthetic oligonucleotide; GAG chr2 60461500 60461519 60461503 -
tccgtggtggccaagttcaa

SEQ ID NO: 184206 - DNA, 20 bp, Artificial Sequence
  Synthetic oligonucleotide; GAG chr2 60461496 60461515 60461499 -
tggtggccaagttcaagagc

SEQ ID NO: 184207 - DNA, 20 bp, Artificial Sequence
  Synthetic oligonucleotide; CGG chr2 60461474 60461493 60461477 -
gaacgaccccaacctgatcc

SEQ ID NO: 184208 - DNA, 20 bp, Artificial Sequence
  Synthetic oligonucleotide; GAG chr2 60461472 60461491 60461475 -
acgaccccaacctgatcccg

SEQ ID NO: 184209 - DNA, 20 bp, Artificial Sequence
  Synthetic oligonucleotide; CGG chr2 60461467 60461486 60461470 -
cccaacctgatcccggagaa

SEQ ID NO: 184210 - DNA, 20 bp, Artificial Sequence
  Synthetic oligonucleotide; GGG chr2 60461466 60461485 60461469 -
ccaacctgatcccggagaac

SEQ ID NO: 184211 - DNA, 20 bp, Artificial Sequence
  Synthetic oligonucleotide; GGG chr2 60461465 60461484 60461468 -
caacctgatcccggagaacg

SEQ ID NO: 184212 - DNA, 20 bp, Artificial Sequence
  Synthetic oligonucleotide; GAG chr2 60461460 60461479 60461463 -
tgatcccggagaacggggac

SEQ ID NO: 184213 - DNA, 20 bp, Artificial Sequence
  Synthetic oligonucleotide; AGG chr2 60461459 60461478 60461462 -
gatcccggagaacggggacg

SEQ ID NO: 184214 - DNA, 20 bp, Artificial Sequence
  Synthetic oligonucleotide; GAG chr2 60461457 60461476 60461460 -
tcccggagaacggggacgag

SEQ ID NO: 184215 - DNA, 20 bp, Artificial Sequence
  Synthetic oligonucleotide; AGG chr2 60461456 60461475 60461459 -
cccggagaacggggacgagg

SEQ ID NO: 184216 - DNA, 20 bp, Artificial Sequence
  Synthetic oligonucleotide; AAG chr2 60461453 60461472 60461456 -
ggagaacggggacgaggagg

SEQ ID NO: 184217 - DNA, 20 bp, Artificial Sequence
  Synthetic oligonucleotide; GAG chr2 60461451 60461470 60461454 -
agaacggggacgaggaggaa

SEQ ID NO: 184218 - DNA, 20 bp, Artificial Sequence
  Synthetic oligonucleotide; AGG chr2 60461450 60461469 60461453 -
gaacggggacgaggaggaag

SEQ ID NO: 184219 - DNA, 20 bp, Artificial Sequence
  Synthetic oligonucleotide; GAG chr2 60461448 60461467 60461451 -
acggggacgaggaggaagag

SEQ ID NO: 184220 - DNA, 20 bp, Artificial Sequence
  Synthetic oligonucleotide; AGG chr2 60461447 60461466 60461450 -
cggggacgaggaggaagagg

SEQ ID NO: 184221 - DNA, 20 bp, Artificial Sequence
  Synthetic oligonucleotide; GAG chr2 60461439 60461458 60461442 -
aggaggaagaggaggacgac

SEQ ID NO: 184222 - DNA, 20 bp, Artificial Sequence
  Synthetic oligonucleotide; AGG chr2 60461438 60461457 60461441 -
ggaggaagaggaggacgacg

SEQ ID NO: 184223 - DNA, 20 bp, Artificial Sequence
  Synthetic oligonucleotide; AAG chr2 60461435 60461454 60461438 -
ggaagaggaggacgacgagg

SEQ ID NO: 184224 - DNA, 20 bp, Artificial Sequence
  Synthetic oligonucleotide; GAG chr2 60461433 60461452 60461436 -
aagaggaggacgacgaggaa

SEQ ID NO: 184225 - DNA, 20 bp, Artificial Sequence
  Synthetic oligonucleotide; AGG chr2 60461432 60461451 60461435 -
agaggaggacgacgaggaag

SEQ ID NO: 184226 - DNA, 20 bp, Artificial Sequence
  Synthetic oligonucleotide; AAG chr2 60461429 60461448 60461432 -
ggaggacgacgaggaagagg

SEQ ID NO: 184227 - DNA, 20 bp, Artificial Sequence
  Synthetic oligonucleotide; AAG chr2 60461426 60461445 60461429 -
ggacgacgaggaagaggaag

SEQ ID NO: 184228 - DNA, 20 bp, Artificial Sequence
  Synthetic oligonucleotide; GAG chr2 60461424 60461443 60461427 -
acgacgaggaagaggaagaa

SEQ ID NO: 184229 - DNA, 20 bp, Artificial Sequence
  Synthetic oligonucleotide; AGG chr2 60461423 60461442 60461426 -
cgacgaggaagaggaagaag

SEQ ID NO: 184230 - DNA, 20 bp, Artificial Sequence
  Synthetic oligonucleotide; GAG chr2 60461421 60461440 60461424 -
acgaggaagaggaagaagag

SEQ ID NO: 184231 - DNA, 20 bp, Artificial Sequence
  Synthetic oligonucleotide; AGG chr2 60461420 60461439 60461423 -
cgaggaagaggaagaagagg

SEQ ID NO: 184232 - DNA, 20 bp, Artificial Sequence
  Synthetic oligonucleotide; AAG chr2 60461417 60461436 60461420 -
ggaagaggaagaagaggagg

SEQ ID NO: 184233 - DNA, 20 bp, Artificial Sequence
  Synthetic oligonucleotide; GAG chr2 60461415 60461434 60461418 -
aagaggaagaagaggaggaa

SEQ ID NO: 184234 - DNA, 20 bp, Artificial Sequence
  Synthetic oligonucleotide; AGG chr2 60461414 60461433 60461417 -
agaggaagaagaggaggaag

SEQ ID NO: 184235 - DNA, 20 bp, Artificial Sequence
  Synthetic oligonucleotide; GAG chr2 60461412 60461431 60461415 -
aggaagaagaggaggaagag

SEQ ID NO: 184236 - DNA, 20 bp, Artificial Sequence
  Synthetic oligonucleotide; AGG chr2 60461411 60461430 60461414 -
ggaagaagaggaggaagagg

SEQ ID NO: 184237 - DNA, 20 bp, Artificial Sequence
  Synthetic oligonucleotide; GAG chr2 60461409 60461428 60461412 -
aagaagaggaggaagaggag

SEQ ID NO: 184238 - DNA, 20 bp, Artificial Sequence
  Synthetic oligonucleotide; AGG chr2 60461408 60461427 60461411 -
agaagaggaggaagaggagg

SEQ ID NO: 184239 - DNA, 20 bp, Artificial Sequence
  Synthetic oligonucleotide; GAG chr2 60461406 60461425 60461409 -
aagaggaggaagaggaggag

SEQ ID NO: 184240 - DNA, 20 bp, Artificial Sequence
  Synthetic oligonucleotide; AGG chr2 60461405 60461424 60461408 -
agaggaggaagaggaggagg

SEQ ID NO: 184241 - DNA, 20 bp, Artificial Sequence
  Synthetic oligonucleotide; GAG chr2 60461403 60461422 60461406 -
aggaggaagaggaggaggag

SEQ ID NO: 184242 - DNA, 20 bp, Artificial Sequence
  Synthetic oligonucleotide; CGG chr2 60461396 60461415 60461399 -
agaggaggaggaggagctga

SEQ ID NO: 184243 - DNA, 20 bp, Artificial Sequence
  Synthetic oligonucleotide; GAG chr2 60461394 60461413 60461397 -
aggaggaggaggagctgacg

SEQ ID NO: 184244 - DNA, 20 bp, Artificial Sequence
  Synthetic oligonucleotide; GAG chr2 60461392 60461411 60461395 -
gaggaggaggagctgacgga

SEQ ID NO: 184245 - DNA, 20 bp, Artificial Sequence
  Synthetic oligonucleotide; GAG chr2 60461388 60461407 60461391 -
aggaggagctgacggagagc

SEQ ID NO: 184246 - DNA, 20 bp, Artificial Sequence
  Synthetic oligonucleotide; GAG chr2 60461386 60461405 60461389 -
gaggagctgacggagagcga

SEQ ID NO: 184247 - DNA, 20 bp, Artificial Sequence
  Synthetic oligonucleotide; AGG chr2 60461385 60461404 60461388 -
aggagctgacggagagcgag

SEQ ID NO: 184248 - DNA, 20 bp, Artificial Sequence
  Synthetic oligonucleotide; GGG chr2 60461384 60461403 60461387 -
ggagctgacggagagcgaga

SEQ ID NO: 184249 - DNA, 20 bp, Artificial Sequence
  Synthetic oligonucleotide; TGG chr2 60461381 60461400 60461384 -
gctgacggagagcgagaggg

SEQ ID NO: 184250 - DNA, 20 bp, Artificial Sequence
  Synthetic oligonucleotide; CGG chr2 60461374 60461393 60461377 -
gagagcgagagggtggacta

SEQ ID NO: 184251 - DNA, 20 bp, Artificial Sequence
  Synthetic oligonucleotide; CGG chr2 60461368 60461387 60461371 -
gagagggtggactacggctt

SEQ ID NO: 184252 - DNA, 20 bp, Artificial Sequence
  Synthetic oligonucleotide; GGG chr2 60461367 60461386 60461370 -
agagggtggactacggcttc

SEQ ID NO: 184253 - DNA, 20 bp, Artificial Sequence
  Synthetic oligonucleotide; GAG chr2 60461362 60461381 60461365 -
gtggactacggcttcgggct

SEQ ID NO: 184254 - DNA, 20 bp, Artificial Sequence
  Synthetic oligonucleotide; TGG chr2 60461357 60461376 60461360 -
ctacggcttcgggctgagcc

SEQ ID NO: 184255 - DNA, 20 bp, Artificial Sequence
  Synthetic oligonucleotide; GAG chr2 60461355 60461374 60461358 -
acggcttcgggctgagcctg

SEQ ID NO: 184256 - DNA, 20 bp, Artificial Sequence
  Synthetic oligonucleotide; AGG chr2 60461354 60461373 60461357 -
cggcttcgggctgagcctgg

SEQ ID NO: 184257 - DNA, 20 bp, Artificial Sequence
  Synthetic oligonucleotide; CGG chr2 60461351 60461370 60461354 -
cttcgggctgagcctggagg

SEQ ID NO: 184258 - DNA, 20 bp, Artificial Sequence
  Synthetic oligonucleotide; GAG chr2 60461337 60461356 60461340 -
tggaggcggcgcgccaccac

SEQ ID NO: 184259 - DNA, 20 bp, Artificial Sequence
  Synthetic oligonucleotide; CAG chr2 60461332 60461351 60461335 -
gcggcgcgccaccacgagaa

SEQ ID NO: 184260 - DNA, 20 bp, Artificial Sequence
  Synthetic oligonucleotide; CGG chr2 60461325 60461344 60461328 -
gccaccacgagaacagctcg

SEQ ID NO: 184261 - DNA, 20 bp, Artificial Sequence
  Synthetic oligonucleotide; GGG chr2 60461324 60461343 60461327 -
ccaccacgagaacagctcgc

SEQ ID NO: 184262 - DNA, 20 bp, Artificial Sequence
  Synthetic oligonucleotide; GGG chr2 60461323 60461342 60461326 -
caccacgagaacagctcgcg

SEQ ID NO: 184263 - DNA, 20 bp, Artificial Sequence
  Synthetic oligonucleotide; CGG chr2 60461318 60461337 60461321 -
cgagaacagctcgcggggcg

SEQ ID NO: 184264 - DNA, 20 bp, Artificial Sequence
  Synthetic oligonucleotide; TGG chr2 60461312 60461331 60461315 -
cagctcgcggggcgcggtcg

SEQ ID NO: 184265 - DNA, 20 bp, Artificial Sequence
  Synthetic oligonucleotide; GGG chr2 60461311 60461330 60461314 -
agctcgcggggcgcggtcgt

SEQ ID NO: 184266 - DNA, 20 bp, Artificial Sequence
  Synthetic oligonucleotide; TGG chr2 60461306 60461325 60461309 -
gcggggcgcggtcgtgggcg

SEQ ID NO: 184267 - DNA, 20 bp, Artificial Sequence
  Synthetic oligonucleotide; GGG chr2 60461305 60461324 60461308 -
cggggcgcggtcgtgggcgt

SEQ ID NO: 184268 - DNA, 20 bp, Artificial Sequence
  Synthetic oligonucleotide; GAG chr2 60461298 60461317 60461301 -
cggtcgtgggcgtgggcgac

SEQ ID NO: 184269 - DNA, 20 bp, Artificial Sequence
  Synthetic oligonucleotide; GAG chr2 60461296 60461315 60461299 -
gtcgtgggcgtgggcgacga

SEQ ID NO: 184270 - DNA, 20 bp, Artificial Sequence
  Synthetic oligonucleotide; CAG chr2 60461271 60461290 60461274 -
gcgccctgcccgacgtcatg

SEQ ID NO: 184271 - DNA, 20 bp, Artificial Sequence
  Synthetic oligonucleotide; AGG chr2 60461270 60461289 60461273 -
cgccctgcccgacgtcatgc

SEQ ID NO: 184272 - DNA, 20 bp, Artificial Sequence
  Synthetic oligonucleotide; GGG chr2 60461269 60461288 60461272 -
gccctgcccgacgtcatgca

SEQ ID NO: 184273 - DNA, 20 bp, Artificial Sequence
  Synthetic oligonucleotide; TGG chr2 60461264 60461283 60461267 -
gcccgacgtcatgcagggca

SEQ ID NO: 184274 - DNA, 20 bp, Artificial Sequence
  Synthetic oligonucleotide; CAG chr2 60461257 60461276 60461260 -
gtcatgcagggcatggtgct

SEQ ID NO: 184275 - DNA, 20 bp, Artificial Sequence
  Synthetic oligonucleotide; CAG chr2 60461247 60461266 60461250 -
gcatggtgctcagctccatg

SEQ ID NO: 184276 - DNA, 20 bp, Artificial Sequence
  Synthetic oligonucleotide; CAG chr2 60461239 60461258 60461242 -
ctcagctccatgcagcactt

SEQ ID NO: 184277 - DNA, 20 bp, Artificial Sequence
  Synthetic oligonucleotide; GAG chr2 60461235 60461254 60461238 -
gctccatgcagcacttcagc

SEQ ID NO: 184278 - DNA, 20 bp, Artificial Sequence
  Synthetic oligonucleotide; AGG chr2 60461234 60461253 60461237 -
ctccatgcagcacttcagcg

SEQ ID NO: 184279 - DNA, 20 bp, Artificial Sequence
  Synthetic oligonucleotide; CAG chr2 60461223 60461242 60461226 -
acttcagcgaggccttccac

SEQ ID NO: 184280 - DNA, 20 bp, Artificial Sequence
  Synthetic oligonucleotide; AGG chr2 60461222 60461241 60461225 -
cttcagcgaggccttccacc

SEQ ID NO: 184281 - DNA, 20 bp, Artificial Sequence
  Synthetic oligonucleotide; TGG chr2 60461216 60461235 60461219 -
cgaggccttccaccaggtcc

SEQ ID NO: 184282 - DNA, 20 bp, Artificial Sequence
  Synthetic oligonucleotide; GGG chr2 60461215 60461234 60461218 -
gaggccttccaccaggtcct

SEQ ID NO: 184283 - DNA, 20 bp, Artificial Sequence
  Synthetic oligonucleotide; GAG chr2 60461211 60461230 60461214 -
ccttccaccaggtcctgggc

SEQ ID NO: 184284 - DNA, 20 bp, Artificial Sequence
  Synthetic oligonucleotide; AAG chr2 60461208 60461227 60461211 -
tccaccaggtcctgggcgag

SEQ ID NO: 184285 - DNA, 20 bp, Artificial Sequence
  Synthetic oligonucleotide; AAG chr2 60461202 60461221 60461205 -
aggtcctgggcgagaagcat

SEQ ID NO: 184286 - DNA, 20 bp, Artificial Sequence
  Synthetic oligonucleotide; CGG chr2 60461197 60461216 60461200 -
ctgggcgagaagcataagcg

SEQ ID NO: 184287 - DNA, 20 bp, Artificial Sequence
  Synthetic oligonucleotide; TGG chr2 60461189 60461208 60461192 -
gaagcataagcgcggccacc

SEQ ID NO: 184288 - DNA, 20 bp, Artificial Sequence
  Synthetic oligonucleotide; GAG chr2 60461184 60461203 60461187 -
ataagcgcggccacctggcc

SEQ ID NO: 184289 - DNA, 20 bp, Artificial Sequence
  Synthetic oligonucleotide; AGG chr2 60461183 60461202 60461186 -
taagcgcggccacctggccg

SEQ ID NO: 184290 - DNA, 20 bp, Artificial Sequence
  Synthetic oligonucleotide; GAG chr2 60461178 60461197 60461181 -
gcggccacctggccgaggcc

SEQ ID NO: 184291 - DNA, 20 bp, Artificial Sequence
  Synthetic oligonucleotide; AGG chr2 60461177 60461196 60461180 -
cggccacctggccgaggccg

SEQ ID NO: 184292 - DNA, 20 bp, Artificial Sequence
  Synthetic oligonucleotide; GGG chr2 60461176 60461195 60461179 -
ggccacctggccgaggccga

SEQ ID NO: 184293 - DNA, 20 bp, Artificial Sequence
  Synthetic oligonucleotide; CAG chr2 60461170 60461189 60461173 -
ctggccgaggccgagggcca

SEQ ID NO: 184294 - DNA, 20 bp, Artificial Sequence
  Synthetic oligonucleotide; AGG chr2 60461169 60461188 60461172 -
tggccgaggccgagggccac

SEQ ID NO: 184295 - DNA, 20 bp, Artificial Sequence
  Synthetic oligonucleotide; GGG chr2 60461168 60461187 60461171 -
ggccgaggccgagggccaca

SEQ ID NO: 184296 - DNA, 20 bp, Artificial Sequence
  Synthetic oligonucleotide; AAG chr2 60461153 60461172 60461156 -
ccacagggacacttgcgacg

SEQ ID NO: 184297 - DNA, 20 bp, Artificial Sequence
  Synthetic oligonucleotide; CGG chr2 60461147 60461166 60461150 -
ggacacttgcgacgaagact

SEQ ID NO: 184298 - DNA, 20 bp, Artificial Sequence
  Synthetic oligonucleotide; TGG chr2 60461144 60461163 60461147 -
cacttgcgacgaagactcgg

SEQ ID NO: 184299 - DNA, 20 bp, Artificial Sequence
  Synthetic oligonucleotide; CGG chr2 60461140 60461159 60461143 -
tgcgacgaagactcggtggc

SEQ ID NO: 184300 - DNA, 20 bp, Artificial Sequence
  Synthetic oligonucleotide; GAG chr2 60461136 60461155 60461139 -
acgaagactcggtggccggc

SEQ ID NO: 184301 - DNA, 20 bp, Artificial Sequence
  Synthetic oligonucleotide; CGG chr2 60461132 60461151 60461135 -
agactcggtggccggcgagt

SEQ ID NO: 184302 - DNA, 20 bp, Artificial Sequence
  Synthetic oligonucleotide; TAG chr2 60461123 60461142 60461126 -
ggccggcgagtcggaccgca

SEQ ID NO: 184303 - DNA, 20 bp, Artificial Sequence
  Synthetic oligonucleotide; TGG chr2 60461116 60461135 60461119 -
gagtcggaccgcatagacga

SEQ ID NO: 184304 - DNA, 20 bp, Artificial Sequence
  Synthetic oligonucleotide; TGG chr2 60461104 60461123 60461107 -
atagacgatggcactgttaa

SEQ ID NO: 184305 - DNA, 20 bp, Artificial Sequence
  Synthetic oligonucleotide; CGG chr2 60461098 60461117 60461101 -
gatggcactgttaatggccg

SEQ ID NO: 184306 - DNA, 20 bp, Artificial Sequence
  Synthetic oligonucleotide; CGG chr2 60461087 60461106 60461090 -
taatggccgcggctgctccc

SEQ ID NO: 184307 - DNA, 20 bp, Artificial Sequence
  Synthetic oligonucleotide; GGG chr2 60461086 60461105 60461089 -
aatggccgcggctgctcccc

SEQ ID NO: 184308 - DNA, 20 bp, Artificial Sequence
  Synthetic oligonucleotide; GAG chr2 60461082 60461101 60461085 -
gccgcggctgctccccgggc

SEQ ID NO: 184309 - DNA, 20 bp, Artificial Sequence
  Synthetic oligonucleotide; CGG chr2 60461078 60461097 60461081 -
cggctgctccccgggcgagt

SEQ ID NO: 184310 - DNA, 20 bp, Artificial Sequence
  Synthetic oligonucleotide; CGG chr2 60461072 60461091 60461075 -
ctccccgggcgagtcggcct

SEQ ID NO: 184311 - DNA, 20 bp, Artificial Sequence
  Synthetic oligonucleotide; GGG chr2 60461071 60461090 60461074 -
tccccgggcgagtcggcctc

SEQ ID NO: 184312 - DNA, 20 bp, Artificial Sequence
  Synthetic oligonucleotide; GGG chr2 60461070 60461089 60461073 -
ccccgggcgagtcggcctcg

SEQ ID NO: 184313 - DNA, 20 bp, Artificial Sequence
  Synthetic oligonucleotide; GGG chr2 60461069 60461088 60461072 -
cccgggcgagtcggcctcgg

SEQ ID NO: 184314 - DNA, 20 bp, Artificial Sequence
  Synthetic oligonucleotide; GGG chr2 60461068 60461087 60461071 -
ccgggcgagtcggcctcggg

SEQ ID NO: 184315 - DNA, 20 bp, Artificial Sequence
  Synthetic oligonucleotide; AAG chr2 60461055 60461074 60461058 -
cctcggggggcctgtccaaa

SEQ ID NO: 184316 - DNA, 20 bp, Artificial Sequence
  Synthetic oligonucleotide; TGG chr2 60461045 60461064 60461048 -
cctgtccaaaaagctgctgc

SEQ ID NO: 184317 - DNA, 20 bp, Artificial Sequence
  Synthetic oligonucleotide; GGG chr2 60461044 60461063 60461047 -
ctgtccaaaaagctgctgct

SEQ ID NO: 184318 - DNA, 20 bp, Artificial Sequence
  Synthetic oligonucleotide; CAG chr2 60461041 60461060 60461044 -
tccaaaaagctgctgctggg

SEQ ID NO: 184319 - DNA, 20 bp, Artificial Sequence
  Synthetic oligonucleotide; CAG chr2 60461035 60461054 60461038 -
aagctgctgctgggcagccc

SEQ ID NO: 184320 - DNA, 20 bp, Artificial Sequence
  Synthetic oligonucleotide; GAG chr2 60461026 60461045 60461029 -
ctgggcagccccagctcgct

SEQ ID NO: 184321 - DNA, 20 bp, Artificial Sequence
  Synthetic oligonucleotide; AAG chr2 60461013 60461032 60461016 -
gctcgctgagccccttctct

SEQ ID NO: 184322 - DNA, 20 bp, Artificial Sequence
  Synthetic oligonucleotide; AAG chr2 60461004 60461023 60461007 -
gccccttctctaagcgcatc

SEQ ID NO: 184323 - DNA, 20 bp, Artificial Sequence
  Synthetic oligonucleotide; GAG chr2 60460998 60461017 60461001 -
tctctaagcgcatcaagctc

SEQ ID NO: 184324 - DNA, 20 bp, Artificial Sequence
  Synthetic oligonucleotide; AAG chr2 60460995 60461014 60460998 -
ctaagcgcatcaagctcgag

SEQ ID NO: 184325 - DNA, 20 bp, Artificial Sequence
  Synthetic oligonucleotide; AGG chr2 60460994 60461013 60460997 -
taagcgcatcaagctcgaga

SEQ ID NO: 184326 - DNA, 20 bp, Artificial Sequence
  Synthetic oligonucleotide; GAG chr2 60460992 60461011 60460995 -
agcgcatcaagctcgagaag

SEQ ID NO: 184327 - DNA, 20 bp, Artificial Sequence
  Synthetic oligonucleotide; CGG chr2 60460976 60460995 60460979 -
gaaggagttcgacctgcccc

SEQ ID NO: 184328 - DNA, 20 bp, Artificial Sequence
  Synthetic oligonucleotide; CGG chr2 60460958 60460977 60460961 -
cccggccgcgatgcccaaca

SEQ ID NO: 184329 - DNA, 20 bp, Artificial Sequence
  Synthetic oligonucleotide; GAG chr2 60460956 60460975 60460959 -
cggccgcgatgcccaacacg

SEQ ID NO: 184330 - DNA, 20 bp, Artificial Sequence
  Synthetic oligonucleotide; CAG chr2 60460941 60460960 60460944 -
acacggagaacgtgtactcg

SEQ ID NO: 184331 - DNA, 20 bp, Artificial Sequence
  Synthetic oligonucleotide; TGG chr2 60460938 60460957 60460941 -
cggagaacgtgtactcgcag

SEQ ID NO: 184332 - DNA, 20 bp, Artificial Sequence
  Synthetic oligonucleotide; CGG chr2 60460930 60460949 60460933 -
gtgtactcgcagtggctcgc

SEQ ID NO: 184333 - DNA, 20 bp, Artificial Sequence
  Synthetic oligonucleotide; CGG chr2 60460922 60460941 60460925 -
gcagtggctcgccggctacg

SEQ ID NO: 184334 - DNA, 20 bp, Artificial Sequence
  Synthetic oligonucleotide; CAG chr2 60460915 60460934 60460918 -
ctcgccggctacgcggcctc

SEQ ID NO: 184335 - DNA, 20 bp, Artificial Sequence
  Synthetic oligonucleotide; AGG chr2 60460914 60460933 60460917 -
tcgccggctacgcggcctcc

SEQ ID NO: 184336 - DNA, 20 bp, Artificial Sequence
  Synthetic oligonucleotide; CAG chr2 60460911 60460930 60460914 -
ccggctacgcggcctccagg

SEQ ID NO: 184337 - DNA, 20 bp, Artificial Sequence
  Synthetic oligonucleotide; AAG chr2 60460904 60460923 60460907 -
cgcggcctccaggcagctca

SEQ ID NO: 184338 - DNA, 20 bp, Artificial Sequence
  Synthetic oligonucleotide; TAG chr2 60460891 60460910 60460894 -
cagctcaaagatcccttcct

SEQ ID NO: 184339 - DNA, 20 bp, Artificial Sequence
  Synthetic oligonucleotide; CGG chr2 60460885 60460904 60460888 -
aaagatcccttccttagctt

SEQ ID NO: 184340 - DNA, 20 bp, Artificial Sequence
  Synthetic oligonucleotide; GAG chr2 60460883 60460902 60460886 -
agatcccttccttagcttcg

SEQ ID NO: 184341 - DNA, 20 bp, Artificial Sequence
  Synthetic oligonucleotide; CAG chr2 60460876 60460895 60460879 -
ttccttagcttcggagactc

SEQ ID NO: 184342 - DNA, 20 bp, Artificial Sequence
  Synthetic oligonucleotide; CGG chr2 60460850 60460869 60460853 -
atcgccttttgcctcctcgt

SEQ ID NO: 184343 - DNA, 20 bp, Artificial Sequence
  Synthetic oligonucleotide; GAG chr2 60460848 60460867 60460851 -
cgccttttgcctcctcgtcg

SEQ ID NO: 184344 - DNA, 20 bp, Artificial Sequence
  Synthetic oligonucleotide; CGG chr2 60460838 60460857 60460841 -
ctcctcgtcggagcactcct

SEQ ID NO: 184345 - DNA, 20 bp, Artificial Sequence
  Synthetic oligonucleotide; GAG chr2 60460836 60460855 60460839 -
cctcgtcggagcactcctcg

SEQ ID NO: 184346 - DNA, 20 bp, Artificial Sequence
  Synthetic oligonucleotide; CGG chr2 60460831 60460850 60460834 -
tcggagcactcctcggagaa

SEQ ID NO: 184347 - DNA, 20 bp, Artificial Sequence
  Synthetic oligonucleotide; GGG chr2 60460830 60460849 60460833 -
cggagcactcctcggagaac

SEQ ID NO: 184348 - DNA, 20 bp, Artificial Sequence
  Synthetic oligonucleotide; GAG chr2 60460828 60460847 60460831 -
gagcactcctcggagaacgg

SEQ ID NO: 184349 - DNA, 20 bp, Artificial Sequence
  Synthetic oligonucleotide; CGG chr2 60460804 60460823 60460807 -
ttgcgcttctccacaccgcc

SEQ ID NO: 184350 - DNA, 20 bp, Artificial Sequence
  Synthetic oligonucleotide; GGG chr2 60460803 60460822 60460806 -
tgcgcttctccacaccgccc

SEQ ID NO: 184351 - DNA, 20 bp, Artificial Sequence
  Synthetic oligonucleotide; GGG chr2 60460802 60460821 60460805 -
gcgcttctccacaccgcccg

SEQ ID NO: 184352 - DNA, 20 bp, Artificial Sequence
  Synthetic oligonucleotide; GAG chr2 60460800 60460819 60460803 -
gcttctccacaccgcccggg

SEQ ID NO: 184353 - DNA, 20 bp, Artificial Sequence
  Synthetic oligonucleotide; TGG chr2 60460796 60460815 60460799 -
ctccacaccgcccggggagc

SEQ ID NO: 184354 - DNA, 20 bp, Artificial Sequence
  Synthetic oligonucleotide; CGG chr2 60460792 60460811 60460795 -
acaccgcccggggagctgga

SEQ ID NO: 184355 - DNA, 20 bp, Artificial Sequence
  Synthetic oligonucleotide; GAG chr2 60460790 60460809 60460793 -
accgcccggggagctggacg

SEQ ID NO: 184356 - DNA, 20 bp, Artificial Sequence
  Synthetic oligonucleotide; AGG chr2 60460789 60460808 60460792 -
ccgcccggggagctggacgg

SEQ ID NO: 184357 - DNA, 20 bp, Artificial Sequence
  Synthetic oligonucleotide; GGG chr2 60460788 60460807 60460791 -
cgcccggggagctggacgga

SEQ ID NO: 184358 - DNA, 20 bp, Artificial Sequence
  Synthetic oligonucleotide; CGG chr2 60460781 60460800 60460784 -
ggagctggacggagggatct

SEQ ID NO: 184359 - DNA, 20 bp, Artificial Sequence
  Synthetic oligonucleotide; GGG chr2 60460780 60460799 60460783 -
gagctggacggagggatctc

SEQ ID NO: 184360 - DNA, 20 bp, Artificial Sequence
  Synthetic oligonucleotide; GGG chr2 60460779 60460798 60460782 -
agctggacggagggatctcg

SEQ ID NO: 184361 - DNA, 20 bp, Artificial Sequence
  Synthetic oligonucleotide; CAG chr2 60460774 60460793 60460777 -
gacggagggatctcggggcg

SEQ ID NO: 184362 - DNA, 20 bp, Artificial Sequence
  Synthetic oligonucleotide; CGG chr2 60460771 60460790 60460774 -
ggagggatctcggggcgcag

SEQ ID NO: 184363 - DNA, 20 bp, Artificial Sequence
  Synthetic oligonucleotide; CGG chr2 60460766 60460785 60460769 -
gatctcggggcgcagcggca

SEQ ID NO: 184364 - DNA, 20 bp, Artificial Sequence
  Synthetic oligonucleotide; GGG chr2 60460765 60460784 60460768 -
atctcggggcgcagcggcac

SEQ ID NO: 184365 - DNA, 20 bp, Artificial Sequence
  Synthetic oligonucleotide; AAG chr2 60460762 60460781 60460765 -
tcggggcgcagcggcacggg

SEQ ID NO: 184366 - DNA, 20 bp, Artificial Sequence
  Synthetic oligonucleotide; TGG chr2 60460759 60460778 60460762 -
gggcgcagcggcacgggaag

SEQ ID NO: 184367 - DNA, 20 bp, Artificial Sequence
  Synthetic oligonucleotide; GAG chr2 60460757 60460776 60460760 -
gcgcagcggcacgggaagtg

SEQ ID NO: 184368 - DNA, 20 bp, Artificial Sequence
  Synthetic oligonucleotide; AGG chr2 60460756 60460775 60460759 -
cgcagcggcacgggaagtgg

SEQ ID NO: 184369 - DNA, 20 bp, Artificial Sequence
  Synthetic oligonucleotide; GGG chr2 60460755 60460774 60460758 -
gcagcggcacgggaagtgga

SEQ ID NO: 184370 - DNA, 20 bp, Artificial Sequence
  Synthetic oligonucleotide; GAG chr2 60460753 60460772 60460756 -
agcggcacgggaagtggagg

SEQ ID NO: 184371 - DNA, 20 bp, Artificial Sequence
  Synthetic oligonucleotide; TAG chr2 60460738 60460757 60460741 -
ggagggagcacgccccatat

SEQ ID NO: 184372 - DNA, 20 bp, Artificial Sequence
  Synthetic oligonucleotide; TGG chr2 60460735 60460754 60460738 -
gggagcacgccccatattag

SEQ ID NO: 184373 - DNA, 20 bp, Artificial Sequence
  Synthetic oligonucleotide; CGG chr2 60460730 60460749 60460733 -
cacgccccatattagtggtc

SEQ ID NO: 184374 - DNA, 20 bp, Artificial Sequence
  Synthetic oligonucleotide; GGG chr2 60460729 60460748 60460732 -
acgccccatattagtggtcc

SEQ ID NO: 184375 - DNA, 20 bp, Artificial Sequence
  Synthetic oligonucleotide; CGG chr2 60460724 60460743 60460727 -
ccatattagtggtccgggcc

SEQ ID NO: 184376 - DNA, 20 bp, Artificial Sequence
  Synthetic oligonucleotide; GGG chr2 60460723 60460742 60460726 -
catattagtggtccgggccc

SEQ ID NO: 184377 - DNA, 20 bp, Artificial Sequence
  Synthetic oligonucleotide; CAG chr2 60460720 60460739 60460723 -
attagtggtccgggcccggg

SEQ ID NO: 184378 - DNA, 20 bp, Artificial Sequence
  Synthetic oligonucleotide; AGG chr2 60460719 60460738 60460722 -
ttagtggtccgggcccgggc

SEQ ID NO: 184379 - DNA, 20 bp, Artificial Sequence
  Synthetic oligonucleotide; CAG chr2 60460714 60460733 60460717 -
ggtccgggcccgggcaggcc

SEQ ID NO: 184380 - DNA, 20 bp, Artificial Sequence
  Synthetic oligonucleotide; AAG chr2 60460706 60460725 60460709 -
cccgggcaggcccagctcaa

SEQ ID NO: 184381 - DNA, 20 bp, Artificial Sequence
  Synthetic oligonucleotide; GAG chr2 60460704 60460723 60460707 -
cgggcaggcccagctcaaaa

SEQ ID NO: 184382 - DNA, 20 bp, Artificial Sequence
  Synthetic oligonucleotide; AGG chr2 60460703 60460722 60460706 -
gggcaggcccagctcaaaag

SEQ ID NO: 184383 - DNA, 20 bp, Artificial Sequence
  Synthetic oligonucleotide; GGG chr2 60460702 60460721 60460705 -
ggcaggcccagctcaaaaga

SEQ ID NO: 184384 - DNA, 20 bp, Artificial Sequence
  Synthetic oligonucleotide; CAG chr2 60460699 60460718 60460702 -
aggcccagctcaaaagaggg

SEQ ID NO: 184385 - DNA, 20 bp, Artificial Sequence
  Synthetic oligonucleotide; CAG chr2 60460693 60460712 60460696 -
agctcaaaagagggcagacg

SEQ ID NO: 184386 - DNA, 20 bp, Artificial Sequence
  Synthetic oligonucleotide; GAG chr2 60460680 60460699 60460683 -
gcagacgcagcgacacttgt

SEQ ID NO: 184387 - DNA, 20 bp, Artificial Sequence
  Synthetic oligonucleotide; TGG chr2 60460672 60460691 60460675 -
agcgacacttgtgagtactg

SEQ ID NO: 184388 - DNA, 20 bp, Artificial Sequence
  Synthetic oligonucleotide; GGG chr2 60460671 60460690 60460674 -
gcgacacttgtgagtactgt

SEQ ID NO: 184389 - DNA, 20 bp, Artificial Sequence
  Synthetic oligonucleotide; AAG chr2 60460667 60460686 60460670 -
cacttgtgagtactgtggga

SEQ ID NO: 184390 - DNA, 20 bp, Artificial Sequence
  Synthetic oligonucleotide; AAG chr2 60460659 60460678 60460662 -
agtactgtgggaaagtcttc

SEQ ID NO: 184391 - DNA, 20 bp, Artificial Sequence
  Synthetic oligonucleotide; TAG chr2 60460651 60460670 60460654 -
gggaaagtcttcaagaactg

SEQ ID NO: 184392 - DNA, 20 bp, Artificial Sequence
  Synthetic oligonucleotide; CAG chr2 60460633 60460652 60460636 -
tgtagcaatctcactgtcca

SEQ ID NO: 184393 - DNA, 20 bp, Artificial Sequence
  Synthetic oligonucleotide; AGG chr2 60460632 60460651 60460635 -
gtagcaatctcactgtccac

SEQ ID NO: 184394 - DNA, 20 bp, Artificial Sequence
  Synthetic oligonucleotide; GAG chr2 60460630 60460649 60460633 -
agcaatctcactgtccacag

SEQ ID NO: 184395 - DNA, 20 bp, Artificial Sequence
  Synthetic oligonucleotide; AAG chr2 60460627 60460646 60460630 -
aatctcactgtccacaggag

SEQ ID NO: 184396 - DNA, 20 bp, Artificial Sequence
  Synthetic oligonucleotide; CGG chr2 60460619 60460638 60460622 -
tgtccacaggagaagccaca

SEQ ID NO: 184397 - DNA, 20 bp, Artificial Sequence
  Synthetic oligonucleotide; GGG chr2 60460618 60460637 60460621 -
gtccacaggagaagccacac

SEQ ID NO: 184398 - DNA, 20 bp, Artificial Sequence
  Synthetic oligonucleotide; AAG chr2 60460612 60460631 60460615 -
aggagaagccacacgggcga

SEQ ID NO: 184399 - DNA, 20 bp, Artificial Sequence
  Synthetic oligonucleotide; AGG chr2 60460611 60460630 60460614 -
ggagaagccacacgggcgaa

SEQ ID NO: 184400 - DNA, 20 bp, Artificial Sequence
  Synthetic oligonucleotide; GAG chr2 60460596 60460615 60460599 -
gcgaaaggccttataaatgc

SEQ ID NO: 184401 - DNA, 20 bp, Artificial Sequence
  Synthetic oligonucleotide; CAG chr2 60460572 60460591 60460575 -
tgtgcaactatgcctgtgcc

SEQ ID NO: 184402 - DNA, 20 bp, Artificial Sequence
  Synthetic oligonucleotide; GAG chr2 60460570 60460589 60460573 -
tgcaactatgcctgtgccca

SEQ ID NO: 184403 - DNA, 20 bp, Artificial Sequence
  Synthetic oligonucleotide; TAG chr2 60460567 60460586 60460570 -
aactatgcctgtgcccagag

SEQ ID NO: 184404 - DNA, 20 bp, Artificial Sequence
  Synthetic oligonucleotide; AAG chr2 60460563 60460582 60460566 -
atgcctgtgcccagagtagc

SEQ ID NO: 184405 - DNA, 20 bp, Artificial Sequence
  Synthetic oligonucleotide; CAG chr2 60460555 60460574 60460558 -
gcccagagtagcaagctcac

SEQ ID NO: 184406 - DNA, 20 bp, Artificial Sequence
  Synthetic oligonucleotide; AGG chr2 60460554 60460573 60460557 -
cccagagtagcaagctcacc

SEQ ID NO: 184407 - DNA, 20 bp, Artificial Sequence
  Synthetic oligonucleotide; TGG chr2 60460537 60460556 60460540 -
accaggcacatgaaaacgca

SEQ ID NO: 184408 - DNA, 20 bp, Artificial Sequence
  Synthetic oligonucleotide; CAG chr2 60460533 60460552 60460536 -
ggcacatgaaaacgcatggc

SEQ ID NO: 184409 - DNA, 20 bp, Artificial Sequence
  Synthetic oligonucleotide; AGG chr2 60460532 60460551 60460535 -
gcacatgaaaacgcatggcc

SEQ ID NO: 184410 - DNA, 20 bp, Artificial Sequence
  Synthetic oligonucleotide; TGG chr2 60460529 60460548 60460532 -
catgaaaacgcatggccagg

SEQ ID NO: 184411 - DNA, 20 bp, Artificial Sequence
  Synthetic oligonucleotide; GGG chr2 60460528 60460547 60460531 -
atgaaaacgcatggccaggt

SEQ ID NO: 184412 - DNA, 20 bp, Artificial Sequence
  Synthetic oligonucleotide; GGG chr2 60460527 60460546 60460530 -
tgaaaacgcatggccaggtg

SEQ ID NO: 184413 - DNA, 20 bp, Artificial Sequence
  Synthetic oligonucleotide; AAG chr2 60460524 60460543 60460527 -
aaacgcatggccaggtgggg

SEQ ID NO: 184414 - DNA, 20 bp, Artificial Sequence
  Synthetic oligonucleotide; AGG chr2 60460523 60460542 60460526 -
aacgcatggccaggtgggga

SEQ ID NO: 184415 - DNA, 20 bp, Artificial Sequence
  Synthetic oligonucleotide; AAG chr2 60460497 60460516 60460500 -
tttacaaatgtgaaatttgt

SEQ ID NO: 184416 - DNA, 20 bp, Artificial Sequence
  Synthetic oligonucleotide; TAG chr2 60460486 60460505 60460489 -
gaaatttgtaagatgccttt

SEQ ID NO: 184417 - DNA, 20 bp, Artificial Sequence
  Synthetic oligonucleotide; CAG chr2 60460477 60460496 60460480 -
aagatgccttttagcgtgta

SEQ ID NO: 184418 - DNA, 20 bp, Artificial Sequence
  Synthetic oligonucleotide; TGG chr2 60460469 60460488 60460472 -
ttttagcgtgtacagtaccc

SEQ ID NO: 184419 - DNA, 20 bp, Artificial Sequence
  Synthetic oligonucleotide; GAG chr2 60460467 60460486 60460470 -
ttagcgtgtacagtaccctg

SEQ ID NO: 184420 - DNA, 20 bp, Artificial Sequence
  Synthetic oligonucleotide; TGG chr2 60460449 60460468 60460452 -
tggagaaacacatgaaaaaa

SEQ ID NO: 184421 - DNA, 20 bp, Artificial Sequence
  Synthetic oligonucleotide; CAG chr2 60460444 60460463 60460447 -
aaacacatgaaaaaatggca

SEQ ID NO: 184422 - DNA, 20 bp, Artificial Sequence
  Synthetic oligonucleotide; GAG chr2 60460436 60460455 60460439 -
gaaaaaatggcacagtgatc

SEQ ID NO: 184423 - DNA, 20 bp, Artificial Sequence
  Synthetic oligonucleotide; TAG chr2 60460407 60460426 60460410 -
ataatgatataaaaactgaa

SEQ ID NO: 184424 - DNA, 20 bp, Artificial Sequence
  Synthetic oligonucleotide; GAG chr2 60460405 60460424 60460408 -
aatgatataaaaactgaata

SEQ ID NO: 184425 - DNA, 20 bp, Artificial Sequence
  Synthetic oligonucleotide; AGG chr2 60460404 60460423 60460407 -
atgatataaaaactgaatag

SEQ ID NO: 184426 - DNA, 20 bp, Artificial Sequence
  Synthetic oligonucleotide; CAG chr2 60460331 60460350 60460334 -
tccccttccccatcgccctc

SEQ ID NO: 184427 - DNA, 20 bp, Artificial Sequence
  Synthetic oligonucleotide; TAG chr2 60460316 60460335 60460319 -
ccctccagccccactccctg

SEQ ID NO: 184428 - DNA, 20 bp, Artificial Sequence
  Synthetic oligonucleotide; AGG chr2 60460315 60460334 60460318 -
cctccagccccactccctgt

SEQ ID NO: 184429 - DNA, 20 bp, Artificial Sequence
  Synthetic oligonucleotide; TAG chr2 60460303 60460322 60460306 -
ctccctgtaggatttttttc

SEQ ID NO: 184430 - DNA, 20 bp, Artificial Sequence
  Synthetic oligonucleotide; CAG chr2 60460268 60460287 60460271 -
taaacaaacaaacaaacaaa

SEQ ID NO: 184431 - DNA, 20 bp, Artificial Sequence
  Synthetic oligonucleotide; AAG chr2 60460265 60460284 60460268 -
acaaacaaacaaacaaacag

SEQ ID NO: 184432 - DNA, 20 bp, Artificial Sequence
  Synthetic oligonucleotide; AAG chr2 60460257 60460276 60460260 -
acaaacaaacagaagtaacg

SEQ ID NO: 184433 - DNA, 20 bp, Artificial Sequence
  Synthetic oligonucleotide; AAG chr2 60460252 60460271 60460255 -
caaacagaagtaacgaagct

SEQ ID NO: 184434 - DNA, 20 bp, Artificial Sequence
  Synthetic oligonucleotide; GAG chr2 60460244 60460263 60460247 -
agtaacgaagctaagaatat

SEQ ID NO: 184435 - DNA, 20 bp, Artificial Sequence
  Synthetic oligonucleotide; GAG chr2 60460242 60460261 60460245 -
taacgaagctaagaatatga

SEQ ID NO: 184436 - DNA, 20 bp, Artificial Sequence
  Synthetic oligonucleotide; CAG chr2 60460229 60460248 60460232 -
aatatgagagtgcttgtcac

SEQ ID NO: 184437 - DNA, 20 bp, Artificial Sequence
  Synthetic oligonucleotide; TGG chr2 60460133 60460152 60460136 -
gtttgaatgcatgatctgta

SEQ ID NO: 184438 - DNA, 20 bp, Artificial Sequence
  Synthetic oligonucleotide; GGG chr2 60460132 60460151 60460135 -
tttgaatgcatgatctgtat

SEQ ID NO: 184439 - DNA, 20 bp, Artificial Sequence
  Synthetic oligonucleotide; GGG chr2 60460131 60460150 60460134 -
ttgaatgcatgatctgtatg

SEQ ID NO: 184440 - DNA, 20 bp, Artificial Sequence
  Synthetic oligonucleotide; GAG chr2 60460100 60460119 60460103 -
ttgcattttacgcaaacttt

SEQ ID NO: 184441 - DNA, 20 bp, Artificial Sequence
  Synthetic oligonucleotide; TAG chr2 60460047 60460066 60460050 -
tgtatgtttttttttaaact

SEQ ID NO: 184442 - DNA, 20 bp, Artificial Sequence
  Synthetic oligonucleotide; CAG chr2 60460043 60460062 60460046 -
tgtttttttttaaacttaga

SEQ ID NO: 184443 - DNA, 20 bp, Artificial Sequence
  Synthetic oligonucleotide; TGG chr2 60460034 60460053 60460037 -
ttaaacttagacagcatgta

SEQ ID NO: 184444 - DNA, 20 bp, Artificial Sequence
  Synthetic oligonucleotide; TGG chr2 60460024 60460043 60460027 -
acagcatgtatggtatgtta

SEQ ID NO: 184445 - DNA, 20 bp, Artificial Sequence
  Synthetic oligonucleotide; GAG chr2 60459992 60460011 60459995 -
attgtccctaattcgttgct

SEQ ID NO: 184446 - DNA, 20 bp, Artificial Sequence
  Synthetic oligonucleotide; CAG chr2 60459971 60459990 60459974 -
agcaaacatgttgctgtttc

SEQ ID NO: 184447 - DNA, 20 bp, Artificial Sequence
  Synthetic oligonucleotide; GAG chr2 60459959 60459978 60459962 -
gctgtttccagttccgttct

SEQ ID NO: 184448 - DNA, 20 bp, Artificial Sequence
  Synthetic oligonucleotide; GAG chr2 60459957 60459976 60459960 -
tgtttccagttccgttctga

SEQ ID NO: 184449 - DNA, 20 bp, Artificial Sequence
  Synthetic oligonucleotide; AAG chr2 60459951 60459970 60459954 -
cagttccgttctgagagaaa

SEQ ID NO: 184450 - DNA, 20 bp, Artificial Sequence
  Synthetic oligonucleotide; GAG chr2 60459949 60459968 60459952 -
gttccgttctgagagaaaaa

SEQ ID NO: 184451 - DNA, 20 bp, Artificial Sequence
  Synthetic oligonucleotide; GAG chr2 60459947 60459966 60459950 -
tccgttctgagagaaaaaga

SEQ ID NO: 184452 - DNA, 20 bp, Artificial Sequence
  Synthetic oligonucleotide; GAG chr2 60459945 60459964 60459948 -
cgttctgagagaaaaagaga

SEQ ID NO: 184453 - DNA, 20 bp, Artificial Sequence
  Synthetic oligonucleotide; GAG chr2 60459943 60459962 60459946 -
ttctgagagaaaaagagaga

SEQ ID NO: 184454 - DNA, 20 bp, Artificial Sequence
  Synthetic oligonucleotide; GAG chr2 60459941 60459960 60459944 -
ctgagagaaaaagagagaga

SEQ ID NO: 184455 - DNA, 20 bp, Artificial Sequence
  Synthetic oligonucleotide; GAG chr2 60459939 60459958 60459942 -
gagagaaaaagagagagaga

SEQ ID NO: 184456 - DNA, 20 bp, Artificial Sequence
  Synthetic oligonucleotide; AAG chr2 60459933 60459952 60459936 -
aaaagagagagagagagaaa

SEQ ID NO: 184457 - DNA, 20 bp, Artificial Sequence
  Synthetic oligonucleotide; CAG chr2 60459894 60459913 60459897 -
tctgtaatacatatcatgta

SEQ ID NO: 184458 - DNA, 20 bp, Artificial Sequence
  Synthetic oligonucleotide; GAG chr2 60459875 60459894 60459878 -
acagttttattttataacgt

SEQ ID NO: 184459 - DNA, 20 bp, Artificial Sequence
  Synthetic oligonucleotide; AGG chr2 60459874 60459893 60459877 -
cagttttattttataacgtg

SEQ ID NO: 184460 - DNA, 20 bp, Artificial Sequence
  Synthetic oligonucleotide; GAG chr2 60459872 60459891 60459875 -
gttttattttataacgtgag

SEQ ID NO: 184461 - DNA, 20 bp, Artificial Sequence
  Synthetic oligonucleotide; AGG chr2 60459871 60459890 60459874 -
ttttattttataacgtgagg

SEQ ID NO: 184462 - DNA, 20 bp, Artificial Sequence
  Synthetic oligonucleotide; CAG chr2 60459863 60459882 60459866 -
tataacgtgaggaggaaaaa

SEQ ID NO: 184463 - DNA, 20 bp, Artificial Sequence
  Synthetic oligonucleotide; TGG chr2 60459856 60459875 60459859 -
tgaggaggaaaaacagtctt

SEQ ID NO: 184464 - DNA, 20 bp, Artificial Sequence
  Synthetic oligonucleotide; TAG chr2 60459841 60459860 60459844 -
gtctttggattaaccctcta

SEQ ID NO: 184465 - DNA, 20 bp, Artificial Sequence
  Synthetic oligonucleotide; CAG chr2 60459837 60459856 60459840 -
ttggattaaccctctataga

SEQ ID NO: 184466 - DNA, 20 bp, Artificial Sequence
  Synthetic oligonucleotide; TAG chr2 60459832 60459851 60459835 -
ttaaccctctatagacagaa

SEQ ID NO: 184467 - DNA, 20 bp, Artificial Sequence
  Synthetic oligonucleotide; TAG chr2 60459828 60459847 60459831 -
ccctctatagacagaataga

SEQ ID NO: 184468 - DNA, 20 bp, Artificial Sequence
  Synthetic oligonucleotide; GAG chr2 60459805 60459824 60459808 -
cactgaaaaaaaatctctat

SEQ ID NO: 184469 - DNA, 20 bp, Artificial Sequence
  Synthetic oligonucleotide; AAG chr2 60459785 60459804 60459788 -
gagctaaatgtctgtctcta

SEQ ID NO: 184470 - DNA, 20 bp, Artificial Sequence
  Synthetic oligonucleotide; AGG chr2 60459784 60459803 60459787 -
agctaaatgtctgtctctaa

SEQ ID NO: 184471 - DNA, 20 bp, Artificial Sequence
  Synthetic oligonucleotide; GGG chr2 60459783 60459802 60459786 -
gctaaatgtctgtctctaaa

SEQ ID NO: 184472 - DNA, 20 bp, Artificial Sequence
  Synthetic oligonucleotide; TGG chr2 60459766 60459785 60459769 -
aaagggttaaatgtatcaat

SEQ ID NO: 184473 - DNA, 20 bp, Artificial Sequence
  Synthetic oligonucleotide; AAG chr2 60459762 60459781 60459765 -
ggttaaatgtatcaattgga

SEQ ID NO: 184474 - DNA, 20 bp, Artificial Sequence
  Synthetic oligonucleotide; AGG chr2 60459761 60459780 60459764 -
gttaaatgtatcaattggaa

SEQ ID NO: 184475 - DNA, 20 bp, Artificial Sequence
  Synthetic oligonucleotide; AAG chr2 60459758 60459777 60459761 -
aaatgtatcaattggaaagg

SEQ ID NO: 184476 - DNA, 20 bp, Artificial Sequence
  Synthetic oligonucleotide; AAG chr2 60459751 60459770 60459754 -
tcaattggaaaggaagaaaa

SEQ ID NO: 184477 - DNA, 20 bp, Artificial Sequence
  Synthetic oligonucleotide; AGG chr2 60459750 60459769 60459753 -
caattggaaaggaagaaaaa

SEQ ID NO: 184478 - DNA, 20 bp, Artificial Sequence
  Synthetic oligonucleotide; CAG chr2 60459728 60459747 60459731 -
gccttgaattgacaaattaa

SEQ ID NO: 184479 - DNA, 20 bp, Artificial Sequence
  Synthetic oligonucleotide; CAG chr2 60459720 60459739 60459723 -
ttgacaaattaacagaaaaa

SEQ ID NO: 184480 - DNA, 20 bp, Artificial Sequence
  Synthetic oligonucleotide; AAG chr2 60459714 60459733 60459717 -
aattaacagaaaaacagaac

SEQ ID NO: 184481 - DNA, 20 bp, Artificial Sequence
  Synthetic oligonucleotide; TGG chr2 60459697 60459716 60459700 -
aacaagtttattctatcatt

SEQ ID NO: 184482 - DNA, 20 bp, Artificial Sequence
  Synthetic oligonucleotide; GAG chr2 60459683 60459702 60459686 -
atcatttggttttaaaatat

SEQ ID NO: 184483 - DNA, 20 bp, Artificial Sequence
  Synthetic oligonucleotide; TGG chr2 60459675 60459694 60459678 -
gttttaaaatatgagtgcct

SEQ ID NO: 184484 - DNA, 20 bp, Artificial Sequence
  Synthetic oligonucleotide; TGG chr2 60459652 60459671 60459655 -
atctattaaaaccacatcga

SEQ ID NO: 184485 - DNA, 20 bp, Artificial Sequence
  Synthetic oligonucleotide; TAG chr2 60459625 60459644 60459628 -
ttctacttgttataaacttg

SEQ ID NO: 184486 - DNA, 20 bp, Artificial Sequence
  Synthetic oligonucleotide; CAG chr2 60459615 60459634 60459618 -
tataaacttgtagcttaatt

SEQ ID NO: 184487 - DNA, 20 bp, Artificial Sequence
  Synthetic oligonucleotide; TGG chr2 60459609 60459628 60459612 -
cttgtagcttaattcagcat

SEQ ID NO: 184488 - DNA, 20 bp, Artificial Sequence
  Synthetic oligonucleotide; GGG chr2 60459608 60459627 60459611 -
ttgtagcttaattcagcatt

SEQ ID NO: 184489 - DNA, 20 bp, Artificial Sequence
  Synthetic oligonucleotide; GAG chr2 60459604 60459623 60459607 -
agcttaattcagcattgggt

SEQ ID NO: 184490 - DNA, 20 bp, Artificial Sequence
  Synthetic oligonucleotide; AGG chr2 60459603 60459622 60459606 -
gcttaattcagcattgggtg

SEQ ID NO: 184491 - DNA, 20 bp, Artificial Sequence
  Synthetic oligonucleotide; TAG chr2 60459590 60459609 60459593 -
ttgggtgaggtaataaacct

SEQ ID NO: 184492 - DNA, 20 bp, Artificial Sequence
  Synthetic oligonucleotide; AGG chr2 60459589 60459608 60459592 -
tgggtgaggtaataaacctt

SEQ ID NO: 184493 - DNA, 20 bp, Artificial Sequence
  Synthetic oligonucleotide; TAG chr2 60459583 60459602 60459586 -
aggtaataaaccttaggaac

SEQ ID NO: 184494 - DNA, 20 bp, Artificial Sequence
  Synthetic oligonucleotide; TGG chr2 60459548 60459567 60459551 -
tattgtatttctcacaacaa

SEQ ID NO: 184495 - DNA, 20 bp, Artificial Sequence
  Synthetic oligonucleotide; AAG chr2 60459536 60459555 60459539 -
cacaacaatggctacctaaa

SEQ ID NO: 184496 - DNA, 20 bp, Artificial Sequence
  Synthetic oligonucleotide; TAG chr2 60459517 60459536 60459520 -
aaagatgacccattatgtcc

SEQ ID NO: 184497 - DNA, 20 bp, Artificial Sequence
  Synthetic oligonucleotide; TAG chr2 60459495 60459514 60459498 -
gttaatcatcatttttcctt

SEQ ID NO: 184498 - DNA, 20 bp, Artificial Sequence
  Synthetic oligonucleotide; CAG chr2 60459463 60459482 60459466 -
ataaacaaaactgattatac

SEQ ID NO: 184499 - DNA, 20 bp, Artificial Sequence
  Synthetic oligonucleotide; AAG chr2 60459455 60459474 60459458 -
aactgattataccagtataa

SEQ ID NO: 184500 - DNA, 20 bp, Artificial Sequence
  Synthetic oligonucleotide; TGG chr2 60459440 60459459 60459443 -
tataaaagctactttgctcc

SEQ ID NO: 184501 - DNA, 20 bp, Artificial Sequence
  Synthetic oligonucleotide; GAG chr2 60459436 60459455 60459439 -
aaagctactttgctcctggt

SEQ ID NO: 184502 - DNA, 20 bp, Artificial Sequence
  Synthetic oligonucleotide; GAG chr2 60459434 60459453 60459437 -
agctactttgctcctggtga

SEQ ID NO: 184503 - DNA, 20 bp, Artificial Sequence
  Synthetic oligonucleotide; AAG chr2 60459426 60459445 60459429 -
tgctcctggtgagagcttaa

SEQ ID NO: 184504 - DNA, 20 bp, Artificial Sequence
  Synthetic oligonucleotide; TGG chr2 60459420 60459439 60459423 -
tggtgagagcttaaaagaaa

SEQ ID NO: 184505 - DNA, 20 bp, Artificial Sequence
  Synthetic oligonucleotide; GGG chr2 60459419 60459438 60459422 -
ggtgagagcttaaaagaaat

SEQ ID NO: 184506 - DNA, 20 bp, Artificial Sequence
  Synthetic oligonucleotide; AAG chr2 60459404 60459423 60459407 -
gaaatgggctgttttgccca

SEQ ID NO: 184507 - DNA, 20 bp, Artificial Sequence
  Synthetic oligonucleotide; AAG chr2 60459355 60459374 60459358 -
attgaatgtgtaatgtgcaa

SEQ ID NO: 184508 - DNA, 20 bp, Artificial Sequence
  Synthetic oligonucleotide; TGG chr2 60459349 60459368 60459352 -
tgtgtaatgtgcaaaagccc

SEQ ID NO: 184509 - DNA, 20 bp, Artificial Sequence
  Synthetic oligonucleotide; TAG chr2 60459329 60459348 60459332 -
tggaacgcaattaaatacac

SEQ ID NO: 184510 - DNA, 20 bp, Artificial Sequence
  Synthetic oligonucleotide; AAG chr2 60459325 60459344 60459328 -
acgcaattaaatacactagt

SEQ ID NO: 184511 - DNA, 20 bp, Artificial Sequence
  Synthetic oligonucleotide; AGG chr2 60459324 60459343 60459327 -
cgcaattaaatacactagta

SEQ ID NO: 184512 - DNA, 20 bp, Artificial Sequence
  Synthetic oligonucleotide; GAG chr2 60459322 60459341 60459325 -
caattaaatacactagtaag

SEQ ID NO: 184513 - DNA, 20 bp, Artificial Sequence
  Synthetic oligonucleotide; AAG chr2 60459308 60459327 60459311 -
agtaaggagttcattttatg

SEQ ID NO: 184514 - DNA, 20 bp, Artificial Sequence
  Synthetic oligonucleotide; TGG chr2 60459272 60459291 60459275 -
taatgtctttttaaaaatac

SEQ ID NO: 184515 - DNA, 20 bp, Artificial Sequence
  Synthetic oligonucleotide; AAG chr2 60459263 60459282 60459266 -
tttaaaaatactggcaccaa

SEQ ID NO: 184516 - DNA, 20 bp, Artificial Sequence
  Synthetic oligonucleotide; TAG chr2 60459257 60459276 60459260 -
aatactggcaccaaaagaaa

SEQ ID NO: 184517 - DNA, 20 bp, Artificial Sequence
  Synthetic oligonucleotide; CAG chr2 60459251 60459270 60459254 -
ggcaccaaaagaaatagatc

SEQ ID NO: 184518 - DNA, 20 bp, Artificial Sequence
  Synthetic oligonucleotide; TGG chr2 60459241 60459260 60459244 -
gaaatagatccagatctact

SEQ ID NO: 184519 - DNA, 20 bp, Artificial Sequence
  Synthetic oligonucleotide; AAG chr2 60459233 60459252 60459236 -
tccagatctacttggttgtc

SEQ ID NO: 184520 - DNA, 20 bp, Artificial Sequence
  Synthetic oligonucleotide; TGG chr2 60459230 60459249 60459233 -
agatctacttggttgtcaag

SEQ ID NO: 184521 - DNA, 20 bp, Artificial Sequence
  Synthetic oligonucleotide; AAG chr2 60459207 60459226 60459210 -
acaatcaaatgataaacttt

SEQ ID NO: 184522 - DNA, 20 bp, Artificial Sequence
  Synthetic oligonucleotide; AAG chr2 60459185 60459204 60459188 -
gaccttgtataccatattga

SEQ ID NO: 184523 - DNA, 20 bp, Artificial Sequence
  Synthetic oligonucleotide; AGG chr2 60459184 60459203 60459187 -
accttgtataccatattgaa

SEQ ID NO: 184524 - DNA, 20 bp, Artificial Sequence
  Synthetic oligonucleotide; AAG chr2 60459181 60459200 60459184 -
ttgtataccatattgaaagg

SEQ ID NO: 184525 - DNA, 20 bp, Artificial Sequence
  Synthetic oligonucleotide; GAG chr2 60459179 60459198 60459182 -
gtataccatattgaaaggaa

SEQ ID NO: 184526 - DNA, 20 bp, Artificial Sequence
  Synthetic oligonucleotide; AGG chr2 60459178 60459197 60459181 -
tataccatattgaaaggaag

SEQ ID NO: 184527 - DNA, 20 bp, Artificial Sequence
  Synthetic oligonucleotide; AAG chr2 60459167 60459186 60459170 -
gaaaggaagaggctgacaat

SEQ ID NO: 184528 - DNA, 20 bp, Artificial Sequence
  Synthetic oligonucleotide; AGG chr2 60459166 60459185 60459169 -
aaaggaagaggctgacaata

SEQ ID NO: 184529 - DNA, 20 bp, Artificial Sequence
  Synthetic oligonucleotide; CAG chr2 60459158 60459177 60459161 -
aggctgacaataaggtttga

SEQ ID NO: 184530 - DNA, 20 bp, Artificial Sequence
  Synthetic oligonucleotide; GAG chr2 60459156 60459175 60459159 -
gctgacaataaggtttgaca

SEQ ID NO: 184531 - DNA, 20 bp, Artificial Sequence
  Synthetic oligonucleotide; AGG chr2 60459155 60459174 60459158 -
ctgacaataaggtttgacag

SEQ ID NO: 184532 - DNA, 20 bp, Artificial Sequence
  Synthetic oligonucleotide; GGG chr2 60459154 60459173 60459157 -
tgacaataaggtttgacaga

SEQ ID NO: 184533 - DNA, 20 bp, Artificial Sequence
  Synthetic oligonucleotide; GGG chr2 60459153 60459172 60459156 -
gacaataaggtttgacagag

SEQ ID NO: 184534 - DNA, 20 bp, Artificial Sequence
  Synthetic oligonucleotide; CAG chr2 60459148 60459167 60459151 -
taaggtttgacagaggggaa

SEQ ID NO: 184535 - DNA, 20 bp, Artificial Sequence
  Synthetic oligonucleotide; AAG chr2 60459145 60459164 60459148 -
ggtttgacagaggggaacag

SEQ ID NO: 184536 - DNA, 20 bp, Artificial Sequence
  Synthetic oligonucleotide; TAG chr2 60459125 60459144 60459128 -
aagaaaataatatgatttat

SEQ ID NO: 184537 - DNA, 20 bp, Artificial Sequence
  Synthetic oligonucleotide; TGG chr2 60459115 60459134 60459118 -
tatgatttattagcacaacg

SEQ ID NO: 184538 - DNA, 20 bp, Artificial Sequence
  Synthetic oligonucleotide; TAG chr2 60459092 60459111 60459095 -
tactatttgccatttaaaac

SEQ ID NO: 184539 - DNA, 20 bp, Artificial Sequence
  Synthetic oligonucleotide; CAG chr2 60459087 60459106 60459090 -
tttgccatttaaaactagaa

SEQ ID NO: 184540 - DNA, 20 bp, Artificial Sequence
  Synthetic oligonucleotide; AGG chr2 60459086 60459105 60459089 -
ttgccatttaaaactagaac

SEQ ID NO: 184541 - DNA, 20 bp, Artificial Sequence
  Synthetic oligonucleotide; AAG chr2 60459078 60459097 60459081 -
taaaactagaacaggtatat

SEQ ID NO: 184542 - DNA, 20 bp, Artificial Sequence
  Synthetic oligonucleotide; AAG chr2 60459038 60459057 60459041 -
atgattaactatgaattctt

SEQ ID NO: 184543 - DNA, 20 bp, Artificial Sequence
  Synthetic oligonucleotide; AAG chr2 60459005 60459024 60459008 -
aaatgtgacattcttaaaaa

SEQ ID NO: 184544 - DNA, 20 bp, Artificial Sequence
  Synthetic oligonucleotide; AAG chr2 60459002 60459021 60459005 -
tgtgacattcttaaaaaaag

SEQ ID NO: 184545 - DNA, 20 bp, Artificial Sequence
  Synthetic oligonucleotide; GAG chr2 60459000 60459019 60459003 -
tgacattcttaaaaaaagaa

SEQ ID NO: 184546 - DNA, 20 bp, Artificial Sequence
  Synthetic oligonucleotide; AAG chr2 60458996 60459015 60458999 -
attcttaaaaaaagaagaga

SEQ ID NO: 184547 - DNA, 20 bp, Artificial Sequence
  Synthetic oligonucleotide; AAG chr2 60458987 60459006 60458990 -
aaaagaagagaaagaatttt

SEQ ID NO: 184548 - DNA, 20 bp, Artificial Sequence
  Synthetic oligonucleotide; GAG chr2 60458985 60459004 60458988 -
aagaagagaaagaattttaa

SEQ ID NO: 184549 - DNA, 20 bp, Artificial Sequence
  Synthetic oligonucleotide; TAG chr2 60458982 60459001 60458985 -
aagagaaagaattttaagag

SEQ ID NO: 184550 - DNA, 20 bp, Artificial Sequence
  Synthetic oligonucleotide; CAG chr2 60458979 60458998 60458982 -
agaaagaattttaagagtag

SEQ ID NO: 184551 - DNA, 20 bp, Artificial Sequence
  Synthetic oligonucleotide; AAG chr2 60458954 60458973 60458957 -
tatatgtctgtgctccctaa

SEQ ID NO: 184552 - DNA, 20 bp, Artificial Sequence
  Synthetic oligonucleotide; TGG chr2 60458904 60458923 60458907 -
gtgtgctatttgtgttaaca

SEQ ID NO: 184553 - DNA, 20 bp, Artificial Sequence
  Synthetic oligonucleotide; AAG chr2 60458901 60458920 60458904 -
tgctatttgtgttaacatgg

SEQ ID NO: 184554 - DNA, 20 bp, Artificial Sequence
  Synthetic oligonucleotide; GAG chr2 60458899 60458918 60458902 -
ctatttgtgttaacatggaa

SEQ ID NO: 184555 - DNA, 20 bp, Artificial Sequence
  Synthetic oligonucleotide; AGG chr2 60458898 60458917 60458901 -
tatttgtgttaacatggaag

SEQ ID NO: 184556 - DNA, 20 bp, Artificial Sequence
  Synthetic oligonucleotide; AAG chr2 60458850 60458869 60458853 -
ttaattttttcttttttatt

SEQ ID NO: 184557 - DNA, 20 bp, Artificial Sequence
  Synthetic oligonucleotide; TAG chr2 60458846 60458865 60458849 -
ttttttcttttttattaagc

SEQ ID NO: 184558 - DNA, 20 bp, Artificial Sequence
  Synthetic oligonucleotide; CAG chr2 60458834 60458853 60458837 -
tattaagctagcatctgccc

SEQ ID NO: 184559 - DNA, 20 bp, Artificial Sequence
  Synthetic oligonucleotide; TGG chr2 60458830 60458849 60458833 -
aagctagcatctgccccagt

SEQ ID NO: 184560 - DNA, 20 bp, Artificial Sequence
  Synthetic oligonucleotide; TAG chr2 60458819 60458838 60458822 -
tgccccagttggtgttcaaa

SEQ ID NO: 184561 - DNA, 20 bp, Artificial Sequence
  Synthetic oligonucleotide; CAG chr2 60458776 60458795 60458779 -
atctgtatcttttctctaat

SEQ ID NO: 184562 - DNA, 20 bp, Artificial Sequence
  Synthetic oligonucleotide; GAG chr2 60458774 60458793 60458777 -
ctgtatcttttctctaatca

SEQ ID NO: 184563 - DNA, 20 bp, Artificial Sequence
  Synthetic oligonucleotide; CAG chr2 60458768 60458787 60458771 -
cttttctctaatcagagata

SEQ ID NO: 184564 - DNA, 20 bp, Artificial Sequence
  Synthetic oligonucleotide; GAG chr2 60458766 60458785 60458769 -
tttctctaatcagagataca

SEQ ID NO: 184565 - DNA, 20 bp, Artificial Sequence
  Synthetic oligonucleotide; AGG chr2 60458765 60458784 60458768 -
ttctctaatcagagatacag

SEQ ID NO: 184566 - DNA, 20 bp, Artificial Sequence
  Synthetic oligonucleotide; GAG chr2 60458760 60458779 60458763 -
taatcagagatacagaggtt

SEQ ID NO: 184567 - DNA, 20 bp, Artificial Sequence
  Synthetic oligonucleotide; CAG chr2 60458740 60458759 60458743 -
gagtataaaataaacctgct

SEQ ID NO: 184568 - DNA, 20 bp, Artificial Sequence
  Synthetic oligonucleotide; TAG chr2 60458736 60458755 60458739 -
ataaaataaacctgctcaga

SEQ ID NO: 184569 - DNA, 20 bp, Artificial Sequence
  Synthetic oligonucleotide; AGG chr2 60458735 60458754 60458738 -
taaaataaacctgctcagat

SEQ ID NO: 184570 - DNA, 20 bp, Artificial Sequence
  Synthetic oligonucleotide; AAG chr2 60458726 60458745 60458729 -
cctgctcagataggacaatt

SEQ ID NO: 184571 - DNA, 20 bp, Artificial Sequence
  Synthetic oligonucleotide; CAG chr2 60458705 60458724 60458708 -
agtgcactgtacaattttcc

SEQ ID NO: 184572 - DNA, 20 bp, Artificial Sequence
  Synthetic oligonucleotide; CAG chr2 60458698 60458717 60458701 -
tgtacaattttcccagttta

SEQ ID NO: 184573 - DNA, 20 bp, Artificial Sequence
  Synthetic oligonucleotide; AGG chr2 60458697 60458716 60458700 -
gtacaattttcccagtttac

SEQ ID NO: 184574 - DNA, 20 bp, Artificial Sequence
  Synthetic oligonucleotide; AAG chr2 60458685 60458704 60458688 -
cagtttacaggtctatactt

SEQ ID NO: 184575 - DNA, 20 bp, Artificial Sequence
  Synthetic oligonucleotide; AGG chr2 60458684 60458703 60458687 -
agtttacaggtctatactta

SEQ ID NO: 184576 - DNA, 20 bp, Artificial Sequence
  Synthetic oligonucleotide; GGG chr2 60458683 60458702 60458686 -
gtttacaggtctatacttaa

SEQ ID NO: 184577 - DNA, 20 bp, Artificial Sequence
  Synthetic oligonucleotide; AAG chr2 60458678 60458697 60458681 -
caggtctatacttaagggaa

SEQ ID NO: 184578 - DNA, 20 bp, Artificial Sequence
  Synthetic oligonucleotide; AAG chr2 60458671 60458690 60458674 -
atacttaagggaaaagttgc

SEQ ID NO: 184579 - DNA, 20 bp, Artificial Sequence
  Synthetic oligonucleotide; GAG chr2 60458636 60458655 60458639 -
aaattgaacacaatctcatt

SEQ ID NO: 184580 - DNA, 20 bp, Artificial Sequence
  Synthetic oligonucleotide; AGG chr2 60458635 60458654 60458638 -
aattgaacacaatctcattg

SEQ ID NO: 184581 - DNA, 20 bp, Artificial Sequence
  Synthetic oligonucleotide; GAG chr2 60458633 60458652 60458636 -
ttgaacacaatctcattgag

SEQ ID NO: 184582 - DNA, 20 bp, Artificial Sequence
  Synthetic oligonucleotide; CAG chr2 60458596 60458615 60458599 -
taaaaaaaaaaaaactttgc

SEQ ID NO: 184583 - DNA, 20 bp, Artificial Sequence
  Synthetic oligonucleotide; GAG chr2 60458576 60458595 60458579 -
cagccatttacttgactatt

SEQ ID NO: 184584 - DNA, 20 bp, Artificial Sequence
  Synthetic oligonucleotide; TGG chr2 60458563 60458582 60458566 -
gactattgagcttacttact

SEQ ID NO: 184585 - DNA, 20 bp, Artificial Sequence
  Synthetic oligonucleotide; AAG chr2 60458548 60458567 60458551 -
ttacttggacgcaacattgc

SEQ ID NO: 184586 - DNA, 20 bp, Artificial Sequence
  Synthetic oligonucleotide; TGG chr2 60458536 60458555 60458539 -
aacattgcaagcgctgtgaa

SEQ ID NO: 184587 - DNA, 20 bp, Artificial Sequence
  Synthetic oligonucleotide; CAG chr2 60458530 60458549 60458533 -
gcaagcgctgtgaatggaaa

SEQ ID NO: 184588 - DNA, 20 bp, Artificial Sequence
  Synthetic oligonucleotide; TAG chr2 60458514 60458533 60458517 -
gaaacagaatacacttaaca

SEQ ID NO: 184589 - DNA, 20 bp, Artificial Sequence
  Synthetic oligonucleotide; CAG chr2 60458486 60458505 60458489 -
aatgattgctttcgcttcta

SEQ ID NO: 184590 - DNA, 20 bp, Artificial Sequence
  Synthetic oligonucleotide; AAG chr2 60458480 60458499 60458483 -
tgctttcgcttctacagtgc

SEQ ID NO: 184591 - DNA, 20 bp, Artificial Sequence
  Synthetic oligonucleotide; AGG chr2 60458479 60458498 60458482 -
gctttcgcttctacagtgca

SEQ ID NO: 184592 - DNA, 20 bp, Artificial Sequence
  Synthetic oligonucleotide; AAG chr2 60458440 60458459 60458443 -
cttttttaaatataaatgtt

SEQ ID NO: 184593 - DNA, 20 bp, Artificial Sequence
  Synthetic oligonucleotide; TAG chr2 60458404 60458423 60458407 -
aaaaaacacttcattatgtt

SEQ ID NO: 184594 - DNA, 20 bp, Artificial Sequence
  Synthetic oligonucleotide; AGG chr2 60458403 60458422 60458406 -
aaaaacacttcattatgttt

SEQ ID NO: 184595 - DNA, 20 bp, Artificial Sequence
  Synthetic oligonucleotide; GGG chr2 60458402 60458421 60458405 -
aaaacacttcattatgttta

SEQ ID NO: 184596 - DNA, 20 bp, Artificial Sequence
  Synthetic oligonucleotide; GGG chr2 60458401 60458420 60458404 -
aaacacttcattatgtttag

SEQ ID NO: 184597 - DNA, 20 bp, Artificial Sequence
  Synthetic oligonucleotide; GGG chr2 60458400 60458419 60458403 -
aacacttcattatgtttagg

SEQ ID NO: 184598 - DNA, 20 bp, Artificial Sequence
  Synthetic oligonucleotide; GGG chr2 60458399 60458418 60458402 -
acacttcattatgtttaggg

SEQ ID NO: 184599 - DNA, 20 bp, Artificial Sequence
  Synthetic oligonucleotide; TAG chr2 60458386 60458405 60458389 -
tttaggggggaactgcattt

SEQ ID NO: 184600 - DNA, 20 bp, Artificial Sequence
  Synthetic oligonucleotide; AGG chr2 60458385 60458404 60458388 -
ttaggggggaactgcatttt

SEQ ID NO: 184601 - DNA, 20 bp, Artificial Sequence
  Synthetic oligonucleotide; GGG chr2 60458384 60458403 60458387 -
taggggggaactgcatttta

SEQ ID NO: 184602 - DNA, 20 bp, Artificial Sequence
  Synthetic oligonucleotide; TGG chr2 60458370 60458389 60458373 -
attttagggttccattgtct

SEQ ID NO: 184603 - DNA, 20 bp, Artificial Sequence
  Synthetic oligonucleotide; TGG chr2 60458367 60458386 60458370 -
ttagggttccattgtcttgg

SEQ ID NO: 184604 - DNA, 20 bp, Artificial Sequence
  Synthetic oligonucleotide; AAG chr2 60458358 60458377 60458361 -
cattgtcttggtggtgttac

SEQ ID NO: 184605 - DNA, 20 bp, Artificial Sequence
  Synthetic oligonucleotide; TGG chr2 60458335 60458354 60458338 -
acttgttatccatttaaaaa

SEQ ID NO: 184606 - DNA, 20 bp, Artificial Sequence
  Synthetic oligonucleotide; TAG chr2 60458332 60458351 60458335 -
tgttatccatttaaaaatgg

SEQ ID NO: 184607 - DNA, 20 bp, Artificial Sequence
  Synthetic oligonucleotide; TGG chr2 60458329 60458348 60458332 -
tatccatttaaaaatggtag

SEQ ID NO: 184608 - DNA, 20 bp, Artificial Sequence
  Synthetic oligonucleotide; TGG chr2 60458313 60458332 60458316 -
gtagtggaaattctatgcct

SEQ ID NO: 184609 - DNA, 20 bp, Artificial Sequence
  Synthetic oligonucleotide; CAG chr2 60458295 60458314 60458298 -
cttggatacacaccgctctt

SEQ ID NO: 184610 - DNA, 20 bp, Artificial Sequence
  Synthetic oligonucleotide; AGG chr2 60458294 60458313 60458297 -
ttggatacacaccgctcttc

SEQ ID NO: 184611 - DNA, 20 bp, Artificial Sequence
  Synthetic oligonucleotide; TGG chr2 60458268 60458287 60458271 -
taaaaaaaaaaaacatacat

SEQ ID NO: 184612 - DNA, 20 bp, Artificial Sequence
  Synthetic oligonucleotide; GGG chr2 60458267 60458286 60458270 -
aaaaaaaaaaaacatacatt

SEQ ID NO: 184613 - DNA, 20 bp, Artificial Sequence
  Synthetic oligonucleotide; GGG chr2 60458266 60458285 60458269 -
aaaaaaaaaaacatacattg

SEQ ID NO: 184614 - DNA, 20 bp, Artificial Sequence
  Synthetic oligonucleotide; AAG chr2 60458262 60458281 60458265 -
aaaaaaacatacattgggga

SEQ ID NO: 184615 - DNA, 20 bp, Artificial Sequence
  Synthetic oligonucleotide; AGG chr2 60458261 60458280 60458264 -
aaaaaacatacattggggaa

SEQ ID NO: 184616 - DNA, 20 bp, Artificial Sequence
  Synthetic oligonucleotide; AAG chr2 60458255 60458274 60458258 -
catacattggggaaaggttt

SEQ ID NO: 184617 - DNA, 20 bp, Artificial Sequence
  Synthetic oligonucleotide; TAG chr2 60458246 60458265 60458249 -
gggaaaggtttaagattata

SEQ ID NO: 184618 - DNA, 20 bp, Artificial Sequence
  Synthetic oligonucleotide; TAG chr2 60458233 60458252 60458236 -
gattatatagtacttaaata

SEQ ID NO: 184619 - DNA, 20 bp, Artificial Sequence
  Synthetic oligonucleotide; AGG chr2 60458232 60458251 60458235 -
attatatagtacttaaatat

SEQ ID NO: 184620 - DNA, 20 bp, Artificial Sequence
  Synthetic oligonucleotide; TGG chr2 60458187 60458206 60458190 -
cctatgctaaaatacattta

SEQ ID NO: 184621 - DNA, 20 bp, Artificial Sequence
  Synthetic oligonucleotide; TAG chr2 60458167 60458186 60458170 -
tggtcttttttctgtatttc

SEQ ID NO: 184622 - DNA, 20 bp, Artificial Sequence
  Synthetic oligonucleotide; TGG chr2 60458162 60458181 60458165 -
ttttttctgtatttctagaa

SEQ ID NO: 184623 - DNA, 20 bp, Artificial Sequence
  Synthetic oligonucleotide; TAG chr2 60458138 60458157 60458141 -
atttgaattaaatgttcatc

SEQ ID NO: 184624 - DNA, 20 bp, Artificial Sequence
  Synthetic oligonucleotide; TAG chr2 60458132 60458151 60458135 -
attaaatgttcatctagtgt

SEQ ID NO: 184625 - DNA, 20 bp, Artificial Sequence
  Synthetic oligonucleotide; AGG chr2 60458131 60458150 60458134 -
ttaaatgttcatctagtgtt

SEQ ID NO: 184626 - DNA, 20 bp, Artificial Sequence
  Synthetic oligonucleotide; TAG chr2 60458123 60458142 60458126 -
tcatctagtgttaggcacta

SEQ ID NO: 184627 - DNA, 20 bp, Artificial Sequence
  Synthetic oligonucleotide; AAG chr2 60458109 60458128 60458112 -
gcactatagtatttatattg

SEQ ID NO: 184628 - DNA, 20 bp, Artificial Sequence
  Synthetic oligonucleotide; AAG chr2 60458074 60458093 60458077 -
actgttgcttgttctcttaa

SEQ ID NO: 184629 - DNA, 20 bp, Artificial Sequence
  Synthetic oligonucleotide; AGG chr2 60458073 60458092 60458076 -
ctgttgcttgttctcttaaa

SEQ ID NO: 184630 - DNA, 20 bp, Artificial Sequence
  Synthetic oligonucleotide; TGG chr2 60458053 60458072 60458056 -
aggtatcaatgtaccttttt

SEQ ID NO: 184631 - DNA, 20 bp, Artificial Sequence
  Synthetic oligonucleotide; TAG chr2 60458050 60458069 60458053 -
tatcaatgtaccttttttgg

SEQ ID NO: 184632 - DNA, 20 bp, Artificial Sequence
  Synthetic oligonucleotide; TGG chr2 60458047 60458066 60458050 -
caatgtaccttttttggtag

SEQ ID NO: 184633 - DNA, 20 bp, Artificial Sequence
  Synthetic oligonucleotide; AAG chr2 60458036 60458055 60458039 -
ttttggtagtggaaaaaaaa

SEQ ID NO: 184634 - DNA, 20 bp, Artificial Sequence
  Synthetic oligonucleotide; CAG chr2 60458032 60458051 60458035 -
ggtagtggaaaaaaaaaaga

SEQ ID NO: 184635 - DNA, 20 bp, Artificial Sequence
  Synthetic oligonucleotide; AGG chr2 60458031 60458050 60458034 -
gtagtggaaaaaaaaaagac

SEQ ID NO: 184636 - DNA, 20 bp, Artificial Sequence
  Synthetic oligonucleotide; CAG chr2 60458022 60458041 60458025 -
aaaaaaaagacaggctgcca

SEQ ID NO: 184637 - DNA, 20 bp, Artificial Sequence
  Synthetic oligonucleotide; TGG chr2 60458004 60458023 60458007 -
cacagtatatttttttaatt

SEQ ID NO: 184638 - DNA, 20 bp, Artificial Sequence
  Synthetic oligonucleotide; CAG chr2 60458001 60458020 60458004 -
agtatatttttttaatttgg

SEQ ID NO: 184639 - DNA, 20 bp, Artificial Sequence
  Synthetic oligonucleotide; AGG chr2 60458000 60458019 60458003 -
gtatatttttttaatttggc

SEQ ID NO: 184640 - DNA, 20 bp, Artificial Sequence
  Synthetic oligonucleotide; TAG chr2 60457991 60458010 60457994 -
tttaatttggcaggataata

SEQ ID NO: 184641 - DNA, 20 bp, Artificial Sequence
  Synthetic oligonucleotide; AAG chr2 60457955 60457974 60457958 -
tatgcttcaaaaaaaaaaaa

SEQ ID NO: 184642 - DNA, 20 bp, Artificial Sequence
  Synthetic oligonucleotide; GAG chr2 60457953 60457972 60457956 -
tgcttcaaaaaaaaaaaaaa

SEQ ID NO: 184643 - DNA, 20 bp, Artificial Sequence
  Synthetic oligonucleotide; GAG chr2 60457951 60457970 60457954 -
cttcaaaaaaaaaaaaaaga

SEQ ID NO: 184644 - DNA, 20 bp, Artificial Sequence
  Synthetic oligonucleotide; AAG chr2 60457940 60457959 60457943 -
aaaaaaagagagaaacaaaa

SEQ ID NO: 184645 - DNA, 20 bp, Artificial Sequence
  Synthetic oligonucleotide; CAG chr2 60457927 60457946 60457930 -
aacaaaaaagtgtgacatta

SEQ ID NO: 184646 - DNA, 20 bp, Artificial Sequence
  Synthetic oligonucleotide; GAG chr2 60457922 60457941 60457925 -
aaaagtgtgacattacagat

SEQ ID NO: 184647 - DNA, 20 bp, Artificial Sequence
  Synthetic oligonucleotide; AAG chr2 60457919 60457938 60457922 -
agtgtgacattacagatgag

SEQ ID NO: 184648 - DNA, 20 bp, Artificial Sequence
  Synthetic oligonucleotide; TGG chr2 60457908 60457927 60457911 -
acagatgagaagccatataa

SEQ ID NO: 184649 - DNA, 20 bp, Artificial Sequence
  Synthetic oligonucleotide; CGG chr2 60457905 60457924 60457908 -
gatgagaagccatataatgg

SEQ ID NO: 184650 - DNA, 20 bp, Artificial Sequence
  Synthetic oligonucleotide; TGG chr2 60457900 60457919 60457903 -
gaagccatataatggcggtt

SEQ ID NO: 184651 - DNA, 20 bp, Artificial Sequence
  Synthetic oligonucleotide; GGG chr2 60457899 60457918 60457902 -
aagccatataatggcggttt

SEQ ID NO: 184652 - DNA, 20 bp, Artificial Sequence
  Synthetic oligonucleotide; GGG chr2 60457898 60457917 60457901 -
agccatataatggcggtttg

SEQ ID NO: 184653 - DNA, 20 bp, Artificial Sequence
  Synthetic oligonucleotide; GGG chr2 60457897 60457916 60457900 -
gccatataatggcggtttgg

SEQ ID NO: 184654 - DNA, 20 bp, Artificial Sequence
  Synthetic oligonucleotide; GAG chr2 60457895 60457914 60457898 -
catataatggcggtttgggg

SEQ ID NO: 184655 - DNA, 20 bp, Artificial Sequence
  Synthetic oligonucleotide; TAG chr2 60457887 60457906 60457890 -
ggcggtttgggggagcctgc

SEQ ID NO: 184656 - DNA, 20 bp, Artificial Sequence
  Synthetic oligonucleotide; TGG chr2 60457875 60457894 60457878 -
gagcctgctagaatgtcaca

SEQ ID NO: 184657 - DNA, 20 bp, Artificial Sequence
  Synthetic oligonucleotide; TGG chr2 60457871 60457890 60457874 -
ctgctagaatgtcacatgga

SEQ ID NO: 184658 - DNA, 20 bp, Artificial Sequence
  Synthetic oligonucleotide; TAG chr2 60457862 60457881 60457865 -
tgtcacatggatggctgtca

SEQ ID NO: 184659 - DNA, 20 bp, Artificial Sequence
  Synthetic oligonucleotide; AGG chr2 60457861 60457880 60457864 -
gtcacatggatggctgtcat

SEQ ID NO: 184660 - DNA, 20 bp, Artificial Sequence
  Synthetic oligonucleotide; GGG chr2 60457860 60457879 60457863 -
tcacatggatggctgtcata

SEQ ID NO: 184661 - DNA, 20 bp, Artificial Sequence
  Synthetic oligonucleotide; GGG chr2 60457859 60457878 60457862 -
cacatggatggctgtcatag

SEQ ID NO: 184662 - DNA, 20 bp, Artificial Sequence
  Synthetic oligonucleotide; CAG chr2 60457809 60457828 60457812 -
tcctgctgccatactgtatg

SEQ ID NO: 184663 - DNA, 20 bp, Artificial Sequence
  Synthetic oligonucleotide; AAG chr2 60457800 60457819 60457803 -
catactgtatgcagtactgc

SEQ ID NO: 184664 - DNA, 20 bp, Artificial Sequence
  Synthetic oligonucleotide; TGG chr2 60457787 60457806 60457790 -
gtactgcaagctaataacgt

SEQ ID NO: 184665 - DNA, 20 bp, Artificial Sequence
  Synthetic oligonucleotide; TAG chr2 60457775 60457794 60457778 -
aataacgttggtttgttatg

SEQ ID NO: 184666 - DNA, 20 bp, Artificial Sequence
  Synthetic oligonucleotide; CAG chr2 60457734 60457753 60457737 -
ccttctatcaccctacattc

SEQ ID NO: 184667 - DNA, 20 bp, Artificial Sequence
  Synthetic oligonucleotide; CAG chr2 60457714 60457733 60457717 -
cagcatcttaccttcatatg

SEQ ID NO: 184668 - DNA, 20 bp, Artificial Sequence
  Synthetic oligonucleotide; AAG chr2 60457708 60457727 60457711 -
cttaccttcatatgcagtaa

SEQ ID NO: 184669 - DNA, 20 bp, Artificial Sequence
  Synthetic oligonucleotide; AAG chr2 60457704 60457723 60457707 -
ccttcatatgcagtaaaaga

SEQ ID NO: 184670 - DNA, 20 bp, Artificial Sequence
  Synthetic oligonucleotide; AAG chr2 60457700 60457719 60457703 -
catatgcagtaaaagaaaga

SEQ ID NO: 184671 - DNA, 20 bp, Artificial Sequence
  Synthetic oligonucleotide; AAG chr2 60457690 60457709 60457693 -
aaaagaaagaaagaaaaaaa

SEQ ID NO: 184672 - DNA, 20 bp, Artificial Sequence
  Synthetic oligonucleotide; AGG chr2 60457689 60457708 60457692 -
aaagaaagaaagaaaaaaaa

SEQ ID NO: 184673 - DNA, 20 bp, Artificial Sequence
  Synthetic oligonucleotide; CAG chr2 60457660 60457679 60457663 -
aaaaaaaaaccaatgttttg

SEQ ID NO: 184674 - DNA, 20 bp, Artificial Sequence
  Synthetic oligonucleotide; TGG chr2 60457633 60457652 60457636 -
tttcattgccaaaaactaaa

SEQ ID NO: 184675 - DNA, 20 bp, Artificial Sequence
  Synthetic oligonucleotide; TAG chr2 60457619 60457638 60457622 -
actaaatggtgctttatatt

SEQ ID NO: 184676 - DNA, 20 bp, Artificial Sequence
  Synthetic oligonucleotide; TGG chr2 60457614 60457633 60457617 -
atggtgctttatatttagat

SEQ ID NO: 184677 - DNA, 20 bp, Artificial Sequence
  Synthetic oligonucleotide; AAG chr2 60457610 60457629 60457613 -
tgctttatatttagattgga

SEQ ID NO: 184678 - DNA, 20 bp, Artificial Sequence
  Synthetic oligonucleotide; AAG chr2 60457594 60457613 60457597 -
tggaaagaatttcatatgca

SEQ ID NO: 184679 - DNA, 20 bp, Artificial Sequence
  Synthetic oligonucleotide; AAG chr2 60457584 60457603 60457587 -
ttcatatgcaaagcatatta

SEQ ID NO: 184680 - DNA, 20 bp, Artificial Sequence
  Synthetic oligonucleotide; GAG chr2 60457582 60457601 60457585 -
catatgcaaagcatattaaa

SEQ ID NO: 184681 - DNA, 20 bp, Artificial Sequence
  Synthetic oligonucleotide; AAG chr2 60457578 60457597 60457581 -
tgcaaagcatattaaagaga

SEQ ID NO: 184682 - DNA, 20 bp, Artificial Sequence
  Synthetic oligonucleotide; TAG chr2 60457568 60457587 60457571 -
attaaagagaaagcccgctt

SEQ ID NO: 184683 - DNA, 20 bp, Artificial Sequence
  Synthetic oligonucleotide; TGG chr2 60457547 60457566 60457550 -
agtcaatacttttttgtaaa

SEQ ID NO: 184684 - DNA, 20 bp, Artificial Sequence
  Synthetic oligonucleotide; CAG chr2 60457539 60457558 60457542 -
cttttttgtaaatggcaatg

SEQ ID NO: 184685 - DNA, 20 bp, Artificial Sequence
  Synthetic oligonucleotide; TGG chr2 60457523 60457542 60457526 -
aatgcagaatattttgttat

SEQ ID NO: 184686 - DNA, 20 bp, Artificial Sequence
  Synthetic oligonucleotide; AAG chr2 60457499 60457518 60457502 -
cttttctattcctgtaatga

SEQ ID NO: 184687 - DNA, 20 bp, Artificial Sequence
  Synthetic oligonucleotide; TGG chr2 60457461 60457480 60457464 -
tgaaattttatcttttacta

SEQ ID NO: 184688 - DNA, 20 bp, Artificial Sequence
  Synthetic oligonucleotide; GGG chr2 60457460 60457479 60457463 -
gaaattttatcttttactat

SEQ ID NO: 184689 - DNA, 20 bp, Artificial Sequence
  Synthetic oligonucleotide; GAG chr2 60457458 60457477 60457461 -
aattttatcttttactatgg

SEQ ID NO: 184690 - DNA, 20 bp, Artificial Sequence
  Synthetic oligonucleotide; CAG chr2 60457419 60457438 60457422 -
cttatgtgccctgttcaaaa

SEQ ID NO: 184691 - DNA, 20 bp, Artificial Sequence
  Synthetic oligonucleotide; GAG chr2 60457417 60457436 60457420 -
tatgtgccctgttcaaaaca

SEQ ID NO: 184692 - DNA, 20 bp, Artificial Sequence
  Synthetic oligonucleotide; AGG chr2 60457416 60457435 60457419 -
atgtgccctgttcaaaacag

SEQ ID NO: 184693 - DNA, 20 bp, Artificial Sequence
  Synthetic oligonucleotide; TAG chr2 60457364 60457383 60457367 -
tttttatttttttttttatt

SEQ ID NO: 184694 - DNA, 20 bp, Artificial Sequence
  Synthetic oligonucleotide; AAG chr2 60457354 60457373 60457357 -
tttttttatttagatgacca

SEQ ID NO: 184695 - DNA, 20 bp, Artificial Sequence
  Synthetic oligonucleotide; AGG chr2 60457353 60457372 60457356 -
ttttttatttagatgaccaa

SEQ ID NO: 184696 - DNA, 20 bp, Artificial Sequence
  Synthetic oligonucleotide; TGG chr2 60457339 60457358 60457342 -
gaccaaaggtcattacaacc

SEQ ID NO: 184697 - DNA, 20 bp, Artificial Sequence
  Synthetic oligonucleotide; TGG chr2 60457316 60457335 60457319 -
ctttttattgtatttgtttc

SEQ ID NO: 184698 - DNA, 20 bp, Artificial Sequence
  Synthetic oligonucleotide; AAG chr2 60457305 60457324 60457308 -
atttgtttctggtctttgtt

SEQ ID NO: 184699 - DNA, 20 bp, Artificial Sequence
  Synthetic oligonucleotide; TGG chr2 60457296 60457315 60457299 -
tggtctttgttaagttctat

SEQ ID NO: 184700 - DNA, 20 bp, Artificial Sequence
  Synthetic oligonucleotide; TGG chr2 60457270 60457289 60457273 -
aaccactgtctgtgtttttt

SEQ ID NO: 184701 - DNA, 20 bp, Artificial Sequence
  Synthetic oligonucleotide; CAG chr2 60457267 60457286 60457270 -
cactgtctgtgtttttttgg

SEQ ID NO: 184702 - DNA, 20 bp, Artificial Sequence
  Synthetic oligonucleotide; AAG chr2 60457201 60457220 60457204 -
tgaaaaaataaaaaaaatta

SEQ ID NO: 184703 - DNA, 20 bp, Artificial Sequence
  Synthetic oligonucleotide; AAG chr2 60457188 60457207 60457191 -
aaaattaaagtacacattgt

SEQ ID NO: 184704 - DNA, 20 bp, Artificial Sequence
  Synthetic oligonucleotide; AAG chr2 60457144 60457163 60457147 -
acactctgtaaattacttgc

SEQ ID NO: 184705 - DNA, 20 bp, Artificial Sequence
  Synthetic oligonucleotide; CAG chr2 60457134 60457153 60457137 -
aattacttgcaagaaaataa

SEQ ID NO: 184706 - DNA, 20 bp, Artificial Sequence
  Synthetic oligonucleotide; AGG chr2 60457133 60457152 60457136 -
attacttgcaagaaaataac

SEQ ID NO: 184707 - DNA, 20 bp, Artificial Sequence
  Synthetic oligonucleotide; AAG chr2 60457126 60457145 60457129 -
gcaagaaaataacaggtttt

SEQ ID NO: 184708 - DNA, 20 bp, Artificial Sequence
  Synthetic oligonucleotide; GAG chr2 60457124 60457143 60457127 -
aagaaaataacaggttttaa

SEQ ID NO: 184709 - DNA, 20 bp, Artificial Sequence
  Synthetic oligonucleotide; AAG chr2 60457121 60457140 60457124 -
aaaataacaggttttaagag

SEQ ID NO: 184710 - DNA, 20 bp, Artificial Sequence
  Synthetic oligonucleotide; AGG chr2 60457120 60457139 60457123 -
aaataacaggttttaagaga

SEQ ID NO: 184711 - DNA, 20 bp, Artificial Sequence
  Synthetic oligonucleotide; CAG chr2 60457116 60457135 60457119 -
aacaggttttaagagaaggc

SEQ ID NO: 184712 - DNA, 20 bp, Artificial Sequence
  Synthetic oligonucleotide; CAG chr2 60457112 60457131 60457115 -
ggttttaagagaaggccagt

SEQ ID NO: 184713 - DNA, 20 bp, Artificial Sequence
  Synthetic oligonucleotide; CAG chr2 60457102 60457121 60457105 -
gaaggccagtcagtcttttt

SEQ ID NO: 184714 - DNA, 20 bp, Artificial Sequence
  Synthetic oligonucleotide; AGG chr2 60457101 60457120 60457104 -
aaggccagtcagtctttttc

SEQ ID NO: 184715 - DNA, 20 bp, Artificial Sequence
  Synthetic oligonucleotide; TGG chr2 60457088 60457107 60457091 -
ctttttcaggattatttcta

SEQ ID NO: 184716 - DNA, 20 bp, Artificial Sequence
  Synthetic oligonucleotide; GGG chr2 60457087 60457106 60457090 -
tttttcaggattatttctat

SEQ ID NO: 184717 - DNA, 20 bp, Artificial Sequence
  Synthetic oligonucleotide; AAG chr2 60457058 60457077 60457061 -
gatgcgtgtattatacccta

SEQ ID NO: 184718 - DNA, 20 bp, Artificial Sequence
  Synthetic oligonucleotide; AGG chr2 60457057 60457076 60457060 -
atgcgtgtattataccctaa

SEQ ID NO: 184719 - DNA, 20 bp, Artificial Sequence
  Synthetic oligonucleotide; AAG chr2 60457048 60457067 60457051 -
ttataccctaaaggaacata

SEQ ID NO: 184720 - DNA, 20 bp, Artificial Sequence
  Synthetic oligonucleotide; TAG chr2 60457028 60457047 60457031 -
aagtacttactatattaaaa

SEQ ID NO: 184721 - DNA, 20 bp, Artificial Sequence
  Synthetic oligonucleotide; TGG chr2 60457010 60457029 60457013 -
aatagacatatctcaaaccc

SEQ ID NO: 184722 - DNA, 20 bp, Artificial Sequence
  Synthetic oligonucleotide; TAG chr2 60457004 60457023 60457007 -
catatctcaaaccctggaca

SEQ ID NO: 184723 - DNA, 20 bp, Artificial Sequence
  Synthetic oligonucleotide; AAG chr2 60456997 60457016 60457000 -
caaaccctggacatagtttt

SEQ ID NO: 184724 - DNA, 20 bp, Artificial Sequence
  Synthetic oligonucleotide; AGG chr2 60456996 60457015 60456999 -
aaaccctggacatagtttta

SEQ ID NO: 184725 - DNA, 20 bp, Artificial Sequence
  Synthetic oligonucleotide; CAG chr2 60456988 60457007 60456991 -
gacatagttttaaggctttc

SEQ ID NO: 184726 - DNA, 20 bp, Artificial Sequence
  Synthetic oligonucleotide; TAG chr2 60456983 60457002 60456986 -
agttttaaggctttccagtt

SEQ ID NO: 184727 - DNA, 20 bp, Artificial Sequence
  Synthetic oligonucleotide; TAG chr2 60456978 60456997 60456981 -
taaggctttccagtttagaa

SEQ ID NO: 184728 - DNA, 20 bp, Artificial Sequence
  Synthetic oligonucleotide; AAG chr2 60456970 60456989 60456973 -
tccagtttagaatagttttc

SEQ ID NO: 184729 - DNA, 20 bp, Artificial Sequence
  Synthetic oligonucleotide; TGG chr2 60456964 60456983 60456967 -
ttagaatagttttcaagaaa

SEQ ID NO: 184730 - DNA, 20 bp, Artificial Sequence
  Synthetic oligonucleotide; AAG chr2 60456961 60456980 60456964 -
gaatagttttcaagaaatgg

SEQ ID NO: 184731 - DNA, 20 bp, Artificial Sequence
  Synthetic oligonucleotide; AGG chr2 60456960 60456979 60456963 -
aatagttttcaagaaatgga

SEQ ID NO: 184732 - DNA, 20 bp, Artificial Sequence
  Synthetic oligonucleotide; CAG chr2 60456951 60456970 60456954 -
caagaaatggaaggtgtttt

SEQ ID NO: 184733 - DNA, 20 bp, Artificial Sequence
  Synthetic oligonucleotide; TAG chr2 60456920 60456939 60456923 -
taaaaacttactccatctct

SEQ ID NO: 184734 - DNA, 20 bp, Artificial Sequence
  Synthetic oligonucleotide; CAG chr2 60456917 60456936 60456920 -
aaacttactccatctcttag

SEQ ID NO: 184735 - DNA, 20 bp, Artificial Sequence
  Synthetic oligonucleotide; AAG chr2 60456898 60456917 60456901 -
gcagaaatccattcaaacat

SEQ ID NO: 184736 - DNA, 20 bp, Artificial Sequence
  Synthetic oligonucleotide; TGG chr2 60456882 60456901 60456885 -
acataagtgaaaaaacttgc

SEQ ID NO: 184737 - DNA, 20 bp, Artificial Sequence
  Synthetic oligonucleotide; TAG chr2 60456876 60456895 60456879 -
gtgaaaaaacttgctggtaa

SEQ ID NO: 184738 - DNA, 20 bp, Artificial Sequence
  Synthetic oligonucleotide; AAG chr2 60456823 60456842 60456826 -
ttgctgttcttgttgtctaa

SEQ ID NO: 184739 - DNA, 20 bp, Artificial Sequence
  Synthetic oligonucleotide; TAG chr2 60456788 60456807 60456791 -
ctcccatccttgctttatct

SEQ ID NO: 184740 - DNA, 20 bp, Artificial Sequence
  Synthetic oligonucleotide; AAG chr2 60456771 60456790 60456774 -
tcttagaacataatgtaaaa

SEQ ID NO: 184741 - DNA, 20 bp, Artificial Sequence
  Synthetic oligonucleotide; CAG chr2 60456751 60456770 60456754 -
aagatttttttaaaaaaaat

SEQ ID NO: 184742 - DNA, 20 bp, Artificial Sequence
  Synthetic oligonucleotide; TGG chr2 60456743 60456762 60456746 -
tttaaaaaaaatcagctctt

SEQ ID NO: 184743 - DNA, 20 bp, Artificial Sequence
  Synthetic oligonucleotide; AAG chr2 60456731 60456750 60456734 -
cagctctttggtttccatgt

SEQ ID NO: 184744 - DNA, 20 bp, Artificial Sequence
  Synthetic oligonucleotide; GAG chr2 60456729 60456748 60456732 -
gctctttggtttccatgtaa

SEQ ID NO: 184745 - DNA, 20 bp, Artificial Sequence
  Synthetic oligonucleotide; TGG chr2 60456681 60456700 60456684 -
acttttgaaatctaaaaatc

SEQ ID NO: 184746 - DNA, 20 bp, Artificial Sequence
  Synthetic oligonucleotide; AAG chr2 60456673 60456692 60456676 -
aatctaaaaatctggaaaca

SEQ ID NO: 184747 - DNA, 20 bp, Artificial Sequence
  Synthetic oligonucleotide; AGG chr2 60456672 60456691 60456675 -
atctaaaaatctggaaacaa

SEQ ID NO: 184748 - DNA, 20 bp, Artificial Sequence
  Synthetic oligonucleotide; CAG chr2 60456666 60456685 60456669 -
aaatctggaaacaaaggcat

SEQ ID NO: 184749 - DNA, 20 bp, Artificial Sequence
  Synthetic oligonucleotide; AGG chr2 60456665 60456684 60456668 -
aatctggaaacaaaggcatc

SEQ ID NO: 184750 - DNA, 20 bp, Artificial Sequence
  Synthetic oligonucleotide; AAG chr2 60456630 60456649 60456633 -
ttgttttgttttgtttaaaa

SEQ ID NO: 184751 - DNA, 20 bp, Artificial Sequence
  Synthetic oligonucleotide; GAG chr2 60456628 60456647 60456631 -
gttttgttttgtttaaaaaa

SEQ ID NO: 184752 - DNA, 20 bp, Artificial Sequence
  Synthetic oligonucleotide; AGG chr2 60456627 60456646 60456630 -
ttttgttttgtttaaaaaag

SEQ ID NO: 184753 - DNA, 20 bp, Artificial Sequence
  Synthetic oligonucleotide; GGG chr2 60456626 60456645 60456629 -
tttgttttgtttaaaaaaga

SEQ ID NO: 184754 - DNA, 20 bp, Artificial Sequence
  Synthetic oligonucleotide; GAG chr2 60456624 60456643 60456627 -
tgttttgtttaaaaaagagg

SEQ ID NO: 184755 - DNA, 20 bp, Artificial Sequence
  Synthetic oligonucleotide; AAG chr2 60456616 60456635 60456619 -
ttaaaaaagagggagaaaaa

SEQ ID NO: 184756 - DNA, 20 bp, Artificial Sequence
  Synthetic oligonucleotide; GAG chr2 60456614 60456633 60456617 -
aaaaaagagggagaaaaaaa

SEQ ID NO: 184757 - DNA, 20 bp, Artificial Sequence
  Synthetic oligonucleotide; GAG chr2 60456612 60456631 60456615 -
aaaagagggagaaaaaaaga

SEQ ID NO: 184758 - DNA, 20 bp, Artificial Sequence
  Synthetic oligonucleotide; GAG chr2 60456610 60456629 60456613 -
aagagggagaaaaaaagaga

SEQ ID NO: 184759 - DNA, 20 bp, Artificial Sequence
  Synthetic oligonucleotide; AAG chr2 60456603 60456622 60456606 -
agaaaaaaagagagagacga

SEQ ID NO: 184760 - DNA, 20 bp, Artificial Sequence
  Synthetic oligonucleotide; AAG chr2 60456598 60456617 60456601 -
aaaagagagagacgaaagaa

SEQ ID NO: 184761 - DNA, 20 bp, Artificial Sequence
  Synthetic oligonucleotide; AAG chr2 60456594 60456613 60456597 -
gagagagacgaaagaaaaga

SEQ ID NO: 184762 - DNA, 20 bp, Artificial Sequence
  Synthetic oligonucleotide; CAG chr2 60456591 60456610 60456594 -
agagacgaaagaaaagaaag

SEQ ID NO: 184763 - DNA, 20 bp, Artificial Sequence
  Synthetic oligonucleotide; TAG chr2 60456584 60456603 60456587 -
aaagaaaagaaagcagccac

SEQ ID NO: 184764 - DNA, 20 bp, Artificial Sequence
  Synthetic oligonucleotide; AGG chr2 60456583 60456602 60456586 -
aagaaaagaaagcagccact

SEQ ID NO: 184765 - DNA, 20 bp, Artificial Sequence
  Synthetic oligonucleotide; GGG chr2 60456582 60456601 60456585 -
agaaaagaaagcagccacta

SEQ ID NO: 184766 - DNA, 20 bp, Artificial Sequence
  Synthetic oligonucleotide; GGG chr2 60456581 60456600 60456584 -
gaaaagaaagcagccactag

SEQ ID NO: 184767 - DNA, 20 bp, Artificial Sequence
  Synthetic oligonucleotide; TAG chr2 60456576 60456595 60456579 -
gaaagcagccactaggggtg

SEQ ID NO: 184768 - DNA, 20 bp, Artificial Sequence
  Synthetic oligonucleotide; CAG chr2 60456572 60456591 60456575 -
gcagccactaggggtgtagc

SEQ ID NO: 184769 - DNA, 20 bp, Artificial Sequence
  Synthetic oligonucleotide; TAG chr2 60456566 60456585 60456569 -
actaggggtgtagccagaca

SEQ ID NO: 184770 - DNA, 20 bp, Artificial Sequence
  Synthetic oligonucleotide; TGG chr2 60456554 60456573 60456557 -
gccagacatagtgaaatctt

SEQ ID NO: 184771 - DNA, 20 bp, Artificial Sequence
  Synthetic oligonucleotide; CAG chr2 60456548 60456567 60456551 -
catagtgaaatctttggaat

SEQ ID NO: 184772 - DNA, 20 bp, Artificial Sequence
  Synthetic oligonucleotide; GAG chr2 60456532 60456551 60456535 -
gaatcagccactgatttcct

SEQ ID NO: 184773 - DNA, 20 bp, Artificial Sequence
  Synthetic oligonucleotide; TAG chr2 60456524 60456543 60456527 -
cactgatttcctgagatgca

SEQ ID NO: 184774 - DNA, 20 bp, Artificial Sequence
  Synthetic oligonucleotide; TGG chr2 60456521 60456540 60456524 -
tgatttcctgagatgcatag

SEQ ID NO: 184775 - DNA, 20 bp, Artificial Sequence
  Synthetic oligonucleotide; TGG chr2 60456509 60456528 60456512 -
atgcatagtggtttgccttg

SEQ ID NO: 184776 - DNA, 20 bp, Artificial Sequence
  Synthetic oligonucleotide; GAG chr2 60456502 60456521 60456505 -
gtggtttgccttgtggttct

SEQ ID NO: 184777 - DNA, 20 bp, Artificial Sequence
  Synthetic oligonucleotide; CAG chr2 60456495 60456514 60456498 -
gccttgtggttctgagatcc

SEQ ID NO: 184778 - DNA, 20 bp, Artificial Sequence
  Synthetic oligonucleotide; AGG chr2 60456494 60456513 60456497 -
ccttgtggttctgagatccc

SEQ ID NO: 184779 - DNA, 20 bp, Artificial Sequence
  Synthetic oligonucleotide; TAG chr2 60456486 60456505 60456489 -
ttctgagatcccaggaaccc

SEQ ID NO: 184780 - DNA, 20 bp, Artificial Sequence
  Synthetic oligonucleotide; CAG chr2 60456477 60456496 60456480 -
cccaggaaccctagatgcta

SEQ ID NO: 184781 - DNA, 20 bp, Artificial Sequence
  Synthetic oligonucleotide; TAG chr2 60456467 60456486 60456470 -
ctagatgctacagattactt

SEQ ID NO: 184782 - DNA, 20 bp, Artificial Sequence
  Synthetic oligonucleotide; AGG chr2 60456466 60456485 60456469 -
tagatgctacagattacttt

SEQ ID NO: 184783 - DNA, 20 bp, Artificial Sequence
  Synthetic oligonucleotide; TAG chr2 60456455 60456474 60456458 -
gattactttaggtgttttga

SEQ ID NO: 184784 - DNA, 20 bp, Artificial Sequence
  Synthetic oligonucleotide; AGG chr2 60456454 60456473 60456457 -
attactttaggtgttttgat

SEQ ID NO: 184785 - DNA, 20 bp, Artificial Sequence
  Synthetic oligonucleotide; GGG chr2 60456453 60456472 60456456 -
ttactttaggtgttttgata

SEQ ID NO: 184786 - DNA, 20 bp, Artificial Sequence
  Synthetic oligonucleotide; TGG chr2 60456444 60456463 60456447 -
gtgttttgatagggtcttcc

SEQ ID NO: 184787 - DNA, 20 bp, Artificial Sequence
  Synthetic oligonucleotide; CAG chr2 60456437 60456456 60456440 -
gatagggtcttcctggatga

SEQ ID NO: 184788 - DNA, 20 bp, Artificial Sequence
  Synthetic oligonucleotide; AAG chr2 60456429 60456448 60456432 -
cttcctggatgacagcaaat

SEQ ID NO: 184789 - DNA, 20 bp, Artificial Sequence
  Synthetic oligonucleotide; AGG chr2 60456428 60456447 60456431 -
ttcctggatgacagcaaata

SEQ ID NO: 184790 - DNA, 20 bp, Artificial Sequence
  Synthetic oligonucleotide; GGG chr2 60456427 60456446 60456430 -
tcctggatgacagcaaataa

SEQ ID NO: 184791 - DNA, 20 bp, Artificial Sequence
  Synthetic oligonucleotide; CGG chr2 60456424 60456443 60456427 -
tggatgacagcaaataaggg

SEQ ID NO: 184792 - DNA, 20 bp, Artificial Sequence
  Synthetic oligonucleotide; GGG chr2 60456423 60456442 60456426 -
ggatgacagcaaataagggc

SEQ ID NO: 184793 - DNA, 20 bp, Artificial Sequence
  Synthetic oligonucleotide; CAG chr2 60456396 60456415 60456399 -
cccttcaattatcttctgac

SEQ ID NO: 184794 - DNA, 20 bp, Artificial Sequence
  Synthetic oligonucleotide; CAG chr2 60456392 60456411 60456395 -
tcaattatcttctgaccagc

SEQ ID NO: 184795 - DNA, 20 bp, Artificial Sequence
  Synthetic oligonucleotide; TAG chr2 60456388 60456407 60456391 -
ttatcttctgaccagccagt

SEQ ID NO: 184796 - DNA, 20 bp, Artificial Sequence
  Synthetic oligonucleotide; AGG chr2 60456387 60456406 60456390 -
tatcttctgaccagccagtt

SEQ ID NO: 184797 - DNA, 20 bp, Artificial Sequence
  Synthetic oligonucleotide; TAG chr2 60456367 60456386 60456370 -
aggtctattttaaaaatcct

SEQ ID NO: 184798 - DNA, 20 bp, Artificial Sequence
  Synthetic oligonucleotide; CAG chr2 60456327 60456346 60456330 -
tttacaaatactgcatgttg

SEQ ID NO: 184799 - DNA, 20 bp, Artificial Sequence
  Synthetic oligonucleotide; CAG chr2 60456272 60456291 60456275 -
tgatatcgtgtccctgttcc

SEQ ID NO: 184800 - DNA, 20 bp, Artificial Sequence
  Synthetic oligonucleotide; TAG chr2 60456267 60456286 60456270 -
tcgtgtccctgttcccagtg

SEQ ID NO: 184801 - DNA, 20 bp, Artificial Sequence
  Synthetic oligonucleotide; AAG chr2 60456217 60456236 60456220 -
tttgtaaaaaaccaaaacaa

SEQ ID NO: 184802 - DNA, 20 bp, Artificial Sequence
  Synthetic oligonucleotide; TGG chr2 60456195 60456214 60456198 -
gccgttctgttgtcttcttg

SEQ ID NO: 184803 - DNA, 20 bp, Artificial Sequence
  Synthetic oligonucleotide; TAG chr2 60456192 60456211 60456195 -
gttctgttgtcttcttgtgg

SEQ ID NO: 184804 - DNA, 20 bp, Artificial Sequence
  Synthetic oligonucleotide; CAG chr2 60456175 60456194 60456178 -
tggtagcattttttgtcgct

SEQ ID NO: 184805 - DNA, 20 bp, Artificial Sequence
  Synthetic oligonucleotide; TAG chr2 60456161 60456180 60456164 -
gtcgctcagttcttatgccc

SEQ ID NO: 184806 - DNA, 20 bp, Artificial Sequence
  Synthetic oligonucleotide; GAG chr2 60456151 60456170 60456154 -
tcttatgccctagtgcctgt

SEQ ID NO: 184807 - DNA, 20 bp, Artificial Sequence
  Synthetic oligonucleotide; AGG chr2 60456150 60456169 60456153 -
cttatgccctagtgcctgtg

SEQ ID NO: 184808 - DNA, 20 bp, Artificial Sequence
  Synthetic oligonucleotide; TGG chr2 60456147 60456166 60456150 -
atgccctagtgcctgtgagg

SEQ ID NO: 184809 - DNA, 20 bp, Artificial Sequence
  Synthetic oligonucleotide; GAG chr2 60456119 60456138 60456122 -
tcatgtcatgccttttatct

SEQ ID NO: 184810 - DNA, 20 bp, Artificial Sequence
  Synthetic oligonucleotide; AGG chr2 60456118 60456137 60456121 -
catgtcatgccttttatctg

SEQ ID NO: 184811 - DNA, 20 bp, Artificial Sequence
  Synthetic oligonucleotide; AAG chr2 60456114 60456133 60456117 -
tcatgccttttatctgaggc

SEQ ID NO: 184812 - DNA, 20 bp, Artificial Sequence
  Synthetic oligonucleotide; TAG chr2 60456109 60456128 60456112 -
ccttttatctgaggcaagaa

SEQ ID NO: 184813 - DNA, 20 bp, Artificial Sequence
  Synthetic oligonucleotide; AAG chr2 60456093 60456112 60456096 -
agaatagttttatctttcta

SEQ ID NO: 184814 - DNA, 20 bp, Artificial Sequence
  Synthetic oligonucleotide; AAG chr2 60456086 60456105 60456089 -
ttttatctttctaaagtata

SEQ ID NO: 184815 - DNA, 20 bp, Artificial Sequence
  Synthetic oligonucleotide; AAG chr2 60456082 60456101 60456085 -
atctttctaaagtataaaga

SEQ ID NO: 184816 - DNA, 20 bp, Artificial Sequence
  Synthetic oligonucleotide; AAG chr2 60456064 60456083 60456067 -
gaaagtcaatgttttctgaa

SEQ ID NO: 184817 - DNA, 20 bp, Artificial Sequence
  Synthetic oligonucleotide; CAG chr2 60456060 60456079 60456063 -
gtcaatgttttctgaaaagc

SEQ ID NO: 184818 - DNA, 20 bp, Artificial Sequence
  Synthetic oligonucleotide; TGG chr2 60456055 60456074 60456058 -
tgttttctgaaaagccagtt

SEQ ID NO: 184819 - DNA, 20 bp, Artificial Sequence
  Synthetic oligonucleotide; GGG chr2 60456054 60456073 60456057 -
gttttctgaaaagccagttt

SEQ ID NO: 184820 - DNA, 20 bp, Artificial Sequence
  Synthetic oligonucleotide; TGG chr2 60456051 60456070 60456054 -
ttctgaaaagccagtttggg

SEQ ID NO: 184821 - DNA, 20 bp, Artificial Sequence
  Synthetic oligonucleotide; GGG chr2 60456050 60456069 60456053 -
tctgaaaagccagtttgggt

SEQ ID NO: 184822 - DNA, 20 bp, Artificial Sequence
  Synthetic oligonucleotide; AAG chr2 60456047 60456066 60456050 -
gaaaagccagtttgggtggg

SEQ ID NO: 184823 - DNA, 20 bp, Artificial Sequence
  Synthetic oligonucleotide; AGG chr2 60456046 60456065 60456049 -
aaaagccagtttgggtggga

SEQ ID NO: 184824 - DNA, 20 bp, Artificial Sequence
  Synthetic oligonucleotide; GAG chr2 60456044 60456063 60456047 -
aagccagtttgggtgggaag

SEQ ID NO: 184825 - DNA, 20 bp, Artificial Sequence
  Synthetic oligonucleotide; GAG chr2 60456042 60456061 60456045 -
gccagtttgggtgggaagga

SEQ ID NO: 184826 - DNA, 20 bp, Artificial Sequence
  Synthetic oligonucleotide; GAG chr2 60456040 60456059 60456043 -
cagtttgggtgggaaggaga

SEQ ID NO: 184827 - DNA, 20 bp, Artificial Sequence
  Synthetic oligonucleotide; TGG chr2 60456037 60456056 60456040 -
tttgggtgggaaggagagag

SEQ ID NO: 184828 - DNA, 20 bp, Artificial Sequence
  Synthetic oligonucleotide; GGG chr2 60456036 60456055 60456039 -
ttgggtgggaaggagagagt

SEQ ID NO: 184829 - DNA, 20 bp, Artificial Sequence
  Synthetic oligonucleotide; GGG chr2 60456035 60456054 60456038 -
tgggtgggaaggagagagtg

SEQ ID NO: 184830 - DNA, 20 bp, Artificial Sequence
  Synthetic oligonucleotide; TAG chr2 60456031 60456050 60456034 -
tgggaaggagagagtggggc

SEQ ID NO: 184831 - DNA, 20 bp, Artificial Sequence
  Synthetic oligonucleotide; GAG chr2 60456029 60456048 60456032 -
ggaaggagagagtggggcta

SEQ ID NO: 184832 - DNA, 20 bp, Artificial Sequence
  Synthetic oligonucleotide; AGG chr2 60456028 60456047 60456031 -
gaaggagagagtggggctag

SEQ ID NO: 184833 - DNA, 20 bp, Artificial Sequence
  Synthetic oligonucleotide; GAG chr2 60456017 60456036 60456020 -
tggggctagaggaatccact

SEQ ID NO: 184834 - DNA, 20 bp, Artificial Sequence
  Synthetic oligonucleotide; AAG chr2 60456013 60456032 60456016 -
gctagaggaatccactgaga

SEQ ID NO: 184835 - DNA, 20 bp, Artificial Sequence
  Synthetic oligonucleotide; AGG chr2 60456012 60456031 60456015 -
ctagaggaatccactgagaa

SEQ ID NO: 184836 - DNA, 20 bp, Artificial Sequence
  Synthetic oligonucleotide; TGG chr2 60456005 60456024 60456008 -
aatccactgagaaaggatgt

SEQ ID NO: 184837 - DNA, 20 bp, Artificial Sequence
  Synthetic oligonucleotide; GAG chr2 60456003 60456022 60456006 -
tccactgagaaaggatgttg

SEQ ID NO: 184838 - DNA, 20 bp, Artificial Sequence
  Synthetic oligonucleotide; TAG chr2 60455991 60456010 60455994 -
ggatgttggagaatattaca

SEQ ID NO: 184839 - DNA, 20 bp, Artificial Sequence
  Synthetic oligonucleotide; AGG chr2 60455990 60456009 60455993 -
gatgttggagaatattacat

SEQ ID NO: 184840 - DNA, 20 bp, Artificial Sequence
  Synthetic oligonucleotide; GAG chr2 60455988 60456007 60455991 -
tgttggagaatattacatag

SEQ ID NO: 184841 - DNA, 20 bp, Artificial Sequence
  Synthetic oligonucleotide; AGG chr2 60455987 60456006 60455990 -
gttggagaatattacatagg

SEQ ID NO: 184842 - DNA, 20 bp, Artificial Sequence
  Synthetic oligonucleotide; TGG chr2 60455984 60456003 60455987 -
ggagaatattacataggagg

SEQ ID NO: 184843 - DNA, 20 bp, Artificial Sequence
  Synthetic oligonucleotide; GGG chr2 60455983 60456002 60455986 -
gagaatattacataggaggt

SEQ ID NO: 184844 - DNA, 20 bp, Artificial Sequence
  Synthetic oligonucleotide; GGG chr2 60455982 60456001 60455985 -
agaatattacataggaggtg

SEQ ID NO: 184845 - DNA, 20 bp, Artificial Sequence
  Synthetic oligonucleotide; TGG chr2 60455979 60455998 60455982 -
atattacataggaggtgggg

SEQ ID NO: 184846 - DNA, 20 bp, Artificial Sequence
  Synthetic oligonucleotide; GGG chr2 60455978 60455997 60455981 -
tattacataggaggtggggt

SEQ ID NO: 184847 - DNA, 20 bp, Artificial Sequence
  Synthetic oligonucleotide; GGG chr2 60455977 60455996 60455980 -
attacataggaggtggggtg

SEQ ID NO: 184848 - DNA, 20 bp, Artificial Sequence
  Synthetic oligonucleotide; TGG chr2 60455974 60455993 60455977 -
acataggaggtggggtgggg

SEQ ID NO: 184849 - DNA, 20 bp, Artificial Sequence
  Synthetic oligonucleotide; GGG chr2 60455973 60455992 60455976 -
cataggaggtggggtggggt

SEQ ID NO: 184850 - DNA, 20 bp, Artificial Sequence
  Synthetic oligonucleotide; CGG chr2 60455966 60455985 60455969 -
ggtggggtggggtgggcgtg

SEQ ID NO: 184851 - DNA, 20 bp, Artificial Sequence
  Synthetic oligonucleotide; GAG chr2 60455957 60455976 60455960 -
gggtgggcgtgcggtacctt

SEQ ID NO: 184852 - DNA, 20 bp, Artificial Sequence
  Synthetic oligonucleotide; TAG chr2 60455931 60455950 60455934 -
ttgatgtttgtcactgaact

SEQ ID NO: 184853 - DNA, 20 bp, Artificial Sequence
  Synthetic oligonucleotide; AAG chr2 60455926 60455945 60455929 -
gtttgtcactgaacttagaa

SEQ ID NO: 184854 - DNA, 20 bp, Artificial Sequence
  Synthetic oligonucleotide; TGG chr2 60455906 60455925 60455909 -
aagatatactgtatgtgttt

SEQ ID NO: 184855 - DNA, 20 bp, Artificial Sequence
  Synthetic oligonucleotide; TAG chr2 60455901 60455920 60455904 -
atactgtatgtgttttggat

SEQ ID NO: 184856 - DNA, 20 bp, Artificial Sequence
  Synthetic oligonucleotide; AGG chr2 60455900 60455919 60455903 -
tactgtatgtgttttggatt

SEQ ID NO: 184857 - DNA, 20 bp, Artificial Sequence
  Synthetic oligonucleotide; AAG chr2 60455866 60455885 60455869 -
ctgaatccaaaatgctgctc

SEQ ID NO: 184858 - DNA, 20 bp, Artificial Sequence
  Synthetic oligonucleotide; CAG chr2 60455862 60455881 60455865 -
atccaaaatgctgctcaaga

SEQ ID NO: 184859 - DNA, 20 bp, Artificial Sequence
  Synthetic oligonucleotide; TAG chr2 60455858 60455877 60455861 -
aaaatgctgctcaagacaga

SEQ ID NO: 184860 - DNA, 20 bp, Artificial Sequence
  Synthetic oligonucleotide; CAG chr2 60455844 60455863 60455847 -
gacagatagaaataattccc

SEQ ID NO: 184861 - DNA, 20 bp, Artificial Sequence
  Synthetic oligonucleotide; CAG chr2 60455833 60455852 60455836 -
ataattccccagtgccatgc

SEQ ID NO: 184862 - DNA, 20 bp, Artificial Sequence
  Synthetic oligonucleotide; TAG chr2 60455827 60455846 60455830 -
ccccagtgccatgccagctt

SEQ ID NO: 184863 - DNA, 20 bp, Artificial Sequence
  Synthetic oligonucleotide; TGG chr2 60455821 60455840 60455824 -
tgccatgccagctttagatg

SEQ ID NO: 184864 - DNA, 20 bp, Artificial Sequence
  Synthetic oligonucleotide; TAG chr2 60455755 60455774 60455758 -
tgtccctattactcttttat

SEQ ID NO: 184865 - DNA, 20 bp, Artificial Sequence
  Synthetic oligonucleotide; AGG chr2 60455754 60455773 60455757 -
gtccctattactcttttatt

SEQ ID NO: 184866 - DNA, 20 bp, Artificial Sequence
  Synthetic oligonucleotide; GAG chr2 60455752 60455771 60455755 -
ccctattactcttttattag

SEQ ID NO: 184867 - DNA, 20 bp, Artificial Sequence
  Synthetic oligonucleotide; GAG chr2 60455745 60455764 60455748 -
actcttttattaggagctat

SEQ ID NO: 184868 - DNA, 20 bp, Artificial Sequence
  Synthetic oligonucleotide; TAG chr2 60455732 60455751 60455735 -
gagctatgagtgcaactgtg

SEQ ID NO: 184869 - DNA, 20 bp, Artificial Sequence
  Synthetic oligonucleotide; AGG chr2 60455731 60455750 60455734 -
agctatgagtgcaactgtgt

SEQ ID NO: 184870 - DNA, 20 bp, Artificial Sequence
  Synthetic oligonucleotide; CAG chr2 60455719 60455738 60455722 -
aactgtgtaggttttatata

SEQ ID NO: 184871 - DNA, 20 bp, Artificial Sequence
  Synthetic oligonucleotide; CAG chr2 60455699 60455718 60455702 -
cagtattcattttaatttct

SEQ ID NO: 184872 - DNA, 20 bp, Artificial Sequence
  Synthetic oligonucleotide; TAG chr2 60455683 60455702 60455686 -
ttctcagtatatgctgctct

SEQ ID NO: 184873 - DNA, 20 bp, Artificial Sequence
  Synthetic oligonucleotide; TAG chr2 60455674 60455693 60455677 -
tatgctgctcttagcgtaat

SEQ ID NO: 184874 - DNA, 20 bp, Artificial Sequence
  Synthetic oligonucleotide; AGG chr2 60455673 60455692 60455676 -
atgctgctcttagcgtaatt

SEQ ID NO: 184875 - DNA, 20 bp, Artificial Sequence
  Synthetic oligonucleotide; CAG chr2 60455657 60455676 60455660 -
aattaggttttgcatcctga

SEQ ID NO: 184876 - DNA, 20 bp, Artificial Sequence
  Synthetic oligonucleotide; CAG chr2 60455653 60455672 60455656 -
aggttttgcatcctgacaga

SEQ ID NO: 184877 - DNA, 20 bp, Artificial Sequence
  Synthetic oligonucleotide; TGG chr2 60455644 60455663 60455647 -
atcctgacagacagaattaa

SEQ ID NO: 184878 - DNA, 20 bp, Artificial Sequence
  Synthetic oligonucleotide; TGG chr2 60455641 60455660 60455644 -
ctgacagacagaattaatgg

SEQ ID NO: 184879 - DNA, 20 bp, Artificial Sequence
  Synthetic oligonucleotide; TGG chr2 60455600 60455619 60455603 -
ttcaaatttcttaaatcaaa

SEQ ID NO: 184880 - DNA, 20 bp, Artificial Sequence
  Synthetic oligonucleotide; GGG chr2 60455599 60455618 60455602 -
tcaaatttcttaaatcaaat

SEQ ID NO: 184881 - DNA, 20 bp, Artificial Sequence
  Synthetic oligonucleotide; GGG chr2 60455598 60455617 60455601 -
caaatttcttaaatcaaatg

SEQ ID NO: 184882 - DNA, 20 bp, Artificial Sequence
  Synthetic oligonucleotide; TGG chr2 60455593 60455612 60455596 -
ttcttaaatcaaatggggaa

SEQ ID NO: 184883 - DNA, 20 bp, Artificial Sequence
  Synthetic oligonucleotide; GGG chr2 60455592 60455611 60455595 -
tcttaaatcaaatggggaat

SEQ ID NO: 184884 - DNA, 20 bp, Artificial Sequence
  Synthetic oligonucleotide; GGG chr2 60455591 60455610 60455594 -
cttaaatcaaatggggaatg

SEQ ID NO: 184885 - DNA, 20 bp, Artificial Sequence
  Synthetic oligonucleotide; GAG chr2 60455589 60455608 60455592 -
taaatcaaatggggaatggg

SEQ ID NO: 184886 - DNA, 20 bp, Artificial Sequence
  Synthetic oligonucleotide; AGG chr2 60455588 60455607 60455591 -
aaatcaaatggggaatgggg

SEQ ID NO: 184887 - DNA, 20 bp, Artificial Sequence
  Synthetic oligonucleotide; GAG chr2 60455586 60455605 60455589 -
atcaaatggggaatggggag

SEQ ID NO: 184888 - DNA, 20 bp, Artificial Sequence
  Synthetic oligonucleotide; TGG chr2 60455573 60455592 60455576 -
tggggaggagtgcaaacatc

SEQ ID NO: 184889 - DNA, 20 bp, Artificial Sequence
  Synthetic oligonucleotide; CAG chr2 60455560 60455579 60455563 -
aaacatctggtgataaatca

SEQ ID NO: 184890 - DNA, 20 bp, Artificial Sequence
  Synthetic oligonucleotide; TGG chr2 60455540 60455559 60455543 -
cagattatgtttgatttaca

SEQ ID NO: 184891 - DNA, 20 bp, Artificial Sequence
  Synthetic oligonucleotide; AAG chr2 60455532 60455551 60455535 -
gtttgatttacatggtccca

SEQ ID NO: 184892 - DNA, 20 bp, Artificial Sequence
  Synthetic oligonucleotide; TGG chr2 60455515 60455534 60455518 -
ccaaagttaaataaatttac

SEQ ID NO: 184893 - DNA, 20 bp, Artificial Sequence
  Synthetic oligonucleotide; GGG chr2 60455514 60455533 60455517 -
caaagttaaataaatttact

SEQ ID NO: 184894 - DNA, 20 bp, Artificial Sequence
  Synthetic oligonucleotide; GAG chr2 60455512 60455531 60455515 -
aagttaaataaatttactgg

SEQ ID NO: 184895 - DNA, 20 bp, Artificial Sequence
  Synthetic oligonucleotide; TGG chr2 60455508 60455527 60455511 -
taaataaatttactgggaga

SEQ ID NO: 184896 - DNA, 20 bp, Artificial Sequence
  Synthetic oligonucleotide; GGG chr2 60455507 60455526 60455510 -
aaataaatttactgggagat

SEQ ID NO: 184897 - DNA, 20 bp, Artificial Sequence
  Synthetic oligonucleotide; CAG chr2 60455499 60455518 60455502 -
ttactgggagatgggttctt

SEQ ID NO: 184898 - DNA, 20 bp, Artificial Sequence
  Synthetic oligonucleotide; AGG chr2 60455498 60455517 60455501 -
tactgggagatgggttcttc

SEQ ID NO: 184899 - DNA, 20 bp, Artificial Sequence
  Synthetic oligonucleotide; TAG chr2 60455490 60455509 60455493 -
gatgggttcttcaggttact

SEQ ID NO: 184900 - DNA, 20 bp, Artificial Sequence
  Synthetic oligonucleotide; AAG chr2 60455445 60455464 60455448 -
ctgataaaatattatttctg

SEQ ID NO: 184901 - DNA, 20 bp, Artificial Sequence
  Synthetic oligonucleotide; TAG chr2 60455431 60455450 60455434 -
tttctgaagctgatgaacaa

SEQ ID NO: 184902 - DNA, 20 bp, Artificial Sequence
  Synthetic oligonucleotide; GAG chr2 60455422 60455441 60455425 -
ctgatgaacaatagaaacat

SEQ ID NO: 184903 - DNA, 20 bp, Artificial Sequence
  Synthetic oligonucleotide; TAG chr2 60455415 60455434 60455418 -
acaatagaaacatgagaacc

SEQ ID NO: 184904 - DNA, 20 bp, Artificial Sequence
  Synthetic oligonucleotide; CAG chr2 60455376 60455395 60455379 -
tataaatgatattttgtatc

SEQ ID NO: 184905 - DNA, 20 bp, Artificial Sequence
  Synthetic oligonucleotide; TAG chr2 60455325 60455344 60455328 -
aataacatgcacatttccaa

SEQ ID NO: 184906 - DNA, 20 bp, Artificial Sequence
  Synthetic oligonucleotide; AAG chr2 60455321 60455340 60455324 -
acatgcacatttccaatagt

SEQ ID NO: 184907 - DNA, 20 bp, Artificial Sequence
  Synthetic oligonucleotide; GAG chr2 60455290 60455309 60455293 -
atgatcttttttttttaaat

SEQ ID NO: 184908 - DNA, 20 bp, Artificial Sequence
  Synthetic oligonucleotide; AGG chr2 60455289 60455308 60455292 -
tgatcttttttttttaaatg

SEQ ID NO: 184909 - DNA, 20 bp, Artificial Sequence
  Synthetic oligonucleotide; AAG chr2 60455279 60455298 60455282 -
tttttaaatgaggaactact

SEQ ID NO: 184910 - DNA, 20 bp, Artificial Sequence
  Synthetic oligonucleotide; AAG chr2 60455251 60455270 60455254 -
taatgtctcttaaaatcctc

SEQ ID NO: 184911 - DNA, 20 bp, Artificial Sequence
  Synthetic oligonucleotide; AAG chr2 60455247 60455266 60455250 -
gtctcttaaaatcctcaagt

SEQ ID NO: 184912 - DNA, 20 bp, Artificial Sequence
  Synthetic oligonucleotide; CAG chr2 60455235 60455254 60455238 -
cctcaagtaagtttttgtaa

SEQ ID NO: 184913 - DNA, 20 bp, Artificial Sequence
  Synthetic oligonucleotide; AGG chr2 60455234 60455253 60455237 -
ctcaagtaagtttttgtaac

SEQ ID NO: 184914 - DNA, 20 bp, Artificial Sequence
  Synthetic oligonucleotide; TGG chr2 60455218 60455237 60455221 -
taacaggcttgacgtgctga

SEQ ID NO: 184915 - DNA, 20 bp, Artificial Sequence
  Synthetic oligonucleotide; GAG chr2 60455160 60455179 60455163 -
gttctttttaatcttcattt

SEQ ID NO: 184916 - DNA, 20 bp, Artificial Sequence
  Synthetic oligonucleotide; CAG chr2 60455143 60455162 60455146 -
tttgagaacaacttaataaa

SEQ ID NO: 184917 - DNA, 20 bp, Artificial Sequence
  Synthetic oligonucleotide; AGG chr2 60455142 60455161 60455145 -
ttgagaacaacttaataaac

SEQ ID NO: 184918 - DNA, 20 bp, Artificial Sequence
  Synthetic oligonucleotide; CAG chr2 60455116 60455135 60455119 -
accgcaaattctatttctca

SEQ ID NO: 184919 - DNA, 20 bp, Artificial Sequence
  Synthetic oligonucleotide; CAG chr2 60455104 60455123 60455107 -
atttctcacagattttaaac

SEQ ID NO: 184920 - DNA, 20 bp, Artificial Sequence
  Synthetic oligonucleotide; CAG chr2 60455092 60455111 60455095 -
ttttaaaccagaaactcttc

SEQ ID NO: 184921 - DNA, 20 bp, Artificial Sequence
  Synthetic oligonucleotide; TAG chr2 60455041 60455060 60455044 -
tttgctatcctctctttgtt

SEQ ID NO: 184922 - DNA, 20 bp, Artificial Sequence
  Synthetic oligonucleotide; AGG chr2 60455040 60455059 60455043 -
ttgctatcctctctttgttt

SEQ ID NO: 184923 - DNA, 20 bp, Artificial Sequence
  Synthetic oligonucleotide; AAG chr2 60455028 60455047 60455031 -
ctttgtttaggacctacaaa

SEQ ID NO: 184924 - DNA, 20 bp, Artificial Sequence
  Synthetic oligonucleotide; AGG chr2 60455027 60455046 60455030 -
tttgtttaggacctacaaaa

SEQ ID NO: 184925 - DNA, 20 bp, Artificial Sequence
  Synthetic oligonucleotide; TGG chr2 60455023 60455042 60455026 -
tttaggacctacaaaaaggc

SEQ ID NO: 184926 - DNA, 20 bp, Artificial Sequence
  Synthetic oligonucleotide; AAG chr2 60455005 60455024 60455008 -
gctggaaccaacacattaca

SEQ ID NO: 184927 - DNA, 20 bp, Artificial Sequence
  Synthetic oligonucleotide; AGG chr2 60455004 60455023 60455007 -
ctggaaccaacacattacaa

SEQ ID NO: 184928 - DNA, 20 bp, Artificial Sequence
  Synthetic oligonucleotide; AAG chr2 60454996 60455015 60454999 -
aacacattacaaaggttgct

SEQ ID NO: 184929 - DNA, 20 bp, Artificial Sequence
  Synthetic oligonucleotide; AAG chr2 60454993 60455012 60454996 -
acattacaaaggttgctaag

SEQ ID NO: 184930 - DNA, 20 bp, Artificial Sequence
  Synthetic oligonucleotide; GAG chr2 60454989 60455008 60454992 -
tacaaaggttgctaagaagt

SEQ ID NO: 184931 - DNA, 20 bp, Artificial Sequence
  Synthetic oligonucleotide; AGG chr2 60454988 60455007 60454991 -
acaaaggttgctaagaagtg

SEQ ID NO: 184932 - DNA, 20 bp, Artificial Sequence
  Synthetic oligonucleotide; CAG chr2 60454979 60454998 60454982 -
gctaagaagtgaggtgaaca

SEQ ID NO: 184933 - DNA, 20 bp, Artificial Sequence
  Synthetic oligonucleotide; TGG chr2 60454962 60454981 60454965 -
acacagttcttcatttgcac

SEQ ID NO: 184934 - DNA, 20 bp, Artificial Sequence
  Synthetic oligonucleotide; TGG chr2 60454956 60454975 60454959 -
ttcttcatttgcactggcca

SEQ ID NO: 184935 - DNA, 20 bp, Artificial Sequence
  Synthetic oligonucleotide; CAG chr2 60454953 60454972 60454956 -
ttcatttgcactggccatgg

SEQ ID NO: 184936 - DNA, 20 bp, Artificial Sequence
  Synthetic oligonucleotide; AAG chr2 60454949 60454968 60454952 -
tttgcactggccatggcaga

SEQ ID NO: 184937 - DNA, 20 bp, Artificial Sequence
  Synthetic oligonucleotide; AAG chr2 60454942 60454961 60454945 -
tggccatggcagaaagtgtg

SEQ ID NO: 184938 - DNA, 20 bp, Artificial Sequence
  Synthetic oligonucleotide; TAG chr2 60454939 60454958 60454942 -
ccatggcagaaagtgtgaag

SEQ ID NO: 184939 - DNA, 20 bp, Artificial Sequence
  Synthetic oligonucleotide; GAG chr2 60454934 60454953 60454937 -
gcagaaagtgtgaagtagtt

SEQ ID NO: 184940 - DNA, 20 bp, Artificial Sequence
  Synthetic oligonucleotide; CAG chr2 60454924 60454943 60454927 -
tgaagtagttgagtttttcc

SEQ ID NO: 184941 - DNA, 20 bp, Artificial Sequence
  Synthetic oligonucleotide; AGG chr2 60454923 60454942 60454926 -
gaagtagttgagtttttccc

SEQ ID NO: 184942 - DNA, 20 bp, Artificial Sequence
  Synthetic oligonucleotide; GGG chr2 60454922 60454941 60454925 -
aagtagttgagtttttccca

SEQ ID NO: 184943 - DNA, 20 bp, Artificial Sequence
  Synthetic oligonucleotide; TAG chr2 60454912 60454931 60454915 -
gtttttcccagggcattctg

SEQ ID NO: 184944 - DNA, 20 bp, Artificial Sequence
  Synthetic oligonucleotide; TAG chr2 60454906 60454925 60454909 -
cccagggcattctgtagata

SEQ ID NO: 184945 - DNA, 20 bp, Artificial Sequence
  Synthetic oligonucleotide; AAG chr2 60454867 60454886 60454870 -
accatttttgtatatgcaat

SEQ ID NO: 184946 - DNA, 20 bp, Artificial Sequence
  Synthetic oligonucleotide; TAG chr2 60454839 60454858 60454842 -
attgtatataatcataatgc

SEQ ID NO: 184947 - DNA, 20 bp, Artificial Sequence
  Synthetic oligonucleotide; AAG chr2 60454836 60454855 60454839 -
gtatataatcataatgctag

SEQ ID NO: 184948 - DNA, 20 bp, Artificial Sequence
  Synthetic oligonucleotide; GAG chr2 60454832 60454851 60454835 -
ataatcataatgctagaagt

SEQ ID NO: 184949 - DNA, 20 bp, Artificial Sequence
  Synthetic oligonucleotide; AAG chr2 60454822 60454841 60454825 -
tgctagaagtgagaacttga

SEQ ID NO: 184950 - DNA, 20 bp, Artificial Sequence
  Synthetic oligonucleotide; AGG chr2 60454821 60454840 60454824 -
gctagaagtgagaacttgaa

SEQ ID NO: 184951 - DNA, 20 bp, Artificial Sequence
  Synthetic oligonucleotide; AAG chr2 60454818 60454837 60454821 -
agaagtgagaacttgaaagg

SEQ ID NO: 184952 - DNA, 20 bp, Artificial Sequence
  Synthetic oligonucleotide; TGG chr2 60454815 60454834 60454818 -
agtgagaacttgaaaggaag

SEQ ID NO: 184953 - DNA, 20 bp, Artificial Sequence
  Synthetic oligonucleotide; CGG chr2 60454812 60454831 60454815 -
gagaacttgaaaggaagtgg

SEQ ID NO: 184954 - DNA, 20 bp, Artificial Sequence
  Synthetic oligonucleotide; GGG chr2 60454811 60454830 60454814 -
agaacttgaaaggaagtggc

SEQ ID NO: 184955 - DNA, 20 bp, Artificial Sequence
  Synthetic oligonucleotide; GAG chr2 60454809 60454828 60454812 -
aacttgaaaggaagtggcgg

SEQ ID NO: 184956 - DNA, 20 bp, Artificial Sequence
  Synthetic oligonucleotide; TGG chr2 60454805 60454824 60454808 -
tgaaaggaagtggcgggaga

SEQ ID NO: 184957 - DNA, 20 bp, Artificial Sequence
  Synthetic oligonucleotide; TAG chr2 60454800 60454819 60454803 -
ggaagtggcgggagatggct

SEQ ID NO: 184958 - DNA, 20 bp, Artificial Sequence
  Synthetic oligonucleotide; AGG chr2 60454799 60454818 60454802 -
gaagtggcgggagatggctt

SEQ ID NO: 184959 - DNA, 20 bp, Artificial Sequence
  Synthetic oligonucleotide; TGG chr2 60454784 60454803 60454787 -
ggcttaggtataattccaat

SEQ ID NO: 184960 - DNA, 20 bp, Artificial Sequence
  Synthetic oligonucleotide; GAG chr2 60454782 60454801 60454785 -
cttaggtataattccaattg

SEQ ID NO: 184961 - DNA, 20 bp, Artificial Sequence
  Synthetic oligonucleotide; AAG chr2 60454775 60454794 60454778 -
ataattccaattggagaaat

SEQ ID NO: 184962 - DNA, 20 bp, Artificial Sequence
  Synthetic oligonucleotide; AGG chr2 60454774 60454793 60454777 -
taattccaattggagaaata

SEQ ID NO: 184963 - DNA, 20 bp, Artificial Sequence
  Synthetic oligonucleotide; GAG chr2 60454767 60454786 60454770 -
aattggagaaataaggaaat

SEQ ID NO: 184964 - DNA, 20 bp, Artificial Sequence
  Synthetic oligonucleotide; AGG chr2 60454766 60454785 60454769 -
attggagaaataaggaaatg

SEQ ID NO: 184965 - DNA, 20 bp, Artificial Sequence
  Synthetic oligonucleotide; TGG chr2 60454763 60454782 60454766 -
ggagaaataaggaaatgagg

SEQ ID NO: 184966 - DNA, 20 bp, Artificial Sequence
  Synthetic oligonucleotide; CAG chr2 60454752 60454771 60454755 -
gaaatgaggtggtttattca

SEQ ID NO: 184967 - DNA, 20 bp, Artificial Sequence
  Synthetic oligonucleotide; CAG chr2 60454746 60454765 60454749 -
aggtggtttattcacagaca

SEQ ID NO: 184968 - DNA, 20 bp, Artificial Sequence
  Synthetic oligonucleotide; AAG chr2 60454735 60454754 60454738 -
tcacagacacagtttgctga

SEQ ID NO: 184969 - DNA, 20 bp, Artificial Sequence
  Synthetic oligonucleotide; AGG chr2 60454734 60454753 60454737 -
cacagacacagtttgctgaa

SEQ ID NO: 184970 - DNA, 20 bp, Artificial Sequence
  Synthetic oligonucleotide; TGG chr2 60454728 60454747 60454731 -
cacagtttgctgaaaggtac

SEQ ID NO: 184971 - DNA, 20 bp, Artificial Sequence
  Synthetic oligonucleotide; GGG chr2 60454727 60454746 60454730 -
acagtttgctgaaaggtact

SEQ ID NO: 184972 - DNA, 20 bp, Artificial Sequence
  Synthetic oligonucleotide; CGG chr2 60454717 60454736 60454720 -
gaaaggtactgggattattt

SEQ ID NO: 184973 - DNA, 20 bp, Artificial Sequence
  Synthetic oligonucleotide; GGG chr2 60454716 60454735 60454719 -
aaaggtactgggattatttc

SEQ ID NO: 184974 - DNA, 20 bp, Artificial Sequence
  Synthetic oligonucleotide; AAG chr2 60454703 60454722 60454706 -
ttatttcgggccttcctgaa

SEQ ID NO: 184975 - DNA, 20 bp, Artificial Sequence
  Synthetic oligonucleotide; AGG chr2 60454702 60454721 60454705 -
tatttcgggccttcctgaaa

SEQ ID NO: 184976 - DNA, 20 bp, Artificial Sequence
  Synthetic oligonucleotide; GAG chr2 60454700 60454719 60454703 -
tttcgggccttcctgaaaag

SEQ ID NO: 184977 - DNA, 20 bp, Artificial Sequence
  Synthetic oligonucleotide; GAG chr2 60454695 60454714 60454698 -
ggccttcctgaaaaggagtt

SEQ ID NO: 184978 - DNA, 20 bp, Artificial Sequence
  Synthetic oligonucleotide; AAG chr2 60454692 60454711 60454695 -
cttcctgaaaaggagttgag

SEQ ID NO: 184979 - DNA, 20 bp, Artificial Sequence
  Synthetic oligonucleotide; CAG chr2 60454686 60454705 60454689 -
gaaaaggagttgagaagcct

SEQ ID NO: 184980 - DNA, 20 bp, Artificial Sequence
  Synthetic oligonucleotide; AGG chr2 60454685 60454704 60454688 -
aaaaggagttgagaagcctc

SEQ ID NO: 184981 - DNA, 20 bp, Artificial Sequence
  Synthetic oligonucleotide; TAG chr2 60454663 60454682 60454666 -
gccccatcctctcctgcttg

SEQ ID NO: 184982 - DNA, 20 bp, Artificial Sequence
  Synthetic oligonucleotide; CAG chr2 60454649 60454668 60454652 -
tgcttgtagtactttgctca

SEQ ID NO: 184983 - DNA, 20 bp, Artificial Sequence
  Synthetic oligonucleotide; GAG chr2 60454647 60454666 60454650 -
cttgtagtactttgctcaca

SEQ ID NO: 184984 - DNA, 20 bp, Artificial Sequence
  Synthetic oligonucleotide; GAG chr2 60454641 60454660 60454644 -
gtactttgctcacagagact

SEQ ID NO: 184985 - DNA, 20 bp, Artificial Sequence
  Synthetic oligonucleotide; AGG chr2 60454640 60454659 60454643 -
tactttgctcacagagactg

SEQ ID NO: 184986 - DNA, 20 bp, Artificial Sequence
  Synthetic oligonucleotide; GGG chr2 60454639 60454658 60454642 -
actttgctcacagagactga

SEQ ID NO: 184987 - DNA, 20 bp, Artificial Sequence
  Synthetic oligonucleotide; GAG chr2 60454637 60454656 60454640 -
tttgctcacagagactgagg

SEQ ID NO: 184988 - DNA, 20 bp, Artificial Sequence
  Synthetic oligonucleotide; AGG chr2 60454636 60454655 60454639 -
ttgctcacagagactgaggg

SEQ ID NO: 184989 - DNA, 20 bp, Artificial Sequence
  Synthetic oligonucleotide; CAG chr2 60454628 60454647 60454631 -
agagactgagggaggaaata

SEQ ID NO: 184990 - DNA, 20 bp, Artificial Sequence
  Synthetic oligonucleotide; AAG chr2 60454611 60454630 60454614 -
atacagtgttttcttgtttt

SEQ ID NO: 184991 - DNA, 20 bp, Artificial Sequence
  Synthetic oligonucleotide; TGG chr2 60454513 60454532 60454516 -
ttctgttactccattgtccc

SEQ ID NO: 184992 - DNA, 20 bp, Artificial Sequence
  Synthetic oligonucleotide; GGG chr2 60454512 60454531 60454515 -
tctgttactccattgtccct

SEQ ID NO: 184993 - DNA, 20 bp, Artificial Sequence
  Synthetic oligonucleotide; TGG chr2 60454507 60454526 60454510 -
tactccattgtccctgggcc

SEQ ID NO: 184994 - DNA, 20 bp, Artificial Sequence
  Synthetic oligonucleotide; CAG chr2 60454498 60454517 60454501 -
gtccctgggcctggtgtgtt

SEQ ID NO: 184995 - DNA, 20 bp, Artificial Sequence
  Synthetic oligonucleotide; AGG chr2 60454497 60454516 60454500 -
tccctgggcctggtgtgttc

SEQ ID NO: 184996 - DNA, 20 bp, Artificial Sequence
  Synthetic oligonucleotide; CAG chr2 60454467 60454486 60454470 -
ccatcccattctcttttttt

SEQ ID NO: 184997 - DNA, 20 bp, Artificial Sequence
  Synthetic oligonucleotide; TGG chr2 60454439 60454458 60454442 -
ttcccataaaaaaaaaattg

SEQ ID NO: 184998 - DNA, 20 bp, Artificial Sequence
  Synthetic oligonucleotide; GGG chr2 60454438 60454457 60454441 -
tcccataaaaaaaaaattgt

SEQ ID NO: 184999 - DNA, 20 bp, Artificial Sequence
  Synthetic oligonucleotide; GAG chr2 60454421 60454440 60454424 -
tgtgggaactttgccgatat

SEQ ID NO: 185000 - DNA, 20 bp, Artificial Sequence
  Synthetic oligonucleotide; AGG chr2 60454420 60454439 60454423 -
gtgggaactttgccgatatg

SEQ ID NO: 185001 - DNA, 20 bp, Artificial Sequence
  Synthetic oligonucleotide; TGG chr2 60454416 60454435 60454419 -
gaactttgccgatatgagga

SEQ ID NO: 185002 - DNA, 20 bp, Artificial Sequence
  Synthetic oligonucleotide; GGG chr2 60454415 60454434 60454418 -
aactttgccgatatgaggat

SEQ ID NO: 185003 - DNA, 20 bp, Artificial Sequence
  Synthetic oligonucleotide; TGG chr2 60454410 60454429 60454413 -
tgccgatatgaggatgggat

SEQ ID NO: 185004 - DNA, 20 bp, Artificial Sequence
  Synthetic oligonucleotide; CAG chr2 60454407 60454426 60454410 -
cgatatgaggatgggattgg

SEQ ID NO: 185005 - DNA, 20 bp, Artificial Sequence
  Synthetic oligonucleotide; GAG chr2 60454405 60454424 60454408 -
atatgaggatgggattggca

SEQ ID NO: 185006 - DNA, 20 bp, Artificial Sequence
  Synthetic oligonucleotide; TGG chr2 60454387 60454406 60454390 -
cagagttctctcaacctgct

SEQ ID NO: 185007 - DNA, 20 bp, Artificial Sequence
  Synthetic oligonucleotide; AAG chr2 60454369 60454388 60454372 -
cttggaaaaatgtttcttaa

SEQ ID NO: 185008 - DNA, 20 bp, Artificial Sequence
  Synthetic oligonucleotide; AAG chr2 60454351 60454370 60454354 -
aaaagactgctaacttttaa

SEQ ID NO: 185009 - DNA, 20 bp, Artificial Sequence
  Synthetic oligonucleotide; AGG chr2 60454350 60454369 60454353 -
aaagactgctaacttttaaa

SEQ ID NO: 185010 - DNA, 20 bp, Artificial Sequence
  Synthetic oligonucleotide; GAG chr2 60454344 60454363 60454347 -
tgctaacttttaaaaggcat

SEQ ID NO: 185011 - DNA, 20 bp, Artificial Sequence
  Synthetic oligonucleotide; TAG chr2 60454336 60454355 60454339 -
tttaaaaggcatgagccatc

SEQ ID NO: 185012 - DNA, 20 bp, Artificial Sequence
  Synthetic oligonucleotide; CAG chr2 60454333 60454352 60454336 -
aaaaggcatgagccatctag

SEQ ID NO: 185013 - DNA, 20 bp, Artificial Sequence
  Synthetic oligonucleotide; TAG chr2 60454323 60454342 60454326 -
agccatctagcagattttcc

SEQ ID NO: 185014 - DNA, 20 bp, Artificial Sequence
  Synthetic oligonucleotide; AAG chr2 60454310 60454329 60454313 -
attttcctagttgtctccta

SEQ ID NO: 185015 - DNA, 20 bp, Artificial Sequence
  Synthetic oligonucleotide; TAG chr2 60454290 60454309 60454293 -
aagccctgcatatttcccaa

SEQ ID NO: 185016 - DNA, 20 bp, Artificial Sequence
  Synthetic oligonucleotide; TAG chr2 60454267 60454286 60454270 -
aaaataaacgaacccattgt

SEQ ID NO: 185017 - DNA, 20 bp, Artificial Sequence
  Synthetic oligonucleotide; GAG chr2 60454265 60454284 60454268 -
aataaacgaacccattgtta

SEQ ID NO: 185018 - DNA, 20 bp, Artificial Sequence
  Synthetic oligonucleotide; TGG chr2 60454259 60454278 60454262 -
cgaacccattgttagagaaa

SEQ ID NO: 185019 - DNA, 20 bp, Artificial Sequence
  Synthetic oligonucleotide; CAG chr2 60454252 60454271 60454255 -
attgttagagaaatggacat

SEQ ID NO: 185020 - DNA, 20 bp, Artificial Sequence
  Synthetic oligonucleotide; TAG chr2 60454243 60454262 60454246 -
gaaatggacatcagaacaca

SEQ ID NO: 185021 - DNA, 20 bp, Artificial Sequence
  Synthetic oligonucleotide; GAG chr2 60454241 60454260 60454244 -
aatggacatcagaacacata

SEQ ID NO: 185022 - DNA, 20 bp, Artificial Sequence
  Synthetic oligonucleotide; AGG chr2 60454240 60454259 60454243 -
atggacatcagaacacatag

SEQ ID NO: 185023 - DNA, 20 bp, Artificial Sequence
  Synthetic oligonucleotide; GGG chr2 60454239 60454258 60454242 -
tggacatcagaacacataga

SEQ ID NO: 185024 - DNA, 20 bp, Artificial Sequence
  Synthetic oligonucleotide; TGG chr2 60454233 60454252 60454236 -
tcagaacacatagagggaat

SEQ ID NO: 185025 - DNA, 20 bp, Artificial Sequence
  Synthetic oligonucleotide; TAG chr2 60454212 60454231 60454215 -
ggtatgatgtgtatttactc

SEQ ID NO: 185026 - DNA, 20 bp, Artificial Sequence
  Synthetic oligonucleotide; AGG chr2 60454211 60454230 60454214 -
gtatgatgtgtatttactct

SEQ ID NO: 185027 - DNA, 20 bp, Artificial Sequence
  Synthetic oligonucleotide; GGG chr2 60454210 60454229 60454213 -
tatgatgtgtatttactcta

SEQ ID NO: 185028 - DNA, 20 bp, Artificial Sequence
  Synthetic oligonucleotide; TAG chr2 60454201 60454220 60454204 -
tatttactctagggctgcta

SEQ ID NO: 185029 - DNA, 20 bp, Artificial Sequence
  Synthetic oligonucleotide; TGG chr2 60454188 60454207 60454191 -
gctgctatagctatgaactg

SEQ ID NO: 185030 - DNA, 20 bp, Artificial Sequence
  Synthetic oligonucleotide; TGG chr2 60454182 60454201 60454185 -
atagctatgaactgtggaca

SEQ ID NO: 185031 - DNA, 20 bp, Artificial Sequence
  Synthetic oligonucleotide; GGG chr2 60454181 60454200 60454184 -
tagctatgaactgtggacat

SEQ ID NO: 185032 - DNA, 20 bp, Artificial Sequence
  Synthetic oligonucleotide; CGG chr2 60454173 60454192 60454176 -
aactgtggacatgggttgtc

SEQ ID NO: 185033 - DNA, 20 bp, Artificial Sequence
  Synthetic oligonucleotide; TGG chr2 60454153 60454172 60454156 -
cggtctgcacttctgcttgc

SEQ ID NO: 185034 - DNA, 20 bp, Artificial Sequence
  Synthetic oligonucleotide; TAG chr2 60454134 60454153 60454137 -
ctggcatctcgttatcccat

SEQ ID NO: 185035 - DNA, 20 bp, Artificial Sequence
  Synthetic oligonucleotide; CAG chr2 60454108 60454127 60454111 -
gctgtttaatttactacata

SEQ ID NO: 185036 - DNA, 20 bp, Artificial Sequence
  Synthetic oligonucleotide; GAG chr2 60454102 60454121 60454105 -
taatttactacatacagcac

SEQ ID NO: 185037 - DNA, 20 bp, Artificial Sequence
  Synthetic oligonucleotide; AGG chr2 60454101 60454120 60454104 -
aatttactacatacagcacg

SEQ ID NO: 185038 - DNA, 20 bp, Artificial Sequence
  Synthetic oligonucleotide; CAG chr2 60454097 60454116 60454100 -
tactacatacagcacgaggc

SEQ ID NO: 185039 - DNA, 20 bp, Artificial Sequence
  Synthetic oligonucleotide; CAG chr2 60454089 60454108 60454092 -
acagcacgaggccagtgact

SEQ ID NO: 185040 - DNA, 20 bp, Artificial Sequence
  Synthetic oligonucleotide; TAG chr2 60454082 60454101 60454085 -
gaggccagtgactcagcctt

SEQ ID NO: 185041 - DNA, 20 bp, Artificial Sequence
  Synthetic oligonucleotide; AGG chr2 60454081 60454100 60454084 -
aggccagtgactcagccttt

SEQ ID NO: 185042 - DNA, 20 bp, Artificial Sequence
  Synthetic oligonucleotide; GGG chr2 60454080 60454099 60454083 -
ggccagtgactcagccttta

SEQ ID NO: 185043 - DNA, 20 bp, Artificial Sequence
  Synthetic oligonucleotide; GGG chr2 60454079 60454098 60454082 -
gccagtgactcagcctttag

SEQ ID NO: 185044 - DNA, 20 bp, Artificial Sequence
  Synthetic oligonucleotide; TGG chr2 60454074 60454093 60454077 -
tgactcagcctttaggggaa

SEQ ID NO: 185045 - DNA, 20 bp, Artificial Sequence
  Synthetic oligonucleotide; GGG chr2 60454073 60454092 60454076 -
gactcagcctttaggggaat

SEQ ID NO: 185046 - DNA, 20 bp, Artificial Sequence
  Synthetic oligonucleotide; GGG chr2 60454072 60454091 60454075 -
actcagcctttaggggaatg

SEQ ID NO: 185047 - DNA, 20 bp, Artificial Sequence
  Synthetic oligonucleotide; CAG chr2 60454027 60454046 60454030 -
ctttctctctctctatttcc

SEQ ID NO: 185048 - DNA, 20 bp, Artificial Sequence
  Synthetic oligonucleotide; CGG chr2 60454015 60454034 60454018 -
ctatttcccagcgtcatcta

SEQ ID NO: 185049 - DNA, 20 bp, Artificial Sequence
  Synthetic oligonucleotide; TGG chr2 60454009 60454028 60454012 -
cccagcgtcatctacggtca

SEQ ID NO: 185050 - DNA, 20 bp, Artificial Sequence
  Synthetic oligonucleotide; GGG chr2 60454008 60454027 60454011 -
ccagcgtcatctacggtcat

SEQ ID NO: 185051 - DNA, 20 bp, Artificial Sequence
  Synthetic oligonucleotide; TGG chr2 60453980 60453999 60453983 -
attaattcctcccttccaaa

SEQ ID NO: 185052 - DNA, 20 bp, Artificial Sequence
  Synthetic oligonucleotide; GGG chr2 60453979 60453998 60453982 -
ttaattcctcccttccaaat

SEQ ID NO: 185053 - DNA, 20 bp, Artificial Sequence
  Synthetic oligonucleotide; AAG chr2 60453975 60453994 60453978 -
ttcctcccttccaaatggga

SEQ ID NO: 185054 - DNA, 20 bp, Artificial Sequence
  Synthetic oligonucleotide; GAG chr2 60453973 60453992 60453976 -
cctcccttccaaatgggaaa

SEQ ID NO: 185055 - DNA, 20 bp, Artificial Sequence
  Synthetic oligonucleotide; CAG chr2 60453963 60453982 60453966 -
aaatgggaaagagaccaatc

SEQ ID NO: 185056 - DNA, 20 bp, Artificial Sequence
  Synthetic oligonucleotide; CGG chr2 60453954 60453973 60453957 -
agagaccaatccagttcaca

SEQ ID NO: 185057 - DNA, 20 bp, Artificial Sequence
  Synthetic oligonucleotide; GGG chr2 60453953 60453972 60453956 -
gagaccaatccagttcacac

SEQ ID NO: 185058 - DNA, 20 bp, Artificial Sequence
  Synthetic oligonucleotide; GAG chr2 60453939 60453958 60453942 -
tcacacgggtcattgtactt

SEQ ID NO: 185059 - DNA, 20 bp, Artificial Sequence
  Synthetic oligonucleotide; TGG chr2 60453926 60453945 60453929 -
tgtacttgagaacctaaact

SEQ ID NO: 185060 - DNA, 20 bp, Artificial Sequence
  Synthetic oligonucleotide; CAG chr2 60453916 60453935 60453919 -
aacctaaacttggctgaaca

SEQ ID NO: 185061 - DNA, 20 bp, Artificial Sequence
  Synthetic oligonucleotide; TGG chr2 60453908 60453927 60453911 -
cttggctgaacacagctcga

SEQ ID NO: 185062 - DNA, 20 bp, Artificial Sequence
  Synthetic oligonucleotide; AAG chr2 60453876 60453895 60453879 -
atacgtttttcctttctgta

SEQ ID NO: 185063 - DNA, 20 bp, Artificial Sequence
  Synthetic oligonucleotide; TGG chr2 60453873 60453892 60453876 -
cgtttttcctttctgtaaag

SEQ ID NO: 185064 - DNA, 20 bp, Artificial Sequence
  Synthetic oligonucleotide; AAG chr2 60453857 60453876 60453860 -
aaagtggcaaaaactatttc

SEQ ID NO: 185065 - DNA, 20 bp, Artificial Sequence
  Synthetic oligonucleotide; AGG chr2 60453856 60453875 60453859 -
aagtggcaaaaactatttca

SEQ ID NO: 185066 - DNA, 20 bp, Artificial Sequence
  Synthetic oligonucleotide; GGG chr2 60453855 60453874 60453858 -
agtggcaaaaactatttcaa

SEQ ID NO: 185067 - DNA, 20 bp, Artificial Sequence
  Synthetic oligonucleotide; GAG chr2 60453853 60453872 60453856 -
tggcaaaaactatttcaagg

SEQ ID NO: 185068 - DNA, 20 bp, Artificial Sequence
  Synthetic oligonucleotide; CAG chr2 60453841 60453860 60453844 -
tttcaagggagcacgtgtat

SEQ ID NO: 185069 - DNA, 20 bp, Artificial Sequence
  Synthetic oligonucleotide; TAG chr2 60453830 60453849 60453833 -
cacgtgtatcagatctttca

SEQ ID NO: 185070 - DNA, 20 bp, Artificial Sequence
  Synthetic oligonucleotide; AGG chr2 60453829 60453848 60453832 -
acgtgtatcagatctttcat

SEQ ID NO: 185071 - DNA, 20 bp, Artificial Sequence
  Synthetic oligonucleotide; GGG chr2 60453828 60453847 60453831 -
cgtgtatcagatctttcata

SEQ ID NO: 185072 - DNA, 20 bp, Artificial Sequence
  Synthetic oligonucleotide; TGG chr2 60453824 60453843 60453827 -
tatcagatctttcataggga

SEQ ID NO: 185073 - DNA, 20 bp, Artificial Sequence
  Synthetic oligonucleotide; TAG chr2 60453821 60453840 60453824 -
cagatctttcatagggatgg

SEQ ID NO: 185074 - DNA, 20 bp, Artificial Sequence
  Synthetic oligonucleotide; AAG chr2 60453816 60453835 60453819 -
ctttcatagggatggtagaa

SEQ ID NO: 185075 - DNA, 20 bp, Artificial Sequence
  Synthetic oligonucleotide; AGG chr2 60453815 60453834 60453818 -
tttcatagggatggtagaaa

SEQ ID NO: 185076 - DNA, 20 bp, Artificial Sequence
  Synthetic oligonucleotide; AAG chr2 60453806 60453825 60453809 -
gatggtagaaaaggcaaatt

SEQ ID NO: 185077 - DNA, 20 bp, Artificial Sequence
  Synthetic oligonucleotide; AAG chr2 60453793 60453812 60453796 -
gcaaattaagccatttcccc

SEQ ID NO: 185078 - DNA, 20 bp, Artificial Sequence
  Synthetic oligonucleotide; AAG chr2 60453781 60453800 60453784 -
atttccccaagtatcctcta

SEQ ID NO: 185079 - DNA, 20 bp, Artificial Sequence
  Synthetic oligonucleotide; CGG chr2 60453778 60453797 60453781 -
tccccaagtatcctctaaag

SEQ ID NO: 185080 - DNA, 20 bp, Artificial Sequence
  Synthetic oligonucleotide; GGG chr2 60453777 60453796 60453780 -
ccccaagtatcctctaaagc

SEQ ID NO: 185081 - DNA, 20 bp, Artificial Sequence
  Synthetic oligonucleotide; GAG chr2 60453775 60453794 60453778 -
ccaagtatcctctaaagcgg

SEQ ID NO: 185082 - DNA, 20 bp, Artificial Sequence
  Synthetic oligonucleotide; TAG chr2 60453760 60453779 60453763 -
agcgggagcccctaaaccca

SEQ ID NO: 185083 - DNA, 20 bp, Artificial Sequence
  Synthetic oligonucleotide; AGG chr2 60453759 60453778 60453762 -
gcgggagcccctaaacccat

SEQ ID NO: 185084 - DNA, 20 bp, Artificial Sequence
  Synthetic oligonucleotide; GGG chr2 60453758 60453777 60453761 -
cgggagcccctaaacccata

SEQ ID NO: 185085 - DNA, 20 bp, Artificial Sequence
  Synthetic oligonucleotide; GGG chr2 60453757 60453776 60453760 -
gggagcccctaaacccatag

SEQ ID NO: 185086 - DNA, 20 bp, Artificial Sequence
  Synthetic oligonucleotide; GGG chr2 60453756 60453775 60453759 -
ggagcccctaaacccatagg

SEQ ID NO: 185087 - DNA, 20 bp, Artificial Sequence
  Synthetic oligonucleotide; GGG chr2 60453755 60453774 60453758 -
gagcccctaaacccataggg

SEQ ID NO: 185088 - DNA, 20 bp, Artificial Sequence
  Synthetic oligonucleotide; TAG chr2 60453739 60453758 60453742 -
aggggggctgtgcttttaaa

SEQ ID NO: 185089 - DNA, 20 bp, Artificial Sequence
  Synthetic oligonucleotide; TGG chr2 60453727 60453746 60453730 -
cttttaaatagctgtgaacg

SEQ ID NO: 185090 - DNA, 20 bp, Artificial Sequence
  Synthetic oligonucleotide; TAG chr2 60453697 60453716 60453700 -
ccatgatatactttgtctat

SEQ ID NO: 185091 - DNA, 20 bp, Artificial Sequence
  Synthetic oligonucleotide; TGG chr2 60453683 60453702 60453686 -
gtctattagaatttgaatat

SEQ ID NO: 185092 - DNA, 20 bp, Artificial Sequence
  Synthetic oligonucleotide; TAG chr2 60453680 60453699 60453683 -
tattagaatttgaatattgg

SEQ ID NO: 185093 - DNA, 20 bp, Artificial Sequence
  Synthetic oligonucleotide; CAG chr2 60453677 60453696 60453680 -
tagaatttgaatattggtag

SEQ ID NO: 185094 - DNA, 20 bp, Artificial Sequence
  Synthetic oligonucleotide; AGG chr2 60453676 60453695 60453679 -
agaatttgaatattggtagc

SEQ ID NO: 185095 - DNA, 20 bp, Artificial Sequence
  Synthetic oligonucleotide; TGG chr2 60453672 60453691 60453675 -
tttgaatattggtagcaggt

SEQ ID NO: 185096 - DNA, 20 bp, Artificial Sequence
  Synthetic oligonucleotide; AAG chr2 60453665 60453684 60453668 -
attggtagcaggttggacga

SEQ ID NO: 185097 - DNA, 20 bp, Artificial Sequence
  Synthetic oligonucleotide; AGG chr2 60453664 60453683 60453667 -
ttggtagcaggttggacgaa

SEQ ID NO: 185098 - DNA, 20 bp, Artificial Sequence
  Synthetic oligonucleotide; GGG chr2 60453663 60453682 60453666 -
tggtagcaggttggacgaaa

SEQ ID NO: 185099 - DNA, 20 bp, Artificial Sequence
  Synthetic oligonucleotide; TGG chr2 60453654 60453673 60453657 -
gttggacgaaagggtttgat

SEQ ID NO: 185100 - DNA, 20 bp, Artificial Sequence
  Synthetic oligonucleotide; GGG chr2 60453653 60453672 60453656 -
ttggacgaaagggtttgatt

SEQ ID NO: 185101 - DNA, 20 bp, Artificial Sequence
  Synthetic oligonucleotide; GGG chr2 60453652 60453671 60453655 -
tggacgaaagggtttgattg

SEQ ID NO: 185102 - DNA, 20 bp, Artificial Sequence
  Synthetic oligonucleotide; CAG chr2 60453646 60453665 60453649 -
aaagggtttgattggggtat

SEQ ID NO: 185103 - DNA, 20 bp, Artificial Sequence
  Synthetic oligonucleotide; AAG chr2 60453640 60453659 60453643 -
tttgattggggtatcagcta

SEQ ID NO: 185104 - DNA, 20 bp, Artificial Sequence
  Synthetic oligonucleotide; AGG chr2 60453639 60453658 60453642 -
ttgattggggtatcagctaa

SEQ ID NO: 185105 - DNA, 20 bp, Artificial Sequence
  Synthetic oligonucleotide; GGG chr2 60453638 60453657 60453641 -
tgattggggtatcagctaaa

SEQ ID NO: 185106 - DNA, 20 bp, Artificial Sequence
  Synthetic oligonucleotide; GGG chr2 60453637 60453656 60453640 -
gattggggtatcagctaaag

SEQ ID NO: 185107 - DNA, 20 bp, Artificial Sequence
  Synthetic oligonucleotide; CAG chr2 60453625 60453644 60453628 -
agctaaaggggcctcgacga

SEQ ID NO: 185108 - DNA, 20 bp, Artificial Sequence
  Synthetic oligonucleotide; TAG chr2 60453617 60453636 60453620 -
gggcctcgacgacagtgact

SEQ ID NO: 185109 - DNA, 20 bp, Artificial Sequence
  Synthetic oligonucleotide; TGG chr2 60453611 60453630 60453614 -
cgacgacagtgacttagcgc

SEQ ID NO: 185110 - DNA, 20 bp, Artificial Sequence
  Synthetic oligonucleotide; TGG chr2 60453606 60453625 60453609 -
acagtgacttagcgctggac

SEQ ID NO: 185111 - DNA, 20 bp, Artificial Sequence
  Synthetic oligonucleotide; GGG chr2 60453605 60453624 60453608 -
cagtgacttagcgctggact

SEQ ID NO: 185112 - DNA, 20 bp, Artificial Sequence
  Synthetic oligonucleotide; TGG chr2 60453600 60453619 60453603 -
acttagcgctggactgggaa

SEQ ID NO: 185113 - DNA, 20 bp, Artificial Sequence
  Synthetic oligonucleotide; GGG chr2 60453599 60453618 60453602 -
cttagcgctggactgggaat

SEQ ID NO: 185114 - DNA, 20 bp, Artificial Sequence
  Synthetic oligonucleotide; CAG chr2 60453590 60453609 60453593 -
ggactgggaatgggattccc

SEQ ID NO: 185115 - DNA, 20 bp, Artificial Sequence
  Synthetic oligonucleotide; TGG chr2 60453579 60453598 60453582 -
gggattccccagaacccacc

SEQ ID NO: 185116 - DNA, 20 bp, Artificial Sequence
  Synthetic oligonucleotide; CAG chr2 60453573 60453592 60453576 -
ccccagaacccacctggacg

SEQ ID NO: 185117 - DNA, 20 bp, Artificial Sequence
  Synthetic oligonucleotide; CAG chr2 60453561 60453580 60453564 -
cctggacgcagcatgcccct

SEQ ID NO: 185118 - DNA, 20 bp, Artificial Sequence
  Synthetic oligonucleotide; CAG chr2 60453556 60453575 60453559 -
acgcagcatgcccctcagcc

SEQ ID NO: 185119 - DNA, 20 bp, Artificial Sequence
  Synthetic oligonucleotide; AGG chr2 60453555 60453574 60453558 -
cgcagcatgcccctcagccc

SEQ ID NO: 185120 - DNA, 20 bp, Artificial Sequence
  Synthetic oligonucleotide; CAG chr2 60453536 60453555 60453539 -
caggtctccgctgctctgct

SEQ ID NO: 185121 - DNA, 20 bp, Artificial Sequence
  Synthetic oligonucleotide; AGG chr2 60453535 60453554 60453538 -
aggtctccgctgctctgctc

SEQ ID NO: 185122 - DNA, 20 bp, Artificial Sequence
  Synthetic oligonucleotide; GGG chr2 60453534 60453553 60453537 -
ggtctccgctgctctgctca

SEQ ID NO: 185123 - DNA, 20 bp, Artificial Sequence
  Synthetic oligonucleotide; GGG chr2 60453533 60453552 60453536 -
gtctccgctgctctgctcag

SEQ ID NO: 185124 - DNA, 20 bp, Artificial Sequence
  Synthetic oligonucleotide; TGG chr2 60453530 60453549 60453533 -
tccgctgctctgctcagggg

SEQ ID NO: 185125 - DNA, 20 bp, Artificial Sequence
  Synthetic oligonucleotide; GGG chr2 60453529 60453548 60453532 -
ccgctgctctgctcaggggt

SEQ ID NO: 185126 - DNA, 20 bp, Artificial Sequence
  Synthetic oligonucleotide; GAG chr2 60453520 60453539 60453523 -
tgctcaggggtgggatgcgt

SEQ ID NO: 185127 - DNA, 20 bp, Artificial Sequence
  Synthetic oligonucleotide; GAG chr2 60453518 60453537 60453521 -
ctcaggggtgggatgcgtga

SEQ ID NO: 185128 - DNA, 20 bp, Artificial Sequence
  Synthetic oligonucleotide; CAG chr2 60453515 60453534 60453518 -
aggggtgggatgcgtgagag

SEQ ID NO: 185129 - DNA, 20 bp, Artificial Sequence
  Synthetic oligonucleotide; GAG chr2 60453510 60453529 60453513 -
tgggatgcgtgagagcagct

SEQ ID NO: 185130 - DNA, 20 bp, Artificial Sequence
  Synthetic oligonucleotide; CAG chr2 60453504 60453523 60453507 -
gcgtgagagcagctgagatc

SEQ ID NO: 185131 - DNA, 20 bp, Artificial Sequence
  Synthetic oligonucleotide; CGG chr2 60453497 60453516 60453500 -
agcagctgagatccagaccc

SEQ ID NO: 185132 - DNA, 20 bp, Artificial Sequence
  Synthetic oligonucleotide; GGG chr2 60453496 60453515 60453499 -
gcagctgagatccagacccc

SEQ ID NO: 185133 - DNA, 20 bp, Artificial Sequence
  Synthetic oligonucleotide; CGG chr2 60453486 60453505 60453489 -
tccagaccccgggcctcctg

SEQ ID NO: 185134 - DNA, 20 bp, Artificial Sequence
  Synthetic oligonucleotide; AAG chr2 60453479 60453498 60453482 -
cccgggcctcctgcggcgcc

SEQ ID NO: 185135 - DNA, 20 bp, Artificial Sequence
  Synthetic oligonucleotide; CAG chr2 60453475 60453494 60453478 -
ggcctcctgcggcgccaagt

SEQ ID NO: 185136 - DNA, 20 bp, Artificial Sequence
  Synthetic oligonucleotide; AGG chr2 60453474 60453493 60453477 -
gcctcctgcggcgccaagtc

SEQ ID NO: 185137 - DNA, 20 bp, Artificial Sequence
  Synthetic oligonucleotide; GGG chr2 60453473 60453492 60453476 -
cctcctgcggcgccaagtca

SEQ ID NO: 185138 - DNA, 20 bp, Artificial Sequence
  Synthetic oligonucleotide; GGG chr2 60453472 60453491 60453475 -
ctcctgcggcgccaagtcag

SEQ ID NO: 185139 - DNA, 20 bp, Artificial Sequence
  Synthetic oligonucleotide; GAG chr2 60453470 60453489 60453473 -
cctgcggcgccaagtcaggg

SEQ ID NO: 185140 - DNA, 20 bp, Artificial Sequence
  Synthetic oligonucleotide; GAG chr2 60453468 60453487 60453471 -
tgcggcgccaagtcagggga

SEQ ID NO: 185141 - DNA, 20 bp, Artificial Sequence
  Synthetic oligonucleotide; AGG chr2 60453467 60453486 60453470 -
gcggcgccaagtcaggggag

SEQ ID NO: 185142 - DNA, 20 bp, Artificial Sequence
  Synthetic oligonucleotide; GAG chr2 60453465 60453484 60453468 -
ggcgccaagtcaggggagag

SEQ ID NO: 185143 - DNA, 20 bp, Artificial Sequence
  Synthetic oligonucleotide; AGG chr2 60453464 60453483 60453467 -
gcgccaagtcaggggagagg

SEQ ID NO: 185144 - DNA, 20 bp, Artificial Sequence
  Synthetic oligonucleotide; CAG chr2 60453458 60453477 60453461 -
agtcaggggagaggaggccc

SEQ ID NO: 185145 - DNA, 20 bp, Artificial Sequence
  Synthetic oligonucleotide; AGG chr2 60453457 60453476 60453460 -
gtcaggggagaggaggcccc

SEQ ID NO: 185146 - DNA, 20 bp, Artificial Sequence
  Synthetic oligonucleotide; CGG chr2 60453445 60453464 60453448 -
gaggccccaggcccctgctt

SEQ ID NO: 185147 - DNA, 20 bp, Artificial Sequence
  Synthetic oligonucleotide; GGG chr2 60453444 60453463 60453447 -
aggccccaggcccctgcttc

SEQ ID NO: 185148 - DNA, 20 bp, Artificial Sequence
  Synthetic oligonucleotide; TGG chr2 60453435 60453454 60453438 -
gcccctgcttcgggtcgcca

SEQ ID NO: 185149 - DNA, 20 bp, Artificial Sequence
  Synthetic oligonucleotide; GAG chr2 60453428 60453447 60453431 -
cttcgggtcgccatggcaac

SEQ ID NO: 185150 - DNA, 20 bp, Artificial Sequence
  Synthetic oligonucleotide; AGG chr2 60453427 60453446 60453430 -
ttcgggtcgccatggcaacg

SEQ ID NO: 185151 - DNA, 20 bp, Artificial Sequence
  Synthetic oligonucleotide; TGG chr2 60453422 60453441 60453425 -
gtcgccatggcaacgaggcc

SEQ ID NO: 185152 - DNA, 20 bp, Artificial Sequence
  Synthetic oligonucleotide; CAG chr2 60453412 60453431 60453415 -
caacgaggcctggaatgcca

SEQ ID NO: 185153 - DNA, 20 bp, Artificial Sequence
  Synthetic oligonucleotide; TGG chr2 60453409 60453428 60453412 -
cgaggcctggaatgccacag

SEQ ID NO: 185154 - DNA, 20 bp, Artificial Sequence
  Synthetic oligonucleotide; TAG chr2 60453406 60453425 60453409 -
ggcctggaatgccacagtgg

SEQ ID NO: 185155 - DNA, 20 bp, Artificial Sequence
  Synthetic oligonucleotide; CGG chr2 60453393 60453412 60453396 -
acagtggtagccctcttcct

SEQ ID NO: 185156 - DNA, 20 bp, Artificial Sequence
  Synthetic oligonucleotide; CGG chr2 60453384 60453403 60453387 -
gccctcttcctcggcacatc

SEQ ID NO: 185157 - DNA, 20 bp, Artificial Sequence
  Synthetic oligonucleotide; CAG chr2 60453376 60453395 60453379 -
cctcggcacatccggactcc

SEQ ID NO: 185158 - DNA, 20 bp, Artificial Sequence
  Synthetic oligonucleotide; AAG chr2 60453361 60453380 60453364 -
actcccagttctgctgcttc

SEQ ID NO: 185159 - DNA, 20 bp, Artificial Sequence
  Synthetic oligonucleotide; CAG chr2 60453348 60453367 60453351 -
ctgcttcaagtcaatgtcca

SEQ ID NO: 185160 - DNA, 20 bp, Artificial Sequence
  Synthetic oligonucleotide; AAG chr2 60453344 60453363 60453347 -
ttcaagtcaatgtccacagc

SEQ ID NO: 185161 - DNA, 20 bp, Artificial Sequence
  Synthetic oligonucleotide; AGG chr2 60453343 60453362 60453346 -
tcaagtcaatgtccacagca

SEQ ID NO: 185162 - DNA, 20 bp, Artificial Sequence
  Synthetic oligonucleotide; GGG chr2 60453342 60453361 60453345 -
caagtcaatgtccacagcaa

SEQ ID NO: 185163 - DNA, 20 bp, Artificial Sequence
  Synthetic oligonucleotide; GAG chr2 60453340 60453359 60453343 -
agtcaatgtccacagcaagg

SEQ ID NO: 185164 - DNA, 20 bp, Artificial Sequence
  Synthetic oligonucleotide; AGG chr2 60453339 60453358 60453342 -
gtcaatgtccacagcaaggg

SEQ ID NO: 185165 - DNA, 20 bp, Artificial Sequence
  Synthetic oligonucleotide; CGG chr2 60453331 60453350 60453334 -
ccacagcaagggaggaaccc

SEQ ID NO: 185166 - DNA, 20 bp, Artificial Sequence
  Synthetic oligonucleotide; GAG chr2 60453329 60453348 60453332 -
acagcaagggaggaaccccg

SEQ ID NO: 185167 - DNA, 20 bp, Artificial Sequence
  Synthetic oligonucleotide; AGG chr2 60453328 60453347 60453331 -
cagcaagggaggaaccccgg

SEQ ID NO: 185168 - DNA, 20 bp, Artificial Sequence
  Synthetic oligonucleotide; AAG chr2 60453275 60453294 60453278 -
ttgccttcccccttccaaaa

SEQ ID NO: 185169 - DNA, 20 bp, Artificial Sequence
  Synthetic oligonucleotide; AAG chr2 60453270 60453289 60453273 -
ttcccccttccaaaaaagaa

SEQ ID NO: 185170 - DNA, 20 bp, Artificial Sequence
  Synthetic oligonucleotide; AAG chr2 60453251 60453270 60453254 -
aaagaaaactgcatgtttga

SEQ ID NO: 185171 - DNA, 20 bp, Artificial Sequence
  Synthetic oligonucleotide; CAG chr2 60453242 60453261 60453245 -
tgcatgtttgaaagaaacta

SEQ ID NO: 185172 - DNA, 20 bp, Artificial Sequence
  Synthetic oligonucleotide; AGG chr2 60453241 60453260 60453244 -
gcatgtttgaaagaaactac

SEQ ID NO: 185173 - DNA, 20 bp, Artificial Sequence
  Synthetic oligonucleotide; CAG chr2 60453238 60453257 60453241 -
tgtttgaaagaaactacagg

SEQ ID NO: 185174 - DNA, 20 bp, Artificial Sequence
  Synthetic oligonucleotide; TGG chr2 60453231 60453250 60453234 -
aagaaactacaggcagtttt

SEQ ID NO: 185175 - DNA, 20 bp, Artificial Sequence
  Synthetic oligonucleotide; GAG chr2 60453220 60453239 60453223 -
ggcagtttttggtgcaattt

SEQ ID NO: 185176 - DNA, 20 bp, Artificial Sequence
  Synthetic oligonucleotide; GAG chr2 60453218 60453237 60453221 -
cagtttttggtgcaatttga

SEQ ID NO: 185177 - DNA, 20 bp, Artificial Sequence
  Synthetic oligonucleotide; TGG chr2 60453206 60453225 60453209 -
caatttgagagcaactcttt

SEQ ID NO: 185178 - DNA, 20 bp, Artificial Sequence
  Synthetic oligonucleotide; GGG chr2 60453205 60453224 60453208 -
aatttgagagcaactctttt

SEQ ID NO: 185179 - DNA, 20 bp, Artificial Sequence
  Synthetic oligonucleotide; TGG chr2 60453199 60453218 60453202 -
agagcaactcttttgggttc

SEQ ID NO: 185180 - DNA, 20 bp, Artificial Sequence
  Synthetic oligonucleotide; CAG chr2 60453187 60453206 60453190 -
ttgggttctggttttctctt

SEQ ID NO: 185181 - DNA, 20 bp, Artificial Sequence
  Synthetic oligonucleotide; GAG chr2 60453185 60453204 60453188 -
gggttctggttttctcttca

SEQ ID NO: 185182 - DNA, 20 bp, Artificial Sequence
  Synthetic oligonucleotide; TGG chr2 60453158 60453177 60453161 -
gttcgcctcttgtaaatcat

SEQ ID NO: 185183 - DNA, 20 bp, Artificial Sequence
  Synthetic oligonucleotide; CAG chr2 60453099 60453118 60453102 -
tcgttgtgctgcttttacat

SEQ ID NO: 185184 - DNA, 20 bp, Artificial Sequence
  Synthetic oligonucleotide; GAG chr2 60453057 60453076 60453060 -
tataattttattattatttt

SEQ ID NO: 185185 - DNA, 20 bp, Artificial Sequence
  Synthetic oligonucleotide; AAG chr2 60453054 60453073 60453057 -
aattttattattattttgag

SEQ ID NO: 185186 - DNA, 20 bp, Artificial Sequence
  Synthetic oligonucleotide; AGG chr2 60453053 60453072 60453056 -
attttattattattttgaga

SEQ ID NO: 185187 - DNA, 20 bp, Artificial Sequence
  Synthetic oligonucleotide; AAG chr2 60453010 60453029 60453013 -
tctcccgctctcctcaacca

SEQ ID NO: 185188 - DNA, 20 bp, Artificial Sequence
  Synthetic oligonucleotide; AGG chr2 60453009 60453028 60453012 -
ctcccgctctcctcaaccaa

SEQ ID NO: 185189 - DNA, 20 bp, Artificial Sequence
  Synthetic oligonucleotide; AAG chr2 60452993 60453012 60452996 -
ccaaaggactgtttcttact

SEQ ID NO: 185190 - DNA, 20 bp, Artificial Sequence
  Synthetic oligonucleotide; CAG chr2 60452984 60453003 60452987 -
tgtttcttactaagttttct

SEQ ID NO: 185191 - DNA, 20 bp, Artificial Sequence
  Synthetic oligonucleotide; AAG chr2 60452977 60452996 60452980 -
tactaagttttctcagtcat

SEQ ID NO: 185192 - DNA, 20 bp, Artificial Sequence
  Synthetic oligonucleotide; AGG chr2 60452976 60452995 60452979 -
actaagttttctcagtcata

SEQ ID NO: 185193 - DNA, 20 bp, Artificial Sequence
  Synthetic oligonucleotide; GGG chr2 60452975 60452994 60452978 -
ctaagttttctcagtcataa

SEQ ID NO: 185194 - DNA, 20 bp, Artificial Sequence
  Synthetic oligonucleotide; AAG chr2 60452971 60452990 60452974 -
gttttctcagtcataagggc

SEQ ID NO: 185195 - DNA, 20 bp, Artificial Sequence
  Synthetic oligonucleotide; CAG chr2 60452958 60452977 60452961 -
taagggcaagtgtttccttc

SEQ ID NO: 185196 - DNA, 20 bp, Artificial Sequence
  Synthetic oligonucleotide; AGG chr2 60452957 60452976 60452960 -
aagggcaagtgtttccttcc

SEQ ID NO: 185197 - DNA, 20 bp, Artificial Sequence
  Synthetic oligonucleotide; GAG chr2 60452946 60452965 60452949 -
tttccttccaggtgtgtccc

SEQ ID NO: 185198 - DNA, 20 bp, Artificial Sequence
  Synthetic oligonucleotide; TAG chr2 60452938 60452957 60452941 -
caggtgtgtcccgagtttat

SEQ ID NO: 185199 - DNA, 20 bp, Artificial Sequence
  Synthetic oligonucleotide; AGG chr2 60452937 60452956 60452940 -
aggtgtgtcccgagtttatt

SEQ ID NO: 185200 - DNA, 20 bp, Artificial Sequence
  Synthetic oligonucleotide; TGG chr2 60452921 60452940 60452924 -
tattaggactatcatacaat

SEQ ID NO: 185201 - DNA, 20 bp, Artificial Sequence
  Synthetic oligonucleotide; GGG chr2 60452920 60452939 60452923 -
attaggactatcatacaatt

SEQ ID NO: 185202 - DNA, 20 bp, Artificial Sequence
  Synthetic oligonucleotide; CAG chr2 60452917 60452936 60452920 -
aggactatcatacaattggg

SEQ ID NO: 185203 - DNA, 20 bp, Artificial Sequence
  Synthetic oligonucleotide; AGG chr2 60452916 60452935 60452919 -
ggactatcatacaattgggc

SEQ ID NO: 185204 - DNA, 20 bp, Artificial Sequence
  Synthetic oligonucleotide; GGG chr2 60452915 60452934 60452918 -
gactatcatacaattgggca

SEQ ID NO: 185205 - DNA, 20 bp, Artificial Sequence
  Synthetic oligonucleotide; GGG chr2 60452914 60452933 60452917 -
actatcatacaattgggcag

SEQ ID NO: 185206 - DNA, 20 bp, Artificial Sequence
  Synthetic oligonucleotide; TGG chr2 60452911 60452930 60452914 -
atcatacaattgggcagggg

SEQ ID NO: 185207 - DNA, 20 bp, Artificial Sequence
  Synthetic oligonucleotide; GGG chr2 60452910 60452929 60452913 -
tcatacaattgggcaggggt

SEQ ID NO: 185208 - DNA, 20 bp, Artificial Sequence
  Synthetic oligonucleotide; GGG chr2 60452909 60452928 60452912 -
catacaattgggcaggggtg

SEQ ID NO: 185209 - DNA, 20 bp, Artificial Sequence
  Synthetic oligonucleotide; GGG chr2 60452908 60452927 60452911 -
atacaattgggcaggggtgg

SEQ ID NO: 185210 - DNA, 20 bp, Artificial Sequence
  Synthetic oligonucleotide; GGG chr2 60452907 60452926 60452910 -
tacaattgggcaggggtggg

SEQ ID NO: 185211 - DNA, 20 bp, Artificial Sequence
  Synthetic oligonucleotide; TGG chr2 60452901 60452920 60452904 -
tgggcaggggtggggggacc

SEQ ID NO: 185212 - DNA, 20 bp, Artificial Sequence
  Synthetic oligonucleotide; GGG chr2 60452900 60452919 60452903 -
gggcaggggtggggggacct

SEQ ID NO: 185213 - DNA, 20 bp, Artificial Sequence
  Synthetic oligonucleotide; TGG chr2 60452890 60452909 60452893 -
ggggggacctgggtcctcct

SEQ ID NO: 185214 - DNA, 20 bp, Artificial Sequence
  Synthetic oligonucleotide; GGG chr2 60452889 60452908 60452892 -
gggggacctgggtcctcctt

SEQ ID NO: 185215 - DNA, 20 bp, Artificial Sequence
  Synthetic oligonucleotide; GGG chr2 60452888 60452907 60452891 -
ggggacctgggtcctccttg

SEQ ID NO: 185216 - DNA, 20 bp, Artificial Sequence
  Synthetic oligonucleotide; GGG chr2 60452887 60452906 60452890 -
gggacctgggtcctccttgg

SEQ ID NO: 185217 - DNA, 20 bp, Artificial Sequence
  Synthetic oligonucleotide; GGG chr2 60452886 60452905 60452889 -
ggacctgggtcctccttggg

SEQ ID NO: 185218 - DNA, 20 bp, Artificial Sequence
  Synthetic oligonucleotide; CGG chr2 60452882 60452901 60452885 -
ctgggtcctccttgggggga

SEQ ID NO: 185219 - DNA, 20 bp, Artificial Sequence
  Synthetic oligonucleotide; AAG chr2 60452879 60452898 60452882 -
ggtcctccttggggggacgg

SEQ ID NO: 185220 - DNA, 20 bp, Artificial Sequence
  Synthetic oligonucleotide; AGG chr2 60452878 60452897 60452881 -
gtcctccttggggggacgga

SEQ ID NO: 185221 - DNA, 20 bp, Artificial Sequence
  Synthetic oligonucleotide; GGG chr2 60452877 60452896 60452880 -
tcctccttggggggacggaa

SEQ ID NO: 185222 - DNA, 20 bp, Artificial Sequence
  Synthetic oligonucleotide; GAG chr2 60452875 60452894 60452878 -
ctccttggggggacggaagg

SEQ ID NO: 185223 - DNA, 20 bp, Artificial Sequence
  Synthetic oligonucleotide; AGG chr2 60452874 60452893 60452877 -
tccttggggggacggaaggg

SEQ ID NO: 185224 - DNA, 20 bp, Artificial Sequence
  Synthetic oligonucleotide; GGG chr2 60452873 60452892 60452876 -
ccttggggggacggaaggga

SEQ ID NO: 185225 - DNA, 20 bp, Artificial Sequence
  Synthetic oligonucleotide; GAG chr2 60452871 60452890 60452874 -
ttggggggacggaagggagg

SEQ ID NO: 185226 - DNA, 20 bp, Artificial Sequence
  Synthetic oligonucleotide; AGG chr2 60452870 60452889 60452873 -
tggggggacggaagggaggg

SEQ ID NO: 185227 - DNA, 20 bp, Artificial Sequence
  Synthetic oligonucleotide; TGG chr2 60452865 60452884 60452868 -
ggacggaagggagggaggca

SEQ ID NO: 185228 - DNA, 20 bp, Artificial Sequence
  Synthetic oligonucleotide; GGG chr2 60452864 60452883 60452867 -
gacggaagggagggaggcat

SEQ ID NO: 185229 - DNA, 20 bp, Artificial Sequence
  Synthetic oligonucleotide; AAG chr2 60452861 60452880 60452864 -
ggaagggagggaggcatggg

SEQ ID NO: 185230 - DNA, 20 bp, Artificial Sequence
  Synthetic oligonucleotide; CAG chr2 60452852 60452871 60452855 -
ggaggcatgggaagacgact

SEQ ID NO: 185231 - DNA, 20 bp, Artificial Sequence
  Synthetic oligonucleotide; GAG chr2 60452850 60452869 60452853 -
aggcatgggaagacgactca

SEQ ID NO: 185232 - DNA, 20 bp, Artificial Sequence
  Synthetic oligonucleotide; AGG chr2 60452849 60452868 60452852 -
ggcatgggaagacgactcag

SEQ ID NO: 185233 - DNA, 20 bp, Artificial Sequence
  Synthetic oligonucleotide; CAG chr2 60452845 60452864 60452848 -
tgggaagacgactcagaggt

SEQ ID NO: 185234 - DNA, 20 bp, Artificial Sequence
  Synthetic oligonucleotide; GAG chr2 60452843 60452862 60452846 -
ggaagacgactcagaggtca

SEQ ID NO: 185235 - DNA, 20 bp, Artificial Sequence
  Synthetic oligonucleotide; TGG chr2 60452835 60452854 60452838 -
actcagaggtcagagatact

SEQ ID NO: 185236 - DNA, 20 bp, Artificial Sequence
  Synthetic oligonucleotide; GGG chr2 60452834 60452853 60452837 -
ctcagaggtcagagatactt

SEQ ID NO: 185237 - DNA, 20 bp, Artificial Sequence
  Synthetic oligonucleotide; GGG chr2 60452833 60452852 60452836 -
tcagaggtcagagatacttg

SEQ ID NO: 185238 - DNA, 20 bp, Artificial Sequence
  Synthetic oligonucleotide; GAG chr2 60452831 60452850 60452834 -
agaggtcagagatacttggg

SEQ ID NO: 185239 - DNA, 20 bp, Artificial Sequence
  Synthetic oligonucleotide; AGG chr2 60452830 60452849 60452833 -
gaggtcagagatacttgggg

SEQ ID NO: 185240 - DNA, 20 bp, Artificial Sequence
  Synthetic oligonucleotide; GGG chr2 60452829 60452848 60452832 -
aggtcagagatacttgggga

SEQ ID NO: 185241 - DNA, 20 bp, Artificial Sequence
  Synthetic oligonucleotide; GGG chr2 60452828 60452847 60452831 -
ggtcagagatacttggggag

SEQ ID NO: 185242 - DNA, 20 bp, Artificial Sequence
  Synthetic oligonucleotide; GAG chr2 60452826 60452845 60452829 -
tcagagatacttggggaggg

SEQ ID NO: 185243 - DNA, 20 bp, Artificial Sequence
  Synthetic oligonucleotide; AGG chr2 60452825 60452844 60452828 -
cagagatacttggggagggg

SEQ ID NO: 185244 - DNA, 20 bp, Artificial Sequence
  Synthetic oligonucleotide; GAG chr2 60452820 60452839 60452823 -
atacttggggaggggaggct

SEQ ID NO: 185245 - DNA, 20 bp, Artificial Sequence
  Synthetic oligonucleotide; AAG chr2 60452802 60452821 60452805 -
ctgagtttgaaatcatgctt

SEQ ID NO: 185246 - DNA, 20 bp, Artificial Sequence
  Synthetic oligonucleotide; CAG chr2 60452795 60452814 60452798 -
tgaaatcatgcttaagatgc

SEQ ID NO: 185247 - DNA, 20 bp, Artificial Sequence
  Synthetic oligonucleotide; TGG chr2 60452792 60452811 60452795 -
aatcatgcttaagatgccag

SEQ ID NO: 185248 - DNA, 20 bp, Artificial Sequence
  Synthetic oligonucleotide; TGG chr2 60452780 60452799 60452783 -
gatgccagtggctcgacctg

SEQ ID NO: 185249 - DNA, 20 bp, Artificial Sequence
  Synthetic oligonucleotide; TGG chr2 60452776 60452795 60452779 -
ccagtggctcgacctgtggt

SEQ ID NO: 185250 - DNA, 20 bp, Artificial Sequence
  Synthetic oligonucleotide; AAG chr2 60452770 60452789 60452773 -
gctcgacctgtggttggttt

SEQ ID NO: 185251 - DNA, 20 bp, Artificial Sequence
  Synthetic oligonucleotide; AAG chr2 60452753 60452772 60452756 -
tttaagttctaatttttaaa

SEQ ID NO: 185252 - DNA, 20 bp, Artificial Sequence
  Synthetic oligonucleotide; TAG chr2 60452749 60452768 60452752 -
agttctaatttttaaaaagc

SEQ ID NO: 185253 - DNA, 20 bp, Artificial Sequence
  Synthetic oligonucleotide; TAG chr2 60452745 60452764 60452748 -
ctaatttttaaaaagctagt

SEQ ID NO: 185254 - DNA, 20 bp, Artificial Sequence
  Synthetic oligonucleotide; GAG chr2 60452743 60452762 60452746 -
aatttttaaaaagctagtta

SEQ ID NO: 185255 - DNA, 20 bp, Artificial Sequence
  Synthetic oligonucleotide; CAG chr2 60452738 60452757 60452741 -
ttaaaaagctagttagagaa

SEQ ID NO: 185256 - DNA, 20 bp, Artificial Sequence
  Synthetic oligonucleotide; TGG chr2 60452727 60452746 60452730 -
gttagagaacagaaaatcat

SEQ ID NO: 185257 - DNA, 20 bp, Artificial Sequence
  Synthetic oligonucleotide; GGG chr2 60452726 60452745 60452729 -
ttagagaacagaaaatcatt

SEQ ID NO: 185258 - DNA, 20 bp, Artificial Sequence
  Synthetic oligonucleotide; AAG chr2 60452721 60452740 60452724 -
gaacagaaaatcattgggcc

SEQ ID NO: 185259 - DNA, 20 bp, Artificial Sequence
  Synthetic oligonucleotide; TAG chr2 60452670 60452689 60452673 -
ctctgtctccaacctctttc

SEQ ID NO: 185260 - DNA, 20 bp, Artificial Sequence
  Synthetic oligonucleotide; AGG chr2 60452669 60452688 60452672 -
tctgtctccaacctctttct

SEQ ID NO: 185261 - DNA, 20 bp, Artificial Sequence
  Synthetic oligonucleotide; CGG chr2 60452647 60452666 60452650 -
gttcttcacacacccccatt

SEQ ID NO: 185262 - DNA, 20 bp, Artificial Sequence
  Synthetic oligonucleotide; TAG chr2 60452642 60452661 60452645 -
tcacacacccccattcggcg

SEQ ID NO: 185263 - DNA, 20 bp, Artificial Sequence
  Synthetic oligonucleotide; CAG chr2 60452635 60452654 60452638 -
cccccattcggcgtagtacc

SEQ ID NO: 185264 - DNA, 20 bp, Artificial Sequence
  Synthetic oligonucleotide; GAG chr2 60452633 60452652 60452636 -
cccattcggcgtagtaccca

SEQ ID NO: 185265 - DNA, 20 bp, Artificial Sequence
  Synthetic oligonucleotide; GAG chr2 60452631 60452650 60452634 -
cattcggcgtagtacccaga

SEQ ID NO: 185266 - DNA, 20 bp, Artificial Sequence
  Synthetic oligonucleotide; AAG chr2 60452625 60452644 60452628 -
gcgtagtacccagagagctc

SEQ ID NO: 185267 - DNA, 20 bp, Artificial Sequence
  Synthetic oligonucleotide; TGG chr2 60452617 60452636 60452620 -
cccagagagctcaagatgtg

SEQ ID NO: 185268 - DNA, 20 bp, Artificial Sequence
  Synthetic oligonucleotide; CAG chr2 60452614 60452633 60452617 -
agagagctcaagatgtgtgg

SEQ ID NO: 185269 - DNA, 20 bp, Artificial Sequence
  Synthetic oligonucleotide; CGG chr2 60452607 60452626 60452610 -
tcaagatgtgtggcagtttt

SEQ ID NO: 185270 - DNA, 20 bp, Artificial Sequence
  Synthetic oligonucleotide; TGG chr2 60452603 60452622 60452606 -
gatgtgtggcagttttcgga

SEQ ID NO: 185271 - DNA, 20 bp, Artificial Sequence
  Synthetic oligonucleotide; AAG chr2 60452600 60452619 60452603 -
gtgtggcagttttcggatgg

SEQ ID NO: 185272 - DNA, 20 bp, Artificial Sequence
  Synthetic oligonucleotide; GAG chr2 60452594 60452613 60452597 -
cagttttcggatggaagctc

SEQ ID NO: 185273 - DNA, 20 bp, Artificial Sequence
  Synthetic oligonucleotide; GAG chr2 60452592 60452611 60452595 -
gttttcggatggaagctcga

SEQ ID NO: 185274 - DNA, 20 bp, Artificial Sequence
  Synthetic oligonucleotide; AAG chr2 60452584 60452603 60452587 -
atggaagctcgagagccctt

SEQ ID NO: 185275 - DNA, 20 bp, Artificial Sequence
  Synthetic oligonucleotide; GAG chr2 60452577 60452596 60452580 -
ctcgagagcccttaagttct

SEQ ID NO: 185276 - DNA, 20 bp, Artificial Sequence
  Synthetic oligonucleotide; AAG chr2 60452566 60452585 60452569 -
ttaagttctgagaaaatttg

SEQ ID NO: 185277 - DNA, 20 bp, Artificial Sequence
  Synthetic oligonucleotide; CAG chr2 60452559 60452578 60452562 -
ctgagaaaatttgaagcccc

SEQ ID NO: 185278 - DNA, 20 bp, Artificial Sequence
  Synthetic oligonucleotide; AGG chr2 60452558 60452577 60452561 -
tgagaaaatttgaagccccc

SEQ ID NO: 185279 - DNA, 20 bp, Artificial Sequence
  Synthetic oligonucleotide; GGG chr2 60452557 60452576 60452560 -
gagaaaatttgaagccccca

SEQ ID NO: 185280 - DNA, 20 bp, Artificial Sequence
  Synthetic oligonucleotide; GGG chr2 60452556 60452575 60452559 -
agaaaatttgaagcccccag

SEQ ID NO: 185281 - DNA, 20 bp, Artificial Sequence
  Synthetic oligonucleotide; TGG chr2 60452553 60452572 60452556 -
aaatttgaagcccccagggg

SEQ ID NO: 185282 - DNA, 20 bp, Artificial Sequence
  Synthetic oligonucleotide; GGG chr2 60452552 60452571 60452555 -
aatttgaagcccccaggggt

SEQ ID NO: 185283 - DNA, 20 bp, Artificial Sequence
  Synthetic oligonucleotide; GGG chr2 60452551 60452570 60452554 -
atttgaagcccccaggggtg

SEQ ID NO: 185284 - DNA, 20 bp, Artificial Sequence
  Synthetic oligonucleotide; TGG chr2 60452548 60452567 60452551 -
tgaagcccccaggggtgggg

SEQ ID NO: 185285 - DNA, 20 bp, Artificial Sequence
  Synthetic oligonucleotide; CAG chr2 60452533 60452552 60452536 -
tggggtggacgcgtgccgcc

SEQ ID NO: 185286 - DNA, 20 bp, Artificial Sequence
  Synthetic oligonucleotide; CAG chr2 60452523 60452542 60452526 -
gcgtgccgcccagtcgacgt

SEQ ID NO: 185287 - DNA, 20 bp, Artificial Sequence
  Synthetic oligonucleotide; TGG chr2 60452518 60452537 60452521 -
ccgcccagtcgacgtcagcg

SEQ ID NO: 185288 - DNA, 20 bp, Artificial Sequence
  Synthetic oligonucleotide; TAG chr2 60452502 60452521 60452505 -
agcgtggtctgtcatcctgc

SEQ ID NO: 185289 - DNA, 20 bp, Artificial Sequence
  Synthetic oligonucleotide; CAG chr2 60452482 60452501 60452485 -
tagtttgtgatgttttctga

SEQ ID NO: 185290 - DNA, 20 bp, Artificial Sequence
  Synthetic oligonucleotide; TAG chr2 60452479 60452498 60452482 -
tttgtgatgttttctgacag

SEQ ID NO: 185291 - DNA, 20 bp, Artificial Sequence
  Synthetic oligonucleotide; AAG chr2 60452471 60452490 60452474 -
gttttctgacagtagcctcc

SEQ ID NO: 185292 - DNA, 20 bp, Artificial Sequence
  Synthetic oligonucleotide; AAG chr2 60452468 60452487 60452471 -
ttctgacagtagcctccaag

SEQ ID NO: 185293 - DNA, 20 bp, Artificial Sequence
  Synthetic oligonucleotide; AAG chr2 60452455 60452474 60452458 -
ctccaagaagccgttgtgcg

SEQ ID NO: 185294 - DNA, 20 bp, Artificial Sequence
  Synthetic oligonucleotide; CAG chr2 60452451 60452470 60452454 -
aagaagccgttgtgcgaaga

SEQ ID NO: 185295 - DNA, 20 bp, Artificial Sequence
  Synthetic oligonucleotide; GAG chr2 60452449 60452468 60452452 -
gaagccgttgtgcgaagaca

SEQ ID NO: 185296 - DNA, 20 bp, Artificial Sequence
  Synthetic oligonucleotide; CAG chr2 60452441 60452460 60452444 -
tgtgcgaagacagagtcctg

SEQ ID NO: 185297 - DNA, 20 bp, Artificial Sequence
  Synthetic oligonucleotide; GAG chr2 60452439 60452458 60452442 -
tgcgaagacagagtcctgca

SEQ ID NO: 185298 - DNA, 20 bp, Artificial Sequence
  Synthetic oligonucleotide; CAG chr2 60452430 60452449 60452433 -
agagtcctgcagagtccttc

SEQ ID NO: 185299 - DNA, 20 bp, Artificial Sequence
  Synthetic oligonucleotide; TAG chr2 60452425 60452444 60452428 -
cctgcagagtccttccagcc

SEQ ID NO: 185300 - DNA, 20 bp, Artificial Sequence
  Synthetic oligonucleotide; AGG chr2 60452424 60452443 60452427 -
ctgcagagtccttccagcct

SEQ ID NO: 185301 - DNA, 20 bp, Artificial Sequence
  Synthetic oligonucleotide; CAG chr2 60452417 60452436 60452420 -
gtccttccagcctaggcctg

SEQ ID NO: 185302 - DNA, 20 bp, Artificial Sequence
  Synthetic oligonucleotide; AAG chr2 60452386 60452405 60452389 -
tatttatattttttaataaa

SEQ ID NO: 185303 - DNA, 20 bp, Artificial Sequence
  Synthetic oligonucleotide; CAG chr2 60452369 60452388 60452372 -
aaaaagtaaaaacaaaaaaa

SEQ ID NO: 185304 - DNA, 20 bp, Artificial Sequence
  Synthetic oligonucleotide; TGG chr2 60452358 60452377 60452361 -
acaaaaaaacagacccacat

SEQ ID NO: 185305 - DNA, 20 bp, Artificial Sequence
  Synthetic oligonucleotide; CAG chr2 60452353 60452372 60452356 -
aaaacagacccacattggaa

SEQ ID NO: 185306 - DNA, 20 bp, Artificial Sequence
  Synthetic oligonucleotide; CAG chr2 60452345 60452364 60452348 -
cccacattggaacagtgaat

SEQ ID NO: 185307 - DNA, 20 bp, Artificial Sequence
  Synthetic oligonucleotide; TAG chr2 60452337 60452356 60452340 -
ggaacagtgaatcagtccca

SEQ ID NO: 185308 - DNA, 20 bp, Artificial Sequence
  Synthetic oligonucleotide; GAG chr2 60452335 60452354 60452338 -
aacagtgaatcagtcccata

SEQ ID NO: 185309 - DNA, 20 bp, Artificial Sequence
  Synthetic oligonucleotide; GAG chr2 60452333 60452352 60452336 -
cagtgaatcagtcccataga

SEQ ID NO: 185310 - DNA, 20 bp, Artificial Sequence
  Synthetic oligonucleotide; AGG chr2 60452332 60452351 60452335 -
agtgaatcagtcccatagag

SEQ ID NO: 185311 - DNA, 20 bp, Artificial Sequence
  Synthetic oligonucleotide; GGG chr2 60452331 60452350 60452334 -
gtgaatcagtcccatagaga

SEQ ID NO: 185312 - DNA, 20 bp, Artificial Sequence
  Synthetic oligonucleotide; TGG chr2 60452324 60452343 60452327 -
agtcccatagagagggcccg

SEQ ID NO: 185313 - DNA, 20 bp, Artificial Sequence
  Synthetic oligonucleotide; GAG chr2 60452307 60452326 60452310 -
ccgtggaccatcgctgtcat

SEQ ID NO: 185314 - DNA, 20 bp, Artificial Sequence
  Synthetic oligonucleotide; TGG chr2 60452296 60452315 60452299 -
cgctgtcatgagtgatgccc

SEQ ID NO: 185315 - DNA, 20 bp, Artificial Sequence
  Synthetic oligonucleotide; CAG chr2 60452281 60452300 60452284 -
tgccctggcccttctgaaac

SEQ ID NO: 185316 - DNA, 20 bp, Artificial Sequence
  Synthetic oligonucleotide; TGG chr2 60452257 60452276 60452260 -
caacctaattacctgtattg

SEQ ID NO: 185317 - DNA, 20 bp, Artificial Sequence
  Synthetic oligonucleotide; GAG chr2 60452244 60452263 60452247 -
tgtattgtggaaatgcgcat

SEQ ID NO: 185318 - DNA, 20 bp, Artificial Sequence
  Synthetic oligonucleotide; AAG chr2 60452198 60452217 60452201 -
attctatgttgtcttttaaa

SEQ ID NO: 185319 - DNA, 20 bp, Artificial Sequence
  Synthetic oligonucleotide; TGG chr2 60452168 60452187 60452171 -
aacattgacacaataaatgt

SEQ ID NO: 185320 - DNA, 20 bp, Artificial Sequence
  Synthetic oligonucleotide; GAG chr2 60452166 60452185 60452169 -
cattgacacaataaatgttg

SEQ ID NO: 185321 - DNA, 20 bp, Artificial Sequence
  Synthetic oligonucleotide; TAG chr2 60452160 60452179 60452163 -
cacaataaatgttggagctt

SEQ ID NO: 185322 - DNA, 20 bp, Artificial Sequence
  Synthetic oligonucleotide; AGG chr2 60452159 60452178 60452162 -
acaataaatgttggagcttt

SEQ ID NO: 185323 - DNA, 20 bp, Artificial Sequence
  Synthetic oligonucleotide; TGG chr2 60452156 60452175 60452159 -
ataaatgttggagctttagg

SEQ ID NO: 185324 - DNA, 20 bp, Artificial Sequence
  Synthetic oligonucleotide; AAG chr2 60452121 60452140 60452124 -
ctttaatttttaatgcttat

SEQ ID NO: 185325 - DNA, 20 bp, Artificial Sequence
  Synthetic oligonucleotide; GAG chr2 60452113 60452132 60452116 -
tttaatgcttataagacaat

SEQ ID NO: 185326 - DNA, 20 bp, Artificial Sequence
  Synthetic oligonucleotide; AGG chr2 60452112 60452131 60452115 -
ttaatgcttataagacaatg

SEQ ID NO: 185327 - DNA, 20 bp, Artificial Sequence
  Synthetic oligonucleotide; CAG chr2 60452073 60452092 60452076 -
acttctgtacctgtttccta

SEQ ID NO: 185328 - DNA, 20 bp, Artificial Sequence
  Synthetic oligonucleotide; CGG chr2 60452062 60452081 60452065 -
tgtttcctacagacacccat

SEQ ID NO: 185329 - DNA, 20 bp, Artificial Sequence
  Synthetic oligonucleotide; GGG chr2 60452061 60452080 60452064 -
gtttcctacagacacccatc

SEQ ID NO: 185330 - DNA, 20 bp, Artificial Sequence
  Synthetic oligonucleotide; TGG chr2 60452058 60452077 60452061 -
tcctacagacacccatcggg

SEQ ID NO: 185331 - DNA, 20 bp, Artificial Sequence
  Synthetic oligonucleotide; GGG chr2 60452057 60452076 60452060 -
cctacagacacccatcgggt

SEQ ID NO: 185332 - DNA, 20 bp, Artificial Sequence
  Synthetic oligonucleotide; TAG chr2 60452054 60452073 60452057 -
acagacacccatcgggtggg

SEQ ID NO: 185333 - DNA, 20 bp, Artificial Sequence
  Synthetic oligonucleotide; AGG chr2 60452053 60452072 60452056 -
cagacacccatcgggtgggt

SEQ ID NO: 185334 - DNA, 20 bp, Artificial Sequence
  Synthetic oligonucleotide; GAG chr2 60452051 60452070 60452054 -
gacacccatcgggtgggtag

SEQ ID NO: 185335 - DNA, 20 bp, Artificial Sequence
  Synthetic oligonucleotide; AGG chr2 60452050 60452069 60452053 -
acacccatcgggtgggtagg

SEQ ID NO: 185336 - DNA, 20 bp, Artificial Sequence
  Synthetic oligonucleotide; CAG chr2 60452045 60452064 60452048 -
catcgggtgggtaggaggaa

SEQ ID NO: 185337 - DNA, 20 bp, Artificial Sequence
  Synthetic oligonucleotide; GAG chr2 60452038 60452057 60452041 -
tgggtaggaggaacagattt

SEQ ID NO: 185338 - DNA, 20 bp, Artificial Sequence
  Synthetic oligonucleotide; TGG chr2 60452032 60452051 60452035 -
ggaggaacagatttgagaaa

SEQ ID NO: 185339 - DNA, 20 bp, Artificial Sequence
  Synthetic oligonucleotide; GGG chr2 60452031 60452050 60452034 -
gaggaacagatttgagaaat

SEQ ID NO: 185340 - DNA, 20 bp, Artificial Sequence
  Synthetic oligonucleotide; CAG chr2 60452028 60452047 60452031 -
gaacagatttgagaaatggg

SEQ ID NO: 185341 - DNA, 20 bp, Artificial Sequence
  Synthetic oligonucleotide; AGG chr2 60452027 60452046 60452030 -
aacagatttgagaaatgggc

SEQ ID NO: 185342 - DNA, 20 bp, Artificial Sequence
  Synthetic oligonucleotide; GAG chr2 60452025 60452044 60452028 -
cagatttgagaaatgggcag

SEQ ID NO: 185343 - DNA, 20 bp, Artificial Sequence
  Synthetic oligonucleotide; TAG chr2 60452019 60452038 60452022 -
tgagaaatgggcaggagatg

SEQ ID NO: 185344 - DNA, 20 bp, Artificial Sequence
  Synthetic oligonucleotide; AGG chr2 60452018 60452037 60452021 -
gagaaatgggcaggagatgt

SEQ ID NO: 185345 - DNA, 20 bp, Artificial Sequence
  Synthetic oligonucleotide; GAG chr2 60452016 60452035 60452019 -
gaaatgggcaggagatgtag

SEQ ID NO: 185346 - DNA, 20 bp, Artificial Sequence
  Synthetic oligonucleotide; AGG chr2 60452015 60452034 60452018 -
aaatgggcaggagatgtagg

SEQ ID NO: 185347 - DNA, 20 bp, Artificial Sequence
  Synthetic oligonucleotide; GGG chr2 60452014 60452033 60452017 -
aatgggcaggagatgtagga

SEQ ID NO: 185348 - DNA, 20 bp, Artificial Sequence
  Synthetic oligonucleotide; GGG chr2 60452013 60452032 60452016 -
atgggcaggagatgtaggag

SEQ ID NO: 185349 - DNA, 20 bp, Artificial Sequence
  Synthetic oligonucleotide; TAG chr2 60452007 60452026 60452010 -
aggagatgtaggaggggaac

SEQ ID NO: 185350 - DNA, 20 bp, Artificial Sequence
  Synthetic oligonucleotide; AGG chr2 60452006 60452025 60452009 -
ggagatgtaggaggggaact

SEQ ID NO: 185351 - DNA, 20 bp, Artificial Sequence
  Synthetic oligonucleotide; CAG chr2 60451992 60452011 60451995 -
ggaactaggttaccgcttat

SEQ ID NO: 185352 - DNA, 20 bp, Artificial Sequence
  Synthetic oligonucleotide; TGG chr2 60451988 60452007 60451991 -
ctaggttaccgcttatcaga

SEQ ID NO: 185353 - DNA, 20 bp, Artificial Sequence
  Synthetic oligonucleotide; AAG chr2 60451974 60451993 60451977 -
atcagatggcataaattttc

SEQ ID NO: 185354 - DNA, 20 bp, Artificial Sequence
  Synthetic oligonucleotide; AGG chr2 60451973 60451992 60451976 -
tcagatggcataaattttca

SEQ ID NO: 185355 - DNA, 20 bp, Artificial Sequence
  Synthetic oligonucleotide; GAG chr2 60451971 60451990 60451974 -
agatggcataaattttcaag

SEQ ID NO: 185356 - DNA, 20 bp, Artificial Sequence
  Synthetic oligonucleotide; TGG chr2 60451951 60451970 60451954 -
gagaatcaaaatgcaaaact

SEQ ID NO: 185357 - DNA, 20 bp, Artificial Sequence
  Synthetic oligonucleotide; GGG chr2 60451950 60451969 60451953 -
agaatcaaaatgcaaaactt

SEQ ID NO: 185358 - DNA, 20 bp, Artificial Sequence
  Synthetic oligonucleotide; TAG chr2 60451938 60451957 60451941 -
caaaacttgggaataaatca

SEQ ID NO: 185359 - DNA, 20 bp, Artificial Sequence
  Synthetic oligonucleotide; TAG chr2 60451918 60451937 60451921 -
tagcaatatcataattaatg

SEQ ID NO: 185360 - DNA, 20 bp, Artificial Sequence
  Synthetic oligonucleotide; TAG chr2 60451915 60451934 60451918 -
caatatcataattaatgtag

SEQ ID NO: 185361 - DNA, 20 bp, Artificial Sequence
  Synthetic oligonucleotide; AAG chr2 60451888 60451907 60451891 -
attgctgtttattaatgctg

SEQ ID NO: 185362 - DNA, 20 bp, Artificial Sequence
  Synthetic oligonucleotide; TGG chr2 60451883 60451902 60451886 -
tgtttattaatgctgaagtg

SEQ ID NO: 185363 - DNA, 20 bp, Artificial Sequence
  Synthetic oligonucleotide; TGG chr2 60451828 60451847 60451831 -
ccattaaataatgcataata

SEQ ID NO: 185364 - DNA, 20 bp, Artificial Sequence
  Synthetic oligonucleotide; TGG chr2 60451792 60451811 60451795 -
gtttttcaaatatatgcttt

SEQ ID NO: 185365 - DNA, 20 bp, Artificial Sequence
  Synthetic oligonucleotide; TGG chr2 60451789 60451808 60451792 -
tttcaaatatatgcttttgg

SEQ ID NO: 185366 - DNA, 20 bp, Artificial Sequence
  Synthetic oligonucleotide; CAG chr2 60451778 60451797 60451781 -
tgcttttggtggctaccatg

SEQ ID NO: 185367 - DNA, 20 bp, Artificial Sequence
  Synthetic oligonucleotide; AGG chr2 60451777 60451796 60451780 -
gcttttggtggctaccatgc

SEQ ID NO: 185368 - DNA, 20 bp, Artificial Sequence
  Synthetic oligonucleotide; TAG chr2 60451753 60451772 60451756 -
tttgaatttgtcttttaatt

SEQ ID NO: 185369 - DNA, 20 bp, Artificial Sequence
  Synthetic oligonucleotide; TAG chr2 60451748 60451767 60451751 -
atttgtcttttaatttagct

SEQ ID NO: 185370 - DNA, 20 bp, Artificial Sequence
  Synthetic oligonucleotide; AGG chr2 60451747 60451766 60451750 -
tttgtcttttaatttagctt

SEQ ID NO: 185371 - DNA, 20 bp, Artificial Sequence
  Synthetic oligonucleotide; AAG chr2 60451743 60451762 60451746 -
tcttttaatttagcttagga

SEQ ID NO: 185372 - DNA, 20 bp, Artificial Sequence
  Synthetic oligonucleotide; TGG chr2 60451732 60451751 60451735 -
agcttaggaaagaacatcac

SEQ ID NO: 185373 - DNA, 20 bp, Artificial Sequence
  Synthetic oligonucleotide; GGG chr2 60451731 60451750 60451734 -
gcttaggaaagaacatcact

SEQ ID NO: 185374 - DNA, 20 bp, Artificial Sequence
  Synthetic oligonucleotide; GAG chr2 60451727 60451746 60451730 -
aggaaagaacatcactgggc

SEQ ID NO: 185375 - DNA, 20 bp, Artificial Sequence
  Synthetic oligonucleotide; CGG chr2 60451724 60451743 60451727 -
aaagaacatcactgggcgag

SEQ ID NO: 185376 - DNA, 20 bp, Artificial Sequence
  Synthetic oligonucleotide; AAG chr2 60451712 60451731 60451715 -
tgggcgagcggtaaatccta

SEQ ID NO: 185377 - DNA, 20 bp, Artificial Sequence
  Synthetic oligonucleotide; AAG chr2 60451709 60451728 60451712 -
gcgagcggtaaatcctaaag

SEQ ID NO: 185378 - DNA, 20 bp, Artificial Sequence
  Synthetic oligonucleotide; AGG chr2 60451708 60451727 60451711 -
cgagcggtaaatcctaaaga

SEQ ID NO: 185379 - DNA, 20 bp, Artificial Sequence
  Synthetic oligonucleotide; CAG chr2 60451695 60451714 60451698 -
ctaaagaaggtgataaatgt

SEQ ID NO: 185380 - DNA, 20 bp, Artificial Sequence
  Synthetic oligonucleotide; TAG chr2 60451692 60451711 60451695 -
aagaaggtgataaatgtcag

SEQ ID NO: 185381 - DNA, 20 bp, Artificial Sequence
  Synthetic oligonucleotide; TAG chr2 60451666 60451685 60451669 -
cttattaaatattctaattt

SEQ ID NO: 185382 - DNA, 20 bp, Artificial Sequence
  Synthetic oligonucleotide; AGG chr2 60451665 60451684 60451668 -
ttattaaatattctaatttt

SEQ ID NO: 185383 - DNA, 20 bp, Artificial Sequence
  Synthetic oligonucleotide; CAG chr2 60451650 60451669 60451653 -
attttaggttcccaaacctt

SEQ ID NO: 185384 - DNA, 20 bp, Artificial Sequence
  Synthetic oligonucleotide; AGG chr2 60451649 60451668 60451652 -
ttttaggttcccaaaccttc

SEQ ID NO: 185385 - DNA, 20 bp, Artificial Sequence
  Synthetic oligonucleotide; CAG chr2 60451631 60451650 60451634 -
tcaggaaatatatcttaatg

SEQ ID NO: 185386 - DNA, 20 bp, Artificial Sequence
  Synthetic oligonucleotide; TAG chr2 60451606 60451625 60451609 -
aaacaaacataaaacttctt

SEQ ID NO: 185387 - DNA, 20 bp, Artificial Sequence
  Synthetic oligonucleotide; CAG chr2 60451594 60451613 60451597 -
aacttctttagtacttacat

SEQ ID NO: 185388 - DNA, 20 bp, Artificial Sequence
  Synthetic oligonucleotide; AGG chr2 60451593 60451612 60451596 -
acttctttagtacttacatc

SEQ ID NO: 185389 - DNA, 20 bp, Artificial Sequence
  Synthetic oligonucleotide; TGG chr2 60451585 60451604 60451588 -
agtacttacatcaggaaatt

SEQ ID NO: 185390 - DNA, 20 bp, Artificial Sequence
  Synthetic oligonucleotide; GGG chr2 60451584 60451603 60451587 -
gtacttacatcaggaaattt

SEQ ID NO: 185391 - DNA, 20 bp, Artificial Sequence
  Synthetic oligonucleotide; GGG chr2 60451583 60451602 60451586 -
tacttacatcaggaaatttg

SEQ ID NO: 185392 - DNA, 20 bp, Artificial Sequence
  Synthetic oligonucleotide; CAG chr2 60451580 60451599 60451583 -
ttacatcaggaaatttgggg

SEQ ID NO: 185393 - DNA, 20 bp, Artificial Sequence
  Synthetic oligonucleotide; TAG chr2 60451573 60451592 60451576 -
aggaaatttggggcagattt

SEQ ID NO: 185394 - DNA, 20 bp, Artificial Sequence
  Synthetic oligonucleotide; GAG chr2 60451571 60451590 60451574 -
gaaatttggggcagatttta

SEQ ID NO: 185395 - DNA, 20 bp, Artificial Sequence
  Synthetic oligonucleotide; AGG chr2 60451570 60451589 60451573 -
aaatttggggcagattttag

SEQ ID NO: 185396 - DNA, 20 bp, Artificial Sequence
  Synthetic oligonucleotide; GGG chr2 60451569 60451588 60451572 -
aatttggggcagattttaga

SEQ ID NO: 185397 - DNA, 20 bp, Artificial Sequence
  Synthetic oligonucleotide; GGG chr2 60451568 60451587 60451571 -
atttggggcagattttagag

SEQ ID NO: 185398 - DNA, 20 bp, Artificial Sequence
  Synthetic oligonucleotide; GGG chr2 60451567 60451586 60451570 -
tttggggcagattttagagg

SEQ ID NO: 185399 - DNA, 20 bp, Artificial Sequence
  Synthetic oligonucleotide; GGG chr2 60451566 60451585 60451569 -
ttggggcagattttagaggg

SEQ ID NO: 185400 - DNA, 20 bp, Artificial Sequence
  Synthetic oligonucleotide; TAG chr2 60451557 60451576 60451560 -
attttagaggggggaaatta

SEQ ID NO: 185401 - DNA, 20 bp, Artificial Sequence
  Synthetic oligonucleotide; AGG chr2 60451556 60451575 60451559 -
ttttagaggggggaaattat

SEQ ID NO: 185402 - DNA, 20 bp, Artificial Sequence
  Synthetic oligonucleotide; GAG chr2 60451554 60451573 60451557 -
ttagaggggggaaattatag

SEQ ID NO: 185403 - DNA, 20 bp, Artificial Sequence
  Synthetic oligonucleotide; AGG chr2 60451553 60451572 60451556 -
tagaggggggaaattatagg

SEQ ID NO: 185404 - DNA, 20 bp, Artificial Sequence
  Synthetic oligonucleotide; AAG chr2 60451549 60451568 60451552 -
ggggggaaattataggagga

SEQ ID NO: 185405 - DNA, 20 bp, Artificial Sequence
  Synthetic oligonucleotide; AAG chr2 60451546 60451565 60451549 -
gggaaattataggaggaaag

SEQ ID NO: 185406 - DNA, 20 bp, Artificial Sequence
  Synthetic oligonucleotide; CAG chr2 60451536 60451555 60451539 -
aggaggaaagaagttcacat

SEQ ID NO: 185407 - DNA, 20 bp, Artificial Sequence
  Synthetic oligonucleotide; CAG chr2 60451531 60451550 60451534 -
gaaagaagttcacatcagaa

SEQ ID NO: 185408 - DNA, 20 bp, Artificial Sequence
  Synthetic oligonucleotide; CAG chr2 60451521 60451540 60451524 -
cacatcagaacagacaatca

SEQ ID NO: 185409 - DNA, 20 bp, Artificial Sequence
  Synthetic oligonucleotide; TAG chr2 60451503 60451522 60451506 -
cacagcaatgctctattcct

SEQ ID NO: 185410 - DNA, 20 bp, Artificial Sequence
  Synthetic oligonucleotide; TAG chr2 60451496 60451515 60451499 -
atgctctattccttagaaat

SEQ ID NO: 185411 - DNA, 20 bp, Artificial Sequence
  Synthetic oligonucleotide; AAG chr2 60451483 60451502 60451486 -
tagaaattagtgccacaaat

SEQ ID NO: 185412 - DNA, 20 bp, Artificial Sequence
  Synthetic oligonucleotide; CAG chr2 60451467 60451486 60451470 -
aaataagttacatctacaaa

SEQ ID NO: 185413 - DNA, 20 bp, Artificial Sequence
  Synthetic oligonucleotide; AGG chr2 60451466 60451485 60451469 -
aataagttacatctacaaac

SEQ ID NO: 185414 - DNA, 20 bp, Artificial Sequence
  Synthetic oligonucleotide; TGG chr2 60451463 60451482 60451466 -
aagttacatctacaaacagg

SEQ ID NO: 185415 - DNA, 20 bp, Artificial Sequence
  Synthetic oligonucleotide; TGG chr2 60451447 60451466 60451450 -
caggtggtaaaaattctttc

SEQ ID NO: 185416 - DNA, 20 bp, Artificial Sequence
  Synthetic oligonucleotide; CAG chr2 60451442 60451461 60451445 -
ggtaaaaattctttctggcc

SEQ ID NO: 185417 - DNA, 20 bp, Artificial Sequence
  Synthetic oligonucleotide; CAG chr2 60451429 60451448 60451432 -
tctggcccagttaatttgca

SEQ ID NO: 185418 - DNA, 20 bp, Artificial Sequence
  Synthetic oligonucleotide; CAG chr2 60451417 60451436 60451420 -
aatttgcacagaacttttct

SEQ ID NO: 185419 - DNA, 20 bp, Artificial Sequence
  Synthetic oligonucleotide; TGG chr2 60451412 60451431 60451415 -
gcacagaacttttctcagtt

SEQ ID NO: 185420 - DNA, 20 bp, Artificial Sequence
  Synthetic oligonucleotide; TGG chr2 60451395 60451414 60451398 -
gtttggtattttttactgct

SEQ ID NO: 185421 - DNA, 20 bp, Artificial Sequence
  Synthetic oligonucleotide; GAG chr2 60451393 60451412 60451396 -
ttggtattttttactgcttg

SEQ ID NO: 185422 - DNA, 20 bp, Artificial Sequence
  Synthetic oligonucleotide; CAG chr2 60451387 60451406 60451390 -
ttttttactgcttggagatc

SEQ ID NO: 185423 - DNA, 20 bp, Artificial Sequence
  Synthetic oligonucleotide; AAG chr2 60451384 60451403 60451387 -
tttactgcttggagatccag

SEQ ID NO: 185424 - DNA, 20 bp, Artificial Sequence
  Synthetic oligonucleotide; GAG chr2 60451382 60451401 60451385 -
tactgcttggagatccagaa

SEQ ID NO: 185425 - DNA, 20 bp, Artificial Sequence
  Synthetic oligonucleotide; TAG chr2 60451376 60451395 60451379 -
ttggagatccagaagagaat

SEQ ID NO: 185426 - DNA, 20 bp, Artificial Sequence
  Synthetic oligonucleotide; TAG chr2 60451365 60451384 60451368 -
gaagagaattagaaacaaca

SEQ ID NO: 185427 - DNA, 20 bp, Artificial Sequence
  Synthetic oligonucleotide; TAG chr2 60451352 60451371 60451355 -
aacaacatagcaaattaaaa

SEQ ID NO: 185428 - DNA, 20 bp, Artificial Sequence
  Synthetic oligonucleotide; AGG chr2 60451351 60451370 60451354 -
acaacatagcaaattaaaat

SEQ ID NO: 185429 - DNA, 20 bp, Artificial Sequence
  Synthetic oligonucleotide; TAG chr2 60451337 60451356 60451340 -
taaaataggtttgtcaataa

SEQ ID NO: 185430 - DNA, 20 bp, Artificial Sequence
  Synthetic oligonucleotide; GAG chr2 60451335 60451354 60451338 -
aaataggtttgtcaataata

SEQ ID NO: 185431 - DNA, 20 bp, Artificial Sequence
  Synthetic oligonucleotide; CAG chr2 60451330 60451349 60451333 -
ggtttgtcaataatagagct

SEQ ID NO: 185432 - DNA, 20 bp, Artificial Sequence
  Synthetic oligonucleotide; TAG chr2 60451313 60451332 60451316 -
gctcagacacctgtgtgctg

SEQ ID NO: 185433 - DNA, 20 bp, Artificial Sequence
  Synthetic oligonucleotide; CAG chr2 60451301 60451320 60451304 -
gtgtgctgtagattcacata

SEQ ID NO: 185434 - DNA, 20 bp, Artificial Sequence
  Synthetic oligonucleotide; AGG chr2 60451300 60451319 60451303 -
tgtgctgtagattcacatac

SEQ ID NO: 185435 - DNA, 20 bp, Artificial Sequence
  Synthetic oligonucleotide; AAG chr2 60451287 60451306 60451290 -
cacatacaggccgtgaacct

SEQ ID NO: 185436 - DNA, 20 bp, Artificial Sequence
  Synthetic oligonucleotide; TGG chr2 60451284 60451303 60451287 -
atacaggccgtgaacctaag

SEQ ID NO: 185437 - DNA, 20 bp, Artificial Sequence
  Synthetic oligonucleotide; GGG chr2 60451283 60451302 60451286 -
tacaggccgtgaacctaagt

SEQ ID NO: 185438 - DNA, 20 bp, Artificial Sequence
  Synthetic oligonucleotide; GGG chr2 60451282 60451301 60451285 -
acaggccgtgaacctaagtg

SEQ ID NO: 185439 - DNA, 20 bp, Artificial Sequence
  Synthetic oligonucleotide; TGG chr2 60451257 60451276 60451260 -
aatcctacctatccaccttc

SEQ ID NO: 185440 - DNA, 20 bp, Artificial Sequence
  Synthetic oligonucleotide; TAG chr2 60451253 60451272 60451256 -
ctacctatccaccttctggc

SEQ ID NO: 185441 - DNA, 20 bp, Artificial Sequence
  Synthetic oligonucleotide; TAG chr2 60451244 60451263 60451247 -
caccttctggctagattacc

SEQ ID NO: 185442 - DNA, 20 bp, Artificial Sequence
  Synthetic oligonucleotide; TAG chr2 60451239 60451258 60451242 -
tctggctagattacctagct

SEQ ID NO: 185443 - DNA, 20 bp, Artificial Sequence
  Synthetic oligonucleotide; AAG chr2 60451232 60451251 60451235 -
agattacctagcttagtgaa

SEQ ID NO: 185444 - DNA, 20 bp, Artificial Sequence
  Synthetic oligonucleotide; TAG chr2 60451228 60451247 60451231 -
tacctagcttagtgaaaaga

SEQ ID NO: 185445 - DNA, 20 bp, Artificial Sequence
  Synthetic oligonucleotide; TGG chr2 60451216 60451235 60451219 -
tgaaaagatagccaaataat

SEQ ID NO: 185446 - DNA, 20 bp, Artificial Sequence
  Synthetic oligonucleotide; CAG chr2 60451167 60451186 60451170 -
taataaataatgactgtcta

SEQ ID NO: 185447 - DNA, 20 bp, Artificial Sequence
  Synthetic oligonucleotide; TAG chr2 60451164 60451183 60451167 -
taaataatgactgtctacag

SEQ ID NO: 185448 - DNA, 20 bp, Artificial Sequence
  Synthetic oligonucleotide; CAG chr2 60451140 60451159 60451143 -
gaactaccttatactgtata

SEQ ID NO: 185449 - DNA, 20 bp, Artificial Sequence
  Synthetic oligonucleotide; TGG chr2 60451106 60451125 60451109 -
gcattatttcacctgctctc

SEQ ID NO: 185450 - DNA, 20 bp, Artificial Sequence
  Synthetic oligonucleotide; GGG chr2 60451105 60451124 60451108 -
cattatttcacctgctctct

SEQ ID NO: 185451 - DNA, 20 bp, Artificial Sequence
  Synthetic oligonucleotide; CAG chr2 60451101 60451120 60451104 -
atttcacctgctctctggga

SEQ ID NO: 185452 - DNA, 20 bp, Artificial Sequence
  Synthetic oligonucleotide; TGG chr2 60451078 60451097 60451081 -
atctcacgacttctacttta

SEQ ID NO: 185453 - DNA, 20 bp, Artificial Sequence
  Synthetic oligonucleotide; GAG chr2 60451076 60451095 60451079 -
ctcacgacttctactttatg

SEQ ID NO: 185454 - DNA, 20 bp, Artificial Sequence
  Synthetic oligonucleotide; AGG chr2 60451075 60451094 60451078 -
tcacgacttctactttatgg

SEQ ID NO: 185455 - DNA, 20 bp, Artificial Sequence
  Synthetic oligonucleotide; TGG chr2 60451072 60451091 60451075 -
cgacttctactttatggagg

SEQ ID NO: 185456 - DNA, 20 bp, Artificial Sequence
  Synthetic oligonucleotide; GAG chr2 60451070 60451089 60451073 -
acttctactttatggaggtg

SEQ ID NO: 185457 - DNA, 20 bp, Artificial Sequence
  Synthetic oligonucleotide; GAG chr2 60451064 60451083 60451067 -
actttatggaggtggagatt

SEQ ID NO: 185458 - DNA, 20 bp, Artificial Sequence
  Synthetic oligonucleotide; AGG chr2 60451063 60451082 60451066 -
ctttatggaggtggagattg

SEQ ID NO: 185459 - DNA, 20 bp, Artificial Sequence
  Synthetic oligonucleotide; AAG chr2 60451054 60451073 60451057 -
ggtggagattgaggcttacc

SEQ ID NO: 185460 - DNA, 20 bp, Artificial Sequence
  Synthetic oligonucleotide; AGG chr2 60451053 60451072 60451056 -
gtggagattgaggcttacca

SEQ ID NO: 185461 - DNA, 20 bp, Artificial Sequence
  Synthetic oligonucleotide; AAG chr2 60451048 60451067 60451051 -
gattgaggcttaccaaggtt

SEQ ID NO: 185462 - DNA, 20 bp, Artificial Sequence
  Synthetic oligonucleotide; AGG chr2 60451047 60451066 60451050 -
attgaggcttaccaaggtta

SEQ ID NO: 185463 - DNA, 20 bp, Artificial Sequence
  Synthetic oligonucleotide; GGG chr2 60451046 60451065 60451049 -
ttgaggcttaccaaggttaa

SEQ ID NO: 185464 - DNA, 20 bp, Artificial Sequence
  Synthetic oligonucleotide; CAG chr2 60451038 60451057 60451041 -
taccaaggttaagggcttgc

SEQ ID NO: 185465 - DNA, 20 bp, Artificial Sequence
  Synthetic oligonucleotide; GAG chr2 60451036 60451055 60451039 -
ccaaggttaagggcttgcca

SEQ ID NO: 185466 - DNA, 20 bp, Artificial Sequence
  Synthetic oligonucleotide; AGG chr2 60451035 60451054 60451038 -
caaggttaagggcttgccag

SEQ ID NO: 185467 - DNA, 20 bp, Artificial Sequence
  Synthetic oligonucleotide; CAG chr2 60451026 60451045 60451029 -
gggcttgccagaggccacat

SEQ ID NO: 185468 - DNA, 20 bp, Artificial Sequence
  Synthetic oligonucleotide; AAG chr2 60451022 60451041 60451025 -
ttgccagaggccacatcagt

SEQ ID NO: 185469 - DNA, 20 bp, Artificial Sequence
  Synthetic oligonucleotide; GAG chr2 60451020 60451039 60451023 -
gccagaggccacatcagtaa

SEQ ID NO: 185470 - DNA, 20 bp, Artificial Sequence
  Synthetic oligonucleotide; GAG chr2 60451018 60451037 60451021 -
cagaggccacatcagtaaga

SEQ ID NO: 185471 - DNA, 20 bp, Artificial Sequence
  Synthetic oligonucleotide; AAG chr2 60451014 60451033 60451017 -
ggccacatcagtaagagaga

SEQ ID NO: 185472 - DNA, 20 bp, Artificial Sequence
  Synthetic oligonucleotide; CAG chr2 60451011 60451030 60451014 -
cacatcagtaagagagaaag

SEQ ID NO: 185473 - DNA, 20 bp, Artificial Sequence
  Synthetic oligonucleotide; GAG chr2 60451009 60451028 60451012 -
catcagtaagagagaaagca

SEQ ID NO: 185474 - DNA, 20 bp, Artificial Sequence
  Synthetic oligonucleotide; AAG chr2 60451006 60451025 60451009 -
cagtaagagagaaagcagag

SEQ ID NO: 185475 - DNA, 20 bp, Artificial Sequence
  Synthetic oligonucleotide; CAG chr2 60451002 60451021 60451005 -
aagagagaaagcagagaagc

SEQ ID NO: 185476 - DNA, 20 bp, Artificial Sequence
  Synthetic oligonucleotide; AGG chr2 60451001 60451020 60451004 -
agagagaaagcagagaagcc

SEQ ID NO: 185477 - DNA, 20 bp, Artificial Sequence
  Synthetic oligonucleotide; TGG chr2 60450993 60451012 60450996 -
agcagagaagccaggttttc

SEQ ID NO: 185478 - DNA, 20 bp, Artificial Sequence
  Synthetic oligonucleotide; CAG chr2 60450981 60451000 60450984 -
aggttttctggtttcttgtc

SEQ ID NO: 185479 - DNA, 20 bp, Artificial Sequence
  Synthetic oligonucleotide; GAG chr2 60450979 60450998 60450982 -
gttttctggtttcttgtcca

SEQ ID NO: 185480 - DNA, 20 bp, Artificial Sequence
  Synthetic oligonucleotide; AAG chr2 60450945 60450964 60450948 -
aaactctgtttaactgatca

SEQ ID NO: 185481 - DNA, 20 bp, Artificial Sequence
  Synthetic oligonucleotide; AGG chr2 60450944 60450963 60450947 -
aactctgtttaactgatcaa

SEQ ID NO: 185482 - DNA, 20 bp, Artificial Sequence
  Synthetic oligonucleotide; GGG chr2 60450943 60450962 60450946 -
actctgtttaactgatcaaa

SEQ ID NO: 185483 - DNA, 20 bp, Artificial Sequence
  Synthetic oligonucleotide; GAG chr2 60450941 60450960 60450944 -
tctgtttaactgatcaaagg

SEQ ID NO: 185484 - DNA, 20 bp, Artificial Sequence
  Synthetic oligonucleotide; TAG chr2 60450923 60450942 60450926 -
gggagtatcttttcctgtgt

SEQ ID NO: 185485 - DNA, 20 bp, Artificial Sequence
  Synthetic oligonucleotide; AAG chr2 60450915 60450934 60450918 -
cttttcctgtgttagcacat

SEQ ID NO: 185486 - DNA, 20 bp, Artificial Sequence
  Synthetic oligonucleotide; CAG chr2 60450899 60450918 60450902 -
acataagtcataaatgttca

SEQ ID NO: 185487 - DNA, 20 bp, Artificial Sequence
  Synthetic oligonucleotide; TGG chr2 60450885 60450904 60450888 -
tgttcacagacacacacatg

SEQ ID NO: 185488 - DNA, 20 bp, Artificial Sequence
  Synthetic oligonucleotide; CAG chr2 60450872 60450891 60450875 -
acacatgtggcttacacata

SEQ ID NO: 185489 - DNA, 20 bp, Artificial Sequence
  Synthetic oligonucleotide; CAG chr2 60450866 60450885 60450869 -
gtggcttacacatacagacc

SEQ ID NO: 185490 - DNA, 20 bp, Artificial Sequence
  Synthetic oligonucleotide; AGG chr2 60450865 60450884 60450868 -
tggcttacacatacagaccc

SEQ ID NO: 185491 - DNA, 20 bp, Artificial Sequence
  Synthetic oligonucleotide; TGG chr2 60450861 60450880 60450864 -
ttacacatacagacccagga

SEQ ID NO: 185492 - DNA, 20 bp, Artificial Sequence
  Synthetic oligonucleotide; TGG chr2 60450854 60450873 60450857 -
tacagacccaggatggcctt

SEQ ID NO: 185493 - DNA, 20 bp, Artificial Sequence
  Synthetic oligonucleotide; AAG chr2 60450849 60450868 60450852 -
acccaggatggcctttggta

SEQ ID NO: 185494 - DNA, 20 bp, Artificial Sequence
  Synthetic oligonucleotide; AGG chr2 60450848 60450867 60450851 -
cccaggatggcctttggtaa

SEQ ID NO: 185495 - DNA, 20 bp, Artificial Sequence
  Synthetic oligonucleotide; CAG chr2 60450841 60450860 60450844 -
tggcctttggtaaaggcatg

SEQ ID NO: 185496 - DNA, 20 bp, Artificial Sequence
  Synthetic oligonucleotide; GAG chr2 60450839 60450858 60450842 -
gcctttggtaaaggcatgca

SEQ ID NO: 185497 - DNA, 20 bp, Artificial Sequence
  Synthetic oligonucleotide; CAG chr2 60450819 60450838 60450822 -
gagttgcctcttcctaccaa

SEQ ID NO: 185498 - DNA, 20 bp, Artificial Sequence
  Synthetic oligonucleotide; GAG chr2 60450805 60450824 60450808 -
taccaacagatgtgtgcact

SEQ ID NO: 185499 - DNA, 20 bp, Artificial Sequence
  Synthetic oligonucleotide; AAG chr2 60450801 60450820 60450804 -
aacagatgtgtgcactgaga

SEQ ID NO: 185500 - DNA, 20 bp, Artificial Sequence
  Synthetic oligonucleotide; AGG chr2 60450800 60450819 60450803 -
acagatgtgtgcactgagaa

SEQ ID NO: 185501 - DNA, 20 bp, Artificial Sequence
  Synthetic oligonucleotide; GGG chr2 60450799 60450818 60450802 -
cagatgtgtgcactgagaaa

SEQ ID NO: 185502 - DNA, 20 bp, Artificial Sequence
  Synthetic oligonucleotide; GAG chr2 60450797 60450816 60450800 -
gatgtgtgcactgagaaagg

SEQ ID NO: 185503 - DNA, 20 bp, Artificial Sequence
  Synthetic oligonucleotide; AGG chr2 60450796 60450815 60450799 -
atgtgtgcactgagaaaggg

SEQ ID NO: 185504 - DNA, 20 bp, Artificial Sequence
  Synthetic oligonucleotide; CAG chr2 60450790 60450809 60450793 -
gcactgagaaagggaggttg

SEQ ID NO: 185505 - DNA, 20 bp, Artificial Sequence
  Synthetic oligonucleotide; TGG chr2 60450762 60450781 60450765 -
ttgccatcacctttcccctg

SEQ ID NO: 185506 - DNA, 20 bp, Artificial Sequence
  Synthetic oligonucleotide; GAG chr2 60450729 60450748 60450732 -
acaaataaccctgattgcac

SEQ ID NO: 185507 - DNA, 20 bp, Artificial Sequence
  Synthetic oligonucleotide; TGG chr2 60450726 60450745 60450729 -
aataaccctgattgcacgag

SEQ ID NO: 185508 - DNA, 20 bp, Artificial Sequence
  Synthetic oligonucleotide; TAG chr2 60450700 60450719 60450703 -
gtttgtgacttcctatcaat

SEQ ID NO: 185509 - DNA, 20 bp, Artificial Sequence
  Synthetic oligonucleotide; TGG chr2 60450696 60450715 60450699 -
gtgacttcctatcaattagt

SEQ ID NO: 185510 - DNA, 20 bp, Artificial Sequence
  Synthetic oligonucleotide; GGG chr2 60450695 60450714 60450698 -
tgacttcctatcaattagtt

SEQ ID NO: 185511 - DNA, 20 bp, Artificial Sequence
  Synthetic oligonucleotide; CAG chr2 60450687 60450706 60450690 -
tatcaattagttgggacttc

SEQ ID NO: 185512 - DNA, 20 bp, Artificial Sequence
  Synthetic oligonucleotide; AAG chr2 60450682 60450701 60450685 -
attagttgggacttccagac

SEQ ID NO: 185513 - DNA, 20 bp, Artificial Sequence
  Synthetic oligonucleotide; AAG chr2 60450679 60450698 60450682 -
agttgggacttccagacaag

SEQ ID NO: 185514 - DNA, 20 bp, Artificial Sequence
  Synthetic oligonucleotide; AAG chr2 60450666 60450685 60450669 -
agacaagaagttatttcata

SEQ ID NO: 185515 - DNA, 20 bp, Artificial Sequence
  Synthetic oligonucleotide; AAG chr2 60450617 60450636 60450620 -
cctatgtgttgctgaaacat

SEQ ID NO: 185516 - DNA, 20 bp, Artificial Sequence
  Synthetic oligonucleotide; TAG chr2 60450609 60450628 60450612 -
ttgctgaaacataagaccat

SEQ ID NO: 185517 - DNA, 20 bp, Artificial Sequence
  Synthetic oligonucleotide; AGG chr2 60450608 60450627 60450611 -
tgctgaaacataagaccatt

SEQ ID NO: 185518 - DNA, 20 bp, Artificial Sequence
  Synthetic oligonucleotide; GGG chr2 60450607 60450626 60450610 -
gctgaaacataagaccatta

SEQ ID NO: 185519 - DNA, 20 bp, Artificial Sequence
  Synthetic oligonucleotide; TGG chr2 60450595 60450614 60450598 -
gaccattagggtttctgtga

SEQ ID NO: 185520 - DNA, 20 bp, Artificial Sequence
  Synthetic oligonucleotide; TAG chr2 60450555 60450574 60450558 -
ctgaactccttgctgatgcc

SEQ ID NO: 185521 - DNA, 20 bp, Artificial Sequence
  Synthetic oligonucleotide; AAG chr2 60450551 60450570 60450554 -
actccttgctgatgcctaga

SEQ ID NO: 185522 - DNA, 20 bp, Artificial Sequence
  Synthetic oligonucleotide; GAG chr2 60450549 60450568 60450552 -
tccttgctgatgcctagaaa

SEQ ID NO: 185523 - DNA, 20 bp, Artificial Sequence
  Synthetic oligonucleotide; AAG chr2 60450532 60450551 60450535 -
aaagagtgacaccacttcca

SEQ ID NO: 185524 - DNA, 20 bp, Artificial Sequence
  Synthetic oligonucleotide; AGG chr2 60450531 60450550 60450534 -
aagagtgacaccacttccaa

SEQ ID NO: 185525 - DNA, 20 bp, Artificial Sequence
  Synthetic oligonucleotide; GGG chr2 60450530 60450549 60450533 -
agagtgacaccacttccaaa

SEQ ID NO: 185526 - DNA, 20 bp, Artificial Sequence
  Synthetic oligonucleotide; GAG chr2 60450528 60450547 60450531 -
agtgacaccacttccaaagg

SEQ ID NO: 185527 - DNA, 20 bp, Artificial Sequence
  Synthetic oligonucleotide; AGG chr2 60450527 60450546 60450530 -
gtgacaccacttccaaaggg

SEQ ID NO: 185528 - DNA, 20 bp, Artificial Sequence
  Synthetic oligonucleotide; CAG chr2 60450523 60450542 60450526 -
caccacttccaaagggaggc

SEQ ID NO: 185529 - DNA, 20 bp, Artificial Sequence
  Synthetic oligonucleotide; TGG chr2 60450503 60450522 60450506 -
cagaactgaaacaacaatcc

SEQ ID NO: 185530 - DNA, 20 bp, Artificial Sequence
  Synthetic oligonucleotide; GGG chr2 60450502 60450521 60450505 -
agaactgaaacaacaatcct

SEQ ID NO: 185531 - DNA, 20 bp, Artificial Sequence
  Synthetic oligonucleotide; GAG chr2 60450495 60450514 60450498 -
aaacaacaatcctgggtctt

SEQ ID NO: 185532 - DNA, 20 bp, Artificial Sequence
  Synthetic oligonucleotide; AAG chr2 60450490 60450509 60450493 -
acaatcctgggtcttgagac

SEQ ID NO: 185533 - DNA, 20 bp, Artificial Sequence
  Synthetic oligonucleotide; CAG chr2 60450485 60450504 60450488 -
cctgggtcttgagacaagtt

SEQ ID NO: 185534 - DNA, 20 bp, Artificial Sequence
  Synthetic oligonucleotide; TGG chr2 60450466 60450485 60450469 -
tcagcctttgtaactgcact

SEQ ID NO: 185535 - DNA, 20 bp, Artificial Sequence
  Synthetic oligonucleotide; TGG chr2 60450463 60450482 60450466 -
gcctttgtaactgcacttgg

SEQ ID NO: 185536 - DNA, 20 bp, Artificial Sequence
  Synthetic oligonucleotide; TGG chr2 60450442 60450461 60450445 -
ggtcactacactttcatttc

SEQ ID NO: 185537 - DNA, 20 bp, Artificial Sequence
  Synthetic oligonucleotide; CAG chr2 60450402 60450421 60450405 -
actttttatatatttcttct

SEQ ID NO: 185538 - DNA, 20 bp, Artificial Sequence
  Synthetic oligonucleotide; GAG chr2 60450400 60450419 60450403 -
tttttatatatttcttctca

SEQ ID NO: 185539 - DNA, 20 bp, Artificial Sequence
  Synthetic oligonucleotide; CAG chr2 60450396 60450415 60450399 -
tatatatttcttctcagagt

SEQ ID NO: 185540 - DNA, 20 bp, Artificial Sequence
  Synthetic oligonucleotide; AAG chr2 60450384 60450403 60450387 -
ctcagagtcagtttgtaaat

SEQ ID NO: 185541 - DNA, 20 bp, Artificial Sequence
  Synthetic oligonucleotide; TGG chr2 60450381 60450400 60450384 -
agagtcagtttgtaaataag

SEQ ID NO: 185542 - DNA, 20 bp, Artificial Sequence
  Synthetic oligonucleotide; AAG chr2 60450368 60450387 60450371 -
aaataagtggatatctctaa

SEQ ID NO: 185543 - DNA, 20 bp, Artificial Sequence
  Synthetic oligonucleotide; TGG chr2 60450365 60450384 60450368 -
taagtggatatctctaaaag

SEQ ID NO: 185544 - DNA, 20 bp, Artificial Sequence
  Synthetic oligonucleotide; GGG chr2 60450364 60450383 60450367 -
aagtggatatctctaaaagt

SEQ ID NO: 185545 - DNA, 20 bp, Artificial Sequence
  Synthetic oligonucleotide; AAG chr2 60450355 60450374 60450358 -
tctctaaaagtgggattttt

SEQ ID NO: 185546 - DNA, 20 bp, Artificial Sequence
  Synthetic oligonucleotide; AGG chr2 60450354 60450373 60450357 -
ctctaaaagtgggattttta

SEQ ID NO: 185547 - DNA, 20 bp, Artificial Sequence
  Synthetic oligonucleotide; GGG chr2 60450353 60450372 60450356 -
tctaaaagtgggatttttaa

SEQ ID NO: 185548 - DNA, 20 bp, Artificial Sequence
  Synthetic oligonucleotide; GGG chr2 60450352 60450371 60450355 -
ctaaaagtgggatttttaag

SEQ ID NO: 185549 - DNA, 20 bp, Artificial Sequence
  Synthetic oligonucleotide; AAG chr2 60450348 60450367 60450351 -
aagtgggatttttaaggggc

SEQ ID NO: 185550 - DNA, 20 bp, Artificial Sequence
  Synthetic oligonucleotide; GAG chr2 60450346 60450365 60450349 -
gtgggatttttaaggggcaa

SEQ ID NO: 185551 - DNA, 20 bp, Artificial Sequence
  Synthetic oligonucleotide; AGG chr2 60450345 60450364 60450348 -
tgggatttttaaggggcaag

SEQ ID NO: 185552 - DNA, 20 bp, Artificial Sequence
  Synthetic oligonucleotide; CAG chr2 60450338 60450357 60450341 -
tttaaggggcaagaggataa

SEQ ID NO: 185553 - DNA, 20 bp, Artificial Sequence
  Synthetic oligonucleotide; AAG chr2 60450335 60450354 60450338 -
aaggggcaagaggataacag

SEQ ID NO: 185554 - DNA, 20 bp, Artificial Sequence
  Synthetic oligonucleotide; TGG chr2 60450332 60450351 60450335 -
gggcaagaggataacagaag

SEQ ID NO: 185555 - DNA, 20 bp, Artificial Sequence
  Synthetic oligonucleotide; AAG chr2 60450326 60450345 60450329 -
gaggataacagaagtggata

SEQ ID NO: 185556 - DNA, 20 bp, Artificial Sequence
  Synthetic oligonucleotide; AGG chr2 60450325 60450344 60450328 -
aggataacagaagtggataa

SEQ ID NO: 185557 - DNA, 20 bp, Artificial Sequence
  Synthetic oligonucleotide; TGG chr2 60450299 60450318 60450302 -
ttgttttatcctcttcactg

SEQ ID NO: 185558 - DNA, 20 bp, Artificial Sequence
  Synthetic oligonucleotide; GAG chr2 60450297 60450316 60450300 -
gttttatcctcttcactgtg

SEQ ID NO: 185559 - DNA, 20 bp, Artificial Sequence
  Synthetic oligonucleotide; AAG chr2 60450294 60450313 60450297 -
ttatcctcttcactgtggag

SEQ ID NO: 185560 - DNA, 20 bp, Artificial Sequence
  Synthetic oligonucleotide; CAG chr2 60450274 60450293 60450277 -
aagaaccccctcaaaacaaa

SEQ ID NO: 185561 - DNA, 20 bp, Artificial Sequence
  Synthetic oligonucleotide; AAG chr2 60450265 60450284 60450268 -
ctcaaaacaaacagaacaaa

SEQ ID NO: 185562 - DNA, 20 bp, Artificial Sequence
  Synthetic oligonucleotide; TGG chr2 60450248 60450267 60450251 -
aaaaagactgtcttttccca

SEQ ID NO: 185563 - DNA, 20 bp, Artificial Sequence
  Synthetic oligonucleotide; AAG chr2 60450239 60450258 60450242 -
gtcttttcccatggctttta

SEQ ID NO: 185564 - DNA, 20 bp, Artificial Sequence
  Synthetic oligonucleotide; AAG chr2 60450232 60450251 60450235 -
cccatggcttttaaagttga

SEQ ID NO: 185565 - DNA, 20 bp, Artificial Sequence
  Synthetic oligonucleotide; CAG chr2 60450211 60450230 60450214 -
agacaacaaaaatttattta

SEQ ID NO: 185566 - DNA, 20 bp, Artificial Sequence
  Synthetic oligonucleotide; TAG chr2 60450201 60450220 60450204 -
aatttatttacagaatttat

SEQ ID NO: 185567 - DNA, 20 bp, Artificial Sequence
  Synthetic oligonucleotide; AGG chr2 60450200 60450219 60450203 -
atttatttacagaatttatt

SEQ ID NO: 185568 - DNA, 20 bp, Artificial Sequence
  Synthetic oligonucleotide; CGG chr2 60450194 60450213 60450197 -
ttacagaatttattaggaaa

SEQ ID NO: 185569 - DNA, 20 bp, Artificial Sequence
  Synthetic oligonucleotide; TAG chr2 60450183 60450202 60450186 -
attaggaaacggtattgtgt

SEQ ID NO: 185570 - DNA, 20 bp, Artificial Sequence
  Synthetic oligonucleotide; AGG chr2 60450182 60450201 60450185 -
ttaggaaacggtattgtgtt

SEQ ID NO: 185571 - DNA, 20 bp, Artificial Sequence
  Synthetic oligonucleotide; GGG chr2 60450181 60450200 60450184 -
taggaaacggtattgtgtta

SEQ ID NO: 185572 - DNA, 20 bp, Artificial Sequence
  Synthetic oligonucleotide; TAG chr2 60450177 60450196 60450180 -
aaacggtattgtgttagggc

SEQ ID NO: 185573 - DNA, 20 bp, Artificial Sequence
  Synthetic oligonucleotide; AAG chr2 60450146 60450165 60450149 -
tttttttttttttttttttt

SEQ ID NO: 185574 - DNA, 20 bp, Artificial Sequence
  Synthetic oligonucleotide; CAG chr2 60450142 60450161 60450145 -
ttttttttttttttttaaga

SEQ ID NO: 185575 - DNA, 20 bp, Artificial Sequence
  Synthetic oligonucleotide; CAG chr2 60450122 60450141 60450125 -
cagaatctcgctctgtcacc

SEQ ID NO: 185576 - DNA, 20 bp, Artificial Sequence
  Synthetic oligonucleotide; AGG chr2 60450121 60450140 60450124 -
agaatctcgctctgtcaccc

SEQ ID NO: 185577 - DNA, 20 bp, Artificial Sequence
  Synthetic oligonucleotide; TGG chr2 60450117 60450136 60450120 -
tctcgctctgtcacccaggc

SEQ ID NO: 185578 - DNA, 20 bp, Artificial Sequence
  Synthetic oligonucleotide; GAG chr2 60450115 60450134 60450118 -
tcgctctgtcacccaggctg

SEQ ID NO: 185579 - DNA, 20 bp, Artificial Sequence
  Synthetic oligonucleotide; CAG chr2 60450110 60450129 60450113 -
ctgtcacccaggctggagtg

SEQ ID NO: 185580 - DNA, 20 bp, Artificial Sequence
  Synthetic oligonucleotide; TGG chr2 60450107 60450126 60450110 -
tcacccaggctggagtgcag

SEQ ID NO: 185581 - DNA, 20 bp, Artificial Sequence
  Synthetic oligonucleotide; AAG chr2 60450103 60450122 60450106 -
ccaggctggagtgcagtggc

SEQ ID NO: 185582 - DNA, 20 bp, Artificial Sequence
  Synthetic oligonucleotide; AGG chr2 60450102 60450121 60450105 -
caggctggagtgcagtggca

SEQ ID NO: 185583 - DNA, 20 bp, Artificial Sequence
  Synthetic oligonucleotide; CAG chr2 60450096 60450115 60450099 -
ggagtgcagtggcaaggact

SEQ ID NO: 185584 - DNA, 20 bp, Artificial Sequence
  Synthetic oligonucleotide; TGG chr2 60450072 60450091 60450075 -
tcaccacaacctccgcctac

SEQ ID NO: 185585 - DNA, 20 bp, Artificial Sequence
  Synthetic oligonucleotide; GGG chr2 60450071 60450090 60450074 -
caccacaacctccgcctact

SEQ ID NO: 185586 - DNA, 20 bp, Artificial Sequence
  Synthetic oligonucleotide; AAG chr2 60450065 60450084 60450068 -
aacctccgcctactgggttc

SEQ ID NO: 185587 - DNA, 20 bp, Artificial Sequence
  Synthetic oligonucleotide; AGG chr2 60450064 60450083 60450067 -
acctccgcctactgggttca

SEQ ID NO: 185588 - DNA, 20 bp, Artificial Sequence
  Synthetic oligonucleotide; GGG chr2 60450063 60450082 60450066 -
cctccgcctactgggttcaa

SEQ ID NO: 185589 - DNA, 20 bp, Artificial Sequence
  Synthetic oligonucleotide; CAG chr2 60450048 60450067 60450051 -
ttcaagggatcctcctgcct

SEQ ID NO: 185590 - DNA, 20 bp, Artificial Sequence
  Synthetic oligonucleotide; AAG chr2 60450039 60450058 60450042 -
tcctcctgcctcagcttccc

SEQ ID NO: 185591 - DNA, 20 bp, Artificial Sequence
  Synthetic oligonucleotide; TAG chr2 60450036 60450055 60450039 -
tcctgcctcagcttcccaag

SEQ ID NO: 185592 - DNA, 20 bp, Artificial Sequence
  Synthetic oligonucleotide; TGG chr2 60450032 60450051 60450035 -
gcctcagcttcccaagtagc

SEQ ID NO: 185593 - DNA, 20 bp, Artificial Sequence
  Synthetic oligonucleotide; GGG chr2 60450031 60450050 60450034 -
cctcagcttcccaagtagct

SEQ ID NO: 185594 - DNA, 20 bp, Artificial Sequence
  Synthetic oligonucleotide; CAG chr2 60450024 60450043 60450027 -
ttcccaagtagctgggacta

SEQ ID NO: 185595 - DNA, 20 bp, Artificial Sequence
  Synthetic oligonucleotide; AGG chr2 60450023 60450042 60450026 -
tcccaagtagctgggactac

SEQ ID NO: 185596 - DNA, 20 bp, Artificial Sequence
  Synthetic oligonucleotide; CAG chr2 60450004 60450023 60450007 -
caggcacgcgccaccacgcc

SEQ ID NO: 185597 - DNA, 20 bp, Artificial Sequence
  Synthetic oligonucleotide; TAG chr2 60449982 60450001 60449985 -
gctaatattttttgtatttt

SEQ ID NO: 185598 - DNA, 20 bp, Artificial Sequence
  Synthetic oligonucleotide; TAG chr2 60449979 60449998 60449982 -
aatattttttgtatttttag

SEQ ID NO: 185599 - DNA, 20 bp, Artificial Sequence
  Synthetic oligonucleotide; CGG chr2 60449973 60449992 60449976 -
ttttgtatttttagtagata

SEQ ID NO: 185600 - DNA, 20 bp, Artificial Sequence
  Synthetic oligonucleotide; TAG chr2 60449957 60449976 60449960 -
gatacggcgtttcaccgtgt

SEQ ID NO: 185601 - DNA, 20 bp, Artificial Sequence
  Synthetic oligonucleotide; CAG chr2 60449953 60449972 60449956 -
cggcgtttcaccgtgttagc

SEQ ID NO: 185602 - DNA, 20 bp, Artificial Sequence
  Synthetic oligonucleotide; AGG chr2 60449952 60449971 60449955 -
ggcgtttcaccgtgttagcc

SEQ ID NO: 185603 - DNA, 20 bp, Artificial Sequence
  Synthetic oligonucleotide; TGG chr2 60449948 60449967 60449951 -
tttcaccgtgttagccagga

SEQ ID NO: 185604 - DNA, 20 bp, Artificial Sequence
  Synthetic oligonucleotide; TAG chr2 60449913 60449932 60449916 -
gatctcgtgatccaccctcc

SEQ ID NO: 185605 - DNA, 20 bp, Artificial Sequence
  Synthetic oligonucleotide; AGG chr2 60449912 60449931 60449915 -
atctcgtgatccaccctcct

SEQ ID NO: 185606 - DNA, 20 bp, Artificial Sequence
  Synthetic oligonucleotide; TAG chr2 60449902 60449921 60449905 -
ccaccctcctaggcctccca

SEQ ID NO: 185607 - DNA, 20 bp, Artificial Sequence
  Synthetic oligonucleotide; TGG chr2 60449896 60449915 60449899 -
tcctaggcctcccatagtgc

SEQ ID NO: 185608 - DNA, 20 bp, Artificial Sequence
  Synthetic oligonucleotide; GGG chr2 60449895 60449914 60449898 -
cctaggcctcccatagtgct

SEQ ID NO: 185609 - DNA, 20 bp, Artificial Sequence
  Synthetic oligonucleotide; TAG chr2 60449890 60449909 60449893 -
gcctcccatagtgctgggat

SEQ ID NO: 185610 - DNA, 20 bp, Artificial Sequence
  Synthetic oligonucleotide; GAG chr2 60449888 60449907 60449891 -
ctcccatagtgctgggatta

SEQ ID NO: 185611 - DNA, 20 bp, Artificial Sequence
  Synthetic oligonucleotide; AGG chr2 60449887 60449906 60449890 -
tcccatagtgctgggattag

SEQ ID NO: 185612 - DNA, 20 bp, Artificial Sequence
  Synthetic oligonucleotide; TGG chr2 60449867 60449886 60449870 -
aggcattgcactacctcacc

SEQ ID NO: 185613 - DNA, 20 bp, Artificial Sequence
  Synthetic oligonucleotide; TAG chr2 60449862 60449881 60449865 -
ttgcactacctcacctggcc

SEQ ID NO: 185614 - DNA, 20 bp, Artificial Sequence
  Synthetic oligonucleotide; AGG chr2 60449861 60449880 60449864 -
tgcactacctcacctggcct

SEQ ID NO: 185615 - DNA, 20 bp, Artificial Sequence
  Synthetic oligonucleotide; GGG chr2 60449860 60449879 60449863 -
gcactacctcacctggccta

SEQ ID NO: 185616 - DNA, 20 bp, Artificial Sequence
  Synthetic oligonucleotide; TAG chr2 60449856 60449875 60449859 -
tacctcacctggcctagggc

SEQ ID NO: 185617 - DNA, 20 bp, Artificial Sequence
  Synthetic oligonucleotide; AAG chr2 60449835 60449854 60449838 -
agacttttgaaaccccatac

SEQ ID NO: 185618 - DNA, 20 bp, Artificial Sequence
  Synthetic oligonucleotide; TGG chr2 60449822 60449841 60449825 -
cccatacaagattgacaatt

SEQ ID NO: 185619 - DNA, 20 bp, Artificial Sequence
  Synthetic oligonucleotide; GGG chr2 60449821 60449840 60449824 -
ccatacaagattgacaattt

SEQ ID NO: 185620 - DNA, 20 bp, Artificial Sequence
  Synthetic oligonucleotide; AAG chr2 60449818 60449837 60449821 -
tacaagattgacaatttggg

SEQ ID NO: 185621 - DNA, 20 bp, Artificial Sequence
  Synthetic oligonucleotide; GAG chr2 60449798 60449817 60449801 -
aagacatctctctgtgtgat

SEQ ID NO: 185622 - DNA, 20 bp, Artificial Sequence
  Synthetic oligonucleotide; AAG chr2 60449793 60449812 60449796 -
atctctctgtgtgatgagtc

SEQ ID NO: 185623 - DNA, 20 bp, Artificial Sequence
  Synthetic oligonucleotide; TGG chr2 60449786 60449805 60449789 -
tgtgtgatgagtcaagatca

SEQ ID NO: 185624 - DNA, 20 bp, Artificial Sequence
  Synthetic oligonucleotide; TGG chr2 60449772 60449791 60449775 -
agatcatggttatccatgaa

SEQ ID NO: 185625 - DNA, 20 bp, Artificial Sequence
  Synthetic oligonucleotide; CAG chr2 60449769 60449788 60449772 -
tcatggttatccatgaatgg

SEQ ID NO: 185626 - DNA, 20 bp, Artificial Sequence
  Synthetic oligonucleotide; AAG chr2 60449766 60449785 60449769 -
tggttatccatgaatggcag

SEQ ID NO: 185627 - DNA, 20 bp, Artificial Sequence
  Synthetic oligonucleotide; CAG chr2 60449763 60449782 60449766 -
ttatccatgaatggcagaag

SEQ ID NO: 185628 - DNA, 20 bp, Artificial Sequence
  Synthetic oligonucleotide; AGG chr2 60449762 60449781 60449765 -
tatccatgaatggcagaagc

SEQ ID NO: 185629 - DNA, 20 bp, Artificial Sequence
  Synthetic oligonucleotide; GGG chr2 60449761 60449780 60449764 -
atccatgaatggcagaagca

SEQ ID NO: 185630 - DNA, 20 bp, Artificial Sequence
  Synthetic oligonucleotide; AAG chr2 60449758 60449777 60449761 -
catgaatggcagaagcaggg

SEQ ID NO: 185631 - DNA, 20 bp, Artificial Sequence
  Synthetic oligonucleotide; GAG chr2 60449756 60449775 60449759 -
tgaatggcagaagcagggaa

SEQ ID NO: 185632 - DNA, 20 bp, Artificial Sequence
  Synthetic oligonucleotide; AGG chr2 60449755 60449774 60449758 -
gaatggcagaagcagggaag

SEQ ID NO: 185633 - DNA, 20 bp, Artificial Sequence
  Synthetic oligonucleotide; CAG chr2 60449739 60449758 60449742 -
gaagaggctcacaaatctgc

SEQ ID NO: 185634 - DNA, 20 bp, Artificial Sequence
  Synthetic oligonucleotide; AGG chr2 60449738 60449757 60449741 -
aagaggctcacaaatctgcc

SEQ ID NO: 185635 - DNA, 20 bp, Artificial Sequence
  Synthetic oligonucleotide; GGG chr2 60449737 60449756 60449740 -
agaggctcacaaatctgcca

SEQ ID NO: 185636 - DNA, 20 bp, Artificial Sequence
  Synthetic oligonucleotide; GGG chr2 60449736 60449755 60449739 -
gaggctcacaaatctgccag

SEQ ID NO: 185637 - DNA, 20 bp, Artificial Sequence
  Synthetic oligonucleotide; CAG chr2 60449713 60449732 60449716 -
ttctcactgtgtcctctctg

SEQ ID NO: 185638 - DNA, 20 bp, Artificial Sequence
  Synthetic oligonucleotide; GAG chr2 60449711 60449730 60449714 -
ctcactgtgtcctctctgca

SEQ ID NO: 185639 - DNA, 20 bp, Artificial Sequence
  Synthetic oligonucleotide; TGG chr2 60449708 60449727 60449711 -
actgtgtcctctctgcagag

SEQ ID NO: 185640 - DNA, 20 bp, Artificial Sequence
  Synthetic oligonucleotide; CAG chr2 60449700 60449719 60449703 -
ctctctgcagagtggaactt

SEQ ID NO: 185641 - DNA, 20 bp, Artificial Sequence
  Synthetic oligonucleotide; CAG chr2 60449693 60449712 60449696 -
cagagtggaacttcagattg

SEQ ID NO: 185642 - DNA, 20 bp, Artificial Sequence
  Synthetic oligonucleotide; GAG chr2 60449691 60449710 60449694 -
gagtggaacttcagattgca

SEQ ID NO: 185643 - DNA, 20 bp, Artificial Sequence
  Synthetic oligonucleotide; GAG chr2 60449689 60449708 60449692 -
gtggaacttcagattgcaga

SEQ ID NO: 185644 - DNA, 20 bp, Artificial Sequence
  Synthetic oligonucleotide; TGG chr2 60449680 60449699 60449683 -
cagattgcagagagataaat

SEQ ID NO: 185645 - DNA, 20 bp, Artificial Sequence
  Synthetic oligonucleotide; GAG chr2 60449666 60449685 60449669 -
ataaattggttgcctgacat

SEQ ID NO: 185646 - DNA, 20 bp, Artificial Sequence
  Synthetic oligonucleotide; CAG chr2 60449661 60449680 60449664 -
ttggttgcctgacatgagca

SEQ ID NO: 185647 - DNA, 20 bp, Artificial Sequence
  Synthetic oligonucleotide; TAG chr2 60449656 60449675 60449659 -
tgcctgacatgagcacagac

SEQ ID NO: 185648 - DNA, 20 bp, Artificial Sequence
  Synthetic oligonucleotide; GAG chr2 60449654 60449673 60449657 -
cctgacatgagcacagacta

SEQ ID NO: 185649 - DNA, 20 bp, Artificial Sequence
  Synthetic oligonucleotide; AGG chr2 60449653 60449672 60449656 -
ctgacatgagcacagactag

SEQ ID NO: 185650 - DNA, 20 bp, Artificial Sequence
  Synthetic oligonucleotide; CAG chr2 60449649 60449668 60449652 -
catgagcacagactagagga

SEQ ID NO: 185651 - DNA, 20 bp, Artificial Sequence
  Synthetic oligonucleotide; GAG chr2 60449647 60449666 60449650 -
tgagcacagactagaggaca

SEQ ID NO: 185652 - DNA, 20 bp, Artificial Sequence
  Synthetic oligonucleotide; CAG chr2 60449641 60449660 60449644 -
cagactagaggacagagtcc

SEQ ID NO: 185653 - DNA, 20 bp, Artificial Sequence
  Synthetic oligonucleotide; TGG chr2 60449633 60449652 60449636 -
aggacagagtcccagccact

SEQ ID NO: 185654 - DNA, 20 bp, Artificial Sequence
  Synthetic oligonucleotide; TGG chr2 60449629 60449648 60449632 -
cagagtcccagccacttgga

SEQ ID NO: 185655 - DNA, 20 bp, Artificial Sequence
  Synthetic oligonucleotide; GAG chr2 60449627 60449646 60449630 -
gagtcccagccacttggatg

SEQ ID NO: 185656 - DNA, 20 bp, Artificial Sequence
  Synthetic oligonucleotide; AGG chr2 60449626 60449645 60449629 -
agtcccagccacttggatgg

SEQ ID NO: 185657 - DNA, 20 bp, Artificial Sequence
  Synthetic oligonucleotide; GAG chr2 60449624 60449643 60449627 -
tcccagccacttggatggag

SEQ ID NO: 185658 - DNA, 20 bp, Artificial Sequence
  Synthetic oligonucleotide; CAG chr2 60449613 60449632 60449616 -
tggatggaggagaccaaata

SEQ ID NO: 185659 - DNA, 20 bp, Artificial Sequence
  Synthetic oligonucleotide; AGG chr2 60449612 60449631 60449615 -
ggatggaggagaccaaatac

SEQ ID NO: 185660 - DNA, 20 bp, Artificial Sequence
  Synthetic oligonucleotide; GGG chr2 60449611 60449630 60449614 -
gatggaggagaccaaataca

SEQ ID NO: 185661 - DNA, 20 bp, Artificial Sequence
  Synthetic oligonucleotide; AAG chr2 60449590 60449609 60449593 -
ggcattgtttttactttccc

SEQ ID NO: 185662 - DNA, 20 bp, Artificial Sequence
  Synthetic oligonucleotide; TGG chr2 60449580 60449599 60449583 -
ttactttcccaagccttttg

SEQ ID NO: 185663 - DNA, 20 bp, Artificial Sequence
  Synthetic oligonucleotide; GGG chr2 60449579 60449598 60449582 -
tactttcccaagccttttgt

SEQ ID NO: 185664 - DNA, 20 bp, Artificial Sequence
  Synthetic oligonucleotide; CAG chr2 60449571 60449590 60449574 -
caagccttttgtgggctgtt

SEQ ID NO: 185665 - DNA, 20 bp, Artificial Sequence
  Synthetic oligonucleotide; GAG chr2 60449517 60449536 60449520 -
ttattattattattattgtt

SEQ ID NO: 185666 - DNA, 20 bp, Artificial Sequence
  Synthetic oligonucleotide; TGG chr2 60449513 60449532 60449516 -
tattattattattgttgaga

SEQ ID NO: 185667 - DNA, 20 bp, Artificial Sequence
  Synthetic oligonucleotide; GAG chr2 60449511 60449530 60449514 -
ttattattattgttgagatg

SEQ ID NO: 185668 - DNA, 20 bp, Artificial Sequence
  Synthetic oligonucleotide; CAG chr2 60449493 60449512 60449496 -
tggagtctcactctattgcc

SEQ ID NO: 185669 - DNA, 20 bp, Artificial Sequence
  Synthetic oligonucleotide; AGG chr2 60449492 60449511 60449495 -
ggagtctcactctattgccc

SEQ ID NO: 185670 - DNA, 20 bp, Artificial Sequence
  Synthetic oligonucleotide; TGG chr2 60449488 60449507 60449491 -
tctcactctattgcccaggc

SEQ ID NO: 185671 - DNA, 20 bp, Artificial Sequence
  Synthetic oligonucleotide; GAG chr2 60449486 60449505 60449489 -
tcactctattgcccaggctg

SEQ ID NO: 185672 - DNA, 20 bp, Artificial Sequence
  Synthetic oligonucleotide; TGG chr2 60449478 60449497 60449481 -
ttgcccaggctggagtgcaa

SEQ ID NO: 185673 - DNA, 20 bp, Artificial Sequence
  Synthetic oligonucleotide; TGG chr2 60449467 60449486 60449470 -
ggagtgcaatggcacgatct

SEQ ID NO: 185674 - DNA, 20 bp, Artificial Sequence
  Synthetic oligonucleotide; CGG chr2 60449443 60449462 60449446 -
tcactgcaacctctacctcc

SEQ ID NO: 185675 - DNA, 20 bp, Artificial Sequence
  Synthetic oligonucleotide; GGG chr2 60449442 60449461 60449445 -
cactgcaacctctacctccc

SEQ ID NO: 185676 - DNA, 20 bp, Artificial Sequence
  Synthetic oligonucleotide; AAG chr2 60449436 60449455 60449439 -
aacctctacctcccgggttc

SEQ ID NO: 185677 - DNA, 20 bp, Artificial Sequence
  Synthetic oligonucleotide; TGG chr2 60449433 60449452 60449436 -
ctctacctcccgggttcaag

SEQ ID NO: 185678 - DNA, 20 bp, Artificial Sequence
  Synthetic oligonucleotide; CAG chr2 60449419 60449438 60449422 -
ttcaagtggttctcctgcct

SEQ ID NO: 185679 - DNA, 20 bp, Artificial Sequence
  Synthetic oligonucleotide; GAG chr2 60449410 60449429 60449413 -
ttctcctgcctcagcctcct

SEQ ID NO: 185680 - DNA, 20 bp, Artificial Sequence
  Synthetic oligonucleotide; TGG chr2 60449407 60449426 60449410 -
tcctgcctcagcctcctgag

SEQ ID NO: 185681 - DNA, 20 bp, Artificial Sequence
  Synthetic oligonucleotide; TGG chr2 60449403 60449422 60449406 -
gcctcagcctcctgagtggc

SEQ ID NO: 185682 - DNA, 20 bp, Artificial Sequence
  Synthetic oligonucleotide; GGG chr2 60449402 60449421 60449405 -
cctcagcctcctgagtggct

SEQ ID NO: 185683 - DNA, 20 bp, Artificial Sequence
  Synthetic oligonucleotide; CAG chr2 60449395 60449414 60449398 -
ctcctgagtggctgggatta

SEQ ID NO: 185684 - DNA, 20 bp, Artificial Sequence
  Synthetic oligonucleotide; AGG chr2 60449394 60449413 60449397 -
tcctgagtggctgggattac

SEQ ID NO: 185685 - DNA, 20 bp, Artificial Sequence
  Synthetic oligonucleotide; TGG chr2 60449380 60449399 60449383 -
gattacaggtgcgtaccacc

SEQ ID NO: 185686 - DNA, 20 bp, Artificial Sequence
  Synthetic oligonucleotide; TAG chr2 60449361 60449380 60449364 -
ctggctaatttttgtatttt

SEQ ID NO: 185687 - DNA, 20 bp, Artificial Sequence
  Synthetic oligonucleotide; TAG chr2 60449358 60449377 60449361 -
gctaatttttgtatttttag

SEQ ID NO: 185688 - DNA, 20 bp, Artificial Sequence
  Synthetic oligonucleotide; GAG chr2 60449356 60449375 60449359 -
taatttttgtatttttagta

SEQ ID NO: 185689 - DNA, 20 bp, Artificial Sequence
  Synthetic oligonucleotide; CGG chr2 60449352 60449371 60449355 -
ttttgtatttttagtagaga

SEQ ID NO: 185690 - DNA, 20 bp, Artificial Sequence
  Synthetic oligonucleotide; GGG chr2 60449351 60449370 60449354 -
tttgtatttttagtagagac

SEQ ID NO: 185691 - DNA, 20 bp, Artificial Sequence
  Synthetic oligonucleotide; GGG chr2 60449350 60449369 60449353 -
ttgtatttttagtagagacg

SEQ ID NO: 185692 - DNA, 20 bp, Artificial Sequence
  Synthetic oligonucleotide; TGG chr2 60449336 60449355 60449339 -
gagacggggtttcaccatgt

SEQ ID NO: 185693 - DNA, 20 bp, Artificial Sequence
  Synthetic oligonucleotide; CAG chr2 60449332 60449351 60449335 -
cggggtttcaccatgttggt

SEQ ID NO: 185694 - DNA, 20 bp, Artificial Sequence
  Synthetic oligonucleotide; AGG chr2 60449331 60449350 60449334 -
ggggtttcaccatgttggtc

SEQ ID NO: 185695 - DNA, 20 bp, Artificial Sequence
  Synthetic oligonucleotide; TGG chr2 60449327 60449346 60449330 -
tttcaccatgttggtcaggc

SEQ ID NO: 185696 - DNA, 20 bp, Artificial Sequence
  Synthetic oligonucleotide; GAG chr2 60449304 60449323 60449307 -
tctcgaactcctgacctcat

SEQ ID NO: 185697 - DNA, 20 bp, Artificial Sequence
  Synthetic oligonucleotide; CGG chr2 60449291 60449310 60449294 -
acctcatgagccacctgcct

SEQ ID NO: 185698 - DNA, 20 bp, Artificial Sequence
  Synthetic oligonucleotide; AAG chr2 60449281 60449300 60449284 -
ccacctgcctcggcctccca

SEQ ID NO: 185699 - DNA, 20 bp, Artificial Sequence
  Synthetic oligonucleotide; TGG chr2 60449275 60449294 60449278 -
gcctcggcctcccaaagtgc

SEQ ID NO: 185700 - DNA, 20 bp, Artificial Sequence
  Synthetic oligonucleotide; GGG chr2 60449274 60449293 60449277 -
cctcggcctcccaaagtgct

SEQ ID NO: 185701 - DNA, 20 bp, Artificial Sequence
  Synthetic oligonucleotide; CAG chr2 60449267 60449286 60449270 -
ctcccaaagtgctgggatta

SEQ ID NO: 185702 - DNA, 20 bp, Artificial Sequence
  Synthetic oligonucleotide; AGG chr2 60449266 60449285 60449269 -
tcccaaagtgctgggattac

SEQ ID NO: 185703 - DNA, 20 bp, Artificial Sequence
  Synthetic oligonucleotide; AAG chr2 60449260 60449279 60449263 -
agtgctgggattacaggtgt

SEQ ID NO: 185704 - DNA, 20 bp, Artificial Sequence
  Synthetic oligonucleotide; CGG chr2 60449247 60449266 60449250 -
caggtgtaagccaccgcgcc

SEQ ID NO: 185705 - DNA, 20 bp, Artificial Sequence
  Synthetic oligonucleotide; CAG chr2 60449243 60449262 60449246 -
tgtaagccaccgcgcccgga

SEQ ID NO: 185706 - DNA, 20 bp, Artificial Sequence
  Synthetic oligonucleotide; AAG chr2 60449221 60449240 60449224 -
gattattacactgtataaaa

SEQ ID NO: 185707 - DNA, 20 bp, Artificial Sequence
  Synthetic oligonucleotide; AGG chr2 60449220 60449239 60449223 -
attattacactgtataaaaa

SEQ ID NO: 185708 - DNA, 20 bp, Artificial Sequence
  Synthetic oligonucleotide; TAG chr2 60449212 60449231 60449215 -
actgtataaaaaaggtctgt

SEQ ID NO: 185709 - DNA, 20 bp, Artificial Sequence
  Synthetic oligonucleotide; TGG chr2 60449206 60449225 60449209 -
taaaaaaggtctgttagaat

SEQ ID NO: 185710 - DNA, 20 bp, Artificial Sequence
  Synthetic oligonucleotide; GGG chr2 60449205 60449224 60449208 -
aaaaaaggtctgttagaatt

SEQ ID NO: 185711 - DNA, 20 bp, Artificial Sequence
  Synthetic oligonucleotide; GGG chr2 60449204 60449223 60449207 -
aaaaaggtctgttagaattg

SEQ ID NO: 185712 - DNA, 20 bp, Artificial Sequence
  Synthetic oligonucleotide; TGG chr2 60449194 60449213 60449197 -
gttagaattggggtccatga

SEQ ID NO: 185713 - DNA, 20 bp, Artificial Sequence
  Synthetic oligonucleotide; GGG chr2 60449193 60449212 60449196 -
ttagaattggggtccatgat

SEQ ID NO: 185714 - DNA, 20 bp, Artificial Sequence
  Synthetic oligonucleotide; GAG chr2 60449191 60449210 60449194 -
agaattggggtccatgatgg

SEQ ID NO: 185715 - DNA, 20 bp, Artificial Sequence
  Synthetic oligonucleotide; GAG chr2 60449189 60449208 60449192 -
aattggggtccatgatggga

SEQ ID NO: 185716 - DNA, 20 bp, Artificial Sequence
  Synthetic oligonucleotide; AAG chr2 60449185 60449204 60449188 -
ggggtccatgatgggagaga

SEQ ID NO: 185717 - DNA, 20 bp, Artificial Sequence
  Synthetic oligonucleotide; AAG chr2 60449175 60449194 60449178 -
atgggagagaaagacactca

SEQ ID NO: 185718 - DNA, 20 bp, Artificial Sequence
  Synthetic oligonucleotide; CAG chr2 60449166 60449185 60449169 -
aaagacactcaaagcccctg

SEQ ID NO: 185719 - DNA, 20 bp, Artificial Sequence
  Synthetic oligonucleotide; CAG chr2 60449159 60449178 60449162 -
ctcaaagcccctgcagcacc

SEQ ID NO: 185720 - DNA, 20 bp, Artificial Sequence
  Synthetic oligonucleotide; CAG chr2 60449152 60449171 60449155 -
cccctgcagcacccagcatc

SEQ ID NO: 185721 - DNA, 20 bp, Artificial Sequence
  Synthetic oligonucleotide; CAG chr2 60449137 60449156 60449140 -
gcatccagcatgttgaatat

SEQ ID NO: 185722 - DNA, 20 bp, Artificial Sequence
  Synthetic oligonucleotide; GAG chr2 60449127 60449146 60449130 -
tgttgaatatcagcctgttt

SEQ ID NO: 185723 - DNA, 20 bp, Artificial Sequence
  Synthetic oligonucleotide; CAG chr2 60449105 60449124 60449108 -
gaaataattgtttcaaaaac

SEQ ID NO: 185724 - DNA, 20 bp, Artificial Sequence
  Synthetic oligonucleotide; AAG chr2 60449092 60449111 60449095 -
caaaaaccagtgatcattta

SEQ ID NO: 185725 - DNA, 20 bp, Artificial Sequence
  Synthetic oligonucleotide; TAG chr2 60449081 60449100 60449084 -
gatcatttaaagaaaactct

SEQ ID NO: 185726 - DNA, 20 bp, Artificial Sequence
  Synthetic oligonucleotide; AGG chr2 60449080 60449099 60449083 -
atcatttaaagaaaactctt

SEQ ID NO: 185727 - DNA, 20 bp, Artificial Sequence
  Synthetic oligonucleotide; AAG chr2 60449076 60449095 60449079 -
tttaaagaaaactcttaggc

SEQ ID NO: 185728 - DNA, 20 bp, Artificial Sequence
  Synthetic oligonucleotide; AGG chr2 60449075 60449094 60449078 -
ttaaagaaaactcttaggca

SEQ ID NO: 185729 - DNA, 20 bp, Artificial Sequence
  Synthetic oligonucleotide; GAG chr2 60449073 60449092 60449076 -
aaagaaaactcttaggcaag

SEQ ID NO: 185730 - DNA, 20 bp, Artificial Sequence
  Synthetic oligonucleotide; TGG chr2 60449062 60449081 60449065 -
ttaggcaaggagtgcaatct

SEQ ID NO: 185731 - DNA, 20 bp, Artificial Sequence
  Synthetic oligonucleotide; GAG chr2 60449051 60449070 60449054 -
gtgcaatcttggaatctgct

SEQ ID NO: 185732 - DNA, 20 bp, Artificial Sequence
  Synthetic oligonucleotide; AGG chr2 60449050 60449069 60449053 -
tgcaatcttggaatctgctg

SEQ ID NO: 185733 - DNA, 20 bp, Artificial Sequence
  Synthetic oligonucleotide; GAG chr2 60449040 60449059 60449043 -
gaatctgctgaggtctaact

SEQ ID NO: 185734 - DNA, 20 bp, Artificial Sequence
  Synthetic oligonucleotide; TGG chr2 60449025 60449044 60449028 -
taactgagtgccccaaacct

SEQ ID NO: 185735 - DNA, 20 bp, Artificial Sequence
  Synthetic oligonucleotide; CAG chr2 60449022 60449041 60449025 -
ctgagtgccccaaaccttgg

SEQ ID NO: 185736 - DNA, 20 bp, Artificial Sequence
  Synthetic oligonucleotide; TGG chr2 60449010 60449029 60449013 -
aaccttggcagcatattttc

SEQ ID NO: 185737 - DNA, 20 bp, Artificial Sequence
  Synthetic oligonucleotide; GGG chr2 60449009 60449028 60449012 -
accttggcagcatattttct

SEQ ID NO: 185738 - DNA, 20 bp, Artificial Sequence
  Synthetic oligonucleotide; TGG chr2 60448996 60449015 60448999 -
attttctgggcacttttgct

SEQ ID NO: 185739 - DNA, 20 bp, Artificial Sequence
  Synthetic oligonucleotide; GAG chr2 60448994 60449013 60448997 -
tttctgggcacttttgcttg

SEQ ID NO: 185740 - DNA, 20 bp, Artificial Sequence
  Synthetic oligonucleotide; AAG chr2 60448986 60449005 60448989 -
cacttttgcttggagtttcc

SEQ ID NO: 185741 - DNA, 20 bp, Artificial Sequence
  Synthetic oligonucleotide; GAG chr2 60448984 60449003 60448987 -
cttttgcttggagtttccaa

SEQ ID NO: 185742 - DNA, 20 bp, Artificial Sequence
  Synthetic oligonucleotide; CAG chr2 60448977 60448996 60448980 -
ttggagtttccaagagcatt

SEQ ID NO: 185743 - DNA, 20 bp, Artificial Sequence
  Synthetic oligonucleotide; AAG chr2 60448965 60448984 60448968 -
agagcattcagattaaaacc

SEQ ID NO: 185744 - DNA, 20 bp, Artificial Sequence
  Synthetic oligonucleotide; AAG chr2 60448956 60448975 60448959 -
agattaaaaccaagcccttc

SEQ ID NO: 185745 - DNA, 20 bp, Artificial Sequence
  Synthetic oligonucleotide; TGG chr2 60448953 60448972 60448956 -
ttaaaaccaagcccttcaag

SEQ ID NO: 185746 - DNA, 20 bp, Artificial Sequence
  Synthetic oligonucleotide; CAG chr2 60448949 60448968 60448952 -
aaccaagcccttcaagtggt

SEQ ID NO: 185747 - DNA, 20 bp, Artificial Sequence
  Synthetic oligonucleotide; AGG chr2 60448948 60448967 60448951 -
accaagcccttcaagtggtc

SEQ ID NO: 185748 - DNA, 20 bp, Artificial Sequence
  Synthetic oligonucleotide; CAG chr2 60448936 60448955 60448939 -
aagtggtcaggaatatcttt

SEQ ID NO: 185749 - DNA, 20 bp, Artificial Sequence
  Synthetic oligonucleotide; AGG chr2 60448935 60448954 60448938 -
agtggtcaggaatatctttc

SEQ ID NO: 185750 - DNA, 20 bp, Artificial Sequence
  Synthetic oligonucleotide; TAG chr2 60448895 60448914 60448898 -
tgatttttttttttttttga

SEQ ID NO: 185751 - DNA, 20 bp, Artificial Sequence
  Synthetic oligonucleotide; GAG chr2 60448891 60448910 60448894 -
ttttttttttttttgatagt

SEQ ID NO: 185752 - DNA, 20 bp, Artificial Sequence
  Synthetic oligonucleotide; AGG chr2 60448890 60448909 60448893 -
tttttttttttttgatagtg

SEQ ID NO: 185753 - DNA, 20 bp, Artificial Sequence
  Synthetic oligonucleotide; AAG chr2 60448875 60448894 60448878 -
tagtgaggttaacattgacg

SEQ ID NO: 185754 - DNA, 20 bp, Artificial Sequence
  Synthetic oligonucleotide; TGG chr2 60448871 60448890 60448874 -
gaggttaacattgacgaaga

SEQ ID NO: 185755 - DNA, 20 bp, Artificial Sequence
  Synthetic oligonucleotide; CAG chr2 60448813 60448832 60448816 -
ataattcttattttataaat

SEQ ID NO: 185756 - DNA, 20 bp, Artificial Sequence
  Synthetic oligonucleotide; CGG chr2 60448804 60448823 60448807 -
attttataaatcagtgtccc

SEQ ID NO: 185757 - DNA, 20 bp, Artificial Sequence
  Synthetic oligonucleotide; AAG chr2 60448801 60448820 60448804 -
ttataaatcagtgtccccgg

SEQ ID NO: 185758 - DNA, 20 bp, Artificial Sequence
  Synthetic oligonucleotide; TAG chr2 60448795 60448814 60448798 -
atcagtgtccccggaagtaa

SEQ ID NO: 185759 - DNA, 20 bp, Artificial Sequence
  Synthetic oligonucleotide; TAG chr2 60448792 60448811 60448795 -
agtgtccccggaagtaatag

SEQ ID NO: 185760 - DNA, 20 bp, Artificial Sequence
  Synthetic oligonucleotide; AGG chr2 60448791 60448810 60448794 -
gtgtccccggaagtaatagt

SEQ ID NO: 185761 - DNA, 20 bp, Artificial Sequence
  Synthetic oligonucleotide; TAG chr2 60448786 60448805 60448789 -
cccggaagtaatagtaggat

SEQ ID NO: 185762 - DNA, 20 bp, Artificial Sequence
  Synthetic oligonucleotide; TGG chr2 60448781 60448800 60448784 -
aagtaatagtaggattagaa

SEQ ID NO: 185763 - DNA, 20 bp, Artificial Sequence
  Synthetic oligonucleotide; AAG chr2 60448778 60448797 60448781 -
taatagtaggattagaatgg

SEQ ID NO: 185764 - DNA, 20 bp, Artificial Sequence
  Synthetic oligonucleotide; TAG chr2 60448768 60448787 60448771 -
attagaatggaagtattttg

SEQ ID NO: 185765 - DNA, 20 bp, Artificial Sequence
  Synthetic oligonucleotide; AGG chr2 60448767 60448786 60448770 -
ttagaatggaagtattttgt

SEQ ID NO: 185766 - DNA, 20 bp, Artificial Sequence
  Synthetic oligonucleotide; TGG chr2 60448760 60448779 60448763 -
ggaagtattttgtaggctgt

SEQ ID NO: 185767 - DNA, 20 bp, Artificial Sequence
  Synthetic oligonucleotide; CAG chr2 60448746 60448765 60448749 -
ggctgttggttctgttctta

SEQ ID NO: 185768 - DNA, 20 bp, Artificial Sequence
  Synthetic oligonucleotide; TAG chr2 60448734 60448753 60448737 -
tgttcttacagtatgccaca

SEQ ID NO: 185769 - DNA, 20 bp, Artificial Sequence
  Synthetic oligonucleotide; TGG chr2 60448718 60448737 60448721 -
cacatagctttgactccttt

SEQ ID NO: 185770 - DNA, 20 bp, Artificial Sequence
  Synthetic oligonucleotide; GAG chr2 60448716 60448735 60448719 -
catagctttgactccttttg

SEQ ID NO: 185771 - DNA, 20 bp, Artificial Sequence
  Synthetic oligonucleotide; TAG chr2 60448711 60448730 60448714 -
ctttgactccttttggagta

SEQ ID NO: 185772 - DNA, 20 bp, Artificial Sequence
  Synthetic oligonucleotide; AAG chr2 60448704 60448723 60448707 -
tccttttggagtatagtgtg

SEQ ID NO: 185773 - DNA, 20 bp, Artificial Sequence
  Synthetic oligonucleotide; AGG chr2 60448703 60448722 60448706 -
ccttttggagtatagtgtga

SEQ ID NO: 185774 - DNA, 20 bp, Artificial Sequence
  Synthetic oligonucleotide; AAG chr2 60448700 60448719 60448703 -
tttggagtatagtgtgaagg

SEQ ID NO: 185775 - DNA, 20 bp, Artificial Sequence
  Synthetic oligonucleotide; CAG chr2 60448697 60448716 60448700 -
ggagtatagtgtgaaggaag

SEQ ID NO: 185776 - DNA, 20 bp, Artificial Sequence
  Synthetic oligonucleotide; GAG chr2 60448690 60448709 60448693 -
agtgtgaaggaagcagattt

SEQ ID NO: 185777 - DNA, 20 bp, Artificial Sequence
  Synthetic oligonucleotide; AGG chr2 60448689 60448708 60448692 -
gtgtgaaggaagcagatttg

SEQ ID NO: 185778 - DNA, 20 bp, Artificial Sequence
  Synthetic oligonucleotide; GAG chr2 60448680 60448699 60448683 -
aagcagatttgaggaatttt

SEQ ID NO: 185779 - DNA, 20 bp, Artificial Sequence
  Synthetic oligonucleotide; TGG chr2 60448675 60448694 60448678 -
gatttgaggaattttgagtc

SEQ ID NO: 185780 - DNA, 20 bp, Artificial Sequence
  Synthetic oligonucleotide; TGG chr2 60448672 60448691 60448675 -
ttgaggaattttgagtctgg

SEQ ID NO: 185781 - DNA, 20 bp, Artificial Sequence
  Synthetic oligonucleotide; AAG chr2 60448669 60448688 60448672 -
aggaattttgagtctggtgg

SEQ ID NO: 185782 - DNA, 20 bp, Artificial Sequence
  Synthetic oligonucleotide; TGG chr2 60448654 60448673 60448657 -
ggtggaagttccaaaataac

SEQ ID NO: 185783 - DNA, 20 bp, Artificial Sequence
  Synthetic oligonucleotide; AAG chr2 60448645 60448664 60448648 -
tccaaaataactggtgatgc

SEQ ID NO: 185784 - DNA, 20 bp, Artificial Sequence
  Synthetic oligonucleotide; AAG chr2 60448626 60448645 60448629 -
caagcacaccttccttcttc

SEQ ID NO: 185785 - DNA, 20 bp, Artificial Sequence
  Synthetic oligonucleotide; GAG chr2 60448624 60448643 60448627 -
agcacaccttccttcttcaa

SEQ ID NO: 185786 - DNA, 20 bp, Artificial Sequence
  Synthetic oligonucleotide; GAG chr2 60448613 60448632 60448616 -
cttcttcaagagttcatctt

SEQ ID NO: 185787 - DNA, 20 bp, Artificial Sequence
  Synthetic oligonucleotide; CAG chr2 60448602 60448621 60448605 -
gttcatcttgagttcctaac

SEQ ID NO: 185788 - DNA, 20 bp, Artificial Sequence
  Synthetic oligonucleotide; CAG chr2 60448599 60448618 60448602 -
catcttgagttcctaaccag

SEQ ID NO: 185789 - DNA, 20 bp, Artificial Sequence
  Synthetic oligonucleotide; GAG chr2 60448597 60448616 60448600 -
tcttgagttcctaaccagca

SEQ ID NO: 185790 - DNA, 20 bp, Artificial Sequence
  Synthetic oligonucleotide; TAG chr2 60448562 60448581 60448565 -
atttctttcctctgactgcc

SEQ ID NO: 185791 - DNA, 20 bp, Artificial Sequence
  Synthetic oligonucleotide; AGG chr2 60448561 60448580 60448564 -
tttctttcctctgactgcct

SEQ ID NO: 185792 - DNA, 20 bp, Artificial Sequence
  Synthetic oligonucleotide; GAG chr2 60448559 60448578 60448562 -
tctttcctctgactgcctag

SEQ ID NO: 185793 - DNA, 20 bp, Artificial Sequence
  Synthetic oligonucleotide; GAG chr2 60448557 60448576 60448560 -
tttcctctgactgcctagga

SEQ ID NO: 185794 - DNA, 20 bp, Artificial Sequence
  Synthetic oligonucleotide; CAG chr2 60448553 60448572 60448556 -
ctctgactgcctaggagaga

SEQ ID NO: 185795 - DNA, 20 bp, Artificial Sequence
  Synthetic oligonucleotide; CAG chr2 60448543 60448562 60448546 -
ctaggagagacagtactctt

SEQ ID NO: 185796 - DNA, 20 bp, Artificial Sequence
  Synthetic oligonucleotide; TGG chr2 60448528 60448547 60448531 -
ctcttcagtttgcattcccc

SEQ ID NO: 185797 - DNA, 20 bp, Artificial Sequence
  Synthetic oligonucleotide; GAG chr2 60448526 60448545 60448529 -
cttcagtttgcattcccctg

SEQ ID NO: 185798 - DNA, 20 bp, Artificial Sequence
  Synthetic oligonucleotide; AAG chr2 60448516 60448535 60448519 -
cattcccctggagttacatt

SEQ ID NO: 185799 - DNA, 20 bp, Artificial Sequence
  Synthetic oligonucleotide; TGG chr2 60448510 60448529 60448513 -
cctggagttacattaagtca

SEQ ID NO: 185800 - DNA, 20 bp, Artificial Sequence
  Synthetic oligonucleotide; CAG chr2 60448494 60448513 60448497 -
gtcatggaacttctcacttc

SEQ ID NO: 185801 - DNA, 20 bp, Artificial Sequence
  Synthetic oligonucleotide; CAG chr2 60448484 60448503 60448487 -
ttctcacttccagtaaaatc

SEQ ID NO: 185802 - DNA, 20 bp, Artificial Sequence
  Synthetic oligonucleotide; AAG chr2 60448481 60448500 60448484 -
tcacttccagtaaaatccag

SEQ ID NO: 185803 - DNA, 20 bp, Artificial Sequence
  Synthetic oligonucleotide; CAG chr2 60448478 60448497 60448481 -
cttccagtaaaatccagaag

SEQ ID NO: 185804 - DNA, 20 bp, Artificial Sequence
  Synthetic oligonucleotide; TAG chr2 60448454 60448473 60448457 -
cattgtctgtttttctatct

SEQ ID NO: 185805 - DNA, 20 bp, Artificial Sequence
  Synthetic oligonucleotide; TAG chr2 60448444 60448463 60448447 -
ttttctatcttagtttaaat

SEQ ID NO: 185806 - DNA, 20 bp, Artificial Sequence
  Synthetic oligonucleotide; AGG chr2 60448443 60448462 60448446 -
tttctatcttagtttaaatt

SEQ ID NO: 185807 - DNA, 20 bp, Artificial Sequence
  Synthetic oligonucleotide; TGG chr2 60448420 60448439 60448423 -
atatcttattacgaaccaca

SEQ ID NO: 185808 - DNA, 20 bp, Artificial Sequence
  Synthetic oligonucleotide; CAG chr2 60448382 60448401 60448385 -
tgtattttaaaaaatgctcc

SEQ ID NO: 185809 - DNA, 20 bp, Artificial Sequence
  Synthetic oligonucleotide; AGG chr2 60448381 60448400 60448384 -
gtattttaaaaaatgctccc

SEQ ID NO: 185810 - DNA, 20 bp, Artificial Sequence
  Synthetic oligonucleotide; AAG chr2 60448378 60448397 60448381 -
ttttaaaaaatgctcccagg

SEQ ID NO: 185811 - DNA, 20 bp, Artificial Sequence
  Synthetic oligonucleotide; AAG chr2 60448370 60448389 60448373 -
aatgctcccaggaagtactt

SEQ ID NO: 185812 - DNA, 20 bp, Artificial Sequence
  Synthetic oligonucleotide; TAG chr2 60448362 60448381 60448365 -
caggaagtacttaagcttta

SEQ ID NO: 185813 - DNA, 20 bp, Artificial Sequence
  Synthetic oligonucleotide; TAG chr2 60448340 60448359 60448343 -
gaatacttttatatacatga

SEQ ID NO: 185814 - DNA, 20 bp, Artificial Sequence
  Synthetic oligonucleotide; TAG chr2 60448309 60448328 60448312 -
ttccttgtgattctataaat

SEQ ID NO: 185815 - DNA, 20 bp, Artificial Sequence
  Synthetic oligonucleotide; AAG chr2 60448304 60448323 60448307 -
tgtgattctataaattagat

SEQ ID NO: 185816 - DNA, 20 bp, Artificial Sequence
  Synthetic oligonucleotide; AAG chr2 60448299 60448318 60448302 -
ttctataaattagataagaa

SEQ ID NO: 185817 - DNA, 20 bp, Artificial Sequence
  Synthetic oligonucleotide; TAG chr2 60448294 60448313 60448297 -
taaattagataagaaaagaa

SEQ ID NO: 185818 - DNA, 20 bp, Artificial Sequence
  Synthetic oligonucleotide; AAG chr2 60448287 60448306 60448290 -
gataagaaaagaatagactg

SEQ ID NO: 185819 - DNA, 20 bp, Artificial Sequence
  Synthetic oligonucleotide; AAG chr2 60448280 60448299 60448283 -
aaagaatagactgaagttga

SEQ ID NO: 185820 - DNA, 20 bp, Artificial Sequence
  Synthetic oligonucleotide; AGG chr2 60448279 60448298 60448282 -
aagaatagactgaagttgaa

SEQ ID NO: 185821 - DNA, 20 bp, Artificial Sequence
  Synthetic oligonucleotide; TAG chr2 60448271 60448290 60448274 -
actgaagttgaaaggaatcc

SEQ ID NO: 185822 - DNA, 20 bp, Artificial Sequence
  Synthetic oligonucleotide; TAG chr2 60448255 60448274 60448258 -
atcctagtaatcactcattt

SEQ ID NO: 185823 - DNA, 20 bp, Artificial Sequence
  Synthetic oligonucleotide; GAG chr2 60448253 60448272 60448256 -
cctagtaatcactcatttta

SEQ ID NO: 185824 - DNA, 20 bp, Artificial Sequence
  Synthetic oligonucleotide; CAG chr2 60448248 60448267 60448251 -
taatcactcattttagagat

SEQ ID NO: 185825 - DNA, 20 bp, Artificial Sequence
  Synthetic oligonucleotide; AAG chr2 60448239 60448258 60448242 -
attttagagatcagaataat

SEQ ID NO: 185826 - DNA, 20 bp, Artificial Sequence
  Synthetic oligonucleotide; AGG chr2 60448238 60448257 60448241 -
ttttagagatcagaataata

SEQ ID NO: 185827 - DNA, 20 bp, Artificial Sequence
  Synthetic oligonucleotide; GGG chr2 60448237 60448256 60448240 -
tttagagatcagaataataa

SEQ ID NO: 185828 - DNA, 20 bp, Artificial Sequence
  Synthetic oligonucleotide; AAG chr2 60448230 60448249 60448233 -
atcagaataataagggccca

SEQ ID NO: 185829 - DNA, 20 bp, Artificial Sequence
  Synthetic oligonucleotide; AAG chr2 60448224 60448243 60448227 -
ataataagggcccaaagatt

SEQ ID NO: 185830 - DNA, 20 bp, Artificial Sequence
  Synthetic oligonucleotide; AAG chr2 60448219 60448238 60448222 -
aagggcccaaagattaagtg

SEQ ID NO: 185831 - DNA, 20 bp, Artificial Sequence
  Synthetic oligonucleotide; AAG chr2 60448211 60448230 60448214 -
aaagattaagtgaagtacct

SEQ ID NO: 185832 - DNA, 20 bp, Artificial Sequence
  Synthetic oligonucleotide; CAG chr2 60448204 60448223 60448207 -
aagtgaagtacctaagatca

SEQ ID NO: 185833 - DNA, 20 bp, Artificial Sequence
  Synthetic oligonucleotide; TAG chr2 60448185 60448204 60448188 -
acagtgtgaaaaaaacatca

SEQ ID NO: 185834 - DNA, 20 bp, Artificial Sequence
  Synthetic oligonucleotide; AAG chr2 60448180 60448199 60448183 -
gtgaaaaaaacatcatagcc

SEQ ID NO: 185835 - DNA, 20 bp, Artificial Sequence
  Synthetic oligonucleotide; ATGAGT chr2 60448237 60448256 60448253 +
ttattattctgatctctaaa

SEQ ID NO: 185836 - DNA, 20 bp, Artificial Sequence
  Synthetic oligonucleotide; TAGGAT chr2 60448249 60448268 60448265 +
tctctaaaatgagtgattac

SEQ ID NO: 185837 - DNA, 20 bp, Artificial Sequence
  Synthetic oligonucleotide; TAGAAT chr2 60448294 60448313 60448310 +
ttcttttcttatctaattta

SEQ ID NO: 185838 - DNA, 20 bp, Artificial Sequence
  Synthetic oligonucleotide; CTGGAT chr2 60448461 60448480 60448477 +
aaaacagacaatgactgctt

SEQ ID NO: 185839 - DNA, 20 bp, Artificial Sequence
  Synthetic oligonucleotide; GGGAAT chr2 60448509 60448528 60448525 +
atgacttaatgtaactccag

SEQ ID NO: 185840 - DNA, 20 bp, Artificial Sequence
  Synthetic oligonucleotide; AAGAGT chr2 60448523 60448542 60448539 +
ctccaggggaatgcaaactg

SEQ ID NO: 185841 - DNA, 20 bp, Artificial Sequence
  Synthetic oligonucleotide; AGGAGT chr2 60448700 60448719 60448716 +
ccttcacactatactccaaa

SEQ ID NO: 185842 - DNA, 20 bp, Artificial Sequence
  Synthetic oligonucleotide; AAGAAT chr2 60448804 60448823 60448820 +
gggacactgatttataaaat

SEQ ID NO: 185843 - DNA, 20 bp, Artificial Sequence
  Synthetic oligonucleotide; AAGAAT chr2 60448818 60448837 60448834 +
taaaataagaattataaaat

SEQ ID NO: 185844 - DNA, 20 bp, Artificial Sequence
  Synthetic oligonucleotide; AGGAAT chr2 60448834 60448853 60448850 +
aaataagaatttttaaaaat

SEQ ID NO: 185845 - DNA, 20 bp, Artificial Sequence
  Synthetic oligonucleotide; CTGAAT chr2 60448954 60448973 60448970 +
ttgaagggcttggttttaat

SEQ ID NO: 185846 - DNA, 20 bp, Artificial Sequence
  Synthetic oligonucleotide; AAGAGT chr2 60449060 60449079 60449076 +
caagattgcactccttgcct

SEQ ID NO: 185847 - DNA, 20 bp, Artificial Sequence
  Synthetic oligonucleotide; CTGGAT chr2 60449129 60449148 60449145 +
acaggctgatattcaacatg

SEQ ID NO: 185848 - DNA, 20 bp, Artificial Sequence
  Synthetic oligonucleotide; CTGGGT chr2 60449136 60449155 60449152 +
gatattcaacatgctggatg

SEQ ID NO: 185849 - DNA, 20 bp, Artificial Sequence
  Synthetic oligonucleotide; TTGAGT chr2 60449154 60449173 60449170 +
tgctgggtgctgcaggggct

SEQ ID NO: 185850 - DNA, 20 bp, Artificial Sequence
  Synthetic oligonucleotide; AGGAGT chr2 60449292 60449311 60449308 +
ggcaggtggctcatgaggtc

SEQ ID NO: 185851 - DNA, 20 bp, Artificial Sequence
  Synthetic oligonucleotide; TAGAGT chr2 60449478 60449497 60449494 +
ttgcactccagcctgggcaa

SEQ ID NO: 185852 - DNA, 20 bp, Artificial Sequence
  Synthetic oligonucleotide; ATGGAT chr2 60449755 60449774 60449771 +
cttccctgcttctgccattc

SEQ ID NO: 185853 - DNA, 20 bp, Artificial Sequence
  Synthetic oligonucleotide; TGGGGT chr2 60449818 60449837 60449834 +
cccaaattgtcaatcttgta

SEQ ID NO: 185854 - DNA, 20 bp, Artificial Sequence
  Synthetic oligonucleotide; GAGGGT chr2 60449894 60449913 60449910 +
cagcactatgggaggcctag

SEQ ID NO: 185855 - DNA, 20 bp, Artificial Sequence
  Synthetic oligonucleotide; GTGGAT chr2 60449898 60449917 60449914 +
actatgggaggcctaggagg

SEQ ID NO: 185856 - DNA, 20 bp, Artificial Sequence
  Synthetic oligonucleotide; GAGGAT chr2 60450034 60450053 60450050 +
tacttgggaagctgaggcag

SEQ ID NO: 185857 - DNA, 20 bp, Artificial Sequence
  Synthetic oligonucleotide; CTGAGT chr2 60450073 60450092 60450089 +
taggcggaggttgtggtgag

SEQ ID NO: 185858 - DNA, 20 bp, Artificial Sequence
  Synthetic oligonucleotide; CTGGGT chr2 60450099 60450118 60450115 +
ccttgccactgcactccagc

SEQ ID NO: 185859 - DNA, 20 bp, Artificial Sequence
  Synthetic oligonucleotide; GGGGGT chr2 60450264 60450283 60450280 +
ttttgttctgtttgttttga

SEQ ID NO: 185860 - DNA, 20 bp, Artificial Sequence
  Synthetic oligonucleotide; GAGGAT chr2 60450286 60450305 60450302 +
gggttcttctccacagtgaa

SEQ ID NO: 185861 - DNA, 20 bp, Artificial Sequence
  Synthetic oligonucleotide; GGGGGT chr2 60450402 60450421 60450418 +
agaagaaatatataaaaagt

SEQ ID NO: 185862 - DNA, 20 bp, Artificial Sequence
  Synthetic oligonucleotide; CAGGAT chr2 60450481 60450500 60450497 +
gctgaacttgtctcaagacc

SEQ ID NO: 185863 - DNA, 20 bp, Artificial Sequence
  Synthetic oligonucleotide; AGGAGT chr2 60450545 60450564 60450561 +
actctttctaggcatcagca

SEQ ID NO: 185864 - DNA, 20 bp, Artificial Sequence
  Synthetic oligonucleotide; GAGGGT chr2 60450635 60450654 60450651 +
ggcagagcatggggcaggga

SEQ ID NO: 185865 - DNA, 20 bp, Artificial Sequence
  Synthetic oligonucleotide; CAGGGT chr2 60450716 60450735 60450732 +
aaacaggccactcgtgcaat

SEQ ID NO: 185866 - DNA, 20 bp, Artificial Sequence
  Synthetic oligonucleotide; CTGGGT chr2 60450843 60450862 60450859 +
tgcctttaccaaaggccatc

SEQ ID NO: 185867 - DNA, 20 bp, Artificial Sequence
  Synthetic oligonucleotide; CAGAGT chr2 60450937 60450956 60450953 +
actccctttgatcagttaaa

SEQ ID NO: 185868 - DNA, 20 bp, Artificial Sequence
  Synthetic oligonucleotide; ATGAAT chr2 60451166 60451185 60451182 +
gtagacagtcattatttatt

SEQ ID NO: 185869 - DNA, 20 bp, Artificial Sequence
  Synthetic oligonucleotide; GTGGAT chr2 60451241 60451260 60451257 +
ctaggtaatctagccagaag

SEQ ID NO: 185870 - DNA, 20 bp, Artificial Sequence
  Synthetic oligonucleotide; TAGGAT chr2 60451250 60451269 60451266 +
ctagccagaaggtggatagg

SEQ ID NO: 185871 - DNA, 20 bp, Artificial Sequence
  Synthetic oligonucleotide; GTGAAT chr2 60451284 60451303 60451300 +
cttaggttcacggcctgtat

SEQ ID NO: 185872 - DNA, 20 bp, Artificial Sequence
  Synthetic oligonucleotide; CTGGAT chr2 60451364 60451383 60451380 +
atgttgtttctaattctctt

SEQ ID NO: 185873 - DNA, 20 bp, Artificial Sequence
  Synthetic oligonucleotide; AAGAAT chr2 60451429 60451448 60451445 +
tgcaaattaactgggccaga

SEQ ID NO: 185874 - DNA, 20 bp, Artificial Sequence
  Synthetic oligonucleotide; AGGAAT chr2 60451483 60451502 60451499 +
atttgtggcactaatttcta

SEQ ID NO: 185875 - DNA, 20 bp, Artificial Sequence
  Synthetic oligonucleotide; TAGAAT chr2 60451650 60451669 60451666 +
aaggtttgggaacctaaaat

SEQ ID NO: 185876 - DNA, 20 bp, Artificial Sequence
  Synthetic oligonucleotide; TAGGAT chr2 60451692 60451711 60451708 +
ctgacatttatcaccttctt

SEQ ID NO: 185877 - DNA, 20 bp, Artificial Sequence
  Synthetic oligonucleotide; CAGGAT chr2 60451791 60451810 60451807 +
aaaagcatatatttgaaaaa

SEQ ID NO: 185878 - DNA, 20 bp, Artificial Sequence
  Synthetic oligonucleotide; ATGGGT chr2 60452042 60452061 60452058 +
ctgttcctcctacccacccg

SEQ ID NO: 185879 - DNA, 20 bp, Artificial Sequence
  Synthetic oligonucleotide; TAGAAT chr2 60452192 60452211 60452208 +
acactttttaaaagacaaca

SEQ ID NO: 185880 - DNA, 20 bp, Artificial Sequence
  Synthetic oligonucleotide; AGGGGT chr2 60452209 60452228 60452225 +
acatagaatgtatagaaaca

SEQ ID NO: 185881 - DNA, 20 bp, Artificial Sequence
  Synthetic oligonucleotide; GTGGGT chr2 60452340 60452359 60452356 +
gactgattcactgttccaat

SEQ ID NO: 185882 - DNA, 20 bp, Artificial Sequence
  Synthetic oligonucleotide; CAGGAT chr2 60452483 60452502 60452499 +
cagaaaacatcacaaactag

SEQ ID NO: 185883 - DNA, 20 bp, Artificial Sequence
  Synthetic oligonucleotide; CTGGGT chr2 60452612 60452631 60452628 +
tgccacacatcttgagctct

SEQ ID NO: 185884 - DNA, 20 bp, Artificial Sequence
  Synthetic oligonucleotide; CCGAAT chr2 60452624 60452643 60452640 +
tgagctctctgggtactacg

SEQ ID NO: 185885 - DNA, 20 bp, Artificial Sequence
  Synthetic oligonucleotide; GGGGGT chr2 60452630 60452649 60452646 +
ctctgggtactacgccgaat

SEQ ID NO: 185886 - DNA, 20 bp, Artificial Sequence
  Synthetic oligonucleotide; CTGAGT chr2 60452829 60452848 60452845 +
tccccaagtatctctgacct

SEQ ID NO: 185887 - DNA, 20 bp, Artificial Sequence
  Synthetic oligonucleotide; AAGAGT chr2 60453187 60453206 60453203 +
aagagaaaaccagaacccaa

SEQ ID NO: 185888 - DNA, 20 bp, Artificial Sequence
  Synthetic oligonucleotide; GGGAGT chr2 60453290 60453309 60453306 +
ggcaatggtgaagggaagaa

SEQ ID NO: 185889 - DNA, 20 bp, Artificial Sequence
  Synthetic oligonucleotide; CGGGGT chr2 60453309 60453328 60453325 +
agggagtggttattttcctc

SEQ ID NO: 185890 - DNA, 20 bp, Artificial Sequence
  Synthetic oligonucleotide; GGGAGT chr2 60453355 60453374 60453371 +
tgacttgaagcagcagaact

SEQ ID NO: 185891 - DNA, 20 bp, Artificial Sequence
  Synthetic oligonucleotide; CCGGAT chr2 60453361 60453380 60453377 +
gaagcagcagaactgggagt

SEQ ID NO: 185892 - DNA, 20 bp, Artificial Sequence
  Synthetic oligonucleotide; CGGGGT chr2 60453475 60453494 60453491 +
acttggcgccgcaggaggcc

SEQ ID NO: 185893 - DNA, 20 bp, Artificial Sequence
  Synthetic oligonucleotide; CTGGAT chr2 60453481 60453500 60453497 +
cgccgcaggaggcccggggt

SEQ ID NO: 185894 - DNA, 20 bp, Artificial Sequence
  Synthetic oligonucleotide; GTGGGT chr2 60453560 60453579 60453576 +
gaggggcatgctgcgtccag

SEQ ID NO: 185895 - DNA, 20 bp, Artificial Sequence
  Synthetic oligonucleotide; GGGAAT chr2 60453570 60453589 60453586 +
ctgcgtccaggtgggttctg

SEQ ID NO: 185896 - DNA, 20 bp, Artificial Sequence
  Synthetic oligonucleotide; ATGGGT chr2 60453739 60453758 60453755 +
tttaaaagcacagcccccct

SEQ ID NO: 185897 - DNA, 20 bp, Artificial Sequence
  Synthetic oligonucleotide; GAGGAT chr2 60453763 60453782 60453779 +
gtttaggggctcccgcttta

SEQ ID NO: 185898 - DNA, 20 bp, Artificial Sequence
  Synthetic oligonucleotide; TTGGAT chr2 60453876 60453895 60453892 +
tacagaaaggaaaaacgtat

SEQ ID NO: 185899 - DNA, 20 bp, Artificial Sequence
  Synthetic oligonucleotide; CTGGAT chr2 60453940 60453959 60453956 +
agtacaatgacccgtgtgaa

SEQ ID NO: 185900 - DNA, 20 bp, Artificial Sequence
  Synthetic oligonucleotide; AGGAAT chr2 60453970 60453989 60453986 +
ctctttcccatttggaaggg

SEQ ID NO: 185901 - DNA, 20 bp, Artificial Sequence
  Synthetic oligonucleotide; CTGAGT chr2 60454066 60454085 60454082 +
cagccccattcccctaaagg

SEQ ID NO: 185902 - DNA, 20 bp, Artificial Sequence
  Synthetic oligonucleotide; TGGGAT chr2 60454115 60454134 60454131 +
taaattaaacagcgggctaa

SEQ ID NO: 185903 - DNA, 20 bp, Artificial Sequence
  Synthetic oligonucleotide; TAGAGT chr2 60454190 60454209 60454206 +
gttcatagctatagcagccc

SEQ ID NO: 185904 - DNA, 20 bp, Artificial Sequence
  Synthetic oligonucleotide; ATGGGT chr2 60454250 60454269 60454266 +
tgatgtccatttctctaaca

SEQ ID NO: 185905 - DNA, 20 bp, Artificial Sequence
  Synthetic oligonucleotide; GAGAAT chr2 60454454 60454473 60454470 +
gggaagttgtctgaaaaaaa

SEQ ID NO: 185906 - DNA, 20 bp, Artificial Sequence
  Synthetic oligonucleotide; TGGGAT chr2 60454459 60454478 60454475 +
gttgtctgaaaaaaagagaa

SEQ ID NO: 185907 - DNA, 20 bp, Artificial Sequence
  Synthetic oligonucleotide; ATGGGT chr2 60454463 60454482 60454479 +
tctgaaaaaaagagaatggg

SEQ ID NO: 185908 - DNA, 20 bp, Artificial Sequence
  Synthetic oligonucleotide; TGGAGT chr2 60454500 60454519 60454516 +
cacaccaggcccagggacaa

SEQ ID NO: 185909 - DNA, 20 bp, Artificial Sequence
  Synthetic oligonucleotide; CAGAAT chr2 60454508 60454527 60454524 +
gcccagggacaatggagtaa

SEQ ID NO: 185910 - DNA, 20 bp, Artificial Sequence
  Synthetic oligonucleotide; GAGGAT chr2 60454652 60454671 60454668 +
gcaaagtactacaagcagga

SEQ ID NO: 185911 - DNA, 20 bp, Artificial Sequence
  Synthetic oligonucleotide; GTGAAT chr2 60454731 60454750 60454747 +
cctttcagcaaactgtgtct

SEQ ID NO: 185912 - DNA, 20 bp, Artificial Sequence
  Synthetic oligonucleotide; TGGAAT chr2 60454766 60454785 60454782 +
catttccttatttctccaat

SEQ ID NO: 185913 - DNA, 20 bp, Artificial Sequence
  Synthetic oligonucleotide; CAGAAT chr2 60454892 60454911 60454908 +
aataaacagttctatatcta

SEQ ID NO: 185914 - DNA, 20 bp, Artificial Sequence
  Synthetic oligonucleotide; GAGGAT chr2 60455029 60455048 60455045 +
ttgtaggtcctaaacaaaga

SEQ ID NO: 185915 - DNA, 20 bp, Artificial Sequence
  Synthetic oligonucleotide; ATGGGT chr2 60455040 60455059 60455056 +
aaacaaagagaggatagcaa

SEQ ID NO: 185916 - DNA, 20 bp, Artificial Sequence
  Synthetic oligonucleotide; AAGAGT chr2 60455073 60455092 60455089 +
ggaggtaatataggcactgg

SEQ ID NO: 185917 - DNA, 20 bp, Artificial Sequence
  Synthetic oligonucleotide; TAGAAT chr2 60455103 60455122 60455119 +
ggtttaaaatctgtgagaaa

SEQ ID NO: 185918 - DNA, 20 bp, Artificial Sequence
  Synthetic oligonucleotide; GAGGAT chr2 60455231 60455250 60455247 +
cctgttacaaaaacttactt

SEQ ID NO: 185919 - DNA, 20 bp, Artificial Sequence
  Synthetic oligonucleotide; ATGAAT chr2 60455288 60455307 60455304 +
tcatttaaaaaaaaaagatc

SEQ ID NO: 185920 - DNA, 20 bp, Artificial Sequence
  Synthetic oligonucleotide; TAGAGT chr2 60455346 60455365 60455362 +
tatattaagattttaaattt

SEQ ID NO: 185921 - DNA, 20 bp, Artificial Sequence
  Synthetic oligonucleotide; CTGGAT chr2 60455353 60455372 60455369 +
agattttaaattttagagtt

SEQ ID NO: 185922 - DNA, 20 bp, Artificial Sequence
  Synthetic oligonucleotide; CAGGAT chr2 60455638 60455657 60455654 +
ccaccattaattctgtctgt

SEQ ID NO: 185923 - DNA, 20 bp, Artificial Sequence
  Synthetic oligonucleotide; ATGAAT chr2 60455689 60455708 60455705 +
gcatatactgagaaattaaa

SEQ ID NO: 185924 - DNA, 20 bp, Artificial Sequence
  Synthetic oligonucleotide; AAGAGT chr2 60455739 60455758 60455755 +
gcactcatagctcctaataa

SEQ ID NO: 185925 - DNA, 20 bp, Artificial Sequence
  Synthetic oligonucleotide; TAGGGT chr2 60455779 60455798 60455795 +
gaggttttatggacatttaa

SEQ ID NO: 185926 - DNA, 20 bp, Artificial Sequence
  Synthetic oligonucleotide; TGGAGT chr2 60455784 60455803 60455800 +
tttatggacatttaataggg

SEQ ID NO: 185927 - DNA, 20 bp, Artificial Sequence
  Synthetic oligonucleotide; GGGAAT chr2 60455824 60455843 60455840 +
ctaaagctggcatggcactg

SEQ ID NO: 185928 - DNA, 20 bp, Artificial Sequence
  Synthetic oligonucleotide; TTGGAT chr2 60455856 60455875 60455872 +
tatctgtcttgagcagcatt

SEQ ID NO: 185929 - DNA, 20 bp, Artificial Sequence
  Synthetic oligonucleotide; GTGGAT chr2 60455998 60456017 60456014 +
ttctccaacatcctttctca

SEQ ID NO: 185930 - DNA, 20 bp, Artificial Sequence
  Synthetic oligonucleotide; AAGGAT chr2 60456346 60456365 60456362 +
aagtgacaacacagatttct

SEQ ID NO: 185931 - DNA, 20 bp, Artificial Sequence
  Synthetic oligonucleotide; AAGGGT chr2 60456391 60456410 60456407 +
ggctggtcagaagataattg

SEQ ID NO: 185932 - DNA, 20 bp, Artificial Sequence
  Synthetic oligonucleotide; TAGGGT chr2 60456464 60456483 60456480 +
ctaaagtaatctgtagcatc

SEQ ID NO: 185933 - DNA, 20 bp, Artificial Sequence
  Synthetic oligonucleotide; TGGGAT chr2 60456473 60456492 60456489 +
tctgtagcatctagggttcc

SEQ ID NO: 185934 - DNA, 20 bp, Artificial Sequence
  Synthetic oligonucleotide; TGGGGT chr2 60456680 60456699 60456696 +
agatttttagatttcaaaag

SEQ ID NO: 185935 - DNA, 20 bp, Artificial Sequence
  Synthetic oligonucleotide; AAGGAT chr2 60456777 60456796 60456793 +
attatgttctaagataaagc

SEQ ID NO: 185936 - DNA, 20 bp, Artificial Sequence
  Synthetic oligonucleotide; GAGAAT chr2 60456785 60456804 60456801 +
ctaagataaagcaaggatgg

SEQ ID NO: 185937 - DNA, 20 bp, Artificial Sequence
  Synthetic oligonucleotide; TTGAAT chr2 60456882 60456901 60456898 +
gcaagttttttcacttatgt

SEQ ID NO: 185938 - DNA, 20 bp, Artificial Sequence
  Synthetic oligonucleotide; ATGGAT chr2 60456886 60456905 60456902 +
gttttttcacttatgtttga

SEQ ID NO: 185939 - DNA, 20 bp, Artificial Sequence
  Synthetic oligonucleotide; TGGAGT chr2 60456905 60456924 60456921 +
aatggatttctgctaagaga

SEQ ID NO: 185940 - DNA, 20 bp, Artificial Sequence
  Synthetic oligonucleotide; CAGGGT chr2 60456988 60457007 60457004 +
gaaagccttaaaactatgtc

SEQ ID NO: 185941 - DNA, 20 bp, Artificial Sequence
  Synthetic oligonucleotide; TAGGGT chr2 60457038 60457057 60457054 +
gtaagtactttatgttcctt

SEQ ID NO: 185942 - DNA, 20 bp, Artificial Sequence
  Synthetic oligonucleotide; CAGAAT chr2 60457057 60457076 60457073 +
ttagggtataatacacgcat

SEQ ID NO: 185943 - DNA, 20 bp, Artificial Sequence
  Synthetic oligonucleotide; CAGAGT chr2 60457136 60457155 60457152 +
attttcttgcaagtaattta

SEQ ID NO: 185944 - DNA, 20 bp, Artificial Sequence
  Synthetic oligonucleotide; ATGGGT chr2 60457214 60457233 60457230 +
tttttcaataaagggacaaa

SEQ ID NO: 185945 - DNA, 20 bp, Artificial Sequence
  Synthetic oligonucleotide; AGGAAT chr2 60457486 60457505 60457502 +
cgacaaacagctttcattac

SEQ ID NO: 185946 - DNA, 20 bp, Artificial Sequence
  Synthetic oligonucleotide; TGGAAT chr2 60457712 60457731 60457728 +
tgcatatgaaggtaagatgc

SEQ ID NO: 185947 - DNA, 20 bp, Artificial Sequence
  Synthetic oligonucleotide; TAGGGT chr2 60457719 60457738 60457735 +
gaaggtaagatgctggaatg

SEQ ID NO: 185948 - DNA, 20 bp, Artificial Sequence
  Synthetic oligonucleotide; AAGGAT chr2 60457822 60457841 60457838 +
agcaggaaaaaggaacaaaa

SEQ ID NO: 185949 - DNA, 20 bp, Artificial Sequence
  Synthetic oligonucleotide; AGGAAT chr2 60458184 60458203 60458200 +
ccataaatgtattttagcat

SEQ ID NO: 185950 - DNA, 20 bp, Artificial Sequence
  Synthetic oligonucleotide; ATGAGT chr2 60458194 60458213 60458210 +
attttagcataggaatcaac

SEQ ID NO: 185951 - DNA, 20 bp, Artificial Sequence
  Synthetic oligonucleotide; TAGAAT chr2 60458298 60458317 60458314 +
agcggtgtgtatccaaggca

SEQ ID NO: 185952 - DNA, 20 bp, Artificial Sequence
  Synthetic oligonucleotide; ATGGAT chr2 60458322 60458341 60458338 +
atttccactaccatttttaa

SEQ ID NO: 185953 - DNA, 20 bp, Artificial Sequence
  Synthetic oligonucleotide; CAGAGT chr2 60458784 60458803 60458800 +
aaagatacagatatcacagg

SEQ ID NO: 185954 - DNA, 20 bp, Artificial Sequence
  Synthetic oligonucleotide; ATGAAT chr2 60458869 60458888 60458885 +
aaaaaataaaaataaaaaca

SEQ ID NO: 185955 - DNA, 20 bp, Artificial Sequence
  Synthetic oligonucleotide; AAGAAT chr2 60458990 60459009 60459006 +
attctttctcttcttttttt

SEQ ID NO: 185956 - DNA, 20 bp, Artificial Sequence
  Synthetic oligonucleotide; AAGAAT chr2 60459018 60459037 60459034 +
cacatttaaatgcaagtctt

SEQ ID NO: 185957 - DNA, 20 bp, Artificial Sequence
  Synthetic oligonucleotide; CTGGAT chr2 60459228 60459247 60459244 +
cacttgacaaccaagtagat

SEQ ID NO: 185958 - DNA, 20 bp, Artificial Sequence
  Synthetic oligonucleotide; ATGGGT chr2 60459504 60459523 60459520 +
tgatgattaactaggacata

SEQ ID NO: 185959 - DNA, 20 bp, Artificial Sequence
  Synthetic oligonucleotide; TAGAAT chr2 60459548 60459567 60459564 +
ttgttgtgagaaatacaata

SEQ ID NO: 185960 - DNA, 20 bp, Artificial Sequence
  Synthetic oligonucleotide; CTGAAT chr2 60459592 60459611 60459608 +
gtttattacctcacccaatg

SEQ ID NO: 185961 - DNA, 20 bp, Artificial Sequence
  Synthetic oligonucleotide; TAGAAT chr2 60459682 60459701 60459698 +
catattttaaaaccaaatga

SEQ ID NO: 185962 - DNA, 20 bp, Artificial Sequence
  Synthetic oligonucleotide; GAGGGT chr2 60459823 60459842 60459839 +
tgctatctattctgtctata

SEQ ID NO: 185963 - DNA, 20 bp, Artificial Sequence
  Synthetic oligonucleotide; CAGAAT chr2 60459890 60459909 60459906 +
actgtacatgatatgtatta

SEQ ID NO: 185964 - DNA, 20 bp, Artificial Sequence
  Synthetic oligonucleotide; ACGAAT chr2 60459976 60459995 60459992 +
agcaacatgtttgctcagca

SEQ ID NO: 185965 - DNA, 20 bp, Artificial Sequence
  Synthetic oligonucleotide; GGGAGT chr2 60460298 60460317 60460314 +
gactagaaaaaaatcctaca

SEQ ID NO: 185966 - DNA, 20 bp, Artificial Sequence
  Synthetic oligonucleotide; GGGAGT chr2 60460327 60460346 60460343 +
gctggagggcgatggggaag

SEQ ID NO: 185967 - DNA, 20 bp, Artificial Sequence
  Synthetic oligonucleotide; GGGGGT chr2 60460342 60460361 60460358 +
ggaaggggagtggtgaaaaa

SEQ ID NO: 185968 - DNA, 20 bp, Artificial Sequence
  Synthetic oligonucleotide; GGGAGT chr2 60460355 60460374 60460371 +
tgaaaaagggggtgtcaggt

SEQ ID NO: 185969 - DNA, 20 bp, Artificial Sequence
  Synthetic oligonucleotide; AGGGGT chr2 60460366 60460385 60460382 +
gtgtcaggtgggagtgaggg

SEQ ID NO: 185970 - DNA, 20 bp, Artificial Sequence
  Synthetic oligonucleotide; CAGGGT chr2 60460447 60460466 60460463 +
cattttttcatgtgtttctc

SEQ ID NO: 185971 - DNA, 20 bp, Artificial Sequence
  Synthetic oligonucleotide; AGGAGT chr2 60460818 60460837 60460834 +
gcgcaaactcccgttctccg

SEQ ID NO: 185972 - DNA, 20 bp, Artificial Sequence
  Synthetic oligonucleotide; TGGAGT chr2 60460854 60460873 60460870 +
ggaggcaaaaggcgattgtc

SEQ ID NO: 185973 - DNA, 20 bp, Artificial Sequence
  Synthetic oligonucleotide; AGGGAT chr2 60460875 60460894 60460891 +
ggagtctccgaagctaagga

SEQ ID NO: 185974 - DNA, 20 bp, Artificial Sequence
  Synthetic oligonucleotide; GCGAGT chr2 60460920 60460939 60460936 +
cgcgtagccggcgagccact

SEQ ID NO: 185975 - DNA, 20 bp, Artificial Sequence
  Synthetic oligonucleotide; CCGAGT chr2 60461124 60461143 60461140 +
gcggtccgactcgccggcca

SEQ ID NO: 185976 - DNA, 20 bp, Artificial Sequence
  Synthetic oligonucleotide; CGGGAT chr2 60461452 60461471 60461468 +
tcctcctcgtccccgttctc

SEQ ID NO: 185977 - DNA, 20 bp, Artificial Sequence
  Synthetic oligonucleotide; TGGGGT chr2 60461463 60461482 60461479 +
cccgttctccgggatcaggt

SEQ ID NO: 185978 - DNA, 20 bp, Artificial Sequence
  Synthetic oligonucleotide; CCGGGT chr2 60461540 60461559 60461556 +
tgcccaccaagtcgctggtg

SEQ ID NO: 185979 - DNA, 20 bp, Artificial Sequence
  Synthetic oligonucleotide; CTGGGT chr2 60461644 60461663 60461660 +
tggcgcttcagcttgctggc

SEQ ID NO: 185980 - DNA, 20 bp, Artificial Sequence
  Synthetic oligonucleotide; GCGGAT chr2 60461795 60461814 60461811 +
ggggctgggagggaggaggg

SEQ ID NO: 185981 - DNA, 20 bp, Artificial Sequence
  Synthetic oligonucleotide; TGGAAT chr2 60461852 60461871 60461868 +
agggcggcttgctacctggc

SEQ ID NO: 185982 - DNA, 20 bp, Artificial Sequence
  Synthetic oligonucleotide; TTGGAT chr2 60461976 60461995 60461992 +
ggcgggaggctccatagcca

SEQ ID NO: 185983 - DNA, 20 bp, Artificial Sequence
  Synthetic oligonucleotide; TCGGGT chr2 60462009 60462028 60462025 +
cagcaccctgtcaaaggcac

SEQ ID NO: 185984 - DNA, 20 bp, Artificial Sequence
  Synthetic oligonucleotide; ATGGGT chr2 60462016 60462035 60462032 +
ctgtcaaaggcactcgggtg

SEQ ID NO: 185985 - DNA, 20 bp, Artificial Sequence
  Synthetic oligonucleotide; GGGGGT chr2 60462063 60462082 60462079 +
ccccaggcgctctatgcggt

SEQ ID NO: 185986 - DNA, 20 bp, Artificial Sequence
  Synthetic oligonucleotide; GGGAGT chr2 60462103 60462122 60462119 +
ggtggtggactaaacagggg

SEQ ID NO: 185987 - DNA, 20 bp, Artificial Sequence
  Synthetic oligonucleotide; GTGGGT chr2 60462107 60462126 60462123 +
gtggactaaacaggggggga

SEQ ID NO: 185988 - DNA, 20 bp, Artificial Sequence
  Synthetic oligonucleotide; AGGGGT chr2 60462180 60462199 60462196 +
tggtattcttagcaggttaa

SEQ ID NO: 185989 - DNA, 20 bp, Artificial Sequence
  Synthetic oligonucleotide; ATGAAT chr2 60462199 60462218 60462215 +
aaggggttattgtctgcaat

SEQ ID NO: 185990 - DNA, 20 bp, Artificial Sequence
  Synthetic oligonucleotide; AGGGAT chr2 60462250 60462269 60462266 +
cattctgcacctagtcctga

SEQ ID NO: 185991 - DNA, 20 bp, Artificial Sequence
  Synthetic oligonucleotide; CGGGGT chr2 60462265 60462284 60462281 +
cctgaagggataccaacccg

SEQ ID NO: 185992 - DNA, 20 bp, Artificial Sequence
  Synthetic oligonucleotide; ATGAGT chr2 60462313 60462332 60462329 +
tctaagtagattcttaatcc

SEQ ID NO: 185993 - DNA, 20 bp, Artificial Sequence
  Synthetic oligonucleotide; GTGAAT chr2 60462353 60462372 60462369 +
gcaagagaaaccatgcactg

SEQ ID NO: 185994 - DNA, 20 bp, Artificial Sequence
  Synthetic oligonucleotide; ATGGGT chr2 60462563 60462582 60462579 +
tgtgcctggcacgtctgagc

SEQ ID NO: 185995 - DNA, 20 bp, Artificial Sequence
  Synthetic oligonucleotide; GAGGAT chr2 60462672 60462691 60462688 +
atcctgaccagttctggctt

SEQ ID NO: 185996 - DNA, 20 bp, Artificial Sequence
  Synthetic oligonucleotide; CTGGGT chr2 60462863 60462882 60462879 +
tcccagctttctattccccc

SEQ ID NO: 185997 - DNA, 20 bp, Artificial Sequence
  Synthetic oligonucleotide; GAGGGT chr2 60463014 60463033 60463030 +
tgttgatattgttaaaatga

SEQ ID NO: 185998 - DNA, 20 bp, Artificial Sequence
  Synthetic oligonucleotide; GAGGAT chr2 60463079 60463098 60463095 +
tctcacaccccagactgtgg

SEQ ID NO: 185999 - DNA, 20 bp, Artificial Sequence
  Synthetic oligonucleotide; GTGAGT chr2 60463087 60463106 60463103 +
cccagactgtgggaggatca

SEQ ID NO: 186000 - DNA, 20 bp, Artificial Sequence
  Synthetic oligonucleotide; AAGAAT chr2 60463142 60463161 60463158 +
ggacgtccatttttatctca

SEQ ID NO: 186001 - DNA, 20 bp, Artificial Sequence
  Synthetic oligonucleotide; ACGGAT chr2 60463186 60463205 60463202 +
aaaaacttcattcagattta

SEQ ID NO: 186002 - DNA, 20 bp, Artificial Sequence
  Synthetic oligonucleotide; AGGAGT chr2 60463210 60463229 60463226 +
ataggctgtatccaatcttt

SEQ ID NO: 186003 - DNA, 20 bp, Artificial Sequence
  Synthetic oligonucleotide; AGGAGT chr2 60463256 60463275 60463272 +
gcaagtctggaaaagttagg

SEQ ID NO: 186004 - DNA, 20 bp, Artificial Sequence
  Synthetic oligonucleotide; AAGAGT chr2 60463555 60463574 60463571 +
tcccttgctgaaaagaaccc

SEQ ID NO: 186005 - DNA, 20 bp, Artificial Sequence
  Synthetic oligonucleotide; TGGAAT chr2 60463676 60463695 60463692 +
acattaaatatatatatata

SEQ ID NO: 186006 - DNA, 20 bp, Artificial Sequence
  Synthetic oligonucleotide; GAGGAT chr2 60463749 60463768 60463765 +
agtaatggtagccaaaggac

SEQ ID NO: 186007 - DNA, 20 bp, Artificial Sequence
  Synthetic oligonucleotide; AAGAGT chr2 60463852 60463871 60463868 +
tcttttaaaagaagggctgc

SEQ ID NO: 186008 - DNA, 20 bp, Artificial Sequence
  Synthetic oligonucleotide; AAGAGT chr2 60463932 60463951 60463948 +
aaaaatctaccagggaggtt

SEQ ID NO: 186009 - DNA, 20 bp, Artificial Sequence
  Synthetic oligonucleotide; GAGAAT chr2 60463938 60463957 60463954 +
ctaccagggaggttaagagt

SEQ ID NO: 186010 - DNA, 20 bp, Artificial Sequence
  Synthetic oligonucleotide; AGGAAT chr2 60463945 60463964 60463961 +
ggaggttaagagtgagaatg

SEQ ID NO: 186011 - DNA, 20 bp, Artificial Sequence
  Synthetic oligonucleotide; CAGGGT chr2 60464000 60464019 60464016 +
aagtcagaaagaaaagccgg

SEQ ID NO: 186012 - DNA, 20 bp, Artificial Sequence
  Synthetic oligonucleotide; CTGGGT chr2 60464144 60464163 60464160 +
ccactcaatatatctcactc

SEQ ID NO: 186013 - DNA, 20 bp, Artificial Sequence
  Synthetic oligonucleotide; TTGGGT chr2 60464369 60464388 60464385 +
tgttgttgttgaacaataac

SEQ ID NO: 186014 - DNA, 20 bp, Artificial Sequence
  Synthetic oligonucleotide; CTGGGT chr2 60464454 60464473 60464470 +
tccttgtcctccctagatct

SEQ ID NO: 186015 - DNA, 20 bp, Artificial Sequence
  Synthetic oligonucleotide; CTGAGT chr2 60464488 60464507 60464504 +
ttcctatttagcctgacgat

SEQ ID NO: 186016 - DNA, 20 bp, Artificial Sequence
  Synthetic oligonucleotide; ATGAAT chr2 60464640 60464659 60464656 +
gtgctggtttcacatgtgcc

SEQ ID NO: 186017 - DNA, 20 bp, Artificial Sequence
  Synthetic oligonucleotide; AAGGAT chr2 60464693 60464712 60464709 +
gtggcatacagcactacatc

SEQ ID NO: 186018 - DNA, 20 bp, Artificial Sequence
  Synthetic oligonucleotide; TGGAAT chr2 60465245 60465264 60465261 +
ctttgatgatttagaaagac

SEQ ID NO: 186019 - DNA, 20 bp, Artificial Sequence
  Synthetic oligonucleotide; GGGGAT chr2 60465373 60465392 60465389 +
gagcctcattgggcatttac

SEQ ID NO: 186020 - DNA, 20 bp, Artificial Sequence
  Synthetic oligonucleotide; AAGGGT chr2 60465441 60465460 60465457 +
ataggaacttgagacatcaa

SEQ ID NO: 186021 - DNA, 20 bp, Artificial Sequence
  Synthetic oligonucleotide; AGGAAT chr2 60465506 60465525 60465522 +
tttcattttactttatggga

SEQ ID NO: 186022 - DNA, 20 bp, Artificial Sequence
  Synthetic oligonucleotide; TGGGAT chr2 60465633 60465652 60465649 +
tatccactagattgtaactc

SEQ ID NO: 186023 - DNA, 20 bp, Artificial Sequence
  Synthetic oligonucleotide; CTGAGT chr2 60465654 60465673 60465670 +
gggatagtcatttgatttct

SEQ ID NO: 186024 - DNA, 20 bp, Artificial Sequence
  Synthetic oligonucleotide; TGGAAT chr2 60465662 60465681 60465678 +
catttgatttctctgagtct

SEQ ID NO: 186025 - DNA, 20 bp, Artificial Sequence
  Synthetic oligonucleotide; AAGAAT chr2 60465704 60465723 60465720 +
agcataaaaacagtacctgt

SEQ ID NO: 186026 - DNA, 20 bp, Artificial Sequence
  Synthetic oligonucleotide; TCGAAT chr2 60465764 60465783 60465780 +
gccctctgtaaactatcagg

SEQ ID NO: 186027 - DNA, 20 bp, Artificial Sequence
  Synthetic oligonucleotide; GTGAAT chr2 60465770 60465789 60465786 +
tgtaaactatcaggtcgaat

SEQ ID NO: 186028 - DNA, 20 bp, Artificial Sequence
  Synthetic oligonucleotide; GTGAGT chr2 60465776 60465795 60465792 +
ctatcaggtcgaatgtgaat

SEQ ID NO: 186029 - DNA, 20 bp, Artificial Sequence
  Synthetic oligonucleotide; AGGGGT chr2 60465795 60465814 60465811 +
tgtgagttttcattactacc

SEQ ID NO: 186030 - DNA, 20 bp, Artificial Sequence
  Synthetic oligonucleotide; GAGGGT chr2 60465812 60465831 60465828 +
accaggggtgattaattact

SEQ ID NO: 186031 - DNA, 20 bp, Artificial Sequence
  Synthetic oligonucleotide; AGGGGT chr2 60465913 60465932 60465929 +
ggaggctctagttaaagagc

SEQ ID NO: 186032 - DNA, 20 bp, Artificial Sequence
  Synthetic oligonucleotide; CAGAGT chr2 60465932 60465951 60465948 +
caggggtgactggcacacag

SEQ ID NO: 186033 - DNA, 20 bp, Artificial Sequence
  Synthetic oligonucleotide; TGGAAT chr2 60465997 60466016 60466013 +
agcaggttaatgccgccaag

SEQ ID NO: 186034 - DNA, 20 bp, Artificial Sequence
  Synthetic oligonucleotide; AGGGGT chr2 60466145 60466164 60466161 +
gtgggaaggtgggagaggac

SEQ ID NO: 186035 - DNA, 20 bp, Artificial Sequence
  Synthetic oligonucleotide; TAGGAT chr2 60466564 60466583 60466580 +
cacaataactctttgttacc

SEQ ID NO: 186036 - DNA, 20 bp, Artificial Sequence
  Synthetic oligonucleotide; AGGAGT chr2 60466575 60466594 60466591 +
tttgttacctaggattacct

SEQ ID NO: 186037 - DNA, 20 bp, Artificial Sequence
  Synthetic oligonucleotide; TTGAAT chr2 60466603 60466622 60466619 +
acaaaaataaacaactggct

SEQ ID NO: 186038 - DNA, 20 bp, Artificial Sequence
  Synthetic oligonucleotide; CAGGGT chr2 60466616 60466635 60466632 +
actggctttgaatctggtct

SEQ ID NO: 186039 - DNA, 20 bp, Artificial Sequence
  Synthetic oligonucleotide; ATGGGT chr2 60466654 60466673 60466670 +
cttcagataccatttacaag

SEQ ID NO: 186040 - DNA, 20 bp, Artificial Sequence
  Synthetic oligonucleotide; TAGGGT chr2 60466855 60466874 60466871 +
tgaacctgcttttttgtgtt

SEQ ID NO: 186041 - DNA, 20 bp, Artificial Sequence
  Synthetic oligonucleotide; TGGAAT chr2 60466860 60466879 60466876 +
ctgcttttttgtgtttaggg

SEQ ID NO: 186042 - DNA, 20 bp, Artificial Sequence
  Synthetic oligonucleotide; ATGAAT chr2 60468223 60468242 60468239 +
agtcaaaattatgtgtgggc

SEQ ID NO: 186043 - DNA, 20 bp, Artificial Sequence
  Synthetic oligonucleotide; AGGAAT chr2 60468270 60468289 60468286 +
aatacacatgtaaatacata

SEQ ID NO: 186044 - DNA, 20 bp, Artificial Sequence
  Synthetic oligonucleotide; TGGAAT chr2 60468282 60468301 60468298 +
aatacataaggaatatgcat

SEQ ID NO: 186045 - DNA, 20 bp, Artificial Sequence
  Synthetic oligonucleotide; TGGAAT chr2 60468293 60468312 60468309 +
aatatgcattggaataactc

SEQ ID NO: 186046 - DNA, 20 bp, Artificial Sequence
  Synthetic oligonucleotide; AGGAGT chr2 60468382 60468401 60468398 +
aaagtcctaaatgaggccac

SEQ ID NO: 186047 - DNA, 20 bp, Artificial Sequence
  Synthetic oligonucleotide; GTGAAT chr2 60468386 60468405 60468402 +
tcctaaatgaggccacagga

SEQ ID NO: 186048 - DNA, 20 bp, Artificial Sequence
  Synthetic oligonucleotide; AGGGAT chr2 60468478 60468497 60468494 +
accctggggagaagacccac

SEQ ID NO: 186049 - DNA, 20 bp, Artificial Sequence
  Synthetic oligonucleotide; CTGAGT chr2 60468550 60468569 60468566 +
gggaagaagtccctctgggg

SEQ ID NO: 186050 - DNA, 20 bp, Artificial Sequence
  Synthetic oligonucleotide; TGGAGT chr2 60468555 60468574 60468571 +
gaagtccctctggggctgag

SEQ ID NO: 186051 - DNA, 20 bp, Artificial Sequence
  Synthetic oligonucleotide; GTGAGT chr2 60468577 60468596 60468593 +
gagtggggagcggctgccaa

SEQ ID NO: 186052 - DNA, 20 bp, Artificial Sequence
  Synthetic oligonucleotide; TGGAAT chr2 60468585 60468604 60468601 +
agcggctgccaagtgagtaa

SEQ ID NO: 186053 - DNA, 20 bp, Artificial Sequence
  Synthetic oligonucleotide; GGGGAT chr2 60468752 60468771 60468768 +
tctgcactcatcccaggcgt

SEQ ID NO: 186054 - DNA, 20 bp, Artificial Sequence
  Synthetic oligonucleotide; CAGGAT chr2 60468872 60468891 60468888 +
acaacgtgcatcataaacca

SEQ ID NO: 186055 - DNA, 20 bp, Artificial Sequence
  Synthetic oligonucleotide; AAGAGT chr2 60468965 60468984 60468981 +
cccaaggcctgaaacaaaag

SEQ ID NO: 186056 - DNA, 20 bp, Artificial Sequence
  Synthetic oligonucleotide; GTGAGT chr2 60468972 60468991 60468988 +
cctgaaacaaaagaagagtg

SEQ ID NO: 186057 - DNA, 20 bp, Artificial Sequence
  Synthetic oligonucleotide; CAGAGT chr2 60468985 60469004 60469001 +
aagagtggtgagttatttcc

SEQ ID NO: 186058 - DNA, 20 bp, Artificial Sequence
  Synthetic oligonucleotide; AAGGGT chr2 60469032 60469051 60469048 +
ggtctttttgacaaaagtga

SEQ ID NO: 186059 - DNA, 20 bp, Artificial Sequence
  Synthetic oligonucleotide; GTGGGT chr2 60469156 60469175 60469172 +
aggggaaaactggtaatatt

SEQ ID NO: 186060 - DNA, 20 bp, Artificial Sequence
  Synthetic oligonucleotide; GGGGAT chr2 60469177 60469196 60469193 +
tgggtagcctggaaacatgg

SEQ ID NO: 186061 - DNA, 20 bp, Artificial Sequence
  Synthetic oligonucleotide; ATGAGT chr2 60469266 60469285 60469282 +
aagcaaaatgctgataggaa

SEQ ID NO: 186062 - DNA, 20 bp, Artificial Sequence
  Synthetic oligonucleotide; GTGAAT chr2 60469278 60469297 60469294 +
gataggaaatgagtagattt

SEQ ID NO: 186063 - DNA, 20 bp, Artificial Sequence
  Synthetic oligonucleotide; CAGAGT chr2 60469298 60469317 60469314 +
gtgaatcgttttttatggga

SEQ ID NO: 186064 - DNA, 20 bp, Artificial Sequence
  Synthetic oligonucleotide; TAGAAT chr2 60469416 60469435 60469432 +
gactgagctgggccatactc

SEQ ID NO: 186065 - DNA, 20 bp, Artificial Sequence
  Synthetic oligonucleotide; TGGGGT chr2 60469495 60469514 60469511 +
gaagataaagattagacttc

SEQ ID NO: 186066 - DNA, 20 bp, Artificial Sequence
  Synthetic oligonucleotide; ATGAAT chr2 60469643 60469662 60469659 +
tgacttctcacactaataaa

SEQ ID NO: 186067 - DNA, 20 bp, Artificial Sequence
  Synthetic oligonucleotide; GGGGAT chr2 60469719 60469738 60469735 +
aaatttggtttgtgcaatct

SEQ ID NO: 186068 - DNA, 20 bp, Artificial Sequence
  Synthetic oligonucleotide; GAGGAT chr2 60469811 60469830 60469827 +
gtccatcttgagacagactg

SEQ ID NO: 186069 - DNA, 20 bp, Artificial Sequence
  Synthetic oligonucleotide; TGGAGT chr2 60469854 60469873 60469870 +
ctctgtgtgttctagaggtt

SEQ ID NO: 186070 - DNA, 20 bp, Artificial Sequence
  Synthetic oligonucleotide; TAGGAT chr2 60469974 60469993 60469990 +
gaagtgttgttgttgtactc

SEQ ID NO: 186071 - DNA, 20 bp, Artificial Sequence
  Synthetic oligonucleotide; GTGGGT chr2 60470083 60470102 60470099 +
ttcctttcgcaaggagcctg

SEQ ID NO: 186072 - DNA, 20 bp, Artificial Sequence
  Synthetic oligonucleotide; GTGAAT chr2 60470316 60470335 60470332 +
catttgactgtttacgtcaa

SEQ ID NO: 186073 - DNA, 20 bp, Artificial Sequence
  Synthetic oligonucleotide; GAGAGT chr2 60470323 60470342 60470339 +
ctgtttacgtcaagtgaatt

SEQ ID NO: 186074 - DNA, 20 bp, Artificial Sequence
  Synthetic oligonucleotide; GAGAAT chr2 60470381 60470400 60470397 +
tatttttcaatgagaaatct

SEQ ID NO: 186075 - DNA, 20 bp, Artificial Sequence
  Synthetic oligonucleotide; TTGGAT chr2 60470511 60470530 60470527 +
agcataaacgcaacaggtac

SEQ ID NO: 186076 - DNA, 20 bp, Artificial Sequence
  Synthetic oligonucleotide; GGGAGT chr2 60470526 60470545 60470542 +
ggtacttggatccttgtatg

SEQ ID NO: 186077 - DNA, 20 bp, Artificial Sequence
  Synthetic oligonucleotide; ATGAAT chr2 60470645 60470664 60470661 +
atccatgcctagcccctcgc

SEQ ID NO: 186078 - DNA, 20 bp, Artificial Sequence
  Synthetic oligonucleotide; TAGAAT chr2 60470932 60470951 60470948 +
attaaccacaatgtgaagat

SEQ ID NO: 186079 - DNA, 20 bp, Artificial Sequence
  Synthetic oligonucleotide; GGGAAT chr2 60470972 60470991 60470988 +
ctgatccagtggtctttcct

SEQ ID NO: 186080 - DNA, 20 bp, Artificial Sequence
  Synthetic oligonucleotide; GAGGGT chr2 60471077 60471096 60471093 +
agtacttaaccgtcttgggg

SEQ ID NO: 186081 - DNA, 20 bp, Artificial Sequence
  Synthetic oligonucleotide; CAGAAT chr2 60471226 60471245 60471242 +
ctctacctctgcttcccctg

SEQ ID NO: 186082 - DNA, 20 bp, Artificial Sequence
  Synthetic oligonucleotide; GAGGGT chr2 60471336 60471355 60471352 +
catttatcttccttcaggaa

SEQ ID NO: 186083 - DNA, 20 bp, Artificial Sequence
  Synthetic oligonucleotide; GTGGGT chr2 60471697 60471716 60471713 +
ctctggttgctggctaggaa

SEQ ID NO: 186084 - DNA, 20 bp, Artificial Sequence
  Synthetic oligonucleotide; GGGAGT chr2 60471797 60471816 60471813 +
acccccgatcagcatcacct

SEQ ID NO: 186085 - DNA, 20 bp, Artificial Sequence
  Synthetic oligonucleotide; CTGAAT chr2 60471843 60471862 60471859 +
tgggcaccacctcagactta

SEQ ID NO: 186086 - DNA, 20 bp, Artificial Sequence
  Synthetic oligonucleotide; GAGGGT chr2 60471857 60471876 60471873 +
gacttactgaatcagaaatt

SEQ ID NO: 186087 - DNA, 20 bp, Artificial Sequence
  Synthetic oligonucleotide; TTGAAT chr2 60471882 60471901 60471898 +
tggggaagcagccttctatg

SEQ ID NO: 186088 - DNA, 20 bp, Artificial Sequence
  Synthetic oligonucleotide; CTGAAT chr2 60471921 60471940 60471937 +
gattctcatgcacactcaag

SEQ ID NO: 186089 - DNA, 20 bp, Artificial Sequence
  Synthetic oligonucleotide; TAGGGT chr2 60471941 60471960 60471957 +
ctgaatcagcactgctgtct

SEQ ID NO: 186090 - DNA, 20 bp, Artificial Sequence
  Synthetic oligonucleotide; GGGAAT chr2 60472076 60472095 60472092 +
tcaaaaacaaattaagctta

SEQ ID NO: 186091 - DNA, 20 bp, Artificial Sequence
  Synthetic oligonucleotide; AAGGAT chr2 60472086 60472105 60472102 +
attaagcttagggaatccct

SEQ ID NO: 186092 - DNA, 20 bp, Artificial Sequence
  Synthetic oligonucleotide; CTGAAT chr2 60472503 60472522 60472519 +
gttgcaaagtttccttatgg

SEQ ID NO: 186093 - DNA, 20 bp, Artificial Sequence
  Synthetic oligonucleotide; GGGAAT chr2 60472563 60472582 60472579 +
taaaaaatatgcagcaaact

SEQ ID NO: 186094 - DNA, 20 bp, Artificial Sequence
  Synthetic oligonucleotide; TTGGGT chr2 60472618 60472637 60472634 +
actttacatttctacatata

SEQ ID NO: 186095 - DNA, 20 bp, Artificial Sequence
  Synthetic oligonucleotide; TGGGAT chr2 60472655 60472674 60472671 +
acaaagagctctaagcccag

SEQ ID NO: 186096 - DNA, 20 bp, Artificial Sequence
  Synthetic oligonucleotide; TGGAAT chr2 60472666 60472685 60472682 +
taagcccagtgggatgttcc

SEQ ID NO: 186097 - DNA, 20 bp, Artificial Sequence
  Synthetic oligonucleotide; CTGGGT chr2 60472763 60472782 60472779 +
tttgtttctgaaactaatca

SEQ ID NO: 186098 - DNA, 20 bp, Artificial Sequence
  Synthetic oligonucleotide; AGGAGT chr2 60472926 60472945 60472942 +
aaaaccacaggactctccac

SEQ ID NO: 186099 - DNA, 20 bp, Artificial Sequence
  Synthetic oligonucleotide; GTGAGT chr2 60473140 60473159 60473156 +
gtgttcatgtgtgtgtatat

SEQ ID NO: 186100 - DNA, 20 bp, Artificial Sequence
  Synthetic oligonucleotide; GTGAAT chr2 60473172 60473191 60473188 +
atatgtgtctgtgtacgtgt

SEQ ID NO: 186101 - DNA, 20 bp, Artificial Sequence
  Synthetic oligonucleotide; TGGAAT chr2 60473274 60473293 60473290 +
agcagtagagctgtcccacg

SEQ ID NO: 186102 - DNA, 20 bp, Artificial Sequence
  Synthetic oligonucleotide; CTGGGT chr2 60473318 60473337 60473334 +
gtgaccccctttctttcacc

SEQ ID NO: 186103 - DNA, 20 bp, Artificial Sequence
  Synthetic oligonucleotide; GAGAAT chr2 60473333 60473352 60473349 +
tcaccctgggtcttcaaaaa

SEQ ID NO: 186104 - DNA, 20 bp, Artificial Sequence
  Synthetic oligonucleotide; ATGGAT chr2 60473337 60473356 60473353 +
cctgggtcttcaaaaagaga

SEQ ID NO: 186105 - DNA, 20 bp, Artificial Sequence
  Synthetic oligonucleotide; AGGGGT chr2 60473358 60473377 60473374 +
tggatgacactatgatgagg

SEQ ID NO: 186106 - DNA, 20 bp, Artificial Sequence
  Synthetic oligonucleotide; CTGAAT chr2 60473522 60473541 60473538 +
tgaaggaacccattccagtt

SEQ ID NO: 186107 - DNA, 20 bp, Artificial Sequence
  Synthetic oligonucleotide; CAGAGT chr2 60473696 60473715 60473712 +
acttagattctctgacttat

SEQ ID NO: 186108 - DNA, 20 bp, Artificial Sequence
  Synthetic oligonucleotide; TTGAGT chr2 60473734 60473753 60473750 +
acattagctatgcctgtgac

SEQ ID NO: 186109 - DNA, 20 bp, Artificial Sequence
  Synthetic oligonucleotide; TAGAAT chr2 60473971 60473990 60473987 +
taattatagacactacaata

SEQ ID NO: 186110 - DNA, 20 bp, Artificial Sequence
  Synthetic oligonucleotide; AAGAGT chr2 60474132 60474151 60474148 +
ggttactaacttcacctttt

SEQ ID NO: 186111 - DNA, 20 bp, Artificial Sequence
  Synthetic oligonucleotide; TTGAAT chr2 60474404 60474423 60474420 +
aaatccttcatttcaaaagg

SEQ ID NO: 186112 - DNA, 20 bp, Artificial Sequence
  Synthetic oligonucleotide; TAGGAT chr2 60474409 60474428 60474425 +
cttcatttcaaaaggttgaa

SEQ ID NO: 186113 - DNA, 20 bp, Artificial Sequence
  Synthetic oligonucleotide; AAGAAT chr2 60474427 60474446 60474443 +
aataggatggtacttaaaaa

SEQ ID NO: 186114 - DNA, 20 bp, Artificial Sequence
  Synthetic oligonucleotide; TAGGGT chr2 60474449 60474468 60474465 +
gaattccagctggttaaatt

SEQ ID NO: 186115 - DNA, 20 bp, Artificial Sequence
  Synthetic oligonucleotide; GTGAAT chr2 60474518 60474537 60474534 +
caaagtattttcacttgatc

SEQ ID NO: 186116 - DNA, 20 bp, Artificial Sequence
  Synthetic oligonucleotide; TAGAAT chr2 60474559 60474578 60474575 +
tacactttaagcttttgcct

SEQ ID NO: 186117 - DNA, 20 bp, Artificial Sequence
  Synthetic oligonucleotide; CAGGAT chr2 60474679 60474698 60474695 +
ctatgcaaaatgtgtgttcc

SEQ ID NO: 186118 - DNA, 20 bp, Artificial Sequence
  Synthetic oligonucleotide; CCGAGT chr2 60474752 60474771 60474768 +
attcattcaacaaatattta

SEQ ID NO: 186119 - DNA, 20 bp, Artificial Sequence
  Synthetic oligonucleotide; ATGAGT chr2 60475002 60475021 60475018 +
tttgggaaagaggaaaactt

SEQ ID NO: 186120 - DNA, 20 bp, Artificial Sequence
  Synthetic oligonucleotide; AAGGAT chr2 60475029 60475048 60475045 +
aaacctggagagccaagaga

SEQ ID NO: 186121 - DNA, 20 bp, Artificial Sequence
  Synthetic oligonucleotide; CAGAGT chr2 60475098 60475117 60475114 +
agcaaagcccaaggtgggca

SEQ ID NO: 186122 - DNA, 20 bp, Artificial Sequence
  Synthetic oligonucleotide; GAGGAT chr2 60475172 60475191 60475188 +
gattcatccagttgacagcg

SEQ ID NO: 186123 - DNA, 20 bp, Artificial Sequence
  Synthetic oligonucleotide; ATGAAT chr2 60475354 60475373 60475370 +
ctcaattgtttcttccccca

SEQ ID NO: 186124 - DNA, 20 bp, Artificial Sequence
  Synthetic oligonucleotide; GTGGGT chr2 60475360 60475379 60475376 +
tgtttcttcccccaatgaat

SEQ ID NO: 186125 - DNA, 20 bp, Artificial Sequence
  Synthetic oligonucleotide; CTGAGT chr2 60475402 60475421 60475418 +
atttactatgttttattcct

SEQ ID NO: 186126 - DNA, 20 bp, Artificial Sequence
  Synthetic oligonucleotide; GAGGAT chr2 60475642 60475661 60475658 +
cttcttttcaaagccatggg

SEQ ID NO: 186127 - DNA, 20 bp, Artificial Sequence
  Synthetic oligonucleotide; AGGGGT chr2 60475648 60475667 60475664 +
ttcaaagccatggggaggat

SEQ ID NO: 186128 - DNA, 20 bp, Artificial Sequence
  Synthetic oligonucleotide; CTGAGT chr2 60475669 60475688 60475685 +
ggggtgcccttactcctgct

SEQ ID NO: 186129 - DNA, 20 bp, Artificial Sequence
  Synthetic oligonucleotide; GAGGAT chr2 60475683 60475702 60475699 +
cctgctctgagtcctcagct

SEQ ID NO: 186130 - DNA, 20 bp, Artificial Sequence
  Synthetic oligonucleotide; AGGGGT chr2 60475717 60475736 60475733 +
tgtgtagtgggggcaggggg

SEQ ID NO: 186131 - DNA, 20 bp, Artificial Sequence
  Synthetic oligonucleotide; CCGGAT chr2 60475816 60475835 60475832 +
attcccactgccaccactcc

SEQ ID NO: 186132 - DNA, 20 bp, Artificial Sequence
  Synthetic oligonucleotide; TTGAAT chr2 60475936 60475955 60475952 +
tcaccagctgtttcgtgact

SEQ ID NO: 186133 - DNA, 20 bp, Artificial Sequence
  Synthetic oligonucleotide; CTGGAT chr2 60475991 60476010 60476007 +
ccatctttaaaaggagaaga

SEQ ID NO: 186134 - DNA, 20 bp, Artificial Sequence
  Synthetic oligonucleotide; TGGGGT chr2 60476001 60476020 60476017 +
aaggagaagactggattaga

SEQ ID NO: 186135 - DNA, 20 bp, Artificial Sequence
  Synthetic oligonucleotide; CAGGAT chr2 60476092 60476111 60476108 +
aggccgtgctagaagctggc

SEQ ID NO: 186136 - DNA, 20 bp, Artificial Sequence
  Synthetic oligonucleotide; CTGGAT chr2 60476124 60476143 60476140 +
gttcccctcatgaccttgac

SEQ ID NO: 186137 - DNA, 20 bp, Artificial Sequence
  Synthetic oligonucleotide; GAGAGT chr2 60476146 60476165 60476162 +
ggatgaggagggccttatag

SEQ ID NO: 186138 - DNA, 20 bp, Artificial Sequence
  Synthetic oligonucleotide; GAGAGT chr2 60476192 60476211 60476208 +
caggctaatccttaggctta

SEQ ID NO: 186139 - DNA, 20 bp, Artificial Sequence
  Synthetic oligonucleotide; ATGGAT chr2 60476208 60476227 60476224 +
cttagagagtgagcctgatg

SEQ ID NO: 186140 - DNA, 20 bp, Artificial Sequence
  Synthetic oligonucleotide; GGGAGT chr2 60476459 60476478 60476475 +
cacacaggactctaagaaaa

SEQ ID NO: 186141 - DNA, 20 bp, Artificial Sequence
  Synthetic oligonucleotide; GAGGGT chr2 60476547 60476566 60476563 +
caccacaccccatcagcatg

SEQ ID NO: 186142 - DNA, 20 bp, Artificial Sequence
  Synthetic oligonucleotide; ATGAAT chr2 60476574 60476593 60476590 +
cttggaaagccatgtgtaaa

SEQ ID NO: 186143 - DNA, 20 bp, Artificial Sequence
  Synthetic oligonucleotide; CCGAAT chr2 60476982 60477001 60476998 +
cctgaacatatttctgtcac

SEQ ID NO: 186144 - DNA, 20 bp, Artificial Sequence
  Synthetic oligonucleotide; AAGGAT chr2 60477056 60477075 60477072 +
cccactcgagaaatgaagaa

SEQ ID NO: 186145 - DNA, 20 bp, Artificial Sequence
  Synthetic oligonucleotide; ATGGAT chr2 60477199 60477218 60477215 +
agaggcatggggctgtgaag

SEQ ID NO: 186146 - DNA, 20 bp, Artificial Sequence
  Synthetic oligonucleotide; GAGAAT chr2 60477210 60477229 60477226 +
gctgtgaagatggatgcgat

SEQ ID NO: 186147 - DNA, 20 bp, Artificial Sequence
  Synthetic oligonucleotide; TAGAAT chr2 60477405 60477424 60477421 +
gatcggtcttgagaaaatac

SEQ ID NO: 186148 - DNA, 20 bp, Artificial Sequence
  Synthetic oligonucleotide; ATGGGT chr2 60477430 60477449 60477446 +
taagctaaagaaaaccaaac

SEQ ID NO: 186149 - DNA, 20 bp, Artificial Sequence
  Synthetic oligonucleotide; AGGGAT chr2 60477450 60477469 60477466 +
atgggtggaggggcaagggg

SEQ ID NO: 186150 - DNA, 20 bp, Artificial Sequence
  Synthetic oligonucleotide; ATGGGT chr2 60477485 60477504 60477501 +
agaaatgcctaatgtagatg

SEQ ID NO: 186151 - DNA, 20 bp, Artificial Sequence
  Synthetic oligonucleotide; TAGAGT chr2 60477570 60477589 60477586 +
tgcacatgtatcccagaact

SEQ ID NO: 186152 - DNA, 20 bp, Artificial Sequence
  Synthetic oligonucleotide; GGGAGT chr2 60477694 60477713 60477710 +
agtggtgctgtgagagacaa

SEQ ID NO: 186153 - DNA, 20 bp, Artificial Sequence
  Synthetic oligonucleotide; TGGAGT chr2 60477990 60478009 60478006 +
tctcactctgttgcccaggc

SEQ ID NO: 186154 - DNA, 20 bp, Artificial Sequence
  Synthetic oligonucleotide; CCGAGT chr2 60478034 60478053 60478050 +
ctcactgcaacctccgcctc

SEQ ID NO: 186155 - DNA, 20 bp, Artificial Sequence
  Synthetic oligonucleotide; TGGGAT chr2 60478133 60478152 60478149 +
ttttgtattttttgtagaga

SEQ ID NO: 186156 - DNA, 20 bp, Artificial Sequence
  Synthetic oligonucleotide; CTGGGT chr2 60478157 60478176 60478173 +
atctcaccatgttgcccagg

SEQ ID NO: 186157 - DNA, 20 bp, Artificial Sequence
  Synthetic oligonucleotide; TGGAAT chr2 60478223 60478242 60478239 +
ctgccccaacagtcgccctg

SEQ ID NO: 186158 - DNA, 20 bp, Artificial Sequence
  Synthetic oligonucleotide; TTGAGT chr2 60478445 60478464 60478461 +
cacttgcctttctggcacta

SEQ ID NO: 186159 - DNA, 20 bp, Artificial Sequence
  Synthetic oligonucleotide; CAGAAT chr2 60478556 60478575 60478572 +
aaccagaactggccattctc

SEQ ID NO: 186160 - DNA, 20 bp, Artificial Sequence
  Synthetic oligonucleotide; AGGAAT chr2 60478681 60478700 60478697 +
tcaggctctaacatttcttc

SEQ ID NO: 186161 - DNA, 20 bp, Artificial Sequence
  Synthetic oligonucleotide; CTGAAT chr2 60478719 60478738 60478735 +
ccctctcgcctgaggtgagg

SEQ ID NO: 186162 - DNA, 20 bp, Artificial Sequence
  Synthetic oligonucleotide; AAGAGT chr2 60479024 60479043 60479040 +
ataccactgaccaatctgga

SEQ ID NO: 186163 - DNA, 20 bp, Artificial Sequence
  Synthetic oligonucleotide; TGGGGT chr2 60479097 60479116 60479113 +
gagcagcctcagtccagcca

SEQ ID NO: 186164 - DNA, 20 bp, Artificial Sequence
  Synthetic oligonucleotide; ATGAGT chr2 60479150 60479169 60479166 +
actaattctgctgattccat

SEQ ID NO: 186165 - DNA, 20 bp, Artificial Sequence
  Synthetic oligonucleotide; TTGAGT chr2 60479326 60479345 60479342 +
cccggagaccattttttgtt

SEQ ID NO: 186166 - DNA, 20 bp, Artificial Sequence
  Synthetic oligonucleotide; AAGAAT chr2 60479451 60479470 60479467 +
caggtctactaggaacagga

SEQ ID NO: 186167 - DNA, 20 bp, Artificial Sequence
  Synthetic oligonucleotide; CTGGGT chr2 60479522 60479541 60479538 +
agggcctcaaccttctactg

SEQ ID NO: 186168 - DNA, 20 bp, Artificial Sequence
  Synthetic oligonucleotide; GAGAGT chr2 60479596 60479615 60479612 +
tcaaaccctgtcaggcggtg

SEQ ID NO: 186169 - DNA, 20 bp, Artificial Sequence
  Synthetic oligonucleotide; AAGAGT chr2 60479714 60479733 60479730 +
tatcaatgtaattcaaggca

SEQ ID NO: 186170 - DNA, 20 bp, Artificial Sequence
  Synthetic oligonucleotide; AAGGGT chr2 60479721 60479740 60479737 +
gtaattcaaggcaaagagtc

SEQ ID NO: 186171 - DNA, 20 bp, Artificial Sequence
  Synthetic oligonucleotide; GGGGGT chr2 60480128 60480147 60480144 +
cagcgaggaggggggaaggt

SEQ ID NO: 186172 - DNA, 20 bp, Artificial Sequence
  Synthetic oligonucleotide; AAGGAT chr2 60480199 60480218 60480215 +
aggtaacacaaaggcctgta

SEQ ID NO: 186173 - DNA, 20 bp, Artificial Sequence
  Synthetic oligonucleotide; CTGGAT chr2 60480244 60480263 60480260 +
ggctctccactccatttctc

SEQ ID NO: 186174 - DNA, 20 bp, Artificial Sequence
  Synthetic oligonucleotide; TAGGAT chr2 60480390 60480409 60480406 +
agagcccctcaataaataat

SEQ ID NO: 186175 - DNA, 20 bp, Artificial Sequence
  Synthetic oligonucleotide; CTGGGT chr2 60480531 60480550 60480547 +
attcactaaccaaggagcct

SEQ ID NO: 186176 - DNA, 20 bp, Artificial Sequence
  Synthetic oligonucleotide; GAGGAT chr2 60480553 60480572 60480569 +
gggtcagccttgacccagga

SEQ ID NO: 186177 - DNA, 20 bp, Artificial Sequence
  Synthetic oligonucleotide; GCGGAT chr2 60480710 60480729 60480726 +
acacagttaaaagagctaca

SEQ ID NO: 186178 - DNA, 20 bp, Artificial Sequence
  Synthetic oligonucleotide; GTGAAT chr2 60480739 60480758 60480755 +
aaatttccttaagtcttctg

SEQ ID NO: 186179 - DNA, 20 bp, Artificial Sequence
  Synthetic oligonucleotide; CTGGGT chr2 60480762 60480781 60480778 +
aattggtctcaattactagt

SEQ ID NO: 186180 - DNA, 20 bp, Artificial Sequence
  Synthetic oligonucleotide; TTGAAT chr2 60480888 60480907 60480904 +
acagtgtgaagtacctccgc

SEQ ID NO: 186181 - DNA, 20 bp, Artificial Sequence
  Synthetic oligonucleotide; TGGAAT chr2 60481187 60481206 60481203 +
cccaaaactgggaagggccc

SEQ ID NO: 186182 - DNA, 20 bp, Artificial Sequence
  Synthetic oligonucleotide; TGGGAT chr2 60481192 60481211 60481208 +
aactgggaagggccctggaa

SEQ ID NO: 186183 - DNA, 20 bp, Artificial Sequence
  Synthetic oligonucleotide; AGGGAT chr2 60481311 60481330 60481327 +
cttgaaaacaaaaatgaagc

SEQ ID NO: 186184 - DNA, 20 bp, Artificial Sequence
  Synthetic oligonucleotide; AGGAGT chr2 60481453 60481472 60481469 +
aagcacatacacatgctctc

SEQ ID NO: 186185 - DNA, 20 bp, Artificial Sequence
  Synthetic oligonucleotide; GAGGGT chr2 60481461 60481480 60481477 +
acacatgctctcaggagtca

SEQ ID NO: 186186 - DNA, 20 bp, Artificial Sequence
  Synthetic oligonucleotide; AGGGAT chr2 60481523 60481542 60481539 +
gctggcaggtgaaggaggac

SEQ ID NO: 186187 - DNA, 20 bp, Artificial Sequence
  Synthetic oligonucleotide; GTGAAT chr2 60481612 60481631 60481628 +
cttctccatttccatggctc

SEQ ID NO: 186188 - DNA, 20 bp, Artificial Sequence
  Synthetic oligonucleotide; TGGAAT chr2 60481806 60481825 60481822 +
ttttgaccatcacagtgtcc

SEQ ID NO: 186189 - DNA, 20 bp, Artificial Sequence
  Synthetic oligonucleotide; GTGAAT chr2 60481835 60481854 60481851 +
ctcagcatgctctctgggaa

SEQ ID NO: 186190 - DNA, 20 bp, Artificial Sequence
  Synthetic oligonucleotide; GTGAAT chr2 60481848 60481867 60481864 +
ctgggaagtgaattgggaaa

SEQ ID NO: 186191 - DNA, 20 bp, Artificial Sequence
  Synthetic oligonucleotide; AGGGGT chr2 60481973 60481992 60481989 +
tagtcctgctgtcaaaagaa

SEQ ID NO: 186192 - DNA, 20 bp, Artificial Sequence
  Synthetic oligonucleotide; GCGGGT chr2 60482086 60482105 60482102 +
agaggcagacctgttaaggg

SEQ ID NO: 186193 - DNA, 20 bp, Artificial Sequence
  Synthetic oligonucleotide; GAGAGT chr2 60482147 60482166 60482163 +
atctctcatgattctatctt

SEQ ID NO: 186194 - DNA, 20 bp, Artificial Sequence
  Synthetic oligonucleotide; TGGAGT chr2 60482163 60482182 60482179 +
tcttgagagtttagtttggt

SEQ ID NO: 186195 - DNA, 20 bp, Artificial Sequence
  Synthetic oligonucleotide; TTGAGT chr2 60482176 60482195 60482192 +
gtttggttggagtttagttt

SEQ ID NO: 186196 - DNA, 20 bp, Artificial Sequence
  Synthetic oligonucleotide; TCGGGT chr2 60482189 60482208 60482205 +
ttagtttttgagttttttgt

SEQ ID NO: 186197 - DNA, 20 bp, Artificial Sequence
  Synthetic oligonucleotide; GAGGGT chr2 60482270 60482289 60482286 +
gttcacggagcggacagaag

SEQ ID NO: 186198 - DNA, 20 bp, Artificial Sequence
  Synthetic oligonucleotide; GAGAAT chr2 60482326 60482345 60482342 +
ctgatacatggagcagagcc

SEQ ID NO: 186199 - DNA, 20 bp, Artificial Sequence
  Synthetic oligonucleotide; CAGAGT chr2 60482431 60482450 60482447 +
gttcctgggcaccaggcata

SEQ ID NO: 186200 - DNA, 20 bp, Artificial Sequence
  Synthetic oligonucleotide; CAGGAT chr2 60482470 60482489 60482486 +
gtgacaactttgccacaaat

SEQ ID NO: 186201 - DNA, 20 bp, Artificial Sequence
  Synthetic oligonucleotide; AAGAAT chr2 60482503 60482522 60482519 +
ttaaatccacaggaagcaag

SEQ ID NO: 186202 - DNA, 20 bp, Artificial Sequence
  Synthetic oligonucleotide; ATGAAT chr2 60482538 60482557 60482554 +
gcttatttatagatttgcag

SEQ ID NO: 186203 - DNA, 20 bp, Artificial Sequence
  Synthetic oligonucleotide; CTGGAT chr2 60482757 60482776 60482773 +
tagtaccacactacatttaa

SEQ ID NO: 186204 - DNA, 20 bp, Artificial Sequence
  Synthetic oligonucleotide; TAGAAT chr2 60482796 60482815 60482812 +
ttatacagtgccttgctttc

SEQ ID NO: 186205 - DNA, 20 bp, Artificial Sequence
  Synthetic oligonucleotide; CAGAGT chr2 60482872 60482891 60482888 +
attgcagcaataattgatag

SEQ ID NO: 186206 - DNA, 20 bp, Artificial Sequence
  Synthetic oligonucleotide; CAGAGT chr2 60482901 60482920 60482917 +
gctggaagatcattgattgg

SEQ ID NO: 186207 - DNA, 20 bp, Artificial Sequence
  Synthetic oligonucleotide; AAGAAT chr2 60483060 60483079 60483076 +
tactttgcgagatgtttgag

SEQ ID NO: 186208 - DNA, 20 bp, Artificial Sequence
  Synthetic oligonucleotide; ATGAAT chr2 60483093 60483112 60483109 +
tgtgatttatattatttccc

SEQ ID NO: 186209 - DNA, 20 bp, Artificial Sequence
  Synthetic oligonucleotide; AAGGAT chr2 60483105 60483124 60483121 +
tatttcccatgaataactgc

SEQ ID NO: 186210 - DNA, 20 bp, Artificial Sequence
  Synthetic oligonucleotide; GTGGGT chr2 60483114 60483133 60483130 +
tgaataactgcaaggatagt

SEQ ID NO: 186211 - DNA, 20 bp, Artificial Sequence
  Synthetic oligonucleotide; GAGAAT chr2 60483128 60483147 60483144 +
gatagtgtgggtagttggag

SEQ ID NO: 186212 - DNA, 20 bp, Artificial Sequence
  Synthetic oligonucleotide; CAGGGT chr2 60483198 60483217 60483214 +
gaacaatgctagccaacaat

SEQ ID NO: 186213 - DNA, 20 bp, Artificial Sequence
  Synthetic oligonucleotide; TGGAAT chr2 60483571 60483590 60483587 +
gttcaacaactcagaccctg

SEQ ID NO: 186214 - DNA, 20 bp, Artificial Sequence
  Synthetic oligonucleotide; GAGGAT chr2 60483604 60483623 60483620 +
ttgtcagaaataactcaaga

SEQ ID NO: 186215 - DNA, 20 bp, Artificial Sequence
  Synthetic oligonucleotide; ATGAAT chr2 60483632 60483651 60483648 +
tcgtccccaggaaacatcaa

SEQ ID NO: 186216 - DNA, 20 bp, Artificial Sequence
  Synthetic oligonucleotide; GTGGAT chr2 60483658 60483677 60483674 +
gagctggcatattagcagac

SEQ ID NO: 186217 - DNA, 20 bp, Artificial Sequence
  Synthetic oligonucleotide; CTGGAT chr2 60483697 60483716 60483713 +
atctaaaacagaagatgtat

SEQ ID NO: 186218 - DNA, 20 bp, Artificial Sequence
  Synthetic oligonucleotide; AAGAAT chr2 60483723 60483742 60483739 +
gcttcagcagacaacaaagg

SEQ ID NO: 186219 - DNA, 20 bp, Artificial Sequence
  Synthetic oligonucleotide; CTGGGT chr2 60483736 60483755 60483752 +
acaaaggaagaatttgggga

SEQ ID NO: 186220 - DNA, 20 bp, Artificial Sequence
  Synthetic oligonucleotide; GAGGAT chr2 60483769 60483788 60483785 +
ctcgcccaaagcactagaag

SEQ ID NO: 186221 - DNA, 20 bp, Artificial Sequence
  Synthetic oligonucleotide; ATGAGT chr2 60483907 60483926 60483923 +
ttgaaactgaaccattataa

SEQ ID NO: 186222 - DNA, 20 bp, Artificial Sequence
  Synthetic oligonucleotide; AGGGGT chr2 60483991 60484010 60484007 +
tgtgacacttaccgcgtatg

SEQ ID NO: 186223 - DNA, 20 bp, Artificial Sequence
  Synthetic oligonucleotide; TTGGGT chr2 60484118 60484137 60484134 +
tgcttcgtctgtgacagttg

SEQ ID NO: 186224 - DNA, 20 bp, Artificial Sequence
  Synthetic oligonucleotide; CAGGGT chr2 60484142 60484161 60484158 +
gttgcccttctaggagctgg

SEQ ID NO: 186225 - DNA, 20 bp, Artificial Sequence
  Synthetic oligonucleotide; TCGAAT chr2 60484288 60484307 60484304 +
cacattcagctgaaaatagc

SEQ ID NO: 186226 - DNA, 20 bp, Artificial Sequence
  Synthetic oligonucleotide; TGGGGT chr2 60484421 60484440 60484437 +
tctctttagtcctcaacaac

SEQ ID NO: 186227 - DNA, 20 bp, Artificial Sequence
  Synthetic oligonucleotide; CCGGGT chr2 60484485 60484504 60484501 +
aagtaggttttacagataaa

SEQ ID NO: 186228 - DNA, 20 bp, Artificial Sequence
  Synthetic oligonucleotide; GGGAAT chr2 60484655 60484674 60484671 +
tgttttttcttaagagaagg

SEQ ID NO: 186229 - DNA, 20 bp, Artificial Sequence
  Synthetic oligonucleotide; GGGAAT chr2 60484779 60484798 60484795 +
agtataaaacctcaaattat

SEQ ID NO: 186230 - DNA, 20 bp, Artificial Sequence
  Synthetic oligonucleotide; GGGGGT chr2 60484823 60484842 60484839 +
cattatggaacatatgtgct

SEQ ID NO: 186231 - DNA, 20 bp, Artificial Sequence
  Synthetic oligonucleotide; AGGGGT chr2 60484845 60484864 60484861 +
gggtctggggagatgggaga

SEQ ID NO: 186232 - DNA, 20 bp, Artificial Sequence
  Synthetic oligonucleotide; CAGAGT chr2 60485177 60485196 60485193 +
tgcaaataaatgcagtcatc

SEQ ID NO: 186233 - DNA, 20 bp, Artificial Sequence
  Synthetic oligonucleotide; TGGAGT chr2 60485201 60485220 60485217 +
gtgtaatggaagtctggcct

SEQ ID NO: 186234 - DNA, 20 bp, Artificial Sequence
  Synthetic oligonucleotide; TGGGAT chr2 60485227 60485246 60485243 +
tactggcttatgaaatgcaa

SEQ ID NO: 186235 - DNA, 20 bp, Artificial Sequence
  Synthetic oligonucleotide; TGGGGT chr2 60485237 60485256 60485253 +
tgaaatgcaatgggatgagg

SEQ ID NO: 186236 - DNA, 20 bp, Artificial Sequence
  Synthetic oligonucleotide; TAGGGT chr2 60485282 60485301 60485298 +
tgaacggcacagtgaccagg

SEQ ID NO: 186237 - DNA, 20 bp, Artificial Sequence
  Synthetic oligonucleotide; AAGAAT chr2 60485307 60485326 60485323 +
tggagcaaggccactccagc

SEQ ID NO: 186238 - DNA, 20 bp, Artificial Sequence
  Synthetic oligonucleotide; AAGGAT chr2 60485316 60485335 60485332 +
gccactccagcaagaatgcc

SEQ ID NO: 186239 - DNA, 20 bp, Artificial Sequence
  Synthetic oligonucleotide; GTGGGT chr2 60485330 60485349 60485346 +
aatgccaaggatagcctgca

SEQ ID NO: 186240 - DNA, 20 bp, Artificial Sequence
  Synthetic oligonucleotide; AGGAAT chr2 60485413 60485432 60485429 +
ggctagcagatgctagtccc

SEQ ID NO: 186241 - DNA, 20 bp, Artificial Sequence
  Synthetic oligonucleotide; CTGAAT chr2 60485602 60485621 60485618 +
catccaacgtcacgaagctg

SEQ ID NO: 186242 - DNA, 20 bp, Artificial Sequence
  Synthetic oligonucleotide; TGGGGT chr2 60485667 60485686 60485683 +
agaaacaacgcttgctattc

SEQ ID NO: 186243 - DNA, 20 bp, Artificial Sequence
  Synthetic oligonucleotide; ATGGAT chr2 60485832 60485851 60485848 +
cagaagtagcccttcaccag

SEQ ID NO: 186244 - DNA, 20 bp, Artificial Sequence
  Synthetic oligonucleotide; AGGAAT chr2 60485907 60485926 60485923 +
cattttcaacaagaaggctg

SEQ ID NO: 186245 - DNA, 20 bp, Artificial Sequence
  Synthetic oligonucleotide; AGGGAT chr2 60486019 60486038 60486035 +
aaaatctttttagtatgttt

SEQ ID NO: 186246 - DNA, 20 bp, Artificial Sequence
  Synthetic oligonucleotide; AAGAGT chr2 60486077 60486096 60486093 +
ccttgttctatcagcaggtc

SEQ ID NO: 186247 - DNA, 20 bp, Artificial Sequence
  Synthetic oligonucleotide; ATGGAT chr2 60486116 60486135 60486132 +
aagctgttctccattctgaa

SEQ ID NO: 186248 - DNA, 20 bp, Artificial Sequence
  Synthetic oligonucleotide; GGGGAT chr2 60486171 60486190 60486187 +
atcctagggagactggtact

SEQ ID NO: 186249 - DNA, 20 bp, Artificial Sequence
  Synthetic oligonucleotide; CAGGGT chr2 60486179 60486198 60486195 +
gagactggtactggggattt

SEQ ID NO: 186250 - DNA, 20 bp, Artificial Sequence
  Synthetic oligonucleotide; GTGGGT chr2 60486194 60486213 60486210 +
gatttcagggtccttgttct

SEQ ID NO: 186251 - DNA, 20 bp, Artificial Sequence
  Synthetic oligonucleotide; GAGAAT chr2 60486219 60486238 60486235 +
tggaccatggctcctttcca

SEQ ID NO: 186252 - DNA, 20 bp, Artificial Sequence
  Synthetic oligonucleotide; ACGGAT chr2 60486345 60486364 60486361 +
ttctcacacaatgagaaaga

SEQ ID NO: 186253 - DNA, 20 bp, Artificial Sequence
  Synthetic oligonucleotide; AAGAGT chr2 60486362 60486381 60486378 +
agaacggatagccaaattct

SEQ ID NO: 186254 - DNA, 20 bp, Artificial Sequence
  Synthetic oligonucleotide; ATGAAT chr2 60486585 60486604 60486601 +
tgagatcctctggctttgag

SEQ ID NO: 186255 - DNA, 20 bp, Artificial Sequence
  Synthetic oligonucleotide; ATGGAT chr2 60486614 60486633 60486630 +
gcacagaaatgagcagcatg

SEQ ID NO: 186256 - DNA, 20 bp, Artificial Sequence
  Synthetic oligonucleotide; CAGGAT chr2 60486666 60486685 60486682 +
tgaacatgccaactcaacat

SEQ ID NO: 186257 - DNA, 20 bp, Artificial Sequence
  Synthetic oligonucleotide; CAGAGT chr2 60486740 60486759 60486756 +
acagaggtattacagtgtga

SEQ ID NO: 186258 - DNA, 20 bp, Artificial Sequence
  Synthetic oligonucleotide; GAGAAT chr2 60486761 60486780 60486777 +
agagtctgagcccacagtct

SEQ ID NO: 186259 - DNA, 20 bp, Artificial Sequence
  Synthetic oligonucleotide; GCGAAT chr2 60486821 60486840 60486837 +
aacaccctgggaagactact

SEQ ID NO: 186260 - DNA, 20 bp, Artificial Sequence
  Synthetic oligonucleotide; TGGAAT chr2 60486903 60486922 60486919 +
cttttccctgctaacagaaa

SEQ ID NO: 186261 - DNA, 20 bp, Artificial Sequence
  Synthetic oligonucleotide; CAGAAT chr2 60486949 60486968 60486965 +
ttttaagattactattctat

SEQ ID NO: 186262 - DNA, 20 bp, Artificial Sequence
  Synthetic oligonucleotide; GTGAGT chr2 60487044 60487063 60487060 +
atttaggagcgctagacaca

SEQ ID NO: 186263 - DNA, 20 bp, Artificial Sequence
  Synthetic oligonucleotide; AAGGAT chr2 60487093 60487112 60487109 +
tgccacaaggcaggaagggg

SEQ ID NO: 186264 - DNA, 20 bp, Artificial Sequence
  Synthetic oligonucleotide; AAGAGT chr2 60487185 60487204 60487201 +
attttgcctttaatcaatga

SEQ ID NO: 186265 - DNA, 20 bp, Artificial Sequence
  Synthetic oligonucleotide; GAGAGT chr2 60487333 60487352 60487349 +
accccacaatgccacacacc

SEQ ID NO: 186266 - DNA, 20 bp, Artificial Sequence
  Synthetic oligonucleotide; TGGGAT chr2 60487444 60487463 60487460 +
aaatgtagattatcttccct

SEQ ID NO: 186267 - DNA, 20 bp, Artificial Sequence
  Synthetic oligonucleotide; ATGAAT chr2 60487505 60487524 60487521 +
tcaacattagatatttaaaa

SEQ ID NO: 186268 - DNA, 20 bp, Artificial Sequence
  Synthetic oligonucleotide; GCGGAT chr2 60487599 60487618 60487615 +
ggcatgaaaaagaaggctta

SEQ ID NO: 186269 - DNA, 20 bp, Artificial Sequence
  Synthetic oligonucleotide; GAGGGT chr2 60487652 60487671 60487668 +
caaccacaccagcctttaac

SEQ ID NO: 186270 - DNA, 20 bp, Artificial Sequence
  Synthetic oligonucleotide; CAGAAT chr2 60487698 60487717 60487714 +
actcccttatttatgagcag

SEQ ID NO: 186271 - DNA, 20 bp, Artificial Sequence
  Synthetic oligonucleotide; CTGGAT chr2 60487815 60487834 60487831 +
atgaacctttaatgggaaat

SEQ ID NO: 186272 - DNA, 20 bp, Artificial Sequence
  Synthetic oligonucleotide; AAGAAT chr2 60487821 60487840 60487837 +
ctttaatgggaaatctggat

SEQ ID NO: 186273 - DNA, 20 bp, Artificial Sequence
  Synthetic oligonucleotide; TAGAAT chr2 60487949 60487968 60487965 +
tgacttggttttcccaactc

SEQ ID NO: 186274 - DNA, 20 bp, Artificial Sequence
  Synthetic oligonucleotide; CTGGGT chr2 60488043 60488062 60488059 +
tctgtgctattacttttgac

SEQ ID NO: 186275 - DNA, 20 bp, Artificial Sequence
  Synthetic oligonucleotide; AAGAGT chr2 60488112 60488131 60488128 +
aaacatttaaattatcctgg

SEQ ID NO: 186276 - DNA, 20 bp, Artificial Sequence
  Synthetic oligonucleotide; AAGAGT chr2 60488137 60488156 60488153 +
tttgtctcacgggctgttca

SEQ ID NO: 186277 - DNA, 20 bp, Artificial Sequence
  Synthetic oligonucleotide; AGGAGT chr2 60488170 60488189 60488186 +
cctttccttctaggaacatg

SEQ ID NO: 186278 - DNA, 20 bp, Artificial Sequence
  Synthetic oligonucleotide; GTGAAT chr2 60488174 60488193 60488190 +
tccttctaggaacatgagga

SEQ ID NO: 186279 - DNA, 20 bp, Artificial Sequence
  Synthetic oligonucleotide; CTGAGT chr2 60488212 60488231 60488228 +
tcaaagcctgtaaaagatac

SEQ ID NO: 186280 - DNA, 20 bp, Artificial Sequence
  Synthetic oligonucleotide; AAGAAT chr2 60488244 60488263 60488260 +
tttaactgaacaatgtctcc

SEQ ID NO: 186281 - DNA, 20 bp, Artificial Sequence
  Synthetic oligonucleotide; GGGAAT chr2 60488293 60488312 60488309 +
gaccgtctctttggtgcagt

SEQ ID NO: 186282 - DNA, 20 bp, Artificial Sequence
  Synthetic oligonucleotide; CAGGAT chr2 60488405 60488424 60488421 +
ataataggacaatgccataa

SEQ ID NO: 186283 - DNA, 20 bp, Artificial Sequence
  Synthetic oligonucleotide; GGGAAT chr2 60488598 60488617 60488614 +
aaatacttactgtactgcag

SEQ ID NO: 186284 - DNA, 20 bp, Artificial Sequence
  Synthetic oligonucleotide; TGGAGT chr2 60488761 60488780 60488777 +
tttgttttttgtttctgagg

SEQ ID NO: 186285 - DNA, 20 bp, Artificial Sequence
  Synthetic oligonucleotide; TGGAGT chr2 60488787 60488806 60488803 +
ttcgctcttgttgcccgggc

SEQ ID NO: 186286 - DNA, 20 bp, Artificial Sequence
  Synthetic oligonucleotide; CCGGGT chr2 60488831 60488850 60488847 +
ctcaccgcaatctccgcctc

SEQ ID NO: 186287 - DNA, 20 bp, Artificial Sequence
  Synthetic oligonucleotide; TGGGAT chr2 60488872 60488891 60488888 +
gcctcagcctcccaagtagc

SEQ ID NO: 186288 - DNA, 20 bp, Artificial Sequence
  Synthetic oligonucleotide; CGGGGT chr2 60488928 60488947 60488944 +
ttctgtatttttggtagaga

SEQ ID NO: 186289 - DNA, 20 bp, Artificial Sequence
  Synthetic oligonucleotide; TGGGAT chr2 60489007 60489026 60489023 +
acctcagcctcccaaagtgc

SEQ ID NO: 186290 - DNA, 20 bp, Artificial Sequence
  Synthetic oligonucleotide; AAGGGT chr2 60489115 60489134 60489131 +
aggtggtcaaaatgtttcta

SEQ ID NO: 186291 - DNA, 20 bp, Artificial Sequence
  Synthetic oligonucleotide; TAGAGT chr2 60489149 60489168 60489165 +
ccccaattaaactgttgctt

SEQ ID NO: 186292 - DNA, 20 bp, Artificial Sequence
  Synthetic oligonucleotide; TGGGGT chr2 60489229 60489248 60489245 +
aacactagcccacatgccaa

SEQ ID NO: 186293 - DNA, 20 bp, Artificial Sequence
  Synthetic oligonucleotide; CAGGAT chr2 60489468 60489487 60489484 +
aaaatagctgcctcatcatc

SEQ ID NO: 186294 - DNA, 20 bp, Artificial Sequence
  Synthetic oligonucleotide; CTGAGT chr2 60489554 60489573 60489570 +
acctatctcaaaagaaaatt

SEQ ID NO: 186295 - DNA, 20 bp, Artificial Sequence
  Synthetic oligonucleotide; CTGGGT chr2 60489643 60489662 60489659 +
tctttcccctctaggacact

SEQ ID NO: 186296 - DNA, 20 bp, Artificial Sequence
  Synthetic oligonucleotide; AGGGAT chr2 60489836 60489855 60489852 +
cactattaaagagagatcac

SEQ ID NO: 186297 - DNA, 20 bp, Artificial Sequence
  Synthetic oligonucleotide; ATGAAT chr2 60489842 60489861 60489858 +
taaagagagatcacagggat

SEQ ID NO: 186298 - DNA, 20 bp, Artificial Sequence
  Synthetic oligonucleotide; CTGAGT chr2 60489918 60489937 60489934 +
catgaaacaccatccatgcc

SEQ ID NO: 186299 - DNA, 20 bp, Artificial Sequence
  Synthetic oligonucleotide; ATGGAT chr2 60489932 60489951 60489948 +
catgccctgagtatcccaac

SEQ ID NO: 186300 - DNA, 20 bp, Artificial Sequence
  Synthetic oligonucleotide; AAGGGT chr2 60490202 60490221 60490218 +
acaggggagaactcggcatg

SEQ ID NO: 186301 - DNA, 20 bp, Artificial Sequence
  Synthetic oligonucleotide; GAGAAT chr2 60490214 60490233 60490230 +
tcggcatgaagggtataaca

SEQ ID NO: 186302 - DNA, 20 bp, Artificial Sequence
  Synthetic oligonucleotide; CAGAGT chr2 60490245 60490264 60490261 +
caactcatccaccccctttg

SEQ ID NO: 186303 - DNA, 20 bp, Artificial Sequence
  Synthetic oligonucleotide; CAGAGT chr2 60490293 60490312 60490309 +
tgctgcctttgtcttctgat

SEQ ID NO: 186304 - DNA, 20 bp, Artificial Sequence
  Synthetic oligonucleotide; TAGGAT chr2 60490323 60490342 60490339 +
cagcagccctctgtgatcta

SEQ ID NO: 186305 - DNA, 20 bp, Artificial Sequence
  Synthetic oligonucleotide; TGGAAT chr2 60490493 60490512 60490509 +
cttcttcttctcttacctcc

SEQ ID NO: 186306 - DNA, 20 bp, Artificial Sequence
  Synthetic oligonucleotide; AAGAAT chr2 60490551 60490570 60490567 +
tacctagtcaccttagcaag

SEQ ID NO: 186307 - DNA, 20 bp, Artificial Sequence
  Synthetic oligonucleotide; ATGAGT chr2 60490677 60490696 60490693 +
attaatttcatgtgttccca

SEQ ID NO: 186308 - DNA, 20 bp, Artificial Sequence
  Synthetic oligonucleotide; AGGAAT chr2 60490771 60490790 60490787 +
acatgatattcatatattct

SEQ ID NO: 186309 - DNA, 20 bp, Artificial Sequence
  Synthetic oligonucleotide; ATGAAT chr2 60490972 60490991 60490988 +
tatgctacacaaagattagc

SEQ ID NO: 186310 - DNA, 20 bp, Artificial Sequence
  Synthetic oligonucleotide; CAGAGT chr2 60491074 60491093 60491090 +
gccaggttggtaaagtctga

SEQ ID NO: 186311 - DNA, 20 bp, Artificial Sequence
  Synthetic oligonucleotide; GAGGAT chr2 60491426 60491445 60491442 +
actttgggaggccggggcag

SEQ ID NO: 186312 - DNA, 20 bp, Artificial Sequence
  Synthetic oligonucleotide; AGGAGT chr2 60491443 60491462 60491459 +
caggaggatcacctgaggtc

SEQ ID NO: 186313 - DNA, 20 bp, Artificial Sequence
  Synthetic oligonucleotide; AAGAGT chr2 60491633 60491652 60491649 +
tgcattccagcccgggcaac

SEQ ID NO: 186314 - DNA, 20 bp, Artificial Sequence
  Synthetic oligonucleotide; GGGAAT chr2 60491943 60491962 60491959 +
aaataccttggaaattgaga

SEQ ID NO: 186315 - DNA, 20 bp, Artificial Sequence
  Synthetic oligonucleotide; ATGGAT chr2 60491961 60491980 60491977 +
gagggaatctggagaggaag

SEQ ID NO: 186316 - DNA, 20 bp, Artificial Sequence
  Synthetic oligonucleotide; AGGAAT chr2 60491995 60492014 60492011 +
aacaaaaaccctcactttac

SEQ ID NO: 186317 - DNA, 20 bp, Artificial Sequence
  Synthetic oligonucleotide; ATGAAT chr2 60492056 60492075 60492072 +
cttaaggagaagacatactg

SEQ ID NO: 186318 - DNA, 20 bp, Artificial Sequence
  Synthetic oligonucleotide; CTGAGT chr2 60492066 60492085 60492082 +
agacatactgatgaataaga

SEQ ID NO: 186319 - DNA, 20 bp, Artificial Sequence
  Synthetic oligonucleotide; GAGGAT chr2 60492130 60492149 60492146 +
actttgggaggtcaaggcag

SEQ ID NO: 186320 - DNA, 20 bp, Artificial Sequence
  Synthetic oligonucleotide; AGGAGT chr2 60492147 60492166 60492163 +
caggaggatcactggagccc

SEQ ID NO: 186321 - DNA, 20 bp, Artificial Sequence
  Synthetic oligonucleotide; CAGGAT chr2 60492255 60492274 60492271 +
tactcaggaggctgaggtga

SEQ ID NO: 186322 - DNA, 20 bp, Artificial Sequence
  Synthetic oligonucleotide; TAGAAT chr2 60492395 60492414 60492411 +
caactaattgggctaatgtt

SEQ ID NO: 186323 - DNA, 20 bp, Artificial Sequence
  Synthetic oligonucleotide; TTGGGT chr2 60492432 60492451 60492448 +
tagggaagaaaaaaacttag

SEQ ID NO: 186324 - DNA, 20 bp, Artificial Sequence
  Synthetic oligonucleotide; TGGAAT chr2 60492470 60492489 60492486 +
ttttactttttgaagcctgc

SEQ ID NO: 186325 - DNA, 20 bp, Artificial Sequence
  Synthetic oligonucleotide; GTGGAT chr2 60492568 60492587 60492584 +
acccaaatgctctgcttatg

SEQ ID NO: 186326 - DNA, 20 bp, Artificial Sequence
  Synthetic oligonucleotide; CAGAAT chr2 60492649 60492668 60492665 +
taccaacttctataaaatct

SEQ ID NO: 186327 - DNA, 20 bp, Artificial Sequence
  Synthetic oligonucleotide; TAGAGT chr2 60492711 60492730 60492727 +
gtgctaccctgaaagacggc

SEQ ID NO: 186328 - DNA, 20 bp, Artificial Sequence
  Synthetic oligonucleotide; GTGGGT chr2 60492772 60492791 60492788 +
gacttggttccactccagtg

SEQ ID NO: 186329 - DNA, 20 bp, Artificial Sequence
  Synthetic oligonucleotide; TTGGAT chr2 60492854 60492873 60492870 +
cattcattttaagtgtacag

SEQ ID NO: 186330 - DNA, 20 bp, Artificial Sequence
  Synthetic oligonucleotide; GAGAAT chr2 60493027 60493046 60493043 +
ccacctaccaccacagtgtt

SEQ ID NO: 186331 - DNA, 20 bp, Artificial Sequence
  Synthetic oligonucleotide; TAGAAT chr2 60493035 60493054 60493051 +
caccacagtgttgagaattc

SEQ ID NO: 186332 - DNA, 20 bp, Artificial Sequence
  Synthetic oligonucleotide; CAGGAT chr2 60493061 60493080 60493077 +
ttgttacaaatggactcata

SEQ ID NO: 186333 - DNA, 20 bp, Artificial Sequence
  Synthetic oligonucleotide; CAGAAT chr2 60493099 60493118 60493115 +
gtttaatttcttccacagag

SEQ ID NO: 186334 - DNA, 20 bp, Artificial Sequence
  Synthetic oligonucleotide; TGGGAT chr2 60493110 60493129 60493126 +
tccacagagcagaatgattc

SEQ ID NO: 186335 - DNA, 20 bp, Artificial Sequence
  Synthetic oligonucleotide; TGGAGT chr2 60493128 60493147 60493144 +
tctgggattcatccatggtg

SEQ ID NO: 186336 - DNA, 20 bp, Artificial Sequence
  Synthetic oligonucleotide; TTGAGT chr2 60493159 60493178 60493175 +
actctttcattcttctactg

SEQ ID NO: 186337 - DNA, 20 bp, Artificial Sequence
  Synthetic oligonucleotide; GTGGGT chr2 60493212 60493231 60493228 +
ttcaacctattggttgccat

SEQ ID NO: 186338 - DNA, 20 bp, Artificial Sequence
  Synthetic oligonucleotide; AGGAAT chr2 60493279 60493298 60493295 +
cactgtgtagatgtgtttat

SEQ ID NO: 186339 - DNA, 20 bp, Artificial Sequence
  Synthetic oligonucleotide; TTGAGT chr2 60493344 60493363 60493360 +
tcgagaacacagaaaaggtt

SEQ ID NO: 186340 - DNA, 20 bp, Artificial Sequence
  Synthetic oligonucleotide; TTGAGT chr2 60493350 60493369 60493366 +
acacagaaaaggttttgagt

SEQ ID NO: 186341 - DNA, 20 bp, Artificial Sequence
  Synthetic oligonucleotide; GAGAGT chr2 60493413 60493432 60493429 +
ccctcccaccccattccctg

SEQ ID NO: 186342 - DNA, 20 bp, Artificial Sequence
  Synthetic oligonucleotide; CCGAAT chr2 60493480 60493499 60493496 +
ctaccaaatgtcatcctatt

SEQ ID NO: 186343 - DNA, 20 bp, Artificial Sequence
  Synthetic oligonucleotide; TTGAAT chr2 60493556 60493575 60493572 +
ttcttaaaatgggcattcat

SEQ ID NO: 186344 - DNA, 20 bp, Artificial Sequence
  Synthetic oligonucleotide; CTGGGT chr2 60493582 60493601 60493598 +
caggccaaataaattggact

SEQ ID NO: 186345 - DNA, 20 bp, Artificial Sequence
  Synthetic oligonucleotide; CGGAGT chr2 60493612 60493631 60493628 +
gataacttaagtgtggtgtt

SEQ ID NO: 186346 - DNA, 20 bp, Artificial Sequence
  Synthetic oligonucleotide; GAGAGT chr2 60493677 60493696 60493693 +
cctcccccattagcagcatg

SEQ ID NO: 186347 - DNA, 20 bp, Artificial Sequence
  Synthetic oligonucleotide; GGGGAT chr2 60493866 60493885 60493882 +
gcttggccatggcagggctg

SEQ ID NO: 186348 - DNA, 20 bp, Artificial Sequence
  Synthetic oligonucleotide; CTGAGT chr2 60493933 60493952 60493949 +
ggcctccagtgggaccagag

SEQ ID NO: 186349 - DNA, 20 bp, Artificial Sequence
  Synthetic oligonucleotide; GGGAGT chr2 60493979 60493998 60493995 +
gctgattaaaggaaggtacg

SEQ ID NO: 186350 - DNA, 20 bp, Artificial Sequence
  Synthetic oligonucleotide; ATGGGT chr2 60494103 60494122 60494119 +
cagagagaaagtgaagcccc

SEQ ID NO: 186351 - DNA, 20 bp, Artificial Sequence
  Synthetic oligonucleotide; AAGAGT chr2 60494194 60494213 60494210 +
ttgagctacacaggctaagc

SEQ ID NO: 186352 - DNA, 20 bp, Artificial Sequence
  Synthetic oligonucleotide; GAGGGT chr2 60494204 60494223 60494220 +
caggctaagcaagagtgaga

SEQ ID NO: 186353 - DNA, 20 bp, Artificial Sequence
  Synthetic oligonucleotide; GAGAGT chr2 60494230 60494249 60494246 +
gatgctgacaggccacatgg

SEQ ID NO: 186354 - DNA, 20 bp, Artificial Sequence
  Synthetic oligonucleotide; GGGAGT chr2 60494258 60494277 60494274 +
gaagacgtgggctgggagct

SEQ ID NO: 186355 - DNA, 20 bp, Artificial Sequence
  Synthetic oligonucleotide; CTGGGT chr2 60494335 60494354 60494351 +
gtcacctccccactctggac

SEQ ID NO: 186356 - DNA, 20 bp, Artificial Sequence
  Synthetic oligonucleotide; GGGAGT chr2 60494425 60494444 60494441 +
tatgcaatttttgccaagat

SEQ ID NO: 186357 - DNA, 20 bp, Artificial Sequence
  Synthetic oligonucleotide; AAGAGT chr2 60494441 60494460 60494457 +
agatgggagtatggggagag

SEQ ID NO: 186358 - DNA, 20 bp, Artificial Sequence
  Synthetic oligonucleotide; TGGAAT chr2 60494623 60494642 60494639 +
ccaaatgttctttcttcagc

SEQ ID NO: 186359 - DNA, 20 bp, Artificial Sequence
  Synthetic oligonucleotide; AGGAAT chr2 60494655 60494674 60494671 +
tatggactcatccgtaaaat

SEQ ID NO: 186360 - DNA, 20 bp, Artificial Sequence
  Synthetic oligonucleotide; TAGGGT chr2 60494680 60494699 60494696 +
taataatagtatatgcttca

SEQ ID NO: 186361 - DNA, 20 bp, Artificial Sequence
  Synthetic oligonucleotide; ATGAGT chr2 60494701 60494720 60494717 +
agggtttgtatgaaaataaa

SEQ ID NO: 186362 - DNA, 20 bp, Artificial Sequence
  Synthetic oligonucleotide; CAGAGT chr2 60494730 60494749 60494746 +
tatttgtaaagttcctagag

SEQ ID NO: 186363 - DNA, 20 bp, Artificial Sequence
  Synthetic oligonucleotide; TTGGGT chr2 60494835 60494854 60494851 +
ccctttccccaattcctagt

SEQ ID NO: 186364 - DNA, 20 bp, Artificial Sequence
  Synthetic oligonucleotide; AAGAAT chr2 60494875 60494894 60494891 +
aaagggagaggaaaaaggaa

SEQ ID NO: 186365 - DNA, 20 bp, Artificial Sequence
  Synthetic oligonucleotide; ATGGAT chr2 60494960 60494979 60494976 +
ctgataggtgcctatatgtg

SEQ ID NO: 186366 - DNA, 20 bp, Artificial Sequence
  Synthetic oligonucleotide; ATGGGT chr2 60494964 60494983 60494980 +
taggtgcctatatgtgatgg

SEQ ID NO: 186367 - DNA, 20 bp, Artificial Sequence
  Synthetic oligonucleotide; GAGAGT chr2 60495011 60495030 60495027 +
atggacaattatgaggaggg

SEQ ID NO: 186368 - DNA, 20 bp, Artificial Sequence
  Synthetic oligonucleotide; GGGAGT chr2 60495052 60495071 60495068 +
ttcacctcctttacaatttt

SEQ ID NO: 186369 - DNA, 20 bp, Artificial Sequence
  Synthetic oligonucleotide; AAGAGT chr2 60495314 60495333 60495330 +
gaccctggtgtgttatgtct

SEQ ID NO: 186370 - DNA, 20 bp, Artificial Sequence
  Synthetic oligonucleotide; TGGAAT chr2 60495372 60495391 60495388 +
tacctgtatggactttgcac

SEQ ID NO: 186371 - DNA, 20 bp, Artificial Sequence
  Synthetic oligonucleotide; AGGAAT chr2 60495492 60495511 60495508 +
ctagctgccttccttatcac

SEQ ID NO: 186372 - DNA, 20 bp, Artificial Sequence
  Synthetic oligonucleotide; CAGAGT chr2 60495522 60495541 60495538 +
cccaaggtccatcagtacct

SEQ ID NO: 186373 - DNA, 20 bp, Artificial Sequence
  Synthetic oligonucleotide; CAGGGT chr2 60495583 60495602 60495599 +
ggcacagtcaggctgttttc

SEQ ID NO: 186374 - DNA, 20 bp, Artificial Sequence
  Synthetic oligonucleotide; TGGGGT chr2 60495588 60495607 60495604 +
agtcaggctgttttccaggg

SEQ ID NO: 186375 - DNA, 20 bp, Artificial Sequence
  Synthetic oligonucleotide; GAGAGT chr2 60495673 60495692 60495689 +
tgttgtgatccctgtggttt

SEQ ID NO: 186376 - DNA, 20 bp, Artificial Sequence
  Synthetic oligonucleotide; GAGAGT chr2 60495901 60495920 60495917 +
aatggtgctgtcatttttct

SEQ ID NO: 186377 - DNA, 20 bp, Artificial Sequence
  Synthetic oligonucleotide; AAGGGT chr2 60495918 60495937 60495934 +
tctgagagtctctaaattac

SEQ ID NO: 186378 - DNA, 20 bp, Artificial Sequence
  Synthetic oligonucleotide; AGGGAT chr2 60496007 60496026 60496023 +
gaacaaacaaaccaaagaga

SEQ ID NO: 186379 - DNA, 20 bp, Artificial Sequence
  Synthetic oligonucleotide; TAGGAT chr2 60496060 60496079 60496076 +
tcaattgataatgaaggctt

SEQ ID NO: 186380 - DNA, 20 bp, Artificial Sequence
  Synthetic oligonucleotide; ATGGAT chr2 60496109 60496128 60496125 +
gcaatgcacctgtgcaggaa

SEQ ID NO: 186381 - DNA, 20 bp, Artificial Sequence
  Synthetic oligonucleotide; GGGAAT chr2 60496125 60496144 60496141 +
ggaaatggattacggaaaca

SEQ ID NO: 186382 - DNA, 20 bp, Artificial Sequence
  Synthetic oligonucleotide; CAGAAT chr2 60496225 60496244 60496241 +
ggaagtccaatacacgttta

SEQ ID NO: 186383 - DNA, 20 bp, Artificial Sequence
  Synthetic oligonucleotide; CAGGGT chr2 60496273 60496292 60496289 +
aggctaccacagatggggga

SEQ ID NO: 186384 - DNA, 20 bp, Artificial Sequence
  Synthetic oligonucleotide; GGGAGT chr2 60496279 60496298 60496295 +
ccacagatgggggacagggt

SEQ ID NO: 186385 - DNA, 20 bp, Artificial Sequence
  Synthetic oligonucleotide; AGGGAT chr2 60496316 60496335 60496332 +
gtggtgttactgaggggcaa

SEQ ID NO: 186386 - DNA, 20 bp, Artificial Sequence
  Synthetic oligonucleotide; GTGAGT chr2 60496464 60496483 60496480 +
gctctggacacacagcaaaa

SEQ ID NO: 186387 - DNA, 20 bp, Artificial Sequence
  Synthetic oligonucleotide; CAGAGT chr2 60496471 60496490 60496487 +
acacacagcaaaagtgagtt

SEQ ID NO: 186388 - DNA, 20 bp, Artificial Sequence
  Synthetic oligonucleotide; GAGGAT chr2 60496505 60496524 60496521 +
gcaggaaagagggaagagag

SEQ ID NO: 186389 - DNA, 20 bp, Artificial Sequence
  Synthetic oligonucleotide; AAGGAT chr2 60496546 60496565 60496562 +
ctttgctgcaggttcaaggc

SEQ ID NO: 186390 - DNA, 20 bp, Artificial Sequence
  Synthetic oligonucleotide; GTGAGT chr2 60496583 60496602 60496599 +
accccttctggaagagcctg

SEQ ID NO: 186391 - DNA, 20 bp, Artificial Sequence
  Synthetic oligonucleotide; TGGAAT chr2 60496667 60496686 60496683 +
gcaggggcctgggccattta

SEQ ID NO: 186392 - DNA, 20 bp, Artificial Sequence
  Synthetic oligonucleotide; GTGAGT chr2 60496748 60496767 60496764 +
ttcccactctaggttccact

SEQ ID NO: 186393 - DNA, 20 bp, Artificial Sequence
  Synthetic oligonucleotide; AGGAGT chr2 60496790 60496809 60496806 +
tctctcactatgctcccaag

SEQ ID NO: 186394 - DNA, 20 bp, Artificial Sequence
  Synthetic oligonucleotide; CTGGAT chr2 60496828 60496847 60496844 +
ccttcctcaaatctccctca

SEQ ID NO: 186395 - DNA, 20 bp, Artificial Sequence
  Synthetic oligonucleotide; CTGAAT chr2 60496868 60496887 60496884 +
cctgaaaagcagcatgcaaa

SEQ ID NO: 186396 - DNA, 20 bp, Artificial Sequence
  Synthetic oligonucleotide; ATGAGT chr2 60496917 60496936 60496933 +
cccatggacagtcataagag

SEQ ID NO: 186397 - DNA, 20 bp, Artificial Sequence
  Synthetic oligonucleotide; CTGGAT chr2 60496974 60496993 60496990 +
acgattacttcacgataaat

SEQ ID NO: 186398 - DNA, 20 bp, Artificial Sequence
  Synthetic oligonucleotide; TTGAGT chr2 60497040 60497059 60497056 +
tctctactcctcccccagtg

SEQ ID NO: 186399 - DNA, 20 bp, Artificial Sequence
  Synthetic oligonucleotide; GGGAGT chr2 60497051 60497070 60497067 +
cccccagtgttgagtggaca

SEQ ID NO: 186400 - DNA, 20 bp, Artificial Sequence
  Synthetic oligonucleotide; AGGAAT chr2 60497232 60497251 60497248 +
tagagaaacattccattgaa

SEQ ID NO: 186401 - DNA, 20 bp, Artificial Sequence
  Synthetic oligonucleotide; CAGAAT chr2 60497330 60497349 60497346 +
tttgatcaagtcagattttt

SEQ ID NO: 186402 - DNA, 20 bp, Artificial Sequence
  Synthetic oligonucleotide; ATGAAT chr2 60497336 60497355 60497352 +
caagtcagatttttcagaat

SEQ ID NO: 186403 - DNA, 20 bp, Artificial Sequence
  Synthetic oligonucleotide; AAGGAT chr2 60497417 60497436 60497433 +
agccctcaggttagcaggcc

SEQ ID NO: 186404 - DNA, 20 bp, Artificial Sequence
  Synthetic oligonucleotide; GAGAGT chr2 60497427 60497446 60497443 +
ttagcaggccaaggatatat

SEQ ID NO: 186405 - DNA, 20 bp, Artificial Sequence
  Synthetic oligonucleotide; CTGAAT chr2 60497463 60497482 60497479 +
ctagacttaaactgccgctc

SEQ ID NO: 186406 - DNA, 20 bp, Artificial Sequence
  Synthetic oligonucleotide; TTGAAT chr2 60497468 60497487 60497484 +
cttaaactgccgctcctgaa

SEQ ID NO: 186407 - DNA, 20 bp, Artificial Sequence
  Synthetic oligonucleotide; AGGAAT chr2 60497514 60497533 60497530 +
gattcatggcccctaacatc

SEQ ID NO: 186408 - DNA, 20 bp, Artificial Sequence
  Synthetic oligonucleotide; CTGGAT chr2 60497631 60497650 60497647 +
aataataataatagcttcca

SEQ ID NO: 186409 - DNA, 20 bp, Artificial Sequence
  Synthetic oligonucleotide; AAGGAT chr2 60497826 60497845 60497842 +
tccagtagagaaatgatcaa

SEQ ID NO: 186410 - DNA, 20 bp, Artificial Sequence
  Synthetic oligonucleotide; CAGGAT chr2 60497869 60497888 60497885 +
atgaaaccaagcttcctctg

SEQ ID NO: 186411 - DNA, 20 bp, Artificial Sequence
  Synthetic oligonucleotide; GAGGAT chr2 60497928 60497947 60497944 +
gacccaccgcttcattggcc

SEQ ID NO: 186412 - DNA, 20 bp, Artificial Sequence
  Synthetic oligonucleotide; CAGGGT chr2 60497948 60497967 60497964 +
gaggatgaccccataaaggt

SEQ ID NO: 186413 - DNA, 20 bp, Artificial Sequence
  Synthetic oligonucleotide; AGGGGT chr2 60498037 60498056 60498053 +
cctggcagaccctcaagagc

SEQ ID NO: 186414 - DNA, 20 bp, Artificial Sequence
  Synthetic oligonucleotide; TGGGGT chr2 60498079 60498098 60498095 +
gacatcactcttagcagggc

SEQ ID NO: 186415 - DNA, 20 bp, Artificial Sequence
  Synthetic oligonucleotide; GTGAGT chr2 60498083 60498102 60498099 +
tcactcttagcagggctggg

SEQ ID NO: 186416 - DNA, 20 bp, Artificial Sequence
  Synthetic oligonucleotide; GAGAAT chr2 60498100 60498119 60498116 +
ggggtgagtcaaaagtctgg

SEQ ID NO: 186417 - DNA, 20 bp, Artificial Sequence
  Synthetic oligonucleotide; GGGGAT chr2 60498117 60498136 60498133 +
tgggagaatggaggtgtgga

SEQ ID NO: 186418 - DNA, 20 bp, Artificial Sequence
  Synthetic oligonucleotide; CTGGGT chr2 60498125 60498144 60498141 +
tggaggtgtggaggggataa

SEQ ID NO: 186419 - DNA, 20 bp, Artificial Sequence
  Synthetic oligonucleotide; ACGGGT chr2 60498162 60498181 60498178 +
caggaagggcctctatgtag

SEQ ID NO: 186420 - DNA, 20 bp, Artificial Sequence
  Synthetic oligonucleotide; AGGGGT chr2 60498402 60498421 60498418 +
acccaggctgggctggacag

SEQ ID NO: 186421 - DNA, 20 bp, Artificial Sequence
  Synthetic oligonucleotide; CAGGGT chr2 60498420 60498439 60498436 +
agaggggtcccacaagatca

SEQ ID NO: 186422 - DNA, 20 bp, Artificial Sequence
  Synthetic oligonucleotide; TAGAAT chr2 60498520 60498539 60498536 +
cccatacccacttcccttcc

SEQ ID NO: 186423 - DNA, 20 bp, Artificial Sequence
  Synthetic oligonucleotide; ATGGAT chr2 60498802 60498821 60498818 +
ggcttaaggaagcctctctg

SEQ ID NO: 186424 - DNA, 20 bp, Artificial Sequence
  Synthetic oligonucleotide; TTGAAT chr2 60498839 60498858 60498855 +
tatgtaccttatacatacat

SEQ ID NO: 186425 - DNA, 20 bp, Artificial Sequence
  Synthetic oligonucleotide; GTGGGT chr2 60498933 60498952 60498949 +
acaggaagcaggtggtggtg

SEQ ID NO: 186426 - DNA, 20 bp, Artificial Sequence
  Synthetic oligonucleotide; AAGAAT chr2 60499028 60499047 60499044 +
ccacacaggcatccaaaggg

SEQ ID NO: 186427 - DNA, 20 bp, Artificial Sequence
  Synthetic oligonucleotide; GCGAGT chr2 60499217 60499236 60499233 +
gcaagacagccatgtgcaag

SEQ ID NO: 186428 - DNA, 20 bp, Artificial Sequence
  Synthetic oligonucleotide; GTGGAT chr2 60499221 60499240 60499237 +
gacagccatgtgcaaggcga

SEQ ID NO: 186429 - DNA, 20 bp, Artificial Sequence
  Synthetic oligonucleotide; AGGGGT chr2 60499257 60499276 60499273 +
cgtcactcccacagagctgc

SEQ ID NO: 186430 - DNA, 20 bp, Artificial Sequence
  Synthetic oligonucleotide; TAGAGT chr2 60499524 60499543 60499540 +
gactcatgtgtagctgactt

SEQ ID NO: 186431 - DNA, 20 bp, Artificial Sequence
  Synthetic oligonucleotide; AGGGGT chr2 60499676 60499695 60499692 +
catgaagctccccggaccaa

SEQ ID NO: 186432 - DNA, 20 bp, Artificial Sequence
  Synthetic oligonucleotide; TTGAGT chr2 60499710 60499729 60499726 +
ctgaaggaaaccgctcaacc

SEQ ID NO: 186433 - DNA, 20 bp, Artificial Sequence
  Synthetic oligonucleotide; TAGGGT chr2 60500130 60500149 60500146 +
ttgccctgggcactgagggc

SEQ ID NO: 186434 - DNA, 20 bp, Artificial Sequence
  Synthetic oligonucleotide; CTGGAT chr2 60500159 60500178 60500175 +
cagaggcctgcggctgtgcc

SEQ ID NO: 186435 - DNA, 20 bp, Artificial Sequence
  Synthetic oligonucleotide; GAGAGT chr2 60500230 60500249 60500246 +
tgtgtgagagcggtggtctt

SEQ ID NO: 186436 - DNA, 20 bp, Artificial Sequence
  Synthetic oligonucleotide; AGGGAT chr2 60500283 60500302 60500299 +
ggaggggacagggggcaggt

SEQ ID NO: 186437 - DNA, 20 bp, Artificial Sequence
  Synthetic oligonucleotide; AAGAAT chr2 60500513 60500532 60500529 +
cccctgagaaaaaatggcag

SEQ ID NO: 186438 - DNA, 20 bp, Artificial Sequence
  Synthetic oligonucleotide; TGGAAT chr2 60500540 60500559 60500556 +
gaagggactacgtgtattga

SEQ ID NO: 186439 - DNA, 20 bp, Artificial Sequence
  Synthetic oligonucleotide; CAGGGT chr2 60500581 60500600 60500597 +
cacttcccaactcctcagga

SEQ ID NO: 186440 - DNA, 20 bp, Artificial Sequence
  Synthetic oligonucleotide; GTGGAT chr2 60500721 60500740 60500737 +
gcacctcacttcaagccttg

SEQ ID NO: 186441 - DNA, 20 bp, Artificial Sequence
  Synthetic oligonucleotide; CTGGAT chr2 60500768 60500787 60500784 +
tcccaagttagacagatgag

SEQ ID NO: 186442 - DNA, 20 bp, Artificial Sequence
  Synthetic oligonucleotide; TGGGGT chr2 60500886 60500905 60500902 +
atgacattgtatggccaacc

SEQ ID NO: 186443 - DNA, 20 bp, Artificial Sequence
  Synthetic oligonucleotide; AAGAGT chr2 60500911 60500930 60500927 +
ttgctgatggaactagttaa

SEQ ID NO: 186444 - DNA, 20 bp, Artificial Sequence
  Synthetic oligonucleotide; CTGGGT chr2 60500936 60500955 60500952 +
tgtctgtgaagcaagcctag

SEQ ID NO: 186445 - DNA, 20 bp, Artificial Sequence
  Synthetic oligonucleotide; CTGGGT chr2 60500958 60500977 60500974 +
gggtgggcttgcaagcattt

SEQ ID NO: 186446 - DNA, 20 bp, Artificial Sequence
  Synthetic oligonucleotide; TGGAAT chr2 60501248 60501267 60501264 +
tgctacttgccagaacaaaa

SEQ ID NO: 186447 - DNA, 20 bp, Artificial Sequence
  Synthetic oligonucleotide; TCGGGT chr2 60501426 60501445 60501442 +
cctggtttgtaagttctctt

SEQ ID NO: 186448 - DNA, 20 bp, Artificial Sequence
  Synthetic oligonucleotide; CTGAGT chr2 60501438 60501457 60501454 +
gttctctttcgggtgcttcc

SEQ ID NO: 186449 - DNA, 20 bp, Artificial Sequence
  Synthetic oligonucleotide; CAGAGT chr2 60501511 60501530 60501527 +
ttttttttttttttttgaga

SEQ ID NO: 186450 - DNA, 20 bp, Artificial Sequence
  Synthetic oligonucleotide; TGGGGT chr2 60501537 60501556 60501553 +
ttcgctcttgttgcccaggc

SEQ ID NO: 186451 - DNA, 20 bp, Artificial Sequence
  Synthetic oligonucleotide; CTGGGT chr2 60501578 60501597 60501594 +
cggctcaccacctctgcctc

SEQ ID NO: 186452 - DNA, 20 bp, Artificial Sequence
  Synthetic oligonucleotide; CTGAGT chr2 60501610 60501629 60501626 +
aattctcctccctcagcctc

SEQ ID NO: 186453 - DNA, 20 bp, Artificial Sequence
  Synthetic oligonucleotide; TGGGAT chr2 60501619 60501638 60501635 +
ccctcagcctcctgagtagc

SEQ ID NO: 186454 - DNA, 20 bp, Artificial Sequence
  Synthetic oligonucleotide; TGGAAT chr2 60501753 60501772 60501769 +
acctcggcctcccaaagtgc

SEQ ID NO: 186455 - DNA, 20 bp, Artificial Sequence
  Synthetic oligonucleotide; GTGAAT chr2 60501932 60501951 60501948 +
ttattctaattattttacta

SEQ ID NO: 186456 - DNA, 20 bp, Artificial Sequence
  Synthetic oligonucleotide; TGGAAT chr2 60501940 60501959 60501956 +
attattttactagtgaatta

SEQ ID NO: 186457 - DNA, 20 bp, Artificial Sequence
  Synthetic oligonucleotide; CAGAAT chr2 60502128 60502147 60502144 +
acaatgcaactcaagactat

SEQ ID NO: 186458 - DNA, 20 bp, Artificial Sequence
  Synthetic oligonucleotide; ATGAAT chr2 60502137 60502156 60502153 +
ctcaagactatcagaatgat

SEQ ID NO: 186459 - DNA, 20 bp, Artificial Sequence
  Synthetic oligonucleotide; ATGGAT chr2 60502244 60502263 60502260 +
aaagctggtgaaacaaaatg

SEQ ID NO: 186460 - DNA, 20 bp, Artificial Sequence
  Synthetic oligonucleotide; GGGAGT chr2 60502276 60502295 60502292 +
tttgctgagctccaaagtca

SEQ ID NO: 186461 - DNA, 20 bp, Artificial Sequence
  Synthetic oligonucleotide; CAGAAT chr2 60502392 60502411 60502408 +
gcctaataaaactgcacaga

SEQ ID NO: 186462 - DNA, 20 bp, Artificial Sequence
  Synthetic oligonucleotide; AAGAGT chr2 60502418 60502437 60502434 +
aacttcttcatcagattcag

SEQ ID NO: 186463 - DNA, 20 bp, Artificial Sequence
  Synthetic oligonucleotide; GGGGGT chr2 60502428 60502447 60502444 +
tcagattcagaagagtagca

SEQ ID NO: 186464 - DNA, 20 bp, Artificial Sequence
  Synthetic oligonucleotide; TGGGAT chr2 60502488 60502507 60502504 +
acactttgtacatacaattc

SEQ ID NO: 186465 - DNA, 20 bp, Artificial Sequence
  Synthetic oligonucleotide; ATGAAT chr2 60502598 60502617 60502614 +
atgctttctaatattaaaat

SEQ ID NO: 186466 - DNA, 20 bp, Artificial Sequence
  Synthetic oligonucleotide; GAGAAT chr2 60502833 60502852 60502849 +
gggaggtacttaatctctaa

SEQ ID NO: 186467 - DNA, 20 bp, Artificial Sequence
  Synthetic oligonucleotide; TCGAGT chr2 60502845 60502864 60502861 +
atctctaagagaatcaagtc

SEQ ID NO: 186468 - DNA, 20 bp, Artificial Sequence
  Synthetic oligonucleotide; GTGGGT chr2 60502849 60502868 60502865 +
ctaagagaatcaagtctcga

SEQ ID NO: 186469 - DNA, 20 bp, Artificial Sequence
  Synthetic oligonucleotide; AGGAGT chr2 60502870 60502889 60502886 +
tgggtaaaatgagctgggga

SEQ ID NO: 186470 - DNA, 20 bp, Artificial Sequence
  Synthetic oligonucleotide; GGGGAT chr2 60502988 60503007 60503004 +
ttaaggcctgggctgtctag

SEQ ID NO: 186471 - DNA, 20 bp, Artificial Sequence
  Synthetic oligonucleotide; CGGAAT chr2 60503042 60503061 60503058 +
gtctgtcatcttaatacaca

SEQ ID NO: 186472 - DNA, 20 bp, Artificial Sequence
  Synthetic oligonucleotide; AGGAAT chr2 60503121 60503140 60503137 +
tttgtcctggcaatgggagc

SEQ ID NO: 186473 - DNA, 20 bp, Artificial Sequence
  Synthetic oligonucleotide; ATGAGT chr2 60503125 60503144 60503141 +
tcctggcaatgggagcagga

SEQ ID NO: 186474 - DNA, 20 bp, Artificial Sequence
  Synthetic oligonucleotide; CAGAAT chr2 60503242 60503261 60503258 +
gctctgaccaggtggaaagc

SEQ ID NO: 186475 - DNA, 20 bp, Artificial Sequence
  Synthetic oligonucleotide; TGGGGT chr2 60503247 60503266 60503263 +
gaccaggtggaaagccagaa

SEQ ID NO: 186476 - DNA, 20 bp, Artificial Sequence
  Synthetic oligonucleotide; CTGAGT chr2 60503540 60503559 60503556 +
ataatgtgtggcgctcaggt

SEQ ID NO: 186477 - DNA, 20 bp, Artificial Sequence
  Synthetic oligonucleotide; CTGGAT chr2 60503788 60503807 60503804 +
ccactgcaagggacaatatt

SEQ ID NO: 186478 - DNA, 20 bp, Artificial Sequence
  Synthetic oligonucleotide; GGGAAT chr2 60503947 60503966 60503963 +
aaggaacgagggggcagaga

SEQ ID NO: 186479 - DNA, 20 bp, Artificial Sequence
  Synthetic oligonucleotide; CTGAGT chr2 60503961 60503980 60503977 +
cagagagggaatgaaagaca

SEQ ID NO: 186480 - DNA, 20 bp, Artificial Sequence
  Synthetic oligonucleotide; AAGAGT chr2 60504054 60504073 60504070 +
ggcacattctgagaactctg

SEQ ID NO: 186481 - DNA, 20 bp, Artificial Sequence
  Synthetic oligonucleotide; CAGGAT chr2 60504245 60504264 60504261 +
gctgcctaccggcacgcatg

SEQ ID NO: 186482 - DNA, 20 bp, Artificial Sequence
  Synthetic oligonucleotide; CTGGGT chr2 60504274 60504293 60504290 +
tgatgaagatgcagtacctt

SEQ ID NO: 186483 - DNA, 20 bp, Artificial Sequence
  Synthetic oligonucleotide; CTGGGT chr2 60504284 60504303 60504300 +
gcagtaccttctgggtctgc

SEQ ID NO: 186484 - DNA, 20 bp, Artificial Sequence
  Synthetic oligonucleotide; CTGAAT chr2 60504367 60504386 60504383 +
aggcagaggaggccacctat

SEQ ID NO: 186485 - DNA, 20 bp, Artificial Sequence
  Synthetic oligonucleotide; TAGGAT chr2 60504375 60504394 60504391 +
gaggccacctatctgaatgc

SEQ ID NO: 186486 - DNA, 20 bp, Artificial Sequence
  Synthetic oligonucleotide; AGGAAT chr2 60504427 60504446 60504443 +
ccagcctgctctcccaaaga

SEQ ID NO: 186487 - DNA, 20 bp, Artificial Sequence
  Synthetic oligonucleotide; CAGAAT chr2 60504559 60504578 60504575 +
ccaaggcaaaaagcaaatag

SEQ ID NO: 186488 - DNA, 20 bp, Artificial Sequence
  Synthetic oligonucleotide; ATGAGT chr2 60504563 60504582 60504579 +
ggcaaaaagcaaatagcaga

SEQ ID NO: 186489 - DNA, 20 bp, Artificial Sequence
  Synthetic oligonucleotide; TGGAAT chr2 60504753 60504772 60504769 +
cttgaaattatatagagagg

SEQ ID NO: 186490 - DNA, 20 bp, Artificial Sequence
  Synthetic oligonucleotide; TGGGGT chr2 60504945 60504964 60504961 +
gtgtgcaggctgtggaagcg

SEQ ID NO: 186491 - DNA, 20 bp, Artificial Sequence
  Synthetic oligonucleotide; AGGAGT chr2 60504966 60504985 60504982 +
ggggtggacccagaagtata

SEQ ID NO: 186492 - DNA, 20 bp, Artificial Sequence
  Synthetic oligonucleotide; CTGGAT chr2 60504973 60504992 60504989 +
acccagaagtataaggagtt

SEQ ID NO: 186493 - DNA, 20 bp, Artificial Sequence
  Synthetic oligonucleotide; CAGAAT chr2 60504979 60504998 60504995 +
aagtataaggagttctggat

SEQ ID NO: 186494 - DNA, 20 bp, Artificial Sequence
  Synthetic oligonucleotide; CAGGGT chr2 60505070 60505089 60505086 +
ccctttctcctgcctcttca

SEQ ID NO: 186495 - DNA, 20 bp, Artificial Sequence
  Synthetic oligonucleotide; GTGAGT chr2 60505086 60505105 60505102 +
ttcacagggttactcatgag

SEQ ID NO: 186496 - DNA, 20 bp, Artificial Sequence
  Synthetic oligonucleotide; AGGGAT chr2 60505185 60505204 60505201 +
cagcacaatggacattcgaa

SEQ ID NO: 186497 - DNA, 20 bp, Artificial Sequence
  Synthetic oligonucleotide; GAGGAT chr2 60505222 60505241 60505238 +
ttcataagccaaaaaagcta

SEQ ID NO: 186498 - DNA, 20 bp, Artificial Sequence
  Synthetic oligonucleotide; ACGGAT chr2 60505245 60505264 60505261 +
gatcggagagaaaagaaggg

SEQ ID NO: 186499 - DNA, 20 bp, Artificial Sequence
  Synthetic oligonucleotide; AAGGGT chr2 60505267 60505286 60505283 +
ggatactcagaaacggcttc

SEQ ID NO: 186500 - DNA, 20 bp, Artificial Sequence
  Synthetic oligonucleotide; CCGAGT chr2 60505422 60505441 60505438 +
atcactcatcaggtagtcag

SEQ ID NO: 186501 - DNA, 20 bp, Artificial Sequence
  Synthetic oligonucleotide; GCGGGT chr2 60505474 60505493 60505490 +
tgcatccacacagggaacaa

SEQ ID NO: 186502 - DNA, 20 bp, Artificial Sequence
  Synthetic oligonucleotide; GAGAGT chr2 60505638 60505657 60505654 +
tcttcaggctgccagagcaa

SEQ ID NO: 186503 - DNA, 20 bp, Artificial Sequence
  Synthetic oligonucleotide; GAGGGT chr2 60505717 60505736 60505733 +
cagctggccactctgtgacg

SEQ ID NO: 186504 - DNA, 20 bp, Artificial Sequence
  Synthetic oligonucleotide; GTGGGT chr2 60505721 60505740 60505737 +
tggccactctgtgacggagg

SEQ ID NO: 186505 - DNA, 20 bp, Artificial Sequence
  Synthetic oligonucleotide; CTGGGT chr2 60505738 60505757 60505754 +
agggtgggtaacctctctac

SEQ ID NO: 186506 - DNA, 20 bp, Artificial Sequence
  Synthetic oligonucleotide; TAGAAT chr2 60505753 60505772 60505769 +
tctacctgggtctatcattt

SEQ ID NO: 186507 - DNA, 20 bp, Artificial Sequence
  Synthetic oligonucleotide; CAGGGT chr2 60505980 60505999 60505996 +
ataacccaaatagggctttg

SEQ ID NO: 186508 - DNA, 20 bp, Artificial Sequence
  Synthetic oligonucleotide; CCGGGT chr2 60506013 60506032 60506029 +
accacactaggctttgcagc

SEQ ID NO: 186509 - DNA, 20 bp, Artificial Sequence
  Synthetic oligonucleotide; GTGAAT chr2 60506043 60506062 60506059 +
ccagatggtgcgagaagata

SEQ ID NO: 186510 - DNA, 20 bp, Artificial Sequence
  Synthetic oligonucleotide; AGGGAT chr2 60506061 60506080 60506077 +
tagtgaatcactcataggca

SEQ ID NO: 186511 - DNA, 20 bp, Artificial Sequence
  Synthetic oligonucleotide; AAGAGT chr2 60506269 60506288 60506285 +
aattctctctgcatcagagg

SEQ ID NO: 186512 - DNA, 20 bp, Artificial Sequence
  Synthetic oligonucleotide; ATGGGT chr2 60506420 60506439 60506436 +
gagctggctcaggacgccac

SEQ ID NO: 186513 - DNA, 20 bp, Artificial Sequence
  Synthetic oligonucleotide; CTGAGT chr2 60506527 60506546 60506543 +
agccggccccagctggcatg

SEQ ID NO: 186514 - DNA, 20 bp, Artificial Sequence
  Synthetic oligonucleotide; ATGGGT chr2 60506772 60506791 60506788 +
tataatgctgagatttatac

SEQ ID NO: 186515 - DNA, 20 bp, Artificial Sequence
  Synthetic oligonucleotide; TGGGAT chr2 60506883 60506902 60506899 +
tggcattatctaatttaact

SEQ ID NO: 186516 - DNA, 20 bp, Artificial Sequence
  Synthetic oligonucleotide; AAGGAT chr2 60507136 60507155 60507152 +
atcccaacagacagagggcc

SEQ ID NO: 186517 - DNA, 20 bp, Artificial Sequence
  Synthetic oligonucleotide; CAGAAT chr2 60507162 60507181 60507178 +
taaatgctcttctagctctg

SEQ ID NO: 186518 - DNA, 20 bp, Artificial Sequence
  Synthetic oligonucleotide; TGGAGT chr2 60507514 60507533 60507530 +
ttttacattttcagatgttt

SEQ ID NO: 186519 - DNA, 20 bp, Artificial Sequence
  Synthetic oligonucleotide; CAGAGT chr2 60507593 60507612 60507609 +
ttcaacagctcactgcataa

SEQ ID NO: 186520 - DNA, 20 bp, Artificial Sequence
  Synthetic oligonucleotide; GCGGGT chr2 60507733 60507752 60507749 +
caaacagcacaagacagaaa

SEQ ID NO: 186521 - DNA, 20 bp, Artificial Sequence
  Synthetic oligonucleotide; TGGGGT chr2 60507738 60507757 60507754 +
agcacaagacagaaagcggg

SEQ ID NO: 186522 - DNA, 20 bp, Artificial Sequence
  Synthetic oligonucleotide; ACGGGT chr2 60507752 60507771 60507768 +
agcgggtggggtggggggcg

SEQ ID NO: 186523 - DNA, 20 bp, Artificial Sequence
  Synthetic oligonucleotide; TGGGAT chr2 60507857 60507876 60507873 +
taacaaaggacagcatacta

SEQ ID NO: 186524 - DNA, 20 bp, Artificial Sequence
  Synthetic oligonucleotide; ATGGAT chr2 60507870 60507889 60507886 +
catactatgggataattact

SEQ ID NO: 186525 - DNA, 20 bp, Artificial Sequence
  Synthetic oligonucleotide; TGGGGT chr2 60507986 60508005 60508002 +
gtcttcggtgttggttccta

SEQ ID NO: 186526 - DNA, 20 bp, Artificial Sequence
  Synthetic oligonucleotide; ACGGAT chr2 60507993 60508012 60508009 +
gtgttggttcctatggggtt

SEQ ID NO: 186527 - DNA, 20 bp, Artificial Sequence
  Synthetic oligonucleotide; CTGGGT chr2 60508309 60508328 60508325 +
agaggagacagagaagcttc

SEQ ID NO: 186528 - DNA, 20 bp, Artificial Sequence
  Synthetic oligonucleotide; CAGAAT chr2 60508318 60508337 60508334 +
agagaagcttcctgggtgtg

SEQ ID NO: 186529 - DNA, 20 bp, Artificial Sequence
  Synthetic oligonucleotide; CCGGGT chr2 60508374 60508393 60508390 +
cacaggagcaagcactgcag

SEQ ID NO: 186530 - DNA, 20 bp, Artificial Sequence
  Synthetic oligonucleotide; CTGAGT chr2 60508382 60508401 60508398 +
caagcactgcagccgggtcc

SEQ ID NO: 186531 - DNA, 20 bp, Artificial Sequence
  Synthetic oligonucleotide; GGGGGT chr2 60508406 60508425 60508422 +
gtctgacttttacccaaaca

SEQ ID NO: 186532 - DNA, 20 bp, Artificial Sequence
  Synthetic oligonucleotide; AGGAAT chr2 60508461 60508480 60508477 +
gcacattacctagttggcaa

SEQ ID NO: 186533 - DNA, 20 bp, Artificial Sequence
  Synthetic oligonucleotide; TGGAAT chr2 60508482 60508501 60508498 +
ggaatgcaactgggaggttc

SEQ ID NO: 186534 - DNA, 20 bp, Artificial Sequence
  Synthetic oligonucleotide; CGGGAT chr2 60508546 60508565 60508562 +
aagaggactttgctttcctc

SEQ ID NO: 186535 - DNA, 20 bp, Artificial Sequence
  Synthetic oligonucleotide; GAGAAT chr2 60508628 60508647 60508644 +
ccaaagagaagcgttgctag

SEQ ID NO: 186536 - DNA, 20 bp, Artificial Sequence
  Synthetic oligonucleotide; GGGAAT chr2 60508699 60508718 60508715 +
cgctcagctacaggggccgt

SEQ ID NO: 186537 - DNA, 20 bp, Artificial Sequence
  Synthetic oligonucleotide; GAGGGT chr2 60508729 60508748 60508745 +
ggaggcctgtgcatttccct

SEQ ID NO: 186538 - DNA, 20 bp, Artificial Sequence
  Synthetic oligonucleotide; TTGGGT chr2 60508796 60508815 60508812 +
actcttctctgagctccccc

SEQ ID NO: 186539 - DNA, 20 bp, Artificial Sequence
  Synthetic oligonucleotide; AAGAGT chr2 60508817 60508836 60508833 +
tgggttacctatgattccag

SEQ ID NO: 186540 - DNA, 20 bp, Artificial Sequence
  Synthetic oligonucleotide; AGGGAT chr2 60508887 60508906 60508903 +
gaaacctaaggcctaccttg

SEQ ID NO: 186541 - DNA, 20 bp, Artificial Sequence
  Synthetic oligonucleotide; TTGAAT chr2 60508933 60508952 60508949 +
actgctacttaaggtgtctt

SEQ ID NO: 186542 - DNA, 20 bp, Artificial Sequence
  Synthetic oligonucleotide; TTGGAT chr2 60509189 60509208 60509205 +
tggtctcagctttggctggc

SEQ ID NO: 186543 - DNA, 20 bp, Artificial Sequence
  Synthetic oligonucleotide; GAGGAT chr2 60509200 60509219 60509216 +
ttggctggcttggatgttat

SEQ ID NO: 186544 - DNA, 20 bp, Artificial Sequence
  Synthetic oligonucleotide; AAGAAT chr2 60509209 60509228 60509225 +
ttggatgttatgaggattcc

SEQ ID NO: 186545 - DNA, 20 bp, Artificial Sequence
  Synthetic oligonucleotide; ACGGAT chr2 60509336 60509355 60509352 +
aacctgtggaaaagaggaca

SEQ ID NO: 186546 - DNA, 20 bp, Artificial Sequence
  Synthetic oligonucleotide; GAGAGT chr2 60509448 60509467 60509464 +
agcacaagacacgtggcagt

SEQ ID NO: 186547 - DNA, 20 bp, Artificial Sequence
  Synthetic oligonucleotide; CTGGAT chr2 60509588 60509607 60509604 +
aagaaacaaagcgcatcttt

SEQ ID NO: 186548 - DNA, 20 bp, Artificial Sequence
  Synthetic oligonucleotide; TGGGGT chr2 60509934 60509953 60509950 +
agtcaccgagccacacattt

SEQ ID NO: 186549 - DNA, 20 bp, Artificial Sequence
  Synthetic oligonucleotide; CAGAAT chr2 60510021 60510040 60510037 +
ttttcccttcgaagtatgtc

SEQ ID NO: 186550 - DNA, 20 bp, Artificial Sequence
  Synthetic oligonucleotide; TTGAGT chr2 60510121 60510140 60510137 +
tctgcctcactttcccatgc

SEQ ID NO: 186551 - DNA, 20 bp, Artificial Sequence
  Synthetic oligonucleotide; TGGAGT chr2 60510203 60510222 60510219 +
ccagtggcttccatctccct

SEQ ID NO: 186552 - DNA, 20 bp, Artificial Sequence
  Synthetic oligonucleotide; GGGGGT chr2 60510590 60510609 60510606 +
tgtctctccccagctagaaa

SEQ ID NO: 186553 - DNA, 20 bp, Artificial Sequence
  Synthetic oligonucleotide; GGGAGT chr2 60510608 60510627 60510624 +
aagggggtgccacaagagca

SEQ ID NO: 186554 - DNA, 20 bp, Artificial Sequence
  Synthetic oligonucleotide; ATGAAT chr2 60510688 60510707 60510704 +
ttcaaaatatttgttgaaaa

SEQ ID NO: 186555 - DNA, 20 bp, Artificial Sequence
  Synthetic oligonucleotide; ATGAGT chr2 60510692 60510711 60510708 +
aaatatttgttgaaaaatga

SEQ ID NO: 186556 - DNA, 20 bp, Artificial Sequence
  Synthetic oligonucleotide; TTGGAT chr2 60510786 60510805 60510802 +
aacctgggggcactttagct

SEQ ID NO: 186557 - DNA, 20 bp, Artificial Sequence
  Synthetic oligonucleotide; TTGGGT chr2 60510793 60510812 60510809 +
gggcactttagctttggatc

SEQ ID NO: 186558 - DNA, 20 bp, Artificial Sequence
  Synthetic oligonucleotide; AGGGGT chr2 60510872 60510891 60510888 +
ttgcattataatgtaaatgg

SEQ ID NO: 186559 - DNA, 20 bp, Artificial Sequence
  Synthetic oligonucleotide; CAGAGT chr2 60511007 60511026 60511023 +
gccaaccaccagcagttcct

SEQ ID NO: 186560 - DNA, 20 bp, Artificial Sequence
  Synthetic oligonucleotide; CGGGAT chr2 60511245 60511264 60511261 +
atcccttctacctgagagcc

SEQ ID NO: 186561 - DNA, 20 bp, Artificial Sequence
  Synthetic oligonucleotide; GTGAAT chr2 60511303 60511322 60511319 +
cctagcatacaatttgacag

SEQ ID NO: 186562 - DNA, 20 bp, Artificial Sequence
  Synthetic oligonucleotide; CTGAAT chr2 60511343 60511362 60511359 +
aggcaataacaaggagaagt

SEQ ID NO: 186563 - DNA, 20 bp, Artificial Sequence
  Synthetic oligonucleotide; GGGAGT chr2 60511771 60511790 60511787 +
tgtaagacactaaggggcag

SEQ ID NO: 186564 - DNA, 20 bp, Artificial Sequence
  Synthetic oligonucleotide; AAGGGT chr2 60511822 60511841 60511838 +
cactctgtttctatgaaggc

SEQ ID NO: 186565 - DNA, 20 bp, Artificial Sequence
  Synthetic oligonucleotide; ATGAAT chr2 60512041 60512060 60512057 +
agtgtcacagtcactccaaa

SEQ ID NO: 186566 - DNA, 20 bp, Artificial Sequence
  Synthetic oligonucleotide; CAGAAT chr2 60512269 60512288 60512285 +
cgatgcgctgatgtggaact

SEQ ID NO: 186567 - DNA, 20 bp, Artificial Sequence
  Synthetic oligonucleotide; CTGGGT chr2 60512312 60512331 60512328 +
ggctgagctgtgctaggtaa

SEQ ID NO: 186568 - DNA, 20 bp, Artificial Sequence
  Synthetic oligonucleotide; AAGGAT chr2 60512395 60512414 60512411 +
acatcttgctctcaggtata

SEQ ID NO: 186569 - DNA, 20 bp, Artificial Sequence
  Synthetic oligonucleotide; GAGGAT chr2 60512468 60512487 60512484 +
tgagaaaggcagctttgaga

SEQ ID NO: 186570 - DNA, 20 bp, Artificial Sequence
  Synthetic oligonucleotide; GAGAGT chr2 60512526 60512545 60512542 +
acctatcacaatgctctgca

SEQ ID NO: 186571 - DNA, 20 bp, Artificial Sequence
  Synthetic oligonucleotide; ATGAGT chr2 60512781 60512800 60512797 +
tctcttttagtgtctcaagt

SEQ ID NO: 186572 - DNA, 20 bp, Artificial Sequence
  Synthetic oligonucleotide; ACGGAT chr2 60512798 60512817 60512814 +
agtatgagtcacctctgatg

SEQ ID NO: 186573 - DNA, 20 bp, Artificial Sequence
  Synthetic oligonucleotide; ATGAAT chr2 60512846 60512865 60512862 +
acaatacacacctaaagtaa

SEQ ID NO: 186574 - DNA, 20 bp, Artificial Sequence
  Synthetic oligonucleotide; AGGAGT chr2 60512907 60512926 60512923 +
tttggaggagacacagagaa

SEQ ID NO: 186575 - DNA, 20 bp, Artificial Sequence
  Synthetic oligonucleotide; ACGAGT chr2 60512977 60512996 60512993 +
aacacacagagcaacagctg

SEQ ID NO: 186576 - DNA, 20 bp, Artificial Sequence
  Synthetic oligonucleotide; AGGGAT chr2 60513071 60513090 60513087 +
caccatttgaggagaggttc

SEQ ID NO: 186577 - DNA, 20 bp, Artificial Sequence
  Synthetic oligonucleotide; ATGGAT chr2 60513106 60513125 60513122 +
tcaccaccccactgaaatcc

SEQ ID NO: 186578 - DNA, 20 bp, Artificial Sequence
  Synthetic oligonucleotide; AGGGGT chr2 60513125 60513144 60513141 +
catggatagtctagcctgtg

SEQ ID NO: 186579 - DNA, 20 bp, Artificial Sequence
  Synthetic oligonucleotide; GGGGGT chr2 60513132 60513151 60513148 +
agtctagcctgtgaggggtt

SEQ ID NO: 186580 - DNA, 20 bp, Artificial Sequence
  Synthetic oligonucleotide; CAGAGT chr2 60513180 60513199 60513196 +
atctttgagcggctcttccc

SEQ ID NO: 186581 - DNA, 20 bp, Artificial Sequence
  Synthetic oligonucleotide; CAGGAT chr2 60513186 60513205 60513202 +
gagcggctcttccccagagt

SEQ ID NO: 186582 - DNA, 20 bp, Artificial Sequence
  Synthetic oligonucleotide; AGGAAT chr2 60513293 60513312 60513309 +
tatgagacaaggaggggaca

SEQ ID NO: 186583 - DNA, 20 bp, Artificial Sequence
  Synthetic oligonucleotide; AGGAGT chr2 60513307 60513326 60513323 +
gggacaaggaatttagtccc

SEQ ID NO: 186584 - DNA, 20 bp, Artificial Sequence
  Synthetic oligonucleotide; AGGAGT chr2 60513322 60513341 60513338 +
gtcccaggagtggcactaga

SEQ ID NO: 186585 - DNA, 20 bp, Artificial Sequence
  Synthetic oligonucleotide; CCGGGT chr2 60513352 60513371 60513368 +
gctccctcaggagccatctg

SEQ ID NO: 186586 - DNA, 20 bp, Artificial Sequence
  Synthetic oligonucleotide; GTGGGT chr2 60513464 60513483 60513480 +
tgggaacccctttggcaggt

SEQ ID NO: 186587 - DNA, 20 bp, Artificial Sequence
  Synthetic oligonucleotide; TTGGGT chr2 60513471 60513490 60513487 +
ccctttggcaggtgtgggtg

SEQ ID NO: 186588 - DNA, 20 bp, Artificial Sequence
  Synthetic oligonucleotide; CTGGAT chr2 60513537 60513556 60513553 +
agcaaatcttcatgtcctgt

SEQ ID NO: 186589 - DNA, 20 bp, Artificial Sequence
  Synthetic oligonucleotide; CTGAAT chr2 60513567 60513586 60513583 +
ccagtcctgccctctctctt

SEQ ID NO: 186590 - DNA, 20 bp, Artificial Sequence
  Synthetic oligonucleotide; ATGAAT chr2 60513633 60513652 60513649 +
ccactcacacgctaaagtaa

SEQ ID NO: 186591 - DNA, 20 bp, Artificial Sequence
  Synthetic oligonucleotide; CTGAGT chr2 60513728 60513747 60513744 +
cactctctgggaaaatagaa

SEQ ID NO: 186592 - DNA, 20 bp, Artificial Sequence
  Synthetic oligonucleotide; CTGGGT chr2 60513757 60513776 60513773 +
agctctagcactgggcacag

SEQ ID NO: 186593 - DNA, 20 bp, Artificial Sequence
  Synthetic oligonucleotide; AAGGGT chr2 60513774 60513793 60513790 +
cagctgggtcagcacctacg

SEQ ID NO: 186594 - DNA, 20 bp, Artificial Sequence
  Synthetic oligonucleotide; CTGGAT chr2 60513909 60513928 60513925 +
cttgtggtgagcaaaactcc

SEQ ID NO: 186595 - DNA, 20 bp, Artificial Sequence
  Synthetic oligonucleotide; TTGAGT chr2 60513914 60513933 60513930 +
ggtgagcaaaactccctgga

SEQ ID NO: 186596 - DNA, 20 bp, Artificial Sequence
  Synthetic oligonucleotide; CTGGAT chr2 60513926 60513945 60513942 +
tccctggattgagtcgagac

SEQ ID NO: 186597 - DNA, 20 bp, Artificial Sequence
  Synthetic oligonucleotide; TTGAAT chr2 60513947 60513966 60513963 +
tggattctagttccactact

SEQ ID NO: 186598 - DNA, 20 bp, Artificial Sequence
  Synthetic oligonucleotide; TGGGAT chr2 60514259 60514278 60514275 +
aggaacaccccggccactgg

SEQ ID NO: 186599 - DNA, 20 bp, Artificial Sequence
  Synthetic oligonucleotide; TAGAAT chr2 60514344 60514363 60514360 +
gagaacaagccatctgaaaa

SEQ ID NO: 186600 - DNA, 20 bp, Artificial Sequence
  Synthetic oligonucleotide; GTGGGT chr2 60514410 60514429 60514426 +
attttgggaggccgaggcgt

SEQ ID NO: 186601 - DNA, 20 bp, Artificial Sequence
  Synthetic oligonucleotide; AGGAGT chr2 60514427 60514446 60514443 +
cgtgtgggtcacctgaggtc

SEQ ID NO: 186602 - DNA, 20 bp, Artificial Sequence
  Synthetic oligonucleotide; GAGAAT chr2 60514556 60514575 60514572 +
tacttgggaggctgaggcag

SEQ ID NO: 186603 - DNA, 20 bp, Artificial Sequence
  Synthetic oligonucleotide; TTGGGT chr2 60514668 60514687 60514684 +
aaaaaaaaaaaaaaattaaa

SEQ ID NO: 186604 - DNA, 20 bp, Artificial Sequence
  Synthetic oligonucleotide; GGGAGT chr2 60514676 60514695 60514692 +
aaaaaaattaaattgggtgg

SEQ ID NO: 186605 - DNA, 20 bp, Artificial Sequence
  Synthetic oligonucleotide; CAGAGT chr2 60514698 60514717 60514714 +
gagtttcttaggaaaaaaat

SEQ ID NO: 186606 - DNA, 20 bp, Artificial Sequence
  Synthetic oligonucleotide; AAGGGT chr2 60514750 60514769 60514766 +
ctgtctttacaacacaatga

SEQ ID NO: 186607 - DNA, 20 bp, Artificial Sequence
  Synthetic oligonucleotide; GTGAAT chr2 60514774 60514793 60514790 +
gtaaggcaccataagaggct

SEQ ID NO: 186608 - DNA, 20 bp, Artificial Sequence
  Synthetic oligonucleotide; GAGGAT chr2 60514793 60514812 60514809 +
tgtgaattccattgataaga

SEQ ID NO: 186609 - DNA, 20 bp, Artificial Sequence
  Synthetic oligonucleotide; GAGAAT chr2 60514890 60514909 60514906 +
aagagagacagagagagaga

SEQ ID NO: 186610 - DNA, 20 bp, Artificial Sequence
  Synthetic oligonucleotide; CAGAAT chr2 60515008 60515027 60515024 +
gacaggctctagcttgtttc

SEQ ID NO: 186611 - DNA, 20 bp, Artificial Sequence
  Synthetic oligonucleotide; AAGGAT chr2 60515075 60515094 60515091 +
ccaaagtgttgcccagacct

SEQ ID NO: 186612 - DNA, 20 bp, Artificial Sequence
  Synthetic oligonucleotide; CAGAAT chr2 60515129 60515148 60515145 +
tggcttccaggtgagcgaga

SEQ ID NO: 186613 - DNA, 20 bp, Artificial Sequence
  Synthetic oligonucleotide; CAGAGT chr2 60515142 60515161 60515158 +
agcgagacagaatctgcaag

SEQ ID NO: 186614 - DNA, 20 bp, Artificial Sequence
  Synthetic oligonucleotide; TGGGGT chr2 60515162 60515181 60515178 +
cagagttcactgcttgacca

SEQ ID NO: 186615 - DNA, 20 bp, Artificial Sequence
  Synthetic oligonucleotide; GGGGAT chr2 60515289 60515308 60515305 +
ccttccctggacagggagct

SEQ ID NO: 186616 - DNA, 20 bp, Artificial Sequence
  Synthetic oligonucleotide; GTGAAT chr2 60515471 60515490 60515487 +
aaatacacccacgagccaat

SEQ ID NO: 186617 - DNA, 20 bp, Artificial Sequence
  Synthetic oligonucleotide; CAGAGT chr2 60515503 60515522 60515519 +
gatccccttttaactaatcc

SEQ ID NO: 186618 - DNA, 20 bp, Artificial Sequence
  Synthetic oligonucleotide; CAGAGT chr2 60515541 60515560 60515557 +
aaagaaagccaagttgctga

SEQ ID NO: 186619 - DNA, 20 bp, Artificial Sequence
  Synthetic oligonucleotide; GTGGGT chr2 60515695 60515714 60515711 +
caggcagggagaaagtggtg

SEQ ID NO: 186620 - DNA, 20 bp, Artificial Sequence
  Synthetic oligonucleotide; GTGAGT chr2 60515714 60515733 60515730 +
ggtgggtggcggacagagat

SEQ ID NO: 186621 - DNA, 20 bp, Artificial Sequence
  Synthetic oligonucleotide; GGGGAT chr2 60515839 60515858 60515855 +
ccactgtgaggtcttactgt

SEQ ID NO: 186622 - DNA, 20 bp, Artificial Sequence
  Synthetic oligonucleotide; CCGAGT chr2 60515847 60515866 60515863 +
aggtcttactgtggggatta

SEQ ID NO: 186623 - DNA, 20 bp, Artificial Sequence
  Synthetic oligonucleotide; GGGAAT chr2 60515911 60515930 60515927 +
attcgagaaagatccaataa

SEQ ID NO: 186624 - DNA, 20 bp, Artificial Sequence
  Synthetic oligonucleotide; AGGGGT chr2 60515950 60515969 60515966 +
cgctgggccaacacccacgg

SEQ ID NO: 186625 - DNA, 20 bp, Artificial Sequence
  Synthetic oligonucleotide; TGGAAT chr2 60515958 60515977 60515974 +
caacacccacggaggggtcc

SEQ ID NO: 186626 - DNA, 20 bp, Artificial Sequence
  Synthetic oligonucleotide; TGGAGT chr2 60515974 60515993 60515990 +
gtcctggaatacaaataccc

SEQ ID NO: 186627 - DNA, 20 bp, Artificial Sequence
  Synthetic oligonucleotide; CTGGGT chr2 60516031 60516050 60516047 +
tcaattatgtcttcattgaa

SEQ ID NO: 186628 - DNA, 20 bp, Artificial Sequence
  Synthetic oligonucleotide; AGGGAT chr2 60516053 60516072 60516069 +
gggttatgaaaaagggaagc

SEQ ID NO: 186629 - DNA, 20 bp, Artificial Sequence
  Synthetic oligonucleotide; TTGGGT chr2 60516107 60516126 60516123 +
tgtgatgactcatgccagct

SEQ ID NO: 186630 - DNA, 20 bp, Artificial Sequence
  Synthetic oligonucleotide; GGGAAT chr2 60516320 60516339 60516336 +
cttggctctgctggctcaca

SEQ ID NO: 186631 - DNA, 20 bp, Artificial Sequence
  Synthetic oligonucleotide; AGGAGT chr2 60516566 60516585 60516582 +
gaagtcagggaactcgtgtc

SEQ ID NO: 186632 - DNA, 20 bp, Artificial Sequence
  Synthetic oligonucleotide; TGGGAT chr2 60516614 60516633 60516630 +
caaggacagagaggggcacc

SEQ ID NO: 186633 - DNA, 20 bp, Artificial Sequence
  Synthetic oligonucleotide; GGGAGT chr2 60516646 60516665 60516662 +
aatgtggcatcaggacaact

SEQ ID NO: 186634 - DNA, 20 bp, Artificial Sequence
  Synthetic oligonucleotide; ATGAGT chr2 60516719 60516738 60516735 +
tagtggacaccaagctgagc

SEQ ID NO: 186635 - DNA, 20 bp, Artificial Sequence
  Synthetic oligonucleotide; AAGAGT chr2 60516766 60516785 60516782 +
taaaaaagcaagcaggacat

SEQ ID NO: 186636 - DNA, 20 bp, Artificial Sequence
  Synthetic oligonucleotide; AAGAAT chr2 60516787 60516806 60516803 +
agagtgcagacataagacta

SEQ ID NO: 186637 - DNA, 20 bp, Artificial Sequence
  Synthetic oligonucleotide; TTGAGT chr2 60516847 60516866 60516863 +
tgtagttatcagactaatgt

SEQ ID NO: 186638 - DNA, 20 bp, Artificial Sequence
  Synthetic oligonucleotide; ATGGGT chr2 60516903 60516922 60516919 +
gagaggcatagaaacaataa

SEQ ID NO: 186639 - DNA, 20 bp, Artificial Sequence
  Synthetic oligonucleotide; ATGAGT chr2 60516926 60516945 60516942 +
ggttacaagataatagatcc

SEQ ID NO: 186640 - DNA, 20 bp, Artificial Sequence
  Synthetic oligonucleotide; GAGAAT chr2 60516973 60516992 60516989 +
tttaggaagaagaagtggcg

SEQ ID NO: 186641 - DNA, 20 bp, Artificial Sequence
  Synthetic oligonucleotide; TGGAAT chr2 60516978 60516997 60516994 +
gaagaagaagtggcggagaa

SEQ ID NO: 186642 - DNA, 20 bp, Artificial Sequence
  Synthetic oligonucleotide; AAGAAT chr2 60516985 60517004 60517001 +
aagtggcggagaatggaatg

SEQ ID NO: 186643 - DNA, 20 bp, Artificial Sequence
  Synthetic oligonucleotide; TGGAAT chr2 60517045 60517064 60517061 +
atgagatactttgtcgtctc

SEQ ID NO: 186644 - DNA, 20 bp, Artificial Sequence
  Synthetic oligonucleotide; ATGGGT chr2 60517060 60517079 60517076 +
gtctctggaatgaagaggaa

SEQ ID NO: 186645 - DNA, 20 bp, Artificial Sequence
  Synthetic oligonucleotide; AGGGAT chr2 60517081 60517100 60517097 +
tgggtttaaaatgaagcata

SEQ ID NO: 186646 - DNA, 20 bp, Artificial Sequence
  Synthetic oligonucleotide; AAGGAT chr2 60517104 60517123 60517120 +
gatcgaaggtagacaaaagg

SEQ ID NO: 186647 - DNA, 20 bp, Artificial Sequence
  Synthetic oligonucleotide; TAGGGT chr2 60517145 60517164 60517161 +
ggtgtctttaaaaatagaac

SEQ ID NO: 186648 - DNA, 20 bp, Artificial Sequence
  Synthetic oligonucleotide; GAGGGT chr2 60517201 60517220 60517217 +
ggagggccatctgcccctga

SEQ ID NO: 186649 - DNA, 20 bp, Artificial Sequence
  Synthetic oligonucleotide; CTGAAT chr2 60517257 60517276 60517273 +
actccattatctccagttat

SEQ ID NO: 186650 - DNA, 20 bp, Artificial Sequence
  Synthetic oligonucleotide; TTGGGT chr2 60517439 60517458 60517455 +
ctctgcaacagcacaggtga

SEQ ID NO: 186651 - DNA, 20 bp, Artificial Sequence
  Synthetic oligonucleotide; TTGGGT chr2 60517459 60517478 60517475 +
ttgggtggtggttttgttgc

SEQ ID NO: 186652 - DNA, 20 bp, Artificial Sequence
  Synthetic oligonucleotide; GTGGGT chr2 60517564 60517583 60517580 +
cagccatcaccgataaaagc

SEQ ID NO: 186653 - DNA, 20 bp, Artificial Sequence
  Synthetic oligonucleotide; AGGAAT chr2 60517654 60517673 60517670 +
tgcgattggtacagtcagcc

SEQ ID NO: 186654 - DNA, 20 bp, Artificial Sequence
  Synthetic oligonucleotide; CAGGGT chr2 60517765 60517784 60517781 +
ctttctcatctgtaaaatga

SEQ ID NO: 186655 - DNA, 20 bp, Artificial Sequence
  Synthetic oligonucleotide; AGGAGT chr2 60518062 60518081 60518078 +
agggaagattgcttgaagct

SEQ ID NO: 186656 - DNA, 20 bp, Artificial Sequence
  Synthetic oligonucleotide; AGGAGT chr2 60518282 60518301 60518298 +
acataaaacatcatagataa

SEQ ID NO: 186657 - DNA, 20 bp, Artificial Sequence
  Synthetic oligonucleotide; CAGGAT chr2 60518290 60518309 60518306 +
catcatagataaaggagtca

SEQ ID NO: 186658 - DNA, 20 bp, Artificial Sequence
  Synthetic oligonucleotide; GAGAAT chr2 60518348 60518367 60518364 +
cctgtcatgaagcagactca

SEQ ID NO: 186659 - DNA, 20 bp, Artificial Sequence
  Synthetic oligonucleotide; CAGGAT chr2 60518415 60518434 60518431 +
tgtctgcgatagagcagatt

SEQ ID NO: 186660 - DNA, 20 bp, Artificial Sequence
  Synthetic oligonucleotide; ATGAAT chr2 60518462 60518481 60518478 +
caactcacctgcatttaaat

SEQ ID NO: 186661 - DNA, 20 bp, Artificial Sequence
  Synthetic oligonucleotide; AAGAGT chr2 60518469 60518488 60518485 +
cctgcatttaaatatgaata

SEQ ID NO: 186662 - DNA, 20 bp, Artificial Sequence
  Synthetic oligonucleotide; GTGAAT chr2 60518523 60518542 60518539 +
catgggagggcatcgcacat

SEQ ID NO: 186663 - DNA, 20 bp, Artificial Sequence
  Synthetic oligonucleotide; GAGAAT chr2 60518588 60518607 60518604 +
ggaagcattgctctagatct

SEQ ID NO: 186664 - DNA, 20 bp, Artificial Sequence
  Synthetic oligonucleotide; AAGAGT chr2 60518653 60518672 60518669 +
cccagcagagaacgttgaga

SEQ ID NO: 186665 - DNA, 20 bp, Artificial Sequence
  Synthetic oligonucleotide; CAGAGT chr2 60518679 60518698 60518695 +
tttaagagcctactcatcat

SEQ ID NO: 186666 - DNA, 20 bp, Artificial Sequence
  Synthetic oligonucleotide; CAGAAT chr2 60518702 60518721 60518718 +
agttcacttaaaagtccatc

SEQ ID NO: 186667 - DNA, 20 bp, Artificial Sequence
  Synthetic oligonucleotide; TGGGAT chr2 60518715 60518734 60518731 +
gtccatccagaatcagaacg

SEQ ID NO: 186668 - DNA, 20 bp, Artificial Sequence
  Synthetic oligonucleotide; TGGGGT chr2 60518720 60518739 60518736 +
tccagaatcagaacgtggga

SEQ ID NO: 186669 - DNA, 20 bp, Artificial Sequence
  Synthetic oligonucleotide; GTGGAT chr2 60518753 60518772 60518769 +
ggcattcctgggggccgggc

SEQ ID NO: 186670 - DNA, 20 bp, Artificial Sequence
  Synthetic oligonucleotide; CTGGAT chr2 60518798 60518817 60518814 +
ctgttcaagttcaggtcaag

SEQ ID NO: 186671 - DNA, 20 bp, Artificial Sequence
  Synthetic oligonucleotide; GTGGGT chr2 60518911 60518930 60518927 +
ctgacattctgtcattcaag

SEQ ID NO: 186672 - DNA, 20 bp, Artificial Sequence
  Synthetic oligonucleotide; GAGAGT chr2 60518968 60518987 60518984 +
cctacaatccacagcaaaag

SEQ ID NO: 186673 - DNA, 20 bp, Artificial Sequence
  Synthetic oligonucleotide; TGGGAT chr2 60519034 60519053 60519050 +
tgagagaaaatggacagaag

SEQ ID NO: 186674 - DNA, 20 bp, Artificial Sequence
  Synthetic oligonucleotide; GGGAGT chr2 60519068 60519087 60519084 +
cctgataccagcaggaaaca

SEQ ID NO: 186675 - DNA, 20 bp, Artificial Sequence
  Synthetic oligonucleotide; ATGGGT chr2 60519217 60519236 60519233 +
ggactatgcatgctctgtct

SEQ ID NO: 186676 - DNA, 20 bp, Artificial Sequence
  Synthetic oligonucleotide; ATGGGT chr2 60519451 60519470 60519467 +
tctataacctgtaaggagag

SEQ ID NO: 186677 - DNA, 20 bp, Artificial Sequence
  Synthetic oligonucleotide; TGGAAT chr2 60519655 60519674 60519671 +
gaaagtgaggctggaaccac

SEQ ID NO: 186678 - DNA, 20 bp, Artificial Sequence
  Synthetic oligonucleotide; AGGAAT chr2 60519719 60519738 60519735 +
cagctgggagccactggttt

SEQ ID NO: 186679 - DNA, 20 bp, Artificial Sequence
  Synthetic oligonucleotide; AGGAAT chr2 60519869 60519888 60519885 +
catttgccaatccataactc

SEQ ID NO: 186680 - DNA, 20 bp, Artificial Sequence
  Synthetic oligonucleotide; TTGGAT chr2 60519887 60519906 60519903 +
tcaggaattcatggctatgc

SEQ ID NO: 186681 - DNA, 20 bp, Artificial Sequence
  Synthetic oligonucleotide; TGGAGT chr2 60519908 60519927 60519924 +
tggataattctctctagact

SEQ ID NO: 186682 - DNA, 20 bp, Artificial Sequence
  Synthetic oligonucleotide; GAGAAT chr2 60519956 60519975 60519972 +
ttctcccctctctctggcag

SEQ ID NO: 186683 - DNA, 20 bp, Artificial Sequence
  Synthetic oligonucleotide; TAGAAT chr2 60520112 60520131 60520128 +
attcagaaagccaaagataa

SEQ ID NO: 186684 - DNA, 20 bp, Artificial Sequence
  Synthetic oligonucleotide; AGGAAT chr2 60520150 60520169 60520166 +
gcaaggtatattgattaggt

SEQ ID NO: 186685 - DNA, 20 bp, Artificial Sequence
  Synthetic oligonucleotide; AGGAGT chr2 60520183 60520202 60520199 +
aattgcaaaattatttatgc

SEQ ID NO: 186686 - DNA, 20 bp, Artificial Sequence
  Synthetic oligonucleotide; ATGGGT chr2 60520220 60520239 60520236 +
cctcaaaagttcccaggcaa

SEQ ID NO: 186687 - DNA, 20 bp, Artificial Sequence
  Synthetic oligonucleotide; GTGAAT chr2 60520317 60520336 60520333 +
tttttttcaagacatgaggt

SEQ ID NO: 186688 - DNA, 20 bp, Artificial Sequence
  Synthetic oligonucleotide; TTGGAT chr2 60520338 60520357 60520354 +
tgaatgatgcaaaacagtat

SEQ ID NO: 186689 - DNA, 20 bp, Artificial Sequence
  Synthetic oligonucleotide; CTGAAT chr2 60520351 60520370 60520367 +
acagtatttggatatgtaaa

SEQ ID NO: 186690 - DNA, 20 bp, Artificial Sequence
  Synthetic oligonucleotide; GTGAGT chr2 60520382 60520401 60520398 +
gcataatgcattactaatca

SEQ ID NO: 186691 - DNA, 20 bp, Artificial Sequence
  Synthetic oligonucleotide; TGGAGT chr2 60520396 60520415 60520412 +
taatcagtgagtataaattc

SEQ ID NO: 186692 - DNA, 20 bp, Artificial Sequence
  Synthetic oligonucleotide; TGGGAT chr2 60520476 60520495 60520492 +
taaagagcatcacccttcgg

SEQ ID NO: 186693 - DNA, 20 bp, Artificial Sequence
  Synthetic oligonucleotide; CAGAGT chr2 60520541 60520560 60520557 +
agaaggagaaattatcctca

SEQ ID NO: 186694 - DNA, 20 bp, Artificial Sequence
  Synthetic oligonucleotide; GAGAGT chr2 60520657 60520676 60520673 +
acaaccacagaagcaccaag

SEQ ID NO: 186695 - DNA, 20 bp, Artificial Sequence
  Synthetic oligonucleotide; CGGAAT chr2 60520724 60520743 60520740 +
caccccatgttggtcgccta

SEQ ID NO: 186696 - DNA, 20 bp, Artificial Sequence
  Synthetic oligonucleotide; AGGAAT chr2 60520734 60520753 60520750 +
tggtcgcctacggaatctac

SEQ ID NO: 186697 - DNA, 20 bp, Artificial Sequence
  Synthetic oligonucleotide; GTGGGT chr2 60520824 60520843 60520840 +
accacccatgcccttctcca

SEQ ID NO: 186698 - DNA, 20 bp, Artificial Sequence
  Synthetic oligonucleotide; AGGGAT chr2 60520999 60521018 60521015 +
tgtctaaacactttttggaa

SEQ ID NO: 186699 - DNA, 20 bp, Artificial Sequence
  Synthetic oligonucleotide; GAGGGT chr2 60521119 60521138 60521135 +
acacactcacacaaatcctt

SEQ ID NO: 186700 - DNA, 20 bp, Artificial Sequence
  Synthetic oligonucleotide; CTGAGT chr2 60521264 60521283 60521280 +
aaagcgccactctcagataa

SEQ ID NO: 186701 - DNA, 20 bp, Artificial Sequence
  Synthetic oligonucleotide; CTGGGT chr2 60521355 60521374 60521371 +
acccgggcctgggcctgggc

SEQ ID NO: 186702 - DNA, 20 bp, Artificial Sequence
  Synthetic oligonucleotide; GGGAAT chr2 60521363 60521382 60521379 +
ctgggcctgggcctgggtct

SEQ ID NO: 186703 - DNA, 20 bp, Artificial Sequence
  Synthetic oligonucleotide; GAGAGT chr2 60521650 60521669 60521666 +
ttctttgtccccttctttct

SEQ ID NO: 186704 - DNA, 20 bp, Artificial Sequence
  Synthetic oligonucleotide; AGGGAT chr2 60521871 60521890 60521887 +
ctcatgcactgaaaaagaca

SEQ ID NO: 186705 - DNA, 20 bp, Artificial Sequence
  Synthetic oligonucleotide; GAGAAT chr2 60521891 60521910 60521907 +
agggatctctgttcttccag

SEQ ID NO: 186706 - DNA, 20 bp, Artificial Sequence
  Synthetic oligonucleotide; GAGAAT chr2 60522128 60522147 60522144 +
tcaaatactacaaaagtaga

SEQ ID NO: 186707 - DNA, 20 bp, Artificial Sequence
  Synthetic oligonucleotide; GGGAGT chr2 60522399 60522418 60522415 +
agtcccgtattaccaaatag

SEQ ID NO: 186708 - DNA, 20 bp, Artificial Sequence
  Synthetic oligonucleotide; CTGGGT chr2 60522435 60522454 60522451 +
tcagaaatacttctttccat

SEQ ID NO: 186709 - DNA, 20 bp, Artificial Sequence
  Synthetic oligonucleotide; GAGGAT chr2 60522450 60522469 60522466 +
tccatctgggtcatgttttg

SEQ ID NO: 186710 - DNA, 20 bp, Artificial Sequence
  Synthetic oligonucleotide; GAGAAT chr2 60522501 60522520 60522517 +
agctgccaagaaaagcttca

SEQ ID NO: 186711 - DNA, 20 bp, Artificial Sequence
  Synthetic oligonucleotide; CTGAAT chr2 60522594 60522613 60522610 +
gtcctttgccctgttcaggg

SEQ ID NO: 186712 - DNA, 20 bp, Artificial Sequence
  Synthetic oligonucleotide; GAGAGT chr2 60522609 60522628 60522625 +
cagggctgaatgcaccctct

SEQ ID NO: 186713 - DNA, 20 bp, Artificial Sequence
  Synthetic oligonucleotide; CTGAGT chr2 60522654 60522673 60522670 +
catcgactgccccacaggcc

SEQ ID NO: 186714 - DNA, 20 bp, Artificial Sequence
  Synthetic oligonucleotide; TGGAAT chr2 60522729 60522748 60522745 +
gcactcccagtgttcagaac

SEQ ID NO: 186715 - DNA, 20 bp, Artificial Sequence
  Synthetic oligonucleotide; CAGAAT chr2 60522777 60522796 60522793 +
ttctcctggacggttctgca

SEQ ID NO: 186716 - DNA, 20 bp, Artificial Sequence
  Synthetic oligonucleotide; TTGGAT chr2 60522801 60522820 60522817 +
attcattcacagagcatgtc

SEQ ID NO: 186717 - DNA, 20 bp, Artificial Sequence
  Synthetic oligonucleotide; ATGGGT chr2 60522841 60522860 60522857 +
atatgtcagttatgttccaa

SEQ ID NO: 186718 - DNA, 20 bp, Artificial Sequence
  Synthetic oligonucleotide; CAGGAT chr2 60522894 60522913 60522910 +
gagcaaatactatttttaga

SEQ ID NO: 186719 - DNA, 20 bp, Artificial Sequence
  Synthetic oligonucleotide; GTGGGT chr2 60523028 60523047 60523044 +
ccgttttctctgtagactct

SEQ ID NO: 186720 - DNA, 20 bp, Artificial Sequence
  Synthetic oligonucleotide; CAGGAT chr2 60523060 60523079 60523076 +
ttgttggacttaatatcttt

SEQ ID NO: 186721 - DNA, 20 bp, Artificial Sequence
  Synthetic oligonucleotide; AAGAAT chr2 60523205 60523224 60523221 +
cacgtgttgcaacctagaga

SEQ ID NO: 186722 - DNA, 20 bp, Artificial Sequence
  Synthetic oligonucleotide; CAGGAT chr2 60523261 60523280 60523277 +
acaaaggacagcctgccatc

SEQ ID NO: 186723 - DNA, 20 bp, Artificial Sequence
  Synthetic oligonucleotide; ATGGAT chr2 60523400 60523419 60523416 +
tgatgaaaagtggtttctac

SEQ ID NO: 186724 - DNA, 20 bp, Artificial Sequence
  Synthetic oligonucleotide; TGGAAT chr2 60523435 60523454 60523451 +
aaacttctatattgatttga

SEQ ID NO: 186725 - DNA, 20 bp, Artificial Sequence
  Synthetic oligonucleotide; GTGAAT chr2 60523445 60523464 60523461 +
attgatttgatggaatcatg

SEQ ID NO: 186726 - DNA, 20 bp, Artificial Sequence
  Synthetic oligonucleotide; GGGGAT chr2 60523627 60523646 60523643 +
atgacagtgttgatgtgttt

SEQ ID NO: 186727 - DNA, 20 bp, Artificial Sequence
  Synthetic oligonucleotide; AAGAGT chr2 60523649 60523668 60523665 +
ggatttttttttttttcaaa

SEQ ID NO: 186728 - DNA, 20 bp, Artificial Sequence
  Synthetic oligonucleotide; ATGAAT chr2 60523775 60523794 60523791 +
acaggagctcaatcaagtaa

SEQ ID NO: 186729 - DNA, 20 bp, Artificial Sequence
  Synthetic oligonucleotide; AAGAAT chr2 60523832 60523851 60523848 +
cttaactagcccaaacgttc

SEQ ID NO: 186730 - DNA, 20 bp, Artificial Sequence
  Synthetic oligonucleotide; AGGGGT chr2 60523996 60524015 60524012 +
ataaatacctctccattatc

SEQ ID NO: 186731 - DNA, 20 bp, Artificial Sequence
  Synthetic oligonucleotide; GAGGGT chr2 60524051 60524070 60524067 +
aggaactagtgtgaaaactg

SEQ ID NO: 186732 - DNA, 20 bp, Artificial Sequence
  Synthetic oligonucleotide; CTGAAT chr2 60524281 60524300 60524297 +
tgaaatcctaaacttcatgt

SEQ ID NO: 186733 - DNA, 20 bp, Artificial Sequence
  Synthetic oligonucleotide; ATGAAT chr2 60524313 60524332 60524329 +
ttttgtcacctatctctggc

SEQ ID NO: 186734 - DNA, 20 bp, Artificial Sequence
  Synthetic oligonucleotide; TTGGGT chr2 60524405 60524424 60524421 +
attcggcctgttatttgctt

SEQ ID NO: 186735 - DNA, 20 bp, Artificial Sequence
  Synthetic oligonucleotide; TTGGGT chr2 60524410 60524429 60524426 +
gcctgttatttgcttttggg

SEQ ID NO: 186736 - DNA, 20 bp, Artificial Sequence
  Synthetic oligonucleotide; AAGAGT chr2 60524639 60524658 60524655 +
ttattgaagctatagatctc

SEQ ID NO: 186737 - DNA, 20 bp, Artificial Sequence
  Synthetic oligonucleotide; TGGGAT chr2 60524708 60524727 60524724 +
tgccccttactctgagcaca

SEQ ID NO: 186738 - DNA, 20 bp, Artificial Sequence
  Synthetic oligonucleotide; AAGGAT chr2 60524746 60524765 60524762 +
ttttagatcatcattatcca

SEQ ID NO: 186739 - DNA, 20 bp, Artificial Sequence
  Synthetic oligonucleotide; TTGAAT chr2 60524756 60524775 60524772 +
tcattatccaaaggataact

SEQ ID NO: 186740 - DNA, 20 bp, Artificial Sequence
  Synthetic oligonucleotide; ATGGAT chr2 60524893 60524912 60524909 +
gtaaacaccaagtttaaaaa

SEQ ID NO: 186741 - DNA, 20 bp, Artificial Sequence
  Synthetic oligonucleotide; ATGAAT chr2 60524947 60524966 60524963 +
catatgcttttacctacatg

SEQ ID NO: 186742 - DNA, 20 bp, Artificial Sequence
  Synthetic oligonucleotide; GAGAGT chr2 60525004 60525023 60525020 +
gtcttcaacactaacagagg

SEQ ID NO: 186743 - DNA, 20 bp, Artificial Sequence
  Synthetic oligonucleotide; TCGGAT chr2 60525028 60525047 60525044 +
gttcttctaaacatgttgca

SEQ ID NO: 186744 - DNA, 20 bp, Artificial Sequence
  Synthetic oligonucleotide; CTGAAT chr2 60525136 60525155 60525152 +
gaggaaggaggaaaatatca

SEQ ID NO: 186745 - DNA, 20 bp, Artificial Sequence
  Synthetic oligonucleotide; TTGAAT chr2 60525154 60525173 60525170 +
cactgaattcagtcagttaa

SEQ ID NO: 186746 - DNA, 20 bp, Artificial Sequence
  Synthetic oligonucleotide; TTGAAT chr2 60525177 60525196 60525193 +
aatttaaaatacctggttgt

SEQ ID NO: 186747 - DNA, 20 bp, Artificial Sequence
  Synthetic oligonucleotide; TGGAGT chr2 60525276 60525295 60525292 +
aaaatacacattacattctt

SEQ ID NO: 186748 - DNA, 20 bp, Artificial Sequence
  Synthetic oligonucleotide; GTGAAT chr2 60525346 60525365 60525362 +
ttataaggctggaaacttct

SEQ ID NO: 186749 - DNA, 20 bp, Artificial Sequence
  Synthetic oligonucleotide; GGGAAT chr2 60525425 60525444 60525441 +
tgcctttaagctttctgttg

SEQ ID NO: 186750 - DNA, 20 bp, Artificial Sequence
  Synthetic oligonucleotide; ACGAAT chr2 60525432 60525451 60525448 +
aagctttctgttggggaatc

SEQ ID NO: 186751 - DNA, 20 bp, Artificial Sequence
  Synthetic oligonucleotide; AAGGGT chr2 60525705 60525724 60525721 +
atctcacagcatgatacaat

SEQ ID NO: 186752 - DNA, 20 bp, Artificial Sequence
  Synthetic oligonucleotide; AAGGGT chr2 60525859 60525878 60525875 +
tttctccatggctttcacag

SEQ ID NO: 186753 - DNA, 20 bp, Artificial Sequence
  Synthetic oligonucleotide; GAGGAT chr2 60526005 60526024 60526021 +
gatactgttattttctggta

SEQ ID NO: 186754 - DNA, 20 bp, Artificial Sequence
  Synthetic oligonucleotide; AAGAAT chr2 60526030 60526049 60526046 +
tggcagcagggctgggaaaa

SEQ ID NO: 186755 - DNA, 20 bp, Artificial Sequence
  Synthetic oligonucleotide; CAGAAT chr2 60526179 60526198 60526195 +
actggtgatttgatcaaatt

SEQ ID NO: 186756 - DNA, 20 bp, Artificial Sequence
  Synthetic oligonucleotide; TGGGAT chr2 60526194 60526213 60526210 +
aaattcagaatcccatattt

SEQ ID NO: 186757 - DNA, 20 bp, Artificial Sequence
  Synthetic oligonucleotide; AAGGAT chr2 60526283 60526302 60526299 +
taaatagttttcatctttaa

SEQ ID NO: 186758 - DNA, 20 bp, Artificial Sequence
  Synthetic oligonucleotide; AAGGGT chr2 60526466 60526485 60526482 +
tcgcagacagcagtgctcaa

SEQ ID NO: 186759 - DNA, 20 bp, Artificial Sequence
  Synthetic oligonucleotide; TCGGGT chr2 60526490 60526509 60526506 +
gtccgcaaaataaaaatgtg

SEQ ID NO: 186760 - DNA, 20 bp, Artificial Sequence
  Synthetic oligonucleotide; ATGGGT chr2 60526502 60526521 60526518 +
aaaatgtgtcgggtaattaa

SEQ ID NO: 186761 - DNA, 20 bp, Artificial Sequence
  Synthetic oligonucleotide; TCGGAT chr2 60526623 60526642 60526639 +
gatggtttataggcctcctc

SEQ ID NO: 186762 - DNA, 20 bp, Artificial Sequence
  Synthetic oligonucleotide; GAGGGT chr2 60526673 60526692 60526689 +
gtgcagtgtgtctatgtcag

SEQ ID NO: 186763 - DNA, 20 bp, Artificial Sequence
  Synthetic oligonucleotide; AAGGGT chr2 60527086 60527105 60527102 +
acatccaggcacttggcctg

SEQ ID NO: 186764 - DNA, 20 bp, Artificial Sequence
  Synthetic oligonucleotide; GGGGGT chr2 60527230 60527249 60527246 +
agggaagagaaggaaaacta

SEQ ID NO: 186765 - DNA, 20 bp, Artificial Sequence
  Synthetic oligonucleotide; AAGGGT chr2 60527254 60527273 60527270 +
gtgcgagcgagggaaataag

SEQ ID NO: 186766 - DNA, 20 bp, Artificial Sequence
  Synthetic oligonucleotide; CAGGGT chr2 60527346 60527365 60527362 +
aaaactaagagcttctcttc

SEQ ID NO: 186767 - DNA, 20 bp, Artificial Sequence
  Synthetic oligonucleotide; AAGGGT chr2 60527382 60527401 60527398 +
aaccactacactcttgaccc

SEQ ID NO: 186768 - DNA, 20 bp, Artificial Sequence
  Synthetic oligonucleotide; AGGGGT chr2 60527417 60527436 60527433 +
caatgaagagggccaagaga

SEQ ID NO: 186769 - DNA, 20 bp, Artificial Sequence
  Synthetic oligonucleotide; CAGAGT chr2 60527473 60527492 60527489 +
aggacgtccatgccccggga

SEQ ID NO: 186770 - DNA, 20 bp, Artificial Sequence
  Synthetic oligonucleotide; ATGGAT chr2 60527516 60527535 60527532 +
ctttggagctcttgacccac

SEQ ID NO: 186771 - DNA, 20 bp, Artificial Sequence
  Synthetic oligonucleotide; CTGGAT chr2 60527565 60527584 60527581 +
cctcaaactcagaagacaac

SEQ ID NO: 186772 - DNA, 20 bp, Artificial Sequence
  Synthetic oligonucleotide; ATGGAT chr2 60527592 60527611 60527608 +
tgaccgacaacttctttgtg

SEQ ID NO: 186773 - DNA, 20 bp, Artificial Sequence
  Synthetic oligonucleotide; AAGGAT chr2 60527788 60527807 60527804 +
tgttagcctggccaatttga

SEQ ID NO: 186774 - DNA, 20 bp, Artificial Sequence
  Synthetic oligonucleotide; GAGAAT chr2 60527795 60527814 60527811 +
ctggccaatttgaaaggatg

SEQ ID NO: 186775 - DNA, 20 bp, Artificial Sequence
  Synthetic oligonucleotide; TGGAAT chr2 60527826 60527845 60527842 +
aaaacagtaacatttggttt

SEQ ID NO: 186776 - DNA, 20 bp, Artificial Sequence
  Synthetic oligonucleotide; TGGAGT chr2 60527904 60527923 60527920 +
aatagcgtcagggcagcctg

SEQ ID NO: 186777 - DNA, 20 bp, Artificial Sequence
  Synthetic oligonucleotide; GCGGAT chr2 60527962 60527981 60527978 +
tgcctctggggaagccacat

SEQ ID NO: 186778 - DNA, 20 bp, Artificial Sequence
  Synthetic oligonucleotide; CAGGAT chr2 60528416 60528435 60528432 +
ggaaatgactacttgcaaag

SEQ ID NO: 186779 - DNA, 20 bp, Artificial Sequence
  Synthetic oligonucleotide; GAGGGT chr2 60528625 60528644 60528641 +
aacgtactgaagaggtagca

SEQ ID NO: 186780 - DNA, 20 bp, Artificial Sequence
  Synthetic oligonucleotide; AAGGAT chr2 60528646 60528665 60528662 +
agggtggcggccgcaggcca

SEQ ID NO: 186781 - DNA, 20 bp, Artificial Sequence
  Synthetic oligonucleotide; GGGAGT chr2 60528730 60528749 60528746 +
ctctaccaaatgaggctaat

SEQ ID NO: 186782 - DNA, 20 bp, Artificial Sequence
  Synthetic oligonucleotide; TGGGAT chr2 60528757 60528776 60528773 +
tttcctttccgaggttgttg

SEQ ID NO: 186783 - DNA, 20 bp, Artificial Sequence
  Synthetic oligonucleotide; TGGAAT chr2 60528762 60528781 60528778 +
tttccgaggttgttgtggga

SEQ ID NO: 186784 - DNA, 20 bp, Artificial Sequence
  Synthetic oligonucleotide; GCGAGT chr2 60528829 60528848 60528845 +
ctggaggtgcagcccccgga

SEQ ID NO: 186785 - DNA, 20 bp, Artificial Sequence
  Synthetic oligonucleotide; TTGAGT chr2 60528891 60528910 60528907 +
actctatgaggtaagggacc

SEQ ID NO: 186786 - DNA, 20 bp, Artificial Sequence
  Synthetic oligonucleotide; CAGAGT chr2 60528975 60528994 60528991 +
gtaacatagaaatctgaacc

SEQ ID NO: 186787 - DNA, 20 bp, Artificial Sequence
  Synthetic oligonucleotide; ATGAGT chr2 60529198 60529217 60529214 +
ggagcacacagttccaagcc

SEQ ID NO: 186788 - DNA, 20 bp, Artificial Sequence
  Synthetic oligonucleotide; TAGGAT chr2 60529285 60529304 60529301 +
agcgcccccacatgctctca

SEQ ID NO: 186789 - DNA, 20 bp, Artificial Sequence
  Synthetic oligonucleotide; GGGAAT chr2 60529359 60529378 60529375 +
attgaggaagcggaggctta

SEQ ID NO: 186790 - DNA, 20 bp, Artificial Sequence
  Synthetic oligonucleotide; CTGAGT chr2 60529581 60529600 60529597 +
gactgcctctaagggcttgg

SEQ ID NO: 186791 - DNA, 20 bp, Artificial Sequence
  Synthetic oligonucleotide; TGGGAT chr2 60529616 60529635 60529632 +
ggagcgggggcaggtatcca

SEQ ID NO: 186792 - DNA, 20 bp, Artificial Sequence
  Synthetic oligonucleotide; GTGAAT chr2 60529799 60529818 60529815 +
ggaaaaatattttttattgt

SEQ ID NO: 186793 - DNA, 20 bp, Artificial Sequence
  Synthetic oligonucleotide; TGGGAT chr2 60529856 60529875 60529872 +
aagccctggtgtcccctagg

SEQ ID NO: 186794 - DNA, 20 bp, Artificial Sequence
  Synthetic oligonucleotide; TGGGAT chr2 60530015 60530034 60530031 +
taaaaatgtcaggaagttat

SEQ ID NO: 186795 - DNA, 20 bp, Artificial Sequence
  Synthetic oligonucleotide; ATGAAT chr2 60530049 60530068 60530065 +
ctgcttgccaacattcatat

SEQ ID NO: 186796 - DNA, 20 bp, Artificial Sequence
  Synthetic oligonucleotide; ATGGGT chr2 60530135 60530154 60530151 +
aacaaaacaagcccaaacac

SEQ ID NO: 186797 - DNA, 20 bp, Artificial Sequence
  Synthetic oligonucleotide; CTGGGT chr2 60530153 60530172 60530169 +
acatgggtttgccatcggtc

SEQ ID NO: 186798 - DNA, 20 bp, Artificial Sequence
  Synthetic oligonucleotide; AAGAGT chr2 60530329 60530348 60530345 +
atttaaaaaaaaaaaaaaaa

SEQ ID NO: 186799 - DNA, 20 bp, Artificial Sequence
  Synthetic oligonucleotide; TCGGGT chr2 60530449 60530468 60530465 +
aaacccttcccatctggccc

SEQ ID NO: 186800 - DNA, 20 bp, Artificial Sequence
  Synthetic oligonucleotide; CTGAGT chr2 60530817 60530836 60530833 +
cccacctcccactacccctc

SEQ ID NO: 186801 - DNA, 20 bp, Artificial Sequence
  Synthetic oligonucleotide; GAGAGT chr2 60531001 60531020 60531017 +
ctggctacaccatggccagg

SEQ ID NO: 186802 - DNA, 20 bp, Artificial Sequence
  Synthetic oligonucleotide; CAGAAT chr2 60531250 60531269 60531266 +
cacaaatcccgttggaccca

SEQ ID NO: 186803 - DNA, 20 bp, Artificial Sequence
  Synthetic oligonucleotide; AAGAAT chr2 60531333 60531352 60531349 +
ccccctcctttgcgttctgc

SEQ ID NO: 186804 - DNA, 20 bp, Artificial Sequence
  Synthetic oligonucleotide; GTGAGT chr2 60531346 60531365 60531362 +
gttctgcaagaatattttaa

SEQ ID NO: 186805 - DNA, 20 bp, Artificial Sequence
  Synthetic oligonucleotide; CGGAAT chr2 60531424 60531443 60531440 +
cacactttttacaaccagta

SEQ ID NO: 186806 - DNA, 20 bp, Artificial Sequence
  Synthetic oligonucleotide; CAGGGT chr2 60531721 60531740 60531737 +
gctgaccccagtacccaagg

SEQ ID NO: 186807 - DNA, 20 bp, Artificial Sequence
  Synthetic oligonucleotide; CTGGGT chr2 60531928 60531947 60531944 +
gactagggcaccatgagcat

SEQ ID NO: 186808 - DNA, 20 bp, Artificial Sequence
  Synthetic oligonucleotide; CGGAAT chr2 60531941 60531960 60531957 +
tgagcatctgggttaaggct

SEQ ID NO: 186809 - DNA, 20 bp, Artificial Sequence
  Synthetic oligonucleotide; TCGAAT chr2 60532092 60532111 60532108 +
ccaacacacccaccgcacaa

SEQ ID NO: 186810 - DNA, 20 bp, Artificial Sequence
  Synthetic oligonucleotide; GAGAAT chr2 60532173 60532192 60532189 +
acagaagttcttcaaatttt

SEQ ID NO: 186811 - DNA, 20 bp, Artificial Sequence
  Synthetic oligonucleotide; TTGGGT chr2 60532304 60532323 60532320 +
tggttgttgctttttggttt

SEQ ID NO: 186812 - DNA, 20 bp, Artificial Sequence
  Synthetic oligonucleotide; CTGGGT chr2 60532460 60532479 60532476 +
aagacagcttctgggccact

SEQ ID NO: 186813 - DNA, 20 bp, Artificial Sequence
  Synthetic oligonucleotide; GTGAAT chr2 60532536 60532555 60532552 +
gatttacagaaccttggtat

SEQ ID NO: 186814 - DNA, 20 bp, Artificial Sequence
  Synthetic oligonucleotide; AAGGAT chr2 60532589 60532608 60532605 +
aaaagaaaattccttggcat

SEQ ID NO: 186815 - DNA, 20 bp, Artificial Sequence
  Synthetic oligonucleotide; ATGGAT chr2 60532672 60532691 60532688 +
aaacagtttgccacagtgag

SEQ ID NO: 186816 - DNA, 20 bp, Artificial Sequence
  Synthetic oligonucleotide; TTGGAT chr2 60532769 60532788 60532785 +
gatttaaagcattaactggt

SEQ ID NO: 186817 - DNA, 20 bp, Artificial Sequence
  Synthetic oligonucleotide; TAGAAT chr2 60532929 60532948 60532945 +
tactttttatttacttcctg

SEQ ID NO: 186818 - DNA, 20 bp, Artificial Sequence
  Synthetic oligonucleotide; CTGGGT chr2 60532986 60533005 60533002 +
ccattatataacaatctacc

SEQ ID NO: 186819 - DNA, 20 bp, Artificial Sequence
  Synthetic oligonucleotide; TAGAAT chr2 60533014 60533033 60533030 +
actagattatgccaatctat

SEQ ID NO: 186820 - DNA, 20 bp, Artificial Sequence
  Synthetic oligonucleotide; CAGAGT chr2 60533100 60533119 60533116 +
aatgtaaagtgttattatag

SEQ ID NO: 186821 - DNA, 20 bp, Artificial Sequence
  Synthetic oligonucleotide; CTGGAT chr2 60533228 60533247 60533244 +
aaaccgacatggcaaaactc

SEQ ID NO: 186822 - DNA, 20 bp, Artificial Sequence
  Synthetic oligonucleotide; CTGAAT chr2 60533237 60533256 60533253 +
tggcaaaactcctggataga

SEQ ID NO: 186823 - DNA, 20 bp, Artificial Sequence
  Synthetic oligonucleotide; TAGGAT chr2 60533285 60533304 60533301 +
ttgtttactttttaccttgt

SEQ ID NO: 186824 - DNA, 20 bp, Artificial Sequence
  Synthetic oligonucleotide; AGGAAT chr2 60533338 60533357 60533354 +
agagaggagagaaagagaga

SEQ ID NO: 186825 - DNA, 20 bp, Artificial Sequence
  Synthetic oligonucleotide; GGGGGT chr2 60533347 60533366 60533363 +
agaaagagagaaggaatgaa

SEQ ID NO: 186826 - DNA, 20 bp, Artificial Sequence
  Synthetic oligonucleotide; CCGGGT chr2 60533480 60533499 60533496 +
ttgttttgttttcttaaata

SEQ ID NO: 186827 - DNA, 20 bp, Artificial Sequence
  Synthetic oligonucleotide; CTGAAT chr2 60533489 60533508 60533505 +
tttcttaaataccgggtcag

SEQ ID NO: 186828 - DNA, 20 bp, Artificial Sequence
  Synthetic oligonucleotide; TGGAAT chr2 60533630 60533649 60533646 +
caagaaaatgatagtgcgtg

SEQ ID NO: 186829 - DNA, 20 bp, Artificial Sequence
  Synthetic oligonucleotide; CAGAAT chr2 60533687 60533706 60533703 +
ggctgtgaagtcggagaggg

SEQ ID NO: 186830 - DNA, 20 bp, Artificial Sequence
  Synthetic oligonucleotide; CTGGAT chr2 60533720 60533739 60533736 +
cacacacaaataaaaagccc

SEQ ID NO: 186831 - DNA, 20 bp, Artificial Sequence
  Synthetic oligonucleotide; CTGGAT chr2 60533796 60533815 60533812 +
cttaataatttatttgtgtt

SEQ ID NO: 186832 - DNA, 20 bp, Artificial Sequence
  Synthetic oligonucleotide; CTGAAT chr2 60533814 60533833 60533830 +
ttctggatactgtttcccag

SEQ ID NO: 186833 - DNA, 20 bp, Artificial Sequence
  Synthetic oligonucleotide; ATGGAT chr2 60533858 60533877 60533874 +
aagcatgcttttagcatggt

SEQ ID NO: 186834 - DNA, 20 bp, Artificial Sequence
  Synthetic oligonucleotide; CAGAAT chr2 60533981 60534000 60533997 +
cattaaacattcgttttaat

SEQ ID NO: 186835 - DNA, 20 bp, Artificial Sequence
  Synthetic oligonucleotide; CAGGAT chr2 60534204 60534223 60534220 +
agcccagggagcctggagac

SEQ ID NO: 186836 - DNA, 20 bp, Artificial Sequence
  Synthetic oligonucleotide; CTGAAT chr2 60534256 60534275 60534272 +
attgtagctcagagcagcag

SEQ ID NO: 186837 - DNA, 20 bp, Artificial Sequence
  Synthetic oligonucleotide; AAGAGT chr2 60534290 60534309 60534306 +
ttacttgatctaaaagataa

SEQ ID NO: 186838 - DNA, 20 bp, Artificial Sequence
  Synthetic oligonucleotide; ACGGAT chr2 60534631 60534650 60534647 +
gtacttaacgttaaaagaaa

SEQ ID NO: 186839 - DNA, 20 bp, Artificial Sequence
  Synthetic oligonucleotide; AGGAGT chr2 60534826 60534845 60534842 +
tatgcaaattacattaatga

SEQ ID NO: 186840 - DNA, 20 bp, Artificial Sequence
  Synthetic oligonucleotide; AAGAAT chr2 60534947 60534966 60534963 +
ttttgcaagattgaaaatct

SEQ ID NO: 186841 - DNA, 20 bp, Artificial Sequence
  Synthetic oligonucleotide; CCGAAT chr2 60535022 60535041 60535038 +
acaggccagcctgatgtgca

SEQ ID NO: 186842 - DNA, 20 bp, Artificial Sequence
  Synthetic oligonucleotide; TAGAAT chr2 60535095 60535114 60535111 +
tggaaggacctaatggtcat

SEQ ID NO: 186843 - DNA, 20 bp, Artificial Sequence
  Synthetic oligonucleotide; AAGGGT chr2 60535236 60535255 60535252 +
taagattcatccaaaaagca

SEQ ID NO: 186844 - DNA, 20 bp, Artificial Sequence
  Synthetic oligonucleotide; CAGAGT chr2 60535448 60535467 60535464 +
gtaatttatcaaaaacagcc

SEQ ID NO: 186845 - DNA, 20 bp, Artificial Sequence
  Synthetic oligonucleotide; ACGAGT chr2 60535499 60535518 60535515 +
ctccaacagaacagattaac

SEQ ID NO: 186846 - DNA, 20 bp, Artificial Sequence
  Synthetic oligonucleotide; TGGAGT chr2 60535596 60535615 60535612 +
aaacagctttttcattggct

SEQ ID NO: 186847 - DNA, 20 bp, Artificial Sequence
  Synthetic oligonucleotide; AGGAGT chr2 60535694 60535713 60535710 +
caaggtctggtttacttctg

SEQ ID NO: 186848 - DNA, 20 bp, Artificial Sequence
  Synthetic oligonucleotide; ACGGGT chr2 60535773 60535792 60535789 +
ccgcatttaatccatggtga

SEQ ID NO: 186849 - DNA, 20 bp, Artificial Sequence
  Synthetic oligonucleotide; GAGAGT chr2 60535850 60535869 60535866 +
ccatcccaccccagttatta

SEQ ID NO: 186850 - DNA, 20 bp, Artificial Sequence
  Synthetic oligonucleotide; CTGGAT chr2 60535867 60535886 60535883 +
ttagagagtatcgtgggaac

SEQ ID NO: 186851 - DNA, 20 bp, Artificial Sequence
  Synthetic oligonucleotide; AAGAAT chr2 60535902 60535921 60535918 +
ttccaattactagtctggag

SEQ ID NO: 186852 - DNA, 20 bp, Artificial Sequence
  Synthetic oligonucleotide; TTGAAT chr2 60535915 60535934 60535931 +
tctggagaagaatcctttgc

SEQ ID NO: 186853 - DNA, 20 bp, Artificial Sequence
  Synthetic oligonucleotide; CAGAAT chr2 60535969 60535988 60535985 +
catttaaaaaattctagtga

SEQ ID NO: 186854 - DNA, 20 bp, Artificial Sequence
  Synthetic oligonucleotide; GAGAAT chr2 60536080 60536099 60536096 +
gctggtgtgcaagtcagact

SEQ ID NO: 186855 - DNA, 20 bp, Artificial Sequence
  Synthetic oligonucleotide; GGGGAT chr2 60536153 60536172 60536169 +
acccaaaagctctctgctgt

SEQ ID NO: 186856 - DNA, 20 bp, Artificial Sequence
  Synthetic oligonucleotide; AAGAAT chr2 60536178 60536197 60536194 +
tttcatttgaactgctatcg

SEQ ID NO: 186857 - DNA, 20 bp, Artificial Sequence
  Synthetic oligonucleotide; TAGAGT chr2 60536245 60536264 60536261 +
cccagcctcagactttctcc

SEQ ID NO: 186858 - DNA, 20 bp, Artificial Sequence
  Synthetic oligonucleotide; GTGGAT chr2 60536267 60536286 60536283 +
gagttgatcttaccggaaat

SEQ ID NO: 186859 - DNA, 20 bp, Artificial Sequence
  Synthetic oligonucleotide; AAGGAT chr2 60536391 60536410 60536407 +
acattttaacatttattaga

SEQ ID NO: 186860 - DNA, 20 bp, Artificial Sequence
  Synthetic oligonucleotide; TAGGAT chr2 60536396 60536415 60536412 +
ttaacatttattagaaagga

SEQ ID NO: 186861 - DNA, 20 bp, Artificial Sequence
  Synthetic oligonucleotide; ATGAGT chr2 60536495 60536514 60536511 +
tgacactaatgttactctac

SEQ ID NO: 186862 - DNA, 20 bp, Artificial Sequence
  Synthetic oligonucleotide; TAGAGT chr2 60536500 60536519 60536516 +
ctaatgttactctacatgag

SEQ ID NO: 186863 - DNA, 20 bp, Artificial Sequence
  Synthetic oligonucleotide; GAGGGT chr2 60536511 60536530 60536527 +
ctacatgagtagagttcaat

SEQ ID NO: 186864 - DNA, 20 bp, Artificial Sequence
  Synthetic oligonucleotide; TGGGAT chr2 60536522 60536541 60536538 +
gagttcaatgagggttgata

SEQ ID NO: 186865 - DNA, 20 bp, Artificial Sequence
  Synthetic oligonucleotide; CAGAAT chr2 60536542 60536561 60536558 +
tgggatgtgacagggcaaat

SEQ ID NO: 186866 - DNA, 20 bp, Artificial Sequence
  Synthetic oligonucleotide; TGGAAT chr2 60536707 60536726 60536723 +
aatcacatcagaaagtaaag

SEQ ID NO: 186867 - DNA, 20 bp, Artificial Sequence
  Synthetic oligonucleotide; CTGAAT chr2 60536897 60536916 60536913 +
acaatgcctgctgtcagcag

SEQ ID NO: 186868 - DNA, 20 bp, Artificial Sequence
  Synthetic oligonucleotide; AGGAAT chr2 60536914 60536933 60536930 +
cagctgaattatttttatac

SEQ ID NO: 186869 - DNA, 20 bp, Artificial Sequence
  Synthetic oligonucleotide; TAGAAT chr2 60536984 60537003 60537000 +
ttaagcaatccacttgtatg

SEQ ID NO: 186870 - DNA, 20 bp, Artificial Sequence
  Synthetic oligonucleotide; AAGAGT chr2 60537107 60537126 60537123 +
gcagttgttttcaaagatcc

SEQ ID NO: 186871 - DNA, 20 bp, Artificial Sequence
  Synthetic oligonucleotide; CAGAAT chr2 60537121 60537140 60537137 +
agatccaagagtatctttat

SEQ ID NO: 186872 - DNA, 20 bp, Artificial Sequence
  Synthetic oligonucleotide; AGGAAT chr2 60537260 60537279 60537276 +
atgttcagttttaaatgtaa

SEQ ID NO: 186873 - DNA, 20 bp, Artificial Sequence
  Synthetic oligonucleotide; TAGGGT chr2 60537282 60537301 60537298 +
gaataatttttttaaaatat

SEQ ID NO: 186874 - DNA, 20 bp, Artificial Sequence
  Synthetic oligonucleotide; AAGGAT chr2 60537357 60537376 60537373 +
ttgttttaactggaaactga

SEQ ID NO: 186875 - DNA, 20 bp, Artificial Sequence
  Synthetic oligonucleotide; GGGAGT chr2 60537371 60537390 60537387 +
aactgaaaggatcggggcag

SEQ ID NO: 186876 - DNA, 20 bp, Artificial Sequence
  Synthetic oligonucleotide; GGGAGT chr2 60537384 60537403 60537400 +
ggggcaggggagttaaaatg

SEQ ID NO: 186877 - DNA, 20 bp, Artificial Sequence
  Synthetic oligonucleotide; AGGGGT chr2 60537403 60537422 60537419 +
ggggagtaaatggttcactg

SEQ ID NO: 186878 - DNA, 20 bp, Artificial Sequence
  Synthetic oligonucleotide; TTGAGT chr2 60537450 60537469 60537466 +
tcataaaatcatggtatacc

SEQ ID NO: 186879 - DNA, 20 bp, Artificial Sequence
  Synthetic oligonucleotide; GAGAAT chr2 60537464 60537483 60537480 +
tataccttgagttggtgaag

SEQ ID NO: 186880 - DNA, 20 bp, Artificial Sequence
  Synthetic oligonucleotide; AGGGAT chr2 60537525 60537544 60537541 +
gtttttgtttgaggaggtgc

SEQ ID NO: 186881 - DNA, 20 bp, Artificial Sequence
  Synthetic oligonucleotide; AAGAAT chr2 60537605 60537624 60537621 +
agtgctttgtgctccaacat

SEQ ID NO: 186882 - DNA, 20 bp, Artificial Sequence
  Synthetic oligonucleotide; ATGAAT chr2 60537703 60537722 60537719 +
attaagaaaatgaacaactg

SEQ ID NO: 186883 - DNA, 20 bp, Artificial Sequence
  Synthetic oligonucleotide; GGGAGT chr2 60537867 60537886 60537883 +
attccattctttattttaat

SEQ ID NO: 186884 - DNA, 20 bp, Artificial Sequence
  Synthetic oligonucleotide; GTGGAT chr2 60537882 60537901 60537898 +
ttaatgggagtttttaatca

SEQ ID NO: 186885 - DNA, 20 bp, Artificial Sequence
  Synthetic oligonucleotide; GAGAAT chr2 60537954 60537973 60537970 +
ttggcaatgctaacaacagt

SEQ ID NO: 186886 - DNA, 20 bp, Artificial Sequence
  Synthetic oligonucleotide; GTGAGT chr2 60537977 60537996 60537993 +
aatacaaacaaaaactcatt

SEQ ID NO: 186887 - DNA, 20 bp, Artificial Sequence
  Synthetic oligonucleotide; GGGAAT chr2 60538038 60538057 60538054 +
acctgctccaggttcccact

SEQ ID NO: 186888 - DNA, 20 bp, Artificial Sequence
  Synthetic oligonucleotide; CTGAAT chr2 60538068 60538087 60538084 +
tggcagagactgattcagtt

SEQ ID NO: 186889 - DNA, 20 bp, Artificial Sequence
  Synthetic oligonucleotide; AAGGGT chr2 60538099 60538118 60538115 +
gctgccagccctatctggaa

SEQ ID NO: 186890 - DNA, 20 bp, Artificial Sequence
  Synthetic oligonucleotide; CAGGGT chr2 60538370 60538389 60538386 +
gatccactcacatcagtctc

SEQ ID NO: 186891 - DNA, 20 bp, Artificial Sequence
  Synthetic oligonucleotide; GTGGAT chr2 60538493 60538512 60538509 +
tatttttctttatacgtttt

SEQ ID NO: 186892 - DNA, 20 bp, Artificial Sequence
  Synthetic oligonucleotide; TGGAAT chr2 60538612 60538631 60538628 +
ataatggtgaaatattttaa

SEQ ID NO: 186893 - DNA, 20 bp, Artificial Sequence
  Synthetic oligonucleotide; CTGAAT chr2 60538693 60538712 60538709 +
agatcagtactagatttaaa

SEQ ID NO: 186894 - DNA, 20 bp, Artificial Sequence
  Synthetic oligonucleotide; AGGGGT chr2 60538776 60538795 60538792 +
tgtgtgtgtaatggggaaag

SEQ ID NO: 186895 - DNA, 20 bp, Artificial Sequence
  Synthetic oligonucleotide; GTGAAT chr2 60538961 60538980 60538977 +
catgcaaaaaaattctggtg

SEQ ID NO: 186896 - DNA, 20 bp, Artificial Sequence
  Synthetic oligonucleotide; CAGAGT chr2 60538977 60538996 60538993 +
ggtggtgaattgggaggtgg

SEQ ID NO: 186897 - DNA, 20 bp, Artificial Sequence
  Synthetic oligonucleotide; AAGGAT chr2 60539008 60539027 60539024 +
agacaactccaagagaagaa

SEQ ID NO: 186898 - DNA, 20 bp, Artificial Sequence
  Synthetic oligonucleotide; AAGAAT chr2 60539048 60539067 60539064 +
gctatagatcaaaggagaac

SEQ ID NO: 186899 - DNA, 20 bp, Artificial Sequence
  Synthetic oligonucleotide; TGGGAT chr2 60539319 60539338 60539335 +
gaagctcacctattccctgc

SEQ ID NO: 186900 - DNA, 20 bp, Artificial Sequence
  Synthetic oligonucleotide; CAGAAT chr2 60539391 60539410 60539407 +
aacctaactcaatgccattg

SEQ ID NO: 186901 - DNA, 20 bp, Artificial Sequence
  Synthetic oligonucleotide; ACGAAT chr2 60539398 60539417 60539414 +
ctcaatgccattgcagaatg

SEQ ID NO: 186902 - DNA, 20 bp, Artificial Sequence
  Synthetic oligonucleotide; GGGAGT chr2 60539483 60539502 60539499 +
aaatgttttaaaaatgcata

SEQ ID NO: 186903 - DNA, 20 bp, Artificial Sequence
  Synthetic oligonucleotide; TGGAAT chr2 60539537 60539556 60539553 +
aaattccaatgaacccaata

SEQ ID NO: 186904 - DNA, 20 bp, Artificial Sequence
  Synthetic oligonucleotide; TTGAGT chr2 60539597 60539616 60539613 +
tgatgtttactggcttcaaa

SEQ ID NO: 186905 - DNA, 20 bp, Artificial Sequence
  Synthetic oligonucleotide; AAGAAT chr2 60539701 60539720 60539717 +
ggagcacatgtagagagcta

SEQ ID NO: 186906 - DNA, 20 bp, Artificial Sequence
  Synthetic oligonucleotide; AAGGAT chr2 60539894 60539913 60539910 +
gtaaaggggagaagctgttt

SEQ ID NO: 186907 - DNA, 20 bp, Artificial Sequence
  Synthetic oligonucleotide; TAGAAT chr2 60540108 60540127 60540124 +
gttaaaagtgggctctaagt

SEQ ID NO: 186908 - DNA, 20 bp, Artificial Sequence
  Synthetic oligonucleotide; CTGGGT chr2 60540245 60540264 60540261 +
aaaagtggcaaggtgccagg

SEQ ID NO: 186909 - DNA, 20 bp, Artificial Sequence
  Synthetic oligonucleotide; TGGGGT chr2 60540320 60540339 60540336 +
tgtaaaaacagacttgggct

SEQ ID NO: 186910 - DNA, 20 bp, Artificial Sequence
  Synthetic oligonucleotide; AAGGGT chr2 60540357 60540376 60540373 +
aatgacttctttgtgcaata

SEQ ID NO: 186911 - DNA, 20 bp, Artificial Sequence
  Synthetic oligonucleotide; TAGGAT chr2 60540587 60540606 60540603 +
aaatctaaaaaatgtttccc

SEQ ID NO: 186912 - DNA, 20 bp, Artificial Sequence
  Synthetic oligonucleotide; AGGAAT chr2 60540890 60540909 60540906 +
gcacaacttgcaacacaaca

SEQ ID NO: 186913 - DNA, 20 bp, Artificial Sequence
  Synthetic oligonucleotide; TGGGGT chr2 60540895 60540914 60540911 +
acttgcaacacaacaaggaa

SEQ ID NO: 186914 - DNA, 20 bp, Artificial Sequence
  Synthetic oligonucleotide; CAGAAT chr2 60541006 60541025 60541022 +
tttgtttttttaagctttca

SEQ ID NO: 186915 - DNA, 20 bp, Artificial Sequence
  Synthetic oligonucleotide; GTGAAT chr2 60541064 60541083 60541080 +
cctctgctcctgttcttgaa

SEQ ID NO: 186916 - DNA, 20 bp, Artificial Sequence
  Synthetic oligonucleotide; CAGGAT chr2 60541162 60541181 60541178 +
cacaatctccacatcacaca

SEQ ID NO: 186917 - DNA, 20 bp, Artificial Sequence
  Synthetic oligonucleotide; AAGGGT chr2 60541257 60541276 60541273 +
catcttttctgtgtcaccac

SEQ ID NO: 186918 - DNA, 20 bp, Artificial Sequence
  Synthetic oligonucleotide; TGGGAT chr2 60541279 60541298 60541295 +
gggtaatgtctgaagaagtt

SEQ ID NO: 186919 - DNA, 20 bp, Artificial Sequence
  Synthetic oligonucleotide; TAGGAT chr2 60541288 60541307 60541304 +
ctgaagaagtttgggatctt

SEQ ID NO: 186920 - DNA, 20 bp, Artificial Sequence
  Synthetic oligonucleotide; AAGAGT chr2 60541475 60541494 60541491 +
tatttacaatttgtcttaga

SEQ ID NO: 186921 - DNA, 20 bp, Artificial Sequence
  Synthetic oligonucleotide; TTGGAT chr2 60541595 60541614 60541611 +
agtttcatgaacattagtct

SEQ ID NO: 186922 - DNA, 20 bp, Artificial Sequence
  Synthetic oligonucleotide; CTGGAT chr2 60541671 60541690 60541687 +
aaaacaatattctctactct

SEQ ID NO: 186923 - DNA, 20 bp, Artificial Sequence
  Synthetic oligonucleotide; CAGAAT chr2 60541786 60541805 60541802 +
agaagtcagtcgtttttatt

SEQ ID NO: 186924 - DNA, 20 bp, Artificial Sequence
  Synthetic oligonucleotide; GAGAAT chr2 60541912 60541931 60541928 +
cagttcagtctgagctagga

SEQ ID NO: 186925 - DNA, 20 bp, Artificial Sequence
  Synthetic oligonucleotide; CAGAAT chr2 60541918 60541937 60541934 +
agtctgagctaggagagaat

SEQ ID NO: 186926 - DNA, 20 bp, Artificial Sequence
  Synthetic oligonucleotide; ATGGAT chr2 60541922 60541941 60541938 +
tgagctaggagagaatcaga

SEQ ID NO: 186927 - DNA, 20 bp, Artificial Sequence
  Synthetic oligonucleotide; TTGAAT chr2 60542017 60542036 60542033 +
catgctaatgtatttccatt

SEQ ID NO: 186928 - DNA, 20 bp, Artificial Sequence
  Synthetic oligonucleotide; TAGAGT chr2 60542041 60542060 60542057 +
attactatatctcccttctt

SEQ ID NO: 186929 - DNA, 20 bp, Artificial Sequence
  Synthetic oligonucleotide; TGGGAT chr2 60542302 60542321 60542318 +
aaacctcaaatctgacatga

SEQ ID NO: 186930 - DNA, 20 bp, Artificial Sequence
  Synthetic oligonucleotide; TTGGGT chr2 60542313 60542332 60542329 +
ctgacatgatgggataatgt

SEQ ID NO: 186931 - DNA, 20 bp, Artificial Sequence
  Synthetic oligonucleotide; ATGAAT chr2 60542362 60542381 60542378 +
ttcacattcagtaatcttcc

SEQ ID NO: 186932 - DNA, 20 bp, Artificial Sequence
  Synthetic oligonucleotide; GAGGGT chr2 60542470 60542489 60542486 +
gtcaaaggctgctgatatct

SEQ ID NO: 186933 - DNA, 20 bp, Artificial Sequence
  Synthetic oligonucleotide; GTGGAT chr2 60542474 60542493 60542490 +
aaggctgctgatatctgagg

SEQ ID NO: 186934 - DNA, 20 bp, Artificial Sequence
  Synthetic oligonucleotide; ATGGAT chr2 60542564 60542583 60542580 +
atactacttcaatgatctca

SEQ ID NO: 186935 - DNA, 20 bp, Artificial Sequence
  Synthetic oligonucleotide; TTGAAT chr2 60542587 60542606 60542603 +
gatcacaatcacacaatatt

SEQ ID NO: 186936 - DNA, 20 bp, Artificial Sequence
  Synthetic oligonucleotide; GTGGAT chr2 60542654 60542673 60542670 +
tgtacagctcatatgtgtac

SEQ ID NO: 186937 - DNA, 20 bp, Artificial Sequence
  Synthetic oligonucleotide; AAGAAT chr2 60542699 60542718 60542715 +
ccatctattcaccaggtaaa

SEQ ID NO: 186938 - DNA, 20 bp, Artificial Sequence
  Synthetic oligonucleotide; GTGGAT chr2 60542782 60542801 60542798 +
actttgggaggccaagccag

SEQ ID NO: 186939 - DNA, 20 bp, Artificial Sequence
  Synthetic oligonucleotide; AGGAGT chr2 60542799 60542818 60542815 +
caggtggatcacctgaggtc

SEQ ID NO: 186940 - DNA, 20 bp, Artificial Sequence
  Synthetic oligonucleotide; GAGAAT chr2 60542918 60542937 60542934 +
tacttgggaggctgaggcag

SEQ ID NO: 186941 - DNA, 20 bp, Artificial Sequence
  Synthetic oligonucleotide; CTGAGT chr2 60543050 60543069 60543066 +
aaaactcagcttggagaggc

SEQ ID NO: 186942 - DNA, 20 bp, Artificial Sequence
  Synthetic oligonucleotide; CCGAAT chr2 60543124 60543143 60543140 +
tattctcctatctgaaagtc

SEQ ID NO: 186943 - DNA, 20 bp, Artificial Sequence
  Synthetic oligonucleotide; CTGAAT chr2 60543387 60543406 60543403 +
tgacacaattcaaatatcta

SEQ ID NO: 186944 - DNA, 20 bp, Artificial Sequence
  Synthetic oligonucleotide; TGGAAT chr2 60543440 60543459 60543456 +
cataaaaagaaaagcagact

SEQ ID NO: 186945 - DNA, 20 bp, Artificial Sequence
  Synthetic oligonucleotide; GGGGGT chr2 60543475 60543494 60543491 +
gtgctttagagaaatgggct

SEQ ID NO: 186946 - DNA, 20 bp, Artificial Sequence
  Synthetic oligonucleotide; CGGAAT chr2 60543537 60543556 60543553 +
gcacctgagggccagagcgt

SEQ ID NO: 186947 - DNA, 20 bp, Artificial Sequence
  Synthetic oligonucleotide; TAGAAT chr2 60543556 60543575 60543572 +
tcggaatttatgtgcaatgg

SEQ ID NO: 186948 - DNA, 20 bp, Artificial Sequence
  Synthetic oligonucleotide; GTGAAT chr2 60543598 60543617 60543614 +
gaaactcttaattcattact

SEQ ID NO: 186949 - DNA, 20 bp, Artificial Sequence
  Synthetic oligonucleotide; CAGGGT chr2 60543678 60543697 60543694 +
tatttatgttcagccagttc

SEQ ID NO: 186950 - DNA, 20 bp, Artificial Sequence
  Synthetic oligonucleotide; CTGGGT chr2 60543757 60543776 60543773 +
gcacgaaaggtttacctcac

SEQ ID NO: 186951 - DNA, 20 bp, Artificial Sequence
  Synthetic oligonucleotide; TTGAAT chr2 60543785 60543804 60543801 +
cagcacttgttgtgcgccca

SEQ ID NO: 186952 - DNA, 20 bp, Artificial Sequence
  Synthetic oligonucleotide; GGGAGT chr2 60543946 60543965 60543962 +
acagaacctttagacaacca

SEQ ID NO: 186953 - DNA, 20 bp, Artificial Sequence
  Synthetic oligonucleotide; CAGAAT chr2 60544067 60544086 60544083 +
ctcctctaaatacagaggca

SEQ ID NO: 186954 - DNA, 20 bp, Artificial Sequence
  Synthetic oligonucleotide; CTGAAT chr2 60544095 60544114 60544111 +
ttgagctggttaatctaaga

SEQ ID NO: 186955 - DNA, 20 bp, Artificial Sequence
  Synthetic oligonucleotide; TTGGAT chr2 60544247 60544266 60544263 +
tttggtgatttagcaaggct

SEQ ID NO: 186956 - DNA, 20 bp, Artificial Sequence
  Synthetic oligonucleotide; GGGGGT chr2 60544375 60544394 60544391 +
gtcattcccacatcctgctg

SEQ ID NO: 186957 - DNA, 20 bp, Artificial Sequence
  Synthetic oligonucleotide; GTGGAT chr2 60544426 60544445 60544442 +
tgtcacataaggtaaatgtg

SEQ ID NO: 186958 - DNA, 20 bp, Artificial Sequence
  Synthetic oligonucleotide; CTGAGT chr2 60544501 60544520 60544517 +
tttcactaaagggaaagtat

SEQ ID NO: 186959 - DNA, 20 bp, Artificial Sequence
  Synthetic oligonucleotide; GTGAAT chr2 60544673 60544692 60544689 +
ggtcggagagacaagttcca

SEQ ID NO: 186960 - DNA, 20 bp, Artificial Sequence
  Synthetic oligonucleotide; CTGGGT chr2 60544737 60544756 60544753 +
aacctcttgcctttcgggag

SEQ ID NO: 186961 - DNA, 20 bp, Artificial Sequence
  Synthetic oligonucleotide; CAGAAT chr2 60544797 60544816 60544813 +
gcatggcatgtctgtcatca

SEQ ID NO: 186962 - DNA, 20 bp, Artificial Sequence
  Synthetic oligonucleotide; GAGGGT chr2 60544846 60544865 60544862 +
gctcaagcaaaaaatgtttt

SEQ ID NO: 186963 - DNA, 20 bp, Artificial Sequence
  Synthetic oligonucleotide; GGGAAT chr2 60544886 60544905 60544902 +
actgtttatcacttagagaa

SEQ ID NO: 186964 - DNA, 20 bp, Artificial Sequence
  Synthetic oligonucleotide; TTGAAT chr2 60544995 60545014 60545011 +
aaccaaaggagggagggctg

SEQ ID NO: 186965 - DNA, 20 bp, Artificial Sequence
  Synthetic oligonucleotide; TGGAGT chr2 60545054 60545073 60545070 +
ttgtgttatagcagaaacag

SEQ ID NO: 186966 - DNA, 20 bp, Artificial Sequence
  Synthetic oligonucleotide; AAGGGT chr2 60545077 60545096 60545093 +
agtctggactggacatttgt

SEQ ID NO: 186967 - DNA, 20 bp, Artificial Sequence
  Synthetic oligonucleotide; TCGAGT chr2 60545256 60545275 60545272 +
ccaacatgcccttaaacttt

SEQ ID NO: 186968 - DNA, 20 bp, Artificial Sequence
  Synthetic oligonucleotide; ATGGAT chr2 60545402 60545421 60545418 +
catccgggctgacagccaat

SEQ ID NO: 186969 - DNA, 20 bp, Artificial Sequence
  Synthetic oligonucleotide; CTGAGT chr2 60545530 60545549 60545546 +
aggaggcctggccagatgtt

SEQ ID NO: 186970 - DNA, 20 bp, Artificial Sequence
  Synthetic oligonucleotide; GGGGAT chr2 60545666 60545685 60545682 +
atacttcaaaatgagaaggt

SEQ ID NO: 186971 - DNA, 20 bp, Artificial Sequence
  Synthetic oligonucleotide; TAGAGT chr2 60545845 60545864 60545861 +
ggctgtcatggacagtcaca

SEQ ID NO: 186972 - DNA, 20 bp, Artificial Sequence
  Synthetic oligonucleotide; CTGGAT chr2 60546024 60546043 60546040 +
tcgtcatcctctggcgtgac

SEQ ID NO: 186973 - DNA, 20 bp, Artificial Sequence
  Synthetic oligonucleotide; CGGGAT chr2 60546041 60546060 60546057 +
gacctggatgccaacctcca

SEQ ID NO: 186974 - DNA, 20 bp, Artificial Sequence
  Synthetic oligonucleotide; TTGGAT chr2 60546046 60546065 60546062 +
ggatgccaacctccacggga

SEQ ID NO: 186975 - DNA, 20 bp, Artificial Sequence
  Synthetic oligonucleotide; AAGAAT chr2 60546153 60546172 60546169 +
cgtttgtgctcgataaaaat

SEQ ID NO: 186976 - DNA, 20 bp, Artificial Sequence
  Synthetic oligonucleotide; AAGAAT chr2 60546258 60546277 60546274 +
tggtctggttcatcatctgt

SEQ ID NO: 186977 - DNA, 20 bp, Artificial Sequence
  Synthetic oligonucleotide; TAGAGT chr2 60546311 60546330 60546327 +
agaaacaaaagcacaattat

SEQ ID NO: 186978 - DNA, 20 bp, Artificial Sequence
  Synthetic oligonucleotide; AAGGAT chr2 60546437 60546456 60546453 +
tgtgagcatacaaaaagtac

SEQ ID NO: 186979 - DNA, 20 bp, Artificial Sequence
  Synthetic oligonucleotide; AAGAAT chr2 60546601 60546620 60546617 +
gtctggtttgtaagtttaga

SEQ ID NO: 186980 - DNA, 20 bp, Artificial Sequence
  Synthetic oligonucleotide; GTGGAT chr2 60546684 60546703 60546700 +
aaaactggttaaaaaaaaaa

SEQ ID NO: 186981 - DNA, 20 bp, Artificial Sequence
  Synthetic oligonucleotide; AAGAAT chr2 60546742 60546761 60546758 +
ccaagttgtccattgtgcca

SEQ ID NO: 186982 - DNA, 20 bp, Artificial Sequence
  Synthetic oligonucleotide; GTGAAT chr2 60546758 60546777 60546774 +
gccaaagaatgaaaggagag

SEQ ID NO: 186983 - DNA, 20 bp, Artificial Sequence
  Synthetic oligonucleotide; GTGAAT chr2 60546785 60546804 60546801 +
aacacacacaccctttgtgt

SEQ ID NO: 186984 - DNA, 20 bp, Artificial Sequence
  Synthetic oligonucleotide; ACGGAT chr2 60546908 60546927 60546924 +
cgactgcatgcacctatgaa

SEQ ID NO: 186985 - DNA, 20 bp, Artificial Sequence
  Synthetic oligonucleotide; TGGGAT chr2 60547042 60547061 60547058 +
tctcagacacattagctaaa

SEQ ID NO: 186986 - DNA, 20 bp, Artificial Sequence
  Synthetic oligonucleotide; TTGAGT chr2 60547052 60547071 60547068 +
attagctaaatgggatactt

SEQ ID NO: 186987 - DNA, 20 bp, Artificial Sequence
  Synthetic oligonucleotide; TGGAAT chr2 60547105 60547124 60547121 +
tttttttttattctgagaaa

SEQ ID NO: 186988 - DNA, 20 bp, Artificial Sequence
  Synthetic oligonucleotide; CAGAAT chr2 60547164 60547183 60547180 +
ggcatctatgatataaaaat

SEQ ID NO: 186989 - DNA, 20 bp, Artificial Sequence
  Synthetic oligonucleotide; CTGAAT chr2 60547264 60547283 60547280 +
tgtcaaagtggactaatttt

SEQ ID NO: 186990 - DNA, 20 bp, Artificial Sequence
  Synthetic oligonucleotide; GCGGAT chr2 60547320 60547339 60547336 +
ttctgcacacataatcacca

SEQ ID NO: 186991 - DNA, 20 bp, Artificial Sequence
  Synthetic oligonucleotide; GAGAGT chr2 60547446 60547465 60547462 +
taagcttccaaaggggaaaa

SEQ ID NO: 186992 - DNA, 20 bp, Artificial Sequence
  Synthetic oligonucleotide; CAGGAT chr2 60547527 60547546 60547543 +
atcacaaaatacaaaacatc

SEQ ID NO: 186993 - DNA, 20 bp, Artificial Sequence
  Synthetic oligonucleotide; GAGAAT chr2 60547643 60547662 60547659 +
ttaatgaacttaaagccaca

SEQ ID NO: 186994 - DNA, 20 bp, Artificial Sequence
  Synthetic oligonucleotide; TTGAGT chr2 60547667 60547686 60547683 +
atcaaaaaatagattttaat

SEQ ID NO: 186995 - DNA, 20 bp, Artificial Sequence
  Synthetic oligonucleotide; TAGAAT chr2 60547674 60547693 60547690 +
aatagattttaatttgagtg

SEQ ID NO: 186996 - DNA, 20 bp, Artificial Sequence
  Synthetic oligonucleotide; CTGAAT chr2 60547751 60547770 60547767 +
ttatttcaaccctacccagg

SEQ ID NO: 186997 - DNA, 20 bp, Artificial Sequence
  Synthetic oligonucleotide; TGGAGT chr2 60547773 60547792 60547789 +
gaatattgagggggaagatc

SEQ ID NO: 186998 - DNA, 20 bp, Artificial Sequence
  Synthetic oligonucleotide; AGGAAT chr2 60547904 60547923 60547920 +
atttaacataaggtcaccac

SEQ ID NO: 186999 - DNA, 20 bp, Artificial Sequence
  Synthetic oligonucleotide; CAGAAT chr2 60547993 60548012 60548009 +
tactggccaaaagataaata

SEQ ID NO: 187000 - DNA, 20 bp, Artificial Sequence
  Synthetic oligonucleotide; AGGAAT chr2 60548101 60548120 60548117 +
gcttccattttgaccaagtg

SEQ ID NO: 187001 - DNA, 20 bp, Artificial Sequence
  Synthetic oligonucleotide; CTGAAT chr2 60548138 60548157 60548154 +
tctcaaaatattcctgttgt

SEQ ID NO: 187002 - DNA, 20 bp, Artificial Sequence
  Synthetic oligonucleotide; AAGGAT chr2 60548145 60548164 60548161 +
atattcctgttgtctgaatt

SEQ ID NO: 187003 - DNA, 20 bp, Artificial Sequence
  Synthetic oligonucleotide; GGGAAT chr2 60548357 60548376 60548373 +
tctgacacatttctaaaagt

SEQ ID NO: 187004 - DNA, 20 bp, Artificial Sequence
  Synthetic oligonucleotide; AAGAAT chr2 60548654 60548673 60548670 +
gtaaattattgctaattaac

SEQ ID NO: 187005 - DNA, 20 bp, Artificial Sequence
  Synthetic oligonucleotide; GGGAGT chr2 60549043 60549062 60549059 +
taaactccggctacaaagca

SEQ ID NO: 187006 - DNA, 20 bp, Artificial Sequence
  Synthetic oligonucleotide; GGGAGT chr2 60549066 60549085 60549082 +
agtcctcgattgaagtggaa

SEQ ID NO: 187007 - DNA, 20 bp, Artificial Sequence
  Synthetic oligonucleotide; GCGAAT chr2 60549097 60549116 60549113 +
aataatcataataattagcc

SEQ ID NO: 187008 - DNA, 20 bp, Artificial Sequence
  Synthetic oligonucleotide; AAGAAT chr2 60549228 60549247 60549244 +
tcctctctgtgtagttgcaa

SEQ ID NO: 187009 - DNA, 20 bp, Artificial Sequence
  Synthetic oligonucleotide; CAGGGT chr2 60549378 60549397 60549394 +
cttctccttgattgtcttaa

SEQ ID NO: 187010 - DNA, 20 bp, Artificial Sequence
  Synthetic oligonucleotide; AAGGGT chr2 60549475 60549494 60549491 +
cccggggcaggggccccggc

SEQ ID NO: 187011 - DNA, 20 bp, Artificial Sequence
  Synthetic oligonucleotide; CGGGGT chr2 60549683 60549702 60549699 +
cagctcggccagctcggccg

SEQ ID NO: 187012 - DNA, 20 bp, Artificial Sequence
  Synthetic oligonucleotide; GCGGGT chr2 60549792 60549811 60549808 +
tctccgcacacacctcaagc

SEQ ID NO: 187013 - DNA, 20 bp, Artificial Sequence
  Synthetic oligonucleotide; GGGGAT chr2 60549842 60549861 60549858 +
agcttacactttttactttg

SEQ ID NO: 187014 - DNA, 20 bp, Artificial Sequence
  Synthetic oligonucleotide; CTGGGT chr2 60549882 60549901 60549898 +
ttcccccgcaattctgggca

SEQ ID NO: 187015 - DNA, 20 bp, Artificial Sequence
  Synthetic oligonucleotide; GGGGGT chr2 60549995 60550014 60550011 +
ccgagctccgaggcgagagg

SEQ ID NO: 187016 - DNA, 20 bp, Artificial Sequence
  Synthetic oligonucleotide; GGGGGT chr2 60550060 60550079 60550076 +
ccgaggtctgtgctttgcat

SEQ ID NO: 187017 - DNA, 20 bp, Artificial Sequence
  Synthetic oligonucleotide; GGGGGT chr2 60550068 60550087 60550084 +
tgtgctttgcatgggggtga

SEQ ID NO: 187018 - DNA, 20 bp, Artificial Sequence
  Synthetic oligonucleotide; GGGGGT chr2 60550250 60550269 60550266 +
gctggtctcagctcgcgcac

SEQ ID NO: 187019 - DNA, 20 bp, Artificial Sequence
  Synthetic oligonucleotide; CGGGGT chr2 60550334 60550353 60550350 +
aaatgaagaacaaagacata

SEQ ID NO: 187020 - DNA, 20 bp, Artificial Sequence
  Synthetic oligonucleotide; GGGAAT chr2 60550355 60550374 60550371 +
ggggtgatgggggagagaaa

SEQ ID NO: 187021 - DNA, 20 bp, Artificial Sequence
  Synthetic oligonucleotide; GAGAAT chr2 60550420 60550439 60550436 +
aagctcgttcctccccggac

SEQ ID NO: 187022 - DNA, 20 bp, Artificial Sequence
  Synthetic oligonucleotide; CCGAAT chr2 60550506 60550525 60550522 +
cttgttctgcctcctagcga

SEQ ID NO: 187023 - DNA, 20 bp, Artificial Sequence
  Synthetic oligonucleotide; GGGGGT chr2 60550548 60550567 60550564 +
atagcagaggcggggggcgg

SEQ ID NO: 187024 - DNA, 20 bp, Artificial Sequence
  Synthetic oligonucleotide; CGGGAT chr2 60550566 60550585 60550582 +
gggggggtggtactgaggac

SEQ ID NO: 187025 - DNA, 20 bp, Artificial Sequence
  Synthetic oligonucleotide; GGGGGT chr2 60550669 60550688 60550685 +
ttaaccccgggacaggagga

SEQ ID NO: 187026 - DNA, 20 bp, Artificial Sequence
  Synthetic oligonucleotide; TAGAGT chr2 60550691 60550710 60550707 +
gggtactaaccctcccagcc

SEQ ID NO: 187027 - DNA, 20 bp, Artificial Sequence
  Synthetic oligonucleotide; AGGGGT chr2 60550722 60550741 60550738 +
aagatggacccaggagggag

SEQ ID NO: 187028 - DNA, 20 bp, Artificial Sequence
  Synthetic oligonucleotide; CCGAGT chr2 60550809 60550828 60550825 +
cgaagaagggcctgactttc

SEQ ID NO: 187029 - DNA, 20 bp, Artificial Sequence
  Synthetic oligonucleotide; GGGAGT chr2 60550910 60550929 60550926 +
tccgcatccggcgcggccgg

SEQ ID NO: 187030 - DNA, 20 bp, Artificial Sequence
  Synthetic oligonucleotide; AGGGAT chr2 60550941 60550960 60550957 +
gcgggggagagcggcgaggg

SEQ ID NO: 187031 - DNA, 20 bp, Artificial Sequence
  Synthetic oligonucleotide; GGGGGT chr2 60550951 60550970 60550967 +
gcggcgagggagggatgcga

SEQ ID NO: 187032 - DNA, 20 bp, Artificial Sequence
  Synthetic oligonucleotide; CGGGGT chr2 60550984 60551003 60551000 +
gggagggccgcgcaacgtgc

SEQ ID NO: 187033 - DNA, 20 bp, Artificial Sequence
  Synthetic oligonucleotide; AAGAAT chr2 60551133 60551152 60551149 +
ctgcatcaaaaatttaaagt

SEQ ID NO: 187034 - DNA, 20 bp, Artificial Sequence
  Synthetic oligonucleotide; TTGAGT chr2 60551145 60551164 60551161 +
tttaaagtaagaatcataaa

SEQ ID NO: 187035 - DNA, 20 bp, Artificial Sequence
  Synthetic oligonucleotide; GGGAAT chr2 60551156 60551175 60551172 +
aatcataaattgagtagggg

SEQ ID NO: 187036 - DNA, 20 bp, Artificial Sequence
  Synthetic oligonucleotide; AAGGGT chr2 60551325 60551344 60551341 +
ggggaagagggcaagaccca

SEQ ID NO: 187037 - DNA, 20 bp, Artificial Sequence
  Synthetic oligonucleotide; CGGGGT chr2 60551339 60551358 60551355 +
gacccaaagggtgaagtgct

SEQ ID NO: 187038 - DNA, 20 bp, Artificial Sequence
  Synthetic oligonucleotide; CAGGAT chr2 60551347 60551366 60551363 +
gggtgaagtgctcggggtcc

SEQ ID NO: 187039 - DNA, 20 bp, Artificial Sequence
  Synthetic oligonucleotide; CGGGGT chr2 60551466 60551485 60551482 +
ggactggtgaccagaccggg

SEQ ID NO: 187040 - DNA, 20 bp, Artificial Sequence
  Synthetic oligonucleotide; GGGGGT chr2 60551473 60551492 60551489 +
tgaccagaccgggcggggtg

SEQ ID NO: 187041 - DNA, 20 bp, Artificial Sequence
  Synthetic oligonucleotide; CCGAGT chr2 60551621 60551640 60551637 +
aataaaaatgctttgcaaag

SEQ ID NO: 187042 - DNA, 20 bp, Artificial Sequence
  Synthetic oligonucleotide; GCGGGT chr2 60551748 60551767 60551764 +
gtggcctgccgccgtgcctg

SEQ ID NO: 187043 - DNA, 20 bp, Artificial Sequence
  Synthetic oligonucleotide; CCGGGT chr2 60551766 60551785 60551782 +
tggcgggtgggcgccgggcg

SEQ ID NO: 187044 - DNA, 20 bp, Artificial Sequence
  Synthetic oligonucleotide; GGGAGT chr2 60552002 60552021 60552018 +
tccaaaaaatagtaagagga

SEQ ID NO: 187045 - DNA, 20 bp, Artificial Sequence
  Synthetic oligonucleotide; AGGGGT chr2 60552054 60552073 60552070 +
cgccctaagtttgcaactga

SEQ ID NO: 187046 - DNA, 20 bp, Artificial Sequence
  Synthetic oligonucleotide; GAGGGT chr2 60552069 60552088 60552085 +
actgaaggggtttgggggaa

SEQ ID NO: 187047 - DNA, 20 bp, Artificial Sequence
  Synthetic oligonucleotide; GGGAGT chr2 60552132 60552151 60552148 +
ttttgcaggggggctggtgg

SEQ ID NO: 187048 - DNA, 20 bp, Artificial Sequence
  Synthetic oligonucleotide; AAGGGT chr2 60552160 60552179 60552176 +
aagagaaggccgtcacagaa

SEQ ID NO: 187049 - DNA, 20 bp, Artificial Sequence
  Synthetic oligonucleotide; GGGGAT chr2 60552628 60552647 60552644 +
tgccactttctcactattgt

SEQ ID NO: 187050 - DNA, 20 bp, Artificial Sequence
  Synthetic oligonucleotide; GGGAAT chr2 60552710 60552729 60552726 +
gtctcacctcttttctcccc

SEQ ID NO: 187051 - DNA, 20 bp, Artificial Sequence
  Synthetic oligonucleotide; GTGAGT chr2 60552766 60552785 60552782 +
tacccccccattttcttacg

SEQ ID NO: 187052 - DNA, 20 bp, Artificial Sequence
  Synthetic oligonucleotide; GTGAGT chr2 60552820 60552839 60552836 +
tcccacccccaggtttgcat

SEQ ID NO: 187053 - DNA, 20 bp, Artificial Sequence
  Synthetic oligonucleotide; GGGAGT chr2 60552878 60552897 60552894 +
caaaactggcggggcggggg

SEQ ID NO: 187054 - DNA, 20 bp, Artificial Sequence
  Synthetic oligonucleotide; TGGAAT chr2 60552883 60552902 60552899 +
ctggcggggcggggggggag

SEQ ID NO: 187055 - DNA, 20 bp, Artificial Sequence
  Synthetic oligonucleotide; AGGAGT chr2 60552942 60552961 60552958 +
ggcggaaaggaggaaagagg

SEQ ID NO: 187056 - DNA, 20 bp, Artificial Sequence
  Synthetic oligonucleotide; TGGGAT chr2 60553023 60553042 60553039 +
tacacggcaatggttccaga

SEQ ID NO: 187057 - DNA, 20 bp, Artificial Sequence
  Synthetic oligonucleotide; GAGGGT chr2 60553029 60553048 60553045 +
gcaatggttccagatgggat

SEQ ID NO: 187058 - DNA, 20 bp, Artificial Sequence
  Synthetic oligonucleotide; TTGGGT chr2 60553183 60553202 60553199 +
aataattattattactatta

SEQ ID NO: 187059 - DNA, 20 bp, Artificial Sequence
  Synthetic oligonucleotide; GAGAAT chr2 60553198 60553217 60553214 +
tattattgggttacttacgc

SEQ ID NO: 187060 - DNA, 20 bp, Artificial Sequence
  Synthetic oligonucleotide; TGGGGT chr2 60553222 60553241 60553238 +
attcccgtttgcttaagtgc

SEQ ID NO: 187061 - DNA, 20 bp, Artificial Sequence
  Synthetic oligonucleotide; CCGGGT chr2 60553327 60553346 60553343 +
ctcggttcacatcgggagag

SEQ ID NO: 187062 - DNA, 20 bp, Artificial Sequence
  Synthetic oligonucleotide; ATGAAT chr2 60553425 60553444 60553441 +
acaaagatggcgcagggaag

SEQ ID NO: 187063 - DNA, 20 bp, Artificial Sequence
  Synthetic oligonucleotide; AGGAGT chr2 60553613 60553632 60553629 +
tccctgcgaacttgaacgtc

SEQ ID NO: 187064 - DNA, 20 bp, Artificial Sequence
  Synthetic oligonucleotide; CTGGAT chr2 60553619 60553638 60553635 +
cgaacttgaacgtcaggagt

SEQ ID NO: 187065 - DNA, 20 bp, Artificial Sequence
  Synthetic oligonucleotide; AGGGGT chr2 60553907 60553926 60553923 +
gcgtggccgggagagaagaa

SEQ ID NO: 187066 - DNA, 20 bp, Artificial Sequence
  Synthetic oligonucleotide; AGGGGT chr2 60553916 60553935 60553932 +
ggagagaagaaaggggtggc

SEQ ID NO: 187067 - DNA, 20 bp, Artificial Sequence
  Synthetic oligonucleotide; AAGGGT chr2 60553929 60553948 60553945 +
gggtggcaggggtgggagga

SEQ ID NO: 187068 - DNA, 20 bp, Artificial Sequence
  Synthetic oligonucleotide; GAGAGT chr2 60554021 60554040 60554037 +
aaaaaagaaaaaaatagagc

SEQ ID NO: 187069 - DNA, 20 bp, Artificial Sequence
  Synthetic oligonucleotide; TAGAGT chr2 60554081 60554100 60554097 +
gcgggcggagggaagccagg

SEQ ID NO: 187070 - DNA, 20 bp, Artificial Sequence
  Synthetic oligonucleotide; CGGAAT chr2 60554324 60554343 60554340 +
ggagggagcgcacggcaacg

SEQ ID NO: 187071 - DNA, 20 bp, Artificial Sequence
  Synthetic oligonucleotide; GCGGGT chr2 60554351 60554370 60554367 +
cagcctaagtttggagggct

SEQ ID NO: 187072 - DNA, 20 bp, Artificial Sequence
  Synthetic oligonucleotide; GGGAAT chr2 60554474 60554493 60554490 +
ccaaggccgagccagggacc

SEQ ID NO: 187073 - DNA, 20 bp, Artificial Sequence
  Synthetic oligonucleotide; CTGGGT chr2 60554500 60554519 60554516 +
ctgagcgccccgccaagcga

SEQ ID NO: 187074 - DNA, 20 bp, Artificial Sequence
  Synthetic oligonucleotide; CTGAAT chr2 60554506 60554525 60554522 +
gccccgccaagcgactgggt

SEQ ID NO: 187075 - DNA, 20 bp, Artificial Sequence
  Synthetic oligonucleotide; CCGAGT chr2 60554525 60554544 60554541 +
tctgaatgcaactgaaagcg

SEQ ID NO: 187076 - DNA, 20 bp, Artificial Sequence
  Synthetic oligonucleotide; AAGGGT chr2 60554542 60554561 60554558 +
gcgccgagtccccggctcct

SEQ ID NO: 187077 - DNA, 20 bp, Artificial Sequence
  Synthetic oligonucleotide; AGGAAT chr2 60554565 60554584 60554581 +
ggtcgcagaaagagagcccg

SEQ ID NO: 187078 - DNA, 20 bp, Artificial Sequence
  Synthetic oligonucleotide; CAGAGT chr2 60554585 60554604 60554601 +
aggaataaagaacgaggagc

SEQ ID NO: 187079 - DNA, 20 bp, Artificial Sequence
  Synthetic oligonucleotide; GGGAGT chr2 60554685 60554704 60554701 +
gacaaagcgcgggcagtccc

SEQ ID NO: 187080 - DNA, 20 bp, Artificial Sequence
  Synthetic oligonucleotide; GGGAAT chr2 60554701 60554720 60554717 +
tcccgggagtcccagtccct

SEQ ID NO: 187081 - DNA, 20 bp, Artificial Sequence
  Synthetic oligonucleotide; CCGGGT chr2 60554737 60554756 60554753 +
cgccgcgggaggtccccgag

SEQ ID NO: 187082 - DNA, 20 bp, Artificial Sequence
  Synthetic oligonucleotide; AGGGAT chr2 60554794 60554813 60554810 +
gagcaactgcaaaagcacag

SEQ ID NO: 187083 - DNA, 20 bp, Artificial Sequence
  Synthetic oligonucleotide; GGGAAT chr2 60554868 60554887 60554884 +
tacccagggaaagagaaaat

SEQ ID NO: 187084 - DNA, 20 bp, Artificial Sequence
  Synthetic oligonucleotide; TCGGGT chr2 60554934 60554953 60554950 +
acggtggtgagatgaccgcc

SEQ ID NO: 187085 - DNA, 20 bp, Artificial Sequence
  Synthetic oligonucleotide; TGGGAT chr2 60555130 60555149 60555146 +
aagcgggcttcactctggcg

SEQ ID NO: 187086 - DNA, 20 bp, Artificial Sequence
  Synthetic oligonucleotide; AGGAGT chr2 60555316 60555335 60555332 +
agtccgattccaaatctgga

SEQ ID NO: 187087 - DNA, 20 bp, Artificial Sequence
  Synthetic oligonucleotide; GAGAAT chr2 60555333 60555352 60555349 +
ggaaggagttggggggagag

SEQ ID NO: 187088 - DNA, 20 bp, Artificial Sequence
  Synthetic oligonucleotide; GAGGGT chr2 60555363 60555382 60555379 +
tcaggtccaagggaggtgcg

SEQ ID NO: 187089 - DNA, 20 bp, Artificial Sequence
  Synthetic oligonucleotide; CAGGGT chr2 60555370 60555389 60555386 +
caagggaggtgcggagggtg

SEQ ID NO: 187090 - DNA, 20 bp, Artificial Sequence
  Synthetic oligonucleotide; ACGGGT chr2 60555380 60555399 60555396 +
gcggagggtgcagggtggag

SEQ ID NO: 187091 - DNA, 20 bp, Artificial Sequence
  Synthetic oligonucleotide; GTGGAT chr2 60555416 60555435 60555432 +
cgcgagaccctgagctgcag

SEQ ID NO: 187092 - DNA, 20 bp, Artificial Sequence
  Synthetic oligonucleotide; GTGAGT chr2 60555426 60555445 60555442 +
tgagctgcaggtggatatgt

SEQ ID NO: 187093 - DNA, 20 bp, Artificial Sequence
  Synthetic oligonucleotide; AAGGGT chr2 60555515 60555534 60555531 +
tcatccccctcttcagtcta

SEQ ID NO: 187094 - DNA, 20 bp, Artificial Sequence
  Synthetic oligonucleotide; TGGGAT chr2 60555772 60555791 60555788 +
gagagagatgtgggctgtac

SEQ ID NO: 187095 - DNA, 20 bp, Artificial Sequence
  Synthetic oligonucleotide; GAGGAT chr2 60555858 60555877 60555874 +
aaattctgtttaagaagcgg

SEQ ID NO: 187096 - DNA, 20 bp, Artificial Sequence
  Synthetic oligonucleotide; CTGAGT chr2 60555916 60555935 60555932 +
gacaccatttccccttttca

SEQ ID NO: 187097 - DNA, 20 bp, Artificial Sequence
  Synthetic oligonucleotide; TGGAGT chr2 60555986 60556005 60556002 +
ttgtcttgttaaaccagcct

SEQ ID NO: 187098 - DNA, 20 bp, Artificial Sequence
  Synthetic oligonucleotide; AAGAAT chr2 60555998 60556017 60556014 +
accagccttggagtcaccaa

SEQ ID NO: 187099 - DNA, 20 bp, Artificial Sequence
  Synthetic oligonucleotide; GGGGGT chr2 60556013 60556032 60556029 +
accaaaagaatgtcttcttg

SEQ ID NO: 187100 - DNA, 20 bp, Artificial Sequence
  Synthetic oligonucleotide; TTGAAT chr2 60556176 60556195 60556192 +
cagaaccaagcttttcagat

SEQ ID NO: 187101 - DNA, 20 bp, Artificial Sequence
  Synthetic oligonucleotide; GCGAGT chr2 60556234 60556253 60556250 +
tagagaagatatataaatga

SEQ ID NO: 187102 - DNA, 20 bp, Artificial Sequence
  Synthetic oligonucleotide; GTGAGT chr2 60556238 60556257 60556254 +
gaagatatataaatgagcga

SEQ ID NO: 187103 - DNA, 20 bp, Artificial Sequence
  Synthetic oligonucleotide; CGGGGT chr2 60556301 60556320 60556317 +
atggtgtgtataaagctttt

SEQ ID NO: 187104 - DNA, 20 bp, Artificial Sequence
  Synthetic oligonucleotide; CTGAAT chr2 60556376 60556395 60556392 +
ggttcacatttaacagtctt

SEQ ID NO: 187105 - DNA, 20 bp, Artificial Sequence
  Synthetic oligonucleotide; TAGGGT chr2 60556447 60556466 60556450 -
gccacagatagcagccctga

SEQ ID NO: 187106 - DNA, 20 bp, Artificial Sequence
  Synthetic oligonucleotide; ATGAAT chr2 60556412 60556431 60556415 -
agagcgcacacaattgtgta

SEQ ID NO: 187107 - DNA, 20 bp, Artificial Sequence
  Synthetic oligonucleotide; ACGGGT chr2 60556217 60556236 60556220 -
ctatagatggacttttatgg

SEQ ID NO: 187108 - DNA, 20 bp, Artificial Sequence
  Synthetic oligonucleotide; AAGAAT chr2 60556175 60556194 60556178 -
tctgaaaagcttggttctga

SEQ ID NO: 187109 - DNA, 20 bp, Artificial Sequence
  Synthetic oligonucleotide; TGGAAT chr2 60555972 60555991 60555975 -
agacaaaaagcagactgtgg

SEQ ID NO: 187110 - DNA, 20 bp, Artificial Sequence
  Synthetic oligonucleotide; GTGAAT chr2 60555888 60555907 60555891 -
gctacagagcttaacttcta

SEQ ID NO: 187111 - DNA, 20 bp, Artificial Sequence
  Synthetic oligonucleotide; CAGAAT chr2 60555866 60555885 60555869 -
gaatcctcccgcttcttaaa

SEQ ID NO: 187112 - DNA, 20 bp, Artificial Sequence
  Synthetic oligonucleotide; AGGGGT chr2 60555737 60555756 60555740 -
aacctccttttcttccttag

SEQ ID NO: 187113 - DNA, 20 bp, Artificial Sequence
  Synthetic oligonucleotide; AGGAAT chr2 60555658 60555677 60555661 -
aaactttactaagacgaaac

SEQ ID NO: 187114 - DNA, 20 bp, Artificial Sequence
  Synthetic oligonucleotide; CGGGAT chr2 60555627 60555646 60555630 -
gccgcttgccggcagggctg

SEQ ID NO: 187115 - DNA, 20 bp, Artificial Sequence
  Synthetic oligonucleotide; ATGGGT chr2 60555623 60555642 60555626 -
cttgccggcagggctgcggg

SEQ ID NO: 187116 - DNA, 20 bp, Artificial Sequence
  Synthetic oligonucleotide; CCGGGT chr2 60555568 60555587 60555571 -
aaaacaataaagccccccca

SEQ ID NO: 187117 - DNA, 20 bp, Artificial Sequence
  Synthetic oligonucleotide; GTGGGT chr2 60555564 60555583 60555567 -
caataaagcccccccaccgg

SEQ ID NO: 187118 - DNA, 20 bp, Artificial Sequence
  Synthetic oligonucleotide; GTGAGT chr2 60555560 60555579 60555563 -
aaagcccccccaccgggtgg

SEQ ID NO: 187119 - DNA, 20 bp, Artificial Sequence
  Synthetic oligonucleotide; GGGGAT chr2 60555523 60555542 60555526 -
acaccctttagactgaagag

SEQ ID NO: 187120 - DNA, 20 bp, Artificial Sequence
  Synthetic oligonucleotide; GGGGGT chr2 60555509 60555528 60555512 -
gaagagggggatgagaagac

SEQ ID NO: 187121 - DNA, 20 bp, Artificial Sequence
  Synthetic oligonucleotide; CAGGGT chr2 60555428 60555447 60555431 -
acacatatccacctgcagct

SEQ ID NO: 187122 - DNA, 20 bp, Artificial Sequence
  Synthetic oligonucleotide; CTGAGT chr2 60555367 60555386 60555370 -
cctccgcacctcccttggac

SEQ ID NO: 187123 - DNA, 20 bp, Artificial Sequence
  Synthetic oligonucleotide; TGGAAT chr2 60555328 60555347 60555331 -
cccccaactccttccagatt

SEQ ID NO: 187124 - DNA, 20 bp, Artificial Sequence
  Synthetic oligonucleotide; CAGAGT chr2 60555285 60555304 60555288 -
ggcggcggcggcggcggctg

SEQ ID NO: 187125 - DNA, 20 bp, Artificial Sequence
  Synthetic oligonucleotide; CTGAAT chr2 60555218 60555237 60555221 -
gggactttacaggcacgttt

SEQ ID NO: 187126 - DNA, 20 bp, Artificial Sequence
  Synthetic oligonucleotide; GGGGGT chr2 60555196 60555215 60555199 -
gaataaactttccaatcgca

SEQ ID NO: 187127 - DNA, 20 bp, Artificial Sequence
  Synthetic oligonucleotide; CAGAGT chr2 60555147 60555166 60555150 -
aaactgaaagtatcccacgc

SEQ ID NO: 187128 - DNA, 20 bp, Artificial Sequence
  Synthetic oligonucleotide; CAGGGT chr2 60555081 60555100 60555084 -
gcgtgtgtgcattaaagaga

SEQ ID NO: 187129 - DNA, 20 bp, Artificial Sequence
  Synthetic oligonucleotide; CTGGGT chr2 60555005 60555024 60555008 -
cgagagggggctgctggctc

SEQ ID NO: 187130 - DNA, 20 bp, Artificial Sequence
  Synthetic oligonucleotide; CTGGGT chr2 60554875 60554894 60554878 -
cattcccattttctctttcc

SEQ ID NO: 187131 - DNA, 20 bp, Artificial Sequence
  Synthetic oligonucleotide; TGGAGT chr2 60554794 60554813 60554797 -
ctgtgcttttgcagttgctc

SEQ ID NO: 187132 - DNA, 20 bp, Artificial Sequence
  Synthetic oligonucleotide; GGGGGT chr2 60554784 60554803 60554787 -
gcagttgctctggagtggga

SEQ ID NO: 187133 - DNA, 20 bp, Artificial Sequence
  Synthetic oligonucleotide; CTGGAT chr2 60554354 60554373 60554357 -
cgcagccctccaaacttagg

SEQ ID NO: 187134 - DNA, 20 bp, Artificial Sequence
  Synthetic oligonucleotide; TCGGGT chr2 60554272 60554291 60554275 -
tggaggctcagctctcaact

SEQ ID NO: 187135 - DNA, 20 bp, Artificial Sequence
  Synthetic oligonucleotide; GTGGGT chr2 60554142 60554161 60554145 -
ggcggcggcggggaggggaa

SEQ ID NO: 187136 - DNA, 20 bp, Artificial Sequence
  Synthetic oligonucleotide; GAGGGT chr2 60554124 60554143 60554127 -
aagtgggtgtgcgtacggag

SEQ ID NO: 187137 - DNA, 20 bp, Artificial Sequence
  Synthetic oligonucleotide; TTGAAT chr2 60554023 60554042 60554026 -
tcgctctatttttttctttt

SEQ ID NO: 187138 - DNA, 20 bp, Artificial Sequence
  Synthetic oligonucleotide; TAGAGT chr2 60554005 60554024 60554008 -
ttttgaataatctttcattt

SEQ ID NO: 187139 - DNA, 20 bp, Artificial Sequence
  Synthetic oligonucleotide; TTGGAT chr2 60553408 60553427 60553411 -
tgtattatttctaatttatt

SEQ ID NO: 187140 - DNA, 20 bp, Artificial Sequence
  Synthetic oligonucleotide; TGGAGT chr2 60553372 60553391 60553375 -
actgatgaagatattttctc

SEQ ID NO: 187141 - DNA, 20 bp, Artificial Sequence
  Synthetic oligonucleotide; GGGAAT chr2 60553228 60553247 60553231 -
accccagcacttaagcaaac

SEQ ID NO: 187142 - DNA, 20 bp, Artificial Sequence
  Synthetic oligonucleotide; AGGGGT chr2 60553135 60553154 60553138 -
agcaaaagcgagggggagag

SEQ ID NO: 187143 - DNA, 20 bp, Artificial Sequence
  Synthetic oligonucleotide; GAGAGT chr2 60553089 60553108 60553092 -
ttttcacgagaaaaacctcc

SEQ ID NO: 187144 - DNA, 20 bp, Artificial Sequence
  Synthetic oligonucleotide; AGGAAT chr2 60552921 60552940 60552924 -
ctttatttctcttttcgaaa

SEQ ID NO: 187145 - DNA, 20 bp, Artificial Sequence
  Synthetic oligonucleotide; GGGGGT chr2 60552830 60552849 60552833 -
aacaactcacatgcaaacct

SEQ ID NO: 187146 - DNA, 20 bp, Artificial Sequence
  Synthetic oligonucleotide; GGGGGT chr2 60552773 60552792 60552776 -
cactcaccgtaagaaaatgg

SEQ ID NO: 187147 - DNA, 20 bp, Artificial Sequence
  Synthetic oligonucleotide; GGGAGT chr2 60552762 60552781 60552765 -
agaaaatgggggggtaggga

SEQ ID NO: 187148 - DNA, 20 bp, Artificial Sequence
  Synthetic oligonucleotide; GTGAGT chr2 60552758 60552777 60552761 -
aatgggggggtagggaggga

SEQ ID NO: 187149 - DNA, 20 bp, Artificial Sequence
  Synthetic oligonucleotide; CTGAGT chr2 60552603 60552622 60552606 -
gaaaggggcccccggcgctc

SEQ ID NO: 187150 - DNA, 20 bp, Artificial Sequence
  Synthetic oligonucleotide; CGGAGT chr2 60552594 60552613 60552597 -
ccccggcgctcctgagtccg

SEQ ID NO: 187151 - DNA, 20 bp, Artificial Sequence
  Synthetic oligonucleotide; GTGGGT chr2 60552498 60552517 60552501 -
gccttttgttccggccagag

SEQ ID NO: 187152 - DNA, 20 bp, Artificial Sequence
  Synthetic oligonucleotide; CTGGGT chr2 60552342 60552361 60552345 -
ggagcccggactgctgcctc

SEQ ID NO: 187153 - DNA, 20 bp, Artificial Sequence
  Synthetic oligonucleotide; GAGAAT chr2 60552234 60552253 60552237 -
aaataaataaaacaaggcaa

SEQ ID NO: 187154 - DNA, 20 bp, Artificial Sequence
  Synthetic oligonucleotide; GTGGAT chr2 60551981 60552000 60551984 -
gattttcaaaaaaagtggaa

SEQ ID NO: 187155 - DNA, 20 bp, Artificial Sequence
  Synthetic oligonucleotide; CTGAAT chr2 60551952 60551971 60551955 -
gattgggaaaaatctcgtgt

SEQ ID NO: 187156 - DNA, 20 bp, Artificial Sequence
  Synthetic oligonucleotide; CCGGAT chr2 60551803 60551822 60551806 -
cgccgcgccccagcccagcc

SEQ ID NO: 187157 - DNA, 20 bp, Artificial Sequence
  Synthetic oligonucleotide; CTGGGT chr2 60551656 60551675 60551659 -
ctcccagactgcgaaatcgg

SEQ ID NO: 187158 - DNA, 20 bp, Artificial Sequence
  Synthetic oligonucleotide; CTGGGT chr2 60551572 60551591 60551575 -
cgcctcccctcccctccgcc

SEQ ID NO: 187159 - DNA, 20 bp, Artificial Sequence
  Synthetic oligonucleotide; CGGGGT chr2 60551434 60551453 60551437 -
agcacgactaggccaggtgg

SEQ ID NO: 187160 - DNA, 20 bp, Artificial Sequence
  Synthetic oligonucleotide; TTGAGT chr2 60551399 60551418 60551402 -
agggcaggggagaagtgtgt

SEQ ID NO: 187161 - DNA, 20 bp, Artificial Sequence
  Synthetic oligonucleotide; CTGGAT chr2 60551377 60551396 60551380 -
gagtgtgcattttaagggcg

SEQ ID NO: 187162 - DNA, 20 bp, Artificial Sequence
  Synthetic oligonucleotide; TTGGGT chr2 60551346 60551365 60551349 -
gaccccgagcacttcaccct

SEQ ID NO: 187163 - DNA, 20 bp, Artificial Sequence
  Synthetic oligonucleotide; GTGAGT chr2 60551300 60551319 60551303 -
tggcttggtctgaggttctt

SEQ ID NO: 187164 - DNA, 20 bp, Artificial Sequence
  Synthetic oligonucleotide; AGGGGT chr2 60551093 60551112 60551096 -
ttggttctgtgtttttttaa

SEQ ID NO: 187165 - DNA, 20 bp, Artificial Sequence
  Synthetic oligonucleotide; GGGGGT chr2 60551080 60551099 60551083 -
tttttaaaggggtggtggtg

SEQ ID NO: 187166 - DNA, 20 bp, Artificial Sequence
  Synthetic oligonucleotide; GGGAAT chr2 60551067 60551086 60551070 -
ggtggtggggggtgcgcaca

SEQ ID NO: 187167 - DNA, 20 bp, Artificial Sequence
  Synthetic oligonucleotide; CCGGAT chr2 60550921 60550940 60550924 -
ccccaactcccccggccgcg

SEQ ID NO: 187168 - DNA, 20 bp, Artificial Sequence
  Synthetic oligonucleotide; GCGGAT chr2 60550915 60550934 60550918 -
ctcccccggccgcgccggat

SEQ ID NO: 187169 - DNA, 20 bp, Artificial Sequence
  Synthetic oligonucleotide; AAGGAT chr2 60550808 60550827 60550811 -
aaagtcaggcccttcttcgg

SEQ ID NO: 187170 - DNA, 20 bp, Artificial Sequence
  Synthetic oligonucleotide; CTGGGT chr2 60550735 60550754 60550738 -
ccctcgtacccctctccctc

SEQ ID NO: 187171 - DNA, 20 bp, Artificial Sequence
  Synthetic oligonucleotide; GAGGGT chr2 60550705 60550724 60550708 -
cttgggacactctaggctgg

SEQ ID NO: 187172 - DNA, 20 bp, Artificial Sequence
  Synthetic oligonucleotide; CGGGGT chr2 60550678 60550697 60550681 -
agtaccccctcctcctgtcc

SEQ ID NO: 187173 - DNA, 20 bp, Artificial Sequence
  Synthetic oligonucleotide; GGGGGT chr2 60550654 60550673 60550657 -
gttaaagggccagtttggga

SEQ ID NO: 187174 - DNA, 20 bp, Artificial Sequence
  Synthetic oligonucleotide; CTGGGT chr2 60550618 60550637 60550621 -
cttctttctgtcctcatttt

SEQ ID NO: 187175 - DNA, 20 bp, Artificial Sequence
  Synthetic oligonucleotide; CTGAAT chr2 60550543 60550562 60550546 -
ccccgcctctgctatgtggg

SEQ ID NO: 187176 - DNA, 20 bp, Artificial Sequence
  Synthetic oligonucleotide; GAGGGT chr2 60550417 60550436 60550420 -
cggggaggaacgagctttgc

SEQ ID NO: 187177 - DNA, 20 bp, Artificial Sequence
  Synthetic oligonucleotide; GGGGGT chr2 60550411 60550430 60550414 -
ggaacgagctttgcgagggt

SEQ ID NO: 187178 - DNA, 20 bp, Artificial Sequence
  Synthetic oligonucleotide; CAGAAT chr2 60550385 60550404 60550388 -
ggggggaaagaacggttagg

SEQ ID NO: 187179 - DNA, 20 bp, Artificial Sequence
  Synthetic oligonucleotide; GGGAGT chr2 60550179 60550198 60550182 -
atttttggtagggaggaacc

SEQ ID NO: 187180 - DNA, 20 bp, Artificial Sequence
  Synthetic oligonucleotide; GGGGAT chr2 60550139 60550158 60550142 -
ttcggggcatggccgaagag

SEQ ID NO: 187181 - DNA, 20 bp, Artificial Sequence
  Synthetic oligonucleotide; CGGAAT chr2 60549998 60550017 60550001 -
ccccctctcgcctcggagct

SEQ ID NO: 187182 - DNA, 20 bp, Artificial Sequence
  Synthetic oligonucleotide; ATGAAT chr2 60549936 60549955 60549939 -
ggcaggcagcgtcattaata

SEQ ID NO: 187183 - DNA, 20 bp, Artificial Sequence
  Synthetic oligonucleotide; CAGAAT chr2 60549898 60549917 60549901 -
cgccgcgcacacccagtgcc

SEQ ID NO: 187184 - DNA, 20 bp, Artificial Sequence
  Synthetic oligonucleotide; CAGAAT chr2 60549834 60549853 60549837 -
aaagtgtaagcttgtggaca

SEQ ID NO: 187185 - DNA, 20 bp, Artificial Sequence
  Synthetic oligonucleotide; ATGAAT chr2 60549830 60549849 60549833 -
tgtaagcttgtggacacaga

SEQ ID NO: 187186 - DNA, 20 bp, Artificial Sequence
  Synthetic oligonucleotide; CCGGGT chr2 60549766 60549785 60549769 -
gactgcaccaggttaaccag

SEQ ID NO: 187187 - DNA, 20 bp, Artificial Sequence
  Synthetic oligonucleotide; CAGAGT chr2 60549539 60549558 60549542 -
acgctgctcgctttgtgcct

SEQ ID NO: 187188 - DNA, 20 bp, Artificial Sequence
  Synthetic oligonucleotide; CTGAAT chr2 60549432 60549451 60549435 -
tgtttctttgcttttcctct

SEQ ID NO: 187189 - DNA, 20 bp, Artificial Sequence
  Synthetic oligonucleotide; AAGGAT chr2 60549280 60549299 60549283 -
tccttaccaacatttcctat

SEQ ID NO: 187190 - DNA, 20 bp, Artificial Sequence
  Synthetic oligonucleotide; GAGAAT chr2 60549127 60549146 60549130 -
tttcttcctcccctcgtaga

SEQ ID NO: 187191 - DNA, 20 bp, Artificial Sequence
  Synthetic oligonucleotide; CGGAGT chr2 60549052 60549071 60549055 -
aggactccctgctttgtagc

SEQ ID NO: 187192 - DNA, 20 bp, Artificial Sequence
  Synthetic oligonucleotide; GAGGAT chr2 60549005 60549024 60549008 -
ttggtattgttggggcgaag

SEQ ID NO: 187193 - DNA, 20 bp, Artificial Sequence
  Synthetic oligonucleotide; TGGAGT chr2 60549000 60549019 60549003 -
attgttggggcgaaggagga

SEQ ID NO: 187194 - DNA, 20 bp, Artificial Sequence
  Synthetic oligonucleotide; TTGAAT chr2 60548995 60549014 60548998 -
tggggcgaaggaggatggag

SEQ ID NO: 187195 - DNA, 20 bp, Artificial Sequence
  Synthetic oligonucleotide; GGGGGT chr2 60548982 60549001 60548985 -
gatggagttgaattgaggga

SEQ ID NO: 187196 - DNA, 20 bp, Artificial Sequence
  Synthetic oligonucleotide; GAGGGT chr2 60548968 60548987 60548971 -
gagggagggggtaaatggct

SEQ ID NO: 187197 - DNA, 20 bp, Artificial Sequence
  Synthetic oligonucleotide; GGGAAT chr2 60548941 60548960 60548944 -
aggaaggtttttagggaaag

SEQ ID NO: 187198 - DNA, 20 bp, Artificial Sequence
  Synthetic oligonucleotide; GAGAAT chr2 60548839 60548858 60548842 -
aaatcagtagactacaccat

SEQ ID NO: 187199 - DNA, 20 bp, Artificial Sequence
  Synthetic oligonucleotide; TAGAAT chr2 60548689 60548708 60548692 -
gttaaacgtatttcatacat

SEQ ID NO: 187200 - DNA, 20 bp, Artificial Sequence
  Synthetic oligonucleotide; CTGAAT chr2 60548527 60548546 60548530 -
ggaggtgtaatcagcaacct

SEQ ID NO: 187201 - DNA, 20 bp, Artificial Sequence
  Synthetic oligonucleotide; GAGAAT chr2 60548412 60548431 60548415 -
tttaactatttgatacctag

SEQ ID NO: 187202 - DNA, 20 bp, Artificial Sequence
  Synthetic oligonucleotide; AAGAAT chr2 60548333 60548352 60548336 -
gggaacaaaaaaaaaaaaaa

SEQ ID NO: 187203 - DNA, 20 bp, Artificial Sequence
  Synthetic oligonucleotide; AGGAAT chr2 60548153 60548172 60548156 -
aaatccttaattcagacaac

SEQ ID NO: 187204 - DNA, 20 bp, Artificial Sequence
  Synthetic oligonucleotide; GAGAAT chr2 60548142 60548161 60548145 -
tcagacaacaggaatatttt

SEQ ID NO: 187205 - DNA, 20 bp, Artificial Sequence
  Synthetic oligonucleotide; ATGAGT chr2 60548138 60548157 60548141 -
acaacaggaatattttgaga

SEQ ID NO: 187206 - DNA, 20 bp, Artificial Sequence
  Synthetic oligonucleotide; AAGAAT chr2 60548090 60548109 60548093 -
aatggaagcaaatgtaagag

SEQ ID NO: 187207 - DNA, 20 bp, Artificial Sequence
  Synthetic oligonucleotide; AGGAAT chr2 60547947 60547966 60547950 -
actttactgtctttattagt

SEQ ID NO: 187208 - DNA, 20 bp, Artificial Sequence
  Synthetic oligonucleotide; AGGAGT chr2 60547900 60547919 60547903 -
tgaccttatgttaaattagg

SEQ ID NO: 187209 - DNA, 20 bp, Artificial Sequence
  Synthetic oligonucleotide; GGGAGT chr2 60547806 60547825 60547809 -
ttatttcacctagcacatct

SEQ ID NO: 187210 - DNA, 20 bp, Artificial Sequence
  Synthetic oligonucleotide; CTGGGT chr2 60547770 60547789 60547773 -
cttccccctcaatattcagc

SEQ ID NO: 187211 - DNA, 20 bp, Artificial Sequence
  Synthetic oligonucleotide; TAGGGT chr2 60547765 60547784 60547768 -
ccctcaatattcagcctggg

SEQ ID NO: 187212 - DNA, 20 bp, Artificial Sequence
  Synthetic oligonucleotide; CTGAGT chr2 60547744 60547763 60547747 -
agggttgaaataaatttaac

SEQ ID NO: 187213 - DNA, 20 bp, Artificial Sequence
  Synthetic oligonucleotide; CTGGAT chr2 60547735 60547754 60547738 -
ataaatttaacctgagttca

SEQ ID NO: 187214 - DNA, 20 bp, Artificial Sequence
  Synthetic oligonucleotide; CTGGAT chr2 60547550 60547569 60547553 -
ttttattaactggcagcatc

SEQ ID NO: 187215 - DNA, 20 bp, Artificial Sequence
  Synthetic oligonucleotide; TGGAGT chr2 60547416 60547435 60547419 -
gaagctggtaaagtagatgc

SEQ ID NO: 187216 - DNA, 20 bp, Artificial Sequence
  Synthetic oligonucleotide; TAGAAT chr2 60547146 60547165 60547149 -
ccaccaagtgcaaacatgtt

SEQ ID NO: 187217 - DNA, 20 bp, Artificial Sequence
  Synthetic oligonucleotide; CAGAAT chr2 60547120 60547139 60547123 -
attataggcattccatttct

SEQ ID NO: 187218 - DNA, 20 bp, Artificial Sequence
  Synthetic oligonucleotide; GAGAGT chr2 60546996 60547015 60546999 -
tttgattttgtggcactgct

SEQ ID NO: 187219 - DNA, 20 bp, Artificial Sequence
  Synthetic oligonucleotide; GTGAAT chr2 60546966 60546985 60546969 -
gcagaaaggtttttggcagt

SEQ ID NO: 187220 - DNA, 20 bp, Artificial Sequence
  Synthetic oligonucleotide; AGGAGT chr2 60546823 60546842 60546826 -
gaagccatgtctgtttactt

SEQ ID NO: 187221 - DNA, 20 bp, Artificial Sequence
  Synthetic oligonucleotide; AAGGGT chr2 60546800 60546819 60546803 -
agtatatacattcacacaca

SEQ ID NO: 187222 - DNA, 20 bp, Artificial Sequence
  Synthetic oligonucleotide; GTGGGT chr2 60546589 60546608 60546592 -
aaccagacacatttgttgct

SEQ ID NO: 187223 - DNA, 20 bp, Artificial Sequence
  Synthetic oligonucleotide; ATGGGT chr2 60546577 60546596 60546580 -
ttgttgctgtgggtgtgtgc

SEQ ID NO: 187224 - DNA, 20 bp, Artificial Sequence
  Synthetic oligonucleotide; TGGAGT chr2 60546549 60546568 60546552 -
atgtgtgtgtgtgtgttctc

SEQ ID NO: 187225 - DNA, 20 bp, Artificial Sequence
  Synthetic oligonucleotide; CTGGGT chr2 60546433 60546452 60546436 -
tttttgtatgctcacatttt

SEQ ID NO: 187226 - DNA, 20 bp, Artificial Sequence
  Synthetic oligonucleotide; TGGGAT chr2 60546388 60546407 60546391 -
aaacactttacatgatgtgg

SEQ ID NO: 187227 - DNA, 20 bp, Artificial Sequence
  Synthetic oligonucleotide; TGGGGT chr2 60546378 60546397 60546381 -
catgatgtggtgggatggca

SEQ ID NO: 187228 - DNA, 20 bp, Artificial Sequence
  Synthetic oligonucleotide; GGGGAT chr2 60546236 60546255 60546239 -
gcccgttgggagctccagaa

SEQ ID NO: 187229 - DNA, 20 bp, Artificial Sequence
  Synthetic oligonucleotide; GTGGAT chr2 60546116 60546135 60546119 -
gcctctgcttagaaaaagct

SEQ ID NO: 187230 - DNA, 20 bp, Artificial Sequence
  Synthetic oligonucleotide; GAGGAT chr2 60546035 60546054 60546038 -
ttggcatccaggtcacgcca

SEQ ID NO: 187231 - DNA, 20 bp, Artificial Sequence
  Synthetic oligonucleotide; AGGAAT chr2 60546003 60546022 60546006 -
tgtttatcaacgtcatctag

SEQ ID NO: 187232 - DNA, 20 bp, Artificial Sequence
  Synthetic oligonucleotide; AGGAGT chr2 60545897 60545916 60545900 -
ggtgctgtagccaagcagta

SEQ ID NO: 187233 - DNA, 20 bp, Artificial Sequence
  Synthetic oligonucleotide; CTGAAT chr2 60545775 60545794 60545778 -
aataaatattttccacctca

SEQ ID NO: 187234 - DNA, 20 bp, Artificial Sequence
  Synthetic oligonucleotide; CAGGAT chr2 60545759 60545778 60545762 -
ctcactgaatcagatgtagg

SEQ ID NO: 187235 - DNA, 20 bp, Artificial Sequence
  Synthetic oligonucleotide; CTGGAT chr2 60545727 60545746 60545730 -
acacatcagacaccttctct

SEQ ID NO: 187236 - DNA, 20 bp, Artificial Sequence
  Synthetic oligonucleotide; TTGGAT chr2 60545712 60545731 60545715 -
tctctctggatctgtcgatt

SEQ ID NO: 187237 - DNA, 20 bp, Artificial Sequence
  Synthetic oligonucleotide; AGGGGT chr2 60545529 60545548 60545532 -
acatctggccaggcctcctt

SEQ ID NO: 187238 - DNA, 20 bp, Artificial Sequence
  Synthetic oligonucleotide; TAGAGT chr2 60545495 60545514 60545498 -
ttctcaaggcttccctgaag

SEQ ID NO: 187239 - DNA, 20 bp, Artificial Sequence
  Synthetic oligonucleotide; CAGGGT chr2 60545482 60545501 60545485 -
cctgaagtagagtgggctgg

SEQ ID NO: 187240 - DNA, 20 bp, Artificial Sequence
  Synthetic oligonucleotide; AAGAGT chr2 60545460 60545479 60545463 -
gggtagttggaggtggtgga

SEQ ID NO: 187241 - DNA, 20 bp, Artificial Sequence
  Synthetic oligonucleotide; TTGGAT chr2 60545432 60545451 60545435 -
actgagcttcagggctagcc

SEQ ID NO: 187242 - DNA, 20 bp, Artificial Sequence
  Synthetic oligonucleotide; CCGGAT chr2 60545409 60545428 60545412 -
gatccatattggctgtcagc

SEQ ID NO: 187243 - DNA, 20 bp, Artificial Sequence
  Synthetic oligonucleotide; TGGGAT chr2 60545375 60545394 60545378 -
aattaaacacagccccgtgg

SEQ ID NO: 187244 - DNA, 20 bp, Artificial Sequence
  Synthetic oligonucleotide; CAGAGT chr2 60545323 60545342 60545326 -
ccattttcgactggccaggc

SEQ ID NO: 187245 - DNA, 20 bp, Artificial Sequence
  Synthetic oligonucleotide; GTGGGT chr2 60544968 60544987 60544971 -
gcagggaggcagctaggtgt

SEQ ID NO: 187246 - DNA, 20 bp, Artificial Sequence
  Synthetic oligonucleotide; AGGAAT chr2 60544941 60544960 60544944 -
tctcggcagctcaagggaaa

SEQ ID NO: 187247 - DNA, 20 bp, Artificial Sequence
  Synthetic oligonucleotide; GTGGAT chr2 60544791 60544810 60544794 -
cagacatgccatgcctgttg

SEQ ID NO: 187248 - DNA, 20 bp, Artificial Sequence
  Synthetic oligonucleotide; ATGAAT chr2 60544707 60544726 60544710 -
taggaaaggtagtgcatatc

SEQ ID NO: 187249 - DNA, 20 bp, Artificial Sequence
  Synthetic oligonucleotide; GGGGAT chr2 60544629 60544648 60544632 -
taataggtcagtggtctaga

SEQ ID NO: 187250 - DNA, 20 bp, Artificial Sequence
  Synthetic oligonucleotide; TAGAAT chr2 60544592 60544611 60544595 -
ttatttctcctctccccctc

SEQ ID NO: 187251 - DNA, 20 bp, Artificial Sequence
  Synthetic oligonucleotide; TGGAGT chr2 60544469 60544488 60544472 -
tgctagggaagctgcatttg

SEQ ID NO: 187252 - DNA, 20 bp, Artificial Sequence
  Synthetic oligonucleotide; TTGAAT chr2 60544456 60544475 60544459 -
gcatttgtggagtgtatttc

SEQ ID NO: 187253 - DNA, 20 bp, Artificial Sequence
  Synthetic oligonucleotide; CAGGAT chr2 60544392 60544411 60544395 -
ttatctcccctaccccccag

SEQ ID NO: 187254 - DNA, 20 bp, Artificial Sequence
  Synthetic oligonucleotide; GGGAAT chr2 60544384 60544403 60544387 -
cctaccccccagcaggatgt

SEQ ID NO: 187255 - DNA, 20 bp, Artificial Sequence
  Synthetic oligonucleotide; GGGGAT chr2 60544294 60544313 60544297 -
tgaagcaagagcaggcggaa

SEQ ID NO: 187256 - DNA, 20 bp, Artificial Sequence
  Synthetic oligonucleotide; TGGAGT chr2 60544245 60544264 60544248 -
ccttgctaaatcaccaaata

SEQ ID NO: 187257 - DNA, 20 bp, Artificial Sequence
  Synthetic oligonucleotide; AAGAAT chr2 60544163 60544182 60544166 -
aaacacagtgtctgtcaagc

SEQ ID NO: 187258 - DNA, 20 bp, Artificial Sequence
  Synthetic oligonucleotide; AGGAAT chr2 60544069 60544088 60544072 -
tgtgcctctgtatttagagg

SEQ ID NO: 187259 - DNA, 20 bp, Artificial Sequence
  Synthetic oligonucleotide; GTGAAT chr2 60544009 60544028 60544012 -
agacttttactgctatagtt

SEQ ID NO: 187260 - DNA, 20 bp, Artificial Sequence
  Synthetic oligonucleotide; ATGAAT chr2 60543757 60543776 60543760 -
gtgaggtaaacctttcgtgc

SEQ ID NO: 187261 - DNA, 20 bp, Artificial Sequence
  Synthetic oligonucleotide; TAGAAT chr2 60543644 60543663 60543647 -
caaagtgagatgtcagtaac

SEQ ID NO: 187262 - DNA, 20 bp, Artificial Sequence
  Synthetic oligonucleotide; ATGAAT chr2 60543614 60543633 60543617 -
acttctcataattcacagta

SEQ ID NO: 187263 - DNA, 20 bp, Artificial Sequence
  Synthetic oligonucleotide; AAGAGT chr2 60543607 60543626 60543610 -
ataattcacagtaatgaatt

SEQ ID NO: 187264 - DNA, 20 bp, Artificial Sequence
  Synthetic oligonucleotide; TTGAAT chr2 60543400 60543419 60543403 -
agtaatcattcagtagatat

SEQ ID NO: 187265 - DNA, 20 bp, Artificial Sequence
  Synthetic oligonucleotide; ATGAAT chr2 60543338 60543357 60543341 -
ttaaggaaagagatatattg

SEQ ID NO: 187266 - DNA, 20 bp, Artificial Sequence
  Synthetic oligonucleotide; AAGAAT chr2 60543326 60543345 60543329 -
atatattgatgaatctctag

SEQ ID NO: 187267 - DNA, 20 bp, Artificial Sequence
  Synthetic oligonucleotide; CTGGGT chr2 60543281 60543300 60543284 -
aaggtagtcatttaagcgtg

SEQ ID NO: 187268 - DNA, 20 bp, Artificial Sequence
  Synthetic oligonucleotide; TTGGAT chr2 60543247 60543266 60543250 -
ctttattaaagtgatgtaag

SEQ ID NO: 187269 - DNA, 20 bp, Artificial Sequence
  Synthetic oligonucleotide; TTGAGT chr2 60543241 60543260 60543244 -
taaagtgatgtaagttggat

SEQ ID NO: 187270 - DNA, 20 bp, Artificial Sequence
  Synthetic oligonucleotide; AAGAAT chr2 60543199 60543218 60543202 -
ctattttataggcaggaagc

SEQ ID NO: 187271 - DNA, 20 bp, Artificial Sequence
  Synthetic oligonucleotide; TAGAAT chr2 60543154 60543173 60543157 -
ttcctaagataaataaagct

SEQ ID NO: 187272 - DNA, 20 bp, Artificial Sequence
  Synthetic oligonucleotide; GAGAAT chr2 60543131 60543150 60543134 -
aattcgggactttcagatag

SEQ ID NO: 187273 - DNA, 20 bp, Artificial Sequence
  Synthetic oligonucleotide; CAGAGT chr2 60543121 60543140 60543124 -
tttcagataggagaataagg

SEQ ID NO: 187274 - DNA, 20 bp, Artificial Sequence
  Synthetic oligonucleotide; TTGAGT chr2 60543105 60543124 60543108 -
aaggcagagttctttaaatc

SEQ ID NO: 187275 - DNA, 20 bp, Artificial Sequence
  Synthetic oligonucleotide; CTGAGT chr2 60543059 60543078 60543062 -
tgtactcaggcctctccaag

SEQ ID NO: 187276 - DNA, 20 bp, Artificial Sequence
  Synthetic oligonucleotide; CAGAGT chr2 60543027 60543046 60543030 -
tttttttttttttttttaga

SEQ ID NO: 187277 - DNA, 20 bp, Artificial Sequence
  Synthetic oligonucleotide; TGGAGT chr2 60543001 60543020 60543004 -
tttgctcttgttgcccaggc

SEQ ID NO: 187278 - DNA, 20 bp, Artificial Sequence
  Synthetic oligonucleotide; TGGGAT chr2 60542916 60542935 60542919 -
gcctcagcctcccaagtagc

SEQ ID NO: 187279 - DNA, 20 bp, Artificial Sequence
  Synthetic oligonucleotide; CAGGGT chr2 60542859 60542878 60542862 -
ttttgtattttcagtagagg

SEQ ID NO: 187280 - DNA, 20 bp, Artificial Sequence
  Synthetic oligonucleotide; TGGGAT chr2 60542780 60542799 60542783 -
ggcttggcctcccaaagtgc

SEQ ID NO: 187281 - DNA, 20 bp, Artificial Sequence
  Synthetic oligonucleotide; CTGAGT chr2 60542743 60542762 60542746 -
gcgaccgcacctggcccaaa

SEQ ID NO: 187282 - DNA, 20 bp, Artificial Sequence
  Synthetic oligonucleotide; GAGGAT chr2 60542729 60542748 60542732 -
cccaaactgagtatttttta

SEQ ID NO: 187283 - DNA, 20 bp, Artificial Sequence
  Synthetic oligonucleotide; GTGAAT chr2 60542711 60542730 60542714 -
tagaggattctttttacctg

SEQ ID NO: 187284 - DNA, 20 bp, Artificial Sequence
  Synthetic oligonucleotide; ATGGGT chr2 60542703 60542722 60542706 -
tctttttacctggtgaatag

SEQ ID NO: 187285 - DNA, 20 bp, Artificial Sequence
  Synthetic oligonucleotide; GGGAAT chr2 60542554 60542573 60542557 -
gaagtagtattaatttagct

SEQ ID NO: 187286 - DNA, 20 bp, Artificial Sequence
  Synthetic oligonucleotide; AGGGGT chr2 60542450 60542469 60542453 -
ttgcagtcagagctttcaat

SEQ ID NO: 187287 - DNA, 20 bp, Artificial Sequence
  Synthetic oligonucleotide; CTGAAT chr2 60542373 60542392 60542376 -
gaaatattcatggaagatta

SEQ ID NO: 187288 - DNA, 20 bp, Artificial Sequence
  Synthetic oligonucleotide; AGGAAT chr2 60542287 60542306 60542290 -
ggttttggcttattgcacat

SEQ ID NO: 187289 - DNA, 20 bp, Artificial Sequence
  Synthetic oligonucleotide; CAGGGT chr2 60542134 60542153 60542137 -
atgaacatagacatttatat

SEQ ID NO: 187290 - DNA, 20 bp, Artificial Sequence
  Synthetic oligonucleotide; CAGAAT chr2 60541984 60542003 60541987 -
atcaaatacaatatgctttt

SEQ ID NO: 187291 - DNA, 20 bp, Artificial Sequence
  Synthetic oligonucleotide; GAGGAT chr2 60541912 60541931 60541915 -
tcctagctcagactgaactg

SEQ ID NO: 187292 - DNA, 20 bp, Artificial Sequence
  Synthetic oligonucleotide; CTGAAT chr2 60541809 60541828 60541812 -
ttctctttatttatgtgatt

SEQ ID NO: 187293 - DNA, 20 bp, Artificial Sequence
  Synthetic oligonucleotide; GTGAAT chr2 60541783 60541802 60541786 -
aaaaacgactgacttctgaa

SEQ ID NO: 187294 - DNA, 20 bp, Artificial Sequence
  Synthetic oligonucleotide; GAGAGT chr2 60541692 60541711 60541695 -
ttacttaccttcaaaatcca

SEQ ID NO: 187295 - DNA, 20 bp, Artificial Sequence
  Synthetic oligonucleotide; GAGAAT chr2 60541685 60541704 60541688 -
ccttcaaaatccagagagta

SEQ ID NO: 187296 - DNA, 20 bp, Artificial Sequence
  Synthetic oligonucleotide; TAGGAT chr2 60541659 60541678 60541662 -
attgttttctaataagtacc

SEQ ID NO: 187297 - DNA, 20 bp, Artificial Sequence
  Synthetic oligonucleotide; GGGAGT chr2 60541595 60541614 60541598 -
agactaatgttcatgaaact

SEQ ID NO: 187298 - DNA, 20 bp, Artificial Sequence
  Synthetic oligonucleotide; TTGGAT chr2 60541534 60541553 60541537 -
aaaggttgtgaactggcagc

SEQ ID NO: 187299 - DNA, 20 bp, Artificial Sequence
  Synthetic oligonucleotide; GAGAAT chr2 60541216 60541235 60541219 -
tcttttataaataatgtttt

SEQ ID NO: 187300 - DNA, 20 bp, Artificial Sequence
  Synthetic oligonucleotide; AAGGAT chr2 60540880 60540899 60540883 -
caagttgtgcctttactata

SEQ ID NO: 187301 - DNA, 20 bp, Artificial Sequence
  Synthetic oligonucleotide; GTGAAT chr2 60540844 60540863 60540847 -
ttttgcacacctttctctta

SEQ ID NO: 187302 - DNA, 20 bp, Artificial Sequence
  Synthetic oligonucleotide; CTGGGT chr2 60540795 60540814 60540798 -
acatgggctggaaaatgcaa

SEQ ID NO: 187303 - DNA, 20 bp, Artificial Sequence
  Synthetic oligonucleotide; CAGGGT chr2 60540774 60540793 60540777 -
tgggtgtagaaacgtgcagg

SEQ ID NO: 187304 - DNA, 20 bp, Artificial Sequence
  Synthetic oligonucleotide; GCGAGT chr2 60540737 60540756 60540740 -
accttcagctcagggaggag

SEQ ID NO: 187305 - DNA, 20 bp, Artificial Sequence
  Synthetic oligonucleotide; TTGGAT chr2 60540732 60540751 60540735 -
cagctcagggaggaggcgag

SEQ ID NO: 187306 - DNA, 20 bp, Artificial Sequence
  Synthetic oligonucleotide; TAGAGT chr2 60540707 60540726 60540710 -
tgcttattaatggcatcttt

SEQ ID NO: 187307 - DNA, 20 bp, Artificial Sequence
  Synthetic oligonucleotide; GGGAGT chr2 60540649 60540668 60540652 -
ccatgtagtttggctaatgt

SEQ ID NO: 187308 - DNA, 20 bp, Artificial Sequence
  Synthetic oligonucleotide; TGGGGT chr2 60540636 60540655 60540639 -
ctaatgtgggagtactaaat

SEQ ID NO: 187309 - DNA, 20 bp, Artificial Sequence
  Synthetic oligonucleotide; GAGAAT chr2 60540555 60540574 60540558 -
aatgaaaatgtttaataaag

SEQ ID NO: 187310 - DNA, 20 bp, Artificial Sequence
  Synthetic oligonucleotide; GTGAAT chr2 60540547 60540566 60540550 -
tgtttaataaaggagaatag

SEQ ID NO: 187311 - DNA, 20 bp, Artificial Sequence
  Synthetic oligonucleotide; CTGGAT chr2 60540422 60540441 60540425 -
gatgcaccaagattgcgtca

SEQ ID NO: 187312 - DNA, 20 bp, Artificial Sequence
  Synthetic oligonucleotide; TTGGGT chr2 60540186 60540205 60540189 -
tctgcttgttcagatttcat

SEQ ID NO: 187313 - DNA, 20 bp, Artificial Sequence
  Synthetic oligonucleotide; AAGGAT chr2 60540151 60540170 60540154 -
gtcagcagtgttgttatttc

SEQ ID NO: 187314 - DNA, 20 bp, Artificial Sequence
  Synthetic oligonucleotide; TTGGAT chr2 60540068 60540087 60540071 -
tttttatgttatgtatcaat

SEQ ID NO: 187315 - DNA, 20 bp, Artificial Sequence
  Synthetic oligonucleotide; ATGGAT chr2 60540018 60540037 60540021 -
tgttcagactatataattta

SEQ ID NO: 187316 - DNA, 20 bp, Artificial Sequence
  Synthetic oligonucleotide; CAGGGT chr2 60539891 60539910 60539894 -
cagcttctcccctttacgac

SEQ ID NO: 187317 - DNA, 20 bp, Artificial Sequence
  Synthetic oligonucleotide; TGGAGT chr2 60539784 60539803 60539787 -
acgaaccatattattgctac

SEQ ID NO: 187318 - DNA, 20 bp, Artificial Sequence
  Synthetic oligonucleotide; AAGAAT chr2 60539731 60539750 60539734 -
ggaaatgtaacctgacaaat

SEQ ID NO: 187319 - DNA, 20 bp, Artificial Sequence
  Synthetic oligonucleotide; TTGGGT chr2 60539555 60539574 60539558 -
aaaatgtaacttattccata

SEQ ID NO: 187320 - DNA, 20 bp, Artificial Sequence
  Synthetic oligonucleotide; TGGAAT chr2 60539545 60539564 60539548 -
ttattccatattgggttcat

SEQ ID NO: 187321 - DNA, 20 bp, Artificial Sequence
  Synthetic oligonucleotide; CAGGGT chr2 60539458 60539477 60539461 -
aaggcttttgctgttcttag

SEQ ID NO: 187322 - DNA, 20 bp, Artificial Sequence
  Synthetic oligonucleotide; TGGGGT chr2 60539444 60539463 60539447 -
tcttagcagggttagtaact

SEQ ID NO: 187323 - DNA, 20 bp, Artificial Sequence
  Synthetic oligonucleotide; TTGAGT chr2 60539403 60539422 60539406 -
ttcgtcattctgcaatggca

SEQ ID NO: 187324 - DNA, 20 bp, Artificial Sequence
  Synthetic oligonucleotide; AAGGAT chr2 60539383 60539402 60539386 -
ttgagttaggttggcaaggg

SEQ ID NO: 187325 - DNA, 20 bp, Artificial Sequence
  Synthetic oligonucleotide; GGGGGT chr2 60539367 60539386 60539370 -
agggaaggatttgaggcatg

SEQ ID NO: 187326 - DNA, 20 bp, Artificial Sequence
  Synthetic oligonucleotide; GGGAAT chr2 60539336 60539355 60539339 -
ggtcacttctgatcccagca

SEQ ID NO: 187327 - DNA, 20 bp, Artificial Sequence
  Synthetic oligonucleotide; TGGAAT chr2 60539222 60539241 60539225 -
tgccctgtcagatgcggagc

SEQ ID NO: 187328 - DNA, 20 bp, Artificial Sequence
  Synthetic oligonucleotide; GGGAAT chr2 60539147 60539166 60539150 -
cttaatatgcagctagtctg

SEQ ID NO: 187329 - DNA, 20 bp, Artificial Sequence
  Synthetic oligonucleotide; TGGAGT chr2 60539019 60539038 60539022 -
acatcatccttttcttctct

SEQ ID NO: 187330 - DNA, 20 bp, Artificial Sequence
  Synthetic oligonucleotide; CAGAAT chr2 60538978 60538997 60538981 -
gccacctcccaattcaccac

SEQ ID NO: 187331 - DNA, 20 bp, Artificial Sequence
  Synthetic oligonucleotide; TTGAAT chr2 60538907 60538926 60538910 -
atatggttaattacaggcgt

SEQ ID NO: 187332 - DNA, 20 bp, Artificial Sequence
  Synthetic oligonucleotide; GGGAGT chr2 60538838 60538857 60538841 -
aagtatgtgatttgaacaaa

SEQ ID NO: 187333 - DNA, 20 bp, Artificial Sequence
  Synthetic oligonucleotide; TGGAAT chr2 60538642 60538661 60538645 -
tttaaaaaacaactttcaac

SEQ ID NO: 187334 - DNA, 20 bp, Artificial Sequence
  Synthetic oligonucleotide; TTGAGT chr2 60538608 60538627 60538611 -
aatatttcaccattatattt

SEQ ID NO: 187335 - DNA, 20 bp, Artificial Sequence
  Synthetic oligonucleotide; CAGAAT chr2 60538553 60538572 60538556 -
tttataatgtgttcctttaa

SEQ ID NO: 187336 - DNA, 20 bp, Artificial Sequence
  Synthetic oligonucleotide; GCGAAT chr2 60538445 60538464 60538448 -
aaataagctgctaagaactg

SEQ ID NO: 187337 - DNA, 20 bp, Artificial Sequence
  Synthetic oligonucleotide; GTGAGT chr2 60538381 60538400 60538384 -
ggttcaccctggagactgat

SEQ ID NO: 187338 - DNA, 20 bp, Artificial Sequence
  Synthetic oligonucleotide; GTGGAT chr2 60538377 60538396 60538380 -
caccctggagactgatgtga

SEQ ID NO: 187339 - DNA, 20 bp, Artificial Sequence
  Synthetic oligonucleotide; CAGAGT chr2 60538214 60538233 60538217 -
tagataaaataccaagttct

SEQ ID NO: 187340 - DNA, 20 bp, Artificial Sequence
  Synthetic oligonucleotide; CTGAAT chr2 60538086 60538105 60538089 -
tggcagcatgttattcagaa

SEQ ID NO: 187341 - DNA, 20 bp, Artificial Sequence
  Synthetic oligonucleotide; GAGAAT chr2 60538068 60538087 60538071 -
aactgaatcagtctctgcca

SEQ ID NO: 187342 - DNA, 20 bp, Artificial Sequence
  Synthetic oligonucleotide; GGGGAT chr2 60538027 60538046 60538030 -
ggagcaggtatgttgatgaa

SEQ ID NO: 187343 - DNA, 20 bp, Artificial Sequence
  Synthetic oligonucleotide; ATGAGT chr2 60537996 60538015 60537999 -
gggacctttggtcactcaca

SEQ ID NO: 187344 - DNA, 20 bp, Artificial Sequence
  Synthetic oligonucleotide; GCGAAT chr2 60537912 60537931 60537915 -
gattttagttttagatagag

SEQ ID NO: 187345 - DNA, 20 bp, Artificial Sequence
  Synthetic oligonucleotide; AAGAAT chr2 60537878 60537897 60537881 -
taaaaactcccattaaaata

SEQ ID NO: 187346 - DNA, 20 bp, Artificial Sequence
  Synthetic oligonucleotide; TGGAAT chr2 60537873 60537892 60537876 -
actcccattaaaataaagaa

SEQ ID NO: 187347 - DNA, 20 bp, Artificial Sequence
  Synthetic oligonucleotide; AAGGGT chr2 60537852 60537871 60537855 -
ggaattattgtgaaacctgc

SEQ ID NO: 187348 - DNA, 20 bp, Artificial Sequence
  Synthetic oligonucleotide; TTGGAT chr2 60537635 60537654 60537638 -
ttagggaaataaagtgtagc

SEQ ID NO: 187349 - DNA, 20 bp, Artificial Sequence
  Synthetic oligonucleotide; TAGAGT chr2 60537572 60537591 60537575 -
gttcctgtacattttaaata

SEQ ID NO: 187350 - DNA, 20 bp, Artificial Sequence
  Synthetic oligonucleotide; GTGAGT chr2 60537327 60537346 60537330 -
aatgttaaatcttaaatctc

SEQ ID NO: 187351 - DNA, 20 bp, Artificial Sequence
  Synthetic oligonucleotide; AAGAAT chr2 60537251 60537270 60537254 -
aaactgaacattggctactg

SEQ ID NO: 187352 - DNA, 20 bp, Artificial Sequence
  Synthetic oligonucleotide; TTGGAT chr2 60537129 60537148 60537132 -
taattctgataaagatactc

SEQ ID NO: 187353 - DNA, 20 bp, Artificial Sequence
  Synthetic oligonucleotide; GTGGAT chr2 60536997 60537016 60537000 -
aaatcttattctacatacaa

SEQ ID NO: 187354 - DNA, 20 bp, Artificial Sequence
  Synthetic oligonucleotide; CTGGGT chr2 60536865 60536884 60536868 -
cttttgtgcttgtcccagct

SEQ ID NO: 187355 - DNA, 20 bp, Artificial Sequence
  Synthetic oligonucleotide; AGGAAT chr2 60536760 60536779 60536763 -
tataggtattgtatttaaag

SEQ ID NO: 187356 - DNA, 20 bp, Artificial Sequence
  Synthetic oligonucleotide; GGGGGT chr2 60536691 60536710 60536694 -
gattgcggtgttgccagcag

SEQ ID NO: 187357 - DNA, 20 bp, Artificial Sequence
  Synthetic oligonucleotide; TAGAGT chr2 60536514 60536533 60536517 -
ctcattgaactctactcatg

SEQ ID NO: 187358 - DNA, 20 bp, Artificial Sequence
  Synthetic oligonucleotide; CGGAAT chr2 60536493 60536512 60536496 -
agagtaacattagtgtcaaa

SEQ ID NO: 187359 - DNA, 20 bp, Artificial Sequence
  Synthetic oligonucleotide; GTGGAT chr2 60536449 60536468 60536452 -
tgtggctcatacagatggtt

SEQ ID NO: 187360 - DNA, 20 bp, Artificial Sequence
  Synthetic oligonucleotide; GTGGGT chr2 60536443 60536462 60536446 -
tcatacagatggttgtggat

SEQ ID NO: 187361 - DNA, 20 bp, Artificial Sequence
  Synthetic oligonucleotide; AAGGAT chr2 60536369 60536388 60536372 -
cacatttctgagcagggccc

SEQ ID NO: 187362 - DNA, 20 bp, Artificial Sequence
  Synthetic oligonucleotide; GAGAGT chr2 60536361 60536380 60536364 -
tgagcagggcccaaggataa

SEQ ID NO: 187363 - DNA, 20 bp, Artificial Sequence
  Synthetic oligonucleotide; GGGGGT chr2 60536345 60536364 60536348 -
ataagagagttaagaaatca

SEQ ID NO: 187364 - DNA, 20 bp, Artificial Sequence
  Synthetic oligonucleotide; AAGGGT chr2 60536231 60536250 60536234 -
gctgggggagagagggggag

SEQ ID NO: 187365 - DNA, 20 bp, Artificial Sequence
  Synthetic oligonucleotide; TGGAAT chr2 60536210 60536229 60536213 -
agggtgcggagagaggttct

SEQ ID NO: 187366 - DNA, 20 bp, Artificial Sequence
  Synthetic oligonucleotide; TTGGGT chr2 60536159 60536178 60536162 -
atccccacagcagagagctt

SEQ ID NO: 187367 - DNA, 20 bp, Artificial Sequence
  Synthetic oligonucleotide; CTGGGT chr2 60536044 60536063 60536047 -
atatactttcttgctttcac

SEQ ID NO: 187368 - DNA, 20 bp, Artificial Sequence
  Synthetic oligonucleotide; TGGGGT chr2 60536029 60536048 60536032 -
ttcacctgggttggagaggt

SEQ ID NO: 187369 - DNA, 20 bp, Artificial Sequence
  Synthetic oligonucleotide; AGGAGT chr2 60536010 60536029 60536013 -
ttggggttgggaggaagagg

SEQ ID NO: 187370 - DNA, 20 bp, Artificial Sequence
  Synthetic oligonucleotide; GGGAAT chr2 60535999 60536018 60536002 -
aggaagaggaggagttcatt

SEQ ID NO: 187371 - DNA, 20 bp, Artificial Sequence
  Synthetic oligonucleotide; TAGAAT chr2 60535985 60536004 60535988 -
ttcattgggaattctgtcac

SEQ ID NO: 187372 - DNA, 20 bp, Artificial Sequence
  Synthetic oligonucleotide; GTGAGT chr2 60535951 60535970 60535954 -
tgtcaggaggttagcaaggt

SEQ ID NO: 187373 - DNA, 20 bp, Artificial Sequence
  Synthetic oligonucleotide; AAGGAT chr2 60535932 60535951 60535935 -
tgtgagttagcattcaagca

SEQ ID NO: 187374 - DNA, 20 bp, Artificial Sequence
  Synthetic oligonucleotide; TGGGGT chr2 60535863 60535882 60535866 -
ccacgatactctctaataac

SEQ ID NO: 187375 - DNA, 20 bp, Artificial Sequence
  Synthetic oligonucleotide; TGGGAT chr2 60535858 60535877 60535861 -
atactctctaataactgggg

SEQ ID NO: 187376 - DNA, 20 bp, Artificial Sequence
  Synthetic oligonucleotide; GTGGGT chr2 60535845 60535864 60535848 -
actggggtgggatggtggtg

SEQ ID NO: 187377 - DNA, 20 bp, Artificial Sequence
  Synthetic oligonucleotide; CTGAAT chr2 60535824 60535843 60535827 -
tgggtggacaccacaacttt

SEQ ID NO: 187378 - DNA, 20 bp, Artificial Sequence
  Synthetic oligonucleotide; ATGGAT chr2 60535788 60535807 60535791 -
gtctgcatgacccgttcacc

SEQ ID NO: 187379 - DNA, 20 bp, Artificial Sequence
  Synthetic oligonucleotide; CCGAAT chr2 60535767 60535786 60535770 -
tggattaaatgcggctggtg

SEQ ID NO: 187380 - DNA, 20 bp, Artificial Sequence
  Synthetic oligonucleotide; CAGGAT chr2 60535730 60535749 60535733 -
gaaaggcaaatctcaagcaa

SEQ ID NO: 187381 - DNA, 20 bp, Artificial Sequence
  Synthetic oligonucleotide; GTGGAT chr2 60535586 60535605 60535589 -
aaagctgtttttataccaca

SEQ ID NO: 187382 - DNA, 20 bp, Artificial Sequence
  Synthetic oligonucleotide; AAGGGT chr2 60535537 60535556 60535540 -
agggggaaaaggctttttgg

SEQ ID NO: 187383 - DNA, 20 bp, Artificial Sequence
  Synthetic oligonucleotide; TTGGAT chr2 60535250 60535269 60535253 -
gaagaaaaaccctttgcttt

SEQ ID NO: 187384 - DNA, 20 bp, Artificial Sequence
  Synthetic oligonucleotide; ATGAAT chr2 60535246 60535265 60535249 -
aaaaaccctttgctttttgg

SEQ ID NO: 187385 - DNA, 20 bp, Artificial Sequence
  Synthetic oligonucleotide; TTGAAT chr2 60535214 60535233 60535217 -
gataatttgctaaagctcat

SEQ ID NO: 187386 - DNA, 20 bp, Artificial Sequence
  Synthetic oligonucleotide; ATGAAT chr2 60535169 60535188 60535172 -
ttcaaaggctaaattgcttt

SEQ ID NO: 187387 - DNA, 20 bp, Artificial Sequence
  Synthetic oligonucleotide; GCGAAT chr2 60535089 60535108 60535092 -
attaggtccttccagtaatt

SEQ ID NO: 187388 - DNA, 20 bp, Artificial Sequence
  Synthetic oligonucleotide; GTGAAT chr2 60534705 60534724 60534708 -
ttcttgccaagtttccttta

SEQ ID NO: 187389 - DNA, 20 bp, Artificial Sequence
  Synthetic oligonucleotide; AGGAAT chr2 60534697 60534716 60534700 -
aagtttcctttagtgaattg

SEQ ID NO: 187390 - DNA, 20 bp, Artificial Sequence
  Synthetic oligonucleotide; TTGAGT chr2 60534678 60534697 60534681 -
gaggaattagaagtctaacc

SEQ ID NO: 187391 - DNA, 20 bp, Artificial Sequence
  Synthetic oligonucleotide; CTGGGT chr2 60534329 60534348 60534332 -
ggcacctaaaggacttgggc

SEQ ID NO: 187392 - DNA, 20 bp, Artificial Sequence
  Synthetic oligonucleotide; ACGAGT chr2 60534182 60534201 60534185 -
cagtgtctccctcaaggtac

SEQ ID NO: 187393 - DNA, 20 bp, Artificial Sequence
  Synthetic oligonucleotide; TTGAAT chr2 60534097 60534116 60534100 -
tttggtgtttgcctttgctg

SEQ ID NO: 187394 - DNA, 20 bp, Artificial Sequence
  Synthetic oligonucleotide; ATGAGT chr2 60534055 60534074 60534058 -
ttgatgttcatctttggttt

SEQ ID NO: 187395 - DNA, 20 bp, Artificial Sequence
  Synthetic oligonucleotide; CAGAAT chr2 60534031 60534050 60534034 -
gtttatcactggttaacaag

SEQ ID NO: 187396 - DNA, 20 bp, Artificial Sequence
  Synthetic oligonucleotide; ACGAAT chr2 60533995 60534014 60533998 -
taactgatattctgattaaa

SEQ ID NO: 187397 - DNA, 20 bp, Artificial Sequence
  Synthetic oligonucleotide; TGGGGT chr2 60533763 60533782 60533766 -
taggcagtaagatgaactga

SEQ ID NO: 187398 - DNA, 20 bp, Artificial Sequence
  Synthetic oligonucleotide; ATGGAT chr2 60533596 60533615 60533599 -
ctaagatatgatgaaatcta

SEQ ID NO: 187399 - DNA, 20 bp, Artificial Sequence
  Synthetic oligonucleotide; CTGAGT chr2 60533540 60533559 60533543 -
tcttcatactttatgtgggg

SEQ ID NO: 187400 - DNA, 20 bp, Artificial Sequence
  Synthetic oligonucleotide; AGGGGT chr2 60533521 60533540 60533524 -
gctgagtgggcagtggagaa

SEQ ID NO: 187401 - DNA, 20 bp, Artificial Sequence
  Synthetic oligonucleotide; GTGGAT chr2 60533440 60533459 60533443 -
ctgcttcagtcgcgttggct

SEQ ID NO: 187402 - DNA, 20 bp, Artificial Sequence
  Synthetic oligonucleotide; AGGGAT chr2 60533315 60533334 60533318 -
tcccccaaactttacaagaa

SEQ ID NO: 187403 - DNA, 20 bp, Artificial Sequence
  Synthetic oligonucleotide; AGGAGT chr2 60533250 60533269 60533253 -
ccttattattcagtctatcc

SEQ ID NO: 187404 - DNA, 20 bp, Artificial Sequence
  Synthetic oligonucleotide; AGGAAT chr2 60533217 60533236 60533220 -
tgtcggtttatttaacttcc

SEQ ID NO: 187405 - DNA, 20 bp, Artificial Sequence
  Synthetic oligonucleotide; TAGAGT chr2 60533165 60533184 60533168 -
agcaagaaagattacagtat

SEQ ID NO: 187406 - DNA, 20 bp, Artificial Sequence
  Synthetic oligonucleotide; TGGAGT chr2 60533055 60533074 60533058 -
actggaaacttctgcttata

SEQ ID NO: 187407 - DNA, 20 bp, Artificial Sequence
  Synthetic oligonucleotide; CAGGGT chr2 60533009 60533028 60533012 -
ttggcataatctagtgtacc

SEQ ID NO: 187408 - DNA, 20 bp, Artificial Sequence
  Synthetic oligonucleotide; TAGAAT chr2 60532928 60532947 60532931 -
aggaagtaaataaaaagtat

SEQ ID NO: 187409 - DNA, 20 bp, Artificial Sequence
  Synthetic oligonucleotide; GGGAAT chr2 60532826 60532845 60532829 -
cttttgaaaatgtattttca

SEQ ID NO: 187410 - DNA, 20 bp, Artificial Sequence
  Synthetic oligonucleotide; GGGAGT chr2 60532729 60532748 60532732 -
tgtttttcgaagtacttaaa

SEQ ID NO: 187411 - DNA, 20 bp, Artificial Sequence
  Synthetic oligonucleotide; AGGGGT chr2 60532721 60532740 60532724 -
gaagtacttaaagggagtgg

SEQ ID NO: 187412 - DNA, 20 bp, Artificial Sequence
  Synthetic oligonucleotide; GTGAAT chr2 60532702 60532721 60532705 -
gaggggtagaaagcatataa

SEQ ID NO: 187413 - DNA, 20 bp, Artificial Sequence
  Synthetic oligonucleotide; AGGAAT chr2 60532603 60532622 60532606 -
gcaaacatatccttatgcca

SEQ ID NO: 187414 - DNA, 20 bp, Artificial Sequence
  Synthetic oligonucleotide; GAGAGT chr2 60532523 60532542 60532526 -
gtaaatcagtaaaccaggca

SEQ ID NO: 187415 - DNA, 20 bp, Artificial Sequence
  Synthetic oligonucleotide; CAGAGT chr2 60532483 60532502 60532486 -
ggaaaccaaatcataatacc

SEQ ID NO: 187416 - DNA, 20 bp, Artificial Sequence
  Synthetic oligonucleotide; CAGAAT chr2 60532360 60532379 60532363 -
ttttaaaaaactggaaatga

SEQ ID NO: 187417 - DNA, 20 bp, Artificial Sequence
  Synthetic oligonucleotide; GGGGGT chr2 60532166 60532185 60532169 -
gaagaacttctgtgattact

SEQ ID NO: 187418 - DNA, 20 bp, Artificial Sequence
  Synthetic oligonucleotide; GTGGGT chr2 60532105 60532124 60532108 -
taattagattcgattgtgcg

SEQ ID NO: 187419 - DNA, 20 bp, Artificial Sequence
  Synthetic oligonucleotide; TTGGAT chr2 60532096 60532115 60532099 -
tcgattgtgcggtgggtgtg

SEQ ID NO: 187420 - DNA, 20 bp, Artificial Sequence
  Synthetic oligonucleotide; GGGAGT chr2 60532069 60532088 60532072 -
tggggggaggggcagaggca

SEQ ID NO: 187421 - DNA, 20 bp, Artificial Sequence
  Synthetic oligonucleotide; TGGGGT chr2 60532061 60532080 60532064 -
ggggcagaggcagggagtgc

SEQ ID NO: 187422 - DNA, 20 bp, Artificial Sequence
  Synthetic oligonucleotide; CTGAGT chr2 60532044 60532063 60532047 -
tgctggggtgaggcgtgagg

SEQ ID NO: 187423 - DNA, 20 bp, Artificial Sequence
  Synthetic oligonucleotide; CAGGAT chr2 60531971 60531990 60531974 -
ggcagcttccaacgctggtg

SEQ ID NO: 187424 - DNA, 20 bp, Artificial Sequence
  Synthetic oligonucleotide; TTGAGT chr2 60531928 60531947 60531931 -
atgctcatggtgccctagtc

SEQ ID NO: 187425 - DNA, 20 bp, Artificial Sequence
  Synthetic oligonucleotide; CTGGGT chr2 60531895 60531914 60531898 -
ttaggtgggcttatttccca

SEQ ID NO: 187426 - DNA, 20 bp, Artificial Sequence
  Synthetic oligonucleotide; GGGGAT chr2 60531886 60531905 60531889 -
cttatttcccactgggtctg

SEQ ID NO: 187427 - DNA, 20 bp, Artificial Sequence
  Synthetic oligonucleotide; CAGGGT chr2 60531860 60531879 60531863 -
ttcatttgtcctttgagggg

SEQ ID NO: 187428 - DNA, 20 bp, Artificial Sequence
  Synthetic oligonucleotide; GAGGGT chr2 60531823 60531842 60531826 -
gaacagctgcggccggcaga

SEQ ID NO: 187429 - DNA, 20 bp, Artificial Sequence
  Synthetic oligonucleotide; GTGGGT chr2 60531794 60531813 60531797 -
taggaagagggaagcagcct

SEQ ID NO: 187430 - DNA, 20 bp, Artificial Sequence
  Synthetic oligonucleotide; CTGAAT chr2 60531765 60531784 60531768 -
ttcccgaccacatggaaagg

SEQ ID NO: 187431 - DNA, 20 bp, Artificial Sequence
  Synthetic oligonucleotide; TTGGGT chr2 60531739 60531758 60531742 -
aagacgttatggaccctgcc

SEQ ID NO: 187432 - DNA, 20 bp, Artificial Sequence
  Synthetic oligonucleotide; TGGGGT chr2 60531731 60531750 60531734 -
atggaccctgccttgggtac

SEQ ID NO: 187433 - DNA, 20 bp, Artificial Sequence
  Synthetic oligonucleotide; TTGAGT chr2 60531662 60531681 60531665 -
ggcactgccaaaacacgctc

SEQ ID NO: 187434 - DNA, 20 bp, Artificial Sequence
  Synthetic oligonucleotide; CTGAGT chr2 60531638 60531657 60531641 -
gtttaatggtagtggttggt

SEQ ID NO: 187435 - DNA, 20 bp, Artificial Sequence
  Synthetic oligonucleotide; ATGAAT chr2 60531553 60531572 60531556 -
aaaagccctggccaaggctt

SEQ ID NO: 187436 - DNA, 20 bp, Artificial Sequence
  Synthetic oligonucleotide; CAGGGT chr2 60531405 60531424 60531408 -
gcttgcatttaattgcaagt

SEQ ID NO: 187437 - DNA, 20 bp, Artificial Sequence
  Synthetic oligonucleotide; ATGGAT chr2 60531393 60531412 60531396 -
ttgcaagtcagggtaaatta

SEQ ID NO: 187438 - DNA, 20 bp, Artificial Sequence
  Synthetic oligonucleotide; GAGGGT chr2 60531289 60531308 60531292 -
ctggtttagtgttagtgtga

SEQ ID NO: 187439 - DNA, 20 bp, Artificial Sequence
  Synthetic oligonucleotide; GTGGGT chr2 60531271 60531290 60531274 -
gagagggtcgaaaagattct

SEQ ID NO: 187440 - DNA, 20 bp, Artificial Sequence
  Synthetic oligonucleotide; CGGGAT chr2 60531261 60531280 60531264 -
aaaagattctgtgggtccaa

SEQ ID NO: 187441 - DNA, 20 bp, Artificial Sequence
  Synthetic oligonucleotide; CGGAGT chr2 60531198 60531217 60531201 -
gggaggagaaaaacctggac

SEQ ID NO: 187442 - DNA, 20 bp, Artificial Sequence
  Synthetic oligonucleotide; TAGGGT chr2 60531193 60531212 60531196 -
gagaaaaacctggaccggag

SEQ ID NO: 187443 - DNA, 20 bp, Artificial Sequence
  Synthetic oligonucleotide; CAGAAT chr2 60530987 60531006 60530990 -
agccagactggtttagcaga

SEQ ID NO: 187444 - DNA, 20 bp, Artificial Sequence
  Synthetic oligonucleotide; AGGGGT chr2 60530965 60530984 60530968 -
gaatgatagattgttttgtc

SEQ ID NO: 187445 - DNA, 20 bp, Artificial Sequence
  Synthetic oligonucleotide; CAGGGT chr2 60530957 60530976 60530960 -
gattgttttgtcaggggtcc

SEQ ID NO: 187446 - DNA, 20 bp, Artificial Sequence
  Synthetic oligonucleotide; TTGAAT chr2 60530921 60530940 60530924 -
cttgaagcactttgtttatc

SEQ ID NO: 187447 - DNA, 20 bp, Artificial Sequence
  Synthetic oligonucleotide; AGGGGT chr2 60530836 60530855 60530839 -
gagaacagagaagactcagg

SEQ ID NO: 187448 - DNA, 20 bp, Artificial Sequence
  Synthetic oligonucleotide; GCGGGT chr2 60530535 60530554 60530538 -
ccagtcttttggctacatat

SEQ ID NO: 187449 - DNA, 20 bp, Artificial Sequence
  Synthetic oligonucleotide; AAGGGT chr2 60530457 60530476 60530460 -
taacccgagggccagatggg

SEQ ID NO: 187450 - DNA, 20 bp, Artificial Sequence
  Synthetic oligonucleotide; TGGGGT chr2 60530408 60530427 60530411 -
tgtgagagctcgtggtgcag

SEQ ID NO: 187451 - DNA, 20 bp, Artificial Sequence
  Synthetic oligonucleotide; GTGAAT chr2 60530300 60530319 60530303 -
ttaacttgttggaagggcct

SEQ ID NO: 187452 - DNA, 20 bp, Artificial Sequence
  Synthetic oligonucleotide; AGGGGT chr2 60530230 60530249 60530233 -
aggaaggctcaagaaaggcc

SEQ ID NO: 187453 - DNA, 20 bp, Artificial Sequence
  Synthetic oligonucleotide; ATGAAT chr2 60530067 60530086 60530070 -
gtgacattatgcattcatat

SEQ ID NO: 187454 - DNA, 20 bp, Artificial Sequence
  Synthetic oligonucleotide; AGGAGT chr2 60530051 60530070 60530054 -
atatatgaatgttggcaagc

SEQ ID NO: 187455 - DNA, 20 bp, Artificial Sequence
  Synthetic oligonucleotide; TTGAAT chr2 60529966 60529985 60529969 -
tgccacaagtggcgaagtaa

SEQ ID NO: 187456 - DNA, 20 bp, Artificial Sequence
  Synthetic oligonucleotide; CTGGGT chr2 60529895 60529914 60529898 -
aggagctgctggggctaaag

SEQ ID NO: 187457 - DNA, 20 bp, Artificial Sequence
  Synthetic oligonucleotide; TAGAAT chr2 60529886 60529905 60529889 -
tggggctaaagctgggttca

SEQ ID NO: 187458 - DNA, 20 bp, Artificial Sequence
  Synthetic oligonucleotide; CAGGAT chr2 60529707 60529726 60529710 -
gctaggcctcataagggagg

SEQ ID NO: 187459 - DNA, 20 bp, Artificial Sequence
  Synthetic oligonucleotide; CTGGGT chr2 60529650 60529669 60529653 -
ctgggaaaatttgggggcct

SEQ ID NO: 187460 - DNA, 20 bp, Artificial Sequence
  Synthetic oligonucleotide; ATGGAT chr2 60529637 60529656 60529640 -
ggggcctctgggtttatccc

SEQ ID NO: 187461 - DNA, 20 bp, Artificial Sequence
  Synthetic oligonucleotide; GAGGGT chr2 60529436 60529455 60529439 -
gaaataaaatggtttaggct

SEQ ID NO: 187462 - DNA, 20 bp, Artificial Sequence
  Synthetic oligonucleotide; GAGAAT chr2 60529347 60529366 60529350 -
tcctcaatctgtaaagtggg

SEQ ID NO: 187463 - DNA, 20 bp, Artificial Sequence
  Synthetic oligonucleotide; TGGGGT chr2 60529198 60529217 60529201 -
ggcttggaactgtgtgctcc

SEQ ID NO: 187464 - DNA, 20 bp, Artificial Sequence
  Synthetic oligonucleotide; TGGGGT chr2 60529171 60529190 60529174 -
tcaaagtagttcccccatta

SEQ ID NO: 187465 - DNA, 20 bp, Artificial Sequence
  Synthetic oligonucleotide; TGGGAT chr2 60529157 60529176 60529160 -
ccattatggggtgagcaggt

SEQ ID NO: 187466 - DNA, 20 bp, Artificial Sequence
  Synthetic oligonucleotide; GGGGGT chr2 60529131 60529150 60529134 -
gagagaagagcagggcaggt

SEQ ID NO: 187467 - DNA, 20 bp, Artificial Sequence
  Synthetic oligonucleotide; CAGGGT chr2 60529115 60529134 60529118 -
aggtgggggtctaaagagct

SEQ ID NO: 187468 - DNA, 20 bp, Artificial Sequence
  Synthetic oligonucleotide; GTGGGT chr2 60529080 60529099 60529083 -
tttctggtggcagctccctc

SEQ ID NO: 187469 - DNA, 20 bp, Artificial Sequence
  Synthetic oligonucleotide; GGGAGT chr2 60529074 60529093 60529077 -
gtggcagctccctcgtgggt

SEQ ID NO: 187470 - DNA, 20 bp, Artificial Sequence
  Synthetic oligonucleotide; CTGGGT chr2 60529020 60529039 60529023 -
tacgagaggcttgtgcctgc

SEQ ID NO: 187471 - DNA, 20 bp, Artificial Sequence
  Synthetic oligonucleotide; CTGGGT chr2 60528998 60529017 60529001 -
gggtgtgtgacacagttact

SEQ ID NO: 187472 - DNA, 20 bp, Artificial Sequence
  Synthetic oligonucleotide; GAGAGT chr2 60528961 60528980 60528964 -
tgttactgctagctggttgg

SEQ ID NO: 187473 - DNA, 20 bp, Artificial Sequence
  Synthetic oligonucleotide; GGGAAT chr2 60528951 60528970 60528954 -
agctggttgggagagtctga

SEQ ID NO: 187474 - DNA, 20 bp, Artificial Sequence
  Synthetic oligonucleotide; TAGAGT chr2 60528897 60528916 60528900 -
actcaaggtcccttacctca

SEQ ID NO: 187475 - DNA, 20 bp, Artificial Sequence
  Synthetic oligonucleotide; CAGAAT chr2 60528832 60528851 60528835 -
cgctccgggggctgcacctc

SEQ ID NO: 187476 - DNA, 20 bp, Artificial Sequence
  Synthetic oligonucleotide; TGGGGT chr2 60528722 60528741 60528725 -
catttggtagaggaggaaat

SEQ ID NO: 187477 - DNA, 20 bp, Artificial Sequence
  Synthetic oligonucleotide; AAGGGT chr2 60528711 60528730 60528714 -
ggaggaaattggggttcatc

SEQ ID NO: 187478 - DNA, 20 bp, Artificial Sequence
  Synthetic oligonucleotide; GAGGGT chr2 60528691 60528710 60528694 -
aagggttaaatgacttccct

SEQ ID NO: 187479 - DNA, 20 bp, Artificial Sequence
  Synthetic oligonucleotide; ATGGGT chr2 60528555 60528574 60528558 -
gctggacagttgtccctccc

SEQ ID NO: 187480 - DNA, 20 bp, Artificial Sequence
  Synthetic oligonucleotide; AAGAAT chr2 60528514 60528533 60528517 -
ttcaatcttctgggaaagag

SEQ ID NO: 187481 - DNA, 20 bp, Artificial Sequence
  Synthetic oligonucleotide; AGGAAT chr2 60528446 60528465 60528449 -
ttgggaaaagttgcaatgta

SEQ ID NO: 187482 - DNA, 20 bp, Artificial Sequence
  Synthetic oligonucleotide; CAGAAT chr2 60528407 60528426 60528410 -
tagtcatttccccatctgtc

SEQ ID NO: 187483 - DNA, 20 bp, Artificial Sequence
  Synthetic oligonucleotide; GAGGGT chr2 60528385 60528404 60528388 -
gaatgagcctgaaatcaagt

SEQ ID NO: 187484 - DNA, 20 bp, Artificial Sequence
  Synthetic oligonucleotide; CTGAAT chr2 60528315 60528334 60528318 -
ggtcaggagactgcagtggg

SEQ ID NO: 187485 - DNA, 20 bp, Artificial Sequence
  Synthetic oligonucleotide; TCGGAT chr2 60528227 60528246 60528230 -
gtctctgtggcatttacttc

SEQ ID NO: 187486 - DNA, 20 bp, Artificial Sequence
  Synthetic oligonucleotide; GAGAAT chr2 60528202 60528221 60528205 -
tcgtaccttcaaaggctggg

SEQ ID NO: 187487 - DNA, 20 bp, Artificial Sequence
  Synthetic oligonucleotide; CAGAAT chr2 60528196 60528215 60528199 -
cttcaaaggctggggagaat

SEQ ID NO: 187488 - DNA, 20 bp, Artificial Sequence
  Synthetic oligonucleotide; CTGAGT chr2 60528172 60528191 60528175 -
attatacagggagggagaga

SEQ ID NO: 187489 - DNA, 20 bp, Artificial Sequence
  Synthetic oligonucleotide; GTGAGT chr2 60528166 60528185 60528169 -
cagggagggagagactgagt

SEQ ID NO: 187490 - DNA, 20 bp, Artificial Sequence
  Synthetic oligonucleotide; GTGAGT chr2 60528162 60528181 60528165 -
gagggagagactgagtgtga

SEQ ID NO: 187491 - DNA, 20 bp, Artificial Sequence
  Synthetic oligonucleotide; ATGGGT chr2 60528128 60528147 60528131 -
cagtggtgtttcttaggacg

SEQ ID NO: 187492 - DNA, 20 bp, Artificial Sequence
  Synthetic oligonucleotide; GGGGGT chr2 60528118 60528137 60528121 -
tcttaggacgatgggttctg

SEQ ID NO: 187493 - DNA, 20 bp, Artificial Sequence
  Synthetic oligonucleotide; TTGAAT chr2 60528021 60528040 60528024 -
ctggaaacttgagggaagtt

SEQ ID NO: 187494 - DNA, 20 bp, Artificial Sequence
  Synthetic oligonucleotide; ATGGAT chr2 60527868 60527887 60527871 -
agacctgaggttcgttgcag

SEQ ID NO: 187495 - DNA, 20 bp, Artificial Sequence
  Synthetic oligonucleotide; GAGAAT chr2 60527774 60527793 60527777 -
ctaacatagacctccactga

SEQ ID NO: 187496 - DNA, 20 bp, Artificial Sequence
  Synthetic oligonucleotide; CAGAAT chr2 60527766 60527785 60527769 -
gacctccactgagagaattt

SEQ ID NO: 187497 - DNA, 20 bp, Artificial Sequence
  Synthetic oligonucleotide; AGGAGT chr2 60527714 60527733 60527717 -
tcatgcggaggccccgtggg

SEQ ID NO: 187498 - DNA, 20 bp, Artificial Sequence
  Synthetic oligonucleotide; AAGAGT chr2 60527706 60527725 60527709 -
aggccccgtgggaggagtgg

SEQ ID NO: 187499 - DNA, 20 bp, Artificial Sequence
  Synthetic oligonucleotide; GCGAGT chr2 60527686 60527705 60527689 -
aagagttggcctcagcactg

SEQ ID NO: 187500 - DNA, 20 bp, Artificial Sequence
  Synthetic oligonucleotide; TCGGAT chr2 60527679 60527698 60527682 -
ggcctcagcactggcgagta

SEQ ID NO: 187501 - DNA, 20 bp, Artificial Sequence
  Synthetic oligonucleotide; CTGAGT chr2 60527577 60527596 60527580 -
ggtcacatccaggttgtctt

SEQ ID NO: 187502 - DNA, 20 bp, Artificial Sequence
  Synthetic oligonucleotide; TGGGAT chr2 60527565 60527584 60527568 -
gttgtcttctgagtttgagg

SEQ ID NO: 187503 - DNA, 20 bp, Artificial Sequence
  Synthetic oligonucleotide; GAGAAT chr2 60527546 60527565 60527549 -
gtgggatggaggtggctgct

SEQ ID NO: 187504 - DNA, 20 bp, Artificial Sequence
  Synthetic oligonucleotide; GTGGGT chr2 60527536 60527555 60527539 -
ggtggctgctgagaatccat

SEQ ID NO: 187505 - DNA, 20 bp, Artificial Sequence
  Synthetic oligonucleotide; TTGGGT chr2 60527404 60527423 60527407 -
ttcattgtctctacataccc

SEQ ID NO: 187506 - DNA, 20 bp, Artificial Sequence
  Synthetic oligonucleotide; AAGAGT chr2 60527397 60527416 60527400 -
tctctacatacccttgggtc

SEQ ID NO: 187507 - DNA, 20 bp, Artificial Sequence
  Synthetic oligonucleotide; CTGGGT chr2 60527341 60527360 60527344 -
gaagctcttagttttatttg

SEQ ID NO: 187508 - DNA, 20 bp, Artificial Sequence
  Synthetic oligonucleotide; CTGGAT chr2 60527094 60527113 60527097 -
tgacccttcaggccaagtgc

SEQ ID NO: 187509 - DNA, 20 bp, Artificial Sequence
  Synthetic oligonucleotide; TCGAAT chr2 60527067 60527086 60527070 -
tggcaaagctacaataaata

SEQ ID NO: 187510 - DNA, 20 bp, Artificial Sequence
  Synthetic oligonucleotide; TTGGAT chr2 60526986 60527005 60526989 -
gtggactggttaagaggctg

SEQ ID NO: 187511 - DNA, 20 bp, Artificial Sequence
  Synthetic oligonucleotide; CCGGGT chr2 60526977 60526996 60526980 -
ttaagaggctgttggatgag

SEQ ID NO: 187512 - DNA, 20 bp, Artificial Sequence
  Synthetic oligonucleotide; AAGAAT chr2 60526872 60526891 60526875 -
tgctaagtagttccccgctt

SEQ ID NO: 187513 - DNA, 20 bp, Artificial Sequence
  Synthetic oligonucleotide; GGGAGT chr2 60526840 60526859 60526843 -
gctgggcagagattagcgca

SEQ ID NO: 187514 - DNA, 20 bp, Artificial Sequence
  Synthetic oligonucleotide; ATGAAT chr2 60526821 60526840 60526824 -
agggagttgtgtgtgtcaca

SEQ ID NO: 187515 - DNA, 20 bp, Artificial Sequence
  Synthetic oligonucleotide; GGGGGT chr2 60526460 60526479 60526463 -
actgctgtctgcgatgcaga

SEQ ID NO: 187516 - DNA, 20 bp, Artificial Sequence
  Synthetic oligonucleotide; AAGGAT chr2 60526397 60526416 60526400 -
tgtacacttcccaaatggta

SEQ ID NO: 187517 - DNA, 20 bp, Artificial Sequence
  Synthetic oligonucleotide; TGGGAT chr2 60526209 60526228 60526212 -
gaacacatcatcccaaaata

SEQ ID NO: 187518 - DNA, 20 bp, Artificial Sequence
  Synthetic oligonucleotide; CTGAAT chr2 60526202 60526221 60526205 -
tcatcccaaaatatgggatt

SEQ ID NO: 187519 - DNA, 20 bp, Artificial Sequence
  Synthetic oligonucleotide; CTGAAT chr2 60526177 60526196 60526180 -
tttgatcaaatcaccagttt

SEQ ID NO: 187520 - DNA, 20 bp, Artificial Sequence
  Synthetic oligonucleotide; CAGGGT chr2 60526143 60526162 60526146 -
atctagattttgcagaagtt

SEQ ID NO: 187521 - DNA, 20 bp, Artificial Sequence
  Synthetic oligonucleotide; ACGAAT chr2 60525942 60525961 60525945 -
actatttttgattaccaaac

SEQ ID NO: 187522 - DNA, 20 bp, Artificial Sequence
  Synthetic oligonucleotide; CTGGGT chr2 60525741 60525760 60525744 -
tgatctgaaaaccaggacac

SEQ ID NO: 187523 - DNA, 20 bp, Artificial Sequence
  Synthetic oligonucleotide; CTGGGT chr2 60525636 60525655 60525639 -
ggtaaaatagatagtttgga

SEQ ID NO: 187524 - DNA, 20 bp, Artificial Sequence
  Synthetic oligonucleotide; GTGGGT chr2 60525632 60525651 60525635 -
aaatagatagtttggactgg

SEQ ID NO: 187525 - DNA, 20 bp, Artificial Sequence
  Synthetic oligonucleotide; TGGAAT chr2 60525559 60525578 60525562 -
gttttctccctgctattttt

SEQ ID NO: 187526 - DNA, 20 bp, Artificial Sequence
  Synthetic oligonucleotide; CTGAAT chr2 60525546 60525565 60525549 -
tattttttggaatctagttg

SEQ ID NO: 187527 - DNA, 20 bp, Artificial Sequence
  Synthetic oligonucleotide; CAGAAT chr2 60525519 60525538 60525522 -
gggctcacctgcaaagacag

SEQ ID NO: 187528 - DNA, 20 bp, Artificial Sequence
  Synthetic oligonucleotide; TTGGAT chr2 60525462 60525481 60525465 -
gctatggtggagattaaggc

SEQ ID NO: 187529 - DNA, 20 bp, Artificial Sequence
  Synthetic oligonucleotide; TGGAAT chr2 60525385 60525404 60525388 -
aaaattgaagtgcagtataa

SEQ ID NO: 187530 - DNA, 20 bp, Artificial Sequence
  Synthetic oligonucleotide; AAGAAT chr2 60525296 60525315 60525299 -
gttttttttgaaaaactcca

SEQ ID NO: 187531 - DNA, 20 bp, Artificial Sequence
  Synthetic oligonucleotide; TTGAAT chr2 60525207 60525226 60525210 -
cgtttttgaaaaagaaatag

SEQ ID NO: 187532 - DNA, 20 bp, Artificial Sequence
  Synthetic oligonucleotide; CTGAAT chr2 60525166 60525185 60525169 -
ttttaaattcaattaactga

SEQ ID NO: 187533 - DNA, 20 bp, Artificial Sequence
  Synthetic oligonucleotide; CTGAGT chr2 60525093 60525112 60525096 -
atggacatagcctacatatg

SEQ ID NO: 187534 - DNA, 20 bp, Artificial Sequence
  Synthetic oligonucleotide; TGGAGT chr2 60525084 60525103 60525087 -
gcctacatatgctgagtccc

SEQ ID NO: 187535 - DNA, 20 bp, Artificial Sequence
  Synthetic oligonucleotide; AGGAAT chr2 60525077 60525096 60525080 -
tatgctgagtccctggagtt

SEQ ID NO: 187536 - DNA, 20 bp, Artificial Sequence
  Synthetic oligonucleotide; ACGGAT chr2 60524879 60524898 60524882 -
gtttaccattggcttttagc

SEQ ID NO: 187537 - DNA, 20 bp, Artificial Sequence
  Synthetic oligonucleotide; TTGAAT chr2 60524827 60524846 60524830 -
aataccatttatatgtggca

SEQ ID NO: 187538 - DNA, 20 bp, Artificial Sequence
  Synthetic oligonucleotide; TTGGAT chr2 60524767 60524786 60524770 -
agggcattcaaagttatcct

SEQ ID NO: 187539 - DNA, 20 bp, Artificial Sequence
  Synthetic oligonucleotide; CAGAGT chr2 60524722 60524741 60524725 -
cttttattatcccatgtgct

SEQ ID NO: 187540 - DNA, 20 bp, Artificial Sequence
  Synthetic oligonucleotide; ATGAAT chr2 60524707 60524726 60524710 -
gtgctcagagtaaggggcaa

SEQ ID NO: 187541 - DNA, 20 bp, Artificial Sequence
  Synthetic oligonucleotide; GGGGAT chr2 60524593 60524612 60524596 -
tctttaatttataatgtttt

SEQ ID NO: 187542 - DNA, 20 bp, Artificial Sequence
  Synthetic oligonucleotide; CCGAAT chr2 60524411 60524430 60524414 -
acccaaaagcaaataacagg

SEQ ID NO: 187543 - DNA, 20 bp, Artificial Sequence
  Synthetic oligonucleotide; ATGAAT chr2 60524407 60524426 60524410 -
aaaagcaaataacaggccga

SEQ ID NO: 187544 - DNA, 20 bp, Artificial Sequence
  Synthetic oligonucleotide; TAGGAT chr2 60524291 60524310 60524294 -
atgtattcagacatgaagtt

SEQ ID NO: 187545 - DNA, 20 bp, Artificial Sequence
  Synthetic oligonucleotide; GCGGAT chr2 60524096 60524115 60524099 -
attttgtttgcgaaatggga

SEQ ID NO: 187546 - DNA, 20 bp, Artificial Sequence
  Synthetic oligonucleotide; CGGAGT chr2 60524045 60524064 60524048 -
tcacactagttcctgtggtc

SEQ ID NO: 187547 - DNA, 20 bp, Artificial Sequence
  Synthetic oligonucleotide; TGGGAT chr2 60523947 60523966 60523950 -
tctctggctgaagtttaaga

SEQ ID NO: 187548 - DNA, 20 bp, Artificial Sequence
  Synthetic oligonucleotide; TAGGGT chr2 60523885 60523904 60523888 -
tttggcttaaataaattatt

SEQ ID NO: 187549 - DNA, 20 bp, Artificial Sequence
  Synthetic oligonucleotide; ATGAAT chr2 60523730 60523749 60523733 -
ttctcaagttttgcctggca

SEQ ID NO: 187550 - DNA, 20 bp, Artificial Sequence
  Synthetic oligonucleotide; TGGAGT chr2 60523712 60523731 60523715 -
caatgaatgattttgcttac

SEQ ID NO: 187551 - DNA, 20 bp, Artificial Sequence
  Synthetic oligonucleotide; ATGAAT chr2 60523543 60523562 60523546 -
atacatacgtatatgcatgt

SEQ ID NO: 187552 - DNA, 20 bp, Artificial Sequence
  Synthetic oligonucleotide; GAGAAT chr2 60523492 60523511 60523495 -
tgtgtagaaagggagagaga

SEQ ID NO: 187553 - DNA, 20 bp, Artificial Sequence
  Synthetic oligonucleotide; TAGAAT chr2 60523475 60523494 60523478 -
agagagaataggaaagtctt

SEQ ID NO: 187554 - DNA, 20 bp, Artificial Sequence
  Synthetic oligonucleotide; CTGGAT chr2 60523338 60523357 60523341 -
agtctgttgttcacatagcg

SEQ ID NO: 187555 - DNA, 20 bp, Artificial Sequence
  Synthetic oligonucleotide; GAGGAT chr2 60523331 60523350 60523334 -
tgttcacatagcgctggatt

SEQ ID NO: 187556 - DNA, 20 bp, Artificial Sequence
  Synthetic oligonucleotide; AGGAAT chr2 60523291 60523310 60523294 -
taggagcaacagtcccaagc

SEQ ID NO: 187557 - DNA, 20 bp, Artificial Sequence
  Synthetic oligonucleotide; CTGGAT chr2 60523284 60523303 60523287 -
aacagtcccaagcaggaatc

SEQ ID NO: 187558 - DNA, 20 bp, Artificial Sequence
  Synthetic oligonucleotide; CTGAGT chr2 60523254 60523273 60523257 -
ggctgtcctttgtgcctccc

SEQ ID NO: 187559 - DNA, 20 bp, Artificial Sequence
  Synthetic oligonucleotide; ATGAGT chr2 60523171 60523190 60523174 -
cccttctttacggttctgcc

SEQ ID NO: 187560 - DNA, 20 bp, Artificial Sequence
  Synthetic oligonucleotide; CAGAGT chr2 60523049 60523068 60523052 -
gtccaacaagcttttaccca

SEQ ID NO: 187561 - DNA, 20 bp, Artificial Sequence
  Synthetic oligonucleotide; GTGAAT chr2 60522811 60522830 60522814 -
gtatatccaagacatgctct

SEQ ID NO: 187562 - DNA, 20 bp, Artificial Sequence
  Synthetic oligonucleotide; ATGAAT chr2 60522807 60522826 60522810 -
atccaagacatgctctgtga

SEQ ID NO: 187563 - DNA, 20 bp, Artificial Sequence
  Synthetic oligonucleotide; ATGAAT chr2 60522759 60522778 60522762 -
aacactttcttccaagacaa

SEQ ID NO: 187564 - DNA, 20 bp, Artificial Sequence
  Synthetic oligonucleotide; GGGAGT chr2 60522737 60522756 60522740 -
gaattccagttctgaacact

SEQ ID NO: 187565 - DNA, 20 bp, Artificial Sequence
  Synthetic oligonucleotide; TCGGAT chr2 60522720 60522739 60522723 -
actgggagtgcacctgcttg

SEQ ID NO: 187566 - DNA, 20 bp, Artificial Sequence
  Synthetic oligonucleotide; GGGAGT chr2 60522693 60522712 60522696 -
tggtgatgggccacatggtg

SEQ ID NO: 187567 - DNA, 20 bp, Artificial Sequence
  Synthetic oligonucleotide; GAGGGT chr2 60522628 60522647 60522631 -
gactgtcacagagactctca

SEQ ID NO: 187568 - DNA, 20 bp, Artificial Sequence
  Synthetic oligonucleotide; GAGAGT chr2 60522536 60522555 60522539 -
tttacacaaggcccttttta

SEQ ID NO: 187569 - DNA, 20 bp, Artificial Sequence
  Synthetic oligonucleotide; AGGGAT chr2 60522480 60522499 60522483 -
cagtcttgaacctcactgga

SEQ ID NO: 187570 - DNA, 20 bp, Artificial Sequence
  Synthetic oligonucleotide; CTGAGT chr2 60522439 60522458 60522442 -
ccagatggaaagaagtattt

SEQ ID NO: 187571 - DNA, 20 bp, Artificial Sequence
  Synthetic oligonucleotide; ACGAGT chr2 60522334 60522353 60522337 -
ttgtatttaaaagaaaaaaa

SEQ ID NO: 187572 - DNA, 20 bp, Artificial Sequence
  Synthetic oligonucleotide; TGGGAT chr2 60522273 60522292 60522276 -
tgatgaaatgatatgacgtc

SEQ ID NO: 187573 - DNA, 20 bp, Artificial Sequence
  Synthetic oligonucleotide; TAGGGT chr2 60522234 60522253 60522237 -
aaaatgggctagggaggcga

SEQ ID NO: 187574 - DNA, 20 bp, Artificial Sequence
  Synthetic oligonucleotide; AAGAAT chr2 60522218 60522237 60522221 -
gcgatagggttacagaagac

SEQ ID NO: 187575 - DNA, 20 bp, Artificial Sequence
  Synthetic oligonucleotide; AAGGGT chr2 60522049 60522068 60522052 -
gtcggtgttgtttcttcacc

SEQ ID NO: 187576 - DNA, 20 bp, Artificial Sequence
  Synthetic oligonucleotide; AGGGGT chr2 60521955 60521974 60521958 -
atctgggaagttcattgtga

SEQ ID NO: 187577 - DNA, 20 bp, Artificial Sequence
  Synthetic oligonucleotide; AAGGGT chr2 60521944 60521963 60521947 -
tcattgtgaaggggtcattt

SEQ ID NO: 187578 - DNA, 20 bp, Artificial Sequence
  Synthetic oligonucleotide; CAGAGT chr2 60521870 60521889 60521873 -
gtctttttcagtgcatgagg

SEQ ID NO: 187579 - DNA, 20 bp, Artificial Sequence
  Synthetic oligonucleotide; TTGAGT chr2 60521848 60521867 60521851 -
gagtcagatgtggcgtttgc

SEQ ID NO: 187580 - DNA, 20 bp, Artificial Sequence
  Synthetic oligonucleotide; GAGGGT chr2 60521812 60521831 60521815 -
gtgcctctgtgcctcgtggt

SEQ ID NO: 187581 - DNA, 20 bp, Artificial Sequence
  Synthetic oligonucleotide; AAGGGT chr2 60521644 60521663 60521647 -
aaggggacaaagaacacgtc

SEQ ID NO: 187582 - DNA, 20 bp, Artificial Sequence
  Synthetic oligonucleotide; CAGAGT chr2 60521582 60521601 60521585 -
agatggaagatgaaagggag

SEQ ID NO: 187583 - DNA, 20 bp, Artificial Sequence
  Synthetic oligonucleotide; GGGAAT chr2 60521555 60521574 60521558 -
gcaattgcagagctggaaag

SEQ ID NO: 187584 - DNA, 20 bp, Artificial Sequence
  Synthetic oligonucleotide; CCGGGT chr2 60521361 60521380 60521364 -
acccaggcccaggcccaggc

SEQ ID NO: 187585 - DNA, 20 bp, Artificial Sequence
  Synthetic oligonucleotide; GAGAGT chr2 60521278 60521297 60521281 -
caagtgtcactcagttatct

SEQ ID NO: 187586 - DNA, 20 bp, Artificial Sequence
  Synthetic oligonucleotide; TTGGGT chr2 60521239 60521258 60521242 -
gccatctaagtgcctgatac

SEQ ID NO: 187587 - DNA, 20 bp, Artificial Sequence
  Synthetic oligonucleotide; AAGGAT chr2 60521139 60521158 60521142 -
aaatgtaacctggcaccctc

SEQ ID NO: 187588 - DNA, 20 bp, Artificial Sequence
  Synthetic oligonucleotide; GTGAGT chr2 60521129 60521148 60521132 -
tggcaccctcaaggatttgt

SEQ ID NO: 187589 - DNA, 20 bp, Artificial Sequence
  Synthetic oligonucleotide; GTGAGT chr2 60521105 60521124 60521108 -
gtgtgtgtgtgtgtgtgtgt

SEQ ID NO: 187590 - DNA, 20 bp, Artificial Sequence
  Synthetic oligonucleotide; CTGGGT chr2 60520970 60520989 60520973 -
ccagacttggttttatcatg

SEQ ID NO: 187591 - DNA, 20 bp, Artificial Sequence
  Synthetic oligonucleotide; TGGAAT chr2 60520942 60520961 60520945 -
acaaaggttgtgtacagagc

SEQ ID NO: 187592 - DNA, 20 bp, Artificial Sequence
  Synthetic oligonucleotide; ATGGGT chr2 60520833 60520852 60520836 -
ggaacccactggagaagggc

SEQ ID NO: 187593 - DNA, 20 bp, Artificial Sequence
  Synthetic oligonucleotide; ATGGGT chr2 60520798 60520817 60520801 -
ttcggttggtggctgatctg

SEQ ID NO: 187594 - DNA, 20 bp, Artificial Sequence
  Synthetic oligonucleotide; CAGAAT chr2 60520784 60520803 60520787 -
gatctgatgggtggtatagg

SEQ ID NO: 187595 - DNA, 20 bp, Artificial Sequence
  Synthetic oligonucleotide; TGGGGT chr2 60520731 60520750 60520734 -
gattccgtaggcgaccaaca

SEQ ID NO: 187596 - DNA, 20 bp, Artificial Sequence
  Synthetic oligonucleotide; GGGGGT chr2 60520725 60520744 60520728 -
gtaggcgaccaacatggggt

SEQ ID NO: 187597 - DNA, 20 bp, Artificial Sequence
  Synthetic oligonucleotide; ATGAAT chr2 60520653 60520672 60520656 -
gtgcttctgtggttgtgcct

SEQ ID NO: 187598 - DNA, 20 bp, Artificial Sequence
  Synthetic oligonucleotide; TTGAGT chr2 60520624 60520643 60520627 -
ggaccttatgcctcatagtg

SEQ ID NO: 187599 - DNA, 20 bp, Artificial Sequence
  Synthetic oligonucleotide; GAGGAT chr2 60520560 60520579 60520563 -
ttttcctcagaaaactctgt

SEQ ID NO: 187600 - DNA, 20 bp, Artificial Sequence
  Synthetic oligonucleotide; CGGAAT chr2 60520535 60520554 60520538 -
taatttctccttcttataaa

SEQ ID NO: 187601 - DNA, 20 bp, Artificial Sequence
  Synthetic oligonucleotide; GCGAAT chr2 60520529 60520548 60520532 -
ctccttcttataaacggaat

SEQ ID NO: 187602 - DNA, 20 bp, Artificial Sequence
  Synthetic oligonucleotide; AAGGGT chr2 60520493 60520512 60520496 -
atgtgtacattatcccaccg

SEQ ID NO: 187603 - DNA, 20 bp, Artificial Sequence
  Synthetic oligonucleotide; CAGAAT chr2 60520418 60520437 60520421 -
gatttcaggtcctcagactc

SEQ ID NO: 187604 - DNA, 20 bp, Artificial Sequence
  Synthetic oligonucleotide; AAGAGT chr2 60520280 60520299 60520283 -
aaaataaacaaaacctgcag

SEQ ID NO: 187605 - DNA, 20 bp, Artificial Sequence
  Synthetic oligonucleotide; AAGGGT chr2 60520267 60520286 60520270 -
cctgcagaagagtttattgt

SEQ ID NO: 187606 - DNA, 20 bp, Artificial Sequence
  Synthetic oligonucleotide; CTGAAT chr2 60520118 60520137 60520121 -
attctattatctttggcttt

SEQ ID NO: 187607 - DNA, 20 bp, Artificial Sequence
  Synthetic oligonucleotide; CCGAAT chr2 60520027 60520046 60520030 -
ggcataaatgaaaatttagg

SEQ ID NO: 187608 - DNA, 20 bp, Artificial Sequence
  Synthetic oligonucleotide; GAGGAT chr2 60520013 60520032 60520016 -
tttaggccgaattatttgaa

SEQ ID NO: 187609 - DNA, 20 bp, Artificial Sequence
  Synthetic oligonucleotide; GAGAAT chr2 60519961 60519980 60519964 -
ttctcctgccagagagaggg

SEQ ID NO: 187610 - DNA, 20 bp, Artificial Sequence
  Synthetic oligonucleotide; GAGAAT chr2 60519920 60519939 60519923 -
tttaacactccaagtctaga

SEQ ID NO: 187611 - DNA, 20 bp, Artificial Sequence
  Synthetic oligonucleotide; ATGAAT chr2 60519899 60519918 60519902 -
agaattatccaagcatagcc

SEQ ID NO: 187612 - DNA, 20 bp, Artificial Sequence
  Synthetic oligonucleotide; CTGAGT chr2 60519891 60519910 60519894 -
ccaagcatagccatgaattc

SEQ ID NO: 187613 - DNA, 20 bp, Artificial Sequence
  Synthetic oligonucleotide; ATGGAT chr2 60519884 60519903 60519887 -
tagccatgaattcctgagtt

SEQ ID NO: 187614 - DNA, 20 bp, Artificial Sequence
  Synthetic oligonucleotide; CTGAGT chr2 60519836 60519855 60519839 -
aaacgatctctttgtcttca

SEQ ID NO: 187615 - DNA, 20 bp, Artificial Sequence
  Synthetic oligonucleotide; TGGAGT chr2 60519818 60519837 60519821 -
cactgagttttctttgtcat

SEQ ID NO: 187616 - DNA, 20 bp, Artificial Sequence
  Synthetic oligonucleotide; GAGAAT chr2 60519805 60519824 60519808 -
ttgtcattggagtaatttag

SEQ ID NO: 187617 - DNA, 20 bp, Artificial Sequence
  Synthetic oligonucleotide; CAGGAT chr2 60519798 60519817 60519801 -
tggagtaatttaggagaata

SEQ ID NO: 187618 - DNA, 20 bp, Artificial Sequence
  Synthetic oligonucleotide; CTGAAT chr2 60519775 60519794 60519778 -
gatgtgactgggagcccttt

SEQ ID NO: 187619 - DNA, 20 bp, Artificial Sequence
  Synthetic oligonucleotide; GTGAAT chr2 60519749 60519768 60519752 -
aagcacagtcccatgcccac

SEQ ID NO: 187620 - DNA, 20 bp, Artificial Sequence
  Synthetic oligonucleotide; ATGAGT chr2 60519512 60519531 60519515 -
ccttattttttctctgcagc

SEQ ID NO: 187621 - DNA, 20 bp, Artificial Sequence
  Synthetic oligonucleotide; TAGAAT chr2 60519283 60519302 60519286 -
gtctctcaatatggaggtta

SEQ ID NO: 187622 - DNA, 20 bp, Artificial Sequence
  Synthetic oligonucleotide; AGGGGT chr2 60519154 60519173 60519157 -
ttgtagcgcctgtatttgaa

SEQ ID NO: 187623 - DNA, 20 bp, Artificial Sequence
  Synthetic oligonucleotide; CAGGAT chr2 60519072 60519091 60519075 -
tccctgtttcctgctggtat

SEQ ID NO: 187624 - DNA, 20 bp, Artificial Sequence
  Synthetic oligonucleotide; AAGAGT chr2 60519035 60519054 60519038 -
acttctgtccattttctctc

SEQ ID NO: 187625 - DNA, 20 bp, Artificial Sequence
  Synthetic oligonucleotide; GTGGAT chr2 60518980 60518999 60518983 -
gaaggaactctccttttgct

SEQ ID NO: 187626 - DNA, 20 bp, Artificial Sequence
  Synthetic oligonucleotide; TTGAAT chr2 60518930 60518949 60518933 -
ctgtggcttcaggacccacc

SEQ ID NO: 187627 - DNA, 20 bp, Artificial Sequence
  Synthetic oligonucleotide; CAGAAT chr2 60518922 60518941 60518925 -
tcaggacccaccttgaatga

SEQ ID NO: 187628 - DNA, 20 bp, Artificial Sequence
  Synthetic oligonucleotide; GTGGAT chr2 60518837 60518856 60518840 -
tgcccatcgagcaacaccat

SEQ ID NO: 187629 - DNA, 20 bp, Artificial Sequence
  Synthetic oligonucleotide; ATGAGT chr2 60518792 60518811 60518795 -
ctgaacttgaacagtaattg

SEQ ID NO: 187630 - DNA, 20 bp, Artificial Sequence
  Synthetic oligonucleotide; AGGAAT chr2 60518762 60518781 60518765 -
aaaatccacgcccggccccc

SEQ ID NO: 187631 - DNA, 20 bp, Artificial Sequence
  Synthetic oligonucleotide; CTGGAT chr2 60518725 60518744 60518728 -
ccccatcccacgttctgatt

SEQ ID NO: 187632 - DNA, 20 bp, Artificial Sequence
  Synthetic oligonucleotide; ATGAGT chr2 60518696 60518715 60518699 -
cttttaagtgaactctgatg

SEQ ID NO: 187633 - DNA, 20 bp, Artificial Sequence
  Synthetic oligonucleotide; CTGGGT chr2 60518658 60518677 60518661 -
ctctttctcaacgttctctg

SEQ ID NO: 187634 - DNA, 20 bp, Artificial Sequence
  Synthetic oligonucleotide; GTGAGT chr2 60518470 60518489 60518473 -
ttattcatatttaaatgcag

SEQ ID NO: 187635 - DNA, 20 bp, Artificial Sequence
  Synthetic oligonucleotide; TGGAAT chr2 60518464 60518483 60518467 -
atatttaaatgcaggtgagt

SEQ ID NO: 187636 - DNA, 20 bp, Artificial Sequence
  Synthetic oligonucleotide; CTGAAT chr2 60518438 60518457 60518441 -
gtcatcttacaggcataatc

SEQ ID NO: 187637 - DNA, 20 bp, Artificial Sequence
  Synthetic oligonucleotide; CTGAGT chr2 60518369 60518388 60518372 -
ctaagtagtagccaaattct

SEQ ID NO: 187638 - DNA, 20 bp, Artificial Sequence
  Synthetic oligonucleotide; GGGAAT chr2 60518253 60518272 60518256 -
gctcagcagatgttgacaga

SEQ ID NO: 187639 - DNA, 20 bp, Artificial Sequence
  Synthetic oligonucleotide; CAGGGT chr2 60518122 60518141 60518125 -
tattaagctttttgtagaga

SEQ ID NO: 187640 - DNA, 20 bp, Artificial Sequence
  Synthetic oligonucleotide; TTGGGT chr2 60517959 60517978 60517962 -
ttttctctcctcccctaaaa

SEQ ID NO: 187641 - DNA, 20 bp, Artificial Sequence
  Synthetic oligonucleotide; TAGAGT chr2 60517951 60517970 60517954 -
cctcccctaaaattgggttt

SEQ ID NO: 187642 - DNA, 20 bp, Artificial Sequence
  Synthetic oligonucleotide; AAGAGT chr2 60517921 60517940 60517924 -
ttcttgttcctctagtcgac

SEQ ID NO: 187643 - DNA, 20 bp, Artificial Sequence
  Synthetic oligonucleotide; AGGAAT chr2 60517910 60517929 60517913 -
ctagtcgacaagagtttctg

SEQ ID NO: 187644 - DNA, 20 bp, Artificial Sequence
  Synthetic oligonucleotide; GTGAAT chr2 60517848 60517867 60517851 -
ttccttcgtggaaagccaaa

SEQ ID NO: 187645 - DNA, 20 bp, Artificial Sequence
  Synthetic oligonucleotide; GGGAGT chr2 60517751 60517770 60517754 -
agaaaggttgaggctaagag

SEQ ID NO: 187646 - DNA, 20 bp, Artificial Sequence
  Synthetic oligonucleotide; GTGAGT chr2 60517747 60517766 60517750 -
aggttgaggctaagagggga

SEQ ID NO: 187647 - DNA, 20 bp, Artificial Sequence
  Synthetic oligonucleotide; CAGAGT chr2 60517739 60517758 60517742 -
gctaagaggggagtgagtgc

SEQ ID NO: 187648 - DNA, 20 bp, Artificial Sequence
  Synthetic oligonucleotide; TGGAAT chr2 60517566 60517585 60517569 -
acgcttttatcggtgatggc

SEQ ID NO: 187649 - DNA, 20 bp, Artificial Sequence
  Synthetic oligonucleotide; GAGAAT chr2 60517442 60517461 60517445 -
caatcacctgtgctgttgca

SEQ ID NO: 187650 - DNA, 20 bp, Artificial Sequence
  Synthetic oligonucleotide; TGGGGT chr2 60517325 60517344 60517328 -
ctcccaaagtgtggcccttc

SEQ ID NO: 187651 - DNA, 20 bp, Artificial Sequence
  Synthetic oligonucleotide; GGGAAT chr2 60517303 60517322 60517306 -
gggtttacatggtgtgccca

SEQ ID NO: 187652 - DNA, 20 bp, Artificial Sequence
  Synthetic oligonucleotide; TGGAGT chr2 60517263 60517282 60517266 -
attcagataactggagataa

SEQ ID NO: 187653 - DNA, 20 bp, Artificial Sequence
  Synthetic oligonucleotide; TGGAGT chr2 60517254 60517273 60517257 -
actggagataatggagtaga

SEQ ID NO: 187654 - DNA, 20 bp, Artificial Sequence
  Synthetic oligonucleotide; TGGGGT chr2 60517248 60517267 60517251 -
gataatggagtagatggagt

SEQ ID NO: 187655 - DNA, 20 bp, Artificial Sequence
  Synthetic oligonucleotide; CAGAAT chr2 60517202 60517221 60517205 -
ctcaggggcagatggccctc

SEQ ID NO: 187656 - DNA, 20 bp, Artificial Sequence
  Synthetic oligonucleotide; ATGGAT chr2 60516948 60516967 60516951 -
tctttcctgaacctgaactc

SEQ ID NO: 187657 - DNA, 20 bp, Artificial Sequence
  Synthetic oligonucleotide; TAGAAT chr2 60516901 60516920 60516904 -
attgtttctatgcctctctt

SEQ ID NO: 187658 - DNA, 20 bp, Artificial Sequence
  Synthetic oligonucleotide; CAGAGT chr2 60516849 60516868 60516852 -
aaacattagtctgataacta

SEQ ID NO: 187659 - DNA, 20 bp, Artificial Sequence
  Synthetic oligonucleotide; AGGAAT chr2 60516720 60516739 60516723 -
tgctcagcttggtgtccact

SEQ ID NO: 187660 - DNA, 20 bp, Artificial Sequence
  Synthetic oligonucleotide; ACGAGT chr2 60516583 60516602 60516586 -
cttagctctccactcctgac

SEQ ID NO: 187661 - DNA, 20 bp, Artificial Sequence
  Synthetic oligonucleotide; CCGGAT chr2 60516554 60516573 60516557 -
ctgacttcctctccacttcc

SEQ ID NO: 187662 - DNA, 20 bp, Artificial Sequence
  Synthetic oligonucleotide; GTGAGT chr2 60516544 60516563 60516547 -
ctccacttccccggatgacg

SEQ ID NO: 187663 - DNA, 20 bp, Artificial Sequence
  Synthetic oligonucleotide; GTGAGT chr2 60516460 60516479 60516463 -
catggaggctgagaaatata

SEQ ID NO: 187664 - DNA, 20 bp, Artificial Sequence
  Synthetic oligonucleotide; TTGAGT chr2 60516314 60516333 60516317 -
ccagcagagccaagtctttt

SEQ ID NO: 187665 - DNA, 20 bp, Artificial Sequence
  Synthetic oligonucleotide; AGGAGT chr2 60516281 60516300 60516284 -
aaaacctgtgttttaataat

SEQ ID NO: 187666 - DNA, 20 bp, Artificial Sequence
  Synthetic oligonucleotide; GTGGGT chr2 60516277 60516296 60516280 -
cctgtgttttaataatagga

SEQ ID NO: 187667 - DNA, 20 bp, Artificial Sequence
  Synthetic oligonucleotide; TGGGGT chr2 60516209 60516228 60516212 -
agcacatcttttctgtgtgc

SEQ ID NO: 187668 - DNA, 20 bp, Artificial Sequence
  Synthetic oligonucleotide; GTGAGT chr2 60516189 60516208 60516192 -
tggggtgaggagaggtgaca

SEQ ID NO: 187669 - DNA, 20 bp, Artificial Sequence
  Synthetic oligonucleotide; TAGGAT chr2 60516180 60516199 60516183 -
gagaggtgacagtgagtgtg

SEQ ID NO: 187670 - DNA, 20 bp, Artificial Sequence
  Synthetic oligonucleotide; ATGAGT chr2 60516120 60516139 60516123 -
ttagagcacccaaagctggc

SEQ ID NO: 187671 - DNA, 20 bp, Artificial Sequence
  Synthetic oligonucleotide; CAGGGT chr2 60515996 60516015 60515999 -
ggccaccgcccttcagactc

SEQ ID NO: 187672 - DNA, 20 bp, Artificial Sequence
  Synthetic oligonucleotide; GTGGGT chr2 60515968 60515987 60515971 -
ttgtattccaggacccctcc

SEQ ID NO: 187673 - DNA, 20 bp, Artificial Sequence
  Synthetic oligonucleotide; GAGAAT chr2 60515943 60515962 60515946 -
tgttggcccagcggtgccca

SEQ ID NO: 187674 - DNA, 20 bp, Artificial Sequence
  Synthetic oligonucleotide; TTGGAT chr2 60515928 60515947 60515931 -
gcccagagaatattccctta

SEQ ID NO: 187675 - DNA, 20 bp, Artificial Sequence
  Synthetic oligonucleotide; TCGAAT chr2 60515917 60515936 60515920 -
attcccttattggatctttc

SEQ ID NO: 187676 - DNA, 20 bp, Artificial Sequence
  Synthetic oligonucleotide; GTGGGT chr2 60515843 60515862 60515846 -
ccccacagtaagacctcaca

SEQ ID NO: 187677 - DNA, 20 bp, Artificial Sequence
  Synthetic oligonucleotide; TTGAGT chr2 60515838 60515857 60515841 -
cagtaagacctcacagtggg

SEQ ID NO: 187678 - DNA, 20 bp, Artificial Sequence
  Synthetic oligonucleotide; TTGGGT chr2 60515787 60515806 60515790 -
gaaatggggaagctggaaag

SEQ ID NO: 187679 - DNA, 20 bp, Artificial Sequence
  Synthetic oligonucleotide; AAGAGT chr2 60515777 60515796 60515780 -
agctggaaagttgggtgatc

SEQ ID NO: 187680 - DNA, 20 bp, Artificial Sequence
  Synthetic oligonucleotide; CTGGGT chr2 60515665 60515684 60515668 -
gctgtgtttcagagaggtag

SEQ ID NO: 187681 - DNA, 20 bp, Artificial Sequence
  Synthetic oligonucleotide; TGGGAT chr2 60515525 60515544 60515528 -
ctttggaggaggtgtcactc

SEQ ID NO: 187682 - DNA, 20 bp, Artificial Sequence
  Synthetic oligonucleotide; GGGGAT chr2 60515510 60515529 60515513 -
cactctgggattagttaaaa

SEQ ID NO: 187683 - DNA, 20 bp, Artificial Sequence
  Synthetic oligonucleotide; GTGGGT chr2 60515483 60515502 60515486 -
agtggtattcacattggctc

SEQ ID NO: 187684 - DNA, 20 bp, Artificial Sequence
  Synthetic oligonucleotide; AGGAGT chr2 60515439 60515458 60515442 -
attataaccttttggagggc

SEQ ID NO: 187685 - DNA, 20 bp, Artificial Sequence
  Synthetic oligonucleotide; TTGAAT chr2 60515323 60515342 60515326 -
gaacagagaaagaccgggct

SEQ ID NO: 187686 - DNA, 20 bp, Artificial Sequence
  Synthetic oligonucleotide; ATGGAT chr2 60515319 60515338 60515322 -
agagaaagaccgggctttga

SEQ ID NO: 187687 - DNA, 20 bp, Artificial Sequence
  Synthetic oligonucleotide; TGGGGT chr2 60515225 60515244 60515228 -
aagtgaaaaagtgaaagtgc

SEQ ID NO: 187688 - DNA, 20 bp, Artificial Sequence
  Synthetic oligonucleotide; TGGGAT chr2 60515219 60515238 60515222 -
aaaagtgaaagtgctggggt

SEQ ID NO: 187689 - DNA, 20 bp, Artificial Sequence
  Synthetic oligonucleotide; GAGGAT chr2 60515105 60515124 60515108 -
tggggaaggagcacgtgggg

SEQ ID NO: 187690 - DNA, 20 bp, Artificial Sequence
  Synthetic oligonucleotide; TGGAGT chr2 60515078 60515097 60515081 -
cttaggtctgggcaacactt

SEQ ID NO: 187691 - DNA, 20 bp, Artificial Sequence
  Synthetic oligonucleotide; GGGGGT chr2 60515070 60515089 60515073 -
tgggcaacactttggagtta

SEQ ID NO: 187692 - DNA, 20 bp, Artificial Sequence
  Synthetic oligonucleotide; CTGAGT chr2 60514990 60515009 60514993 -
tctcaccagagggagaacgg

SEQ ID NO: 187693 - DNA, 20 bp, Artificial Sequence
  Synthetic oligonucleotide; TTGGGT chr2 60514957 60514976 60514960 -
ggactggggcctgctttcct

SEQ ID NO: 187694 - DNA, 20 bp, Artificial Sequence
  Synthetic oligonucleotide; TTGGAT chr2 60514936 60514955 60514939 -
tgggtggctttgactggctc

SEQ ID NO: 187695 - DNA, 20 bp, Artificial Sequence
  Synthetic oligonucleotide; ATGAGT chr2 60514932 60514951 60514935 -
tggctttgactggctcttgg

SEQ ID NO: 187696 - DNA, 20 bp, Artificial Sequence
  Synthetic oligonucleotide; TTGAGT chr2 60514831 60514850 60514834 -
gtatgcaagacctttgatat

SEQ ID NO: 187697 - DNA, 20 bp, Artificial Sequence
  Synthetic oligonucleotide; TGGAAT chr2 60514804 60514823 60514807 -
gggaaatcctctcttatcaa

SEQ ID NO: 187698 - DNA, 20 bp, Artificial Sequence
  Synthetic oligonucleotide; TGGAGT chr2 60514664 60514683 60514667 -
atttttttttttttttgaga

SEQ ID NO: 187699 - DNA, 20 bp, Artificial Sequence
  Synthetic oligonucleotide; TGGAGT chr2 60514639 60514658 60514642 -
tctcgctctgtcgcccaggc

SEQ ID NO: 187700 - DNA, 20 bp, Artificial Sequence
  Synthetic oligonucleotide; TGGGAT chr2 60514554 60514573 60514557 -
gcctcagcctcccaagtagc

SEQ ID NO: 187701 - DNA, 20 bp, Artificial Sequence
  Synthetic oligonucleotide; TGGGGT chr2 60514487 60514506 60514490 -
tttttttttttaagtagaga

SEQ ID NO: 187702 - DNA, 20 bp, Artificial Sequence
  Synthetic oligonucleotide; ATGGGT chr2 60514322 60514341 60514325 -
agtcttgggactgcccagaa

SEQ ID NO: 187703 - DNA, 20 bp, Artificial Sequence
  Synthetic oligonucleotide; CGGGGT chr2 60514271 60514290 60514274 -
actgcgatcccaccagtggc

SEQ ID NO: 187704 - DNA, 20 bp, Artificial Sequence
  Synthetic oligonucleotide; GAGAGT chr2 60514143 60514162 60514146 -
tccagcctggaagcctctca

SEQ ID NO: 187705 - DNA, 20 bp, Artificial Sequence
  Synthetic oligonucleotide; CAGAGT chr2 60514073 60514092 60514076 -
aggagatggctggtgtggct

SEQ ID NO: 187706 - DNA, 20 bp, Artificial Sequence
  Synthetic oligonucleotide; GAGGAT chr2 60514000 60514019 60514003 -
cctcaagtctgtccttctct

SEQ ID NO: 187707 - DNA, 20 bp, Artificial Sequence
  Synthetic oligonucleotide; GAGAAT chr2 60513977 60513996 60513980 -
gatttaggactgtgaaccta

SEQ ID NO: 187708 - DNA, 20 bp, Artificial Sequence
  Synthetic oligonucleotide; TAGAAT chr2 60513956 60513975 60513959 -
agaattcaaagtagtggaac

SEQ ID NO: 187709 - DNA, 20 bp, Artificial Sequence
  Synthetic oligonucleotide; GGGAGT chr2 60513930 60513949 60513933 -
ccaggtctcgactcaatcca

SEQ ID NO: 187710 - DNA, 20 bp, Artificial Sequence
  Synthetic oligonucleotide; GAGAAT chr2 60513866 60513885 60513869 -
aggtgcctgtctggaaggca

SEQ ID NO: 187711 - DNA, 20 bp, Artificial Sequence
  Synthetic oligonucleotide; GAGAGT chr2 60513841 60513860 60513844 -
tctctggcttgttgagaaga

SEQ ID NO: 187712 - DNA, 20 bp, Artificial Sequence
  Synthetic oligonucleotide; GAGAGT chr2 60513735 60513754 60513738 -
gactcagttctattttccca

SEQ ID NO: 187713 - DNA, 20 bp, Artificial Sequence
  Synthetic oligonucleotide; AGGGAT chr2 60513685 60513704 60513688 -
ttcttttttcagtcctgatc

SEQ ID NO: 187714 - DNA, 20 bp, Artificial Sequence
  Synthetic oligonucleotide; ATGAGT chr2 60513681 60513700 60513684 -
tttttcagtcctgatcaggg

SEQ ID NO: 187715 - DNA, 20 bp, Artificial Sequence
  Synthetic oligonucleotide; TTGGGT chr2 60513667 60513686 60513670 -
tcagggatgagtccgtgctg

SEQ ID NO: 187716 - DNA, 20 bp, Artificial Sequence
  Synthetic oligonucleotide; GTGAGT chr2 60513641 60513660 60513644 -
ttattcatttactttagcgt

SEQ ID NO: 187717 - DNA, 20 bp, Artificial Sequence
  Synthetic oligonucleotide; ATGGAT chr2 60513629 60513648 60513632 -
tttagcgtgtgagtggggag

SEQ ID NO: 187718 - DNA, 20 bp, Artificial Sequence
  Synthetic oligonucleotide; AAGGGT chr2 60513605 60513624 60513608 -
attaggcagcaggcccttgg

SEQ ID NO: 187719 - DNA, 20 bp, Artificial Sequence
  Synthetic oligonucleotide; AGGAGT chr2 60513518 60513537 60513521 -
tccacaaagagagaagcagc

SEQ ID NO: 187720 - DNA, 20 bp, Artificial Sequence
  Synthetic oligonucleotide; AGGGGT chr2 60513475 60513494 60513478 -
ccaacacccacacctgccaa

SEQ ID NO: 187721 - DNA, 20 bp, Artificial Sequence
  Synthetic oligonucleotide; TGGGGT chr2 60513464 60513483 60513467 -
acctgccaaaggggttccca

SEQ ID NO: 187722 - DNA, 20 bp, Artificial Sequence
  Synthetic oligonucleotide; GGGGAT chr2 60513447 60513466 60513450 -
ccatggggtggctggcttga

SEQ ID NO: 187723 - DNA, 20 bp, Artificial Sequence
  Synthetic oligonucleotide; TGGAGT chr2 60513259 60513278 60513262 -
gccgtgtcagctgcagagac

SEQ ID NO: 187724 - DNA, 20 bp, Artificial Sequence
  Synthetic oligonucleotide; GGGGAT chr2 60513241 60513260 60513244 -
actggagtccggggcatgat

SEQ ID NO: 187725 - DNA, 20 bp, Artificial Sequence
  Synthetic oligonucleotide; GAGAGT chr2 60513219 60513238 60513222 -
ggatgtacctgaaacctagt

SEQ ID NO: 187726 - DNA, 20 bp, Artificial Sequence
  Synthetic oligonucleotide; ATGGAT chr2 60513128 60513147 60513131 -
cctcacaggctagactatcc

SEQ ID NO: 187727 - DNA, 20 bp, Artificial Sequence
  Synthetic oligonucleotide; TGGGGT chr2 60513117 60513136 60513120 -
agactatccatggatttcag

SEQ ID NO: 187728 - DNA, 20 bp, Artificial Sequence
  Synthetic oligonucleotide; GTGAGT chr2 60513110 60513129 60513113 -
ccatggatttcagtggggtg

SEQ ID NO: 187729 - DNA, 20 bp, Artificial Sequence
  Synthetic oligonucleotide; GGGGGT chr2 60513063 60513082 60513066 -
cctcaaatggtgactgttct

SEQ ID NO: 187730 - DNA, 20 bp, Artificial Sequence
  Synthetic oligonucleotide; GGGGGT chr2 60513038 60513057 60513041 -
tcctttctctgcctttctca

SEQ ID NO: 187731 - DNA, 20 bp, Artificial Sequence
  Synthetic oligonucleotide; ATGGAT chr2 60512908 60512927 60512911 -
tttctctgtgtctcctccaa

SEQ ID NO: 187732 - DNA, 20 bp, Artificial Sequence
  Synthetic oligonucleotide; GTGGGT chr2 60512897 60512916 60512900 -
ctcctccaaatggatgccat

SEQ ID NO: 187733 - DNA, 20 bp, Artificial Sequence
  Synthetic oligonucleotide; TTGGGT chr2 60512880 60512899 60512883 -
catgtgggtgggcaaagtgg

SEQ ID NO: 187734 - DNA, 20 bp, Artificial Sequence
  Synthetic oligonucleotide; GAGAAT chr2 60512785 60512804 60512788 -
tcatacttgagacactaaaa

SEQ ID NO: 187735 - DNA, 20 bp, Artificial Sequence
  Synthetic oligonucleotide; AGGGAT chr2 60512721 60512740 60512724 -
gaaccaacttcaagtaacgt

SEQ ID NO: 187736 - DNA, 20 bp, Artificial Sequence
  Synthetic oligonucleotide; TGGAGT chr2 60512667 60512686 60512670 -
ctccaattagatatgcaaaa

SEQ ID NO: 187737 - DNA, 20 bp, Artificial Sequence
  Synthetic oligonucleotide; TTGGAT chr2 60512571 60512590 60512574 -
tcactttttacaatttagca

SEQ ID NO: 187738 - DNA, 20 bp, Artificial Sequence
  Synthetic oligonucleotide; CTGGGT chr2 60512525 60512544 60512528 -
gcagagcattgtgataggtt

SEQ ID NO: 187739 - DNA, 20 bp, Artificial Sequence
  Synthetic oligonucleotide; GCGAGT chr2 60512460 60512479 60512463 -
ctgcctttctcatttgagag

SEQ ID NO: 187740 - DNA, 20 bp, Artificial Sequence
  Synthetic oligonucleotide; ATGAAT chr2 60512302 60512321 60512305 -
cagctcagccacaagcccaa

SEQ ID NO: 187741 - DNA, 20 bp, Artificial Sequence
  Synthetic oligonucleotide; CTGAGT chr2 60512292 60512311 60512295 -
acaagcccaaatgaatgatt

SEQ ID NO: 187742 - DNA, 20 bp, Artificial Sequence
  Synthetic oligonucleotide; AGGGGT chr2 60512171 60512190 60512174 -
ttcctctctgactgctctcc

SEQ ID NO: 187743 - DNA, 20 bp, Artificial Sequence
  Synthetic oligonucleotide; AGGGGT chr2 60512156 60512175 60512159 -
tctccaggggtggtgagcac

SEQ ID NO: 187744 - DNA, 20 bp, Artificial Sequence
  Synthetic oligonucleotide; TTGAAT chr2 60512103 60512122 60512106 -
tccttagccttccaagttgt

SEQ ID NO: 187745 - DNA, 20 bp, Artificial Sequence
  Synthetic oligonucleotide; TGGAGT chr2 60512059 60512078 60512062 -
ggctgcacacatattcattt

SEQ ID NO: 187746 - DNA, 20 bp, Artificial Sequence
  Synthetic oligonucleotide; GAGGAT chr2 60511944 60511963 60511947 -
ttgaacacctacattgctgg

SEQ ID NO: 187747 - DNA, 20 bp, Artificial Sequence
  Synthetic oligonucleotide; GAGAGT chr2 60511930 60511949 60511933 -
tgctgggaggataccttagt

SEQ ID NO: 187748 - DNA, 20 bp, Artificial Sequence
  Synthetic oligonucleotide; CAGAGT chr2 60511829 60511848 60511832 -
aacccttgccttcatagaaa

SEQ ID NO: 187749 - DNA, 20 bp, Artificial Sequence
  Synthetic oligonucleotide; AAGAAT chr2 60511808 60511827 60511811 -
agagtgttgaaagcttggag

SEQ ID NO: 187750 - DNA, 20 bp, Artificial Sequence
  Synthetic oligonucleotide; CTGAGT chr2 60511696 60511715 60511699 -
tggcttggaaaatacgttga

SEQ ID NO: 187751 - DNA, 20 bp, Artificial Sequence
  Synthetic oligonucleotide; TAGAGT chr2 60511625 60511644 60511628 -
tcattaatagtgcagttatg

SEQ ID NO: 187752 - DNA, 20 bp, Artificial Sequence
  Synthetic oligonucleotide; TTGAGT chr2 60511611 60511630 60511614 -
gttatgtagagtgtagctct

SEQ ID NO: 187753 - DNA, 20 bp, Artificial Sequence
  Synthetic oligonucleotide; TTGAAT chr2 60511597 60511616 60511600 -
agctctttgagtcttcagtt

SEQ ID NO: 187754 - DNA, 20 bp, Artificial Sequence
  Synthetic oligonucleotide; ATGAAT chr2 60511459 60511478 60511462 -
cattagcactttatgtctgc

SEQ ID NO: 187755 - DNA, 20 bp, Artificial Sequence
  Synthetic oligonucleotide; AAGAGT chr2 60511422 60511441 60511425 -
gtgttttattggtaacggaa

SEQ ID NO: 187756 - DNA, 20 bp, Artificial Sequence
  Synthetic oligonucleotide; TGGAGT chr2 60511417 60511436 60511420 -
ttattggtaacggaaaagag

SEQ ID NO: 187757 - DNA, 20 bp, Artificial Sequence
  Synthetic oligonucleotide; TAGAAT chr2 60511407 60511426 60511410 -
cggaaaagagtggagtcaca

SEQ ID NO: 187758 - DNA, 20 bp, Artificial Sequence
  Synthetic oligonucleotide; GCGAGT chr2 60511382 60511401 60511385 -
tgacattacttcccaaattg

SEQ ID NO: 187759 - DNA, 20 bp, Artificial Sequence
  Synthetic oligonucleotide; TAGGGT chr2 60511307 60511326 60511310 -
tcacctgtcaaattgtatgc

SEQ ID NO: 187760 - DNA, 20 bp, Artificial Sequence
  Synthetic oligonucleotide; AAGGGT chr2 60511297 60511316 60511300 -
aattgtatgctagggtggga

SEQ ID NO: 187761 - DNA, 20 bp, Artificial Sequence
  Synthetic oligonucleotide; AGGGAT chr2 60511251 60511270 60511254 -
atcccgggctctcaggtaga

SEQ ID NO: 187762 - DNA, 20 bp, Artificial Sequence
  Synthetic oligonucleotide; GAGAAT chr2 60511184 60511203 60511187 -
gtgcccctgccaggaggagg

SEQ ID NO: 187763 - DNA, 20 bp, Artificial Sequence
  Synthetic oligonucleotide; AAGAAT chr2 60511170 60511189 60511173 -
aggagggagaatctgaaagc

SEQ ID NO: 187764 - DNA, 20 bp, Artificial Sequence
  Synthetic oligonucleotide; GAGAGT chr2 60511159 60511178 60511162 -
tctgaaagcaagaatggagg

SEQ ID NO: 187765 - DNA, 20 bp, Artificial Sequence
  Synthetic oligonucleotide; TGGGAT chr2 60511136 60511155 60511139 -
agtaatgccgtggaggcagc

SEQ ID NO: 187766 - DNA, 20 bp, Artificial Sequence
  Synthetic oligonucleotide; TTGGAT chr2 60511101 60511120 60511104 -
gccagtgcccctgcacagta

SEQ ID NO: 187767 - DNA, 20 bp, Artificial Sequence
  Synthetic oligonucleotide; ATGAGT chr2 60511095 60511114 60511098 -
gcccctgcacagtattggat

SEQ ID NO: 187768 - DNA, 20 bp, Artificial Sequence
  Synthetic oligonucleotide; AAGGGT chr2 60510921 60510940 60510924 -
ggttttaactggctcctgtc

SEQ ID NO: 187769 - DNA, 20 bp, Artificial Sequence
  Synthetic oligonucleotide; GTGGGT chr2 60510860 60510879 60510863 -
taatgcaaaagctcttccct

SEQ ID NO: 187770 - DNA, 20 bp, Artificial Sequence
  Synthetic oligonucleotide; TGGAAT chr2 60510834 60510853 60510837 -
ctcagggcctgtggggaaaa

SEQ ID NO: 187771 - DNA, 20 bp, Artificial Sequence
  Synthetic oligonucleotide; TTGAGT chr2 60510756 60510775 60510759 -
acagttttatagatatggca

SEQ ID NO: 187772 - DNA, 20 bp, Artificial Sequence
  Synthetic oligonucleotide; TGGAAT chr2 60510735 60510754 60510738 -
tgagtggcctcctggcagtt

SEQ ID NO: 187773 - DNA, 20 bp, Artificial Sequence
  Synthetic oligonucleotide; GTGAAT chr2 60510570 60510589 60510573 -
gaagatgcaccaataaatat

SEQ ID NO: 187774 - DNA, 20 bp, Artificial Sequence
  Synthetic oligonucleotide; AGGGGT chr2 60510509 60510528 60510512 -
acgaaaataaggtggggaag

SEQ ID NO: 187775 - DNA, 20 bp, Artificial Sequence
  Synthetic oligonucleotide; AGGGGT chr2 60510502 60510521 60510505 -
taaggtggggaagaggggta

SEQ ID NO: 187776 - DNA, 20 bp, Artificial Sequence
  Synthetic oligonucleotide; TAGGAT chr2 60510474 60510493 60510477 -
atggtgaccaggcttttaaa

SEQ ID NO: 187777 - DNA, 20 bp, Artificial Sequence
  Synthetic oligonucleotide; GAGAAT chr2 60510411 60510430 60510414 -
gaggtgaggaagttggccat

SEQ ID NO: 187778 - DNA, 20 bp, Artificial Sequence
  Synthetic oligonucleotide; AAGAGT chr2 60510385 60510404 60510388 -
tttgagaagatggttccagg

SEQ ID NO: 187779 - DNA, 20 bp, Artificial Sequence
  Synthetic oligonucleotide; CAGAGT chr2 60510311 60510330 60510314 -
ggagcaaggggccctgaggt

SEQ ID NO: 187780 - DNA, 20 bp, Artificial Sequence
  Synthetic oligonucleotide; AAGAGT chr2 60510302 60510321 60510305 -
ggccctgaggtcagagtgga

SEQ ID NO: 187781 - DNA, 20 bp, Artificial Sequence
  Synthetic oligonucleotide; AGGGAT chr2 60510246 60510265 60510249 -
ctccttgaaggacgtagagc

SEQ ID NO: 187782 - DNA, 20 bp, Artificial Sequence
  Synthetic oligonucleotide; AGGAGT chr2 60510203 60510222 60510206 -
agggagatggaagccactgg

SEQ ID NO: 187783 - DNA, 20 bp, Artificial Sequence
  Synthetic oligonucleotide; GAGAGT chr2 60510173 60510192 60510176 -
tcatatgacttgcgcttcca

SEQ ID NO: 187784 - DNA, 20 bp, Artificial Sequence
  Synthetic oligonucleotide; CAGGGT chr2 60510077 60510096 60510080 -
caagtgatggtggcgtggac

SEQ ID NO: 187785 - DNA, 20 bp, Artificial Sequence
  Synthetic oligonucleotide; CTGGAT chr2 60510051 60510070 60510054 -
ggtggggacgtgagaagggg

SEQ ID NO: 187786 - DNA, 20 bp, Artificial Sequence
  Synthetic oligonucleotide; CAGGAT chr2 60510017 60510036 60510020 -
tacttcgaagggaaaaccgg

SEQ ID NO: 187787 - DNA, 20 bp, Artificial Sequence
  Synthetic oligonucleotide; TGGGAT chr2 60510000 60510019 60510003 -
cggcaggatttgctgactgg

SEQ ID NO: 187788 - DNA, 20 bp, Artificial Sequence
  Synthetic oligonucleotide; ATGGGT chr2 60509996 60510015 60509999 -
aggatttgctgactggtggg

SEQ ID NO: 187789 - DNA, 20 bp, Artificial Sequence
  Synthetic oligonucleotide; AGGAGT chr2 60509974 60509993 60509977 -
gggttgtatgaaaggaaggg

SEQ ID NO: 187790 - DNA, 20 bp, Artificial Sequence
  Synthetic oligonucleotide; GAGAAT chr2 60509932 60509951 60509935 -
atgtgtggctcggtgactgg

SEQ ID NO: 187791 - DNA, 20 bp, Artificial Sequence
  Synthetic oligonucleotide; TAGAAT chr2 60509927 60509946 60509930 -
tggctcggtgactgggagaa

SEQ ID NO: 187792 - DNA, 20 bp, Artificial Sequence
  Synthetic oligonucleotide; TGGGAT chr2 60509911 60509930 60509914 -
agaatagaattgctgtttat

SEQ ID NO: 187793 - DNA, 20 bp, Artificial Sequence
  Synthetic oligonucleotide; GAGGAT chr2 60509878 60509897 60509881 -
aaaggctgtggaggtgctca

SEQ ID NO: 187794 - DNA, 20 bp, Artificial Sequence
  Synthetic oligonucleotide; ATGGGT chr2 60509874 60509893 60509877 -
gctgtggaggtgctcagagg

SEQ ID NO: 187795 - DNA, 20 bp, Artificial Sequence
  Synthetic oligonucleotide; GTGGAT chr2 60509834 60509853 60509837 -
ttcaccacttcaggacttca

SEQ ID NO: 187796 - DNA, 20 bp, Artificial Sequence
  Synthetic oligonucleotide; GAGAGT chr2 60509788 60509807 60509791 -
aggaagatcgtgaggggaaa

SEQ ID NO: 187797 - DNA, 20 bp, Artificial Sequence
  Synthetic oligonucleotide; TCGAGT chr2 60509719 60509738 60509722 -
tatagctgagatgatttaag

SEQ ID NO: 187798 - DNA, 20 bp, Artificial Sequence
  Synthetic oligonucleotide; AGGAAT chr2 60509516 60509535 60509519 -
gctgttaattggtgatattt

SEQ ID NO: 187799 - DNA, 20 bp, Artificial Sequence
  Synthetic oligonucleotide; ATGGGT chr2 60509512 60509531 60509515 -
ttaattggtgatatttagga

SEQ ID NO: 187800 - DNA, 20 bp, Artificial Sequence
  Synthetic oligonucleotide; TGGAAT chr2 60509379 60509398 60509382 -
tccacggttagcccctggct

SEQ ID NO: 187801 - DNA, 20 bp, Artificial Sequence
  Synthetic oligonucleotide; GAGAGT chr2 60509270 60509289 60509273 -
agagcctttttccttgaaag

SEQ ID NO: 187802 - DNA, 20 bp, Artificial Sequence
  Synthetic oligonucleotide; TGGAAT chr2 60509230 60509249 60509233 -
tggaaaagtaaaaaaattct

SEQ ID NO: 187803 - DNA, 20 bp, Artificial Sequence
  Synthetic oligonucleotide; GGGGGT chr2 60509177 60509196 60509180 -
tgagaccaagtaaattattg

SEQ ID NO: 187804 - DNA, 20 bp, Artificial Sequence
  Synthetic oligonucleotide; CTGAAT chr2 60509158 60509177 60509161 -
ggggggtaatttgcaagggc

SEQ ID NO: 187805 - DNA, 20 bp, Artificial Sequence
  Synthetic oligonucleotide; TTGAAT chr2 60509124 60509143 60509127 -
ttgctttcttgtttctcagc

SEQ ID NO: 187806 - DNA, 20 bp, Artificial Sequence
  Synthetic oligonucleotide; CGGAGT chr2 60509094 60509113 60509097 -
agaccagaagcctgtgattt

SEQ ID NO: 187807 - DNA, 20 bp, Artificial Sequence
  Synthetic oligonucleotide; AAGAGT chr2 60509076 60509095 60509079 -
ttcggagtctgatgagaaat

SEQ ID NO: 187808 - DNA, 20 bp, Artificial Sequence
  Synthetic oligonucleotide; CAGGAT chr2 60508963 60508982 60508966 -
taggagagctccttggtcct

SEQ ID NO: 187809 - DNA, 20 bp, Artificial Sequence
  Synthetic oligonucleotide; GTGGGT chr2 60508935 60508954 60508938 -
aaaagacaccttaagtagca

SEQ ID NO: 187810 - DNA, 20 bp, Artificial Sequence
  Synthetic oligonucleotide; TGGAAT chr2 60508836 60508855 60508839 -
acatgtagaacaaactcttc

SEQ ID NO: 187811 - DNA, 20 bp, Artificial Sequence
  Synthetic oligonucleotide; AAGAGT chr2 60508802 60508821 60508805 -
acccaagggggagctcagag

SEQ ID NO: 187812 - DNA, 20 bp, Artificial Sequence
  Synthetic oligonucleotide; AGGGAT chr2 60508460 60508479 60508463 -
tgccaactaggtaatgtgct

SEQ ID NO: 187813 - DNA, 20 bp, Artificial Sequence
  Synthetic oligonucleotide; TTGGGT chr2 60508423 60508442 60508426 -
agcaactggcaaccccctgt

SEQ ID NO: 187814 - DNA, 20 bp, Artificial Sequence
  Synthetic oligonucleotide; GGGAGT chr2 60508365 60508384 60508368 -
ttgctcctgtggcccctgca

SEQ ID NO: 187815 - DNA, 20 bp, Artificial Sequence
  Synthetic oligonucleotide; TGGGGT chr2 60508353 60508372 60508356 -
cccctgcagggagtgtggcc

SEQ ID NO: 187816 - DNA, 20 bp, Artificial Sequence
  Synthetic oligonucleotide; GTGGAT chr2 60508274 60508293 60508277 -
ccctgtgtcctgaaccaagt

SEQ ID NO: 187817 - DNA, 20 bp, Artificial Sequence
  Synthetic oligonucleotide; ATGAGT chr2 60508270 60508289 60508273 -
gtgtcctgaaccaagtgtgg

SEQ ID NO: 187818 - DNA, 20 bp, Artificial Sequence
  Synthetic oligonucleotide; GGGGGT chr2 60508211 60508230 60508214 -
tgttgttgttgttgttgttt

SEQ ID NO: 187819 - DNA, 20 bp, Artificial Sequence
  Synthetic oligonucleotide; GGGGGT chr2 60508205 60508224 60508208 -
tgttgttgttgtttgggggt

SEQ ID NO: 187820 - DNA, 20 bp, Artificial Sequence
  Synthetic oligonucleotide; CAGAAT chr2 60508181 60508200 60508184 -
gtagacagtgctgggcctgt

SEQ ID NO: 187821 - DNA, 20 bp, Artificial Sequence
  Synthetic oligonucleotide; ATGAAT chr2 60508156 60508175 60508159 -
ttttaggttggttctttgag

SEQ ID NO: 187822 - DNA, 20 bp, Artificial Sequence
  Synthetic oligonucleotide; GAGAAT chr2 60508084 60508103 60508087 -
cagtaagcaccatgacatga

SEQ ID NO: 187823 - DNA, 20 bp, Artificial Sequence
  Synthetic oligonucleotide; GTGAAT chr2 60507939 60507958 60507942 -
gcgtgtgtaatatgtctttt

SEQ ID NO: 187824 - DNA, 20 bp, Artificial Sequence
  Synthetic oligonucleotide; TTGGAT chr2 60507849 60507868 60507852 -
tgtcctttgttacaggagca

SEQ ID NO: 187825 - DNA, 20 bp, Artificial Sequence
  Synthetic oligonucleotide; TGGGAT chr2 60507142 60507161 60507145 -
atccttggccctctgtctgt

SEQ ID NO: 187826 - DNA, 20 bp, Artificial Sequence
  Synthetic oligonucleotide; TAGAGT chr2 60507072 60507091 60507075 -
cagtatttcagaacaaaaat

SEQ ID NO: 187827 - DNA, 20 bp, Artificial Sequence
  Synthetic oligonucleotide; TTGAGT chr2 60507056 60507075 60507059 -
aaattagagttagttcataa

SEQ ID NO: 187828 - DNA, 20 bp, Artificial Sequence
  Synthetic oligonucleotide; CAGGGT chr2 60506946 60506965 60506949 -
tcatcacatgccttaccagt

SEQ ID NO: 187829 - DNA, 20 bp, Artificial Sequence
  Synthetic oligonucleotide; TTGGAT chr2 60506913 60506932 60506916 -
ggcacatgcttttcaatagt

SEQ ID NO: 187830 - DNA, 20 bp, Artificial Sequence
  Synthetic oligonucleotide; TTGAAT chr2 60506858 60506877 60506861 -
tagcaatttaattacattaa

SEQ ID NO: 187831 - DNA, 20 bp, Artificial Sequence
  Synthetic oligonucleotide; ATGGAT chr2 60506744 60506763 60506747 -
ttgaggttgctgacagaaaa

SEQ ID NO: 187832 - DNA, 20 bp, Artificial Sequence
  Synthetic oligonucleotide; GTGGGT chr2 60506590 60506609 60506593 -
gcagccatgcacaaaggcac

SEQ ID NO: 187833 - DNA, 20 bp, Artificial Sequence
  Synthetic oligonucleotide; GAGGGT chr2 60506476 60506495 60506479 -
gtgaggtctttgtcaccttg

SEQ ID NO: 187834 - DNA, 20 bp, Artificial Sequence
  Synthetic oligonucleotide; TCGGGT chr2 60506454 60506473 60506457 -
gggtctgaggactggtgcgc

SEQ ID NO: 187835 - DNA, 20 bp, Artificial Sequence
  Synthetic oligonucleotide; CTGGAT chr2 60506416 60506435 60506419 -
cgtcctgagccagctctgtc

SEQ ID NO: 187836 - DNA, 20 bp, Artificial Sequence
  Synthetic oligonucleotide; AGGGGT chr2 60506384 60506403 60506387 -
aacactgtctgaagttttcc

SEQ ID NO: 187837 - DNA, 20 bp, Artificial Sequence
  Synthetic oligonucleotide; CAGAAT chr2 60506369 60506388 60506372 -
tttccaggggtttgacagac

SEQ ID NO: 187838 - DNA, 20 bp, Artificial Sequence
  Synthetic oligonucleotide; GAGAAT chr2 60506276 60506295 60506279 -
gactcttcctctgatgcaga

SEQ ID NO: 187839 - DNA, 20 bp, Artificial Sequence
  Synthetic oligonucleotide; GGGAGT chr2 60506213 60506232 60506216 -
tccatgccctcagagaaagt

SEQ ID NO: 187840 - DNA, 20 bp, Artificial Sequence
  Synthetic oligonucleotide; GTGGGT chr2 60506135 60506154 60506138 -
acctctctgtgatttctatg

SEQ ID NO: 187841 - DNA, 20 bp, Artificial Sequence
  Synthetic oligonucleotide; AAGGAT chr2 60506125 60506144 60506128 -
gatttctatggtgggtgtca

SEQ ID NO: 187842 - DNA, 20 bp, Artificial Sequence
  Synthetic oligonucleotide; GGGGAT chr2 60506109 60506128 60506112 -
gtcaaaggatggctgggaaa

SEQ ID NO: 187843 - DNA, 20 bp, Artificial Sequence
  Synthetic oligonucleotide; ATGAGT chr2 60506076 60506095 60506079 -
tgtgctaacatcccttgcct

SEQ ID NO: 187844 - DNA, 20 bp, Artificial Sequence
  Synthetic oligonucleotide; TTGGGT chr2 60505989 60506008 60505992 -
cataccctgcaaagccctat

SEQ ID NO: 187845 - DNA, 20 bp, Artificial Sequence
  Synthetic oligonucleotide; CTGGGT chr2 60505913 60505932 60505916 -
aggtggggctgctattgctt

SEQ ID NO: 187846 - DNA, 20 bp, Artificial Sequence
  Synthetic oligonucleotide; CGGGAT chr2 60505902 60505921 60505905 -
ctattgcttctgggtattta

SEQ ID NO: 187847 - DNA, 20 bp, Artificial Sequence
  Synthetic oligonucleotide; AGGGAT chr2 60505866 60505885 60505869 -
ctgcccaccgttgttttggg

SEQ ID NO: 187848 - DNA, 20 bp, Artificial Sequence
  Synthetic oligonucleotide; TAGAGT chr2 60505844 60505863 60505847 -
ggatttccccctccctcagg

SEQ ID NO: 187849 - DNA, 20 bp, Artificial Sequence
  Synthetic oligonucleotide; AAGAGT chr2 60505801 60505820 60505804 -
gtaattggcccttcccattt

SEQ ID NO: 187850 - DNA, 20 bp, Artificial Sequence
  Synthetic oligonucleotide; ACGAAT chr2 60505790 60505809 60505793 -
ttcccatttaagagtcagcc

SEQ ID NO: 187851 - DNA, 20 bp, Artificial Sequence
  Synthetic oligonucleotide; CAGAGT chr2 60505732 60505751 60505735 -
aggttacccaccctccgtca

SEQ ID NO: 187852 - DNA, 20 bp, Artificial Sequence
  Synthetic oligonucleotide; GGGAAT chr2 60505696 60505715 60505699 -
gtcccctgcttccgggaggt

SEQ ID NO: 187853 - DNA, 20 bp, Artificial Sequence
  Synthetic oligonucleotide; AGGGGT chr2 60505682 60505701 60505685 -
ggaggtgggaatgcatgtgg

SEQ ID NO: 187854 - DNA, 20 bp, Artificial Sequence
  Synthetic oligonucleotide; CTGGGT chr2 60505561 60505580 60505564 -
atttgagggagagaggccca

SEQ ID NO: 187855 - DNA, 20 bp, Artificial Sequence
  Synthetic oligonucleotide; GTGGAT chr2 60505483 60505502 60505486 -
agcacccgcttgttccctgt

SEQ ID NO: 187856 - DNA, 20 bp, Artificial Sequence
  Synthetic oligonucleotide; ATGAGT chr2 60505431 60505450 60505434 -
ctcactcggctgactacctg

SEQ ID NO: 187857 - DNA, 20 bp, Artificial Sequence
  Synthetic oligonucleotide; AAGAAT chr2 60505314 60505333 60505317 -
aggcatttggaacaatctgg

SEQ ID NO: 187858 - DNA, 20 bp, Artificial Sequence
  Synthetic oligonucleotide; TGGGGT chr2 60505309 60505328 60505312 -
tttggaacaatctggaagaa

SEQ ID NO: 187859 - DNA, 20 bp, Artificial Sequence
  Synthetic oligonucleotide; CTGAGT chr2 60505277 60505296 60505280 -
ggacacccttgaagccgttt

SEQ ID NO: 187860 - DNA, 20 bp, Artificial Sequence
  Synthetic oligonucleotide; TCGAAT chr2 60505204 60505223 60505207 -
aaaaattgggcccatccctt

SEQ ID NO: 187861 - DNA, 20 bp, Artificial Sequence
  Synthetic oligonucleotide; GAGGAT chr2 60505177 60505196 60505180 -
tccattgtgctgttagtaat

SEQ ID NO: 187862 - DNA, 20 bp, Artificial Sequence
  Synthetic oligonucleotide; ACGGAT chr2 60505171 60505190 60505174 -
gtgctgttagtaatgaggat

SEQ ID NO: 187863 - DNA, 20 bp, Artificial Sequence
  Synthetic oligonucleotide; TTGAGT chr2 60505148 60505167 60505151 -
gataaaatcacatttttttt

SEQ ID NO: 187864 - DNA, 20 bp, Artificial Sequence
  Synthetic oligonucleotide; AGGAGT chr2 60505132 60505151 60505135 -
ttttttgagtaagccctttg

SEQ ID NO: 187865 - DNA, 20 bp, Artificial Sequence
  Synthetic oligonucleotide; ATGAGT chr2 60505103 60505122 60505106 -
gtcaaattgagactcacctc

SEQ ID NO: 187866 - DNA, 20 bp, Artificial Sequence
  Synthetic oligonucleotide; AAGGGT chr2 60505075 60505094 60505078 -
ccctgtgaagaggcaggaga

SEQ ID NO: 187867 - DNA, 20 bp, Artificial Sequence
  Synthetic oligonucleotide; AGGGGT chr2 60505020 60505039 60505023 -
gtctggtctcatgcagccgc

SEQ ID NO: 187868 - DNA, 20 bp, Artificial Sequence
  Synthetic oligonucleotide; AGGGAT chr2 60505009 60505028 60505012 -
tgcagccgcaggggtagact

SEQ ID NO: 187869 - DNA, 20 bp, Artificial Sequence
  Synthetic oligonucleotide; CTGGGT chr2 60504979 60504998 60504982 -
atccagaactccttatactt

SEQ ID NO: 187870 - DNA, 20 bp, Artificial Sequence
  Synthetic oligonucleotide; CAGGGT chr2 60504946 60504965 60504949 -
acgcttccacagcctgcaca

SEQ ID NO: 187871 - DNA, 20 bp, Artificial Sequence
  Synthetic oligonucleotide; AGGAAT chr2 60504830 60504849 60504833 -
tggtaggggaggcatgtgat

SEQ ID NO: 187872 - DNA, 20 bp, Artificial Sequence
  Synthetic oligonucleotide; CAGAGT chr2 60504610 60504629 60504613 -
gggcttgggggagacagaga

SEQ ID NO: 187873 - DNA, 20 bp, Artificial Sequence
  Synthetic oligonucleotide; CTGGGT chr2 60504547 60504566 60504550 -
tgccttggagattatttttt

SEQ ID NO: 187874 - DNA, 20 bp, Artificial Sequence
  Synthetic oligonucleotide; GTGGGT chr2 60504362 60504381 60504365 -
tggcctcctctgccttttca

SEQ ID NO: 187875 - DNA, 20 bp, Artificial Sequence
  Synthetic oligonucleotide; CTGGGT chr2 60504349 60504368 60504352 -
cttttcagtgggtggctggg

SEQ ID NO: 187876 - DNA, 20 bp, Artificial Sequence
  Synthetic oligonucleotide; AAGGGT chr2 60504318 60504337 60504321 -
cttgcagtgactaagaaagg

SEQ ID NO: 187877 - DNA, 20 bp, Artificial Sequence
  Synthetic oligonucleotide; TGGAAT chr2 60504240 60504259 60504243 -
gtgccggtaggcagcagttc

SEQ ID NO: 187878 - DNA, 20 bp, Artificial Sequence
  Synthetic oligonucleotide; GGGAGT chr2 60504157 60504176 60504160 -
gagcatctctgttctgtttg

SEQ ID NO: 187879 - DNA, 20 bp, Artificial Sequence
  Synthetic oligonucleotide; GTGAGT chr2 60504137 60504156 60504140 -
gggagtcctgccaggcaagt

SEQ ID NO: 187880 - DNA, 20 bp, Artificial Sequence
  Synthetic oligonucleotide; CTGAGT chr2 60504089 60504108 60504092 -
tgtcatgggggcagtgtcgg

SEQ ID NO: 187881 - DNA, 20 bp, Artificial Sequence
  Synthetic oligonucleotide; CAGAGT chr2 60504074 60504093 60504077 -
gtcggctgagtggtactctt

SEQ ID NO: 187882 - DNA, 20 bp, Artificial Sequence
  Synthetic oligonucleotide; CAGAAT chr2 60504065 60504084 60504068 -
gtggtactcttcagagttct

SEQ ID NO: 187883 - DNA, 20 bp, Artificial Sequence
  Synthetic oligonucleotide; TGGGGT chr2 60504015 60504034 60504018 -
tccagcaggcttctagcaga

SEQ ID NO: 187884 - DNA, 20 bp, Artificial Sequence
  Synthetic oligonucleotide; CTGGGT chr2 60504004 60504023 60504007 -
tctagcagatggggttttgg

SEQ ID NO: 187885 - DNA, 20 bp, Artificial Sequence
  Synthetic oligonucleotide; TAGAAT chr2 60503919 60503938 60503922 -
ttcttgctttcttttttttc

SEQ ID NO: 187886 - DNA, 20 bp, Artificial Sequence
  Synthetic oligonucleotide; ATGAAT chr2 60503875 60503894 60503878 -
ccaattttcaggaggtttag

SEQ ID NO: 187887 - DNA, 20 bp, Artificial Sequence
  Synthetic oligonucleotide; GTGAAT chr2 60503869 60503888 60503872 -
ttcaggaggtttagatgaat

SEQ ID NO: 187888 - DNA, 20 bp, Artificial Sequence
  Synthetic oligonucleotide; CAGAAT chr2 60503811 60503830 60503814 -
taaagctctgacaaaagatc

SEQ ID NO: 187889 - DNA, 20 bp, Artificial Sequence
  Synthetic oligonucleotide; TAGGGT chr2 60503784 60503803 60503787 -
ttgtcccttgcagtgggctt

SEQ ID NO: 187890 - DNA, 20 bp, Artificial Sequence
  Synthetic oligonucleotide; GCGGGT chr2 60503752 60503771 60503755 -
ttggctcctaaatcttctag

SEQ ID NO: 187891 - DNA, 20 bp, Artificial Sequence
  Synthetic oligonucleotide; GAGGGT chr2 60503694 60503713 60503697 -
tggcagctataggtttccag

SEQ ID NO: 187892 - DNA, 20 bp, Artificial Sequence
  Synthetic oligonucleotide; CTGGGT chr2 60503675 60503694 60503678 -
ggagggtgaacaagggccat

SEQ ID NO: 187893 - DNA, 20 bp, Artificial Sequence
  Synthetic oligonucleotide; CTGGGT chr2 60503647 60503666 60503650 -
ttgctgagggcttctcagtc

SEQ ID NO: 187894 - DNA, 20 bp, Artificial Sequence
  Synthetic oligonucleotide; CTGGGT chr2 60503633 60503652 60503636 -
tcagtcctgggtaggaactg

SEQ ID NO: 187895 - DNA, 20 bp, Artificial Sequence
  Synthetic oligonucleotide; ATGGAT chr2 60503518 60503537 60503521 -
tcccagatttgggcaatcta

SEQ ID NO: 187896 - DNA, 20 bp, Artificial Sequence
  Synthetic oligonucleotide; GAGGGT chr2 60503506 60503525 60503509 -
gcaatctaatggataggagg

SEQ ID NO: 187897 - DNA, 20 bp, Artificial Sequence
  Synthetic oligonucleotide; GTGAAT chr2 60503488 60503507 60503491 -
gggagggttatgccccatct

SEQ ID NO: 187898 - DNA, 20 bp, Artificial Sequence
  Synthetic oligonucleotide; GAGGGT chr2 60503472 60503491 60503475 -
atctgtgaataggtggagga

SEQ ID NO: 187899 - DNA, 20 bp, Artificial Sequence
  Synthetic oligonucleotide; TGGAAT chr2 60503397 60503416 60503400 -
ccagggacatgtctggctcc

SEQ ID NO: 187900 - DNA, 20 bp, Artificial Sequence
  Synthetic oligonucleotide; GTGGGT chr2 60503375 60503394 60503378 -
gaatgcctgtccaggctgcg

SEQ ID NO: 187901 - DNA, 20 bp, Artificial Sequence
  Synthetic oligonucleotide; ATGGGT chr2 60503366 60503385 60503369 -
tccaggctgcggtgggtggc

SEQ ID NO: 187902 - DNA, 20 bp, Artificial Sequence
  Synthetic oligonucleotide; AAGGGT chr2 60503360 60503379 60503363 -
ctgcggtgggtggcatgggt

SEQ ID NO: 187903 - DNA, 20 bp, Artificial Sequence
  Synthetic oligonucleotide; TTGGGT chr2 60503290 60503309 60503293 -
agccacctgccttttctgtc

SEQ ID NO: 187904 - DNA, 20 bp, Artificial Sequence
  Synthetic oligonucleotide; CAGAAT chr2 60503230 60503249 60503233 -
gtcagagcctcctgaggctg

SEQ ID NO: 187905 - DNA, 20 bp, Artificial Sequence
  Synthetic oligonucleotide; AAGGGT chr2 60503209 60503228 60503212 -
agaatggggctaacatgatc

SEQ ID NO: 187906 - DNA, 20 bp, Artificial Sequence
  Synthetic oligonucleotide; AGGAGT chr2 60503178 60503197 60503181 -
ggcttctccatcttgggact

SEQ ID NO: 187907 - DNA, 20 bp, Artificial Sequence
  Synthetic oligonucleotide; CAGAGT chr2 60503119 60503138 60503122 -
tcccattgccaggacaaatg

SEQ ID NO: 187908 - DNA, 20 bp, Artificial Sequence
  Synthetic oligonucleotide; GTGGAT chr2 60503115 60503134 60503118 -
attgccaggacaaatgcaga

SEQ ID NO: 187909 - DNA, 20 bp, Artificial Sequence
  Synthetic oligonucleotide; CTGGGT chr2 60503109 60503128 60503112 -
aggacaaatgcagagtggat

SEQ ID NO: 187910 - DNA, 20 bp, Artificial Sequence
  Synthetic oligonucleotide; CTGGGT chr2 60502818 60502837 60502821 -
ctcccctggtcacatagttt

SEQ ID NO: 187911 - DNA, 20 bp, Artificial Sequence
  Synthetic oligonucleotide; TAGAAT chr2 60502804 60502823 60502807 -
tagtttctgggtgacaggac

SEQ ID NO: 187912 - DNA, 20 bp, Artificial Sequence
  Synthetic oligonucleotide; TTGAGT chr2 60502778 60502797 60502781 -
ttatttcttttgatcaccaa

SEQ ID NO: 187913 - DNA, 20 bp, Artificial Sequence
  Synthetic oligonucleotide; AAGAGT chr2 60502669 60502688 60502672 -
atcaagaacattacaacaca

SEQ ID NO: 187914 - DNA, 20 bp, Artificial Sequence
  Synthetic oligonucleotide; TGGGAT chr2 60502599 60502618 60502602 -
tattttaatattagaaagca

SEQ ID NO: 187915 - DNA, 20 bp, Artificial Sequence
  Synthetic oligonucleotide; TTGGGT chr2 60502594 60502613 60502597 -
taatattagaaagcatggga

SEQ ID NO: 187916 - DNA, 20 bp, Artificial Sequence
  Synthetic oligonucleotide; TTGGAT chr2 60502575 60502594 60502578 -
attgggtgtgaacactgctt

SEQ ID NO: 187917 - DNA, 20 bp, Artificial Sequence
  Synthetic oligonucleotide; CAGAAT chr2 60502510 60502529 60502513 -
aggagcaatacctgagatcc

SEQ ID NO: 187918 - DNA, 20 bp, Artificial Sequence
  Synthetic oligonucleotide; CTGAAT chr2 60502438 60502457 60502441 -
agaaaccccctgctactctt

SEQ ID NO: 187919 - DNA, 20 bp, Artificial Sequence
  Synthetic oligonucleotide; CAGAAT chr2 60502354 60502373 60502357 -
tttatttttccgtttgctca

SEQ ID NO: 187920 - DNA, 20 bp, Artificial Sequence
  Synthetic oligonucleotide; CAGGAT chr2 60502237 60502256 60502240 -
tttcaccagcttttacaaag

SEQ ID NO: 187921 - DNA, 20 bp, Artificial Sequence
  Synthetic oligonucleotide; TTGAGT chr2 60502142 60502161 60502145 -
ttcatatcattctgatagtc

SEQ ID NO: 187922 - DNA, 20 bp, Artificial Sequence
  Synthetic oligonucleotide; TGGAGT chr2 60502074 60502093 60502077 -
ctggtggtacagcttctctg

SEQ ID NO: 187923 - DNA, 20 bp, Artificial Sequence
  Synthetic oligonucleotide; TAGAAT chr2 60501940 60501959 60501943 -
taattcactagtaaaataat

SEQ ID NO: 187924 - DNA, 20 bp, Artificial Sequence
  Synthetic oligonucleotide; TGGAAT chr2 60501922 60501941 60501925 -
attagaataaaaggctgttt

SEQ ID NO: 187925 - DNA, 20 bp, Artificial Sequence
  Synthetic oligonucleotide; CAGAAT chr2 60501885 60501904 60501888 -
gaggggctgatataacttct

SEQ ID NO: 187926 - DNA, 20 bp, Artificial Sequence
  Synthetic oligonucleotide; GTGGGT chr2 60501755 60501774 60501758 -
cagcactttgggaggccgag

SEQ ID NO: 187927 - DNA, 20 bp, Artificial Sequence
  Synthetic oligonucleotide; AAGAGT chr2 60501734 60501753 60501737 -
tgggtagatcacctgaggtc

SEQ ID NO: 187928 - DNA, 20 bp, Artificial Sequence
  Synthetic oligonucleotide; GAGAAT chr2 60501617 60501636 60501620 -
tactcaggaggctgagggag

SEQ ID NO: 187929 - DNA, 20 bp, Artificial Sequence
  Synthetic oligonucleotide; AAGAGT chr2 60501395 60501414 60501398 -
gaagtgattaatcatattac

SEQ ID NO: 187930 - DNA, 20 bp, Artificial Sequence
  Synthetic oligonucleotide; GGGAAT chr2 60501287 60501306 60501290 -
ctgtgagctccttgagggca

SEQ ID NO: 187931 - DNA, 20 bp, Artificial Sequence
  Synthetic oligonucleotide; ATGAAT chr2 60501231 60501250 60501234 -
gcactacaggtttggaccaa

SEQ ID NO: 187932 - DNA, 20 bp, Artificial Sequence
  Synthetic oligonucleotide; TTGAAT chr2 60501211 60501230 60501214 -
atgaattaaattggctgcca

SEQ ID NO: 187933 - DNA, 20 bp, Artificial Sequence
  Synthetic oligonucleotide; CAGAAT chr2 60501200 60501219 60501203 -
tggctgccattgaatcaaag

SEQ ID NO: 187934 - DNA, 20 bp, Artificial Sequence
  Synthetic oligonucleotide; TTGGAT chr2 60501152 60501171 60501155 -
taatataaataagtgcaaaa

SEQ ID NO: 187935 - DNA, 20 bp, Artificial Sequence
  Synthetic oligonucleotide; CTGAGT chr2 60501054 60501073 60501057 -
tcctgtggagacctctgttg

SEQ ID NO: 187936 - DNA, 20 bp, Artificial Sequence
  Synthetic oligonucleotide; GTGAGT chr2 60501050 60501069 60501053 -
gtggagacctctgttgctga

SEQ ID NO: 187937 - DNA, 20 bp, Artificial Sequence
  Synthetic oligonucleotide; CAGGGT chr2 60501019 60501038 60501022 -
atgaggtcggctgagcagtt

SEQ ID NO: 187938 - DNA, 20 bp, Artificial Sequence
  Synthetic oligonucleotide; GAGGAT chr2 60500996 60501015 60500999 -
ggttctcccattttacagag

SEQ ID NO: 187939 - DNA, 20 bp, Artificial Sequence
  Synthetic oligonucleotide; AAGGAT chr2 60500798 60500817 60500801 -
caggaaattggtggtagatg

SEQ ID NO: 187940 - DNA, 20 bp, Artificial Sequence
  Synthetic oligonucleotide; CTGAGT chr2 60500766 60500785 60500769 -
catctgtctaacttgggagc

SEQ ID NO: 187941 - DNA, 20 bp, Artificial Sequence
  Synthetic oligonucleotide; GTGAGT chr2 60500714 60500733 60500717 -
tgaagtgaggtgccccgact

SEQ ID NO: 187942 - DNA, 20 bp, Artificial Sequence
  Synthetic oligonucleotide; GAGGGT chr2 60500649 60500668 60500652 -
gtcttataccttaactggtg

SEQ ID NO: 187943 - DNA, 20 bp, Artificial Sequence
  Synthetic oligonucleotide; AGGAGT chr2 60500596 60500615 60500599 -
tagctctgaaccctgtcctg

SEQ ID NO: 187944 - DNA, 20 bp, Artificial Sequence
  Synthetic oligonucleotide; TGGGGT chr2 60500581 60500600 60500584 -
tcctgaggagttgggaagtg

SEQ ID NO: 187945 - DNA, 20 bp, Artificial Sequence
  Synthetic oligonucleotide; TTGGGT chr2 60500492 60500511 60500495 -
tctccttccttccctggctc

SEQ ID NO: 187946 - DNA, 20 bp, Artificial Sequence
  Synthetic oligonucleotide; TGGGAT chr2 60500457 60500476 60500460 -
gctctgatgtaagttcctgc

SEQ ID NO: 187947 - DNA, 20 bp, Artificial Sequence
  Synthetic oligonucleotide; AAGAGT chr2 60500015 60500034 60500018 -
acaggagacaaacaccagct

SEQ ID NO: 187948 - DNA, 20 bp, Artificial Sequence
  Synthetic oligonucleotide; TGGGGT chr2 60499995 60500014 60499998 -
aagagtaaacagcctggcag

SEQ ID NO: 187949 - DNA, 20 bp, Artificial Sequence
  Synthetic oligonucleotide; GTGAGT chr2 60499991 60500010 60499994 -
gtaaacagcctggcagtggg

SEQ ID NO: 187950 - DNA, 20 bp, Artificial Sequence
  Synthetic oligonucleotide; CCGAAT chr2 60499920 60499939 60499923 -
caggtcggtggctgctctct

SEQ ID NO: 187951 - DNA, 20 bp, Artificial Sequence
  Synthetic oligonucleotide; ATGGAT chr2 60499851 60499870 60499854 -
gggcttgaggtctggtgctt

SEQ ID NO: 187952 - DNA, 20 bp, Artificial Sequence
  Synthetic oligonucleotide; CAGAGT chr2 60499822 60499841 60499825 -
gaggaagagaagacagatgg

SEQ ID NO: 187953 - DNA, 20 bp, Artificial Sequence
  Synthetic oligonucleotide; TGGGGT chr2 60499651 60499670 60499654 -
gggcctcactgacacctgca

SEQ ID NO: 187954 - DNA, 20 bp, Artificial Sequence
  Synthetic oligonucleotide; AGGGGT chr2 60499630 60499649 60499633 -
ggggttggtggggaggtatg

SEQ ID NO: 187955 - DNA, 20 bp, Artificial Sequence
  Synthetic oligonucleotide; AGGGGT chr2 60499621 60499640 60499624 -
ggggaggtatgaggggttgg

SEQ ID NO: 187956 - DNA, 20 bp, Artificial Sequence
  Synthetic oligonucleotide; ATGAGT chr2 60499531 60499550 60499534 -
gactctaaagtcagctacac

SEQ ID NO: 187957 - DNA, 20 bp, Artificial Sequence
  Synthetic oligonucleotide; AGGAGT chr2 60499406 60499425 60499409 -
tgggaagaaatatcacttag

SEQ ID NO: 187958 - DNA, 20 bp, Artificial Sequence
  Synthetic oligonucleotide; CAGAAT chr2 60499398 60499417 60499401 -
aatatcacttagaggagtta

SEQ ID NO: 187959 - DNA, 20 bp, Artificial Sequence
  Synthetic oligonucleotide; AGGAGT chr2 60499378 60499397 60499381 -
cagaatgtgcaacctttccc

SEQ ID NO: 187960 - DNA, 20 bp, Artificial Sequence
  Synthetic oligonucleotide; AGGAAT chr2 60499361 60499380 60499364 -
cccaggagtattgctcctga

SEQ ID NO: 187961 - DNA, 20 bp, Artificial Sequence
  Synthetic oligonucleotide; AAGGGT chr2 60499310 60499329 60499313 -
cctccagcactgtggcccag

SEQ ID NO: 187962 - DNA, 20 bp, Artificial Sequence
  Synthetic oligonucleotide; GGGAGT chr2 60499267 60499286 60499270 -
tcacacccctgcagctctgt

SEQ ID NO: 187963 - DNA, 20 bp, Artificial Sequence
  Synthetic oligonucleotide; CTGAAT chr2 60499125 60499144 60499128 -
gataatggcagcccagaaac

SEQ ID NO: 187964 - DNA, 20 bp, Artificial Sequence
  Synthetic oligonucleotide; TAGGGT chr2 60499103 60499122 60499106 -
gaatactggggaacacattg

SEQ ID NO: 187965 - DNA, 20 bp, Artificial Sequence
  Synthetic oligonucleotide; TTGGAT chr2 60499044 60499063 60499047 -
tagctgtagcattcttccct

SEQ ID NO: 187966 - DNA, 20 bp, Artificial Sequence
  Synthetic oligonucleotide; CAGAAT chr2 60499025 60499044 60499028 -
tttggatgcctgtgtgggga

SEQ ID NO: 187967 - DNA, 20 bp, Artificial Sequence
  Synthetic oligonucleotide; TGGAAT chr2 60499016 60499035 60499019 -
ctgtgtggggacagaatcag

SEQ ID NO: 187968 - DNA, 20 bp, Artificial Sequence
  Synthetic oligonucleotide; CTGGAT chr2 60498912 60498931 60498915 -
ctattagacaaacgtagttt

SEQ ID NO: 187969 - DNA, 20 bp, Artificial Sequence
  Synthetic oligonucleotide; ATGAGT chr2 60498908 60498927 60498911 -
tagacaaacgtagtttctgg

SEQ ID NO: 187970 - DNA, 20 bp, Artificial Sequence
  Synthetic oligonucleotide; CTGAGT chr2 60498891 60498910 60498894 -
tggatgagttggacagtcat

SEQ ID NO: 187971 - DNA, 20 bp, Artificial Sequence
  Synthetic oligonucleotide; CTGGGT chr2 60498766 60498785 60498769 -
tcagagaactggcagtctgg

SEQ ID NO: 187972 - DNA, 20 bp, Artificial Sequence
  Synthetic oligonucleotide; GTGAGT chr2 60498673 60498692 60498676 -
cttctctttactgatcttat

SEQ ID NO: 187973 - DNA, 20 bp, Artificial Sequence
  Synthetic oligonucleotide; AGGGGT chr2 60498661 60498680 60498664 -
gatcttatgtgagtaggtag

SEQ ID NO: 187974 - DNA, 20 bp, Artificial Sequence
  Synthetic oligonucleotide; ATGAAT chr2 60498563 60498582 60498566 -
gtgccagaggtggctaaata

SEQ ID NO: 187975 - DNA, 20 bp, Artificial Sequence
  Synthetic oligonucleotide; GTGGGT chr2 60498531 60498550 60498534 -
ggccaattctaggaagggaa

SEQ ID NO: 187976 - DNA, 20 bp, Artificial Sequence
  Synthetic oligonucleotide; CAGGAT chr2 60498497 60498516 60498500 -
gcccattgccttcctggtac

SEQ ID NO: 187977 - DNA, 20 bp, Artificial Sequence
  Synthetic oligonucleotide; CTGGGT chr2 60498408 60498427 60498411 -
acccctctgtccagcccagc

SEQ ID NO: 187978 - DNA, 20 bp, Artificial Sequence
  Synthetic oligonucleotide; AGGGGT chr2 60498372 60498391 60498375 -
tgtgcttggtcggcactgat

SEQ ID NO: 187979 - DNA, 20 bp, Artificial Sequence
  Synthetic oligonucleotide; GGGAGT chr2 60498359 60498378 60498362 -
cactgataggggtcgcggta

SEQ ID NO: 187980 - DNA, 20 bp, Artificial Sequence
  Synthetic oligonucleotide; CTGGGT chr2 60498212 60498231 60498215 -
cacttctgtgcccagggctg

SEQ ID NO: 187981 - DNA, 20 bp, Artificial Sequence
  Synthetic oligonucleotide; TGGGGT chr2 60498160 60498179 60498163 -
acatagaggcccttcctgct

SEQ ID NO: 187982 - DNA, 20 bp, Artificial Sequence
  Synthetic oligonucleotide; AAGAGT chr2 60498091 60498110 60498094 -
tgactcaccccagccctgct

SEQ ID NO: 187983 - DNA, 20 bp, Artificial Sequence
  Synthetic oligonucleotide; GAGGGT chr2 60498051 60498070 60498054 -
aagagaagacccctgctctt

SEQ ID NO: 187984 - DNA, 20 bp, Artificial Sequence
  Synthetic oligonucleotide; GTGGGT chr2 60498038 60498057 60498041 -
tgctcttgagggtctgccag

SEQ ID NO: 187985 - DNA, 20 bp, Artificial Sequence
  Synthetic oligonucleotide; TTGGAT chr2 60498004 60498023 60498007 -
tccccacctccatgggcctc

SEQ ID NO: 187986 - DNA, 20 bp, Artificial Sequence
  Synthetic oligonucleotide; TGGGGT chr2 60497961 60497980 60497964 -
ctgcaacaccctgaccttta

SEQ ID NO: 187987 - DNA, 20 bp, Artificial Sequence
  Synthetic oligonucleotide; GTGGGT chr2 60497935 60497954 60497938 -
catcctcggccaatgaagcg

SEQ ID NO: 187988 - DNA, 20 bp, Artificial Sequence
  Synthetic oligonucleotide; CAGGAT chr2 60497856 60497875 60497859 -
gtttcatttaggacaatgtg

SEQ ID NO: 187989 - DNA, 20 bp, Artificial Sequence
  Synthetic oligonucleotide; CTGGAT chr2 60497831 60497850 60497834 -
tccttttgatcatttctcta

SEQ ID NO: 187990 - DNA, 20 bp, Artificial Sequence
  Synthetic oligonucleotide; CTGAGT chr2 60497790 60497809 60497793 -
aaatgagacaaaagaggcca

SEQ ID NO: 187991 - DNA, 20 bp, Artificial Sequence
  Synthetic oligonucleotide; AAGAGT chr2 60497734 60497753 60497737 -
gtgatagttcagagaaagag

SEQ ID NO: 187992 - DNA, 20 bp, Artificial Sequence
  Synthetic oligonucleotide; AAGGAT chr2 60497693 60497712 60497696 -
aaggccttccaaaaaaagta

SEQ ID NO: 187993 - DNA, 20 bp, Artificial Sequence
  Synthetic oligonucleotide; TAGGAT chr2 60497597 60497616 60497600 -
ggtcattatcatcaccatta

SEQ ID NO: 187994 - DNA, 20 bp, Artificial Sequence
  Synthetic oligonucleotide; TTGAGT chr2 60497555 60497574 60497558 -
tagtgactggtaagagccga

SEQ ID NO: 187995 - DNA, 20 bp, Artificial Sequence
  Synthetic oligonucleotide; ATGAAT chr2 60497521 60497540 60497524 -
gattcctgatgttaggggcc

SEQ ID NO: 187996 - DNA, 20 bp, Artificial Sequence
  Synthetic oligonucleotide; TGGAAT chr2 60497506 60497525 60497509 -
gggccatgaatctgtctacc

SEQ ID NO: 187997 - DNA, 20 bp, Artificial Sequence
  Synthetic oligonucleotide; AGGGAT chr2 60497410 60497429 60497413 -
taacctgagggctagtttct

SEQ ID NO: 187998 - DNA, 20 bp, Artificial Sequence
  Synthetic oligonucleotide; TTGAAT chr2 60497375 60497394 60497378 -
taaagacagttcatatatgc

SEQ ID NO: 187999 - DNA, 20 bp, Artificial Sequence
  Synthetic oligonucleotide; AAGGAT chr2 60497274 60497293 60497277 -
attttcccccctctttacaa

SEQ ID NO: 188000 - DNA, 20 bp, Artificial Sequence
  Synthetic oligonucleotide; TGGAAT chr2 60497247 60497266 60497250 -
cacagtggtattcctttcaa

SEQ ID NO: 188001 - DNA, 20 bp, Artificial Sequence
  Synthetic oligonucleotide; GGGGAT chr2 60497132 60497151 60497135 -
ctagctctagctctagctta

SEQ ID NO: 188002 - DNA, 20 bp, Artificial Sequence
  Synthetic oligonucleotide; GGGAAT chr2 60497116 60497135 60497119 -
cttaggggatgctagctaaa

SEQ ID NO: 188003 - DNA, 20 bp, Artificial Sequence
  Synthetic oligonucleotide; TAGAAT chr2 60497110 60497129 60497113 -
ggatgctagctaaagggaat

SEQ ID NO: 188004 - DNA, 20 bp, Artificial Sequence
  Synthetic oligonucleotide; AGGAGT chr2 60497051 60497070 60497054 -
tgtccactcaacactggggg

SEQ ID NO: 188005 - DNA, 20 bp, Artificial Sequence
  Synthetic oligonucleotide; TGGAAT chr2 60497004 60497023 60497007 -
gtgagagcttatagtccctt

SEQ ID NO: 188006 - DNA, 20 bp, Artificial Sequence
  Synthetic oligonucleotide; ATGGGT chr2 60496914 60496933 60496917 -
ttatgactgtccatggggaa

SEQ ID NO: 188007 - DNA, 20 bp, Artificial Sequence
  Synthetic oligonucleotide; AGGGGT chr2 60496831 60496850 60496834 -
cagtgagggagatttgagga

SEQ ID NO: 188008 - DNA, 20 bp, Artificial Sequence
  Synthetic oligonucleotide; TAGAGT chr2 60496759 60496778 60496762 -
agagcactcacagtggaacc

SEQ ID NO: 188009 - DNA, 20 bp, Artificial Sequence
  Synthetic oligonucleotide; GAGGGT chr2 60496636 60496655 60496639 -
agagaaagtcggtgaggaga

SEQ ID NO: 188010 - DNA, 20 bp, Artificial Sequence
  Synthetic oligonucleotide; AGGGGT chr2 60496589 60496608 60496592 -
actcaccaggctcttccaga

SEQ ID NO: 188011 - DNA, 20 bp, Artificial Sequence
  Synthetic oligonucleotide; TGGGAT chr2 60496316 60496335 60496319 -
ttgcccctcagtaacaccac

SEQ ID NO: 188012 - DNA, 20 bp, Artificial Sequence
  Synthetic oligonucleotide; TGGGAT chr2 60496167 60496186 60496170 -
ctttcccggttctggttttc

SEQ ID NO: 188013 - DNA, 20 bp, Artificial Sequence
  Synthetic oligonucleotide; GAGGGT chr2 60496048 60496067 60496051 -
tcaattgacttttcacatat

SEQ ID NO: 188014 - DNA, 20 bp, Artificial Sequence
  Synthetic oligonucleotide; CTGGAT chr2 60496037 60496056 60496040 -
ttcacatatgagggtgacct

SEQ ID NO: 188015 - DNA, 20 bp, Artificial Sequence
  Synthetic oligonucleotide; AAGAAT chr2 60495959 60495978 60495962 -
aggtgttttaaaaaatagct

SEQ ID NO: 188016 - DNA, 20 bp, Artificial Sequence
  Synthetic oligonucleotide; TGGAAT chr2 60495894 60495913 60495897 -
tgacagcaccatttagagcc

SEQ ID NO: 188017 - DNA, 20 bp, Artificial Sequence
  Synthetic oligonucleotide; AAGGGT chr2 60495839 60495858 60495842 -
ccccaggctcccatggtggc

SEQ ID NO: 188018 - DNA, 20 bp, Artificial Sequence
  Synthetic oligonucleotide; AGGGGT chr2 60495819 60495838 60495822 -
aagggtttttggttggggga

SEQ ID NO: 188019 - DNA, 20 bp, Artificial Sequence
  Synthetic oligonucleotide; TTGAAT chr2 60495812 60495831 60495815 -
tttggttgggggaaggggta

SEQ ID NO: 188020 - DNA, 20 bp, Artificial Sequence
  Synthetic oligonucleotide; AAGAAT chr2 60495786 60495805 60495789 -
tgcctgtctttgagcaggaa

SEQ ID NO: 188021 - DNA, 20 bp, Artificial Sequence
  Synthetic oligonucleotide; GAGAAT chr2 60495730 60495749 60495733 -
gtgctgattgagggcccatt

SEQ ID NO: 188022 - DNA, 20 bp, Artificial Sequence
  Synthetic oligonucleotide; AGGGAT chr2 60495686 60495705 60495689 -
gctccaaactctcaaaccac

SEQ ID NO: 188023 - DNA, 20 bp, Artificial Sequence
  Synthetic oligonucleotide; GAGAAT chr2 60495626 60495645 60495629 -
tgtaagcatcacaacaggca

SEQ ID NO: 188024 - DNA, 20 bp, Artificial Sequence
  Synthetic oligonucleotide; GGGGGT chr2 60495557 60495576 60495560 -
gcaaaccagactagtttata

SEQ ID NO: 188025 - DNA, 20 bp, Artificial Sequence
  Synthetic oligonucleotide; TTGGGT chr2 60495527 60495546 60495530 -
ctctgaggtactgatggacc

SEQ ID NO: 188026 - DNA, 20 bp, Artificial Sequence
  Synthetic oligonucleotide; GGGAGT chr2 60495483 60495502 60495486 -
aaggcagctagacaggactt

SEQ ID NO: 188027 - DNA, 20 bp, Artificial Sequence
  Synthetic oligonucleotide; CAGGGT chr2 60495321 60495340 60495324 -
tactcttagacataacacac

SEQ ID NO: 188028 - DNA, 20 bp, Artificial Sequence
  Synthetic oligonucleotide; AAGGGT chr2 60495254 60495273 60495257 -
cttttatcacaggctccagg

SEQ ID NO: 188029 - DNA, 20 bp, Artificial Sequence
  Synthetic oligonucleotide; TAGGGT chr2 60495236 60495255 60495239 -
ggaagggtttggcctctgat

SEQ ID NO: 188030 - DNA, 20 bp, Artificial Sequence
  Synthetic oligonucleotide; GTGGGT chr2 60495224 60495243 60495227 -
cctctgattagggtgggggc

SEQ ID NO: 188031 - DNA, 20 bp, Artificial Sequence
  Synthetic oligonucleotide; TGGGGT chr2 60495219 60495238 60495222 -
gattagggtgggggcgtggg

SEQ ID NO: 188032 - DNA, 20 bp, Artificial Sequence
  Synthetic oligonucleotide; GAGAAT chr2 60495136 60495155 60495139 -
ggaaggctctcttggtgatg

SEQ ID NO: 188033 - DNA, 20 bp, Artificial Sequence
  Synthetic oligonucleotide; TTGGAT chr2 60495131 60495150 60495134 -
gctctcttggtgatggagaa

SEQ ID NO: 188034 - DNA, 20 bp, Artificial Sequence
  Synthetic oligonucleotide; GGGAAT chr2 60495112 60495131 60495115 -
attggattttatttctcaat

SEQ ID NO: 188035 - DNA, 20 bp, Artificial Sequence
  Synthetic oligonucleotide; TAGGAT chr2 60494944 60494963 60494947 -
tcaggtaccagctactgtgt

SEQ ID NO: 188036 - DNA, 20 bp, Artificial Sequence
  Synthetic oligonucleotide; AGGAAT chr2 60494852 60494871 60494855 -
cttttcttctgacccaaact

SEQ ID NO: 188037 - DNA, 20 bp, Artificial Sequence
  Synthetic oligonucleotide; ACGGAT chr2 60494670 60494689 60494673 -
actattattattcctatttt

SEQ ID NO: 188038 - DNA, 20 bp, Artificial Sequence
  Synthetic oligonucleotide; ATGAGT chr2 60494666 60494685 60494669 -
ttattattcctattttacgg

SEQ ID NO: 188039 - DNA, 20 bp, Artificial Sequence
  Synthetic oligonucleotide; AGGAAT chr2 60494611 60494630 60494614 -
acatttggtgataaatcatt

SEQ ID NO: 188040 - DNA, 20 bp, Artificial Sequence
  Synthetic oligonucleotide; AGGAGT chr2 60494600 60494619 60494603 -
taaatcattaggaatgagct

SEQ ID NO: 188041 - DNA, 20 bp, Artificial Sequence
  Synthetic oligonucleotide; TGGAAT chr2 60494527 60494546 60494530 -
ccaattggagattagggaga

SEQ ID NO: 188042 - DNA, 20 bp, Artificial Sequence
  Synthetic oligonucleotide; TAGGGT chr2 60494410 60494429 60494413 -
gcataagatttataagacat

SEQ ID NO: 188043 - DNA, 20 bp, Artificial Sequence
  Synthetic oligonucleotide; CAGAGT chr2 60494352 60494371 60494355 -
acagaggggcaacccaggtc

SEQ ID NO: 188044 - DNA, 20 bp, Artificial Sequence
  Synthetic oligonucleotide; AAGGAT chr2 60494196 60494215 60494199 -
ttgcttagcctgtgtagctc

SEQ ID NO: 188045 - DNA, 20 bp, Artificial Sequence
  Synthetic oligonucleotide; AAGAAT chr2 60494170 60494189 60494173 -
gtatttattgccctaggcgt

SEQ ID NO: 188046 - DNA, 20 bp, Artificial Sequence
  Synthetic oligonucleotide; AGGGGT chr2 60493922 60493941 60493925 -
ctggaggccctgtctccccc

SEQ ID NO: 188047 - DNA, 20 bp, Artificial Sequence
  Synthetic oligonucleotide; GAGGAT chr2 60493862 60493881 60493865 -
cctgccatggccaagctgat

SEQ ID NO: 188048 - DNA, 20 bp, Artificial Sequence
  Synthetic oligonucleotide; GGGAAT chr2 60493838 60493857 60493841 -
atgggggagggggaggcagg

SEQ ID NO: 188049 - DNA, 20 bp, Artificial Sequence
  Synthetic oligonucleotide; TGGAGT chr2 60493775 60493794 60493778 -
ctgggcagcagctgcctccc

SEQ ID NO: 188050 - DNA, 20 bp, Artificial Sequence
  Synthetic oligonucleotide; CAGAGT chr2 60493605 60493624 60493608 -
cacttaagttatctctgacc

SEQ ID NO: 188051 - DNA, 20 bp, Artificial Sequence
  Synthetic oligonucleotide; ATGAAT chr2 60493576 60493595 60493579 -
atttatttggcctgattcaa

SEQ ID NO: 188052 - DNA, 20 bp, Artificial Sequence
  Synthetic oligonucleotide; AAGAAT chr2 60493561 60493580 60493564 -
ttcaaatgaatgcccatttt

SEQ ID NO: 188053 - DNA, 20 bp, Artificial Sequence
  Synthetic oligonucleotide; TGGGGT chr2 60493551 60493570 60493554 -
tgcccattttaagaatgttt

SEQ ID NO: 188054 - DNA, 20 bp, Artificial Sequence
  Synthetic oligonucleotide; CGGAAT chr2 60493503 60493522 60493506 -
gtagtggagaggtttctatt

SEQ ID NO: 188055 - DNA, 20 bp, Artificial Sequence
  Synthetic oligonucleotide; TAGGAT chr2 60493498 60493517 60493501 -
ggagaggtttctattcggaa

SEQ ID NO: 188056 - DNA, 20 bp, Artificial Sequence
  Synthetic oligonucleotide; TGGGAT chr2 60493462 60493481 60493465 -
agctgagccaaacagatagc

SEQ ID NO: 188057 - DNA, 20 bp, Artificial Sequence
  Synthetic oligonucleotide; TAGGGT chr2 60493455 60493474 60493458 -
ccaaacagatagctgggata

SEQ ID NO: 188058 - DNA, 20 bp, Artificial Sequence
  Synthetic oligonucleotide; TGGAGT chr2 60493448 60493467 60493451 -
gatagctgggatatagggtt

SEQ ID NO: 188059 - DNA, 20 bp, Artificial Sequence
  Synthetic oligonucleotide; GGGAAT chr2 60493431 60493450 60493434 -
gtttggagttgaactctcca

SEQ ID NO: 188060 - DNA, 20 bp, Artificial Sequence
  Synthetic oligonucleotide; TGGGGT chr2 60493426 60493445 60493429 -
gagttgaactctccagggaa

SEQ ID NO: 188061 - DNA, 20 bp, Artificial Sequence
  Synthetic oligonucleotide; GAGGAT chr2 60493403 60493422 60493406 -
ggtgggaggggggcagcctg

SEQ ID NO: 188062 - DNA, 20 bp, Artificial Sequence
  Synthetic oligonucleotide; TTGAAT chr2 60493217 60493236 60493220 -
cccacatggcaaccaatagg

SEQ ID NO: 188063 - DNA, 20 bp, Artificial Sequence
  Synthetic oligonucleotide; ATGGAT chr2 60493213 60493232 60493216 -
catggcaaccaataggttga

SEQ ID NO: 188064 - DNA, 20 bp, Artificial Sequence
  Synthetic oligonucleotide; TGGAAT chr2 60493194 60493213 60493197 -
aatggataaacgccctatgg

SEQ ID NO: 188065 - DNA, 20 bp, Artificial Sequence
  Synthetic oligonucleotide; AAGAAT chr2 60493173 60493192 60493176 -
ggaatacaactcaacagtag

SEQ ID NO: 188066 - DNA, 20 bp, Artificial Sequence
  Synthetic oligonucleotide; AAGAGT chr2 60493165 60493184 60493168 -
actcaacagtagaagaatga

SEQ ID NO: 188067 - DNA, 20 bp, Artificial Sequence
  Synthetic oligonucleotide; ATGGAT chr2 60493144 60493163 60493147 -
agagtaacacactccacacc

SEQ ID NO: 188068 - DNA, 20 bp, Artificial Sequence
  Synthetic oligonucleotide; ATGAAT chr2 60493140 60493159 60493143 -
taacacactccacaccatgg

SEQ ID NO: 188069 - DNA, 20 bp, Artificial Sequence
  Synthetic oligonucleotide; CAGAAT chr2 60493132 60493151 60493135 -
tccacaccatggatgaatcc

SEQ ID NO: 188070 - DNA, 20 bp, Artificial Sequence
  Synthetic oligonucleotide; ATGAGT chr2 60493080 60493099 60493083 -
cacaaaagacgatatcctgt

SEQ ID NO: 188071 - DNA, 20 bp, Artificial Sequence
  Synthetic oligonucleotide; TAGAAT chr2 60493057 60493076 60493060 -
agtccatttgtaacaaattc

SEQ ID NO: 188072 - DNA, 20 bp, Artificial Sequence
  Synthetic oligonucleotide; GGGGGT chr2 60493029 60493048 60493032 -
tcaacactgtggtggtaggt

SEQ ID NO: 188073 - DNA, 20 bp, Artificial Sequence
  Synthetic oligonucleotide; AGGGGT chr2 60493007 60493026 60493010 -
gggttcagtggttagaagga

SEQ ID NO: 188074 - DNA, 20 bp, Artificial Sequence
  Synthetic oligonucleotide; GAGGGT chr2 60492999 60493018 60493002 -
tggttagaaggaaggggtca

SEQ ID NO: 188075 - DNA, 20 bp, Artificial Sequence
  Synthetic oligonucleotide; GGGGAT chr2 60492986 60493005 60492989 -
ggggtcagagggttagggaa

SEQ ID NO: 188076 - DNA, 20 bp, Artificial Sequence
  Synthetic oligonucleotide; TTGAAT chr2 60492884 60492903 60492887 -
agctgtatacaactggcaaa

SEQ ID NO: 188077 - DNA, 20 bp, Artificial Sequence
  Synthetic oligonucleotide; ATGAAT chr2 60492861 60492880 60492864 -
aatccaactgtacacttaaa

SEQ ID NO: 188078 - DNA, 20 bp, Artificial Sequence
  Synthetic oligonucleotide; TGGAGT chr2 60492789 60492808 60492792 -
caaaacaaaacacccaccac

SEQ ID NO: 188079 - DNA, 20 bp, Artificial Sequence
  Synthetic oligonucleotide; TTGGGT chr2 60492752 60492771 60492755 -
tgtctgtaacctttaactgt

SEQ ID NO: 188080 - DNA, 20 bp, Artificial Sequence
  Synthetic oligonucleotide; CAGGGT chr2 60492722 60492741 60492725 -
tcaagactctagccgtcttt

SEQ ID NO: 188081 - DNA, 20 bp, Artificial Sequence
  Synthetic oligonucleotide; GAGAAT chr2 60492690 60492709 60492693 -
aaagtacatttcagggaaat

SEQ ID NO: 188082 - DNA, 20 bp, Artificial Sequence
  Synthetic oligonucleotide; TGGGGT chr2 60492601 60492620 60492604 -
gagagggaggcccactgaga

SEQ ID NO: 188083 - DNA, 20 bp, Artificial Sequence
  Synthetic oligonucleotide; TTGGGT chr2 60492574 60492593 60492577 -
atccaccataagcagagcat

SEQ ID NO: 188084 - DNA, 20 bp, Artificial Sequence
  Synthetic oligonucleotide; ATGAGT chr2 60492557 60492576 60492560 -
catttgggtctgagaagcgc

SEQ ID NO: 188085 - DNA, 20 bp, Artificial Sequence
  Synthetic oligonucleotide; GTGAGT chr2 60492547 60492566 60492550 -
tgagaagcgcatgagtactg

SEQ ID NO: 188086 - DNA, 20 bp, Artificial Sequence
  Synthetic oligonucleotide; TAGAAT chr2 60492500 60492519 60492503 -
ggggaggaaatctgttttcc

SEQ ID NO: 188087 - DNA, 20 bp, Artificial Sequence
  Synthetic oligonucleotide; GGGAGT chr2 60492464 60492483 60492467 -
ttcaaaaagtaaaaagggga

SEQ ID NO: 188088 - DNA, 20 bp, Artificial Sequence
  Synthetic oligonucleotide; CAGGGT chr2 60492363 60492382 60492366 -
ttgtttgtttgtttttgaga

SEQ ID NO: 188089 - DNA, 20 bp, Artificial Sequence
  Synthetic oligonucleotide; TAGAGT chr2 60492338 60492357 60492341 -
tctcgctgtgttgcctaggc

SEQ ID NO: 188090 - DNA, 20 bp, Artificial Sequence
  Synthetic oligonucleotide; CTGAGT chr2 60492262 60492281 60492265 -
catcctgtcacctcagcctc

SEQ ID NO: 188091 - DNA, 20 bp, Artificial Sequence
  Synthetic oligonucleotide; TGGAGT chr2 60492207 60492226 60492210 -
cctggctaattttgtagaga

SEQ ID NO: 188092 - DNA, 20 bp, Artificial Sequence
  Synthetic oligonucleotide; TGGGAT chr2 60492128 60492147 60492131 -
gccttgacctcccaaagtgc

SEQ ID NO: 188093 - DNA, 20 bp, Artificial Sequence
  Synthetic oligonucleotide; CTGAAT chr2 60492025 60492044 60492028 -
acaatgtagcatctcctgtg

SEQ ID NO: 188094 - DNA, 20 bp, Artificial Sequence
  Synthetic oligonucleotide; GAGGGT chr2 60492008 60492027 60492011 -
gtgctgaattcctgtaaagt

SEQ ID NO: 188095 - DNA, 20 bp, Artificial Sequence
  Synthetic oligonucleotide; TTGGGT chr2 60491875 60491894 60491878 -
actgccttttctgaacctat

SEQ ID NO: 188096 - DNA, 20 bp, Artificial Sequence
  Synthetic oligonucleotide; ATGGAT chr2 60491857 60491876 60491860 -
atttgggtgctaaggactgt

SEQ ID NO: 188097 - DNA, 20 bp, Artificial Sequence
  Synthetic oligonucleotide; TTGGGT chr2 60491851 60491870 60491854 -
gtgctaaggactgtatggat

SEQ ID NO: 188098 - DNA, 20 bp, Artificial Sequence
  Synthetic oligonucleotide; TTGGGT chr2 60491811 60491830 60491814 -
acgtctgtgcctgcgtagtg

SEQ ID NO: 188099 - DNA, 20 bp, Artificial Sequence
  Synthetic oligonucleotide; CGGAGT chr2 60491779 60491798 60491782 -
tggccacttggctctcaaca

SEQ ID NO: 188100 - DNA, 20 bp, Artificial Sequence
  Synthetic oligonucleotide; TAGGGT chr2 60491764 60491783 60491767 -
caacacggagtgatgatgcc

SEQ ID NO: 188101 - DNA, 20 bp, Artificial Sequence
  Synthetic oligonucleotide; TGGAAT chr2 60491642 60491661 60491645 -
tttactcttgttgcccgggc

SEQ ID NO: 188102 - DNA, 20 bp, Artificial Sequence
  Synthetic oligonucleotide; CCGAGT chr2 60491567 60491586 60491570 -
cgatctcctgcctcagcctc

SEQ ID NO: 188103 - DNA, 20 bp, Artificial Sequence
  Synthetic oligonucleotide; CGGGGT chr2 60491503 60491522 60491506 -
ttttgtatttttagtagaga

SEQ ID NO: 188104 - DNA, 20 bp, Artificial Sequence
  Synthetic oligonucleotide; TGGGAT chr2 60491424 60491443 60491427 -
gccccggcctcccaaagtgc

SEQ ID NO: 188105 - DNA, 20 bp, Artificial Sequence
  Synthetic oligonucleotide; AAGAAT chr2 60491255 60491274 60491258 -
gctgcatttaaaacagcatt

SEQ ID NO: 188106 - DNA, 20 bp, Artificial Sequence
  Synthetic oligonucleotide; GAGGAT chr2 60491221 60491240 60491224 -
agaacttagctttttgcatt

SEQ ID NO: 188107 - DNA, 20 bp, Artificial Sequence
  Synthetic oligonucleotide; TAGAGT chr2 60491160 60491179 60491163 -
ccatggttgaaagtcagcta

SEQ ID NO: 188108 - DNA, 20 bp, Artificial Sequence
  Synthetic oligonucleotide; CAGGGT chr2 60491032 60491051 60491035 -
acttcacatttgctcttctc

SEQ ID NO: 188109 - DNA, 20 bp, Artificial Sequence
  Synthetic oligonucleotide; TGGGGT chr2 60491025 60491044 60491028 -
atttgctcttctccagggtg

SEQ ID NO: 188110 - DNA, 20 bp, Artificial Sequence
  Synthetic oligonucleotide; GAGGGT chr2 60491008 60491027 60491011 -
gtgtggggtggctgtttaaa

SEQ ID NO: 188111 - DNA, 20 bp, Artificial Sequence
  Synthetic oligonucleotide; GTGGAT chr2 60491004 60491023 60491007 -
ggggtggctgtttaaagagg

SEQ ID NO: 188112 - DNA, 20 bp, Artificial Sequence
  Synthetic oligonucleotide; GTGGGT chr2 60490903 60490922 60490906 -
atatcagaagggaaatgttt

SEQ ID NO: 188113 - DNA, 20 bp, Artificial Sequence
  Synthetic oligonucleotide; TTGAAT chr2 60490801 60490820 60490804 -
agtcatttatatgctatttg

SEQ ID NO: 188114 - DNA, 20 bp, Artificial Sequence
  Synthetic oligonucleotide; TAGAAT chr2 60490792 60490811 60490795 -
tatgctatttgttgaattcc

SEQ ID NO: 188115 - DNA, 20 bp, Artificial Sequence
  Synthetic oligonucleotide; ATGAAT chr2 60490784 60490803 60490787 -
ttgttgaattcctagaatat

SEQ ID NO: 188116 - DNA, 20 bp, Artificial Sequence
  Synthetic oligonucleotide; AAGAGT chr2 60490724 60490743 60490727 -
taatagaagcaagtaggaga

SEQ ID NO: 188117 - DNA, 20 bp, Artificial Sequence
  Synthetic oligonucleotide; GAGGGT chr2 60490667 60490686 60490670 -
tgaaattaattagaggcata

SEQ ID NO: 188118 - DNA, 20 bp, Artificial Sequence
  Synthetic oligonucleotide; ATGAGT chr2 60490637 60490656 60490640 -
cagcaatgtaaggcctagat

SEQ ID NO: 188119 - DNA, 20 bp, Artificial Sequence
  Synthetic oligonucleotide; GGGAGT chr2 60490629 60490648 60490632 -
taaggcctagatatgagtca

SEQ ID NO: 188120 - DNA, 20 bp, Artificial Sequence
  Synthetic oligonucleotide; TGGGAT chr2 60490617 60490636 60490620 -
atgagtcagggagtggtgca

SEQ ID NO: 188121 - DNA, 20 bp, Artificial Sequence
  Synthetic oligonucleotide; ATGAGT chr2 60490613 60490632 60490616 -
gtcagggagtggtgcatggg

SEQ ID NO: 188122 - DNA, 20 bp, Artificial Sequence
  Synthetic oligonucleotide; AAGGAT chr2 60490590 60490609 60490593 -
agtgttctatgaggttggag

SEQ ID NO: 188123 - DNA, 20 bp, Artificial Sequence
  Synthetic oligonucleotide; CAGGAT chr2 60490523 60490542 60490526 -
ttgaggccttgaagtatgag

SEQ ID NO: 188124 - DNA, 20 bp, Artificial Sequence
  Synthetic oligonucleotide; AGGGAT chr2 60490466 60490485 60490469 -
aggaaggaaatgagaacgga

SEQ ID NO: 188125 - DNA, 20 bp, Artificial Sequence
  Synthetic oligonucleotide; CAGAAT chr2 60490449 60490468 60490452 -
ggaagggatttttacttggg

SEQ ID NO: 188126 - DNA, 20 bp, Artificial Sequence
  Synthetic oligonucleotide; ATGGGT chr2 60490433 60490452 60490436 -
tgggcagaatattttccttg

SEQ ID NO: 188127 - DNA, 20 bp, Artificial Sequence
  Synthetic oligonucleotide; TGGAAT chr2 60490412 60490431 60490415 -
tgggtacggggaactaagac

SEQ ID NO: 188128 - DNA, 20 bp, Artificial Sequence
  Synthetic oligonucleotide; TGGAGT chr2 60490399 60490418 60490402 -
ctaagactggaatagaaaat

SEQ ID NO: 188129 - DNA, 20 bp, Artificial Sequence
  Synthetic oligonucleotide; TTGGAT chr2 60490394 60490413 60490397 -
actggaatagaaaattggag

SEQ ID NO: 188130 - DNA, 20 bp, Artificial Sequence
  Synthetic oligonucleotide; TGGAAT chr2 60490378 60490397 60490381 -
ggagttggattgtggagctc

SEQ ID NO: 188131 - DNA, 20 bp, Artificial Sequence
  Synthetic oligonucleotide; AGGAGT chr2 60490363 60490382 60490366 -
agctctggaatgatggctta

SEQ ID NO: 188132 - DNA, 20 bp, Artificial Sequence
  Synthetic oligonucleotide; GGGGAT chr2 60490288 60490307 60490291 -
aagacaaaggcagcatgcta

SEQ ID NO: 188133 - DNA, 20 bp, Artificial Sequence
  Synthetic oligonucleotide; GGGGGT chr2 60490261 60490280 60490264 -
ttaagtgaggactctgcaaa

SEQ ID NO: 188134 - DNA, 20 bp, Artificial Sequence
  Synthetic oligonucleotide; GTGGAT chr2 60490257 60490276 60490260 -
gtgaggactctgcaaagggg

SEQ ID NO: 188135 - DNA, 20 bp, Artificial Sequence
  Synthetic oligonucleotide; ATGAGT chr2 60490253 60490272 60490256 -
ggactctgcaaagggggtgg

SEQ ID NO: 188136 - DNA, 20 bp, Artificial Sequence
  Synthetic oligonucleotide; CCGAGT chr2 60490218 60490237 60490221 -
tctctgttatacccttcatg

SEQ ID NO: 188137 - DNA, 20 bp, Artificial Sequence
  Synthetic oligonucleotide; GAGGAT chr2 60490186 60490205 60490189 -
ctgttgacttatatgttcta

SEQ ID NO: 188138 - DNA, 20 bp, Artificial Sequence
  Synthetic oligonucleotide; TGGAGT chr2 60490181 60490200 60490184 -
gacttatatgttctagagga

SEQ ID NO: 188139 - DNA, 20 bp, Artificial Sequence
  Synthetic oligonucleotide; TAGGGT chr2 60490165 60490184 60490168 -
aggatggagttggttgaccg

SEQ ID NO: 188140 - DNA, 20 bp, Artificial Sequence
  Synthetic oligonucleotide; CAGAAT chr2 60490146 60490165 60490149 -
gtagggtttcctttcactag

SEQ ID NO: 188141 - DNA, 20 bp, Artificial Sequence
  Synthetic oligonucleotide; ATGGGT chr2 60490112 60490131 60490115 -
atattgtaggagcctagcac

SEQ ID NO: 188142 - DNA, 20 bp, Artificial Sequence
  Synthetic oligonucleotide; GGGAGT chr2 60490036 60490055 60490039 -
ctttgcccccattgcagatg

SEQ ID NO: 188143 - DNA, 20 bp, Artificial Sequence
  Synthetic oligonucleotide; AGGAAT chr2 60490026 60490045 60490029 -
attgcagatggggagtgggc

SEQ ID NO: 188144 - DNA, 20 bp, Artificial Sequence
  Synthetic oligonucleotide; CAGAAT chr2 60490014 60490033 60490017 -
gagtgggcaggaatgacgtt

SEQ ID NO: 188145 - DNA, 20 bp, Artificial Sequence
  Synthetic oligonucleotide; CAGGGT chr2 60489997 60490016 60490000 -
gttcagaatcaagggcccat

SEQ ID NO: 188146 - DNA, 20 bp, Artificial Sequence
  Synthetic oligonucleotide; TGGGAT chr2 60489950 60489969 60489953 -
ctcctccagtccatccatgt

SEQ ID NO: 188147 - DNA, 20 bp, Artificial Sequence
  Synthetic oligonucleotide; ATGGAT chr2 60489935 60489954 60489938 -
catgttgggatactcagggc

SEQ ID NO: 188148 - DNA, 20 bp, Artificial Sequence
  Synthetic oligonucleotide; GGGGGT chr2 60489824 60489843 60489827 -
taatagtgtcctcctgcttt

SEQ ID NO: 188149 - DNA, 20 bp, Artificial Sequence
  Synthetic oligonucleotide; TTGAGT chr2 60489800 60489819 60489803 -
gttattaagctagcctgaac

SEQ ID NO: 188150 - DNA, 20 bp, Artificial Sequence
  Synthetic oligonucleotide; TTGGAT chr2 60489786 60489805 60489789 -
ctgaacttgagtaaacattt

SEQ ID NO: 188151 - DNA, 20 bp, Artificial Sequence
  Synthetic oligonucleotide; TGGGGT chr2 60489781 60489800 60489784 -
cttgagtaaacatttttgga

SEQ ID NO: 188152 - DNA, 20 bp, Artificial Sequence
  Synthetic oligonucleotide; CAGAGT chr2 60489666 60489685 60489669 -
aagcagagatgctagtgacc

SEQ ID NO: 188153 - DNA, 20 bp, Artificial Sequence
  Synthetic oligonucleotide; TAGAAT chr2 60489635 60489654 60489638 -
agaggggaaagaacctctgt

SEQ ID NO: 188154 - DNA, 20 bp, Artificial Sequence
  Synthetic oligonucleotide; CAGAAT chr2 60489577 60489596 60489580 -
caggtgcttcctcttctact

SEQ ID NO: 188155 - DNA, 20 bp, Artificial Sequence
  Synthetic oligonucleotide; CTGGAT chr2 60489491 60489510 60489494 -
cagtgtggctgtttgtcatc

SEQ ID NO: 188156 - DNA, 20 bp, Artificial Sequence
  Synthetic oligonucleotide; CAGAGT chr2 60489363 60489382 60489366 -
ggcagaaattagttaggaag

SEQ ID NO: 188157 - DNA, 20 bp, Artificial Sequence
  Synthetic oligonucleotide; CTGGGT chr2 60489353 60489372 60489356 -
agttaggaagcagagtagca

SEQ ID NO: 188158 - DNA, 20 bp, Artificial Sequence
  Synthetic oligonucleotide; ATGAAT chr2 60489329 60489348 60489332 -
gttccaaatgcctctattgt

SEQ ID NO: 188159 - DNA, 20 bp, Artificial Sequence
  Synthetic oligonucleotide; TTGGAT chr2 60489323 60489342 60489326 -
aatgcctctattgtatgaat

SEQ ID NO: 188160 - DNA, 20 bp, Artificial Sequence
  Synthetic oligonucleotide; TGGAAT chr2 60489288 60489307 60489291 -
gcaaaatgacataaaagaaa

SEQ ID NO: 188161 - DNA, 20 bp, Artificial Sequence
  Synthetic oligonucleotide; GTGAAT chr2 60489213 60489232 60489216 -
tgttgactggctctcacagt

SEQ ID NO: 188162 - DNA, 20 bp, Artificial Sequence
  Synthetic oligonucleotide; TGGGGT chr2 60489154 60489173 60489157 -
ctctaaagcaacagtttaat

SEQ ID NO: 188163 - DNA, 20 bp, Artificial Sequence
  Synthetic oligonucleotide; TTGGGT chr2 60489068 60489087 60489071 -
tctttgaagataaatttgtt

SEQ ID NO: 188164 - DNA, 20 bp, Artificial Sequence
  Synthetic oligonucleotide; CTGGGT chr2 60489058 60489077 60489061 -
taaatttgttttgggtatgg

SEQ ID NO: 188165 - DNA, 20 bp, Artificial Sequence
  Synthetic oligonucleotide; GTGGGT chr2 60489009 60489028 60489012 -
cagcactttgggaggctgag

SEQ ID NO: 188166 - DNA, 20 bp, Artificial Sequence
  Synthetic oligonucleotide; GTGGAT chr2 60489005 60489024 60489008 -
actttgggaggctgaggtgg

SEQ ID NO: 188167 - DNA, 20 bp, Artificial Sequence
  Synthetic oligonucleotide; GGGAGT chr2 60488988 60489007 60488991 -
tgggtggatcacctaaggtc

SEQ ID NO: 188168 - DNA, 20 bp, Artificial Sequence
  Synthetic oligonucleotide; GAGAAT chr2 60488870 60488889 60488873 -
tacttgggaggctgaggcag

SEQ ID NO: 188169 - DNA, 20 bp, Artificial Sequence
  Synthetic oligonucleotide; TTGGGT chr2 60488731 60488750 60488734 -
aacaaacaaacaaaatcgtt

SEQ ID NO: 188170 - DNA, 20 bp, Artificial Sequence
  Synthetic oligonucleotide; TTGGAT chr2 60488704 60488723 60488707 -
gcagtggctttaggctgttt

SEQ ID NO: 188171 - DNA, 20 bp, Artificial Sequence
  Synthetic oligonucleotide; CCGAAT chr2 60488628 60488647 60488631 -
agcaaaactagaaagtttta

SEQ ID NO: 188172 - DNA, 20 bp, Artificial Sequence
  Synthetic oligonucleotide; CAGGGT chr2 60488561 60488580 60488564 -
caaactatttacagccataa

SEQ ID NO: 188173 - DNA, 20 bp, Artificial Sequence
  Synthetic oligonucleotide; GTGAAT chr2 60488550 60488569 60488553 -
cagccataacagggtttcca

SEQ ID NO: 188174 - DNA, 20 bp, Artificial Sequence
  Synthetic oligonucleotide; CTGAGT chr2 60488531 60488550 60488534 -
agtgaattgtataagtagca

SEQ ID NO: 188175 - DNA, 20 bp, Artificial Sequence
  Synthetic oligonucleotide; CTGGAT chr2 60488367 60488386 60488370 -
taaatgctgtcaaattgtaa

SEQ ID NO: 188176 - DNA, 20 bp, Artificial Sequence
  Synthetic oligonucleotide; CTGAAT chr2 60488274 60488293 60488277 -
cttcttccccctctcacagt

SEQ ID NO: 188177 - DNA, 20 bp, Artificial Sequence
  Synthetic oligonucleotide; CAGGAT chr2 60488131 60488150 60488134 -
gcccgtgagacaaactcttc

SEQ ID NO: 188178 - DNA, 20 bp, Artificial Sequence
  Synthetic oligonucleotide; GAGAAT chr2 60488103 60488122 60488106 -
tttaaatgtttctacataat

SEQ ID NO: 188179 - DNA, 20 bp, Artificial Sequence
  Synthetic oligonucleotide; AGGGAT chr2 60488042 60488061 60488045 -
tcaaaagtaatagcacagag

SEQ ID NO: 188180 - DNA, 20 bp, Artificial Sequence
  Synthetic oligonucleotide; TAGAGT chr2 60487971 60487990 60487974 -
tttagatgagggctccattc

SEQ ID NO: 188181 - DNA, 20 bp, Artificial Sequence
  Synthetic oligonucleotide; TGGAGT chr2 60487916 60487935 60487919 -
ggcagatgttatcagggagc

SEQ ID NO: 188182 - DNA, 20 bp, Artificial Sequence
  Synthetic oligonucleotide; TGGAGT chr2 60487910 60487929 60487913 -
tgttatcagggagctggagt

SEQ ID NO: 188183 - DNA, 20 bp, Artificial Sequence
  Synthetic oligonucleotide; TAGAAT chr2 60487778 60487797 60487781 -
ctttctgcagcttccttaga

SEQ ID NO: 188184 - DNA, 20 bp, Artificial Sequence
  Synthetic oligonucleotide; GGGAGT chr2 60487704 60487723 60487707 -
attctgctgctcataaataa

SEQ ID NO: 188185 - DNA, 20 bp, Artificial Sequence
  Synthetic oligonucleotide; GAGAAT chr2 60487649 60487668 60487652 -
aaaggctggtgtggttgcca

SEQ ID NO: 188186 - DNA, 20 bp, Artificial Sequence
  Synthetic oligonucleotide; GGGGAT chr2 60487629 60487648 60487632 -
gagaatagggctaacttaag

SEQ ID NO: 188187 - DNA, 20 bp, Artificial Sequence
  Synthetic oligonucleotide; CTGGAT chr2 60487579 60487598 60487582 -
tttttttgttttgttttgtt

SEQ ID NO: 188188 - DNA, 20 bp, Artificial Sequence
  Synthetic oligonucleotide; CTGAAT chr2 60487541 60487560 60487544 -
tcatttagttttcccttaat

SEQ ID NO: 188189 - DNA, 20 bp, Artificial Sequence
  Synthetic oligonucleotide; AAGGAT chr2 60487474 60487493 60487477 -
tattatttatagccctccag

SEQ ID NO: 188190 - DNA, 20 bp, Artificial Sequence
  Synthetic oligonucleotide; CTGAAT chr2 60487376 60487395 60487379 -
ccactacactgctccccctg

SEQ ID NO: 188191 - DNA, 20 bp, Artificial Sequence
  Synthetic oligonucleotide; TGGGGT chr2 60487339 60487358 60487342 -
actctcggtgtgtggcattg

SEQ ID NO: 188192 - DNA, 20 bp, Artificial Sequence
  Synthetic oligonucleotide; GGGAGT chr2 60487240 60487259 60487243 -
gacttgcaaaatataggtta

SEQ ID NO: 188193 - DNA, 20 bp, Artificial Sequence
  Synthetic oligonucleotide; TAGGAT chr2 60487230 60487249 60487233 -
atataggttagggagtttta

SEQ ID NO: 188194 - DNA, 20 bp, Artificial Sequence
  Synthetic oligonucleotide; ATGGGT chr2 60487163 60487182 60487166 -
tacattaactagatcattac

SEQ ID NO: 188195 - DNA, 20 bp, Artificial Sequence
  Synthetic oligonucleotide; AGGGGT chr2 60487133 60487152 60487136 -
ggttagaacttcacacactt

SEQ ID NO: 188196 - DNA, 20 bp, Artificial Sequence
  Synthetic oligonucleotide; CTGAAT chr2 60487042 60487061 60487045 -
tgtctagcgctcctaaatgc

SEQ ID NO: 188197 - DNA, 20 bp, Artificial Sequence
  Synthetic oligonucleotide; TTGAAT chr2 60486997 60487016 60487000 -
gaggggcatttgccttcgct

SEQ ID NO: 188198 - DNA, 20 bp, Artificial Sequence
  Synthetic oligonucleotide; CCGAGT chr2 60486988 60487007 60486991 -
ttgccttcgctttgaatctc

SEQ ID NO: 188199 - DNA, 20 bp, Artificial Sequence
  Synthetic oligonucleotide; TAGAAT chr2 60486968 60486987 60486971 -
ccgagtcttttttattctga

SEQ ID NO: 188200 - DNA, 20 bp, Artificial Sequence
  Synthetic oligonucleotide; CAGAGT chr2 60486854 60486873 60486857 -
ccatggccaggtttgagaga

SEQ ID NO: 188201 - DNA, 20 bp, Artificial Sequence
  Synthetic oligonucleotide; CAGGGT chr2 60486830 60486849 60486833 -
gtgattcgcagtagtcttcc

SEQ ID NO: 188202 - DNA, 20 bp, Artificial Sequence
  Synthetic oligonucleotide; TTGAGT chr2 60486823 60486842 60486826 -
gcagtagtcttcccagggtg

SEQ ID NO: 188203 - DNA, 20 bp, Artificial Sequence
  Synthetic oligonucleotide; AGGGAT chr2 60486799 60486818 60486802 -
gtgggaacgtctccctggga

SEQ ID NO: 188204 - DNA, 20 bp, Artificial Sequence
  Synthetic oligonucleotide; TTGAGT chr2 60486683 60486702 60486686 -
tttcaggcccaatcctgatg

SEQ ID NO: 188205 - DNA, 20 bp, Artificial Sequence
  Synthetic oligonucleotide; GAGGAT chr2 60486595 60486614 60486598 -
cattattcatctcaaagcca

SEQ ID NO: 188206 - DNA, 20 bp, Artificial Sequence
  Synthetic oligonucleotide; GTGGAT chr2 60486562 60486581 60486565 -
ccatcacagggctgtggtct

SEQ ID NO: 188207 - DNA, 20 bp, Artificial Sequence
  Synthetic oligonucleotide; TTGAAT chr2 60486436 60486455 60486439 -
tgtgcctaagtatagttttc

SEQ ID NO: 188208 - DNA, 20 bp, Artificial Sequence
  Synthetic oligonucleotide; TAGAAT chr2 60486383 60486402 60486386 -
atgtgcagaaagtgaactct

SEQ ID NO: 188209 - DNA, 20 bp, Artificial Sequence
  Synthetic oligonucleotide; TAGGAT chr2 60486177 60486196 60486180 -
atccccagtaccagtctccc

SEQ ID NO: 188210 - DNA, 20 bp, Artificial Sequence
  Synthetic oligonucleotide; CAGAAT chr2 60486134 60486153 60486137 -
ctgttcagtcaaatccattt

SEQ ID NO: 188211 - DNA, 20 bp, Artificial Sequence
  Synthetic oligonucleotide; TTGGGT chr2 60486065 60486084 60486068 -
gaacaaggggcttggagatt

SEQ ID NO: 188212 - DNA, 20 bp, Artificial Sequence
  Synthetic oligonucleotide; GAGAAT chr2 60485908 60485927 60485911 -
tcagccttcttgttgaaaat

SEQ ID NO: 188213 - DNA, 20 bp, Artificial Sequence
  Synthetic oligonucleotide; TGGGAT chr2 60485862 60485881 60485865 -
ttccaagagctatctggtga

SEQ ID NO: 188214 - DNA, 20 bp, Artificial Sequence
  Synthetic oligonucleotide; TGGAAT chr2 60485825 60485844 60485828 -
agggctacttctgggggacc

SEQ ID NO: 188215 - DNA, 20 bp, Artificial Sequence
  Synthetic oligonucleotide; CTGGGT chr2 60485786 60485805 60485789 -
ttgggaaacacttgccttct

SEQ ID NO: 188216 - DNA, 20 bp, Artificial Sequence
  Synthetic oligonucleotide; CCGAGT chr2 60485719 60485738 60485722 -
atagactgtgtttgacagtc

SEQ ID NO: 188217 - DNA, 20 bp, Artificial Sequence
  Synthetic oligonucleotide; CAGAAT chr2 60485689 60485708 60485692 -
ggcaacttcacttctcaccc

SEQ ID NO: 188218 - DNA, 20 bp, Artificial Sequence
  Synthetic oligonucleotide; TTGGAT chr2 60485609 60485628 60485612 -
tattcagcagcttcgtgacg

SEQ ID NO: 188219 - DNA, 20 bp, Artificial Sequence
  Synthetic oligonucleotide; GAGGGT chr2 60485602 60485621 60485605 -
cagcttcgtgacgttggatg

SEQ ID NO: 188220 - DNA, 20 bp, Artificial Sequence
  Synthetic oligonucleotide; ATGAGT chr2 60485584 60485603 60485587 -
tggagggtttttctttttaa

SEQ ID NO: 188221 - DNA, 20 bp, Artificial Sequence
  Synthetic oligonucleotide; TAGAAT chr2 60485516 60485535 60485519 -
gtttatttttcccttatagg

SEQ ID NO: 188222 - DNA, 20 bp, Artificial Sequence
  Synthetic oligonucleotide; AAGAGT chr2 60485506 60485525 60485509 -
cccttataggtagaatataa

SEQ ID NO: 188223 - DNA, 20 bp, Artificial Sequence
  Synthetic oligonucleotide; TGGGGT chr2 60485499 60485518 60485502 -
aggtagaatataaaagagta

SEQ ID NO: 188224 - DNA, 20 bp, Artificial Sequence
  Synthetic oligonucleotide; TGGAGT chr2 60485325 60485344 60485328 -
gctatccttggcattcttgc

SEQ ID NO: 188225 - DNA, 20 bp, Artificial Sequence
  Synthetic oligonucleotide; CTGGAT chr2 60485200 60485219 60485203 -
ggccagacttccattacact

SEQ ID NO: 188226 - DNA, 20 bp, Artificial Sequence
  Synthetic oligonucleotide; AGGGAT chr2 60485095 60485114 60485098 -
cttgcgaaattgtggctgca

SEQ ID NO: 188227 - DNA, 20 bp, Artificial Sequence
  Synthetic oligonucleotide; GAGGGT chr2 60485051 60485070 60485054 -
tatgccttggtggtggtggt

SEQ ID NO: 188228 - DNA, 20 bp, Artificial Sequence
  Synthetic oligonucleotide; GAGGAT chr2 60484943 60484962 60484946 -
agtcctaaacaagtgccaca

SEQ ID NO: 188229 - DNA, 20 bp, Artificial Sequence
  Synthetic oligonucleotide; GAGAAT chr2 60484809 60484828 60484812 -
ataatgaggtgttcctaagt

SEQ ID NO: 188230 - DNA, 20 bp, Artificial Sequence
  Synthetic oligonucleotide; TGGAAT chr2 60484780 60484799 60484783 -
cataatttgaggttttatac

SEQ ID NO: 188231 - DNA, 20 bp, Artificial Sequence
  Synthetic oligonucleotide; TCGAGT chr2 60484733 60484752 60484736 -
cagcccatgtgcattttttc

SEQ ID NO: 188232 - DNA, 20 bp, Artificial Sequence
  Synthetic oligonucleotide; GAGAGT chr2 60484554 60484573 60484557 -
tatttaaaaggcagggaggg

SEQ ID NO: 188233 - DNA, 20 bp, Artificial Sequence
  Synthetic oligonucleotide; GTGAAT chr2 60484476 60484495 60484479 -
aaaacctacttccctttctg

SEQ ID NO: 188234 - DNA, 20 bp, Artificial Sequence
  Synthetic oligonucleotide; GAGGGT chr2 60484324 60484343 60484327 -
agagaggaggcagggggaga

SEQ ID NO: 188235 - DNA, 20 bp, Artificial Sequence
  Synthetic oligonucleotide; TGGAAT chr2 60484318 60484337 60484321 -
gaggcagggggagagagggt

SEQ ID NO: 188236 - DNA, 20 bp, Artificial Sequence
  Synthetic oligonucleotide; CTGAAT chr2 60484297 60484316 60484300 -
ggaattcgagctattttcag

SEQ ID NO: 188237 - DNA, 20 bp, Artificial Sequence
  Synthetic oligonucleotide; GTGAGT chr2 60484291 60484310 60484294 -
cgagctattttcagctgaat

SEQ ID NO: 188238 - DNA, 20 bp, Artificial Sequence
  Synthetic oligonucleotide; CAGAGT chr2 60484181 60484200 60484184 -
actgcattttctgacactgt

SEQ ID NO: 188239 - DNA, 20 bp, Artificial Sequence
  Synthetic oligonucleotide; TAGAGT chr2 60484039 60484058 60484042 -
ttaacagaggagctctaaat

SEQ ID NO: 188240 - DNA, 20 bp, Artificial Sequence
  Synthetic oligonucleotide; GCGAGT chr2 60483774 60483793 60483777 -
tcctccttctagtgctttgg

SEQ ID NO: 188241 - DNA, 20 bp, Artificial Sequence
  Synthetic oligonucleotide; TTGAGT chr2 60483622 60483641 60483625 -
ctggggacgagcatcctctc

SEQ ID NO: 188242 - DNA, 20 bp, Artificial Sequence
  Synthetic oligonucleotide; CAGGGT chr2 60483591 60483610 60483594 -
ctgacaactgcagcattcca

SEQ ID NO: 188243 - DNA, 20 bp, Artificial Sequence
  Synthetic oligonucleotide; CTGAGT chr2 60483585 60483604 60483588 -
actgcagcattccacagggt

SEQ ID NO: 188244 - DNA, 20 bp, Artificial Sequence
  Synthetic oligonucleotide; TTGGGT chr2 60483515 60483534 60483518 -
tgacatagacagcagttgat

SEQ ID NO: 188245 - DNA, 20 bp, Artificial Sequence
  Synthetic oligonucleotide; AGGGAT chr2 60483399 60483418 60483402 -
caagtcttctgaccttggcc

SEQ ID NO: 188246 - DNA, 20 bp, Artificial Sequence
  Synthetic oligonucleotide; GGGAAT chr2 60483378 60483397 60483381 -
gggatctttgcactgggcag

SEQ ID NO: 188247 - DNA, 20 bp, Artificial Sequence
  Synthetic oligonucleotide; TTGAGT chr2 60483372 60483391 60483375 -
tttgcactgggcaggggaat

SEQ ID NO: 188248 - DNA, 20 bp, Artificial Sequence
  Synthetic oligonucleotide; CTGAAT chr2 60483327 60483346 60483330 -
ttaaaccacttttcaaaggc

SEQ ID NO: 188249 - DNA, 20 bp, Artificial Sequence
  Synthetic oligonucleotide; CGGGAT chr2 60483257 60483276 60483260 -
tcaagaccatttctctacca

SEQ ID NO: 188250 - DNA, 20 bp, Artificial Sequence
  Synthetic oligonucleotide; TTGGAT chr2 60482861 60482880 60482864 -
tgctgcaattatttgtctag

SEQ ID NO: 188251 - DNA, 20 bp, Artificial Sequence
  Synthetic oligonucleotide; CTGAAT chr2 60482787 60482806 60482790 -
gcactgtataatcacatgaa

SEQ ID NO: 188252 - DNA, 20 bp, Artificial Sequence
  Synthetic oligonucleotide; TAGAAT chr2 60482742 60482761 60482745 -
tactaacctgtccttcaaaa

SEQ ID NO: 188253 - DNA, 20 bp, Artificial Sequence
  Synthetic oligonucleotide; TGGGAT chr2 60482675 60482694 60482678 -
caggaagctgatcttaacct

SEQ ID NO: 188254 - DNA, 20 bp, Artificial Sequence
  Synthetic oligonucleotide; CAGGGT chr2 60482657 60482676 60482660 -
cttgggatgcagtgtgcttt

SEQ ID NO: 188255 - DNA, 20 bp, Artificial Sequence
  Synthetic oligonucleotide; TTGGGT chr2 60482652 60482671 60482655 -
gatgcagtgtgctttcaggg

SEQ ID NO: 188256 - DNA, 20 bp, Artificial Sequence
  Synthetic oligonucleotide; TGGAAT chr2 60482610 60482629 60482613 -
gaactttccaagtctgaaaa

SEQ ID NO: 188257 - DNA, 20 bp, Artificial Sequence
  Synthetic oligonucleotide; GTGGAT chr2 60482513 60482532 60482516 -
ctctattcttcttgcttcct

SEQ ID NO: 188258 - DNA, 20 bp, Artificial Sequence
  Synthetic oligonucleotide; CCGGAT chr2 60482358 60482377 60482361 -
tttctcacttttctccagtt

SEQ ID NO: 188259 - DNA, 20 bp, Artificial Sequence
  Synthetic oligonucleotide; TAGAAT chr2 60482163 60482182 60482166 -
accaaactaaactctcaaga

SEQ ID NO: 188260 - DNA, 20 bp, Artificial Sequence
  Synthetic oligonucleotide; GGGAGT chr2 60482080 60482099 60482083 -
acaggtctgcctctcttcct

SEQ ID NO: 188261 - DNA, 20 bp, Artificial Sequence
  Synthetic oligonucleotide; CTGGAT chr2 60482055 60482074 60482058 -
tcagaagtgaccttgatgaa

SEQ ID NO: 188262 - DNA, 20 bp, Artificial Sequence
  Synthetic oligonucleotide; GTGGGT chr2 60481934 60481953 60481937 -
gagaaggtctctatacctag

SEQ ID NO: 188263 - DNA, 20 bp, Artificial Sequence
  Synthetic oligonucleotide; GAGAAT chr2 60481917 60481936 60481920 -
taggtgggtttcctgagctg

SEQ ID NO: 188264 - DNA, 20 bp, Artificial Sequence
  Synthetic oligonucleotide; CAGAAT chr2 60481788 60481807 60481791 -
aaggctctcccaccatcaca

SEQ ID NO: 188265 - DNA, 20 bp, Artificial Sequence
  Synthetic oligonucleotide; TAGGGT chr2 60481778 60481797 60481781 -
caccatcacacagaatgtac

SEQ ID NO: 188266 - DNA, 20 bp, Artificial Sequence
  Synthetic oligonucleotide; CTGAGT chr2 60481715 60481734 60481718 -
gcccttaaaacactggagcc

SEQ ID NO: 188267 - DNA, 20 bp, Artificial Sequence
  Synthetic oligonucleotide; GGGGGT chr2 60481672 60481691 60481675 -
gtggggaaaagaaagatgta

SEQ ID NO: 188268 - DNA, 20 bp, Artificial Sequence
  Synthetic oligonucleotide; CTGGGT chr2 60481516 60481535 60481519 -
ttcacctgccagcttgtggg

SEQ ID NO: 188269 - DNA, 20 bp, Artificial Sequence
  Synthetic oligonucleotide; CTGGGT chr2 60481494 60481513 60481497 -
gggtggcttaagttctagcc

SEQ ID NO: 188270 - DNA, 20 bp, Artificial Sequence
  Synthetic oligonucleotide; GTGGGT chr2 60481450 60481469 60481453 -
agcatgtgtatgtgcttgtg

SEQ ID NO: 188271 - DNA, 20 bp, Artificial Sequence
  Synthetic oligonucleotide; TGGGGT chr2 60481445 60481464 60481448 -
gtgtatgtgcttgtggtggg

SEQ ID NO: 188272 - DNA, 20 bp, Artificial Sequence
  Synthetic oligonucleotide; CTGGGT chr2 60481368 60481387 60481371 -
tgggagacagagagaaggcc

SEQ ID NO: 188273 - DNA, 20 bp, Artificial Sequence
  Synthetic oligonucleotide; CTGAAT chr2 60481361 60481380 60481364 -
cagagagaaggccctgggtt

SEQ ID NO: 188274 - DNA, 20 bp, Artificial Sequence
  Synthetic oligonucleotide; TAGGAT chr2 60481341 60481360 60481344 -
ctgaatgtttttacttttcc

SEQ ID NO: 188275 - DNA, 20 bp, Artificial Sequence
  Synthetic oligonucleotide; AGGAGT chr2 60481313 60481332 60481316 -
ctgcttcatttttgttttca

SEQ ID NO: 188276 - DNA, 20 bp, Artificial Sequence
  Synthetic oligonucleotide; ATGGGT chr2 60481263 60481282 60481266 -
ccagcatgtcccaagcagag

SEQ ID NO: 188277 - DNA, 20 bp, Artificial Sequence
  Synthetic oligonucleotide; GGGAAT chr2 60481247 60481266 60481250 -
agagatgggtggctaggttt

SEQ ID NO: 188278 - DNA, 20 bp, Artificial Sequence
  Synthetic oligonucleotide; TGGGGT chr2 60481242 60481261 60481245 -
tgggtggctaggtttgggaa

SEQ ID NO: 188279 - DNA, 20 bp, Artificial Sequence
  Synthetic oligonucleotide; GGGGAT chr2 60481224 60481243 60481227 -
aatggggtgctgggagggga

SEQ ID NO: 188280 - DNA, 20 bp, Artificial Sequence
  Synthetic oligonucleotide; CAGGAT chr2 60481106 60481125 60481109 -
cggccaccactgggctgtac

SEQ ID NO: 188281 - DNA, 20 bp, Artificial Sequence
  Synthetic oligonucleotide; TTGGGT chr2 60481090 60481109 60481093 -
gtaccaggatctagtgcaac

SEQ ID NO: 188282 - DNA, 20 bp, Artificial Sequence
  Synthetic oligonucleotide; GTGGGT chr2 60481076 60481095 60481079 -
tgcaacttgggtgacaaggt

SEQ ID NO: 188283 - DNA, 20 bp, Artificial Sequence
  Synthetic oligonucleotide; ATGAGT chr2 60480934 60480953 60480937 -
agcaaaaactatttagaact

SEQ ID NO: 188284 - DNA, 20 bp, Artificial Sequence
  Synthetic oligonucleotide; TAGGAT chr2 60480921 60480940 60480924 -
tagaactatgagttcaaaaa

SEQ ID NO: 188285 - DNA, 20 bp, Artificial Sequence
  Synthetic oligonucleotide; GGGGGT chr2 60480867 60480886 60480870 -
ctttctcttgggacagagat

SEQ ID NO: 188286 - DNA, 20 bp, Artificial Sequence
  Synthetic oligonucleotide; GGGGAT chr2 60480854 60480873 60480857 -
cagagatgggggtgcaggta

SEQ ID NO: 188287 - DNA, 20 bp, Artificial Sequence
  Synthetic oligonucleotide; GAGAAT chr2 60480848 60480867 60480851 -
tgggggtgcaggtaggggat

SEQ ID NO: 188288 - DNA, 20 bp, Artificial Sequence
  Synthetic oligonucleotide; GAGGAT chr2 60480829 60480848 60480832 -
tgagaatagaggaaaatgtg

SEQ ID NO: 188289 - DNA, 20 bp, Artificial Sequence
  Synthetic oligonucleotide; GTGAAT chr2 60480690 60480709 60480693 -
aattacacagcatttggaaa

SEQ ID NO: 188290 - DNA, 20 bp, Artificial Sequence
  Synthetic oligonucleotide; TTGAGT chr2 60480657 60480676 60480660 -
ctgattgtccataacaacca

SEQ ID NO: 188291 - DNA, 20 bp, Artificial Sequence
  Synthetic oligonucleotide; CTGGGT chr2 60480571 60480590 60480574 -
caaggggctgtaatcctctc

SEQ ID NO: 188292 - DNA, 20 bp, Artificial Sequence
  Synthetic oligonucleotide; GTGAAT chr2 60480537 60480556 60480540 -
acccagaggctccttggtta

SEQ ID NO: 188293 - DNA, 20 bp, Artificial Sequence
  Synthetic oligonucleotide; TAGAAT chr2 60480463 60480482 60480466 -
gtccttccagccaggtcatt

SEQ ID NO: 188294 - DNA, 20 bp, Artificial Sequence
  Synthetic oligonucleotide; TTGAAT chr2 60480420 60480439 60480423 -
aaaagttcactgcacagcgc

SEQ ID NO: 188295 - DNA, 20 bp, Artificial Sequence
  Synthetic oligonucleotide; CTGAGT chr2 60480350 60480369 60480353 -
ggacagtcagaggtagacca

SEQ ID NO: 188296 - DNA, 20 bp, Artificial Sequence
  Synthetic oligonucleotide; TTGGAT chr2 60480274 60480293 60480277 -
catgctgattacagggagac

SEQ ID NO: 188297 - DNA, 20 bp, Artificial Sequence
  Synthetic oligonucleotide; TGGAGT chr2 60480258 60480277 60480261 -
agacttggatccaggagaaa

SEQ ID NO: 188298 - DNA, 20 bp, Artificial Sequence
  Synthetic oligonucleotide; CAGAGT chr2 60480119 60480138 60480122 -
cctcctcgctgtccttggtg

SEQ ID NO: 188299 - DNA, 20 bp, Artificial Sequence
  Synthetic oligonucleotide; TTGAGT chr2 60479986 60480005 60479989 -
tgatttaacaaaagcagctt

SEQ ID NO: 188300 - DNA, 20 bp, Artificial Sequence
  Synthetic oligonucleotide; CTGAGT chr2 60479973 60479992 60479976 -
gcagcttttgagtgagaaag

SEQ ID NO: 188301 - DNA, 20 bp, Artificial Sequence
  Synthetic oligonucleotide; TGGAGT chr2 60479968 60479987 60479971 -
ttttgagtgagaaagctgag

SEQ ID NO: 188302 - DNA, 20 bp, Artificial Sequence
  Synthetic oligonucleotide; TTGAAT chr2 60479730 60479749 60479733 -
cagacccttgactctttgcc

SEQ ID NO: 188303 - DNA, 20 bp, Artificial Sequence
  Synthetic oligonucleotide; AGGAGT chr2 60479684 60479703 60479687 -
tattgcattagagctggggc

SEQ ID NO: 188304 - DNA, 20 bp, Artificial Sequence
  Synthetic oligonucleotide; CAGGGT chr2 60479606 60479625 60479609 -
ccacactctccaccgcctga

SEQ ID NO: 188305 - DNA, 20 bp, Artificial Sequence
  Synthetic oligonucleotide; TTGAGT chr2 60479600 60479619 60479603 -
tctccaccgcctgacagggt

SEQ ID NO: 188306 - DNA, 20 bp, Artificial Sequence
  Synthetic oligonucleotide; AAGGAT chr2 60479514 60479533 60479517 -
ggttgaggccctggaagcaa

SEQ ID NO: 188307 - DNA, 20 bp, Artificial Sequence
  Synthetic oligonucleotide; GAGAGT chr2 60479484 60479503 60479487 -
gcctgaggggcttgttaagg

SEQ ID NO: 188308 - DNA, 20 bp, Artificial Sequence
  Synthetic oligonucleotide; CCGGGT chr2 60479331 60479350 60479334 -
ctcaaaacaaaaaatggtct

SEQ ID NO: 188309 - DNA, 20 bp, Artificial Sequence
  Synthetic oligonucleotide; CTGAGT chr2 60479275 60479294 60479278 -
agaggccaggtgtccatagg

SEQ ID NO: 188310 - DNA, 20 bp, Artificial Sequence
  Synthetic oligonucleotide; GTGGGT chr2 60479250 60479269 60479253 -
tccccacgtggacctgctag

SEQ ID NO: 188311 - DNA, 20 bp, Artificial Sequence
  Synthetic oligonucleotide; AGGAGT chr2 60479240 60479259 60479243 -
gacctgctaggtgggtagaa

SEQ ID NO: 188312 - DNA, 20 bp, Artificial Sequence
  Synthetic oligonucleotide; TTGGAT chr2 60479185 60479204 60479188 -
cttggaggtgtctgggaaca

SEQ ID NO: 188313 - DNA, 20 bp, Artificial Sequence
  Synthetic oligonucleotide; TGGAAT chr2 60479169 60479188 60479172 -
aacattggatgttactcata

SEQ ID NO: 188314 - DNA, 20 bp, Artificial Sequence
  Synthetic oligonucleotide; CAGAAT chr2 60479160 60479179 60479163 -
tgttactcatatggaatcag

SEQ ID NO: 188315 - DNA, 20 bp, Artificial Sequence
  Synthetic oligonucleotide; AAGGAT chr2 60479019 60479038 60479022 -
attggtcagtggtataaatg

SEQ ID NO: 188316 - DNA, 20 bp, Artificial Sequence
  Synthetic oligonucleotide; TTGGGT chr2 60479006 60479025 60479009 -
ataaatgaaggattaggaaa

SEQ ID NO: 188317 - DNA, 20 bp, Artificial Sequence
  Synthetic oligonucleotide; GAGAAT chr2 60478576 60478595 60478579 -
cataataggttttaattctg

SEQ ID NO: 188318 - DNA, 20 bp, Artificial Sequence
  Synthetic oligonucleotide; CAGAAT chr2 60478554 60478573 60478557 -
gaatggccagttctggttct

SEQ ID NO: 188319 - DNA, 20 bp, Artificial Sequence
  Synthetic oligonucleotide; CAGAGT chr2 60478529 60478548 60478532 -
tctcttggccaagactgtca

SEQ ID NO: 188320 - DNA, 20 bp, Artificial Sequence
  Synthetic oligonucleotide; AGGGGT chr2 60478368 60478387 60478371 -
ggccctgaggtggcagtggg

SEQ ID NO: 188321 - DNA, 20 bp, Artificial Sequence
  Synthetic oligonucleotide; CAGGGT chr2 60478347 60478366 60478350 -
ggggtttgtcagaaggtggg

SEQ ID NO: 188322 - DNA, 20 bp, Artificial Sequence
  Synthetic oligonucleotide; TCGAGT chr2 60478289 60478308 60478292 -
gcaggacacttctgagatct

SEQ ID NO: 188323 - DNA, 20 bp, Artificial Sequence
  Synthetic oligonucleotide; CAGGAT chr2 60478226 60478245 60478229 -
ccacagggcgactgttgggg

SEQ ID NO: 188324 - DNA, 20 bp, Artificial Sequence
  Synthetic oligonucleotide; GAGAGT chr2 60478215 60478234 60478218 -
ctgttggggcaggatgtgag

SEQ ID NO: 188325 - DNA, 20 bp, Artificial Sequence
  Synthetic oligonucleotide; CAGAGT chr2 60478000 60478019 60478003 -
ctgcactccagcctgggcaa

SEQ ID NO: 188326 - DNA, 20 bp, Artificial Sequence
  Synthetic oligonucleotide; TAGAGT chr2 60477915 60477934 60477918 -
tgtgcttccttaagaagggc

SEQ ID NO: 188327 - DNA, 20 bp, Artificial Sequence
  Synthetic oligonucleotide; TTGGAT chr2 60477804 60477823 60477807 -
tctccgtgcacagaccagtc

SEQ ID NO: 188328 - DNA, 20 bp, Artificial Sequence
  Synthetic oligonucleotide; AGGAGT chr2 60477659 60477678 60477662 -
gtgcccacgaacaaaacatc

SEQ ID NO: 188329 - DNA, 20 bp, Artificial Sequence
  Synthetic oligonucleotide; TGGGAT chr2 60477585 60477604 60477588 -
atttattttactctaagttc

SEQ ID NO: 188330 - DNA, 20 bp, Artificial Sequence
  Synthetic oligonucleotide; CAGAAT chr2 60477572 60477591 60477575 -
taagttctgggatacatgtg

SEQ ID NO: 188331 - DNA, 20 bp, Artificial Sequence
  Synthetic oligonucleotide; GTGAGT chr2 60477370 60477389 60477373 -
aggcataaagcacatttgtt

SEQ ID NO: 188332 - DNA, 20 bp, Artificial Sequence
  Synthetic oligonucleotide; TGGGGT chr2 60477345 60477364 60477348 -
ttgatgcagataaaaaggct

SEQ ID NO: 188333 - DNA, 20 bp, Artificial Sequence
  Synthetic oligonucleotide; CAGAGT chr2 60477333 60477352 60477336 -
aaaaggcttggggtggtctt

SEQ ID NO: 188334 - DNA, 20 bp, Artificial Sequence
  Synthetic oligonucleotide; GGGAGT chr2 60477322 60477341 60477325 -
ggtggtcttcagagtaattt

SEQ ID NO: 188335 - DNA, 20 bp, Artificial Sequence
  Synthetic oligonucleotide; CAGAAT chr2 60477261 60477280 60477264 -
tctgctctggcaggtgttat

SEQ ID NO: 188336 - DNA, 20 bp, Artificial Sequence
  Synthetic oligonucleotide; CTGAAT chr2 60477197 60477216 60477200 -
tcacagccccatgcctcttc

SEQ ID NO: 188337 - DNA, 20 bp, Artificial Sequence
  Synthetic oligonucleotide; TCGAGT chr2 60477065 60477084 60477068 -
cccatccttttcttcatttc

SEQ ID NO: 188338 - DNA, 20 bp, Artificial Sequence
  Synthetic oligonucleotide; CGGGGT chr2 60477044 60477063 60477047 -
cgagtggggcagggaggcat

SEQ ID NO: 188339 - DNA, 20 bp, Artificial Sequence
  Synthetic oligonucleotide; TCGGGT chr2 60477006 60477025 60477009 -
tttgtgtgaagctggacaat

SEQ ID NO: 188340 - DNA, 20 bp, Artificial Sequence
  Synthetic oligonucleotide; ATGGAT chr2 60476946 60476965 60476949 -
tcccttctaactacaaaggc

SEQ ID NO: 188341 - DNA, 20 bp, Artificial Sequence
  Synthetic oligonucleotide; GAGAGT chr2 60476871 60476890 60476874 -
taatggaaactgataaatta

SEQ ID NO: 188342 - DNA, 20 bp, Artificial Sequence
  Synthetic oligonucleotide; CAGGGT chr2 60476816 60476835 60476819 -
cttttcaaaaggtttcacca

SEQ ID NO: 188343 - DNA, 20 bp, Artificial Sequence
  Synthetic oligonucleotide; CTGAAT chr2 60476786 60476805 60476789 -
ttaaatagtgagctccccca

SEQ ID NO: 188344 - DNA, 20 bp, Artificial Sequence
  Synthetic oligonucleotide; GAGGAT chr2 60476741 60476760 60476744 -
atcattaactacttgacaga

SEQ ID NO: 188345 - DNA, 20 bp, Artificial Sequence
  Synthetic oligonucleotide; GGGGGT chr2 60476732 60476751 60476735 -
tacttgacagagaggatatt

SEQ ID NO: 188346 - DNA, 20 bp, Artificial Sequence
  Synthetic oligonucleotide; AAGGGT chr2 60476660 60476679 60476663 -
ccaattttcaatgagcctgg

SEQ ID NO: 188347 - DNA, 20 bp, Artificial Sequence
  Synthetic oligonucleotide; TGGGGT chr2 60476559 60476578 60476562 -
ccaagaaccctccatgctga

SEQ ID NO: 188348 - DNA, 20 bp, Artificial Sequence
  Synthetic oligonucleotide; CAGGGT chr2 60476532 60476551 60476535 -
tggtgggaggtcaaggacca

SEQ ID NO: 188349 - DNA, 20 bp, Artificial Sequence
  Synthetic oligonucleotide; TAGAGT chr2 60476473 60476492 60476476 -
gggagaggactcccttttct

SEQ ID NO: 188350 - DNA, 20 bp, Artificial Sequence
  Synthetic oligonucleotide; ATGGGT chr2 60476445 60476464 60476448 -
tgtgtgtgcctttgtgagca

SEQ ID NO: 188351 - DNA, 20 bp, Artificial Sequence
  Synthetic oligonucleotide; CTGGGT chr2 60476359 60476378 60476362 -
cttttcccttgacatttagc

SEQ ID NO: 188352 - DNA, 20 bp, Artificial Sequence
  Synthetic oligonucleotide; AAGGAT chr2 60476205 60476224 60476208 -
caggctcactctctaagcct

SEQ ID NO: 188353 - DNA, 20 bp, Artificial Sequence
  Synthetic oligonucleotide; AAGGAT chr2 60475970 60475989 60475973 -
aacacttagggccagaaaga

SEQ ID NO: 188354 - DNA, 20 bp, Artificial Sequence
  Synthetic oligonucleotide; GTGAGT chr2 60475940 60475959 60475943 -
tcaaagtcacgaaacagctg

SEQ ID NO: 188355 - DNA, 20 bp, Artificial Sequence
  Synthetic oligonucleotide; CAGAGT chr2 60475932 60475951 60475935 -
acgaaacagctggtgagtgg

SEQ ID NO: 188356 - DNA, 20 bp, Artificial Sequence
  Synthetic oligonucleotide; TGGGGT chr2 60475926 60475945 60475929 -
cagctggtgagtggcagagt

SEQ ID NO: 188357 - DNA, 20 bp, Artificial Sequence
  Synthetic oligonucleotide; AAGAAT chr2 60475846 60475865 60475849 -
cctgcttcctaaaggaagaa

SEQ ID NO: 188358 - DNA, 20 bp, Artificial Sequence
  Synthetic oligonucleotide; GGGAGT chr2 60475837 60475856 60475840 -
taaaggaagaaaagaatccg

SEQ ID NO: 188359 - DNA, 20 bp, Artificial Sequence
  Synthetic oligonucleotide; GGGAAT chr2 60475822 60475841 60475825 -
atccggggagtggtggcagt

SEQ ID NO: 188360 - DNA, 20 bp, Artificial Sequence
  Synthetic oligonucleotide; TCGGAT chr2 60475763 60475782 60475766 -
caaataacctgataaatacc

SEQ ID NO: 188361 - DNA, 20 bp, Artificial Sequence
  Synthetic oligonucleotide; AGGAGT chr2 60475686 60475705 60475689 -
ctcagctgaggactcagagc

SEQ ID NO: 188362 - DNA, 20 bp, Artificial Sequence
  Synthetic oligonucleotide; AGGGAT chr2 60475625 60475644 60475628 -
aagaaagaggggaaatttgg

SEQ ID NO: 188363 - DNA, 20 bp, Artificial Sequence
  Synthetic oligonucleotide; AGGAAT chr2 60475422 60475441 60475425 -
cacttgtttgtctgactcag

SEQ ID NO: 188364 - DNA, 20 bp, Artificial Sequence
  Synthetic oligonucleotide; TGGAGT chr2 60475323 60475342 60475326 -
acagaacagatgaaccttca

SEQ ID NO: 188365 - DNA, 20 bp, Artificial Sequence
  Synthetic oligonucleotide; AAGAGT chr2 60475312 60475331 60475315 -
gaaccttcatggagtttcac

SEQ ID NO: 188366 - DNA, 20 bp, Artificial Sequence
  Synthetic oligonucleotide; GAGGAT chr2 60475220 60475239 60475223 -
agatgtcacagaaatcttca

SEQ ID NO: 188367 - DNA, 20 bp, Artificial Sequence
  Synthetic oligonucleotide; CTGGAT chr2 60475183 60475202 60475186 -
gtcgtatcctccgctgtcaa

SEQ ID NO: 188368 - DNA, 20 bp, Artificial Sequence
  Synthetic oligonucleotide; ATGAAT chr2 60475179 60475198 60475182 -
tatcctccgctgtcaactgg

SEQ ID NO: 188369 - DNA, 20 bp, Artificial Sequence
  Synthetic oligonucleotide; GTGAAT chr2 60475154 60475173 60475157 -
tcagtgtgcaatattttgat

SEQ ID NO: 188370 - DNA, 20 bp, Artificial Sequence
  Synthetic oligonucleotide; TAGGAT chr2 60475061 60475080 60475064 -
acctgctttttctttttatc

SEQ ID NO: 188371 - DNA, 20 bp, Artificial Sequence
  Synthetic oligonucleotide; TTGAAT chr2 60474960 60474979 60474963 -
tggaaataatttctcttcct

SEQ ID NO: 188372 - DNA, 20 bp, Artificial Sequence
  Synthetic oligonucleotide; GGGGGT chr2 60474907 60474926 60474910 -
tcatgacacactttctacat

SEQ ID NO: 188373 - DNA, 20 bp, Artificial Sequence
  Synthetic oligonucleotide; TTGAAT chr2 60474762 60474781 60474765 -
aggcactcggtaaatatttg

SEQ ID NO: 188374 - DNA, 20 bp, Artificial Sequence
  Synthetic oligonucleotide; ATGAAT chr2 60474758 60474777 60474761 -
actcggtaaatatttgttga

SEQ ID NO: 188375 - DNA, 20 bp, Artificial Sequence
  Synthetic oligonucleotide; TTGAAT chr2 60474742 60474761 60474745 -
ttgaatgaatgcatgagagg

SEQ ID NO: 188376 - DNA, 20 bp, Artificial Sequence
  Synthetic oligonucleotide; ATGAAT chr2 60474738 60474757 60474741 -
atgaatgcatgagaggttga

SEQ ID NO: 188377 - DNA, 20 bp, Artificial Sequence
  Synthetic oligonucleotide; GAGAAT chr2 60474726 60474745 60474729 -
gaggttgaatgaatgcatga

SEQ ID NO: 188378 - DNA, 20 bp, Artificial Sequence
  Synthetic oligonucleotide; ATGAAT chr2 60474722 60474741 60474725 -
ttgaatgaatgcatgagaga

SEQ ID NO: 188379 - DNA, 20 bp, Artificial Sequence
  Synthetic oligonucleotide; ATGAAT chr2 60474718 60474737 60474721 -
atgaatgcatgagagaatga

SEQ ID NO: 188380 - DNA, 20 bp, Artificial Sequence
  Synthetic oligonucleotide; TGGAAT chr2 60474713 60474732 60474716 -
tgcatgagagaatgaatgaa

SEQ ID NO: 188381 - DNA, 20 bp, Artificial Sequence
  Synthetic oligonucleotide; AAGAAT chr2 60474506 60474525 60474509 -
atactttgggcccagagcca

SEQ ID NO: 188382 - DNA, 20 bp, Artificial Sequence
  Synthetic oligonucleotide; TGGAGT chr2 60474495 60474514 60474498 -
ccagagccaaagaatattat

SEQ ID NO: 188383 - DNA, 20 bp, Artificial Sequence
  Synthetic oligonucleotide; TGGAAT chr2 60474457 60474476 60474460 -
acaccctaaatttaaccagc

SEQ ID NO: 188384 - DNA, 20 bp, Artificial Sequence
  Synthetic oligonucleotide; AAGGAT chr2 60474412 60474431 60474415 -
ctattcaaccttttgaaatg

SEQ ID NO: 188385 - DNA, 20 bp, Artificial Sequence
  Synthetic oligonucleotide; TGGAAT chr2 60474312 60474331 60474315 -
aaagcaagattttttttttt

SEQ ID NO: 188386 - DNA, 20 bp, Artificial Sequence
  Synthetic oligonucleotide; TTGAGT chr2 60474126 60474145 60474129 -
tgaagttagtaacctgttgt

SEQ ID NO: 188387 - DNA, 20 bp, Artificial Sequence
  Synthetic oligonucleotide; GAGGAT chr2 60474106 60474125 60474109 -
ttgagtaatcaaggctctaa

SEQ ID NO: 188388 - DNA, 20 bp, Artificial Sequence
  Synthetic oligonucleotide; AAGAGT chr2 60474086 60474105 60474089 -
gaggatagcattgatcaaaa

SEQ ID NO: 188389 - DNA, 20 bp, Artificial Sequence
  Synthetic oligonucleotide; ATGAGT chr2 60474074 60474093 60474077 -
gatcaaaaaagagttttaaa

SEQ ID NO: 188390 - DNA, 20 bp, Artificial Sequence
  Synthetic oligonucleotide; AGGAAT chr2 60474034 60474053 60474037 -
aagtcactggtgaagtatca

SEQ ID NO: 188391 - DNA, 20 bp, Artificial Sequence
  Synthetic oligonucleotide; GAGAGT chr2 60474015 60474034 60474018 -
aaggaatctaaggaccatga

SEQ ID NO: 188392 - DNA, 20 bp, Artificial Sequence
  Synthetic oligonucleotide; CAGAAT chr2 60473952 60473971 60473955 -
attgctttcttttgtttttg

SEQ ID NO: 188393 - DNA, 20 bp, Artificial Sequence
  Synthetic oligonucleotide; CAGGAT chr2 60473928 60473947 60473931 -
atacactttttaaagaacat

SEQ ID NO: 188394 - DNA, 20 bp, Artificial Sequence
  Synthetic oligonucleotide; GAGAGT chr2 60473849 60473868 60473852 -
tgctcatttctagaacaaaa

SEQ ID NO: 188395 - DNA, 20 bp, Artificial Sequence
  Synthetic oligonucleotide; GTGAGT chr2 60473805 60473824 60473808 -
gaaggttaattaagaagtct

SEQ ID NO: 188396 - DNA, 20 bp, Artificial Sequence
  Synthetic oligonucleotide; GAGAAT chr2 60473708 60473727 60473711 -
tataatactctgataagtca

SEQ ID NO: 188397 - DNA, 20 bp, Artificial Sequence
  Synthetic oligonucleotide; TAGGGT chr2 60473669 60473688 60473672 -
actggtatctatggtaaaca

SEQ ID NO: 188398 - DNA, 20 bp, Artificial Sequence
  Synthetic oligonucleotide; CTGAAT chr2 60473647 60473666 60473650 -
gggtcaagagctagatgcgg

SEQ ID NO: 188399 - DNA, 20 bp, Artificial Sequence
  Synthetic oligonucleotide; TCGGAT chr2 60473552 60473571 60473555 -
gtgtggcttgaacctagtaa

SEQ ID NO: 188400 - DNA, 20 bp, Artificial Sequence
  Synthetic oligonucleotide; TGGAAT chr2 60473539 60473558 60473542 -
ctagtaatcggattcagaac

SEQ ID NO: 188401 - DNA, 20 bp, Artificial Sequence
  Synthetic oligonucleotide; ATGGGT chr2 60473535 60473554 60473538 -
taatcggattcagaactgga

SEQ ID NO: 188402 - DNA, 20 bp, Artificial Sequence
  Synthetic oligonucleotide; CAGGGT chr2 60473524 60473543 60473527 -
agaactggaatgggttcctt

SEQ ID NO: 188403 - DNA, 20 bp, Artificial Sequence
  Synthetic oligonucleotide; CAGGAT chr2 60473504 60473523 60473507 -
cagggtactttacaaacgtt

SEQ ID NO: 188404 - DNA, 20 bp, Artificial Sequence
  Synthetic oligonucleotide; GAGGAT chr2 60473448 60473467 60473451 -
atggaagagctgagggactt

SEQ ID NO: 188405 - DNA, 20 bp, Artificial Sequence
  Synthetic oligonucleotide; CAGGGT chr2 60473341 60473360 60473344 -
ccattctctttttgaagacc

SEQ ID NO: 188406 - DNA, 20 bp, Artificial Sequence
  Synthetic oligonucleotide; GGGGGT chr2 60473327 60473346 60473330 -
aagacccagggtgaaagaaa

SEQ ID NO: 188407 - DNA, 20 bp, Artificial Sequence
  Synthetic oligonucleotide; GTGAAT chr2 60472973 60472992 60472976 -
acacacacacgtacatttta

SEQ ID NO: 188408 - DNA, 20 bp, Artificial Sequence
  Synthetic oligonucleotide; GAGAGT chr2 60472943 60472962 60472946 -
cacatctatgtactcctgtg

SEQ ID NO: 188409 - DNA, 20 bp, Artificial Sequence
  Synthetic oligonucleotide; TGGAAT chr2 60472882 60472901 60472885 -
aaagcagtcattaaacgtgt

SEQ ID NO: 188410 - DNA, 20 bp, Artificial Sequence
  Synthetic oligonucleotide; AGGAAT chr2 60472746 60472765 60472749 -
aaatagcatgttaatagtca

SEQ ID NO: 188411 - DNA, 20 bp, Artificial Sequence
  Synthetic oligonucleotide; AAGAGT chr2 60472547 60472566 60472550 -
tttaatgaaacctgaaaaat

SEQ ID NO: 188412 - DNA, 20 bp, Artificial Sequence
  Synthetic oligonucleotide; CTGGGT chr2 60472461 60472480 60472464 -
tgaggccccaagtggaaata

SEQ ID NO: 188413 - DNA, 20 bp, Artificial Sequence
  Synthetic oligonucleotide; TTGAGT chr2 60472381 60472400 60472384 -
gtaagacatttgaaaaaaga

SEQ ID NO: 188414 - DNA, 20 bp, Artificial Sequence
  Synthetic oligonucleotide; AAGAGT chr2 60472330 60472349 60472333 -
gagagaccagaaagggaaac

SEQ ID NO: 188415 - DNA, 20 bp, Artificial Sequence
  Synthetic oligonucleotide; TTGGGT chr2 60472224 60472243 60472227 -
tctgtctggcacaagctggt

SEQ ID NO: 188416 - DNA, 20 bp, Artificial Sequence
  Synthetic oligonucleotide; GAGGGT chr2 60472143 60472162 60472146 -
gtccttatcaatgacagacg

SEQ ID NO: 188417 - DNA, 20 bp, Artificial Sequence
  Synthetic oligonucleotide; CTGAAT chr2 60472132 60472151 60472135 -
tgacagacggagggtggaac

SEQ ID NO: 188418 - DNA, 20 bp, Artificial Sequence
  Synthetic oligonucleotide; AGGGAT chr2 60472116 60472135 60472119 -
gaacctgaatttcctaatgg

SEQ ID NO: 188419 - DNA, 20 bp, Artificial Sequence
  Synthetic oligonucleotide; AGGGAT chr2 60472106 60472125 60472109 -
ttcctaatggagggatcctt

SEQ ID NO: 188420 - DNA, 20 bp, Artificial Sequence
  Synthetic oligonucleotide; GTGGGT chr2 60472056 60472075 60472059 -
ctgttccagtcctaaaggag

SEQ ID NO: 188421 - DNA, 20 bp, Artificial Sequence
  Synthetic oligonucleotide; ATGGGT chr2 60472018 60472037 60472021 -
ggaaaacagcctcatggccc

SEQ ID NO: 188422 - DNA, 20 bp, Artificial Sequence
  Synthetic oligonucleotide; GGGAAT chr2 60472003 60472022 60472006 -
ggcccatgggtctctgccca

SEQ ID NO: 188423 - DNA, 20 bp, Artificial Sequence
  Synthetic oligonucleotide; TTGAGT chr2 60471940 60471959 60471943 -
gacagcagtgctgattcagc

SEQ ID NO: 188424 - DNA, 20 bp, Artificial Sequence
  Synthetic oligonucleotide; GAGAAT chr2 60471928 60471947 60471931 -
gattcagcttgagtgtgcat

SEQ ID NO: 188425 - DNA, 20 bp, Artificial Sequence
  Synthetic oligonucleotide; GAGAAT chr2 60471916 60471935 60471919 -
gtgtgcatgagaatcacctg

SEQ ID NO: 188426 - DNA, 20 bp, Artificial Sequence
  Synthetic oligonucleotide; AAGAAT chr2 60471844 60471863 60471847 -
gtaagtctgaggtggtgccc

SEQ ID NO: 188427 - DNA, 20 bp, Artificial Sequence
  Synthetic oligonucleotide; GGGGGT chr2 60471803 60471822 60471806 -
actcccaggtgatgctgatc

SEQ ID NO: 188428 - DNA, 20 bp, Artificial Sequence
  Synthetic oligonucleotide; CTGGGT chr2 60471793 60471812 60471796 -
gatgctgatcgggggtgggc

SEQ ID NO: 188429 - DNA, 20 bp, Artificial Sequence
  Synthetic oligonucleotide; GAGAAT chr2 60471778 60471797 60471781 -
tgggcctgggtctgcgctgt

SEQ ID NO: 188430 - DNA, 20 bp, Artificial Sequence
  Synthetic oligonucleotide; GAGAAT chr2 60471681 60471700 60471684 -
agagcccatctctggctggg

SEQ ID NO: 188431 - DNA, 20 bp, Artificial Sequence
  Synthetic oligonucleotide; TCGAGT chr2 60471591 60471610 60471594 -
tgggaaggcagagctgctcc

SEQ ID NO: 188432 - DNA, 20 bp, Artificial Sequence
  Synthetic oligonucleotide; GGGAAT chr2 60471458 60471477 60471461 -
ttagcatttccagttcatgt

SEQ ID NO: 188433 - DNA, 20 bp, Artificial Sequence
  Synthetic oligonucleotide; GAGAAT chr2 60471433 60471452 60471436 -
tgtcgattttacttaccaaa

SEQ ID NO: 188434 - DNA, 20 bp, Artificial Sequence
  Synthetic oligonucleotide; ATGGAT chr2 60471424 60471443 60471427 -
tacttaccaaagagaatatt

SEQ ID NO: 188435 - DNA, 20 bp, Artificial Sequence
  Synthetic oligonucleotide; CAGAAT chr2 60471398 60471417 60471401 -
gtgtttagtggaagaagcag

SEQ ID NO: 188436 - DNA, 20 bp, Artificial Sequence
  Synthetic oligonucleotide; TGGGGT chr2 60471388 60471407 60471391 -
gaagaagcagcagaatcagc

SEQ ID NO: 188437 - DNA, 20 bp, Artificial Sequence
  Synthetic oligonucleotide; AAGGGT chr2 60471335 60471354 60471338 -
tcctgaaggaagataaatgc

SEQ ID NO: 188438 - DNA, 20 bp, Artificial Sequence
  Synthetic oligonucleotide; GTGAGT chr2 60471331 60471350 60471334 -
gaaggaagataaatgcaagg

SEQ ID NO: 188439 - DNA, 20 bp, Artificial Sequence
  Synthetic oligonucleotide; GAGGGT chr2 60471229 60471248 60471232 -
ctgcaggggaagcagaggta

SEQ ID NO: 188440 - DNA, 20 bp, Artificial Sequence
  Synthetic oligonucleotide; ATGGAT chr2 60471072 60471091 60471075 -
agacggttaagtactgctta

SEQ ID NO: 188441 - DNA, 20 bp, Artificial Sequence
  Synthetic oligonucleotide; CTGGAT chr2 60470981 60471000 60470984 -
caaattcccaggaaagacca

SEQ ID NO: 188442 - DNA, 20 bp, Artificial Sequence
  Synthetic oligonucleotide; AGGAGT chr2 60470974 60470993 60470977 -
ccaggaaagaccactggatc

SEQ ID NO: 188443 - DNA, 20 bp, Artificial Sequence
  Synthetic oligonucleotide; TAGGGT chr2 60470845 60470864 60470848 -
gggacagacttgatgatagc

SEQ ID NO: 188444 - DNA, 20 bp, Artificial Sequence
  Synthetic oligonucleotide; ATGGGT chr2 60470702 60470721 60470705 -
cgtcagcttgtttagggcta

SEQ ID NO: 188445 - DNA, 20 bp, Artificial Sequence
  Synthetic oligonucleotide; ATGGAT chr2 60470651 60470670 60470654 -
attcatgcgaggggctaggc

SEQ ID NO: 188446 - DNA, 20 bp, Artificial Sequence
  Synthetic oligonucleotide; CAGGGT chr2 60470597 60470616 60470600 -
ggaggcctgctgaagcactt

SEQ ID NO: 188447 - DNA, 20 bp, Artificial Sequence
  Synthetic oligonucleotide; CAGAGT chr2 60470584 60470603 60470587 -
agcacttcagggtctcttcc

SEQ ID NO: 188448 - DNA, 20 bp, Artificial Sequence
  Synthetic oligonucleotide; GAGAAT chr2 60470570 60470589 60470573 -
tcttcccagagtaagtggca

SEQ ID NO: 188449 - DNA, 20 bp, Artificial Sequence
  Synthetic oligonucleotide; AAGGAT chr2 60470541 60470560 60470544 -
aaatttgatactccccatac

SEQ ID NO: 188450 - DNA, 20 bp, Artificial Sequence
  Synthetic oligonucleotide; TGGGAT chr2 60470512 60470531 60470515 -
agtacctgttgcgtttatgc

SEQ ID NO: 188451 - DNA, 20 bp, Artificial Sequence
  Synthetic oligonucleotide; CTGGGT chr2 60470495 60470514 60470498 -
tgctgggatcacagagatac

SEQ ID NO: 188452 - DNA, 20 bp, Artificial Sequence
  Synthetic oligonucleotide; AAGGAT chr2 60470470 60470489 60470473 -
ttgcctgtgtttcctaagaa

SEQ ID NO: 188453 - DNA, 20 bp, Artificial Sequence
  Synthetic oligonucleotide; ATGGAT chr2 60470411 60470430 60470414 -
aggcaaaaacaagtgcaaag

SEQ ID NO: 188454 - DNA, 20 bp, Artificial Sequence
  Synthetic oligonucleotide; TTGGGT chr2 60470247 60470266 60470250 -
tttgtggtgtttattttgtt

SEQ ID NO: 188455 - DNA, 20 bp, Artificial Sequence
  Synthetic oligonucleotide; GAGGAT chr2 60470237 60470256 60470240 -
ttattttgttttgggtcaga

SEQ ID NO: 188456 - DNA, 20 bp, Artificial Sequence
  Synthetic oligonucleotide; CAGGAT chr2 60470029 60470048 60470032 -
tgtgctctatataaggagaa

SEQ ID NO: 188457 - DNA, 20 bp, Artificial Sequence
  Synthetic oligonucleotide; TAGAGT chr2 60469996 60470015 60469999 -
acacttgagacctgctatcc

SEQ ID NO: 188458 - DNA, 20 bp, Artificial Sequence
  Synthetic oligonucleotide; CAGAGT chr2 60469632 60469651 60469635 -
gagaagtcacttgtcttcac

SEQ ID NO: 188459 - DNA, 20 bp, Artificial Sequence
  Synthetic oligonucleotide; ATGGGT chr2 60469599 60469618 60469602 -
agtgcagtaaaatggtgaag

SEQ ID NO: 188460 - DNA, 20 bp, Artificial Sequence
  Synthetic oligonucleotide; CAGGGT chr2 60469593 60469612 60469596 -
gtaaaatggtgaagatgggt

SEQ ID NO: 188461 - DNA, 20 bp, Artificial Sequence
  Synthetic oligonucleotide; CTGGGT chr2 60469585 60469604 60469588 -
gtgaagatgggtcagggttt

SEQ ID NO: 188462 - DNA, 20 bp, Artificial Sequence
  Synthetic oligonucleotide; TGGAAT chr2 60469568 60469587 60469571 -
tttctgggtgctggcattat

SEQ ID NO: 188463 - DNA, 20 bp, Artificial Sequence
  Synthetic oligonucleotide; CAGGAT chr2 60469446 60469465 60469449 -
tgtgtaaggtttccagttga

SEQ ID NO: 188464 - DNA, 20 bp, Artificial Sequence
  Synthetic oligonucleotide; TAGAGT chr2 60469438 60469457 60469441 -
gtttccagttgacaggattc

SEQ ID NO: 188465 - DNA, 20 bp, Artificial Sequence
  Synthetic oligonucleotide; TTGGGT chr2 60469261 60469280 60469264 -
atcagcattttgctttttgc

SEQ ID NO: 188466 - DNA, 20 bp, Artificial Sequence
  Synthetic oligonucleotide; TGGAAT chr2 60468915 60468934 60468918 -
gatgttgtaatctattttaa

SEQ ID NO: 188467 - DNA, 20 bp, Artificial Sequence
  Synthetic oligonucleotide; TTGGGT chr2 60468851 60468870 60468854 -
tgtagctgtagtgcttgatt

SEQ ID NO: 188468 - DNA, 20 bp, Artificial Sequence
  Synthetic oligonucleotide; TGGGAT chr2 60468767 60468786 60468770 -
ggagctctaatccccacgcc

SEQ ID NO: 188469 - DNA, 20 bp, Artificial Sequence
  Synthetic oligonucleotide; ATGAGT chr2 60468763 60468782 60468766 -
ctctaatccccacgcctggg

SEQ ID NO: 188470 - DNA, 20 bp, Artificial Sequence
  Synthetic oligonucleotide; CAGAAT chr2 60468756 60468775 60468759 -
ccccacgcctgggatgagtg

SEQ ID NO: 188471 - DNA, 20 bp, Artificial Sequence
  Synthetic oligonucleotide; CAGGGT chr2 60468742 60468761 60468745 -
tgagtgcagaatatgccccg

SEQ ID NO: 188472 - DNA, 20 bp, Artificial Sequence
  Synthetic oligonucleotide; GAGAAT chr2 60468685 60468704 60468688 -
atgtccatgtgtatagagat

SEQ ID NO: 188473 - DNA, 20 bp, Artificial Sequence
  Synthetic oligonucleotide; AGGAGT chr2 60468646 60468665 60468649 -
ccttactttttaagtactga

SEQ ID NO: 188474 - DNA, 20 bp, Artificial Sequence
  Synthetic oligonucleotide; GTGGGT chr2 60468498 60468517 60468501 -
gctgatagtagctcatccct

SEQ ID NO: 188475 - DNA, 20 bp, Artificial Sequence
  Synthetic oligonucleotide; CAGGGT chr2 60468484 60468503 60468487 -
atccctgtgggtcttctccc

SEQ ID NO: 188476 - DNA, 20 bp, Artificial Sequence
  Synthetic oligonucleotide; TTGGGT chr2 60468384 60468403 60468387 -
ctgtggcctcatttaggact

SEQ ID NO: 188477 - DNA, 20 bp, Artificial Sequence
  Synthetic oligonucleotide; CAGAAT chr2 60468347 60468366 60468350 -
cacacatctttagccaaggc

SEQ ID NO: 188478 - DNA, 20 bp, Artificial Sequence
  Synthetic oligonucleotide; AGGAGT chr2 60468337 60468356 60468340 -
tagccaaggccagaatcaaa

SEQ ID NO: 188479 - DNA, 20 bp, Artificial Sequence
  Synthetic oligonucleotide; TAGGGT chr2 60468326 60468345 60468329 -
agaatcaaaaggagtcagtt

SEQ ID NO: 188480 - DNA, 20 bp, Artificial Sequence
  Synthetic oligonucleotide; CAGAGT chr2 60468315 60468334 60468318 -
gagtcagtttagggttattc

SEQ ID NO: 188481 - DNA, 20 bp, Artificial Sequence
  Synthetic oligonucleotide; ATGAAT chr2 60466926 60466945 60466929 -
tctgtgtaggaacacatggt

SEQ ID NO: 188482 - DNA, 20 bp, Artificial Sequence
  Synthetic oligonucleotide; GGGGGT chr2 60466900 60466919 60466903 -
catgcatggctaaaaggtta

SEQ ID NO: 188483 - DNA, 20 bp, Artificial Sequence
  Synthetic oligonucleotide; GAGAAT chr2 60466756 60466775 60466759 -
aaggaaaaaggtcatggaga

SEQ ID NO: 188484 - DNA, 20 bp, Artificial Sequence
  Synthetic oligonucleotide; CAGAGT chr2 60466733 60466752 60466736 -
aataacaaagagcaagatgc

SEQ ID NO: 188485 - DNA, 20 bp, Artificial Sequence
  Synthetic oligonucleotide; AAGAGT chr2 60466577 60466596 60466580 -
ctaggtaatcctaggtaaca

SEQ ID NO: 188486 - DNA, 20 bp, Artificial Sequence
  Synthetic oligonucleotide; GTGAAT chr2 60466565 60466584 60466568 -
aggtaacaaagagttattgt

SEQ ID NO: 188487 - DNA, 20 bp, Artificial Sequence
  Synthetic oligonucleotide; CTGGGT chr2 60466534 60466553 60466537 -
aagccctcaggtcctgaggg

SEQ ID NO: 188488 - DNA, 20 bp, Artificial Sequence
  Synthetic oligonucleotide; AGGGGT chr2 60466523 60466542 60466526 -
tcctgagggctgggtggttc

SEQ ID NO: 188489 - DNA, 20 bp, Artificial Sequence
  Synthetic oligonucleotide; CTGGGT chr2 60466473 60466492 60466476 -
cccccaagctgggcctaagc

SEQ ID NO: 188490 - DNA, 20 bp, Artificial Sequence
  Synthetic oligonucleotide; CTGGGT chr2 60466404 60466423 60466407 -
ttctagtccctgcatgctgg

SEQ ID NO: 188491 - DNA, 20 bp, Artificial Sequence
  Synthetic oligonucleotide; AGGGAT chr2 60466323 60466342 60466326 -
cggagccacttttggaggga

SEQ ID NO: 188492 - DNA, 20 bp, Artificial Sequence
  Synthetic oligonucleotide; GGGAGT chr2 60466313 60466332 60466316 -
tttggagggaagggatagaa

SEQ ID NO: 188493 - DNA, 20 bp, Artificial Sequence
  Synthetic oligonucleotide; GAGGGT chr2 60466293 60466312 60466296 -
gggagttgagcagttcagag

SEQ ID NO: 188494 - DNA, 20 bp, Artificial Sequence
  Synthetic oligonucleotide; TGGAGT chr2 60466288 60466307 60466291 -
ttgagcagttcagaggaggg

SEQ ID NO: 188495 - DNA, 20 bp, Artificial Sequence
  Synthetic oligonucleotide; GGGAGT chr2 60466215 60466234 60466218 -
gcctggtcttcctgagggct

SEQ ID NO: 188496 - DNA, 20 bp, Artificial Sequence
  Synthetic oligonucleotide; GAGGGT chr2 60466140 60466159 60466143 -
ctcccaccttcccacaaagg

SEQ ID NO: 188497 - DNA, 20 bp, Artificial Sequence
  Synthetic oligonucleotide; AGGAGT chr2 60466096 60466115 60466099 -
cctgctggcaggaccaattt

SEQ ID NO: 188498 - DNA, 20 bp, Artificial Sequence
  Synthetic oligonucleotide; GTGGGT chr2 60466068 60466087 60466071 -
ccagaacaaggtatgtggaa

SEQ ID NO: 188499 - DNA, 20 bp, Artificial Sequence
  Synthetic oligonucleotide; GGGGGT chr2 60466059 60466078 60466062 -
ggtatgtggaagtgggttgt

SEQ ID NO: 188500 - DNA, 20 bp, Artificial Sequence
  Synthetic oligonucleotide; CTGGGT chr2 60465906 60465925 60465909 -
aactagagcctccttttggc

SEQ ID NO: 188501 - DNA, 20 bp, Artificial Sequence
  Synthetic oligonucleotide; CGGGGT chr2 60465864 60465883 60465867 -
accttcctctggaagccgtt

SEQ ID NO: 188502 - DNA, 20 bp, Artificial Sequence
  Synthetic oligonucleotide; AGGAAT chr2 60465692 60465711 60465695 -
tttatgctcattttacagat

SEQ ID NO: 188503 - DNA, 20 bp, Artificial Sequence
  Synthetic oligonucleotide; CAGAGT chr2 60465655 60465674 60465658 -
gagaaatcaaatgactatcc

SEQ ID NO: 188504 - DNA, 20 bp, Artificial Sequence
  Synthetic oligonucleotide; GTGGAT chr2 60465640 60465659 60465643 -
tatcccagagttacaatcta

SEQ ID NO: 188505 - DNA, 20 bp, Artificial Sequence
  Synthetic oligonucleotide; CTGAAT chr2 60465595 60465614 60465598 -
tctcagacctccttgttctt

SEQ ID NO: 188506 - DNA, 20 bp, Artificial Sequence
  Synthetic oligonucleotide; GGGGGT chr2 60465539 60465558 60465542 -
attggtgacatactagaaat

SEQ ID NO: 188507 - DNA, 20 bp, Artificial Sequence
  Synthetic oligonucleotide; CAGAGT chr2 60465349 60465368 60465352 -
attgagaagttgattttcat

SEQ ID NO: 188508 - DNA, 20 bp, Artificial Sequence
  Synthetic oligonucleotide; AAGAAT chr2 60465338 60465357 60465341 -
gattttcatcagagtaaatg

SEQ ID NO: 188509 - DNA, 20 bp, Artificial Sequence
  Synthetic oligonucleotide; AGGAAT chr2 60465181 60465200 60465184 -
tttattgatgactgcagttt

SEQ ID NO: 188510 - DNA, 20 bp, Artificial Sequence
  Synthetic oligonucleotide; TAGAAT chr2 60465174 60465193 60465177 -
atgactgcagtttaggaatt

SEQ ID NO: 188511 - DNA, 20 bp, Artificial Sequence
  Synthetic oligonucleotide; CTGAGT chr2 60465129 60465148 60465132 -
atatggtacaccggcatgag

SEQ ID NO: 188512 - DNA, 20 bp, Artificial Sequence
  Synthetic oligonucleotide; TAGAAT chr2 60464964 60464983 60464967 -
cactagctgccctcatgatc

SEQ ID NO: 188513 - DNA, 20 bp, Artificial Sequence
  Synthetic oligonucleotide; GGGAAT chr2 60464947 60464966 60464950 -
atctagaatatctagttgat

SEQ ID NO: 188514 - DNA, 20 bp, Artificial Sequence
  Synthetic oligonucleotide; GAGGAT chr2 60464853 60464872 60464856 -
ctgatgtatgagagagaggg

SEQ ID NO: 188515 - DNA, 20 bp, Artificial Sequence
  Synthetic oligonucleotide; TAGGAT chr2 60464789 60464808 60464792 -
actggctctgaaaaaaagtt

SEQ ID NO: 188516 - DNA, 20 bp, Artificial Sequence
  Synthetic oligonucleotide; AAGGAT chr2 60464734 60464753 60464737 -
tctcatttaagcctttttga

SEQ ID NO: 188517 - DNA, 20 bp, Artificial Sequence
  Synthetic oligonucleotide; ATGAGT chr2 60464632 60464651 60464635 -
tgaaaccagcaccactaatt

SEQ ID NO: 188518 - DNA, 20 bp, Artificial Sequence
  Synthetic oligonucleotide; CTGGAT chr2 60464620 60464639 60464623 -
cactaattatgagtctagtc

SEQ ID NO: 188519 - DNA, 20 bp, Artificial Sequence
  Synthetic oligonucleotide; TGGAGT chr2 60464571 60464590 60464574 -
aaatataattttaaggcatt

SEQ ID NO: 188520 - DNA, 20 bp, Artificial Sequence
  Synthetic oligonucleotide; TTGGAT chr2 60464547 60464566 60464550 -
gtgatgaacgtgttaaggac

SEQ ID NO: 188521 - DNA, 20 bp, Artificial Sequence
  Synthetic oligonucleotide; AGGAAT chr2 60464493 60464512 60464496 -
ctcagatcgtcaggctaaat

SEQ ID NO: 188522 - DNA, 20 bp, Artificial Sequence
  Synthetic oligonucleotide; GAGGAT chr2 60464444 60464463 60464447 -
aggacaaggaggaagccaca

SEQ ID NO: 188523 - DNA, 20 bp, Artificial Sequence
  Synthetic oligonucleotide; AGGAGT chr2 60464166 60464185 60464169 -
cttgtttaagagatttaccc

SEQ ID NO: 188524 - DNA, 20 bp, Artificial Sequence
  Synthetic oligonucleotide; TTGAGT chr2 60464152 60464171 60464155 -
ttacccaggagtgagatata

SEQ ID NO: 188525 - DNA, 20 bp, Artificial Sequence
  Synthetic oligonucleotide; TGGGAT chr2 60464147 60464166 60464150 -
caggagtgagatatattgag

SEQ ID NO: 188526 - DNA, 20 bp, Artificial Sequence
  Synthetic oligonucleotide; AGGAGT chr2 60464104 60464123 60464107 -
gtaaattacaaggtcagggc

SEQ ID NO: 188527 - DNA, 20 bp, Artificial Sequence
  Synthetic oligonucleotide; TGGAAT chr2 60464058 60464077 60464061 -
tgagcgaggctggcttattt

SEQ ID NO: 188528 - DNA, 20 bp, Artificial Sequence
  Synthetic oligonucleotide; CAGAAT chr2 60463804 60463823 60463807 -
tattttaaggcttttttttt

SEQ ID NO: 188529 - DNA, 20 bp, Artificial Sequence
  Synthetic oligonucleotide; TTGGGT chr2 60463577 60463596 60463580 -
caaagtggcatttaccactc

SEQ ID NO: 188530 - DNA, 20 bp, Artificial Sequence
  Synthetic oligonucleotide; CAGAGT chr2 60463506 60463525 60463509 -
cagacggcttggctactggc

SEQ ID NO: 188531 - DNA, 20 bp, Artificial Sequence
  Synthetic oligonucleotide; CTGAGT chr2 60463457 60463476 60463460 -
tgtttctttctcaactggag

SEQ ID NO: 188532 - DNA, 20 bp, Artificial Sequence
  Synthetic oligonucleotide; CAGGAT chr2 60463437 60463456 60463440 -
ctgagtcccagccgagggcg

SEQ ID NO: 188533 - DNA, 20 bp, Artificial Sequence
  Synthetic oligonucleotide; GAGGAT chr2 60463384 60463403 60463387 -
cctctcaaaacaatgaggag

SEQ ID NO: 188534 - DNA, 20 bp, Artificial Sequence
  Synthetic oligonucleotide; TAGGAT chr2 60463316 60463335 60463319 -
gttttaactgttccttaaac

SEQ ID NO: 188535 - DNA, 20 bp, Artificial Sequence
  Synthetic oligonucleotide; TTGGAT chr2 60463225 60463244 60463228 -
cgggggacaactcctaaaga

SEQ ID NO: 188536 - DNA, 20 bp, Artificial Sequence
  Synthetic oligonucleotide; CTGAAT chr2 60463201 60463220 60463204 -
atacagcctatccgttaaat

SEQ ID NO: 188537 - DNA, 20 bp, Artificial Sequence
  Synthetic oligonucleotide; TGGGGT chr2 60463139 60463158 60463142 -
gataaaaatggacgtcccca

SEQ ID NO: 188538 - DNA, 20 bp, Artificial Sequence
  Synthetic oligonucleotide; TGGGGT chr2 60463091 60463110 60463094 -
tcactgatcctcccacagtc

SEQ ID NO: 188539 - DNA, 20 bp, Artificial Sequence
  Synthetic oligonucleotide; GAGAAT chr2 60463083 60463102 60463086 -
cctcccacagtctggggtgt

SEQ ID NO: 188540 - DNA, 20 bp, Artificial Sequence
  Synthetic oligonucleotide; ATGAGT chr2 60463046 60463065 60463049 -
tttttccacggaagtatttt

SEQ ID NO: 188541 - DNA, 20 bp, Artificial Sequence
  Synthetic oligonucleotide; GTGAGT chr2 60462959 60462978 60462962 -
tagggccatagaacattgta

SEQ ID NO: 188542 - DNA, 20 bp, Artificial Sequence
  Synthetic oligonucleotide; GGGAAT chr2 60462881 60462900 60462884 -
agttcacctgtcacccaggg

SEQ ID NO: 188543 - DNA, 20 bp, Artificial Sequence
  Synthetic oligonucleotide; TGGGAT chr2 60462868 60462887 60462871 -
cccaggggggaatagaaagc

SEQ ID NO: 188544 - DNA, 20 bp, Artificial Sequence
  Synthetic oligonucleotide; TTGGGT chr2 60462841 60462860 60462844 -
taggaagccaaaaagtttcc

SEQ ID NO: 188545 - DNA, 20 bp, Artificial Sequence
  Synthetic oligonucleotide; TAGAAT chr2 60462716 60462735 60462719 -
aagacatttgttgaggtgcc

SEQ ID NO: 188546 - DNA, 20 bp, Artificial Sequence
  Synthetic oligonucleotide; CAGGAT chr2 60462678 60462697 60462681 -
atcctcaagccagaactggt

SEQ ID NO: 188547 - DNA, 20 bp, Artificial Sequence
  Synthetic oligonucleotide; GGGGAT chr2 60462661 60462680 60462664 -
ggtcaggatttttctgcttt

SEQ ID NO: 188548 - DNA, 20 bp, Artificial Sequence
  Synthetic oligonucleotide; TTGGAT chr2 60462656 60462675 60462659 -
ggatttttctgctttgggga

SEQ ID NO: 188549 - DNA, 20 bp, Artificial Sequence
  Synthetic oligonucleotide; CTGAGT chr2 60462635 60462654 60462638 -
tggatataaaatttctagaa

SEQ ID NO: 188550 - DNA, 20 bp, Artificial Sequence
  Synthetic oligonucleotide; CTGGGT chr2 60462595 60462614 60462598 -
atcaattggaccaatattta

SEQ ID NO: 188551 - DNA, 20 bp, Artificial Sequence
  Synthetic oligonucleotide; GGGGGT chr2 60462563 60462582 60462566 -
gctcagacgtgccaggcaca

SEQ ID NO: 188552 - DNA, 20 bp, Artificial Sequence
  Synthetic oligonucleotide; TGGGGT chr2 60462535 60462554 60462538 -
gtcagtgagggcttaggcct

SEQ ID NO: 188553 - DNA, 20 bp, Artificial Sequence
  Synthetic oligonucleotide; AGGGGT chr2 60462527 60462546 60462530 -
gggcttaggccttggggttg

SEQ ID NO: 188554 - DNA, 20 bp, Artificial Sequence
  Synthetic oligonucleotide; ATGGAT chr2 60462335 60462354 60462338 -
gcaacacgcacagaacactc

SEQ ID NO: 188555 - DNA, 20 bp, Artificial Sequence
  Synthetic oligonucleotide; AAGAAT chr2 60462328 60462347 60462331 -
gcacagaacactcatggatt

SEQ ID NO: 188556 - DNA, 20 bp, Artificial Sequence
  Synthetic oligonucleotide; GCGGGT chr2 60462286 60462305 60462289 -
cacggaagtcccctgacccc

SEQ ID NO: 188557 - DNA, 20 bp, Artificial Sequence
  Synthetic oligonucleotide; CAGAAT chr2 60462257 60462276 60462260 -
tatcccttcaggactaggtg

SEQ ID NO: 188558 - DNA, 20 bp, Artificial Sequence
  Synthetic oligonucleotide; TGGGAT chr2 60462229 60462248 60462232 -
ccttcccagccacctctcca

SEQ ID NO: 188559 - DNA, 20 bp, Artificial Sequence
  Synthetic oligonucleotide; AAGAAT chr2 60462190 60462209 60462193 -
aataacccctttaacctgct

SEQ ID NO: 188560 - DNA, 20 bp, Artificial Sequence
  Synthetic oligonucleotide; CAGGAT chr2 60462182 60462201 60462185 -
ctttaacctgctaagaatac

SEQ ID NO: 188561 - DNA, 20 bp, Artificial Sequence
  Synthetic oligonucleotide; CCGAGT chr2 60462033 60462052 60462036 -
tggccctggccacccatcac

SEQ ID NO: 188562 - DNA, 20 bp, Artificial Sequence
  Synthetic oligonucleotide; CAGGGT chr2 60462019 60462038 60462022 -
catcacccgagtgcctttga

SEQ ID NO: 188563 - DNA, 20 bp, Artificial Sequence
  Synthetic oligonucleotide; TTGAAT chr2 60462006 60462025 60462009 -
cctttgacagggtgctgcgg

SEQ ID NO: 188564 - DNA, 20 bp, Artificial Sequence
  Synthetic oligonucleotide; ATGGAT chr2 60461976 60461995 60461979 -
tggctatggagcctcccgcc

SEQ ID NO: 188565 - DNA, 20 bp, Artificial Sequence
  Synthetic oligonucleotide; GCGAGT chr2 60461777 60461796 60461780 -
cccggtcaagtccaagtcat

SEQ ID NO: 188566 - DNA, 20 bp, Artificial Sequence
  Synthetic oligonucleotide; GAGGGT chr2 60461386 60461405 60461389 -
gaggagctgacggagagcga

SEQ ID NO: 188567 - DNA, 20 bp, Artificial Sequence
  Synthetic oligonucleotide; GCGAGT chr2 60461138 60461157 60461141 -
cgacgaagactcggtggccg

SEQ ID NO: 188568 - DNA, 20 bp, Artificial Sequence
  Synthetic oligonucleotide; GCGAGT chr2 60461084 60461103 60461087 -
tggccgcggctgctccccgg

SEQ ID NO: 188569 - DNA, 20 bp, Artificial Sequence
  Synthetic oligonucleotide; AGGAGT chr2 60460994 60461013 60460997 -
taagcgcatcaagctcgaga

SEQ ID NO: 188570 - DNA, 20 bp, Artificial Sequence
  Synthetic oligonucleotide; GGGAGT chr2 60460830 60460849 60460833 -
cggagcactcctcggagaac

SEQ ID NO: 188571 - DNA, 20 bp, Artificial Sequence
  Synthetic oligonucleotide; AGGGAT chr2 60460789 60460808 60460792 -
ccgcccggggagctggacgg

SEQ ID NO: 188572 - DNA, 20 bp, Artificial Sequence
  Synthetic oligonucleotide; GTGAGT chr2 60460682 60460701 60460685 -
gggcagacgcagcgacactt

SEQ ID NO: 188573 - DNA, 20 bp, Artificial Sequence
  Synthetic oligonucleotide; CAGAGT chr2 60460572 60460591 60460575 -
tgtgcaactatgcctgtgcc

SEQ ID NO: 188574 - DNA, 20 bp, Artificial Sequence
  Synthetic oligonucleotide; TCGAGT chr2 60460438 60460457 60460441 -
atgaaaaaatggcacagtga

SEQ ID NO: 188575 - DNA, 20 bp, Artificial Sequence
  Synthetic oligonucleotide; TTGAAT chr2 60460431 60460450 60460434 -
aatggcacagtgatcgagtg

SEQ ID NO: 188576 - DNA, 20 bp, Artificial Sequence
  Synthetic oligonucleotide; CTGAAT chr2 60460412 60460431 60460415 -
gttgaataatgatataaaaa

SEQ ID NO: 188577 - DNA, 20 bp, Artificial Sequence
  Synthetic oligonucleotide; TAGGAT chr2 60460316 60460335 60460319 -
ccctccagccccactccctg

SEQ ID NO: 188578 - DNA, 20 bp, Artificial Sequence
  Synthetic oligonucleotide; AAGAAT chr2 60460252 60460271 60460255 -
caaacagaagtaacgaagct

SEQ ID NO: 188579 - DNA, 20 bp, Artificial Sequence
  Synthetic oligonucleotide; GAGAGT chr2 60460244 60460263 60460247 -
agtaacgaagctaagaatat

SEQ ID NO: 188580 - DNA, 20 bp, Artificial Sequence
  Synthetic oligonucleotide; TTGAAT chr2 60460151 60460170 60460154 -
ttcctttatgttctcaccgt

SEQ ID NO: 188581 - DNA, 20 bp, Artificial Sequence
  Synthetic oligonucleotide; TTGGAT chr2 60459857 60459876 60459860 -
gtgaggaggaaaaacagtct

SEQ ID NO: 188582 - DNA, 20 bp, Artificial Sequence
  Synthetic oligonucleotide; CAGAAT chr2 60459837 60459856 60459840 -
ttggattaaccctctataga

SEQ ID NO: 188583 - DNA, 20 bp, Artificial Sequence
  Synthetic oligonucleotide; AAGGGT chr2 60459785 60459804 60459788 -
gagctaaatgtctgtctcta

SEQ ID NO: 188584 - DNA, 20 bp, Artificial Sequence
  Synthetic oligonucleotide; TTGAAT chr2 60459745 60459764 60459748 -
ggaaaggaagaaaaaaggcc

SEQ ID NO: 188585 - DNA, 20 bp, Artificial Sequence
  Synthetic oligonucleotide; ATGAGT chr2 60459685 60459704 60459688 -
ctatcatttggttttaaaat

SEQ ID NO: 188586 - DNA, 20 bp, Artificial Sequence
  Synthetic oligonucleotide; TTGGAT chr2 60459676 60459695 60459679 -
ggttttaaaatatgagtgcc

SEQ ID NO: 188587 - DNA, 20 bp, Artificial Sequence
  Synthetic oligonucleotide; TTGGGT chr2 60459610 60459629 60459613 -
acttgtagcttaattcagca

SEQ ID NO: 188588 - DNA, 20 bp, Artificial Sequence
  Synthetic oligonucleotide; TTGAAT chr2 60459374 60459393 60459377 -
ttttttaaacaatgattaaa

SEQ ID NO: 188589 - DNA, 20 bp, Artificial Sequence
  Synthetic oligonucleotide; AGGAGT chr2 60459324 60459343 60459327 -
cgcaattaaatacactagta

SEQ ID NO: 188590 - DNA, 20 bp, Artificial Sequence
  Synthetic oligonucleotide; ATGAAT chr2 60459048 60459067 60459051 -
tgatacaatgatgattaact

SEQ ID NO: 188591 - DNA, 20 bp, Artificial Sequence
  Synthetic oligonucleotide; AAGAAT chr2 60458996 60459015 60458999 -
attcttaaaaaaagaagaga

SEQ ID NO: 188592 - DNA, 20 bp, Artificial Sequence
  Synthetic oligonucleotide; AAGAGT chr2 60458987 60459006 60458990 -
aaaagaagagaaagaatttt

SEQ ID NO: 188593 - DNA, 20 bp, Artificial Sequence
  Synthetic oligonucleotide; GAGGAT chr2 60458899 60458918 60458902 -
ctatttgtgttaacatggaa

SEQ ID NO: 188594 - DNA, 20 bp, Artificial Sequence
  Synthetic oligonucleotide; TTGAGT chr2 60458762 60458781 60458765 -
tctaatcagagatacagagg

SEQ ID NO: 188595 - DNA, 20 bp, Artificial Sequence
  Synthetic oligonucleotide; AAGAAT chr2 60458671 60458690 60458674 -
atacttaagggaaaagttgc

SEQ ID NO: 188596 - DNA, 20 bp, Artificial Sequence
  Synthetic oligonucleotide; GTGAAT chr2 60458541 60458560 60458544 -
gacgcaacattgcaagcgct

SEQ ID NO: 188597 - DNA, 20 bp, Artificial Sequence
  Synthetic oligonucleotide; CAGAAT chr2 60458530 60458549 60458533 -
gcaagcgctgtgaatggaaa

SEQ ID NO: 188598 - DNA, 20 bp, Artificial Sequence
  Synthetic oligonucleotide; ATGAAT chr2 60458509 60458528 60458512 -
agaatacacttaacatagaa

SEQ ID NO: 188599 - DNA, 20 bp, Artificial Sequence
  Synthetic oligonucleotide; AAGGAT chr2 60458480 60458499 60458483 -
tgctttcgcttctacagtgc

SEQ ID NO: 188600 - DNA, 20 bp, Artificial Sequence
  Synthetic oligonucleotide; TAGGGT chr2 60458386 60458405 60458389 -
tttaggggggaactgcattt

SEQ ID NO: 188601 - DNA, 20 bp, Artificial Sequence
  Synthetic oligonucleotide; TTGGAT chr2 60458314 60458333 60458317 -
ggtagtggaaattctatgcc

SEQ ID NO: 188602 - DNA, 20 bp, Artificial Sequence
  Synthetic oligonucleotide; TAGAAT chr2 60458167 60458186 60458170 -
tggtcttttttctgtatttc

SEQ ID NO: 188603 - DNA, 20 bp, Artificial Sequence
  Synthetic oligonucleotide; TTGAAT chr2 60458156 60458175 60458159 -
ctgtatttctagaatggtat

SEQ ID NO: 188604 - DNA, 20 bp, Artificial Sequence
  Synthetic oligonucleotide; CAGGAT chr2 60458001 60458020 60458004 -
agtatatttttttaatttgg

SEQ ID NO: 188605 - DNA, 20 bp, Artificial Sequence
  Synthetic oligonucleotide; TAGAAT chr2 60457887 60457906 60457890 -
ggcggtttgggggagcctgc

SEQ ID NO: 188606 - DNA, 20 bp, Artificial Sequence
  Synthetic oligonucleotide; ATGGAT chr2 60457876 60457895 60457879 -
ggagcctgctagaatgtcac

SEQ ID NO: 188607 - DNA, 20 bp, Artificial Sequence
  Synthetic oligonucleotide; AGGGGT chr2 60457861 60457880 60457864 -
gtcacatggatggctgtcat

SEQ ID NO: 188608 - DNA, 20 bp, Artificial Sequence
  Synthetic oligonucleotide; AAGAAT chr2 60457610 60457629 60457613 -
tgctttatatttagattgga

SEQ ID NO: 188609 - DNA, 20 bp, Artificial Sequence
  Synthetic oligonucleotide; CAGAAT chr2 60457539 60457558 60457542 -
cttttttgtaaatggcaatg

SEQ ID NO: 188610 - DNA, 20 bp, Artificial Sequence
  Synthetic oligonucleotide; GGGAGT chr2 60457460 60457479 60457463 -
gaaattttatcttttactat

SEQ ID NO: 188611 - DNA, 20 bp, Artificial Sequence
  Synthetic oligonucleotide; CAGGAT chr2 60457102 60457121 60457105 -
gaaggccagtcagtcttttt

SEQ ID NO: 188612 - DNA, 20 bp, Artificial Sequence
  Synthetic oligonucleotide; TAGAAT chr2 60456983 60457002 60456986 -
agttttaaggctttccagtt

SEQ ID NO: 188613 - DNA, 20 bp, Artificial Sequence
  Synthetic oligonucleotide; AAGAGT chr2 60456731 60456750 60456734 -
cagctctttggtttccatgt

SEQ ID NO: 188614 - DNA, 20 bp, Artificial Sequence
  Synthetic oligonucleotide; AGGGGT chr2 60456583 60456602 60456586 -
aagaaaagaaagcagccact

SEQ ID NO: 188615 - DNA, 20 bp, Artificial Sequence
  Synthetic oligonucleotide; TGGAAT chr2 60456554 60456573 60456557 -
gccagacatagtgaaatctt

SEQ ID NO: 188616 - DNA, 20 bp, Artificial Sequence
  Synthetic oligonucleotide; TAGGGT chr2 60456455 60456474 60456458 -
gattactttaggtgttttga

SEQ ID NO: 188617 - DNA, 20 bp, Artificial Sequence
  Synthetic oligonucleotide; CTGGAT chr2 60456445 60456464 60456448 -
ggtgttttgatagggtcttc

SEQ ID NO: 188618 - DNA, 20 bp, Artificial Sequence
  Synthetic oligonucleotide; GGGAAT chr2 60456423 60456442 60456426 -
ggatgacagcaaataagggc

SEQ ID NO: 188619 - DNA, 20 bp, Artificial Sequence
  Synthetic oligonucleotide; ATGAAT chr2 60456264 60456283 60456267 -
tgtccctgttcccagtgtag

SEQ ID NO: 188620 - DNA, 20 bp, Artificial Sequence
  Synthetic oligonucleotide; ATGAAT chr2 60456260 60456279 60456263 -
cctgttcccagtgtagatga

SEQ ID NO: 188621 - DNA, 20 bp, Artificial Sequence
  Synthetic oligonucleotide; AAGAAT chr2 60456114 60456133 60456117 -
tcatgccttttatctgaggc

SEQ ID NO: 188622 - DNA, 20 bp, Artificial Sequence
  Synthetic oligonucleotide; TTGGGT chr2 60456056 60456075 60456059 -
atgttttctgaaaagccagt

SEQ ID NO: 188623 - DNA, 20 bp, Artificial Sequence
  Synthetic oligonucleotide; GAGAGT chr2 60456042 60456061 60456045 -
gccagtttgggtgggaagga

SEQ ID NO: 188624 - DNA, 20 bp, Artificial Sequence
  Synthetic oligonucleotide; AGGAAT chr2 60456028 60456047 60456031 -
gaaggagagagtggggctag

SEQ ID NO: 188625 - DNA, 20 bp, Artificial Sequence
  Synthetic oligonucleotide; AAGGAT chr2 60456013 60456032 60456016 -
gctagaggaatccactgaga

SEQ ID NO: 188626 - DNA, 20 bp, Artificial Sequence
  Synthetic oligonucleotide; GAGAAT chr2 60456003 60456022 60456006 -
tccactgagaaaggatgttg

SEQ ID NO: 188627 - DNA, 20 bp, Artificial Sequence
  Synthetic oligonucleotide; TGGGGT chr2 60455984 60456003 60455987 -
ggagaatattacataggagg

SEQ ID NO: 188628 - DNA, 20 bp, Artificial Sequence
  Synthetic oligonucleotide; TGGGGT chr2 60455979 60455998 60455982 -
atattacataggaggtgggg

SEQ ID NO: 188629 - DNA, 20 bp, Artificial Sequence
  Synthetic oligonucleotide; TTGGAT chr2 60455907 60455926 60455910 -
aaagatatactgtatgtgtt

SEQ ID NO: 188630 - DNA, 20 bp, Artificial Sequence
  Synthetic oligonucleotide; CTGAAT chr2 60455886 60455905 60455889 -
tggattaggtttctccaaaa

SEQ ID NO: 188631 - DNA, 20 bp, Artificial Sequence
  Synthetic oligonucleotide; ATGAGT chr2 60455747 60455766 60455750 -
ttactcttttattaggagct

SEQ ID NO: 188632 - DNA, 20 bp, Artificial Sequence
  Synthetic oligonucleotide; CAGAAT chr2 60455653 60455672 60455656 -
aggttttgcatcctgacaga

SEQ ID NO: 188633 - DNA, 20 bp, Artificial Sequence
  Synthetic oligonucleotide; GTGGAT chr2 60455642 60455661 60455645 -
cctgacagacagaattaatg

SEQ ID NO: 188634 - DNA, 20 bp, Artificial Sequence
  Synthetic oligonucleotide; GGGAAT chr2 60455598 60455617 60455601 -
caaatttcttaaatcaaatg

SEQ ID NO: 188635 - DNA, 20 bp, Artificial Sequence
  Synthetic oligonucleotide; AGGAGT chr2 60455588 60455607 60455591 -
aaatcaaatggggaatgggg

SEQ ID NO: 188636 - DNA, 20 bp, Artificial Sequence
  Synthetic oligonucleotide; ATGGGT chr2 60455509 60455528 60455512 -
ttaaataaatttactgggag

SEQ ID NO: 188637 - DNA, 20 bp, Artificial Sequence
  Synthetic oligonucleotide; ATGAAT chr2 60455318 60455337 60455321 -
tgcacatttccaatagtaag

SEQ ID NO: 188638 - DNA, 20 bp, Artificial Sequence
  Synthetic oligonucleotide; TGGAAT chr2 60455218 60455237 60455221 -
taacaggcttgacgtgctga

SEQ ID NO: 188639 - DNA, 20 bp, Artificial Sequence
  Synthetic oligonucleotide; AGGAAT chr2 60455142 60455161 60455145 -
ttgagaacaacttaataaac

SEQ ID NO: 188640 - DNA, 20 bp, Artificial Sequence
  Synthetic oligonucleotide; TTGAGT chr2 60454936 60454955 60454939 -
tggcagaaagtgtgaagtag

SEQ ID NO: 188641 - DNA, 20 bp, Artificial Sequence
  Synthetic oligonucleotide; TGGGAT chr2 60454728 60454747 60454731 -
cacagtttgctgaaaggtac

SEQ ID NO: 188642 - DNA, 20 bp, Artificial Sequence
  Synthetic oligonucleotide; AGGAGT chr2 60454702 60454721 60454705 -
tatttcgggccttcctgaaa

SEQ ID NO: 188643 - DNA, 20 bp, Artificial Sequence
  Synthetic oligonucleotide; AGGAAT chr2 60454497 60454516 60454500 -
tccctgggcctggtgtgttc

SEQ ID NO: 188644 - DNA, 20 bp, Artificial Sequence
  Synthetic oligonucleotide; GAGGAT chr2 60454421 60454440 60454424 -
tgtgggaactttgccgatat

SEQ ID NO: 188645 - DNA, 20 bp, Artificial Sequence
  Synthetic oligonucleotide; TGGGAT chr2 60454416 60454435 60454419 -
gaactttgccgatatgagga

SEQ ID NO: 188646 - DNA, 20 bp, Artificial Sequence
  Synthetic oligonucleotide; CAGAGT chr2 60454407 60454426 60454410 -
cgatatgaggatgggattgg

SEQ ID NO: 188647 - DNA, 20 bp, Artificial Sequence
  Synthetic oligonucleotide; GGGAAT chr2 60454239 60454258 60454242 -
tggacatcagaacacataga

SEQ ID NO: 188648 - DNA, 20 bp, Artificial Sequence
  Synthetic oligonucleotide; ATGGGT chr2 60454183 60454202 60454186 -
tatagctatgaactgtggac

SEQ ID NO: 188649 - DNA, 20 bp, Artificial Sequence
  Synthetic oligonucleotide; GGGAAT chr2 60454079 60454098 60454082 -
gccagtgactcagcctttag

SEQ ID NO: 188650 - DNA, 20 bp, Artificial Sequence
  Synthetic oligonucleotide; TGGGAT chr2 60454009 60454028 60454012 -
cccagcgtcatctacggtca

SEQ ID NO: 188651 - DNA, 20 bp, Artificial Sequence
  Synthetic oligonucleotide; ACGGGT chr2 60453955 60453974 60453958 -
aagagaccaatccagttcac

SEQ ID NO: 188652 - DNA, 20 bp, Artificial Sequence
  Synthetic oligonucleotide; AGGGAT chr2 60453829 60453848 60453832 -
acgtgtatcagatctttcat

SEQ ID NO: 188653 - DNA, 20 bp, Artificial Sequence
  Synthetic oligonucleotide; TAGAAT chr2 60453697 60453716 60453700 -
ccatgatatactttgtctat

SEQ ID NO: 188654 - DNA, 20 bp, Artificial Sequence
  Synthetic oligonucleotide; TTGAAT chr2 60453691 60453710 60453694 -
tatactttgtctattagaat

SEQ ID NO: 188655 - DNA, 20 bp, Artificial Sequence
  Synthetic oligonucleotide; AAGGGT chr2 60453665 60453684 60453668 -
attggtagcaggttggacga

SEQ ID NO: 188656 - DNA, 20 bp, Artificial Sequence
  Synthetic oligonucleotide; TGGGGT chr2 60453654 60453673 60453657 -
gttggacgaaagggtttgat

SEQ ID NO: 188657 - DNA, 20 bp, Artificial Sequence
  Synthetic oligonucleotide; GGGAAT chr2 60453605 60453624 60453608 -
cagtgacttagcgctggact

SEQ ID NO: 188658 - DNA, 20 bp, Artificial Sequence
  Synthetic oligonucleotide; TGGGAT chr2 60453600 60453619 60453603 -
acttagcgctggactgggaa

SEQ ID NO: 188659 - DNA, 20 bp, Artificial Sequence
  Synthetic oligonucleotide; AGGGGT chr2 60453535 60453554 60453538 -
aggtctccgctgctctgctc

SEQ ID NO: 188660 - DNA, 20 bp, Artificial Sequence
  Synthetic oligonucleotide; TGGGAT chr2 60453530 60453549 60453533 -
tccgctgctctgctcagggg

SEQ ID NO: 188661 - DNA, 20 bp, Artificial Sequence
  Synthetic oligonucleotide; TCGGGT chr2 60453446 60453465 60453449 -
ggaggccccaggcccctgct

SEQ ID NO: 188662 - DNA, 20 bp, Artificial Sequence
  Synthetic oligonucleotide; TGGAAT chr2 60453422 60453441 60453425 -
gtcgccatggcaacgaggcc

SEQ ID NO: 188663 - DNA, 20 bp, Artificial Sequence
  Synthetic oligonucleotide; TTGGGT chr2 60453207 60453226 60453210 -
gcaatttgagagcaactctt

SEQ ID NO: 188664 - DNA, 20 bp, Artificial Sequence
  Synthetic oligonucleotide; CCGAGT chr2 60452948 60452967 60452951 -
tgtttccttccaggtgtgtc

SEQ ID NO: 188665 - DNA, 20 bp, Artificial Sequence
  Synthetic oligonucleotide; AGGGGT chr2 60452916 60452935 60452919 -
ggactatcatacaattgggc

SEQ ID NO: 188666 - DNA, 20 bp, Artificial Sequence
  Synthetic oligonucleotide; CTGGGT chr2 60452902 60452921 60452905 -
ttgggcaggggtggggggac

SEQ ID NO: 188667 - DNA, 20 bp, Artificial Sequence
  Synthetic oligonucleotide; CTGAGT chr2 60452822 60452841 60452825 -
agatacttggggaggggagg

SEQ ID NO: 188668 - DNA, 20 bp, Artificial Sequence
  Synthetic oligonucleotide; TCGGAT chr2 60452608 60452627 60452611 -
ctcaagatgtgtggcagttt

SEQ ID NO: 188669 - DNA, 20 bp, Artificial Sequence
  Synthetic oligonucleotide; AGGGGT chr2 60452558 60452577 60452561 -
tgagaaaatttgaagccccc

SEQ ID NO: 188670 - DNA, 20 bp, Artificial Sequence
  Synthetic oligonucleotide; TGGGGT chr2 60452553 60452572 60452556 -
aaatttgaagcccccagggg

SEQ ID NO: 188671 - DNA, 20 bp, Artificial Sequence
  Synthetic oligonucleotide; CAGAGT chr2 60452451 60452470 60452454 -
aagaagccgttgtgcgaaga

SEQ ID NO: 188672 - DNA, 20 bp, Artificial Sequence
  Synthetic oligonucleotide; CAGAGT chr2 60452441 60452460 60452444 -
tgtgcgaagacagagtcctg

SEQ ID NO: 188673 - DNA, 20 bp, Artificial Sequence
  Synthetic oligonucleotide; GTGAAT chr2 60452351 60452370 60452354 -
aacagacccacattggaaca

SEQ ID NO: 188674 - DNA, 20 bp, Artificial Sequence
  Synthetic oligonucleotide; ATGAGT chr2 60452309 60452328 60452312 -
gcccgtggaccatcgctgtc

SEQ ID NO: 188675 - DNA, 20 bp, Artificial Sequence
  Synthetic oligonucleotide; ATGAGT chr2 60452246 60452265 60452249 -
cctgtattgtggaaatgcgc

SEQ ID NO: 188676 - DNA, 20 bp, Artificial Sequence
  Synthetic oligonucleotide; TCGGGT chr2 60452063 60452082 60452066 -
ctgtttcctacagacaccca

SEQ ID NO: 188677 - DNA, 20 bp, Artificial Sequence
  Synthetic oligonucleotide; GTGGGT chr2 60452059 60452078 60452062 -
ttcctacagacacccatcgg

SEQ ID NO: 188678 - DNA, 20 bp, Artificial Sequence
  Synthetic oligonucleotide; GAGAAT chr2 60451971 60451990 60451974 -
agatggcataaattttcaag

SEQ ID NO: 188679 - DNA, 20 bp, Artificial Sequence
  Synthetic oligonucleotide; GGGAAT chr2 60451950 60451969 60451953 -
agaatcaaaatgcaaaactt

SEQ ID NO: 188680 - DNA, 20 bp, Artificial Sequence
  Synthetic oligonucleotide; CCGAAT chr2 60451821 60451840 60451824 -
ataatgcataatatggcacg

SEQ ID NO: 188681 - DNA, 20 bp, Artificial Sequence
  Synthetic oligonucleotide; CAGGAT chr2 60451778 60451797 60451781 -
tgcttttggtggctaccatg

SEQ ID NO: 188682 - DNA, 20 bp, Artificial Sequence
  Synthetic oligonucleotide; TTGAAT chr2 60451772 60451791 60451775 -
tggtggctaccatgcaggat

SEQ ID NO: 188683 - DNA, 20 bp, Artificial Sequence
  Synthetic oligonucleotide; GAGAAT chr2 60451382 60451401 60451385 -
tactgcttggagatccagaa

SEQ ID NO: 188684 - DNA, 20 bp, Artificial Sequence
  Synthetic oligonucleotide; GTGAAT chr2 60451210 60451229 60451213 -
gatagccaaataattggcat

SEQ ID NO: 188685 - DNA, 20 bp, Artificial Sequence
  Synthetic oligonucleotide; GGGAGT chr2 60450943 60450962 60450946 -
actctgtttaactgatcaaa

SEQ ID NO: 188686 - DNA, 20 bp, Artificial Sequence
  Synthetic oligonucleotide; CAGGAT chr2 60450866 60450885 60450869 -
gtggcttacacatacagacc

SEQ ID NO: 188687 - DNA, 20 bp, Artificial Sequence
  Synthetic oligonucleotide; CAGAGT chr2 60450841 60450860 60450844 -
tggcctttggtaaaggcatg

SEQ ID NO: 188688 - DNA, 20 bp, Artificial Sequence
  Synthetic oligonucleotide; ACGAGT chr2 60450731 60450750 60450734 -
tgacaaataaccctgattgc

SEQ ID NO: 188689 - DNA, 20 bp, Artificial Sequence
  Synthetic oligonucleotide; TAGGGT chr2 60450609 60450628 60450612 -
ttgctgaaacataagaccat

SEQ ID NO: 188690 - DNA, 20 bp, Artificial Sequence
  Synthetic oligonucleotide; AAGAGT chr2 60450551 60450570 60450554 -
actccttgctgatgcctaga

SEQ ID NO: 188691 - DNA, 20 bp, Artificial Sequence
  Synthetic oligonucleotide; CTGGGT chr2 60450504 60450523 60450507 -
ccagaactgaaacaacaatc

SEQ ID NO: 188692 - DNA, 20 bp, Artificial Sequence
  Synthetic oligonucleotide; CAGAGT chr2 60450402 60450421 60450405 -
actttttatatatttcttct

SEQ ID NO: 188693 - DNA, 20 bp, Artificial Sequence
  Synthetic oligonucleotide; GTGGAT chr2 60450382 60450401 60450385 -
cagagtcagtttgtaaataa

SEQ ID NO: 188694 - DNA, 20 bp, Artificial Sequence
  Synthetic oligonucleotide; TGGGAT chr2 60450365 60450384 60450368 -
taagtggatatctctaaaag

SEQ ID NO: 188695 - DNA, 20 bp, Artificial Sequence
  Synthetic oligonucleotide; GAGGAT chr2 60450346 60450365 60450349 -
gtgggatttttaaggggcaa

SEQ ID NO: 188696 - DNA, 20 bp, Artificial Sequence
  Synthetic oligonucleotide; GTGGAT chr2 60450333 60450352 60450336 -
ggggcaagaggataacagaa

SEQ ID NO: 188697 - DNA, 20 bp, Artificial Sequence
  Synthetic oligonucleotide; AAGGAT chr2 60450326 60450345 60450329 -
gaggataacagaagtggata

SEQ ID NO: 188698 - DNA, 20 bp, Artificial Sequence
  Synthetic oligonucleotide; CAGAAT chr2 60450211 60450230 60450214 -
agacaacaaaaatttattta

SEQ ID NO: 188699 - DNA, 20 bp, Artificial Sequence
  Synthetic oligonucleotide; CAGAAT chr2 60450142 60450161 60450145 -
ttttttttttttttttaaga

SEQ ID NO: 188700 - DNA, 20 bp, Artificial Sequence
  Synthetic oligonucleotide; TGGAGT chr2 60450117 60450136 60450120 -
tctcgctctgtcacccaggc

SEQ ID NO: 188701 - DNA, 20 bp, Artificial Sequence
  Synthetic oligonucleotide; CTGGGT chr2 60450073 60450092 60450076 -
ctcaccacaacctccgccta

SEQ ID NO: 188702 - DNA, 20 bp, Artificial Sequence
  Synthetic oligonucleotide; AGGGAT chr2 60450064 60450083 60450067 -
acctccgcctactgggttca

SEQ ID NO: 188703 - DNA, 20 bp, Artificial Sequence
  Synthetic oligonucleotide; CAGGAT chr2 60449953 60449972 60449956 -
cggcgtttcaccgtgttagc

SEQ ID NO: 188704 - DNA, 20 bp, Artificial Sequence
  Synthetic oligonucleotide; TGGGAT chr2 60449896 60449915 60449899 -
tcctaggcctcccatagtgc

SEQ ID NO: 188705 - DNA, 20 bp, Artificial Sequence
  Synthetic oligonucleotide; ATGAGT chr2 60449800 60449819 60449803 -
ggaagacatctctctgtgtg

SEQ ID NO: 188706 - DNA, 20 bp, Artificial Sequence
  Synthetic oligonucleotide; ATGAAT chr2 60449777 60449796 60449780 -
agtcaagatcatggttatcc

SEQ ID NO: 188707 - DNA, 20 bp, Artificial Sequence
  Synthetic oligonucleotide; AGGGGT chr2 60449738 60449757 60449741 -
aagaggctcacaaatctgcc

SEQ ID NO: 188708 - DNA, 20 bp, Artificial Sequence
  Synthetic oligonucleotide; CAGAGT chr2 60449713 60449732 60449716 -
ttctcactgtgtcctctctg

SEQ ID NO: 188709 - DNA, 20 bp, Artificial Sequence
  Synthetic oligonucleotide; CAGAGT chr2 60449649 60449668 60449652 -
catgagcacagactagagga

SEQ ID NO: 188710 - DNA, 20 bp, Artificial Sequence
  Synthetic oligonucleotide; TTGGAT chr2 60449634 60449653 60449637 -
gaggacagagtcccagccac

SEQ ID NO: 188711 - DNA, 20 bp, Artificial Sequence
  Synthetic oligonucleotide; TGGAGT chr2 60449513 60449532 60449516 -
tattattattattgttgaga

SEQ ID NO: 188712 - DNA, 20 bp, Artificial Sequence
  Synthetic oligonucleotide; TGGAGT chr2 60449488 60449507 60449491 -
tctcactctattgcccaggc

SEQ ID NO: 188713 - DNA, 20 bp, Artificial Sequence
  Synthetic oligonucleotide; CCGGGT chr2 60449444 60449463 60449447 -
ctcactgcaacctctacctc

SEQ ID NO: 188714 - DNA, 20 bp, Artificial Sequence
  Synthetic oligonucleotide; CTGAGT chr2 60449412 60449431 60449415 -
ggttctcctgcctcagcctc

SEQ ID NO: 188715 - DNA, 20 bp, Artificial Sequence
  Synthetic oligonucleotide; TGGGAT chr2 60449403 60449422 60449406 -
gcctcagcctcctgagtggc

SEQ ID NO: 188716 - DNA, 20 bp, Artificial Sequence
  Synthetic oligonucleotide; CGGGGT chr2 60449352 60449371 60449355 -
ttttgtatttttagtagaga

SEQ ID NO: 188717 - DNA, 20 bp, Artificial Sequence
  Synthetic oligonucleotide; TGGGAT chr2 60449275 60449294 60449278 -
gcctcggcctcccaaagtgc

SEQ ID NO: 188718 - DNA, 20 bp, Artificial Sequence
  Synthetic oligonucleotide; TAGAAT chr2 60449212 60449231 60449215 -
actgtataaaaaaggtctgt

SEQ ID NO: 188719 - DNA, 20 bp, Artificial Sequence
  Synthetic oligonucleotide; TGGGGT chr2 60449206 60449225 60449209 -
taaaaaaggtctgttagaat

SEQ ID NO: 188720 - DNA, 20 bp, Artificial Sequence
  Synthetic oligonucleotide; TTGAAT chr2 60449145 60449164 60449148 -
agcacccagcatccagcatg

SEQ ID NO: 188721 - DNA, 20 bp, Artificial Sequence
  Synthetic oligonucleotide; AGGAGT chr2 60449075 60449094 60449078 -
ttaaagaaaactcttaggca

SEQ ID NO: 188722 - DNA, 20 bp, Artificial Sequence
  Synthetic oligonucleotide; TGGAAT chr2 60449062 60449081 60449065 -
ttaggcaaggagtgcaatct

SEQ ID NO: 188723 - DNA, 20 bp, Artificial Sequence
  Synthetic oligonucleotide; CTGAGT chr2 60449042 60449061 60449045 -
tggaatctgctgaggtctaa

SEQ ID NO: 188724 - DNA, 20 bp, Artificial Sequence
  Synthetic oligonucleotide; TGGAGT chr2 60448996 60449015 60448999 -
attttctgggcacttttgct

SEQ ID NO: 188725 - DNA, 20 bp, Artificial Sequence
  Synthetic oligonucleotide; AGGAAT chr2 60448948 60448967 60448951 -
accaagcccttcaagtggtc

SEQ ID NO: 188726 - DNA, 20 bp, Artificial Sequence
  Synthetic oligonucleotide; TAGGAT chr2 60448792 60448811 60448795 -
agtgtccccggaagtaatag

SEQ ID NO: 188727 - DNA, 20 bp, Artificial Sequence
  Synthetic oligonucleotide; TAGAAT chr2 60448786 60448805 60448789 -
cccggaagtaatagtaggat

SEQ ID NO: 188728 - DNA, 20 bp, Artificial Sequence
  Synthetic oligonucleotide; TGGAGT chr2 60448718 60448737 60448721 -
cacatagctttgactccttt

SEQ ID NO: 188729 - DNA, 20 bp, Artificial Sequence
  Synthetic oligonucleotide; AGGAAT chr2 60448689 60448708 60448692 -
gtgtgaaggaagcagatttg

SEQ ID NO: 188730 - DNA, 20 bp, Artificial Sequence
  Synthetic oligonucleotide; TTGAGT chr2 60448682 60448701 60448685 -
ggaagcagatttgaggaatt

SEQ ID NO: 188731 - DNA, 20 bp, Artificial Sequence
  Synthetic oligonucleotide; AAGAGT chr2 60448626 60448645 60448629 -
caagcacaccttccttcttc

SEQ ID NO: 188732 - DNA, 20 bp, Artificial Sequence
  Synthetic oligonucleotide; TTGAGT chr2 60448615 60448634 60448618 -
tccttcttcaagagttcatc

SEQ ID NO: 188733 - DNA, 20 bp, Artificial Sequence
  Synthetic oligonucleotide; TGGAGT chr2 60448528 60448547 60448531 -
ctcttcagtttgcattcccc

SEQ ID NO: 188734 - DNA, 20 bp, Artificial Sequence
  Synthetic oligonucleotide; TAGGAT chr2 60448444 60448463 60448447 -
ttttctatcttagtttaaat

SEQ ID NO: 188735 - DNA, 20 bp, Artificial Sequence
  Synthetic oligonucleotide; TAGAAT chr2 60448362 60448381 60448365 -
caggaagtacttaagcttta

SEQ ID NO: 188736 - DNA, 20 bp, Artificial Sequence
  Synthetic oligonucleotide; TAGAAT chr2 60448340 60448359 60448343 -
gaatacttttatatacatga

SEQ ID NO: 188737 - DNA, 20 bp, Artificial Sequence
  Synthetic oligonucleotide; AAGAAT chr2 60448299 60448318 60448302 -
ttctataaattagataagaa

SEQ ID NO: 188738 - DNA, 20 bp, Artificial Sequence
  Synthetic oligonucleotide; AGGAAT chr2 60448279 60448298 60448282 -
aagaatagactgaagttgaa

SEQ ID NO: 188739 - DNA, 20 bp, Artificial Sequence
  Synthetic oligonucleotide; CAGAAT chr2 60448248 60448267 60448251 -
taatcactcattttagagat

SEQ ID NO: 188740 - DNA, 20 bp, Artificial Sequence
  Synthetic oligonucleotide; ATAGAAT chr2 60448293 60448312 60448309 +
attcttttcttatctaattt

SEQ ID NO: 188741 - DNA, 20 bp, Artificial Sequence
  Synthetic oligonucleotide; AAAGAAA chr2 60448388 60448407 60448404 +
ttttttaaaatacaaagcaa

SEQ ID NO: 188742 - DNA, 20 bp, Artificial Sequence
  Synthetic oligonucleotide; ATAGAAA chr2 60448436 60448455 60448452 +
atatcctaatttaaactaag

SEQ ID NO: 188743 - DNA, 20 bp, Artificial Sequence
  Synthetic oligonucleotide; AAAGAAA chr2 60448554 60448573 60448570 +
ctctcctaggcagtcagagg

SEQ ID NO: 188744 - DNA, 20 bp, Artificial Sequence
  Synthetic oligonucleotide; TAAGAAT chr2 60448803 60448822 60448819 +
ggggacactgatttataaaa

SEQ ID NO: 188745 - DNA, 20 bp, Artificial Sequence
  Synthetic oligonucleotide; TAAGAAT chr2 60448817 60448836 60448833 +
ataaaataagaattataaaa

SEQ ID NO: 188746 - DNA, 20 bp, Artificial Sequence
  Synthetic oligonucleotide; CCAGAAA chr2 60448987 60449006 60449003 +
gaaactccaagcaaaagtgc

SEQ ID NO: 188747 - DNA, 20 bp, Artificial Sequence
  Synthetic oligonucleotide; GAAGAAA chr2 60450383 60450402 60450399 +
tatttacaaactgactctga

SEQ ID NO: 188748 - DNA, 20 bp, Artificial Sequence
  Synthetic oligonucleotide; GTAGAAA chr2 60450406 60450425 60450422 +
gaaatatataaaaagtgggg

SEQ ID NO: 188749 - DNA, 20 bp, Artificial Sequence
  Synthetic oligonucleotide; CCAGAAA chr2 60450419 60450438 60450435 +
agtgggggtagaaacacaga

SEQ ID NO: 188750 - DNA, 20 bp, Artificial Sequence
  Synthetic oligonucleotide; ACAGAAA chr2 60450577 60450596 60450593 +
catttagggaggaagccatc

SEQ ID NO: 188751 - DNA, 20 bp, Artificial Sequence
  Synthetic oligonucleotide; CAAGAAA chr2 60450963 60450982 60450979 +
ttggtgaaattagctctgga

SEQ ID NO: 188752 - DNA, 20 bp, Artificial Sequence
  Synthetic oligonucleotide; CCAGAAA chr2 60450970 60450989 60450986 +
aattagctctggacaagaaa

SEQ ID NO: 188753 - DNA, 20 bp, Artificial Sequence
  Synthetic oligonucleotide; TGAGAAA chr2 60451395 60451414 60451411 +
agcagtaaaaaataccaaac

SEQ ID NO: 188754 - DNA, 20 bp, Artificial Sequence
  Synthetic oligonucleotide; CCAGAAA chr2 60451424 60451443 60451440 +
ttctgtgcaaattaactggg

SEQ ID NO: 188755 - DNA, 20 bp, Artificial Sequence
  Synthetic oligonucleotide; AAAGAAT chr2 60451428 60451447 60451444 +
gtgcaaattaactgggccag

SEQ ID NO: 188756 - DNA, 20 bp, Artificial Sequence
  Synthetic oligonucleotide; TTAGAAT chr2 60451649 60451668 60451665 +
gaaggtttgggaacctaaaa

SEQ ID NO: 188757 - DNA, 20 bp, Artificial Sequence
  Synthetic oligonucleotide; TAAGAAA chr2 60451662 60451681 60451678 +
cctaaaattagaatatttaa

SEQ ID NO: 188758 - DNA, 20 bp, Artificial Sequence
  Synthetic oligonucleotide; ATAGAAT chr2 60452191 60452210 60452207 +
cacactttttaaaagacaac

SEQ ID NO: 188759 - DNA, 20 bp, Artificial Sequence
  Synthetic oligonucleotide; ATAGAAA chr2 60452200 60452219 60452216 +
taaaagacaacatagaatgt

SEQ ID NO: 188760 - DNA, 20 bp, Artificial Sequence
  Synthetic oligonucleotide; TCAGAAA chr2 60452462 60452481 60452478 +
cggcttcttggaggctactg

SEQ ID NO: 188761 - DNA, 20 bp, Artificial Sequence
  Synthetic oligonucleotide; CTAGAAA chr2 60452647 60452666 60452663 +
aatgggggtgtgtgaagaac

SEQ ID NO: 188762 - DNA, 20 bp, Artificial Sequence
  Synthetic oligonucleotide; TGAGAAA chr2 60452962 60452981 60452978 +
gaaacacttgcccttatgac

SEQ ID NO: 188763 - DNA, 20 bp, Artificial Sequence
  Synthetic oligonucleotide; TAAGAAA chr2 60452975 60452994 60452991 +
ttatgactgagaaaacttag

SEQ ID NO: 188764 - DNA, 20 bp, Artificial Sequence
  Synthetic oligonucleotide; AAAGAAA chr2 60453056 60453075 60453072 +
caaaataataataaaattat

SEQ ID NO: 188765 - DNA, 20 bp, Artificial Sequence
  Synthetic oligonucleotide; AGAGAAA chr2 60453168 60453187 60453184 +
agaggcgaacaaatctctga

SEQ ID NO: 188766 - DNA, 20 bp, Artificial Sequence
  Synthetic oligonucleotide; ACAGAAA chr2 60453857 60453876 60453873 +
gaaatagtttttgccacttt

SEQ ID NO: 188767 - DNA, 20 bp, Artificial Sequence
  Synthetic oligonucleotide; AGAGAAA chr2 60454019 60454038 60454035 +
tgacgctgggaaatagagag

SEQ ID NO: 188768 - DNA, 20 bp, Artificial Sequence
  Synthetic oligonucleotide; AGAGAAA chr2 60454039 60454058 60454055 +
agagaaagagagagagagag

SEQ ID NO: 188769 - DNA, 20 bp, Artificial Sequence
  Synthetic oligonucleotide; TAAGAAA chr2 60454350 60454369 60454366 +
tttaaaagttagcagtcttt

SEQ ID NO: 188770 - DNA, 20 bp, Artificial Sequence
  Synthetic oligonucleotide; AGAGAAT chr2 60454453 60454472 60454469 +
tgggaagttgtctgaaaaaa

SEQ ID NO: 188771 - DNA, 20 bp, Artificial Sequence
  Synthetic oligonucleotide; ACAGAAT chr2 60454507 60454526 60454523 +
ggcccagggacaatggagta

SEQ ID NO: 188772 - DNA, 20 bp, Artificial Sequence
  Synthetic oligonucleotide; CAAGAAA chr2 60454595 60454614 60454611 +
gggggaaaagaggcttaaaa

SEQ ID NO: 188773 - DNA, 20 bp, Artificial Sequence
  Synthetic oligonucleotide; ACAGAAT chr2 60454891 60454910 60454907 +
aaataaacagttctatatct

SEQ ID NO: 188774 - DNA, 20 bp, Artificial Sequence
  Synthetic oligonucleotide; TGAGAAA chr2 60455096 60455115 60455112 +
agtttctggtttaaaatctg

SEQ ID NO: 188775 - DNA, 20 bp, Artificial Sequence
  Synthetic oligonucleotide; ATAGAAT chr2 60455102 60455121 60455118 +
tggtttaaaatctgtgagaa

SEQ ID NO: 188776 - DNA, 20 bp, Artificial Sequence
  Synthetic oligonucleotide; TCAGAAA chr2 60455424 60455443 60455440 +
gtttctattgttcatcagct

SEQ ID NO: 188777 - DNA, 20 bp, Artificial Sequence
  Synthetic oligonucleotide; TAAGAAA chr2 60455587 60455606 60455603 +
tccccattccccatttgatt

SEQ ID NO: 188778 - DNA, 20 bp, Artificial Sequence
  Synthetic oligonucleotide; TGAGAAA chr2 60455677 60455696 60455693 +
acgctaagagcagcatatac

SEQ ID NO: 188779 - DNA, 20 bp, Artificial Sequence
  Synthetic oligonucleotide; GGAGAAA chr2 60455870 60455889 60455886 +
agcattttggattcagtttt

SEQ ID NO: 188780 - DNA, 20 bp, Artificial Sequence
  Synthetic oligonucleotide; TCAGAAA chr2 60456045 60456064 60456061 +
ttcccacccaaactggcttt

SEQ ID NO: 188781 - DNA, 20 bp, Artificial Sequence
  Synthetic oligonucleotide; TTAGAAA chr2 60456072 60456091 60456088 +
acattgactttctttatact

SEQ ID NO: 188782 - DNA, 20 bp, Artificial Sequence
  Synthetic oligonucleotide; TGAGAAA chr2 60456696 60456715 60456712 +
aaagtggggttattttgtta

SEQ ID NO: 188783 - DNA, 20 bp, Artificial Sequence
  Synthetic oligonucleotide; GGAGAAT chr2 60456784 60456803 60456800 +
tctaagataaagcaaggatg

SEQ ID NO: 188784 - DNA, 20 bp, Artificial Sequence
  Synthetic oligonucleotide; ATAGAAA chr2 60456789 60456808 60456805 +
gataaagcaaggatgggaga

SEQ ID NO: 188785 - DNA, 20 bp, Artificial Sequence
  Synthetic oligonucleotide; TCAGAAT chr2 60457056 60457075 60457072 +
tttagggtataatacacgca

SEQ ID NO: 188786 - DNA, 20 bp, Artificial Sequence
  Synthetic oligonucleotide; ATAGAAA chr2 60457067 60457086 60457083 +
atacacgcatcagaatgccc

SEQ ID NO: 188787 - DNA, 20 bp, Artificial Sequence
  Synthetic oligonucleotide; CCAGAAA chr2 60457293 60457312 60457309 +
ccaatagaacttaacaaaga

SEQ ID NO: 188788 - DNA, 20 bp, Artificial Sequence
  Synthetic oligonucleotide; AAAGAAA chr2 60457365 60457384 60457381 +
ataaaaaaaaaaataaaaac

SEQ ID NO: 188789 - DNA, 20 bp, Artificial Sequence
  Synthetic oligonucleotide; ATAGAAA chr2 60457490 60457509 60457506 +
aaacagctttcattacagga

SEQ ID NO: 188790 - DNA, 20 bp, Artificial Sequence
  Synthetic oligonucleotide; CTAGAAA chr2 60458144 60458163 60458160 +
catttaattcaaataccatt

SEQ ID NO: 188791 - DNA, 20 bp, Artificial Sequence
  Synthetic oligonucleotide; ACAGAAA chr2 60458152 60458171 60458168 +
tcaaataccattctagaaat

SEQ ID NO: 188792 - DNA, 20 bp, Artificial Sequence
  Synthetic oligonucleotide; ATAGAAT chr2 60458297 60458316 60458313 +
gagcggtgtgtatccaaggc

SEQ ID NO: 188793 - DNA, 20 bp, Artificial Sequence
  Synthetic oligonucleotide; AGAGAAA chr2 60458759 60458778 60458775 +
caacctctgtatctctgatt

SEQ ID NO: 188794 - DNA, 20 bp, Artificial Sequence
  Synthetic oligonucleotide; AAAGAAA chr2 60458836 60458855 60458852 +
gcagatgctagcttaataaa

SEQ ID NO: 188795 - DNA, 20 bp, Artificial Sequence
  Synthetic oligonucleotide; AAAGAAA chr2 60458914 60458933 60458930 +
aatagcacacagtgtatgga

SEQ ID NO: 188796 - DNA, 20 bp, Artificial Sequence
  Synthetic oligonucleotide; TAAGAAT chr2 60458989 60459008 60459005 +
aattctttctcttctttttt

SEQ ID NO: 188797 - DNA, 20 bp, Artificial Sequence
  Synthetic oligonucleotide; TAAGAAT chr2 60459017 60459036 60459033 +
tcacatttaaatgcaagtct

SEQ ID NO: 188798 - DNA, 20 bp, Artificial Sequence
  Synthetic oligonucleotide; TGAGAAA chr2 60459534 60459553 60459550 +
tttttaggtagccattgttg

SEQ ID NO: 188799 - DNA, 20 bp, Artificial Sequence
  Synthetic oligonucleotide; ATAGAAT chr2 60459547 60459566 60459563 +
attgttgtgagaaatacaat

SEQ ID NO: 188800 - DNA, 20 bp, Artificial Sequence
  Synthetic oligonucleotide; GTAGAAA chr2 60459619 60459638 60459635 +
aagctacaagtttataacaa

SEQ ID NO: 188801 - DNA, 20 bp, Artificial Sequence
  Synthetic oligonucleotide; ATAGAAT chr2 60459681 60459700 60459697 +
tcatattttaaaaccaaatg

SEQ ID NO: 188802 - DNA, 20 bp, Artificial Sequence
  Synthetic oligonucleotide; ACAGAAT chr2 60459889 60459908 60459905 +
aactgtacatgatatgtatt

SEQ ID NO: 188803 - DNA, 20 bp, Artificial Sequence
  Synthetic oligonucleotide; AGAGAAA chr2 60460068 60460087 60460084 +
aacatgtaaattattgcaca

SEQ ID NO: 188804 - DNA, 20 bp, Artificial Sequence
  Synthetic oligonucleotide; AAAGAAA chr2 60460167 60460186 60460183 +
ggaaaaaaaaaaaaaaggaa

SEQ ID NO: 188805 - DNA, 20 bp, Artificial Sequence
  Synthetic oligonucleotide; AAAGAAA chr2 60460174 60460193 60460190 +
aaaaaaaaaggaaaaagaaa

SEQ ID NO: 188806 - DNA, 20 bp, Artificial Sequence
  Synthetic oligonucleotide; AAAGAAA chr2 60460180 60460199 60460196 +
aaaggaaaaagaaaaaagaa

SEQ ID NO: 188807 - DNA, 20 bp, Artificial Sequence
  Synthetic oligonucleotide; AAAGAAA chr2 60460186 60460205 60460202 +
aaaagaaaaaagaaaaagaa

SEQ ID NO: 188808 - DNA, 20 bp, Artificial Sequence
  Synthetic oligonucleotide; CTAGAAA chr2 60460280 60460299 60460296 +
tttgtttaaatcacatggga

SEQ ID NO: 188809 - DNA, 20 bp, Artificial Sequence
  Synthetic oligonucleotide; AGAGAAA chr2 60461944 60461963 60461960 +
gccagctctctaagtctcct

SEQ ID NO: 188810 - DNA, 20 bp, Artificial Sequence
  Synthetic oligonucleotide; AGAGAAA chr2 60462336 60462355 60462352 +
agtgttctgtgcgtgttgca

SEQ ID NO: 188811 - DNA, 20 bp, Artificial Sequence
  Synthetic oligonucleotide; CTAGAAA chr2 60462617 60462636 60462633 +
tcctgccattaaactcagtt

SEQ ID NO: 188812 - DNA, 20 bp, Artificial Sequence
  Synthetic oligonucleotide; GCAGAAA chr2 60462644 60462663 60462660 +
ttttatatccaatccccaaa

SEQ ID NO: 188813 - DNA, 20 bp, Artificial Sequence
  Synthetic oligonucleotide; TGAGAAA chr2 60462795 60462814 60462811 +
tctgtttcctccttgttaag

SEQ ID NO: 188814 - DNA, 20 bp, Artificial Sequence
  Synthetic oligonucleotide; AAAGAAT chr2 60463141 60463160 60463157 +
gggacgtccatttttatctc

SEQ ID NO: 188815 - DNA, 20 bp, Artificial Sequence
  Synthetic oligonucleotide; AAAGAAA chr2 60463162 60463181 60463178 +
aagaatgtttaaaaaatctg

SEQ ID NO: 188816 - DNA, 20 bp, Artificial Sequence
  Synthetic oligonucleotide; TGAGAAA chr2 60463342 60463361 60463358 +
cgccatgacaggcagcaggc

SEQ ID NO: 188817 - DNA, 20 bp, Artificial Sequence
  Synthetic oligonucleotide; TGAGAAA chr2 60463444 60463463 60463460 +
ggctgggactcagctccagt

SEQ ID NO: 188818 - DNA, 20 bp, Artificial Sequence
  Synthetic oligonucleotide; AAAGAAA chr2 60463448 60463467 60463464 +
gggactcagctccagttgag

SEQ ID NO: 188819 - DNA, 20 bp, Artificial Sequence
  Synthetic oligonucleotide; ACAGAAA chr2 60463454 60463473 60463470 +
cagctccagttgagaaagaa

SEQ ID NO: 188820 - DNA, 20 bp, Artificial Sequence
  Synthetic oligonucleotide; TGAGAAA chr2 60463754 60463773 60463770 +
tggtagccaaaggacgagga

SEQ ID NO: 188821 - DNA, 20 bp, Artificial Sequence
  Synthetic oligonucleotide; TGAGAAA chr2 60463808 60463827 60463824 +
aaaaagccttaaaatataac

SEQ ID NO: 188822 - DNA, 20 bp, Artificial Sequence
  Synthetic oligonucleotide; TGAGAAT chr2 60463937 60463956 60463953 +
tctaccagggaggttaagag

SEQ ID NO: 188823 - DNA, 20 bp, Artificial Sequence
  Synthetic oligonucleotide; TCAGAAA chr2 60463983 60464002 60463999 +
tgatgcctccatttagcaag

SEQ ID NO: 188824 - DNA, 20 bp, Artificial Sequence
  Synthetic oligonucleotide; AAAGAAA chr2 60463987 60464006 60464003 +
gcctccatttagcaagtcag

SEQ ID NO: 188825 - DNA, 20 bp, Artificial Sequence
  Synthetic oligonucleotide; GCAGAAA chr2 60464230 60464249 60464246 +
atgtggaagggggaaaaaag

SEQ ID NO: 188826 - DNA, 20 bp, Artificial Sequence
  Synthetic oligonucleotide; AAAGAAA chr2 60464244 60464263 60464260 +
aaaaaggcagaaagattttg

SEQ ID NO: 188827 - DNA, 20 bp, Artificial Sequence
  Synthetic oligonucleotide; TGAGAAA chr2 60464729 60464748 60464745 +
tcctttcaaaaaggcttaaa

SEQ ID NO: 188828 - DNA, 20 bp, Artificial Sequence
  Synthetic oligonucleotide; AGAGAAA chr2 60464856 60464875 60464872 +
tctctctcatacatcaggtc

SEQ ID NO: 188829 - DNA, 20 bp, Artificial Sequence
  Synthetic oligonucleotide; TTAGAAA chr2 60465235 60465254 60465251 +
ttcataacatctttgatgat

SEQ ID NO: 188830 - DNA, 20 bp, Artificial Sequence
  Synthetic oligonucleotide; TAAGAAT chr2 60465703 60465722 60465719 +
gagcataaaaacagtacctg

SEQ ID NO: 188831 - DNA, 20 bp, Artificial Sequence
  Synthetic oligonucleotide; CTAGAAA chr2 60466398 60466417 60466414 +
acccagccagcatgcaggga

SEQ ID NO: 188832 - DNA, 20 bp, Artificial Sequence
  Synthetic oligonucleotide; TCAGAAA chr2 60466961 60466980 60466977 +
attttctaaaacagtatctt

SEQ ID NO: 188833 - DNA, 20 bp, Artificial Sequence
  Synthetic oligonucleotide; GGAGAAA chr2 60468192 60468211 60468208 +
tgcatttttctctaaaacca

SEQ ID NO: 188834 - DNA, 20 bp, Artificial Sequence
  Synthetic oligonucleotide; AAAGAAA chr2 60468516 60468535 60468532 +
gctcccagcctccagtgagg

SEQ ID NO: 188835 - DNA, 20 bp, Artificial Sequence
  Synthetic oligonucleotide; CCAGAAA chr2 60468653 60468672 60468669 +
ttaaaaagtaagggcaattt

SEQ ID NO: 188836 - DNA, 20 bp, Artificial Sequence
  Synthetic oligonucleotide; GAAGAAA chr2 60468690 60468709 60468706 +
tatacacatggacatttgta

SEQ ID NO: 188837 - DNA, 20 bp, Artificial Sequence
  Synthetic oligonucleotide; AAAGAAA chr2 60468819 60468838 60468835 +
agtgcagaagtttatctgtg

SEQ ID NO: 188838 - DNA, 20 bp, Artificial Sequence
  Synthetic oligonucleotide; CTAGAAT chr2 60469415 60469434 60469431 +
ggactgagctgggccatact

SEQ ID NO: 188839 - DNA, 20 bp, Artificial Sequence
  Synthetic oligonucleotide; CCAGAAA chr2 60469561 60469580 60469577 +
cattccaataatgccagcac

SEQ ID NO: 188840 - DNA, 20 bp, Artificial Sequence
  Synthetic oligonucleotide; CAAGAAA chr2 60469886 60469905 60469902 +
tgattggggagggcgggaga

SEQ ID NO: 188841 - DNA, 20 bp, Artificial Sequence
  Synthetic oligonucleotide; TGAGAAA chr2 60470371 60470390 60470387 +
tttgtcatggtatttttcaa

SEQ ID NO: 188842 - DNA, 20 bp, Artificial Sequence
  Synthetic oligonucleotide; TGAGAAT chr2 60470380 60470399 60470396 +
gtatttttcaatgagaaatc

SEQ ID NO: 188843 - DNA, 20 bp, Artificial Sequence
  Synthetic oligonucleotide; CAAGAAA chr2 60470599 60470618 60470615 +
gtgcttcagcaggcctccag

SEQ ID NO: 188844 - DNA, 20 bp, Artificial Sequence
  Synthetic oligonucleotide; TGAGAAA chr2 60470875 60470894 60470891 +
agatggggaaactgaggcca

SEQ ID NO: 188845 - DNA, 20 bp, Artificial Sequence
  Synthetic oligonucleotide; TTAGAAT chr2 60470931 60470950 60470947 +
gattaaccacaatgtgaaga

SEQ ID NO: 188846 - DNA, 20 bp, Artificial Sequence
  Synthetic oligonucleotide; GCAGAAT chr2 60471225 60471244 60471241 +
cctctacctctgcttcccct

SEQ ID NO: 188847 - DNA, 20 bp, Artificial Sequence
  Synthetic oligonucleotide; TTAGAAA chr2 60471276 60471295 60471292 +
agcctaagaagctatttact

SEQ ID NO: 188848 - DNA, 20 bp, Artificial Sequence
  Synthetic oligonucleotide; TCAGAAA chr2 60471848 60471867 60471864 +
accacctcagacttactgaa

SEQ ID NO: 188849 - DNA, 20 bp, Artificial Sequence
  Synthetic oligonucleotide; TCAGAAA chr2 60472458 60472477 60472474 +
cagtatttccacttggggcc

SEQ ID NO: 188850 - DNA, 20 bp, Artificial Sequence
  Synthetic oligonucleotide; AGAGAAT chr2 60473332 60473351 60473348 +
ttcaccctgggtcttcaaaa

SEQ ID NO: 188851 - DNA, 20 bp, Artificial Sequence
  Synthetic oligonucleotide; CTAGAAA chr2 60473836 60473855 60473852 +
aaatcgcactctcttttgtt

SEQ ID NO: 188852 - DNA, 20 bp, Artificial Sequence
  Synthetic oligonucleotide; AAAGAAA chr2 60473940 60473959 60473956 +
aagtgtattctgcaaaaaca

SEQ ID NO: 188853 - DNA, 20 bp, Artificial Sequence
  Synthetic oligonucleotide; ATAGAAT chr2 60473970 60473989 60473986 +
ataattatagacactacaat

SEQ ID NO: 188854 - DNA, 20 bp, Artificial Sequence
  Synthetic oligonucleotide; AAAGAAT chr2 60474426 60474445 60474442 +
gaataggatggtacttaaaa

SEQ ID NO: 188855 - DNA, 20 bp, Artificial Sequence
  Synthetic oligonucleotide; TTAGAAT chr2 60474558 60474577 60474574 +
ttacactttaagcttttgcc

SEQ ID NO: 188856 - DNA, 20 bp, Artificial Sequence
  Synthetic oligonucleotide; AAAGAAA chr2 60474802 60474821 60474818 +
ctagccgctgtgggcagtac

SEQ ID NO: 188857 - DNA, 20 bp, Artificial Sequence
  Synthetic oligonucleotide; GTAGAAA chr2 60474847 60474866 60474863 +
cccacagcaggcttcattta

SEQ ID NO: 188858 - DNA, 20 bp, Artificial Sequence
  Synthetic oligonucleotide; ACAGAAA chr2 60474867 60474886 60474883 +
gtagaaaaggtaaggcctgc

SEQ ID NO: 188859 - DNA, 20 bp, Artificial Sequence
  Synthetic oligonucleotide; GTAGAAA chr2 60474889 60474908 60474905 +
agaaattgctctacccccat

SEQ ID NO: 188860 - DNA, 20 bp, Artificial Sequence
  Synthetic oligonucleotide; AGAGAAA chr2 60474944 60474963 60474960 +
tgctatggaaattcaaagga

SEQ ID NO: 188861 - DNA, 20 bp, Artificial Sequence
  Synthetic oligonucleotide; AGAGAAA chr2 60475024 60475043 60475040 +
gagttaaacctggagagcca

SEQ ID NO: 188862 - DNA, 20 bp, Artificial Sequence
  Synthetic oligonucleotide; AAAGAAA chr2 60475046 60475065 60475062 +
agaaaggatatcctagataa

SEQ ID NO: 188863 - DNA, 20 bp, Artificial Sequence
  Synthetic oligonucleotide; CAAGAAA chr2 60475543 60475562 60475559 +
attttcaacaaatgactgtg

SEQ ID NO: 188864 - DNA, 20 bp, Artificial Sequence
  Synthetic oligonucleotide; GAAGAAA chr2 60476317 60476336 60476333 +
actgaaggtcagagaaccag

SEQ ID NO: 188865 - DNA, 20 bp, Artificial Sequence
  Synthetic oligonucleotide; TAAGAAA chr2 60476451 60476470 60476467 +
caaaggcacacacaggactc

SEQ ID NO: 188866 - DNA, 20 bp, Artificial Sequence
  Synthetic oligonucleotide; AAAGAAA chr2 60476784 60476803 60476800 +
agtgggggagctcactattt

SEQ ID NO: 188867 - DNA, 20 bp, Artificial Sequence
  Synthetic oligonucleotide; CGAGAAA chr2 60477042 60477061 60477058 +
cgatgcctccctgccccact

SEQ ID NO: 188868 - DNA, 20 bp, Artificial Sequence
  Synthetic oligonucleotide; GAAGAAA chr2 60477050 60477069 60477066 +
ccctgccccactcgagaaat

SEQ ID NO: 188869 - DNA, 20 bp, Artificial Sequence
  Synthetic oligonucleotide; TGAGAAT chr2 60477209 60477228 60477225 +
ggctgtgaagatggatgcga

SEQ ID NO: 188870 - DNA, 20 bp, Artificial Sequence
  Synthetic oligonucleotide; TGAGAAA chr2 60477394 60477413 60477410 +
attatcatttcgatcggtct

SEQ ID NO: 188871 - DNA, 20 bp, Artificial Sequence
  Synthetic oligonucleotide; CTAGAAT chr2 60477404 60477423 60477420 +
cgatcggtcttgagaaaata

SEQ ID NO: 188872 - DNA, 20 bp, Artificial Sequence
  Synthetic oligonucleotide; AAAGAAA chr2 60477416 60477435 60477432 +
agaaaatactagaataagct

SEQ ID NO: 188873 - DNA, 20 bp, Artificial Sequence
  Synthetic oligonucleotide; GGAGAAA chr2 60477463 60477482 60477479 +
caaggggagggatagcatta

SEQ ID NO: 188874 - DNA, 20 bp, Artificial Sequence
  Synthetic oligonucleotide; AAAGAAA chr2 60477585 60477604 60477601 +
gaacttagagtaaaataaat

SEQ ID NO: 188875 - DNA, 20 bp, Artificial Sequence
  Synthetic oligonucleotide; AAAGAAA chr2 60477589 60477608 60477605 +
ttagagtaaaataaataaag

SEQ ID NO: 188876 - DNA, 20 bp, Artificial Sequence
  Synthetic oligonucleotide; AAAGAAA chr2 60477593 60477612 60477609 +
agtaaaataaataaagaaag

SEQ ID NO: 188877 - DNA, 20 bp, Artificial Sequence
  Synthetic oligonucleotide; AAAGAAA chr2 60477597 60477616 60477613 +
aaataaataaagaaagaaag

SEQ ID NO: 188878 - DNA, 20 bp, Artificial Sequence
  Synthetic oligonucleotide; AAAGAAA chr2 60477601 60477620 60477617 +
aaataaagaaagaaagaaag

SEQ ID NO: 188879 - DNA, 20 bp, Artificial Sequence
  Synthetic oligonucleotide; GCAGAAA chr2 60478371 60478390 60478387 +
actgccacctcagggccgcg

SEQ ID NO: 188880 - DNA, 20 bp, Artificial Sequence
  Synthetic oligonucleotide; CCAGAAT chr2 60478555 60478574 60478571 +
gaaccagaactggccattct

SEQ ID NO: 188881 - DNA, 20 bp, Artificial Sequence
  Synthetic oligonucleotide; TCAGAAA chr2 60478599 60478618 60478615 +
tatggttaacacagagctgc

SEQ ID NO: 188882 - DNA, 20 bp, Artificial Sequence
  Synthetic oligonucleotide; TCAGAAA chr2 60478783 60478802 60478799 +
catgacggcaagtccttctt

SEQ ID NO: 188883 - DNA, 20 bp, Artificial Sequence
  Synthetic oligonucleotide; AAAGAAT chr2 60479450 60479469 60479466 +
tcaggtctactaggaacagg

SEQ ID NO: 188884 - DNA, 20 bp, Artificial Sequence
  Synthetic oligonucleotide; GTAGAAA chr2 60479526 60479545 60479542 +
cctcaaccttctactgctgg

SEQ ID NO: 188885 - DNA, 20 bp, Artificial Sequence
  Synthetic oligonucleotide; AAAGAAA chr2 60479912 60479931 60479928 +
tttgatttatggggaggagg

SEQ ID NO: 188886 - DNA, 20 bp, Artificial Sequence
  Synthetic oligonucleotide; AGAGAAA chr2 60480859 60480878 60480875 +
gcacccccatctctgtccca

SEQ ID NO: 188887 - DNA, 20 bp, Artificial Sequence
  Synthetic oligonucleotide; GAAGAAA chr2 60481115 60481134 60481131 +
agtggtggccgcagctcagg

SEQ ID NO: 188888 - DNA, 20 bp, Artificial Sequence
  Synthetic oligonucleotide; AGAGAAA chr2 60481274 60481293 60481290 +
acatgctggaaggcaagaag

SEQ ID NO: 188889 - DNA, 20 bp, Artificial Sequence
  Synthetic oligonucleotide; GCAGAAA chr2 60481577 60481596 60481593 +
cctggctaagagcaactgca

SEQ ID NO: 188890 - DNA, 20 bp, Artificial Sequence
  Synthetic oligonucleotide; AAAGAAA chr2 60481967 60481986 60481983 +
ctgttctagtcctgctgtca

SEQ ID NO: 188891 - DNA, 20 bp, Artificial Sequence
  Synthetic oligonucleotide; CGAGAAT chr2 60482325 60482344 60482341 +
gctgatacatggagcagagc

SEQ ID NO: 188892 - DNA, 20 bp, Artificial Sequence
  Synthetic oligonucleotide; GGAGAAA chr2 60482342 60482361 60482358 +
agccgagaatatccggaact

SEQ ID NO: 188893 - DNA, 20 bp, Artificial Sequence
  Synthetic oligonucleotide; TGAGAAA chr2 60482351 60482370 60482367 +
tatccggaactggagaaaag

SEQ ID NO: 188894 - DNA, 20 bp, Artificial Sequence
  Synthetic oligonucleotide; GAAGAAT chr2 60482502 60482521 60482518 +
tttaaatccacaggaagcaa

SEQ ID NO: 188895 - DNA, 20 bp, Artificial Sequence
  Synthetic oligonucleotide; CTAGAAT chr2 60482795 60482814 60482811 +
attatacagtgccttgcttt

SEQ ID NO: 188896 - DNA, 20 bp, Artificial Sequence
  Synthetic oligonucleotide; ACAGAAA chr2 60482939 60482958 60482955 +
aaatctttctttcaaacatt

SEQ ID NO: 188897 - DNA, 20 bp, Artificial Sequence
  Synthetic oligonucleotide; CAAGAAA chr2 60483012 60483031 60483028 +
atttactgataaaggcactg

SEQ ID NO: 188898 - DNA, 20 bp, Artificial Sequence
  Synthetic oligonucleotide; GAAGAAT chr2 60483059 60483078 60483075 +
ttactttgcgagatgtttga

SEQ ID NO: 188899 - DNA, 20 bp, Artificial Sequence
  Synthetic oligonucleotide; GGAGAAT chr2 60483127 60483146 60483143 +
ggatagtgtgggtagttgga

SEQ ID NO: 188900 - DNA, 20 bp, Artificial Sequence
  Synthetic oligonucleotide; AGAGAAA chr2 60483241 60483260 60483257 +
tctaatatatatcccgtggt

SEQ ID NO: 188901 - DNA, 20 bp, Artificial Sequence
  Synthetic oligonucleotide; TCAGAAA chr2 60483587 60483606 60483603 +
cctgtggaatgctgcagttg

SEQ ID NO: 188902 - DNA, 20 bp, Artificial Sequence
  Synthetic oligonucleotide; GAAGAAT chr2 60483722 60483741 60483738 +
tgcttcagcagacaacaaag

SEQ ID NO: 188903 - DNA, 20 bp, Artificial Sequence
  Synthetic oligonucleotide; TTAGAAA chr2 60484039 60484058 60484055 +
atttagagctcctctgttaa

SEQ ID NO: 188904 - DNA, 20 bp, Artificial Sequence
  Synthetic oligonucleotide; TCAGAAA chr2 60484167 60484186 60484183 +
ttgtccagactctgacagtg

SEQ ID NO: 188905 - DNA, 20 bp, Artificial Sequence
  Synthetic oligonucleotide; CCAGAAA chr2 60484455 60484474 60484471 +
gtcaaaaacagccacattca

SEQ ID NO: 188906 - DNA, 20 bp, Artificial Sequence
  Synthetic oligonucleotide; ACAGAAA chr2 60484522 60484541 60484538 +
gaaacagcagtgattgtgga

SEQ ID NO: 188907 - DNA, 20 bp, Artificial Sequence
  Synthetic oligonucleotide; GGAGAAA chr2 60484683 60484702 60484699 +
ggaggggggcaaaaaaagaa

SEQ ID NO: 188908 - DNA, 20 bp, Artificial Sequence
  Synthetic oligonucleotide; CGAGAAA chr2 60484710 60484729 60484726 +
gagaggaaaggttaaccact

SEQ ID NO: 188909 - DNA, 20 bp, Artificial Sequence
  Synthetic oligonucleotide; AAAGAAA chr2 60484911 60484930 60484927 +
ttttatcaagttcaagccaa

SEQ ID NO: 188910 - DNA, 20 bp, Artificial Sequence
  Synthetic oligonucleotide; GAAGAAA chr2 60485057 60485076 60485073 +
accaccaaggcatagccttg

SEQ ID NO: 188911 - DNA, 20 bp, Artificial Sequence
  Synthetic oligonucleotide; CAAGAAT chr2 60485306 60485325 60485322 +
gtggagcaaggccactccag

SEQ ID NO: 188912 - DNA, 20 bp, Artificial Sequence
  Synthetic oligonucleotide; AAAGAAA chr2 60485568 60485587 60485584 +
aagccaatcaactcatttaa

SEQ ID NO: 188913 - DNA, 20 bp, Artificial Sequence
  Synthetic oligonucleotide; TGAGAAA chr2 60485645 60485664 60485661 +
ctgtcccagcaacctagata

SEQ ID NO: 188914 - DNA, 20 bp, Artificial Sequence
  Synthetic oligonucleotide; AGAGAAT chr2 60486218 60486237 60486234 +
gtggaccatggctcctttcc

SEQ ID NO: 188915 - DNA, 20 bp, Artificial Sequence
  Synthetic oligonucleotide; TGAGAAA chr2 60486336 60486355 60486352 +
tttgcctccttctcacacaa

SEQ ID NO: 188916 - DNA, 20 bp, Artificial Sequence
  Synthetic oligonucleotide; TGAGAAA chr2 60486404 60486423 60486420 +
tgtgtagttaagtactgaag

SEQ ID NO: 188917 - DNA, 20 bp, Artificial Sequence
  Synthetic oligonucleotide; CAAGAAA chr2 60486413 60486432 60486429 +
aagtactgaagtgagaaatt

SEQ ID NO: 188918 - DNA, 20 bp, Artificial Sequence
  Synthetic oligonucleotide; AAAGAAA chr2 60486489 60486508 60486505 +
cctaccaatctaagatactg

SEQ ID NO: 188919 - DNA, 20 bp, Artificial Sequence
  Synthetic oligonucleotide; CCAGAAA chr2 60486511 60486530 60486527 +
agaaaatggctacatcaggc

SEQ ID NO: 188920 - DNA, 20 bp, Artificial Sequence
  Synthetic oligonucleotide; ACAGAAA chr2 60486596 60486615 60486612 +
ggctttgagatgaataatgc

SEQ ID NO: 188921 - DNA, 20 bp, Artificial Sequence
  Synthetic oligonucleotide; TGAGAAT chr2 60486760 60486779 60486776 +
cagagtctgagcccacagtc

SEQ ID NO: 188922 - DNA, 20 bp, Artificial Sequence
  Synthetic oligonucleotide; ACAGAAA chr2 60486896 60486915 60486912 +
atttgcccttttccctgcta

SEQ ID NO: 188923 - DNA, 20 bp, Artificial Sequence
  Synthetic oligonucleotide; TCAGAAT chr2 60486948 60486967 60486964 +
attttaagattactattcta

SEQ ID NO: 188924 - DNA, 20 bp, Artificial Sequence
  Synthetic oligonucleotide; AAAGAAA chr2 60487343 60487362 60487359 +
gccacacaccgagagtggaa

SEQ ID NO: 188925 - DNA, 20 bp, Artificial Sequence
  Synthetic oligonucleotide; GCAGAAT chr2 60487697 60487716 60487713 +
cactcccttatttatgagca

SEQ ID NO: 188926 - DNA, 20 bp, Artificial Sequence
  Synthetic oligonucleotide; GCAGAAA chr2 60487770 60487789 60487786 +
ccattctatctaaggaagct

SEQ ID NO: 188927 - DNA, 20 bp, Artificial Sequence
  Synthetic oligonucleotide; TAAGAAT chr2 60487820 60487839 60487836 +
cctttaatgggaaatctgga

SEQ ID NO: 188928 - DNA, 20 bp, Artificial Sequence
  Synthetic oligonucleotide; CTAGAAT chr2 60487948 60487967 60487964 +
ctgacttggttttcccaact

SEQ ID NO: 188929 - DNA, 20 bp, Artificial Sequence
  Synthetic oligonucleotide; GTAGAAA chr2 60488088 60488107 60488104 +
ttacaatttattctcattat

SEQ ID NO: 188930 - DNA, 20 bp, Artificial Sequence
  Synthetic oligonucleotide; CAAGAAT chr2 60488243 60488262 60488259 +
ttttaactgaacaatgtctc

SEQ ID NO: 188931 - DNA, 20 bp, Artificial Sequence
  Synthetic oligonucleotide; AAAGAAA chr2 60488424 60488443 60488440 +
acaggattacagcaaatgtg

SEQ ID NO: 188932 - DNA, 20 bp, Artificial Sequence
  Synthetic oligonucleotide; AAAGAAA chr2 60488573 60488592 60488589 +
atagtttgcttcccccaatg

SEQ ID NO: 188933 - DNA, 20 bp, Artificial Sequence
  Synthetic oligonucleotide; AAAGAAA chr2 60489063 60489082 60489079 +
cccaaaacaaatttatcttc

SEQ ID NO: 188934 - DNA, 20 bp, Artificial Sequence
  Synthetic oligonucleotide; AAAGAAA chr2 60489544 60489563 60489560 +
tttgaccagcacctatctca

SEQ ID NO: 188935 - DNA, 20 bp, Artificial Sequence
  Synthetic oligonucleotide; AAAGAAA chr2 60489588 60489607 60489604 +
aagcacctgaaggaagctga

SEQ ID NO: 188936 - DNA, 20 bp, Artificial Sequence
  Synthetic oligonucleotide; AGAGAAT chr2 60490213 60490232 60490229 +
ctcggcatgaagggtataac

SEQ ID NO: 188937 - DNA, 20 bp, Artificial Sequence
  Synthetic oligonucleotide; GAAGAAT chr2 60490550 60490569 60490566 +
ctacctagtcaccttagcaa

SEQ ID NO: 188938 - DNA, 20 bp, Artificial Sequence
  Synthetic oligonucleotide; AAAGAAA chr2 60491659 60491678 60491675 +
aaatctccgtctcaccaaaa

SEQ ID NO: 188939 - DNA, 20 bp, Artificial Sequence
  Synthetic oligonucleotide; AAAGAAA chr2 60491666 60491685 60491682 +
cgtctcaccaaaaaaagaaa

SEQ ID NO: 188940 - DNA, 20 bp, Artificial Sequence
  Synthetic oligonucleotide; AAAGAAA chr2 60491681 60491700 60491697 +
agaaaaaagaaaaaaaaaaa

SEQ ID NO: 188941 - DNA, 20 bp, Artificial Sequence
  Synthetic oligonucleotide; AAAGAAA chr2 60491685 60491704 60491701 +
aaaagaaaaaaaaaaaaaag

SEQ ID NO: 188942 - DNA, 20 bp, Artificial Sequence
  Synthetic oligonucleotide; TCAGAAA chr2 60491861 60491880 60491877 +
tccttagcacccaaataggt

SEQ ID NO: 188943 - DNA, 20 bp, Artificial Sequence
  Synthetic oligonucleotide; GGAGAAA chr2 60492175 60492194 60492191 +
aagaccagcctgggcaacag

SEQ ID NO: 188944 - DNA, 20 bp, Artificial Sequence
  Synthetic oligonucleotide; TTAGAAT chr2 60492394 60492413 60492410 +
acaactaattgggctaatgt

SEQ ID NO: 188945 - DNA, 20 bp, Artificial Sequence
  Synthetic oligonucleotide; GAAGAAA chr2 60492416 60492435 60492432 +
agaataaatgtatttctagg

SEQ ID NO: 188946 - DNA, 20 bp, Artificial Sequence
  Synthetic oligonucleotide; TCAGAAT chr2 60492648 60492667 60492664 +
ttaccaacttctataaaatc

SEQ ID NO: 188947 - DNA, 20 bp, Artificial Sequence
  Synthetic oligonucleotide; CTAGAAA chr2 60492928 60492947 60492944 +
tacagaacacgtccaccagt

SEQ ID NO: 188948 - DNA, 20 bp, Artificial Sequence
  Synthetic oligonucleotide; TGAGAAT chr2 60493026 60493045 60493042 +
cccacctaccaccacagtgt

SEQ ID NO: 188949 - DNA, 20 bp, Artificial Sequence
  Synthetic oligonucleotide; CTAGAAT chr2 60493034 60493053 60493050 +
ccaccacagtgttgagaatt

SEQ ID NO: 188950 - DNA, 20 bp, Artificial Sequence
  Synthetic oligonucleotide; GCAGAAT chr2 60493098 60493117 60493114 +
tgtttaatttcttccacaga

SEQ ID NO: 188951 - DNA, 20 bp, Artificial Sequence
  Synthetic oligonucleotide; ACAGAAA chr2 60493332 60493351 60493348 +
atctaaggcatttcgagaac

SEQ ID NO: 188952 - DNA, 20 bp, Artificial Sequence
  Synthetic oligonucleotide; ATAGAAA chr2 60493484 60493503 60493500 +
caaatgtcatcctattccga

SEQ ID NO: 188953 - DNA, 20 bp, Artificial Sequence
  Synthetic oligonucleotide; TCAGAAA chr2 60493637 60493656 60493653 +
tcctaagagcccccactagc

SEQ ID NO: 188954 - DNA, 20 bp, Artificial Sequence
  Synthetic oligonucleotide; GAAGAAA chr2 60493718 60493737 60493734 +
taccttgccaaaggccttgg

SEQ ID NO: 188955 - DNA, 20 bp, Artificial Sequence
  Synthetic oligonucleotide; GGAGAAA chr2 60494038 60494057 60494054 +
cttagacaacaatgcaaggg

SEQ ID NO: 188956 - DNA, 20 bp, Artificial Sequence
  Synthetic oligonucleotide; GAAGAAA chr2 60494047 60494066 60494063 +
caatgcaagggggagaaact

SEQ ID NO: 188957 - DNA, 20 bp, Artificial Sequence
  Synthetic oligonucleotide; AGAGAAA chr2 60494086 60494105 60494102 +
ccactactggcaataaacag

SEQ ID NO: 188958 - DNA, 20 bp, Artificial Sequence
  Synthetic oligonucleotide; TAAGAAA chr2 60494128 60494147 60494144 +
tgaggcacacctacattact

SEQ ID NO: 188959 - DNA, 20 bp, Artificial Sequence
  Synthetic oligonucleotide; GCAGAAA chr2 60494795 60494814 60494811 +
tatttattagttacacctca

SEQ ID NO: 188960 - DNA, 20 bp, Artificial Sequence
  Synthetic oligonucleotide; GAAGAAA chr2 60494843 60494862 60494859 +
ccaattcctagtttgggtca

SEQ ID NO: 188961 - DNA, 20 bp, Artificial Sequence
  Synthetic oligonucleotide; AAAGAAT chr2 60494874 60494893 60494890 +
aaaagggagaggaaaaagga

SEQ ID NO: 188962 - DNA, 20 bp, Artificial Sequence
  Synthetic oligonucleotide; TGAGAAA chr2 60495094 60495113 60495110 +
acaaattatttcattcccat

SEQ ID NO: 188963 - DNA, 20 bp, Artificial Sequence
  Synthetic oligonucleotide; TAAGAAA chr2 60495958 60495977 60495974 +
tagctattttttaaaacacc

SEQ ID NO: 188964 - DNA, 20 bp, Artificial Sequence
  Synthetic oligonucleotide; CCAGAAA chr2 60496144 60496163 60496160 +
agggaattgttcatgaaatc

SEQ ID NO: 188965 - DNA, 20 bp, Artificial Sequence
  Synthetic oligonucleotide; ACAGAAT chr2 60496224 60496243 60496240 +
tggaagtccaatacacgttt

SEQ ID NO: 188966 - DNA, 20 bp, Artificial Sequence
  Synthetic oligonucleotide; AGAGAAA chr2 60497213 60497232 60497229 +
ctgtaaacacttaatgagct

SEQ ID NO: 188967 - DNA, 20 bp, Artificial Sequence
  Synthetic oligonucleotide; TCAGAAT chr2 60497329 60497348 60497345 +
gtttgatcaagtcagatttt

SEQ ID NO: 188968 - DNA, 20 bp, Artificial Sequence
  Synthetic oligonucleotide; CTAGAAA chr2 60497388 60497407 60497404 +
gtctttaagttaatcaatcc

SEQ ID NO: 188969 - DNA, 20 bp, Artificial Sequence
  Synthetic oligonucleotide; CTAGAAA chr2 60497523 60497542 60497539 +
cccctaacatcaggaatcag

SEQ ID NO: 188970 - DNA, 20 bp, Artificial Sequence
  Synthetic oligonucleotide; AGAGAAA chr2 60497812 60497831 60497828 +
ccctttgctgatgatccagt

SEQ ID NO: 188971 - DNA, 20 bp, Artificial Sequence
  Synthetic oligonucleotide; GGAGAAT chr2 60498099 60498118 60498115 +
tggggtgagtcaaaagtctg

SEQ ID NO: 188972 - DNA, 20 bp, Artificial Sequence
  Synthetic oligonucleotide; CTAGAAT chr2 60498519 60498538 60498535 +
ccccatacccacttcccttc

SEQ ID NO: 188973 - DNA, 20 bp, Artificial Sequence
  Synthetic oligonucleotide; GGAGAAA chr2 60498698 60498717 60498714 +
aggcagatgaggtgacaagg

SEQ ID NO: 188974 - DNA, 20 bp, Artificial Sequence
  Synthetic oligonucleotide; CCAGAAA chr2 60498888 60498907 60498904 +
cagatgactgtccaactcat

SEQ ID NO: 188975 - DNA, 20 bp, Artificial Sequence
  Synthetic oligonucleotide; GAAGAAT chr2 60499027 60499046 60499043 +
cccacacaggcatccaaagg

SEQ ID NO: 188976 - DNA, 20 bp, Artificial Sequence
  Synthetic oligonucleotide; TGAGAAA chr2 60500497 60500516 60500513 +
agggaaggaaggagagcccc

SEQ ID NO: 188977 - DNA, 20 bp, Artificial Sequence
  Synthetic oligonucleotide; GAAGAAT chr2 60500512 60500531 60500528 +
gcccctgagaaaaaatggca

SEQ ID NO: 188978 - DNA, 20 bp, Artificial Sequence
  Synthetic oligonucleotide; TCAGAAA chr2 60501157 60501176 60501173 +
cacttatttatattattgtt

SEQ ID NO: 188979 - DNA, 20 bp, Artificial Sequence
  Synthetic oligonucleotide; TCAGAAT chr2 60502127 60502146 60502143 +
aacaatgcaactcaagacta

SEQ ID NO: 188980 - DNA, 20 bp, Artificial Sequence
  Synthetic oligonucleotide; ACAGAAT chr2 60502391 60502410 60502407 +
agcctaataaaactgcacag

SEQ ID NO: 188981 - DNA, 20 bp, Artificial Sequence
  Synthetic oligonucleotide; AAAGAAA chr2 60502510 60502529 60502526 +
ggatctcaggtattgctcct

SEQ ID NO: 188982 - DNA, 20 bp, Artificial Sequence
  Synthetic oligonucleotide; TAAGAAA chr2 60502605 60502624 60502621 +
ctaatattaaaatatgaatt

SEQ ID NO: 188983 - DNA, 20 bp, Artificial Sequence
  Synthetic oligonucleotide; CCAGAAA chr2 60502637 60502656 60502653 +
gtgaaaagagattttttaaa

SEQ ID NO: 188984 - DNA, 20 bp, Artificial Sequence
  Synthetic oligonucleotide; AGAGAAA chr2 60502699 60502718 60502715 +
aactgttttcaatcatcatc

SEQ ID NO: 188985 - DNA, 20 bp, Artificial Sequence
  Synthetic oligonucleotide; GCAGAAA chr2 60502741 60502760 60502757 +
gatcatggtagcacagtaga

SEQ ID NO: 188986 - DNA, 20 bp, Artificial Sequence
  Synthetic oligonucleotide; AAAGAAA chr2 60502768 60502787 60502784 +
gagcactcaattggtgatca

SEQ ID NO: 188987 - DNA, 20 bp, Artificial Sequence
  Synthetic oligonucleotide; CCAGAAA chr2 60502794 60502813 60502810 +
ataaattctagtcctgtcac

SEQ ID NO: 188988 - DNA, 20 bp, Artificial Sequence
  Synthetic oligonucleotide; AGAGAAT chr2 60502832 60502851 60502848 +
ggggaggtacttaatctcta

SEQ ID NO: 188989 - DNA, 20 bp, Artificial Sequence
  Synthetic oligonucleotide; TGAGAAA chr2 60502883 60502902 60502899 +
ctggggaaggagtgaaccag

SEQ ID NO: 188990 - DNA, 20 bp, Artificial Sequence
  Synthetic oligonucleotide; CCAGAAT chr2 60503241 60503260 60503257 +
ggctctgaccaggtggaaag

SEQ ID NO: 188991 - DNA, 20 bp, Artificial Sequence
  Synthetic oligonucleotide; ACAGAAA chr2 60503271 60503290 60503287 +
gtccaaccaggagacccaag

SEQ ID NO: 188992 - DNA, 20 bp, Artificial Sequence
  Synthetic oligonucleotide; CTAGAAA chr2 60503896 60503915 60503912 +
tattggctgcttcgttgatt

SEQ ID NO: 188993 - DNA, 20 bp, Artificial Sequence
  Synthetic oligonucleotide; AAAGAAA chr2 60503905 60503924 60503921 +
cttcgttgattctagaaaaa

SEQ ID NO: 188994 - DNA, 20 bp, Artificial Sequence
  Synthetic oligonucleotide; CAAGAAA chr2 60503913 60503932 60503929 +
attctagaaaaaaaagaaag

SEQ ID NO: 188995 - DNA, 20 bp, Artificial Sequence
  Synthetic oligonucleotide; CCAGAAA chr2 60504523 60504542 60504539 +
ggagctcagcatcgggacac

SEQ ID NO: 188996 - DNA, 20 bp, Artificial Sequence
  Synthetic oligonucleotide; GCAGAAT chr2 60504558 60504577 60504574 +
tccaaggcaaaaagcaaata

SEQ ID NO: 188997 - DNA, 20 bp, Artificial Sequence
  Synthetic oligonucleotide; TCAGAAT chr2 60504978 60504997 60504994 +
gaagtataaggagttctgga

SEQ ID NO: 188998 - DNA, 20 bp, Artificial Sequence
  Synthetic oligonucleotide; AGAGAAA chr2 60505231 60505250 60505247 +
caaaaaagctagaggatcgg

SEQ ID NO: 188999 - DNA, 20 bp, Artificial Sequence
  Synthetic oligonucleotide; TCAGAAA chr2 60505253 60505272 60505269 +
agaaaagaagggacggatac

SEQ ID NO: 189000 - DNA, 20 bp, Artificial Sequence
  Synthetic oligonucleotide; TTAGAAT chr2 60505752 60505771 60505768 +
ctctacctgggtctatcatt

SEQ ID NO: 189001 - DNA, 20 bp, Artificial Sequence
  Synthetic oligonucleotide; GCAGAAA chr2 60505862 60505881 60505878 +
ccctcccaaaacaacggtgg

SEQ ID NO: 189002 - DNA, 20 bp, Artificial Sequence
  Synthetic oligonucleotide; ATAGAAA chr2 60506116 60506135 60506132 +
gccatcctttgacacccacc

SEQ ID NO: 189003 - DNA, 20 bp, Artificial Sequence
  Synthetic oligonucleotide; TCAGAAA chr2 60506134 60506153 60506150 +
ccatagaaatcacagagagg

SEQ ID NO: 189004 - DNA, 20 bp, Artificial Sequence
  Synthetic oligonucleotide; TAAGAAA chr2 60506619 60506638 60506635 +
taatgataaaggcagctcac

SEQ ID NO: 189005 - DNA, 20 bp, Artificial Sequence
  Synthetic oligonucleotide; GCAGAAT chr2 60507161 60507180 60507177 +
ttaaatgctcttctagctct

SEQ ID NO: 189006 - DNA, 20 bp, Artificial Sequence
  Synthetic oligonucleotide; GAAGAAA chr2 60507183 60507202 60507199 +
agaatgcaaagcaagacaag

SEQ ID NO: 189007 - DNA, 20 bp, Artificial Sequence
  Synthetic oligonucleotide; CTAGAAA chr2 60507396 60507415 60507412 +
cccttgcctttcttgaaaag

SEQ ID NO: 189008 - DNA, 20 bp, Artificial Sequence
  Synthetic oligonucleotide; CCAGAAA chr2 60507466 60507485 60507482 +
tgaagctgcttccgttcaag

SEQ ID NO: 189009 - DNA, 20 bp, Artificial Sequence
  Synthetic oligonucleotide; CAAGAAA chr2 60507524 60507543 60507540 +
tcagatgttttggagtctct

SEQ ID NO: 189010 - DNA, 20 bp, Artificial Sequence
  Synthetic oligonucleotide; GCAGAAA chr2 60507690 60507709 60507706 +
cagcttttctaagacatatg

SEQ ID NO: 189011 - DNA, 20 bp, Artificial Sequence
  Synthetic oligonucleotide; ACAGAAA chr2 60507726 60507745 60507742 +
tgtcttccaaacagcacaag

SEQ ID NO: 189012 - DNA, 20 bp, Artificial Sequence
  Synthetic oligonucleotide; AAAGAAA chr2 60508035 60508054 60508051 +
acgacagatgcaaacacaaa

SEQ ID NO: 189013 - DNA, 20 bp, Artificial Sequence
  Synthetic oligonucleotide; GCAGAAT chr2 60508317 60508336 60508333 +
cagagaagcttcctgggtgt

SEQ ID NO: 189014 - DNA, 20 bp, Artificial Sequence
  Synthetic oligonucleotide; GGAGAAT chr2 60508627 60508646 60508643 +
gccaaagagaagcgttgcta

SEQ ID NO: 189015 - DNA, 20 bp, Artificial Sequence
  Synthetic oligonucleotide; AAAGAAA chr2 60509021 60509040 60509037 +
aagcctagaggacctcctcc

SEQ ID NO: 189016 - DNA, 20 bp, Artificial Sequence
  Synthetic oligonucleotide; ACAGAAA chr2 60509038 60509057 60509054 +
tccaaagaaaagtggctcag

SEQ ID NO: 189017 - DNA, 20 bp, Artificial Sequence
  Synthetic oligonucleotide; TGAGAAA chr2 60509106 60509125 60509122 +
tctggtctaaagattcaagc

SEQ ID NO: 189018 - DNA, 20 bp, Artificial Sequence
  Synthetic oligonucleotide; CAAGAAA chr2 60509113 60509132 60509129 +
taaagattcaagctgagaaa

SEQ ID NO: 189019 - DNA, 20 bp, Artificial Sequence
  Synthetic oligonucleotide; CAAGAAT chr2 60509208 60509227 60509224 +
cttggatgttatgaggattc

SEQ ID NO: 189020 - DNA, 20 bp, Artificial Sequence
  Synthetic oligonucleotide; CCAGAAA chr2 60509290 60509309 60509306 +
atgtgccagcccacttcttt

SEQ ID NO: 189021 - DNA, 20 bp, Artificial Sequence
  Synthetic oligonucleotide; GAAGAAA chr2 60509347 60509366 60509363 +
aagaggacaacggatttccg

SEQ ID NO: 189022 - DNA, 20 bp, Artificial Sequence
  Synthetic oligonucleotide; TCAGAAA chr2 60509408 60509427 60509424 +
agcagagccacacggacgtc

SEQ ID NO: 189023 - DNA, 20 bp, Artificial Sequence
  Synthetic oligonucleotide; TGAGAAA chr2 60509539 60509558 60509555 +
tcgatggtctacctgagacc

SEQ ID NO: 189024 - DNA, 20 bp, Artificial Sequence
  Synthetic oligonucleotide; AAAGAAA chr2 60509558 60509577 60509574 +
ctgagaaaacaaacgaaggg

SEQ ID NO: 189025 - DNA, 20 bp, Artificial Sequence
  Synthetic oligonucleotide; CAAGAAA chr2 60509567 60509586 60509583 +
caaacgaagggaaagaaatg

SEQ ID NO: 189026 - DNA, 20 bp, Artificial Sequence
  Synthetic oligonucleotide; GGAGAAA chr2 60509664 60509683 60509680 +
gaacaaaaagattaggagga

SEQ ID NO: 189027 - DNA, 20 bp, Artificial Sequence
  Synthetic oligonucleotide; CCAGAAT chr2 60510020 60510039 60510036 +
gttttcccttcgaagtatgt

SEQ ID NO: 189028 - DNA, 20 bp, Artificial Sequence
  Synthetic oligonucleotide; CTAGAAA chr2 60510583 60510602 60510599 +
catcttctgtctctccccag

SEQ ID NO: 189029 - DNA, 20 bp, Artificial Sequence
  Synthetic oligonucleotide; CTAGAAA chr2 60510956 60510975 60510972 +
ctaaggcttaggtggagcct

SEQ ID NO: 189030 - DNA, 20 bp, Artificial Sequence
  Synthetic oligonucleotide; CCAGAAA chr2 60511255 60511274 60511271 +
cctgagagcccgggatgcag

SEQ ID NO: 189031 - DNA, 20 bp, Artificial Sequence
  Synthetic oligonucleotide; ACAGAAA chr2 60511695 60511714 60511711 +
gtcaacgtattttccaagcc

SEQ ID NO: 189032 - DNA, 20 bp, Artificial Sequence
  Synthetic oligonucleotide; AAAGAAA chr2 60511949 60511968 60511965 +
aatgtaggtgttcaaaggca

SEQ ID NO: 189033 - DNA, 20 bp, Artificial Sequence
  Synthetic oligonucleotide; TCAGAAT chr2 60512268 60512287 60512284 +
ccgatgcgctgatgtggaac

SEQ ID NO: 189034 - DNA, 20 bp, Artificial Sequence
  Synthetic oligonucleotide; TGAGAAA chr2 60512448 60512467 60512464 +
acacacactcgcctctcaaa

SEQ ID NO: 189035 - DNA, 20 bp, Artificial Sequence
  Synthetic oligonucleotide; AAAGAAA chr2 60512618 60512637 60512634 +
agctctaaattatttggtct

SEQ ID NO: 189036 - DNA, 20 bp, Artificial Sequence
  Synthetic oligonucleotide; AGAGAAA chr2 60512901 60512920 60512917 +
catccatttggaggagacac

SEQ ID NO: 189037 - DNA, 20 bp, Artificial Sequence
  Synthetic oligonucleotide; TGAGAAA chr2 60513018 60513037 60513034 +
caccacctctggttaccccc

SEQ ID NO: 189038 - DNA, 20 bp, Artificial Sequence
  Synthetic oligonucleotide; AGAGAAA chr2 60513028 60513047 60513044 +
ggttaccccctgagaaaggc

SEQ ID NO: 189039 - DNA, 20 bp, Artificial Sequence
  Synthetic oligonucleotide; GCAGAAA chr2 60513403 60513422 60513419 +
cccacttgaggctgtccaca

SEQ ID NO: 189040 - DNA, 20 bp, Artificial Sequence
  Synthetic oligonucleotide; AAAGAAA chr2 60513679 60513698 60513695 +
atccctgatcaggactgaaa

SEQ ID NO: 189041 - DNA, 20 bp, Artificial Sequence
  Synthetic oligonucleotide; AAAGAAA chr2 60513685 60513704 60513701 +
gatcaggactgaaaaaagaa

SEQ ID NO: 189042 - DNA, 20 bp, Artificial Sequence
  Synthetic oligonucleotide; ATAGAAT chr2 60514343 60514362 60514359 +
ggagaacaagccatctgaaa

SEQ ID NO: 189043 - DNA, 20 bp, Artificial Sequence
  Synthetic oligonucleotide; GGAGAAT chr2 60514555 60514574 60514571 +
ctacttgggaggctgaggca

SEQ ID NO: 189044 - DNA, 20 bp, Artificial Sequence
  Synthetic oligonucleotide; ACAGAAA chr2 60514843 60514862 60514859 +
ttgcatacacatacactaaa

SEQ ID NO: 189045 - DNA, 20 bp, Artificial Sequence
  Synthetic oligonucleotide; AAAGAAA chr2 60514850 60514869 60514866 +
cacatacactaaaacagaaa

SEQ ID NO: 189046 - DNA, 20 bp, Artificial Sequence
  Synthetic oligonucleotide; AAAGAAA chr2 60514864 60514883 60514880 +
cagaaaaaagaaaaaaaaaa

SEQ ID NO: 189047 - DNA, 20 bp, Artificial Sequence
  Synthetic oligonucleotide; AGAGAAT chr2 60514889 60514908 60514905 +
aaagagagacagagagagag

SEQ ID NO: 189048 - DNA, 20 bp, Artificial Sequence
  Synthetic oligonucleotide; CCAGAAT chr2 60515007 60515026 60515023 +
agacaggctctagcttgttt

SEQ ID NO: 189049 - DNA, 20 bp, Artificial Sequence
  Synthetic oligonucleotide; ACAGAAT chr2 60515128 60515147 60515144 +
ctggcttccaggtgagcgag

SEQ ID NO: 189050 - DNA, 20 bp, Artificial Sequence
  Synthetic oligonucleotide; GGAGAAA chr2 60515446 60515465 60515462 +
aaaaggttataatttgagga

SEQ ID NO: 189051 - DNA, 20 bp, Artificial Sequence
  Synthetic oligonucleotide; AAAGAAA chr2 60515521 60515540 60515537 +
cccagagtgacacctcctcc

SEQ ID NO: 189052 - DNA, 20 bp, Artificial Sequence
  Synthetic oligonucleotide; CTAGAAA chr2 60515564 60515583 60515580 +
agtcaggccttcctagttac

SEQ ID NO: 189053 - DNA, 20 bp, Artificial Sequence
  Synthetic oligonucleotide; ACAGAAA chr2 60515607 60515626 60515623 +
ccagcccactagaaggagat

SEQ ID NO: 189054 - DNA, 20 bp, Artificial Sequence
  Synthetic oligonucleotide; GGAGAAA chr2 60515682 60515701 60515698 +
agcccagtgctttcaggcag

SEQ ID NO: 189055 - DNA, 20 bp, Artificial Sequence
  Synthetic oligonucleotide; CGAGAAA chr2 60515894 60515913 60515910 +
aggaagtgaacaagtcaatt

SEQ ID NO: 189056 - DNA, 20 bp, Artificial Sequence
  Synthetic oligonucleotide; ACAGAAA chr2 60516193 60516212 60516209 +
acctctcctcaccccagcac

SEQ ID NO: 189057 - DNA, 20 bp, Artificial Sequence
  Synthetic oligonucleotide; CAAGAAA chr2 60516423 60516442 60516439 +
ttaccgagcagtaagtgagg

SEQ ID NO: 189058 - DNA, 20 bp, Artificial Sequence
  Synthetic oligonucleotide; GGAGAAA chr2 60516621 60516640 60516637 +
agagaggggcacctgggatg

SEQ ID NO: 189059 - DNA, 20 bp, Artificial Sequence
  Synthetic oligonucleotide; AAAGAAT chr2 60516786 60516805 60516802 +
aagagtgcagacataagact

SEQ ID NO: 189060 - DNA, 20 bp, Artificial Sequence
  Synthetic oligonucleotide; ATAGAAA chr2 60516890 60516909 60516906 +
agcagattctaaagagaggc

SEQ ID NO: 189061 - DNA, 20 bp, Artificial Sequence
  Synthetic oligonucleotide; GGAGAAT chr2 60516972 60516991 60516988 +
atttaggaagaagaagtggc

SEQ ID NO: 189062 - DNA, 20 bp, Artificial Sequence
  Synthetic oligonucleotide; GAAGAAT chr2 60516984 60517003 60517000 +
gaagtggcggagaatggaat

SEQ ID NO: 189063 - DNA, 20 bp, Artificial Sequence
  Synthetic oligonucleotide; AGAGAAA chr2 60517369 60517388 60517385 +
gaccagccccgaaaaagggc

SEQ ID NO: 189064 - DNA, 20 bp, Artificial Sequence
  Synthetic oligonucleotide; GAAGAAA chr2 60517397 60517416 60517413 +
cagggaaaggaacaaggcaa

SEQ ID NO: 189065 - DNA, 20 bp, Artificial Sequence
  Synthetic oligonucleotide; TAAGAAA chr2 60517530 60517549 60517546 +
ctcttcaacaaagctccagt

SEQ ID NO: 189066 - DNA, 20 bp, Artificial Sequence
  Synthetic oligonucleotide; TCAGAAA chr2 60517889 60517908 60517905 +
gtgctttcttctatgattcc

SEQ ID NO: 189067 - DNA, 20 bp, Artificial Sequence
  Synthetic oligonucleotide; AGAGAAA chr2 60517951 60517970 60517967 +
aaacccaattttaggggagg

SEQ ID NO: 189068 - DNA, 20 bp, Artificial Sequence
  Synthetic oligonucleotide; TCAGAAA chr2 60518020 60518039 60518036 +
atttgcttatgcctataatc

SEQ ID NO: 189069 - DNA, 20 bp, Artificial Sequence
  Synthetic oligonucleotide; AAAGAAA chr2 60518161 60518180 60518177 +
tgagatttagctatcttttc

SEQ ID NO: 189070 - DNA, 20 bp, Artificial Sequence
  Synthetic oligonucleotide; AGAGAAT chr2 60518347 60518366 60518363 +
gcctgtcatgaagcagactc

SEQ ID NO: 189071 - DNA, 20 bp, Artificial Sequence
  Synthetic oligonucleotide; TGAGAAT chr2 60518587 60518606 60518603 +
aggaagcattgctctagatc

SEQ ID NO: 189072 - DNA, 20 bp, Artificial Sequence
  Synthetic oligonucleotide; TGAGAAA chr2 60518648 60518667 60518664 +
acaaacccagcagagaacgt

SEQ ID NO: 189073 - DNA, 20 bp, Artificial Sequence
  Synthetic oligonucleotide; CCAGAAT chr2 60518701 60518720 60518717 +
gagttcacttaaaagtccat

SEQ ID NO: 189074 - DNA, 20 bp, Artificial Sequence
  Synthetic oligonucleotide; AGAGAAA chr2 60519016 60519035 60519032 +
cacacatctctcaactcttg

SEQ ID NO: 189075 - DNA, 20 bp, Artificial Sequence
  Synthetic oligonucleotide; AAAGAAA chr2 60519156 60519175 60519172 +
caaatacaggcgctacaaaa

SEQ ID NO: 189076 - DNA, 20 bp, Artificial Sequence
  Synthetic oligonucleotide; CAAGAAA chr2 60519180 60519199 60519196 +
aaataggtgtgaaagcgggg

SEQ ID NO: 189077 - DNA, 20 bp, Artificial Sequence
  Synthetic oligonucleotide; AGAGAAA chr2 60519497 60519516 60519513 +
ggtgactgcactcatgctgc

SEQ ID NO: 189078 - DNA, 20 bp, Artificial Sequence
  Synthetic oligonucleotide; AGAGAAA chr2 60519577 60519596 60519593 +
gcctgccttctttccttaca

SEQ ID NO: 189079 - DNA, 20 bp, Artificial Sequence
  Synthetic oligonucleotide; GGAGAAA chr2 60519632 60519651 60519648 +
acagcagtaagttgaccact

SEQ ID NO: 189080 - DNA, 20 bp, Artificial Sequence
  Synthetic oligonucleotide; TCAGAAA chr2 60519751 60519770 60519767 +
gggcatgggactgtgcttat

SEQ ID NO: 189081 - DNA, 20 bp, Artificial Sequence
  Synthetic oligonucleotide; AAAGAAA chr2 60519803 60519822 60519819 +
tcctaaattactccaatgac

SEQ ID NO: 189082 - DNA, 20 bp, Artificial Sequence
  Synthetic oligonucleotide; GGAGAAT chr2 60519955 60519974 60519971 +
attctcccctctctctggca

SEQ ID NO: 189083 - DNA, 20 bp, Artificial Sequence
  Synthetic oligonucleotide; TCAGAAA chr2 60520094 60520113 60520110 +
ttttctgaaaattgaaaaat

SEQ ID NO: 189084 - DNA, 20 bp, Artificial Sequence
  Synthetic oligonucleotide; ATAGAAT chr2 60520111 60520130 60520127 +
aattcagaaagccaaagata

SEQ ID NO: 189085 - DNA, 20 bp, Artificial Sequence
  Synthetic oligonucleotide; GGAGAAA chr2 60520525 60520544 60520541 +
tcgcattccgtttataagaa

SEQ ID NO: 189086 - DNA, 20 bp, Artificial Sequence
  Synthetic oligonucleotide; GCAGAAA chr2 60520868 60520887 60520884 +
gcaagcttagccccttcttt

SEQ ID NO: 189087 - DNA, 20 bp, Artificial Sequence
  Synthetic oligonucleotide; GTAGAAA chr2 60520897 60520916 60520913 +
aagatattgatgtgccaaca

SEQ ID NO: 189088 - DNA, 20 bp, Artificial Sequence
  Synthetic oligonucleotide; GAAGAAA chr2 60520904 60520923 60520920 +
tgatgtgccaacagtagaaa

SEQ ID NO: 189089 - DNA, 20 bp, Artificial Sequence
  Synthetic oligonucleotide; AAAGAAA chr2 60521714 60521733 60521730 +
tagccagggctcaaatggcc

SEQ ID NO: 189090 - DNA, 20 bp, Artificial Sequence
  Synthetic oligonucleotide; GGAGAAT chr2 60521890 60521909 60521906 +
aagggatctctgttcttcca

SEQ ID NO: 189091 - DNA, 20 bp, Artificial Sequence
  Synthetic oligonucleotide; GAAGAAA chr2 60522032 60522051 60522048 +
ctctgagccaaacccttggt

SEQ ID NO: 189092 - DNA, 20 bp, Artificial Sequence
  Synthetic oligonucleotide; AGAGAAT chr2 60522127 60522146 60522143 +
ctcaaatactacaaaagtag

SEQ ID NO: 189093 - DNA, 20 bp, Artificial Sequence
  Synthetic oligonucleotide; TCAGAAA chr2 60522415 60522434 60522431 +
ataggggagttattttaaac

SEQ ID NO: 189094 - DNA, 20 bp, Artificial Sequence
  Synthetic oligonucleotide; CAAGAAA chr2 60522487 60522506 60522503 +
aggttcaagactgaagctgc

SEQ ID NO: 189095 - DNA, 20 bp, Artificial Sequence
  Synthetic oligonucleotide; AGAGAAT chr2 60522500 60522519 60522516 +
aagctgccaagaaaagcttc

SEQ ID NO: 189096 - DNA, 20 bp, Artificial Sequence
  Synthetic oligonucleotide; GAAGAAA chr2 60522747 60522766 60522763 +
actggaattcatttgtcttg

SEQ ID NO: 189097 - DNA, 20 bp, Artificial Sequence
  Synthetic oligonucleotide; ACAGAAT chr2 60522776 60522795 60522792 +
gttctcctggacggttctgc

SEQ ID NO: 189098 - DNA, 20 bp, Artificial Sequence
  Synthetic oligonucleotide; ACAGAAA chr2 60523134 60523153 60523150 +
accagatgcagaggcaggtc

SEQ ID NO: 189099 - DNA, 20 bp, Artificial Sequence
  Synthetic oligonucleotide; AGAGAAA chr2 60523200 60523219 60523216 +
ggcaacacgtgttgcaacct

SEQ ID NO: 189100 - DNA, 20 bp, Artificial Sequence
  Synthetic oligonucleotide; AAAGAAT chr2 60523204 60523223 60523220 +
acacgtgttgcaacctagag

SEQ ID NO: 189101 - DNA, 20 bp, Artificial Sequence
  Synthetic oligonucleotide; TGAGAAA chr2 60523724 60523743 60523740 +
attcattgccaggcaaaact

SEQ ID NO: 189102 - DNA, 20 bp, Artificial Sequence
  Synthetic oligonucleotide; TTAGAAA chr2 60523736 60523755 60523752 +
gcaaaacttgagaaatacat

SEQ ID NO: 189103 - DNA, 20 bp, Artificial Sequence
  Synthetic oligonucleotide; ACAGAAA chr2 60523790 60523809 60523806 +
agtaaatgaatcaccaaggc

SEQ ID NO: 189104 - DNA, 20 bp, Artificial Sequence
  Synthetic oligonucleotide; CAAGAAT chr2 60523831 60523850 60523847 +
acttaactagcccaaacgtt

SEQ ID NO: 189105 - DNA, 20 bp, Artificial Sequence
  Synthetic oligonucleotide; TCAGAAA chr2 60524519 60524538 60524535 +
agatagaagagcatgcaaaa

SEQ ID NO: 189106 - DNA, 20 bp, Artificial Sequence
  Synthetic oligonucleotide; AAAGAAA chr2 60524718 60524737 60524734 +
tctgagcacatgggataata

SEQ ID NO: 189107 - DNA, 20 bp, Artificial Sequence
  Synthetic oligonucleotide; ACAGAAA chr2 60524845 60524864 60524861 +
tttgctggacagtgtggaaa

SEQ ID NO: 189108 - DNA, 20 bp, Artificial Sequence
  Synthetic oligonucleotide; AGAGAAA chr2 60525095 60525114 60525111 +
tatgtaggctatgtccatac

SEQ ID NO: 189109 - DNA, 20 bp, Artificial Sequence
  Synthetic oligonucleotide; GGAGAAA chr2 60525252 60525271 60525268 +
ttgcccaaaaaagcaaactt

SEQ ID NO: 189110 - DNA, 20 bp, Artificial Sequence
  Synthetic oligonucleotide; GGAGAAA chr2 60525317 60525336 60525333 +
gcttgcaacaattaaaagat

SEQ ID NO: 189111 - DNA, 20 bp, Artificial Sequence
  Synthetic oligonucleotide; CAAGAAA chr2 60525481 60525500 60525497 +
cttccatctttgaggcaaat

SEQ ID NO: 189112 - DNA, 20 bp, Artificial Sequence
  Synthetic oligonucleotide; GGAGAAA chr2 60525550 60525569 60525566 +
tagattccaaaaaatagcag

SEQ ID NO: 189113 - DNA, 20 bp, Artificial Sequence
  Synthetic oligonucleotide; AAAGAAT chr2 60526029 60526048 60526045 +
atggcagcagggctgggaaa

SEQ ID NO: 189114 - DNA, 20 bp, Artificial Sequence
  Synthetic oligonucleotide; TCAGAAA chr2 60526153 60526172 60526169 +
aaatctagatttgatcaaat

SEQ ID NO: 189115 - DNA, 20 bp, Artificial Sequence
  Synthetic oligonucleotide; TCAGAAT chr2 60526178 60526197 60526194 +
aactggtgatttgatcaaat

SEQ ID NO: 189116 - DNA, 20 bp, Artificial Sequence
  Synthetic oligonucleotide; GCAGAAA chr2 60526211 60526230 60526227 +
ttttgggatgatgtgttcta

SEQ ID NO: 189117 - DNA, 20 bp, Artificial Sequence
  Synthetic oligonucleotide; GTAGAAA chr2 60526940 60526959 60526956 +
gacatttcaatcaggttgaa

SEQ ID NO: 189118 - DNA, 20 bp, Artificial Sequence
  Synthetic oligonucleotide; GCAGAAA chr2 60527139 60527158 60527155 +
tttgtgcttacctaacgaag

SEQ ID NO: 189119 - DNA, 20 bp, Artificial Sequence
  Synthetic oligonucleotide; ACAGAAA chr2 60527145 60527164 60527161 +
cttacctaacgaaggcagaa

SEQ ID NO: 189120 - DNA, 20 bp, Artificial Sequence
  Synthetic oligonucleotide; AAAGAAA chr2 60527151 60527170 60527167 +
taacgaaggcagaaacagaa

SEQ ID NO: 189121 - DNA, 20 bp, Artificial Sequence
  Synthetic oligonucleotide; AAAGAAA chr2 60527157 60527176 60527173 +
aggcagaaacagaaaaagaa

SEQ ID NO: 189122 - DNA, 20 bp, Artificial Sequence
  Synthetic oligonucleotide; GGAGAAT chr2 60527794 60527813 60527810 +
cctggccaatttgaaaggat

SEQ ID NO: 189123 - DNA, 20 bp, Artificial Sequence
  Synthetic oligonucleotide; CCAGAAA chr2 60528059 60528078 60528075 +
cttaccacagccttgttcag

SEQ ID NO: 189124 - DNA, 20 bp, Artificial Sequence
  Synthetic oligonucleotide; TAAGAAA chr2 60528113 60528132 60528129 +
ccccccagaacccatcgtcc

SEQ ID NO: 189125 - DNA, 20 bp, Artificial Sequence
  Synthetic oligonucleotide; GAAGAAA chr2 60528592 60528611 60528608 +
agttgttgcctggcaccgct

SEQ ID NO: 189126 - DNA, 20 bp, Artificial Sequence
  Synthetic oligonucleotide; ATAGAAA chr2 60528960 60528979 60528976 +
cccaaccagctagcagtaac

SEQ ID NO: 189127 - DNA, 20 bp, Artificial Sequence
  Synthetic oligonucleotide; CCAGAAA chr2 60529073 60529092 60529089 +
cacccacgagggagctgcca

SEQ ID NO: 189128 - DNA, 20 bp, Artificial Sequence
  Synthetic oligonucleotide; CTAGAAA chr2 60529388 60529407 60529404 +
atctgcccaaggttgcacaa

SEQ ID NO: 189129 - DNA, 20 bp, Artificial Sequence
  Synthetic oligonucleotide; GAAGAAA chr2 60529452 60529471 60529468 +
tttcgtgtaatcaaagagaa

SEQ ID NO: 189130 - DNA, 20 bp, Artificial Sequence
  Synthetic oligonucleotide; AAAGAAA chr2 60529457 60529476 60529473 +
tgtaatcaaagagaagaaga

SEQ ID NO: 189131 - DNA, 20 bp, Artificial Sequence
  Synthetic oligonucleotide; CTAGAAA chr2 60529663 60529682 60529679 +
ttcccagtttttatttgcta

SEQ ID NO: 189132 - DNA, 20 bp, Artificial Sequence
  Synthetic oligonucleotide; TAAGAAA chr2 60530102 60530121 60530118 +
acaggaagaggccaagaaga

SEQ ID NO: 189133 - DNA, 20 bp, Artificial Sequence
  Synthetic oligonucleotide; AAAGAAA chr2 60530659 60530678 60530675 +
acagtcagcaggtatttaaa

SEQ ID NO: 189134 - DNA, 20 bp, Artificial Sequence
  Synthetic oligonucleotide; AAAGAAA chr2 60530663 60530682 60530679 +
tcagcaggtatttaaaaaag

SEQ ID NO: 189135 - DNA, 20 bp, Artificial Sequence
  Synthetic oligonucleotide; AAAGAAA chr2 60530667 60530686 60530683 +
caggtatttaaaaaagaaag

SEQ ID NO: 189136 - DNA, 20 bp, Artificial Sequence
  Synthetic oligonucleotide; TCAGAAA chr2 60531129 60531148 60531145 +
ttaagcccctcctggcaacc

SEQ ID NO: 189137 - DNA, 20 bp, Artificial Sequence
  Synthetic oligonucleotide; AGAGAAA chr2 60531138 60531157 60531154 +
tcctggcaacctcagaaatt

SEQ ID NO: 189138 - DNA, 20 bp, Artificial Sequence
  Synthetic oligonucleotide; ACAGAAT chr2 60531249 60531268 60531265 +
acacaaatcccgttggaccc

SEQ ID NO: 189139 - DNA, 20 bp, Artificial Sequence
  Synthetic oligonucleotide; CCAGAAA chr2 60531285 60531304 60531301 +
cctctcacactaacactaaa

SEQ ID NO: 189140 - DNA, 20 bp, Artificial Sequence
  Synthetic oligonucleotide; CAAGAAT chr2 60531332 60531351 60531348 +
gccccctcctttgcgttctg

SEQ ID NO: 189141 - DNA, 20 bp, Artificial Sequence
  Synthetic oligonucleotide; GAAGAAA chr2 60532112 60532131 60532128 +
tcgaatctaattaagatcag

SEQ ID NO: 189142 - DNA, 20 bp, Artificial Sequence
  Synthetic oligonucleotide; TGAGAAT chr2 60532172 60532191 60532188 +
cacagaagttcttcaaattt

SEQ ID NO: 189143 - DNA, 20 bp, Artificial Sequence
  Synthetic oligonucleotide; TCAGAAA chr2 60532435 60532454 60532451 +
gtggtggcgttaatgtttct

SEQ ID NO: 189144 - DNA, 20 bp, Artificial Sequence
  Synthetic oligonucleotide; AAAGAAA chr2 60532548 60532567 60532564 +
cttggtatgtgaatggcgaa

SEQ ID NO: 189145 - DNA, 20 bp, Artificial Sequence
  Synthetic oligonucleotide; AAAGAAA chr2 60532562 60532581 60532578 +
ggcgaaaaagaaaaaaaagg

SEQ ID NO: 189146 - DNA, 20 bp, Artificial Sequence
  Synthetic oligonucleotide; AAAGAAA chr2 60532570 60532589 60532586 +
agaaaaaaaaggaaagaaaa

SEQ ID NO: 189147 - DNA, 20 bp, Artificial Sequence
  Synthetic oligonucleotide; TAAGAAA chr2 60532896 60532915 60532912 +
accaaaatttaatggtgact

SEQ ID NO: 189148 - DNA, 20 bp, Artificial Sequence
  Synthetic oligonucleotide; GTAGAAT chr2 60532928 60532947 60532944 +
atactttttatttacttcct

SEQ ID NO: 189149 - DNA, 20 bp, Artificial Sequence
  Synthetic oligonucleotide; TTAGAAT chr2 60533013 60533032 60533029 +
cactagattatgccaatcta

SEQ ID NO: 189150 - DNA, 20 bp, Artificial Sequence
  Synthetic oligonucleotide; AGAGAAA chr2 60533325 60533344 60533341 +
gtttgggggagagagagagg

SEQ ID NO: 189151 - DNA, 20 bp, Artificial Sequence
  Synthetic oligonucleotide; CAAGAAA chr2 60533610 60533629 60533626 +
tcttagtaaagcaattacat

SEQ ID NO: 189152 - DNA, 20 bp, Artificial Sequence
  Synthetic oligonucleotide; GCAGAAT chr2 60533686 60533705 60533702 +
aggctgtgaagtcggagagg

SEQ ID NO: 189153 - DNA, 20 bp, Artificial Sequence
  Synthetic oligonucleotide; TCAGAAT chr2 60533980 60533999 60533996 +
tcattaaacattcgttttaa

SEQ ID NO: 189154 - DNA, 20 bp, Artificial Sequence
  Synthetic oligonucleotide; TGAGAAA chr2 60534261 60534280 60534277 +
agctcagagcagcagctgaa

SEQ ID NO: 189155 - DNA, 20 bp, Artificial Sequence
  Synthetic oligonucleotide; GAAGAAA chr2 60534344 60534363 60534360 +
gtgccagccatctatctaaa

SEQ ID NO: 189156 - DNA, 20 bp, Artificial Sequence
  Synthetic oligonucleotide; TTAGAAA chr2 60534363 60534382 60534379 +
agaagaaacctaaagcattg

SEQ ID NO: 189157 - DNA, 20 bp, Artificial Sequence
  Synthetic oligonucleotide; ACAGAAA chr2 60534495 60534514 60534511 +
ccctgcaatgttcgtgggga

SEQ ID NO: 189158 - DNA, 20 bp, Artificial Sequence
  Synthetic oligonucleotide; AAAGAAA chr2 60534624 60534643 60534640 +
acaaactgtacttaacgtta

SEQ ID NO: 189159 - DNA, 20 bp, Artificial Sequence
  Synthetic oligonucleotide; GAAGAAA chr2 60534889 60534908 60534905 +
tggtgaacttttaatcttga

SEQ ID NO: 189160 - DNA, 20 bp, Artificial Sequence
  Synthetic oligonucleotide; TAAGAAT chr2 60534946 60534965 60534962 +
attttgcaagattgaaaatc

SEQ ID NO: 189161 - DNA, 20 bp, Artificial Sequence
  Synthetic oligonucleotide; TTAGAAT chr2 60535094 60535113 60535110 +
ctggaaggacctaatggtca

SEQ ID NO: 189162 - DNA, 20 bp, Artificial Sequence
  Synthetic oligonucleotide; CAAGAAA chr2 60535643 60535662 60535659 +
tgcttccaaagggaaaccag

SEQ ID NO: 189163 - DNA, 20 bp, Artificial Sequence
  Synthetic oligonucleotide; TCAGAAA chr2 60535800 60535819 60535816 +
atgcagacatcagctgacat

SEQ ID NO: 189164 - DNA, 20 bp, Artificial Sequence
  Synthetic oligonucleotide; GAAGAAT chr2 60535901 60535920 60535917 +
tttccaattactagtctgga

SEQ ID NO: 189165 - DNA, 20 bp, Artificial Sequence
  Synthetic oligonucleotide; ACAGAAT chr2 60535968 60535987 60535984 +
acatttaaaaaattctagtg

SEQ ID NO: 189166 - DNA, 20 bp, Artificial Sequence
  Synthetic oligonucleotide; CAAGAAA chr2 60536031 60536050 60536047 +
ctctccaacccaggtgaaag

SEQ ID NO: 189167 - DNA, 20 bp, Artificial Sequence
  Synthetic oligonucleotide; TGAGAAT chr2 60536079 60536098 60536095 +
agctggtgtgcaagtcagac

SEQ ID NO: 189168 - DNA, 20 bp, Artificial Sequence
  Synthetic oligonucleotide; GAAGAAT chr2 60536177 60536196 60536193 +
atttcatttgaactgctatc

SEQ ID NO: 189169 - DNA, 20 bp, Artificial Sequence
  Synthetic oligonucleotide; GGAGAAA chr2 60536299 60536318 60536315 +
aaggaaatcggaaagagaag

SEQ ID NO: 189170 - DNA, 20 bp, Artificial Sequence
  Synthetic oligonucleotide; TCAGAAA chr2 60536358 60536377 60536374 +
ctcttatccttgggccctgc

SEQ ID NO: 189171 - DNA, 20 bp, Artificial Sequence
  Synthetic oligonucleotide; TTAGAAA chr2 60536386 60536405 60536402 +
gtgccacattttaacattta

SEQ ID NO: 189172 - DNA, 20 bp, Artificial Sequence
  Synthetic oligonucleotide; TCAGAAT chr2 60536541 60536560 60536557 +
atgggatgtgacagggcaaa

SEQ ID NO: 189173 - DNA, 20 bp, Artificial Sequence
  Synthetic oligonucleotide; TTAGAAA chr2 60536566 60536585 60536582 +
attagattaaaaacaaaagt

SEQ ID NO: 189174 - DNA, 20 bp, Artificial Sequence
  Synthetic oligonucleotide; TCAGAAA chr2 60536694 60536713 60536710 +
ctggcaacaccgcaatcaca

SEQ ID NO: 189175 - DNA, 20 bp, Artificial Sequence
  Synthetic oligonucleotide; GTAGAAT chr2 60536983 60537002 60536999 +
gttaagcaatccacttgtat

SEQ ID NO: 189176 - DNA, 20 bp, Artificial Sequence
  Synthetic oligonucleotide; GAAGAAA chr2 60537036 60537055 60537052 +
gtcacacagctccaagatca

SEQ ID NO: 189177 - DNA, 20 bp, Artificial Sequence
  Synthetic oligonucleotide; TCAGAAT chr2 60537120 60537139 60537136 +
aagatccaagagtatcttta

SEQ ID NO: 189178 - DNA, 20 bp, Artificial Sequence
  Synthetic oligonucleotide; AGAGAAA chr2 60537295 60537314 60537311 +
aaaatattagggtgtgatgg

SEQ ID NO: 189179 - DNA, 20 bp, Artificial Sequence
  Synthetic oligonucleotide; GGAGAAT chr2 60537463 60537482 60537479 +
gtataccttgagttggtgaa

SEQ ID NO: 189180 - DNA, 20 bp, Artificial Sequence
  Synthetic oligonucleotide; TAAGAAT chr2 60537604 60537623 60537620 +
tagtgctttgtgctccaaca

SEQ ID NO: 189181 - DNA, 20 bp, Artificial Sequence
  Synthetic oligonucleotide; TAAGAAA chr2 60537685 60537704 60537701 +
ttttatgcatcattacatat

SEQ ID NO: 189182 - DNA, 20 bp, Artificial Sequence
  Synthetic oligonucleotide; TTAGAAA chr2 60537756 60537775 60537772 +
aaaaagcttccttgtgtttt

SEQ ID NO: 189183 - DNA, 20 bp, Artificial Sequence
  Synthetic oligonucleotide; ATAGAAA chr2 60537776 60537795 60537792 +
ttagaaagttcaaaaagcaa

SEQ ID NO: 189184 - DNA, 20 bp, Artificial Sequence
  Synthetic oligonucleotide; TGAGAAT chr2 60537953 60537972 60537969 +
attggcaatgctaacaacag

SEQ ID NO: 189185 - DNA, 20 bp, Artificial Sequence
  Synthetic oligonucleotide; GAAGAAA chr2 60539002 60539021 60539018 +
ttggggagacaactccaaga

SEQ ID NO: 189186 - DNA, 20 bp, Artificial Sequence
  Synthetic oligonucleotide; CAAGAAT chr2 60539047 60539066 60539063 +
cgctatagatcaaaggagaa

SEQ ID NO: 189187 - DNA, 20 bp, Artificial Sequence
  Synthetic oligonucleotide; GCAGAAT chr2 60539390 60539409 60539406 +
caacctaactcaatgccatt

SEQ ID NO: 189188 - DNA, 20 bp, Artificial Sequence
  Synthetic oligonucleotide; TCAGAAA chr2 60539408 60539427 60539424 +
ttgcagaatgacgaatgagc

SEQ ID NO: 189189 - DNA, 20 bp, Artificial Sequence
  Synthetic oligonucleotide; TTAGAAA chr2 60539563 60539582 60539579 +
aagttacattttaaaactga

SEQ ID NO: 189190 - DNA, 20 bp, Artificial Sequence
  Synthetic oligonucleotide; AAAGAAT chr2 60539700 60539719 60539716 +
aggagcacatgtagagagct

SEQ ID NO: 189191 - DNA, 20 bp, Artificial Sequence
  Synthetic oligonucleotide; ACAGAAA chr2 60539748 60539767 60539764 +
tcctggaaattaagtttgtg

SEQ ID NO: 189192 - DNA, 20 bp, Artificial Sequence
  Synthetic oligonucleotide; GGAGAAA chr2 60539917 60539936 60539933 +
gatgcccatttacctaggta

SEQ ID NO: 189193 - DNA, 20 bp, Artificial Sequence
  Synthetic oligonucleotide; TTAGAAT chr2 60540107 60540126 60540123 +
tgttaaaagtgggctctaag

SEQ ID NO: 189194 - DNA, 20 bp, Artificial Sequence
  Synthetic oligonucleotide; GCAGAAA chr2 60540181 60540200 60540197 +
cccaaatgaaatctgaacaa

SEQ ID NO: 189195 - DNA, 20 bp, Artificial Sequence
  Synthetic oligonucleotide; TGAGAAA chr2 60540554 60540573 60540570 +
cctttattaaacattttcat

SEQ ID NO: 189196 - DNA, 20 bp, Artificial Sequence
  Synthetic oligonucleotide; AGAGAAA chr2 60540826 60540845 60540842 +
attatatgccacattcacta

SEQ ID NO: 189197 - DNA, 20 bp, Artificial Sequence
  Synthetic oligonucleotide; TAAGAAA chr2 60540905 60540924 60540921 +
caacaaggaatggggtgatt

SEQ ID NO: 189198 - DNA, 20 bp, Artificial Sequence
  Synthetic oligonucleotide; ACAGAAT chr2 60541005 60541024 60541021 +
ttttgtttttttaagctttc

SEQ ID NO: 189199 - DNA, 20 bp, Artificial Sequence
  Synthetic oligonucleotide; ACAGAAA chr2 60541129 60541148 60541145 +
actgtctgtaacagcaggag

SEQ ID NO: 189200 - DNA, 20 bp, Artificial Sequence
  Synthetic oligonucleotide; TTAGAAA chr2 60541470 60541489 60541486 +
agttctatttacaatttgtc

SEQ ID NO: 189201 - DNA, 20 bp, Artificial Sequence
  Synthetic oligonucleotide; TTAGAAA chr2 60541647 60541666 60541663 +
atgaaaatcctaggtactta

SEQ ID NO: 189202 - DNA, 20 bp, Artificial Sequence
  Synthetic oligonucleotide; TCAGAAT chr2 60541785 60541804 60541801 +
cagaagtcagtcgtttttat

SEQ ID NO: 189203 - DNA, 20 bp, Artificial Sequence
  Synthetic oligonucleotide; AGAGAAA chr2 60541803 60541822 60541819 +
attcagaatcacataaataa

SEQ ID NO: 189204 - DNA, 20 bp, Artificial Sequence
  Synthetic oligonucleotide; AAAGAAA chr2 60541808 60541827 60541824 +
gaatcacataaataaagaga

SEQ ID NO: 189205 - DNA, 20 bp, Artificial Sequence
  Synthetic oligonucleotide; AGAGAAT chr2 60541911 60541930 60541927 +
ccagttcagtctgagctagg

SEQ ID NO: 189206 - DNA, 20 bp, Artificial Sequence
  Synthetic oligonucleotide; TCAGAAT chr2 60541917 60541936 60541933 +
cagtctgagctaggagagaa

SEQ ID NO: 189207 - DNA, 20 bp, Artificial Sequence
  Synthetic oligonucleotide; AAAGAAA chr2 60541932 60541951 60541948 +
gagaatcagaatggatacaa

SEQ ID NO: 189208 - DNA, 20 bp, Artificial Sequence
  Synthetic oligonucleotide; AGAGAAA chr2 60542142 60542161 60542158 +
gtctatgttcatgattttaa

SEQ ID NO: 189209 - DNA, 20 bp, Artificial Sequence
  Synthetic oligonucleotide; AAAGAAA chr2 60542402 60542421 60542418 +
taaaatatgagactaaaaaa

SEQ ID NO: 189210 - DNA, 20 bp, Artificial Sequence
  Synthetic oligonucleotide; AAAGAAT chr2 60542698 60542717 60542714 +
cccatctattcaccaggtaa

SEQ ID NO: 189211 - DNA, 20 bp, Artificial Sequence
  Synthetic oligonucleotide; GGAGAAT chr2 60542917 60542936 60542933 +
ctacttgggaggctgaggca

SEQ ID NO: 189212 - DNA, 20 bp, Artificial Sequence
  Synthetic oligonucleotide; AAAGAAA chr2 60543425 60543444 60543441 +
tgtttccttcctcatcataa

SEQ ID NO: 189213 - DNA, 20 bp, Artificial Sequence
  Synthetic oligonucleotide; AGAGAAA chr2 60543462 60543481 60543478 +
gaattgtgcagacgtgcttt

SEQ ID NO: 189214 - DNA, 20 bp, Artificial Sequence
  Synthetic oligonucleotide; GTAGAAT chr2 60543555 60543574 60543571 +
gtcggaatttatgtgcaatg

SEQ ID NO: 189215 - DNA, 20 bp, Artificial Sequence
  Synthetic oligonucleotide; AAAGAAA chr2 60543708 60543727 60543724 +
acaggtgattaaacacaatg

SEQ ID NO: 189216 - DNA, 20 bp, Artificial Sequence
  Synthetic oligonucleotide; ACAGAAT chr2 60544066 60544085 60544082 +
cctcctctaaatacagaggc

SEQ ID NO: 189217 - DNA, 20 bp, Artificial Sequence
  Synthetic oligonucleotide; CAAGAAA chr2 60544433 60544452 60544449 +
taaggtaaatgtggtggatt

SEQ ID NO: 189218 - DNA, 20 bp, Artificial Sequence
  Synthetic oligonucleotide; ACAGAAA chr2 60544513 60544532 60544529 +
gaaagtatctgagtgctatc

SEQ ID NO: 189219 - DNA, 20 bp, Artificial Sequence
  Synthetic oligonucleotide; AAAGAAA chr2 60544529 60544548 60544545 +
tatcacagaaagcactaaaa

SEQ ID NO: 189220 - DNA, 20 bp, Artificial Sequence
  Synthetic oligonucleotide; AAAGAAA chr2 60544533 60544552 60544549 +
acagaaagcactaaaaaaag

SEQ ID NO: 189221 - DNA, 20 bp, Artificial Sequence
  Synthetic oligonucleotide; GGAGAAA chr2 60544582 60544601 60544598 +
tcaaattctagagggggaga

SEQ ID NO: 189222 - DNA, 20 bp, Artificial Sequence
  Synthetic oligonucleotide; GAAGAAA chr2 60544755 60544774 60544771 +
agctgggtggtaggtagatg

SEQ ID NO: 189223 - DNA, 20 bp, Artificial Sequence
  Synthetic oligonucleotide; ACAGAAT chr2 60544796 60544815 60544812 +
ggcatggcatgtctgtcatc

SEQ ID NO: 189224 - DNA, 20 bp, Artificial Sequence
  Synthetic oligonucleotide; CGAGAAA chr2 60544936 60544955 60544952 +
ttccttttcccttgagctgc

SEQ ID NO: 189225 - DNA, 20 bp, Artificial Sequence
  Synthetic oligonucleotide; CAAGAAA chr2 60545018 60545037 60545034 +
aatacgtgtgtgtatttttc

SEQ ID NO: 189226 - DNA, 20 bp, Artificial Sequence
  Synthetic oligonucleotide; GCAGAAA chr2 60545044 60545063 60545060 +
aatttttacattgtgttata

SEQ ID NO: 189227 - DNA, 20 bp, Artificial Sequence
  Synthetic oligonucleotide; GAAGAAA chr2 60545675 60545694 60545691 +
aatgagaaggtggggatggg

SEQ ID NO: 189228 - DNA, 20 bp, Artificial Sequence
  Synthetic oligonucleotide; AAAGAAA chr2 60545680 60545699 60545696 +
gaaggtggggatggggaaga

SEQ ID NO: 189229 - DNA, 20 bp, Artificial Sequence
  Synthetic oligonucleotide; ACAGAAA chr2 60545798 60545817 60545814 +
ctgtgttctggacgtaagca

SEQ ID NO: 189230 - DNA, 20 bp, Artificial Sequence
  Synthetic oligonucleotide; AGAGAAA chr2 60545854 60545873 60545870 +
ggacagtcacatagagtaat

SEQ ID NO: 189231 - DNA, 20 bp, Artificial Sequence
  Synthetic oligonucleotide; AAAGAAA chr2 60545908 60545927 60545924 +
tacagcacctctgaaaatga

SEQ ID NO: 189232 - DNA, 20 bp, Artificial Sequence
  Synthetic oligonucleotide; TAAGAAT chr2 60546152 60546171 60546168 +
ccgtttgtgctcgataaaaa

SEQ ID NO: 189233 - DNA, 20 bp, Artificial Sequence
  Synthetic oligonucleotide; TAAGAAT chr2 60546257 60546276 60546273 +
gtggtctggttcatcatctg

SEQ ID NO: 189234 - DNA, 20 bp, Artificial Sequence
  Synthetic oligonucleotide; GGAGAAA chr2 60546289 60546308 60546305 +
caagaggctcggctgtggtt

SEQ ID NO: 189235 - DNA, 20 bp, Artificial Sequence
  Synthetic oligonucleotide; ACAGAAA chr2 60546327 60546346 60546343 +
ttattagagtgccagagagg

SEQ ID NO: 189236 - DNA, 20 bp, Artificial Sequence
  Synthetic oligonucleotide; CCAGAAA chr2 60546409 60546428 60546425 +
taggcttctctatataatac

SEQ ID NO: 189237 - DNA, 20 bp, Artificial Sequence
  Synthetic oligonucleotide; AAAGAAA chr2 60546499 60546518 60546515 +
aggcaaatcatcacatatgt

SEQ ID NO: 189238 - DNA, 20 bp, Artificial Sequence
  Synthetic oligonucleotide; TTAGAAA chr2 60546596 60546615 60546612 +
aatgtgtctggtttgtaagt

SEQ ID NO: 189239 - DNA, 20 bp, Artificial Sequence
  Synthetic oligonucleotide; AAAGAAT chr2 60546600 60546619 60546616 +
tgtctggtttgtaagtttag

SEQ ID NO: 189240 - DNA, 20 bp, Artificial Sequence
  Synthetic oligonucleotide; AAAGAAA chr2 60546636 60546655 60546652 +
atagttaacacagggaacat

SEQ ID NO: 189241 - DNA, 20 bp, Artificial Sequence
  Synthetic oligonucleotide; CAAGAAA chr2 60546659 60546678 60546675 +
gaaagcttaaataataacta

SEQ ID NO: 189242 - DNA, 20 bp, Artificial Sequence
  Synthetic oligonucleotide; ATAGAAA chr2 60546688 60546707 60546704 +
ctggttaaaaaaaaaagtgg

SEQ ID NO: 189243 - DNA, 20 bp, Artificial Sequence
  Synthetic oligonucleotide; AAAGAAT chr2 60546741 60546760 60546757 +
accaagttgtccattgtgcc

SEQ ID NO: 189244 - DNA, 20 bp, Artificial Sequence
  Synthetic oligonucleotide; TTAGAAA chr2 60546828 60546847 60546844 +
aacagacatggcttcataaa

SEQ ID NO: 189245 - DNA, 20 bp, Artificial Sequence
  Synthetic oligonucleotide; TAAGAAA chr2 60546880 60546899 60546896 +
ccacatttacactgctgtaa

SEQ ID NO: 189246 - DNA, 20 bp, Artificial Sequence
  Synthetic oligonucleotide; AAAGAAA chr2 60546993 60547012 60547009 +
ctcagcagtgccacaaaatc

SEQ ID NO: 189247 - DNA, 20 bp, Artificial Sequence
  Synthetic oligonucleotide; TAAGAAA chr2 60547061 60547080 60547077 +
atgggatacttttgagtact

SEQ ID NO: 189248 - DNA, 20 bp, Artificial Sequence
  Synthetic oligonucleotide; TGAGAAA chr2 60547098 60547117 60547114 +
tagtcattttttttttattc

SEQ ID NO: 189249 - DNA, 20 bp, Artificial Sequence
  Synthetic oligonucleotide; TCAGAAT chr2 60547163 60547182 60547179 +
tggcatctatgatataaaaa

SEQ ID NO: 189250 - DNA, 20 bp, Artificial Sequence
  Synthetic oligonucleotide; GCAGAAA chr2 60547555 60547574 60547571 +
tgccagttaataaaactgaa

SEQ ID NO: 189251 - DNA, 20 bp, Artificial Sequence
  Synthetic oligonucleotide; AGAGAAT chr2 60547642 60547661 60547658 +
tttaatgaacttaaagccac

SEQ ID NO: 189252 - DNA, 20 bp, Artificial Sequence
  Synthetic oligonucleotide; GTAGAAT chr2 60547673 60547692 60547689 +
aaatagattttaatttgagt

SEQ ID NO: 189253 - DNA, 20 bp, Artificial Sequence
  Synthetic oligonucleotide; ACAGAAT chr2 60547992 60548011 60548008 +
atactggccaaaagataaat

SEQ ID NO: 189254 - DNA, 20 bp, Artificial Sequence
  Synthetic oligonucleotide; CAAGAAT chr2 60548653 60548672 60548669 +
cgtaaattattgctaattaa

SEQ ID NO: 189255 - DNA, 20 bp, Artificial Sequence
  Synthetic oligonucleotide; AGAGAAA chr2 60548726 60548745 60548742 +
acatttggctagtggtgttc

SEQ ID NO: 189256 - DNA, 20 bp, Artificial Sequence
  Synthetic oligonucleotide; AAAGAAA chr2 60548793 60548812 60548809 +
aatcagacaaagtgggacac

SEQ ID NO: 189257 - DNA, 20 bp, Artificial Sequence
  Synthetic oligonucleotide; GAAGAAA chr2 60549120 60549139 60549136 +
aattctctctacgaggggag

SEQ ID NO: 189258 - DNA, 20 bp, Artificial Sequence
  Synthetic oligonucleotide; ATAGAAA chr2 60549126 60549145 60549142 +
ctctacgaggggaggaagaa

SEQ ID NO: 189259 - DNA, 20 bp, Artificial Sequence
  Synthetic oligonucleotide; AAAGAAT chr2 60549227 60549246 60549243 +
ttcctctctgtgtagttgca

SEQ ID NO: 189260 - DNA, 20 bp, Artificial Sequence
  Synthetic oligonucleotide; AAAGAAA chr2 60549423 60549442 60549439 +
gaaattcagagaggaaaagc

SEQ ID NO: 189261 - DNA, 20 bp, Artificial Sequence
  Synthetic oligonucleotide; GCAGAAA chr2 60549488 60549507 60549504 +
ccccggcaagggtggaccgt

SEQ ID NO: 189262 - DNA, 20 bp, Artificial Sequence
  Synthetic oligonucleotide; AAAGAAA chr2 60550189 60550208 60550205 +
taccaaaaatgccggccccg

SEQ ID NO: 189263 - DNA, 20 bp, Artificial Sequence
  Synthetic oligonucleotide; AGAGAAA chr2 60550348 60550367 60550364 +
gacatacggggtgatggggg

SEQ ID NO: 189264 - DNA, 20 bp, Artificial Sequence
  Synthetic oligonucleotide; CGAGAAT chr2 60550419 60550438 60550435 +
aaagctcgttcctccccgga

SEQ ID NO: 189265 - DNA, 20 bp, Artificial Sequence
  Synthetic oligonucleotide; CCAGAAA chr2 60550594 60550613 60550610 +
ctcctgccccctctgagcac

SEQ ID NO: 189266 - DNA, 20 bp, Artificial Sequence
  Synthetic oligonucleotide; ACAGAAA chr2 60550607 60550626 60550623 +
tgagcacccagaaaatgagg

SEQ ID NO: 189267 - DNA, 20 bp, Artificial Sequence
  Synthetic oligonucleotide; TAAGAAT chr2 60551132 60551151 60551148 +
actgcatcaaaaatttaaag

SEQ ID NO: 189268 - DNA, 20 bp, Artificial Sequence
  Synthetic oligonucleotide; TGAGAAA chr2 60551537 60551556 60551553 +
agctgtggacaagagacgtc

SEQ ID NO: 189269 - DNA, 20 bp, Artificial Sequence
  Synthetic oligonucleotide; ACAGAAA chr2 60552154 60552173 60552170 +
gagtcaaagagaaggccgtc

SEQ ID NO: 189270 - DNA, 20 bp, Artificial Sequence
  Synthetic oligonucleotide; CAAGAAA chr2 60552195 60552214 60552211 +
gtttggcttcggtttggggg

SEQ ID NO: 189271 - DNA, 20 bp, Artificial Sequence
  Synthetic oligonucleotide; AGAGAAA chr2 60552909 60552928 60552925 +
cattgcattccttttcgaaa

SEQ ID NO: 189272 - DNA, 20 bp, Artificial Sequence
  Synthetic oligonucleotide; CGAGAAT chr2 60553197 60553216 60553213 +
ctattattgggttacttacg

SEQ ID NO: 189273 - DNA, 20 bp, Artificial Sequence
  Synthetic oligonucleotide; TTAGAAA chr2 60553332 60553351 60553348 +
ttcacatcgggagagccggg

SEQ ID NO: 189274 - DNA, 20 bp, Artificial Sequence
  Synthetic oligonucleotide; AGAGAAA chr2 60553351 60553370 60553367 +
gttagaaagaaggagactcc

SEQ ID NO: 189275 - DNA, 20 bp, Artificial Sequence
  Synthetic oligonucleotide; TTAGAAA chr2 60553394 60553413 60553410 +
cttttgacatccaaaataaa

SEQ ID NO: 189276 - DNA, 20 bp, Artificial Sequence
  Synthetic oligonucleotide; GAAGAAA chr2 60553901 60553920 60553917 +
gcggtggcgtggccgggaga

SEQ ID NO: 189277 - DNA, 20 bp, Artificial Sequence
  Synthetic oligonucleotide; AAAGAAA chr2 60554004 60554023 60554020 +
aaaatgaaagattattcaaa

SEQ ID NO: 189278 - DNA, 20 bp, Artificial Sequence
  Synthetic oligonucleotide; AAAGAAA chr2 60554235 60554254 60554251 +
ttgcccgaggagaggacagc

SEQ ID NO: 189279 - DNA, 20 bp, Artificial Sequence
  Synthetic oligonucleotide; GCAGAAA chr2 60554549 60554568 60554565 +
gtccccggctcctaagggtc

SEQ ID NO: 189280 - DNA, 20 bp, Artificial Sequence
  Synthetic oligonucleotide; GAAGAAA chr2 60554802 60554821 60554818 +
gcaaaagcacagagggatgg

SEQ ID NO: 189281 - DNA, 20 bp, Artificial Sequence
  Synthetic oligonucleotide; AGAGAAA chr2 60554859 60554878 60554875 +
ctgtgctgttacccagggaa

SEQ ID NO: 189282 - DNA, 20 bp, Artificial Sequence
  Synthetic oligonucleotide; TCAGAAA chr2 60555194 60555213 60555210 +
cctgcgattggaaagtttat

SEQ ID NO: 189283 - DNA, 20 bp, Artificial Sequence
  Synthetic oligonucleotide; GGAGAAT chr2 60555332 60555351 60555348 +
tggaaggagttggggggaga

SEQ ID NO: 189284 - DNA, 20 bp, Artificial Sequence
  Synthetic oligonucleotide; TTAGAAA chr2 60555671 60555690 60555687 +
aaagtttcaagtctactgtg

SEQ ID NO: 189285 - DNA, 20 bp, Artificial Sequence
  Synthetic oligonucleotide; GAAGAAA chr2 60555722 60555741 60555738 +
gagcttcggacccctctaag

SEQ ID NO: 189286 - DNA, 20 bp, Artificial Sequence
  Synthetic oligonucleotide; AAAGAAT chr2 60555997 60556016 60556013 +
aaccagccttggagtcacca

SEQ ID NO: 189287 - DNA, 20 bp, Artificial Sequence
  Synthetic oligonucleotide; GAAGAAA chr2 60556071 60556090 60556087 +
gggaaggtgaagagagggaa

SEQ ID NO: 189288 - DNA, 20 bp, Artificial Sequence
  Synthetic oligonucleotide; AAAGAAA chr2 60556113 60556132 60556129 +
ctttgaaaaataaataaata

SEQ ID NO: 189289 - DNA, 20 bp, Artificial Sequence
  Synthetic oligonucleotide; AAAGAAT chr2 60556176 60556195 60556179 -
atctgaaaagcttggttctg

SEQ ID NO: 189290 - DNA, 20 bp, Artificial Sequence
  Synthetic oligonucleotide; ACAGAAT chr2 60555867 60555886 60555870 -
tgaatcctcccgcttcttaa

SEQ ID NO: 189291 - DNA, 20 bp, Artificial Sequence
  Synthetic oligonucleotide; GCAGAAA chr2 60555034 60555053 60555037 -
ctaatttccagggaacgtct

SEQ ID NO: 189292 - DNA, 20 bp, Artificial Sequence
  Synthetic oligonucleotide; TAAGAAA chr2 60554839 60554858 60554842 -
gaacagttgtgctctgcccg

SEQ ID NO: 189293 - DNA, 20 bp, Artificial Sequence
  Synthetic oligonucleotide; CGAGAAA chr2 60553103 60553122 60553106 -
atgcatttttaaatttttca

SEQ ID NO: 189294 - DNA, 20 bp, Artificial Sequence
  Synthetic oligonucleotide; TAAGAAA chr2 60552784 60552803 60552787 -
aggttgcttcccactcaccg

SEQ ID NO: 189295 - DNA, 20 bp, Artificial Sequence
  Synthetic oligonucleotide; GGAGAAA chr2 60552728 60552747 60552731 -
gtctaaaaaacgattcccgg

SEQ ID NO: 189296 - DNA, 20 bp, Artificial Sequence
  Synthetic oligonucleotide; TGAGAAA chr2 60552641 60552660 60552644 -
agtagtcatccccacaatag

SEQ ID NO: 189297 - DNA, 20 bp, Artificial Sequence
  Synthetic oligonucleotide; AGAGAAT chr2 60552235 60552254 60552238 -
aaaataaataaaacaaggca

SEQ ID NO: 189298 - DNA, 20 bp, Artificial Sequence
  Synthetic oligonucleotide; CTAGAAA chr2 60552115 60552134 60552118 -
aaaatctcacaatctctcat

SEQ ID NO: 189299 - DNA, 20 bp, Artificial Sequence
  Synthetic oligonucleotide; AAAGAAA chr2 60551204 60551223 60551207 -
ggaaagtttggcagcaaggg

SEQ ID NO: 189300 - DNA, 20 bp, Artificial Sequence
  Synthetic oligonucleotide; CAAGAAA chr2 60550504 60550523 60550507 -
gctaggaggcagaacaagat

SEQ ID NO: 189301 - DNA, 20 bp, Artificial Sequence
  Synthetic oligonucleotide; GCAGAAT chr2 60550386 60550405 60550389 -
tggggggaaagaacggttag

SEQ ID NO: 189302 - DNA, 20 bp, Artificial Sequence
  Synthetic oligonucleotide; CCAGAAT chr2 60549899 60549918 60549902 -
ccgccgcgcacacccagtgc

SEQ ID NO: 189303 - DNA, 20 bp, Artificial Sequence
  Synthetic oligonucleotide; ACAGAAT chr2 60549835 60549854 60549838 -
aaaagtgtaagcttgtggac

SEQ ID NO: 189304 - DNA, 20 bp, Artificial Sequence
  Synthetic oligonucleotide; AGAGAAT chr2 60549128 60549147 60549131 -
atttcttcctcccctcgtag

SEQ ID NO: 189305 - DNA, 20 bp, Artificial Sequence
  Synthetic oligonucleotide; TTAGAAA chr2 60549034 60549053 60549037 -
gccggagtttaggccggagc

SEQ ID NO: 189306 - DNA, 20 bp, Artificial Sequence
  Synthetic oligonucleotide; AGAGAAA chr2 60548921 60548940 60548924 -
gggaatttgcattaaaatgc

SEQ ID NO: 189307 - DNA, 20 bp, Artificial Sequence
  Synthetic oligonucleotide; CCAGAAA chr2 60548903 60548922 60548906 -
gcagagaaattatcagatgc

SEQ ID NO: 189308 - DNA, 20 bp, Artificial Sequence
  Synthetic oligonucleotide; TGAGAAA chr2 60548878 60548897 60548881 -
aaggaaatgttgattgccac

SEQ ID NO: 189309 - DNA, 20 bp, Artificial Sequence
  Synthetic oligonucleotide; TGAGAAT chr2 60548840 60548859 60548843 -
caaatcagtagactacacca

SEQ ID NO: 189310 - DNA, 20 bp, Artificial Sequence
  Synthetic oligonucleotide; TTAGAAT chr2 60548690 60548709 60548693 -
tgttaaacgtatttcataca

SEQ ID NO: 189311 - DNA, 20 bp, Artificial Sequence
  Synthetic oligonucleotide; ATAGAAA chr2 60548645 60548664 60548648 -
caataatttacgttaagagc

SEQ ID NO: 189312 - DNA, 20 bp, Artificial Sequence
  Synthetic oligonucleotide; GGAGAAT chr2 60548413 60548432 60548416 -
ctttaactatttgataccta

SEQ ID NO: 189313 - DNA, 20 bp, Artificial Sequence
  Synthetic oligonucleotide; TTAGAAA chr2 60548373 60548392 60548376 -
cctaaataatattcccactt

SEQ ID NO: 189314 - DNA, 20 bp, Artificial Sequence
  Synthetic oligonucleotide; AAAGAAT chr2 60548334 60548353 60548337 -
tgggaacaaaaaaaaaaaaa

SEQ ID NO: 189315 - DNA, 20 bp, Artificial Sequence
  Synthetic oligonucleotide; TGAGAAT chr2 60548143 60548162 60548146 -
ttcagacaacaggaatattt

SEQ ID NO: 189316 - DNA, 20 bp, Artificial Sequence
  Synthetic oligonucleotide; GAAGAAT chr2 60548091 60548110 60548094 -
aaatggaagcaaatgtaaga

SEQ ID NO: 189317 - DNA, 20 bp, Artificial Sequence
  Synthetic oligonucleotide; AAAGAAA chr2 60547985 60548004 60547988 -
ttttggccagtatgttgggc

SEQ ID NO: 189318 - DNA, 20 bp, Artificial Sequence
  Synthetic oligonucleotide; CTAGAAA chr2 60547886 60547905 60547889 -
attaggaggagtaccagagg

SEQ ID NO: 189319 - DNA, 20 bp, Artificial Sequence
  Synthetic oligonucleotide; AAAGAAA chr2 60547375 60547394 60547378 -
taaaaaaaaaagcaaacagg

SEQ ID NO: 189320 - DNA, 20 bp, Artificial Sequence
  Synthetic oligonucleotide; GCAGAAA chr2 60547326 60547345 60547329 -
atccgctggtgattatgtgt

SEQ ID NO: 189321 - DNA, 20 bp, Artificial Sequence
  Synthetic oligonucleotide; TCAGAAA chr2 60547288 60547307 60547291 -
tgaagcattttggagctcat

SEQ ID NO: 189322 - DNA, 20 bp, Artificial Sequence
  Synthetic oligonucleotide; AAAGAAA chr2 60547239 60547258 60547242 -
aggcgaagtatttcaagtct

SEQ ID NO: 189323 - DNA, 20 bp, Artificial Sequence
  Synthetic oligonucleotide; TTAGAAT chr2 60547147 60547166 60547150 -
gccaccaagtgcaaacatgt

SEQ ID NO: 189324 - DNA, 20 bp, Artificial Sequence
  Synthetic oligonucleotide; TCAGAAT chr2 60547121 60547140 60547124 -
tattataggcattccatttc

SEQ ID NO: 189325 - DNA, 20 bp, Artificial Sequence
  Synthetic oligonucleotide; TGAGAAA chr2 60547047 60547066 60547050 -
tcccatttagctaatgtgtc

SEQ ID NO: 189326 - DNA, 20 bp, Artificial Sequence
  Synthetic oligonucleotide; GCAGAAA chr2 60546986 60547005 60546989 -
tggcactgctgagagtgaga

SEQ ID NO: 189327 - DNA, 20 bp, Artificial Sequence
  Synthetic oligonucleotide; AAAGAAA chr2 60546731 60546750 60546734 -
acaacttggtgtataggaaa

SEQ ID NO: 189328 - DNA, 20 bp, Artificial Sequence
  Synthetic oligonucleotide; CTAGAAA chr2 60546412 60546431 60546415 -
tgggtattatatagagaagc

SEQ ID NO: 189329 - DNA, 20 bp, Artificial Sequence
  Synthetic oligonucleotide; TTAGAAA chr2 60546128 60546147 60546131 -
aatgcaatggcagcctctgc

SEQ ID NO: 189330 - DNA, 20 bp, Artificial Sequence
  Synthetic oligonucleotide; GGAGAAA chr2 60545956 60545975 60545959 -
agcaggtaaatgagaagcaa

SEQ ID NO: 189331 - DNA, 20 bp, Artificial Sequence
  Synthetic oligonucleotide; ACAGAAA chr2 60545802 60545821 60545805 -
ctgttgcttacgtccagaac

SEQ ID NO: 189332 - DNA, 20 bp, Artificial Sequence
  Synthetic oligonucleotide; CTAGAAT chr2 60544593 60544612 60544596 -
attatttctcctctccccct

SEQ ID NO: 189333 - DNA, 20 bp, Artificial Sequence
  Synthetic oligonucleotide; CAAGAAT chr2 60544164 60544183 60544167 -
aaaacacagtgtctgtcaag

SEQ ID NO: 189334 - DNA, 20 bp, Artificial Sequence
  Synthetic oligonucleotide; CTAGAAT chr2 60543645 60543664 60543648 -
tcaaagtgagatgtcagtaa

SEQ ID NO: 189335 - DNA, 20 bp, Artificial Sequence
  Synthetic oligonucleotide; AAAGAAA chr2 60543384 60543403 60543387 -
atatttgaattgtgtcacaa

SEQ ID NO: 189336 - DNA, 20 bp, Artificial Sequence
  Synthetic oligonucleotide; GAAGAAT chr2 60543327 60543346 60543330 -
gatatattgatgaatctcta

SEQ ID NO: 189337 - DNA, 20 bp, Artificial Sequence
  Synthetic oligonucleotide; CAAGAAT chr2 60543200 60543219 60543203 -
actattttataggcaggaag

SEQ ID NO: 189338 - DNA, 20 bp, Artificial Sequence
  Synthetic oligonucleotide; TTAGAAT chr2 60543155 60543174 60543158 -
cttcctaagataaataaagc

SEQ ID NO: 189339 - DNA, 20 bp, Artificial Sequence
  Synthetic oligonucleotide; GGAGAAT chr2 60543132 60543151 60543135 -
gaattcgggactttcagata

SEQ ID NO: 189340 - DNA, 20 bp, Artificial Sequence
  Synthetic oligonucleotide; ATAGAAA chr2 60542348 60542367 60542351 -
tgtgaaactgctgttccctt

SEQ ID NO: 189341 - DNA, 20 bp, Artificial Sequence
  Synthetic oligonucleotide; AGAGAAA chr2 60542234 60542253 60542237 -
agttagctttttgagagact

SEQ ID NO: 189342 - DNA, 20 bp, Artificial Sequence
  Synthetic oligonucleotide; TCAGAAT chr2 60541985 60542004 60541988 -
aatcaaatacaatatgcttt

SEQ ID NO: 189343 - DNA, 20 bp, Artificial Sequence
  Synthetic oligonucleotide; TTAGAAA chr2 60541978 60541997 60541981 -
tacaatatgcttttcagaat

SEQ ID NO: 189344 - DNA, 20 bp, Artificial Sequence
  Synthetic oligonucleotide; AGAGAAT chr2 60541686 60541705 60541689 -
accttcaaaatccagagagt

SEQ ID NO: 189345 - DNA, 20 bp, Artificial Sequence
  Synthetic oligonucleotide; AGAGAAA chr2 60541558 60541577 60541561 -
gctgtatttgtaaataagac

SEQ ID NO: 189346 - DNA, 20 bp, Artificial Sequence
  Synthetic oligonucleotide; AGAGAAA chr2 60541507 60541526 60541510 -
ttttgtcaaagtacaatgtc

SEQ ID NO: 189347 - DNA, 20 bp, Artificial Sequence
  Synthetic oligonucleotide; ACAGAAA chr2 60541269 60541288 60541272 -
gacattacccttgtggtgac

SEQ ID NO: 189348 - DNA, 20 bp, Artificial Sequence
  Synthetic oligonucleotide; TGAGAAT chr2 60541217 60541236 60541220 -
atcttttataaataatgttt

SEQ ID NO: 189349 - DNA, 20 bp, Artificial Sequence
  Synthetic oligonucleotide; GTAGAAA chr2 60540789 60540808 60540792 -
gctggaaaatgcaactgggt

SEQ ID NO: 189350 - DNA, 20 bp, Artificial Sequence
  Synthetic oligonucleotide; GGAGAAT chr2 60540556 60540575 60540559 -
caatgaaaatgtttaataaa

SEQ ID NO: 189351 - DNA, 20 bp, Artificial Sequence
  Synthetic oligonucleotide; TAAGAAA chr2 60540519 60540538 60540522 -
tggctttgcgtgctggtcag

SEQ ID NO: 189352 - DNA, 20 bp, Artificial Sequence
  Synthetic oligonucleotide; GTAGAAA chr2 60540462 60540481 60540465 -
aaatattaaatttaaccgaa

SEQ ID NO: 189353 - DNA, 20 bp, Artificial Sequence
  Synthetic oligonucleotide; TAAGAAT chr2 60539732 60539751 60539735 -
aggaaatgtaacctgacaaa

SEQ ID NO: 189354 - DNA, 20 bp, Artificial Sequence
  Synthetic oligonucleotide; CCAGAAT chr2 60538979 60538998 60538982 -
tgccacctcccaattcacca

SEQ ID NO: 189355 - DNA, 20 bp, Artificial Sequence
  Synthetic oligonucleotide; GGAGAAA chr2 60538952 60538971 60538955 -
ttttttgcatgtgctggtat

SEQ ID NO: 189356 - DNA, 20 bp, Artificial Sequence
  Synthetic oligonucleotide; ACAGAAT chr2 60538554 60538573 60538557 -
ttttataatgtgttccttta

SEQ ID NO: 189357 - DNA, 20 bp, Artificial Sequence
  Synthetic oligonucleotide; AAAGAAA chr2 60538504 60538523 60538507 -
ggtagatccacaaaacgtat

SEQ ID NO: 189358 - DNA, 20 bp, Artificial Sequence
  Synthetic oligonucleotide; AGAGAAT chr2 60538069 60538088 60538072 -
gaactgaatcagtctctgcc

SEQ ID NO: 189359 - DNA, 20 bp, Artificial Sequence
  Synthetic oligonucleotide; AAAGAAT chr2 60537879 60537898 60537882 -
ttaaaaactcccattaaaat

SEQ ID NO: 189360 - DNA, 20 bp, Artificial Sequence
  Synthetic oligonucleotide; AAAGAAA chr2 60537838 60537857 60537841 -
acctgcaagggtgccttcaa

SEQ ID NO: 189361 - DNA, 20 bp, Artificial Sequence
  Synthetic oligonucleotide; GAAGAAT chr2 60537252 60537271 60537255 -
aaaactgaacattggctact

SEQ ID NO: 189362 - DNA, 20 bp, Artificial Sequence
  Synthetic oligonucleotide; GGAGAAA chr2 60537176 60537195 60537179 -
ttatgtttttgttatgttaa

SEQ ID NO: 189363 - DNA, 20 bp, Artificial Sequence
  Synthetic oligonucleotide; CAAGAAA chr2 60537030 60537049 60537033 -
tggagctgtgtgactggtag

SEQ ID NO: 189364 - DNA, 20 bp, Artificial Sequence
  Synthetic oligonucleotide; AAAGAAA chr2 60537026 60537045 60537029 -
gctgtgtgactggtagcaag

SEQ ID NO: 189365 - DNA, 20 bp, Artificial Sequence
  Synthetic oligonucleotide; TAAGAAA chr2 60536355 60536374 60536358 -
gggcccaaggataagagagt

SEQ ID NO: 189366 - DNA, 20 bp, Artificial Sequence
  Synthetic oligonucleotide; GGAGAAA chr2 60536265 60536284 60536268 -
ttccggtaagatcaactcta

SEQ ID NO: 189367 - DNA, 20 bp, Artificial Sequence
  Synthetic oligonucleotide; CTAGAAT chr2 60535986 60536005 60535989 -
gttcattgggaattctgtca

SEQ ID NO: 189368 - DNA, 20 bp, Artificial Sequence
  Synthetic oligonucleotide; TCAGAAA chr2 60535753 60535772 60535756 -
ctggtgccgaatggaggaaa

SEQ ID NO: 189369 - DNA, 20 bp, Artificial Sequence
  Synthetic oligonucleotide; GCAGAAA chr2 60535646 60535665 60535649 -
ttgctggtttccctttggaa

SEQ ID NO: 189370 - DNA, 20 bp, Artificial Sequence
  Synthetic oligonucleotide; GAAGAAA chr2 60535270 60535289 60535273 -
aaaaaatgaggaaatcatag

SEQ ID NO: 189371 - DNA, 20 bp, Artificial Sequence
  Synthetic oligonucleotide; GGAGAAA chr2 60535010 60535029 60535013 -
tggcctgtcagcctgctgaa

SEQ ID NO: 189372 - DNA, 20 bp, Artificial Sequence
  Synthetic oligonucleotide; GTAGAAA chr2 60534750 60534769 60534753 -
tctcctcctcagatgcccca

SEQ ID NO: 189373 - DNA, 20 bp, Artificial Sequence
  Synthetic oligonucleotide; AGAGAAA chr2 60534542 60534561 60534545 -
tgaggcacttccagatacat

SEQ ID NO: 189374 - DNA, 20 bp, Artificial Sequence
  Synthetic oligonucleotide; GCAGAAT chr2 60534032 60534051 60534035 -
agtttatcactggttaacaa

SEQ ID NO: 189375 - DNA, 20 bp, Artificial Sequence
  Synthetic oligonucleotide; AAAGAAA chr2 60533981 60534000 60533984 -
attaaaacgaatgtttaatg

SEQ ID NO: 189376 - DNA, 20 bp, Artificial Sequence
  Synthetic oligonucleotide; TAAGAAA chr2 60533945 60533964 60533948 -
gatggaaaatgaacagtgtg

SEQ ID NO: 189377 - DNA, 20 bp, Artificial Sequence
  Synthetic oligonucleotide; GGAGAAA chr2 60533527 60533546 60533530 -
tgtggggctgagtgggcagt

SEQ ID NO: 189378 - DNA, 20 bp, Artificial Sequence
  Synthetic oligonucleotide; TAAGAAA chr2 60533496 60533515 60533499 -
tattcagctgacccggtatt

SEQ ID NO: 189379 - DNA, 20 bp, Artificial Sequence
  Synthetic oligonucleotide; CAAGAAA chr2 60533321 60533340 60533324 -
tctctctcccccaaacttta

SEQ ID NO: 189380 - DNA, 20 bp, Artificial Sequence
  Synthetic oligonucleotide; CAAGAAA chr2 60533183 60533202 60533186 -
tgacacagccctagaagcag

SEQ ID NO: 189381 - DNA, 20 bp, Artificial Sequence
  Synthetic oligonucleotide; GGAGAAA chr2 60532988 60533007 60532991 -
agggtagattgttatataat

SEQ ID NO: 189382 - DNA, 20 bp, Artificial Sequence
  Synthetic oligonucleotide; TTAGAAT chr2 60532929 60532948 60532932 -
caggaagtaaataaaaagta

SEQ ID NO: 189383 - DNA, 20 bp, Artificial Sequence
  Synthetic oligonucleotide; GTAGAAA chr2 60532717 60532736 60532720 -
tacttaaagggagtggaggg

SEQ ID NO: 189384 - DNA, 20 bp, Artificial Sequence
  Synthetic oligonucleotide; GAAGAAA chr2 60532457 60532476 60532460 -
ggcccagaagctgtctttct

SEQ ID NO: 189385 - DNA, 20 bp, Artificial Sequence
  Synthetic oligonucleotide; AAAGAAA chr2 60532427 60532446 60532430 -
taacgccaccaccaccaaaa

SEQ ID NO: 189386 - DNA, 20 bp, Artificial Sequence
  Synthetic oligonucleotide; ACAGAAT chr2 60532361 60532380 60532364 -
tttttaaaaaactggaaatg

SEQ ID NO: 189387 - DNA, 20 bp, Artificial Sequence
  Synthetic oligonucleotide; AAAGAAA chr2 60532153 60532172 60532156 -
gattactgggggtacagtga

SEQ ID NO: 189388 - DNA, 20 bp, Artificial Sequence
  Synthetic oligonucleotide; GGAGAAA chr2 60531214 60531233 60531217 -
cgtcgggcaacacagaggga

SEQ ID NO: 189389 - DNA, 20 bp, Artificial Sequence
  Synthetic oligonucleotide; AAAGAAA chr2 60531091 60531110 60531094 -
tctgctccggagaaggtggt

SEQ ID NO: 189390 - DNA, 20 bp, Artificial Sequence
  Synthetic oligonucleotide; ACAGAAT chr2 60530988 60531007 60530991 -
tagccagactggtttagcag

SEQ ID NO: 189391 - DNA, 20 bp, Artificial Sequence
  Synthetic oligonucleotide; ATAGAAA chr2 60530917 60530936 60530920 -
aagcactttgtttatcttga

SEQ ID NO: 189392 - DNA, 20 bp, Artificial Sequence
  Synthetic oligonucleotide; TAAGAAA chr2 60530371 60530390 60530374 -
ggcgtgcctgcgtgtgcagg

SEQ ID NO: 189393 - DNA, 20 bp, Artificial Sequence
  Synthetic oligonucleotide; CAAGAAA chr2 60530241 60530260 60530244 -
aggaaggctcaaggaaggct

SEQ ID NO: 189394 - DNA, 20 bp, Artificial Sequence
  Synthetic oligonucleotide; ATAGAAT chr2 60529887 60529906 60529890 -
ctggggctaaagctgggttc

SEQ ID NO: 189395 - DNA, 20 bp, Artificial Sequence
  Synthetic oligonucleotide; TAAGAAA chr2 60529544 60529563 60529547 -
gtctttgtaacctgagctgg

SEQ ID NO: 189396 - DNA, 20 bp, Artificial Sequence
  Synthetic oligonucleotide; ACAGAAA chr2 60529527 60529546 60529530 -
tggtaagaaagggaggaggg

SEQ ID NO: 189397 - DNA, 20 bp, Artificial Sequence
  Synthetic oligonucleotide; GGAGAAT chr2 60529348 60529367 60529351 -
ttcctcaatctgtaaagtgg

SEQ ID NO: 189398 - DNA, 20 bp, Artificial Sequence
  Synthetic oligonucleotide; CCAGAAT chr2 60528833 60528852 60528836 -
tcgctccgggggctgcacct

SEQ ID NO: 189399 - DNA, 20 bp, Artificial Sequence
  Synthetic oligonucleotide; GAAGAAT chr2 60528515 60528534 60528518 -
tttcaatcttctgggaaaga

SEQ ID NO: 189400 - DNA, 20 bp, Artificial Sequence
  Synthetic oligonucleotide; CCAGAAT chr2 60528408 60528427 60528411 -
gtagtcatttccccatctgt

SEQ ID NO: 189401 - DNA, 20 bp, Artificial Sequence
  Synthetic oligonucleotide; TGAGAAA chr2 60528377 60528396 60528380 -
ctgaaatcaagtgagggtcc

SEQ ID NO: 189402 - DNA, 20 bp, Artificial Sequence
  Synthetic oligonucleotide; TGAGAAA chr2 60528310 60528329 60528313 -
ggagactgcagtgggctgaa

SEQ ID NO: 189403 - DNA, 20 bp, Artificial Sequence
  Synthetic oligonucleotide; GGAGAAT chr2 60528203 60528222 60528206 -
atcgtaccttcaaaggctgg

SEQ ID NO: 189404 - DNA, 20 bp, Artificial Sequence
  Synthetic oligonucleotide; TCAGAAT chr2 60528197 60528216 60528200 -
ccttcaaaggctggggagaa

SEQ ID NO: 189405 - DNA, 20 bp, Artificial Sequence
  Synthetic oligonucleotide; AGAGAAT chr2 60527775 60527794 60527778 -
gctaacatagacctccactg

SEQ ID NO: 189406 - DNA, 20 bp, Artificial Sequence
  Synthetic oligonucleotide; TCAGAAT chr2 60527767 60527786 60527770 -
agacctccactgagagaatt

SEQ ID NO: 189407 - DNA, 20 bp, Artificial Sequence
  Synthetic oligonucleotide; TGAGAAT chr2 60527547 60527566 60527550 -
ggtgggatggaggtggctgc

SEQ ID NO: 189408 - DNA, 20 bp, Artificial Sequence
  Synthetic oligonucleotide; TAAGAAT chr2 60526873 60526892 60526876 -
gtgctaagtagttccccgct

SEQ ID NO: 189409 - DNA, 20 bp, Artificial Sequence
  Synthetic oligonucleotide; GAAGAAA chr2 60526270 60526289 60526273 -
ctatttaaaaatcttttggg

SEQ ID NO: 189410 - DNA, 20 bp, Artificial Sequence
  Synthetic oligonucleotide; AGAGAAA chr2 60526136 60526155 60526139 -
ttttgcagaagttcagggtg

SEQ ID NO: 189411 - DNA, 20 bp, Artificial Sequence
  Synthetic oligonucleotide; CTAGAAA chr2 60526112 60526131 60526115 -
aaaccatgcctgttttatat

SEQ ID NO: 189412 - DNA, 20 bp, Artificial Sequence
  Synthetic oligonucleotide; ATAGAAA chr2 60526091 60526110 60526094 -
tagaaagtgaaatcattgtt

SEQ ID NO: 189413 - DNA, 20 bp, Artificial Sequence
  Synthetic oligonucleotide; TTAGAAA chr2 60526071 60526090 60526074 -
atagaaaaaacctactgtgg

SEQ ID NO: 189414 - DNA, 20 bp, Artificial Sequence
  Synthetic oligonucleotide; CCAGAAA chr2 60526023 60526042 60526026 -
agccctgctgccatcctcta

SEQ ID NO: 189415 - DNA, 20 bp, Artificial Sequence
  Synthetic oligonucleotide; GGAGAAA chr2 60525866 60525885 60525869 -
tacccttctgtgaaagccat

SEQ ID NO: 189416 - DNA, 20 bp, Artificial Sequence
  Synthetic oligonucleotide; GCAGAAT chr2 60525520 60525539 60525523 -
ggggctcacctgcaaagaca

SEQ ID NO: 189417 - DNA, 20 bp, Artificial Sequence
  Synthetic oligonucleotide; ACAGAAA chr2 60525443 60525462 60525446 -
cttggattcgtgattcccca

SEQ ID NO: 189418 - DNA, 20 bp, Artificial Sequence
  Synthetic oligonucleotide; AAAGAAT chr2 60525297 60525316 60525300 -
tgttttttttgaaaaactcc

SEQ ID NO: 189419 - DNA, 20 bp, Artificial Sequence
  Synthetic oligonucleotide; AAAGAAA chr2 60525217 60525236 60525220 -
aatagaagtacgtttttgaa

SEQ ID NO: 189420 - DNA, 20 bp, Artificial Sequence
  Synthetic oligonucleotide; CAAGAAA chr2 60524492 60524511 60524495 -
caaaataaaatcttaaaaaa

SEQ ID NO: 189421 - DNA, 20 bp, Artificial Sequence
  Synthetic oligonucleotide; AAAGAAA chr2 60524485 60524504 60524488 -
aaatcttaaaaaacaagaaa

SEQ ID NO: 189422 - DNA, 20 bp, Artificial Sequence
  Synthetic oligonucleotide; GTAGAAA chr2 60523509 60523528 60523512 -
agttgtgtgcctgtgtgtgt

SEQ ID NO: 189423 - DNA, 20 bp, Artificial Sequence
  Synthetic oligonucleotide; AGAGAAT chr2 60523493 60523512 60523496 -
gtgtgtagaaagggagagag

SEQ ID NO: 189424 - DNA, 20 bp, Artificial Sequence
  Synthetic oligonucleotide; TTAGAAT chr2 60523476 60523495 60523479 -
gagagagaataggaaagtct

SEQ ID NO: 189425 - DNA, 20 bp, Artificial Sequence
  Synthetic oligonucleotide; GTAGAAA chr2 60523420 60523439 60523423 -
agtttttgaaagctatccat

SEQ ID NO: 189426 - DNA, 20 bp, Artificial Sequence
  Synthetic oligonucleotide; AGAGAAA chr2 60523039 60523058 60523042 -
cttttacccacagagtctac

SEQ ID NO: 189427 - DNA, 20 bp, Artificial Sequence
  Synthetic oligonucleotide; AAAGAAA chr2 60522345 60522364 60522348 -
tggttttgcagttgtattta

SEQ ID NO: 189428 - DNA, 20 bp, Artificial Sequence
  Synthetic oligonucleotide; CAAGAAT chr2 60522219 60522238 60522222 -
ggcgatagggttacagaaga

SEQ ID NO: 189429 - DNA, 20 bp, Artificial Sequence
  Synthetic oligonucleotide; CCAGAAA chr2 60522121 60522140 60522124 -
ttgtagtatttgagattttt

SEQ ID NO: 189430 - DNA, 20 bp, Artificial Sequence
  Synthetic oligonucleotide; CAAGAAA chr2 60522005 60522024 60522008 -
ggggacaagtgtcctatggg

SEQ ID NO: 189431 - DNA, 20 bp, Artificial Sequence
  Synthetic oligonucleotide; AGAGAAA chr2 60521712 60521731 60521715 -
ccatttgagccctggctatt

SEQ ID NO: 189432 - DNA, 20 bp, Artificial Sequence
  Synthetic oligonucleotide; TCAGAAA chr2 60521672 60521691 60521675 -
agaggagattgaccacactc

SEQ ID NO: 189433 - DNA, 20 bp, Artificial Sequence
  Synthetic oligonucleotide; GTAGAAA chr2 60521163 60521182 60521166 -
gacaatggaaggcagctgtt

SEQ ID NO: 189434 - DNA, 20 bp, Artificial Sequence
  Synthetic oligonucleotide; GCAGAAT chr2 60520785 60520804 60520788 -
tgatctgatgggtggtatag

SEQ ID NO: 189435 - DNA, 20 bp, Artificial Sequence
  Synthetic oligonucleotide; TCAGAAA chr2 60520574 60520593 60520577 -
ggccacttatttaattttcc

SEQ ID NO: 189436 - DNA, 20 bp, Artificial Sequence
  Synthetic oligonucleotide; CCAGAAT chr2 60520419 60520438 60520422 -
tgatttcaggtcctcagact

SEQ ID NO: 189437 - DNA, 20 bp, Artificial Sequence
  Synthetic oligonucleotide; TCAGAAA chr2 60520102 60520121 60520105 -
ctttctgaatttttcaattt

SEQ ID NO: 189438 - DNA, 20 bp, Artificial Sequence
  Synthetic oligonucleotide; GGAGAAT chr2 60519962 60519981 60519965 -
attctcctgccagagagagg

SEQ ID NO: 189439 - DNA, 20 bp, Artificial Sequence
  Synthetic oligonucleotide; AGAGAAT chr2 60519921 60519940 60519924 -
ttttaacactccaagtctag

SEQ ID NO: 189440 - DNA, 20 bp, Artificial Sequence
  Synthetic oligonucleotide; GGAGAAT chr2 60519806 60519825 60519809 -
tttgtcattggagtaattta

SEQ ID NO: 189441 - DNA, 20 bp, Artificial Sequence
  Synthetic oligonucleotide; TCAGAAA chr2 60519696 60519715 60519699 -
gtgtcagaacagaactggcc

SEQ ID NO: 189442 - DNA, 20 bp, Artificial Sequence
  Synthetic oligonucleotide; ATAGAAT chr2 60519284 60519303 60519287 -
tgtctctcaatatggaggtt

SEQ ID NO: 189443 - DNA, 20 bp, Artificial Sequence
  Synthetic oligonucleotide; GGAGAAA chr2 60519134 60519153 60519137 -
aggggttcctggtgtacttg

SEQ ID NO: 189444 - DNA, 20 bp, Artificial Sequence
  Synthetic oligonucleotide; ACAGAAT chr2 60518923 60518942 60518926 -
ttcaggacccaccttgaatg

SEQ ID NO: 189445 - DNA, 20 bp, Artificial Sequence
  Synthetic oligonucleotide; GAAGAAA chr2 60517900 60517919 60517903 -
agagtttctgaggaatcata

SEQ ID NO: 189446 - DNA, 20 bp, Artificial Sequence
  Synthetic oligonucleotide; TGAGAAA chr2 60517773 60517792 60517776 -
taaccctgtcattttacaga

SEQ ID NO: 189447 - DNA, 20 bp, Artificial Sequence
  Synthetic oligonucleotide; AGAGAAT chr2 60517443 60517462 60517446 -
ccaatcacctgtgctgttgc

SEQ ID NO: 189448 - DNA, 20 bp, Artificial Sequence
  Synthetic oligonucleotide; CCAGAAT chr2 60517203 60517222 60517206 -
tctcaggggcagatggccct

SEQ ID NO: 189449 - DNA, 20 bp, Artificial Sequence
  Synthetic oligonucleotide; TTAGAAT chr2 60516902 60516921 60516905 -
tattgtttctatgcctctct

SEQ ID NO: 189450 - DNA, 20 bp, Artificial Sequence
  Synthetic oligonucleotide; TGAGAAA chr2 60516471 60516490 60516474 -
agtgacgacttcatggaggc

SEQ ID NO: 189451 - DNA, 20 bp, Artificial Sequence
  Synthetic oligonucleotide; AGAGAAT chr2 60515944 60515963 60515947 -
gtgttggcccagcggtgccc

SEQ ID NO: 189452 - DNA, 20 bp, Artificial Sequence
  Synthetic oligonucleotide; GCAGAAA chr2 60515810 60515829 60515813 -
cctgggagctcaagtcaggg

SEQ ID NO: 189453 - DNA, 20 bp, Artificial Sequence
  Synthetic oligonucleotide; AGAGAAA chr2 60515339 60515358 60515342 -
ctcacgctgcttgattgaac

SEQ ID NO: 189454 - DNA, 20 bp, Artificial Sequence
  Synthetic oligonucleotide; GGAGAAA chr2 60515250 60515269 60515253 -
atttcccccttcctccctgg

SEQ ID NO: 189455 - DNA, 20 bp, Artificial Sequence
  Synthetic oligonucleotide; TAAGAAA chr2 60514708 60514727 60514711 -
cacaactctgatttttttcc

SEQ ID NO: 189456 - DNA, 20 bp, Artificial Sequence
  Synthetic oligonucleotide; CCAGAAA chr2 60514328 60514347 60514331 -
tctccaagtcttgggactgc

SEQ ID NO: 189457 - DNA, 20 bp, Artificial Sequence
  Synthetic oligonucleotide; AGAGAAT chr2 60513978 60513997 60513981 -
ggatttaggactgtgaacct

SEQ ID NO: 189458 - DNA, 20 bp, Artificial Sequence
  Synthetic oligonucleotide; CTAGAAT chr2 60513957 60513976 60513960 -
gagaattcaaagtagtggaa

SEQ ID NO: 189459 - DNA, 20 bp, Artificial Sequence
  Synthetic oligonucleotide; AGAGAAT chr2 60513867 60513886 60513870 -
gaggtgcctgtctggaaggc

SEQ ID NO: 189460 - DNA, 20 bp, Artificial Sequence
  Synthetic oligonucleotide; TGAGAAA chr2 60513181 60513200 60513184 -
ggggaagagccgctcaaaga

SEQ ID NO: 189461 - DNA, 20 bp, Artificial Sequence
  Synthetic oligonucleotide; TGAGAAA chr2 60512971 60512990 60512974 -
ttgctctgtgtgttcatttt

SEQ ID NO: 189462 - DNA, 20 bp, Artificial Sequence
  Synthetic oligonucleotide; AGAGAAT chr2 60512786 60512805 60512789 -
ctcatacttgagacactaaa

SEQ ID NO: 189463 - DNA, 20 bp, Artificial Sequence
  Synthetic oligonucleotide; AAAGAAA chr2 60511868 60511887 60511871 -
tcattttactgatttatttg

SEQ ID NO: 189464 - DNA, 20 bp, Artificial Sequence
  Synthetic oligonucleotide; ATAGAAA chr2 60511836 60511855 60511839 -
tccctccaacccttgccttc

SEQ ID NO: 189465 - DNA, 20 bp, Artificial Sequence
  Synthetic oligonucleotide; GAAGAAT chr2 60511809 60511828 60511812 -
cagagtgttgaaagcttgga

SEQ ID NO: 189466 - DNA, 20 bp, Artificial Sequence
  Synthetic oligonucleotide; TCAGAAA chr2 60511529 60511548 60511532 -
gaaggaaaaaaaaagaactg

SEQ ID NO: 189467 - DNA, 20 bp, Artificial Sequence
  Synthetic oligonucleotide; ATAGAAT chr2 60511408 60511427 60511411 -
acggaaaagagtggagtcac

SEQ ID NO: 189468 - DNA, 20 bp, Artificial Sequence
  Synthetic oligonucleotide; GGAGAAT chr2 60511185 60511204 60511188 -
agtgcccctgccaggaggag

SEQ ID NO: 189469 - DNA, 20 bp, Artificial Sequence
  Synthetic oligonucleotide; CAAGAAT chr2 60511171 60511190 60511174 -
gaggagggagaatctgaaag

SEQ ID NO: 189470 - DNA, 20 bp, Artificial Sequence
  Synthetic oligonucleotide; ATAGAAA chr2 60510650 60510669 60510653 -
aacggttcttggtgttgggc

SEQ ID NO: 189471 - DNA, 20 bp, Artificial Sequence
  Synthetic oligonucleotide; TGAGAAT chr2 60510412 60510431 60510415 -
agaggtgaggaagttggcca

SEQ ID NO: 189472 - DNA, 20 bp, Artificial Sequence
  Synthetic oligonucleotide; GGAGAAT chr2 60509933 60509952 60509936 -
aatgtgtggctcggtgactg

SEQ ID NO: 189473 - DNA, 20 bp, Artificial Sequence
  Synthetic oligonucleotide; ATAGAAT chr2 60509928 60509947 60509931 -
gtggctcggtgactgggaga

SEQ ID NO: 189474 - DNA, 20 bp, Artificial Sequence
  Synthetic oligonucleotide; CCAGAAA chr2 60509902 60509921 60509905 -
ttgctgtttattgggatggg

SEQ ID NO: 189475 - DNA, 20 bp, Artificial Sequence
  Synthetic oligonucleotide; CCAGAAA chr2 60509612 60509631 60509615 -
agacaacttgatcttttgat

SEQ ID NO: 189476 - DNA, 20 bp, Artificial Sequence
  Synthetic oligonucleotide; TGAGAAA chr2 60509084 60509103 60509087 -
cctgtgatttcggagtctga

SEQ ID NO: 189477 - DNA, 20 bp, Artificial Sequence
  Synthetic oligonucleotide; TCAGAAT chr2 60508182 60508201 60508185 -
ggtagacagtgctgggcctg

SEQ ID NO: 189478 - DNA, 20 bp, Artificial Sequence
  Synthetic oligonucleotide; AAAGAAA chr2 60508114 60508133 60508117 -
ctcaactacttttgtttgtg

SEQ ID NO: 189479 - DNA, 20 bp, Artificial Sequence
  Synthetic oligonucleotide; AGAGAAT chr2 60508085 60508104 60508088 -
gcagtaagcaccatgacatg

SEQ ID NO: 189480 - DNA, 20 bp, Artificial Sequence
  Synthetic oligonucleotide; TTAGAAA chr2 60507969 60507988 60507972 -
gaccatatgattttaaagct

SEQ ID NO: 189481 - DNA, 20 bp, Artificial Sequence
  Synthetic oligonucleotide; TTAGAAA chr2 60507914 60507933 60507917 -
tttttttttgttcttttgct

SEQ ID NO: 189482 - DNA, 20 bp, Artificial Sequence
  Synthetic oligonucleotide; TTAGAAA chr2 60507702 60507721 60507705 -
ccacatttctgccatatgtc

SEQ ID NO: 189483 - DNA, 20 bp, Artificial Sequence
  Synthetic oligonucleotide; CAAGAAA chr2 60507411 60507430 60507414 -
gacacagttttctagctttt

SEQ ID NO: 189484 - DNA, 20 bp, Artificial Sequence
  Synthetic oligonucleotide; ACAGAAA chr2 60506752 60506771 60506755 -
gacattatttgaggttgctg

SEQ ID NO: 189485 - DNA, 20 bp, Artificial Sequence
  Synthetic oligonucleotide; CCAGAAT chr2 60506370 60506389 60506373 -
ttttccaggggtttgacaga

SEQ ID NO: 189486 - DNA, 20 bp, Artificial Sequence
  Synthetic oligonucleotide; AGAGAAT chr2 60506277 60506296 60506280 -
tgactcttcctctgatgcag

SEQ ID NO: 189487 - DNA, 20 bp, Artificial Sequence
  Synthetic oligonucleotide; AGAGAAA chr2 60506222 60506241 60506225 -
tgcctcccctccatgccctc

SEQ ID NO: 189488 - DNA, 20 bp, Artificial Sequence
  Synthetic oligonucleotide; GAAGAAT chr2 60505315 60505334 60505318 -
caggcatttggaacaatctg

SEQ ID NO: 189489 - DNA, 20 bp, Artificial Sequence
  Synthetic oligonucleotide; GGAGAAA chr2 60505080 60505099 60505083 -
agtaaccctgtgaagaggca

SEQ ID NO: 189490 - DNA, 20 bp, Artificial Sequence
  Synthetic oligonucleotide; GTAGAAA chr2 60504725 60504744 60504728 -
ggcattgtccctaagcacca

SEQ ID NO: 189491 - DNA, 20 bp, Artificial Sequence
  Synthetic oligonucleotide; TAAGAAA chr2 60504327 60504346 60504330 -
gggtgaaatcttgcagtgac

SEQ ID NO: 189492 - DNA, 20 bp, Artificial Sequence
  Synthetic oligonucleotide; TCAGAAT chr2 60504066 60504085 60504069 -
agtggtactcttcagagttc

SEQ ID NO: 189493 - DNA, 20 bp, Artificial Sequence
  Synthetic oligonucleotide; CTAGAAT chr2 60503920 60503939 60503923 -
tttcttgctttctttttttt

SEQ ID NO: 189494 - DNA, 20 bp, Artificial Sequence
  Synthetic oligonucleotide; CCAGAAT chr2 60503812 60503831 60503815 -
ataaagctctgacaaaagat

SEQ ID NO: 189495 - DNA, 20 bp, Artificial Sequence
  Synthetic oligonucleotide; AGAGAAA chr2 60503464 60503483 60503467 -
ataggtggaggagagggtcc

SEQ ID NO: 189496 - DNA, 20 bp, Artificial Sequence
  Synthetic oligonucleotide; GCAGAAT chr2 60503231 60503250 60503234 -
ggtcagagcctcctgaggct

SEQ ID NO: 189497 - DNA, 20 bp, Artificial Sequence
  Synthetic oligonucleotide; CAAGAAA chr2 60502962 60502981 60502965 -
aggaggtgtttggacaagag

SEQ ID NO: 189498 - DNA, 20 bp, Artificial Sequence
  Synthetic oligonucleotide; CTAGAAT chr2 60502805 60502824 60502808 -
atagtttctgggtgacagga

SEQ ID NO: 189499 - DNA, 20 bp, Artificial Sequence
  Synthetic oligonucleotide; TTAGAAA chr2 60502609 60502628 60502612 -
cttaaattcatattttaata

SEQ ID NO: 189500 - DNA, 20 bp, Artificial Sequence
  Synthetic oligonucleotide; CCAGAAT chr2 60502511 60502530 60502514 -
taggagcaatacctgagatc

SEQ ID NO: 189501 - DNA, 20 bp, Artificial Sequence
  Synthetic oligonucleotide; CGAGAAA chr2 60502460 60502479 60502463 -
agagctcaaatctgtgctag

SEQ ID NO: 189502 - DNA, 20 bp, Artificial Sequence
  Synthetic oligonucleotide; ACAGAAT chr2 60502355 60502374 60502358 -
gtttatttttccgtttgctc

SEQ ID NO: 189503 - DNA, 20 bp, Artificial Sequence
  Synthetic oligonucleotide; GTAGAAA chr2 60501991 60502010 60501994 -
cctagtgcaacacaagttgt

SEQ ID NO: 189504 - DNA, 20 bp, Artificial Sequence
  Synthetic oligonucleotide; AAAGAAA chr2 60501987 60502006 60501990 -
gtgcaacacaagttgtgtag

SEQ ID NO: 189505 - DNA, 20 bp, Artificial Sequence
  Synthetic oligonucleotide; TTAGAAT chr2 60501941 60501960 60501944 -
ataattcactagtaaaataa

SEQ ID NO: 189506 - DNA, 20 bp, Artificial Sequence
  Synthetic oligonucleotide; TCAGAAT chr2 60501886 60501905 60501889 -
agaggggctgatataacttc

SEQ ID NO: 189507 - DNA, 20 bp, Artificial Sequence
  Synthetic oligonucleotide; TAAGAAA chr2 60501822 60501841 60501825 -
gatgagcacactgctgtaat

SEQ ID NO: 189508 - DNA, 20 bp, Artificial Sequence
  Synthetic oligonucleotide; GGAGAAA chr2 60501706 60501725 60501709 -
gagaccagcctgaccaacat

SEQ ID NO: 189509 - DNA, 20 bp, Artificial Sequence
  Synthetic oligonucleotide; GGAGAAT chr2 60501618 60501637 60501621 -
ctactcaggaggctgaggga

SEQ ID NO: 189510 - DNA, 20 bp, Artificial Sequence
  Synthetic oligonucleotide; AAAGAAA chr2 60501509 60501528 60501512 -
tcaaaaaaaaaaaaaaaaaa

SEQ ID NO: 189511 - DNA, 20 bp, Artificial Sequence
  Synthetic oligonucleotide; GCAGAAT chr2 60501201 60501220 60501204 -
ttggctgccattgaatcaaa

SEQ ID NO: 189512 - DNA, 20 bp, Artificial Sequence
  Synthetic oligonucleotide; CCAGAAA chr2 60501130 60501149 60501133 -
ggatgtttaccaacaacttt

SEQ ID NO: 189513 - DNA, 20 bp, Artificial Sequence
  Synthetic oligonucleotide; CCAGAAA chr2 60500982 60501001 60500985 -
acagaggaggatgcagcgac

SEQ ID NO: 189514 - DNA, 20 bp, Artificial Sequence
  Synthetic oligonucleotide; GAAGAAA chr2 60500868 60500887 60500871 -
atcatacacattttaccagt

SEQ ID NO: 189515 - DNA, 20 bp, Artificial Sequence
  Synthetic oligonucleotide; TGAGAAA chr2 60499579 60499598 60499582 -
gcccgtggcaaacactgtct

SEQ ID NO: 189516 - DNA, 20 bp, Artificial Sequence
  Synthetic oligonucleotide; GAAGAAA chr2 60499423 60499442 60499426 -
atttccttttttgcccctgg

SEQ ID NO: 189517 - DNA, 20 bp, Artificial Sequence
  Synthetic oligonucleotide; ACAGAAT chr2 60499399 60499418 60499402 -
aaatatcacttagaggagtt

SEQ ID NO: 189518 - DNA, 20 bp, Artificial Sequence
  Synthetic oligonucleotide; CCAGAAA chr2 60499133 60499152 60499136 -
ccagagaagataatggcagc

SEQ ID NO: 189519 - DNA, 20 bp, Artificial Sequence
  Synthetic oligonucleotide; CCAGAAA chr2 60499091 60499110 60499094 -
acacattgtagggtgatctc

SEQ ID NO: 189520 - DNA, 20 bp, Artificial Sequence
  Synthetic oligonucleotide; CGAGAAA chr2 60499078 60499097 60499081 -
tgatctcccagaaaagccag

SEQ ID NO: 189521 - DNA, 20 bp, Artificial Sequence
  Synthetic oligonucleotide; ACAGAAT chr2 60499026 60499045 60499029 -
ctttggatgcctgtgtgggg

SEQ ID NO: 189522 - DNA, 20 bp, Artificial Sequence
  Synthetic oligonucleotide; GAAGAAA chr2 60499000 60499019 60499003 -
tcagtggaatggaaaatgaa

SEQ ID NO: 189523 - DNA, 20 bp, Artificial Sequence
  Synthetic oligonucleotide; GGAGAAA chr2 60497814 60497833 60497817 -
ctactggatcatcagcaaag

SEQ ID NO: 189524 - DNA, 20 bp, Artificial Sequence
  Synthetic oligonucleotide; AGAGAAA chr2 60497744 60497763 60497747 -
ctatagtaaggtgatagttc

SEQ ID NO: 189525 - DNA, 20 bp, Artificial Sequence
  Synthetic oligonucleotide; AGAGAAA chr2 60497182 60497201 60497185 -
ctgcatggaaggactttgct

SEQ ID NO: 189526 - DNA, 20 bp, Artificial Sequence
  Synthetic oligonucleotide; TTAGAAT chr2 60497111 60497130 60497114 -
gggatgctagctaaagggaa

SEQ ID NO: 189527 - DNA, 20 bp, Artificial Sequence
  Synthetic oligonucleotide; ACAGAAA chr2 60496970 60496989 60496973 -
atcgtgaagtaatcgtgaag

SEQ ID NO: 189528 - DNA, 20 bp, Artificial Sequence
  Synthetic oligonucleotide; AGAGAAA chr2 60496656 60496675 60496659 -
ggcccctgctggctgctggg

SEQ ID NO: 189529 - DNA, 20 bp, Artificial Sequence
  Synthetic oligonucleotide; TAAGAAT chr2 60495960 60495979 60495963 -
taggtgttttaaaaaatagc

SEQ ID NO: 189530 - DNA, 20 bp, Artificial Sequence
  Synthetic oligonucleotide; TCAGAAA chr2 60495923 60495942 60495926 -
cccttgtaatttagagactc

SEQ ID NO: 189531 - DNA, 20 bp, Artificial Sequence
  Synthetic oligonucleotide; AAAGAAT chr2 60495787 60495806 60495790 -
ttgcctgtctttgagcagga

SEQ ID NO: 189532 - DNA, 20 bp, Artificial Sequence
  Synthetic oligonucleotide; TGAGAAT chr2 60495731 60495750 60495734 -
tgtgctgattgagggcccat

SEQ ID NO: 189533 - DNA, 20 bp, Artificial Sequence
  Synthetic oligonucleotide; AGAGAAT chr2 60495627 60495646 60495630 -
atgtaagcatcacaacaggc

SEQ ID NO: 189534 - DNA, 20 bp, Artificial Sequence
  Synthetic oligonucleotide; CCAGAAA chr2 60495362 60495381 60495365 -
catacaggtaataacatagg

SEQ ID NO: 189535 - DNA, 20 bp, Artificial Sequence
  Synthetic oligonucleotide; GGAGAAT chr2 60495137 60495156 60495140 -
cggaaggctctcttggtgat

SEQ ID NO: 189536 - DNA, 20 bp, Artificial Sequence
  Synthetic oligonucleotide; GAAGAAA chr2 60494640 60494659 60494643 -
ccatattttaaattccagct

SEQ ID NO: 189537 - DNA, 20 bp, Artificial Sequence
  Synthetic oligonucleotide; TAAGAAT chr2 60494171 60494190 60494174 -
tgtatttattgccctaggcg

SEQ ID NO: 189538 - DNA, 20 bp, Artificial Sequence
  Synthetic oligonucleotide; TAAGAAT chr2 60493562 60493581 60493565 -
attcaaatgaatgcccattt

SEQ ID NO: 189539 - DNA, 20 bp, Artificial Sequence
  Synthetic oligonucleotide; AGAGAAA chr2 60493323 60493342 60493326 -
atgccttagatgtttaccta

SEQ ID NO: 189540 - DNA, 20 bp, Artificial Sequence
  Synthetic oligonucleotide; GAAGAAT chr2 60493174 60493193 60493177 -
tggaatacaactcaacagta

SEQ ID NO: 189541 - DNA, 20 bp, Artificial Sequence
  Synthetic oligonucleotide; CCAGAAT chr2 60493133 60493152 60493136 -
ctccacaccatggatgaatc

SEQ ID NO: 189542 - DNA, 20 bp, Artificial Sequence
  Synthetic oligonucleotide; GAAGAAA chr2 60493112 60493131 60493115 -
cagaatcattctgctctgtg

SEQ ID NO: 189543 - DNA, 20 bp, Artificial Sequence
  Synthetic oligonucleotide; CTAGAAT chr2 60493058 60493077 60493061 -
gagtccatttgtaacaaatt

SEQ ID NO: 189544 - DNA, 20 bp, Artificial Sequence
  Synthetic oligonucleotide; TGAGAAT chr2 60492691 60492710 60492694 -
caaagtacatttcagggaaa

SEQ ID NO: 189545 - DNA, 20 bp, Artificial Sequence
  Synthetic oligonucleotide; CTAGAAT chr2 60492501 60492520 60492504 -
aggggaggaaatctgttttc

SEQ ID NO: 189546 - DNA, 20 bp, Artificial Sequence
  Synthetic oligonucleotide; CTAGAAA chr2 60492435 60492454 60492438 -
caactaagtttttttcttcc

SEQ ID NO: 189547 - DNA, 20 bp, Artificial Sequence
  Synthetic oligonucleotide; TAAGAAT chr2 60491256 60491275 60491259 -
tgctgcatttaaaacagcat

SEQ ID NO: 189548 - DNA, 20 bp, Artificial Sequence
  Synthetic oligonucleotide; ACAGAAA chr2 60490869 60490888 60490872 -
ggttaaaattaccattttga

SEQ ID NO: 189549 - DNA, 20 bp, Artificial Sequence
  Synthetic oligonucleotide; CTAGAAT chr2 60490793 60490812 60490796 -
atatgctatttgttgaattc

SEQ ID NO: 189550 - DNA, 20 bp, Artificial Sequence
  Synthetic oligonucleotide; GGAGAAA chr2 60490729 60490748 60490732 -
aaatataatagaagcaagta

SEQ ID NO: 189551 - DNA, 20 bp, Artificial Sequence
  Synthetic oligonucleotide; GAAGAAA chr2 60490709 60490728 60490712 -
ggagaaagagtccctgtatt

SEQ ID NO: 189552 - DNA, 20 bp, Artificial Sequence
  Synthetic oligonucleotide; GAAGAAA chr2 60490497 60490516 60490500 -
tccaggaggtaagagaagaa

SEQ ID NO: 189553 - DNA, 20 bp, Artificial Sequence
  Synthetic oligonucleotide; GCAGAAT chr2 60490450 60490469 60490453 -
cggaagggatttttacttgg

SEQ ID NO: 189554 - DNA, 20 bp, Artificial Sequence
  Synthetic oligonucleotide; ATAGAAA chr2 60490408 60490427 60490411 -
tacggggaactaagactgga

SEQ ID NO: 189555 - DNA, 20 bp, Artificial Sequence
  Synthetic oligonucleotide; GCAGAAT chr2 60490147 60490166 60490150 -
cgtagggtttcctttcacta

SEQ ID NO: 189556 - DNA, 20 bp, Artificial Sequence
  Synthetic oligonucleotide; TCAGAAT chr2 60490015 60490034 60490018 -
ggagtgggcaggaatgacgt

SEQ ID NO: 189557 - DNA, 20 bp, Artificial Sequence
  Synthetic oligonucleotide; TTAGAAT chr2 60489636 60489655 60489639 -
tagaggggaaagaacctctg

SEQ ID NO: 189558 - DNA, 20 bp, Artificial Sequence
  Synthetic oligonucleotide; TCAGAAT chr2 60489578 60489597 60489581 -
tcaggtgcttcctcttctac

SEQ ID NO: 189559 - DNA, 20 bp, Artificial Sequence
  Synthetic oligonucleotide; CAAGAAA chr2 60489436 60489455 60489439 -
ggccgccgtgtgtttactgc

SEQ ID NO: 189560 - DNA, 20 bp, Artificial Sequence
  Synthetic oligonucleotide; GCAGAAA chr2 60489382 60489401 60489385 -
ttaggaacaaacttccagcg

SEQ ID NO: 189561 - DNA, 20 bp, Artificial Sequence
  Synthetic oligonucleotide; AAAGAAA chr2 60489295 60489314 60489298 -
gttgtgggcaaaatgacata

SEQ ID NO: 189562 - DNA, 20 bp, Artificial Sequence
  Synthetic oligonucleotide; TGAGAAA chr2 60489283 60489302 60489286 -
atgacataaaagaaatggaa

SEQ ID NO: 189563 - DNA, 20 bp, Artificial Sequence
  Synthetic oligonucleotide; TTAGAAA chr2 60489136 60489155 60489139 -
attggggtctaaggtaccct

SEQ ID NO: 189564 - DNA, 20 bp, Artificial Sequence
  Synthetic oligonucleotide; GGAGAAA chr2 60488960 60488979 60488963 -
gagaccagcctgaccaacat

SEQ ID NO: 189565 - DNA, 20 bp, Artificial Sequence
  Synthetic oligonucleotide; ACAGAAA chr2 60488934 60488953 60488937 -
accccgtctctaccaaaaat

SEQ ID NO: 189566 - DNA, 20 bp, Artificial Sequence
  Synthetic oligonucleotide; GGAGAAT chr2 60488871 60488890 60488874 -
ctacttgggaggctgaggca

SEQ ID NO: 189567 - DNA, 20 bp, Artificial Sequence
  Synthetic oligonucleotide; TCAGAAA chr2 60488779 60488798 60488782 -
aacaagagcgaaactccacc

SEQ ID NO: 189568 - DNA, 20 bp, Artificial Sequence
  Synthetic oligonucleotide; CTAGAAA chr2 60488641 60488660 60488644 -
tattttcatgttaagcaaaa

SEQ ID NO: 189569 - DNA, 20 bp, Artificial Sequence
  Synthetic oligonucleotide; GAAGAAA chr2 60488171 60488190 60488174 -
tcatgttcctagaaggaaag

SEQ ID NO: 189570 - DNA, 20 bp, Artificial Sequence
  Synthetic oligonucleotide; TGAGAAT chr2 60488104 60488123 60488107 -
atttaaatgtttctacataa

SEQ ID NO: 189571 - DNA, 20 bp, Artificial Sequence
  Synthetic oligonucleotide; ATAGAAT chr2 60487779 60487798 60487782 -
cctttctgcagcttccttag

SEQ ID NO: 189572 - DNA, 20 bp, Artificial Sequence
  Synthetic oligonucleotide; TGAGAAA chr2 60487766 60487785 60487769 -
tccttagatagaatggttga

SEQ ID NO: 189573 - DNA, 20 bp, Artificial Sequence
  Synthetic oligonucleotide; AGAGAAT chr2 60487650 60487669 60487653 -
taaaggctggtgtggttgcc

SEQ ID NO: 189574 - DNA, 20 bp, Artificial Sequence
  Synthetic oligonucleotide; ATAGAAT chr2 60486969 60486988 60486972 -
cccgagtcttttttattctg

SEQ ID NO: 189575 - DNA, 20 bp, Artificial Sequence
  Synthetic oligonucleotide; TTAGAAA chr2 60486486 60486505 60486489 -
tatcttagattggtaggtct

SEQ ID NO: 189576 - DNA, 20 bp, Artificial Sequence
  Synthetic oligonucleotide; GCAGAAA chr2 60486399 60486418 60486402 -
gtacttaactacacatatgt

SEQ ID NO: 189577 - DNA, 20 bp, Artificial Sequence
  Synthetic oligonucleotide; TTAGAAT chr2 60486384 60486403 60486387 -
tatgtgcagaaagtgaactc

SEQ ID NO: 189578 - DNA, 20 bp, Artificial Sequence
  Synthetic oligonucleotide; TCAGAAT chr2 60486135 60486154 60486138 -
gctgttcagtcaaatccatt

SEQ ID NO: 189579 - DNA, 20 bp, Artificial Sequence
  Synthetic oligonucleotide; GGAGAAA chr2 60485975 60485994 60485978 -
gagaaccagagcagaaggtt

SEQ ID NO: 189580 - DNA, 20 bp, Artificial Sequence
  Synthetic oligonucleotide; AAAGAAA chr2 60485971 60485990 60485974 -
accagagcagaaggttggag

SEQ ID NO: 189581 - DNA, 20 bp, Artificial Sequence
  Synthetic oligonucleotide; TGAGAAT chr2 60485909 60485928 60485912 -
ctcagccttcttgttgaaaa

SEQ ID NO: 189582 - DNA, 20 bp, Artificial Sequence
  Synthetic oligonucleotide; CCAGAAT chr2 60485690 60485709 60485693 -
aggcaacttcacttctcacc

SEQ ID NO: 189583 - DNA, 20 bp, Artificial Sequence
  Synthetic oligonucleotide; GTAGAAT chr2 60485517 60485536 60485520 -
ggtttatttttcccttatag

SEQ ID NO: 189584 - DNA, 20 bp, Artificial Sequence
  Synthetic oligonucleotide; TGAGAAT chr2 60484810 60484829 60484813 -
cataatgaggtgttcctaag

SEQ ID NO: 189585 - DNA, 20 bp, Artificial Sequence
  Synthetic oligonucleotide; TAAGAAA chr2 60484667 60484686 60484670 -
ctccaaattcccccttctct

SEQ ID NO: 189586 - DNA, 20 bp, Artificial Sequence
  Synthetic oligonucleotide; TGAGAAA chr2 60484414 60484433 60484417 -
aggactaaagagagagaaga

SEQ ID NO: 189587 - DNA, 20 bp, Artificial Sequence
  Synthetic oligonucleotide; GGAGAAA chr2 60484385 60484404 60484388 -
agatgctggaaacagaggtt

SEQ ID NO: 189588 - DNA, 20 bp, Artificial Sequence
  Synthetic oligonucleotide; GTAGAAA chr2 60484365 60484384 60484368 -
ggagaaagagaggcaaggaa

SEQ ID NO: 189589 - DNA, 20 bp, Artificial Sequence
  Synthetic oligonucleotide; GCAGAAA chr2 60484083 60484102 60484086 -
gtcgatagtgacctgcattt

SEQ ID NO: 189590 - DNA, 20 bp, Artificial Sequence
  Synthetic oligonucleotide; CAAGAAA chr2 60483888 60483907 60483891 -
aagggggaaaaaaaagcaac

SEQ ID NO: 189591 - DNA, 20 bp, Artificial Sequence
  Synthetic oligonucleotide; AAAGAAA chr2 60483884 60483903 60483887 -
gggaaaaaaaagcaaccaag

SEQ ID NO: 189592 - DNA, 20 bp, Artificial Sequence
  Synthetic oligonucleotide; AAAGAAA chr2 60483870 60483889 60483873 -
accaagaaagaaaaagaagg

SEQ ID NO: 189593 - DNA, 20 bp, Artificial Sequence
  Synthetic oligonucleotide; GGAGAAA chr2 60483858 60483877 60483861 -
aaagaaggaaagaaaaaaag

SEQ ID NO: 189594 - DNA, 20 bp, Artificial Sequence
  Synthetic oligonucleotide; GAAGAAA chr2 60483849 60483868 60483852 -
aagaaaaaaagggagaaaag

SEQ ID NO: 189595 - DNA, 20 bp, Artificial Sequence
  Synthetic oligonucleotide; AAAGAAA chr2 60483845 60483864 60483848 -
aaaaaagggagaaaaggaag

SEQ ID NO: 189596 - DNA, 20 bp, Artificial Sequence
  Synthetic oligonucleotide; AAAGAAA chr2 60483813 60483832 60483816 -
accagaagaacaaaaatagg

SEQ ID NO: 189597 - DNA, 20 bp, Artificial Sequence
  Synthetic oligonucleotide; AAAGAAA chr2 60483801 60483820 60483804 -
aaaataggaaagaaaaataa

SEQ ID NO: 189598 - DNA, 20 bp, Artificial Sequence
  Synthetic oligonucleotide; AGAGAAA chr2 60483497 60483516 60483500 -
atttgggttctgccttggac

SEQ ID NO: 189599 - DNA, 20 bp, Artificial Sequence
  Synthetic oligonucleotide; AAAGAAA chr2 60482951 60482970 60482954 -
catcatttctgtaatgtttg

SEQ ID NO: 189600 - DNA, 20 bp, Artificial Sequence
  Synthetic oligonucleotide; TCAGAAA chr2 60482842 60482861 60482845 -
gttggatatttaaaatgtca

SEQ ID NO: 189601 - DNA, 20 bp, Artificial Sequence
  Synthetic oligonucleotide; CTAGAAA chr2 60482819 60482838 60482822 -
gaaagagatgattacacatt

SEQ ID NO: 189602 - DNA, 20 bp, Artificial Sequence
  Synthetic oligonucleotide; ATAGAAT chr2 60482743 60482762 60482746 -
gtactaacctgtccttcaaa

SEQ ID NO: 189603 - DNA, 20 bp, Artificial Sequence
  Synthetic oligonucleotide; CAAGAAA chr2 60482394 60482413 60482397 -
aattacaactgtttggaagc

SEQ ID NO: 189604 - DNA, 20 bp, Artificial Sequence
  Synthetic oligonucleotide; ACAGAAA chr2 60482265 60482284 60482268 -
gtccgctccgtgaacaggaa

SEQ ID NO: 189605 - DNA, 20 bp, Artificial Sequence
  Synthetic oligonucleotide; AGAGAAA chr2 60482227 60482246 60482230 -
tttttttttttaatggagga

SEQ ID NO: 189606 - DNA, 20 bp, Artificial Sequence
  Synthetic oligonucleotide; ATAGAAT chr2 60482164 60482183 60482167 -
aaccaaactaaactctcaag

SEQ ID NO: 189607 - DNA, 20 bp, Artificial Sequence
  Synthetic oligonucleotide; GGAGAAT chr2 60481918 60481937 60481921 -
ctaggtgggtttcctgagct

SEQ ID NO: 189608 - DNA, 20 bp, Artificial Sequence
  Synthetic oligonucleotide; ACAGAAT chr2 60481789 60481808 60481792 -
aaaggctctcccaccatcac

SEQ ID NO: 189609 - DNA, 20 bp, Artificial Sequence
  Synthetic oligonucleotide; TTAGAAA chr2 60481768 60481787 60481771 -
cagaatgtactagggttctg

SEQ ID NO: 189610 - DNA, 20 bp, Artificial Sequence
  Synthetic oligonucleotide; AAAGAAA chr2 60481685 60481704 60481688 -
tgtgctggagcatgtgggga

SEQ ID NO: 189611 - DNA, 20 bp, Artificial Sequence
  Synthetic oligonucleotide; CAAGAAA chr2 60481659 60481678 60481662 -
agatgtagggggtggagcgt

SEQ ID NO: 189612 - DNA, 20 bp, Artificial Sequence
  Synthetic oligonucleotide; GAAGAAA chr2 60481616 60481635 60481619 -
tcacgagccatggaaatgga

SEQ ID NO: 189613 - DNA, 20 bp, Artificial Sequence
  Synthetic oligonucleotide; TGAGAAT chr2 60480849 60480868 60480852 -
atgggggtgcaggtagggga

SEQ ID NO: 189614 - DNA, 20 bp, Artificial Sequence
  Synthetic oligonucleotide; GAAGAAA chr2 60480798 60480817 60480801 -
aaacaaattgagagaggaag

SEQ ID NO: 189615 - DNA, 20 bp, Artificial Sequence
  Synthetic oligonucleotide; TTAGAAT chr2 60480464 60480483 60480467 -
ggtccttccagccaggtcat

SEQ ID NO: 189616 - DNA, 20 bp, Artificial Sequence
  Synthetic oligonucleotide; GAAGAAA chr2 60480444 60480463 60480447 -
ttagaatggctctccaacag

SEQ ID NO: 189617 - DNA, 20 bp, Artificial Sequence
  Synthetic oligonucleotide; GGAGAAA chr2 60480265 60480284 60480268 -
tacagggagacttggatcca

SEQ ID NO: 189618 - DNA, 20 bp, Artificial Sequence
  Synthetic oligonucleotide; TGAGAAA chr2 60479981 60480000 60479984 -
taacaaaagcagcttttgag

SEQ ID NO: 189619 - DNA, 20 bp, Artificial Sequence
  Synthetic oligonucleotide; TAAGAAA chr2 60479863 60479882 60479866 -
cgtttcattttcagattttg

SEQ ID NO: 189620 - DNA, 20 bp, Artificial Sequence
  Synthetic oligonucleotide; GTAGAAA chr2 60479246 60479265 60479249 -
cacgtggacctgctaggtgg

SEQ ID NO: 189621 - DNA, 20 bp, Artificial Sequence
  Synthetic oligonucleotide; GCAGAAT chr2 60479161 60479180 60479164 -
atgttactcatatggaatca

SEQ ID NO: 189622 - DNA, 20 bp, Artificial Sequence
  Synthetic oligonucleotide; GAAGAAA chr2 60478701 60478720 60478704 -
ggcagcctagttttattcct

SEQ ID NO: 189623 - DNA, 20 bp, Artificial Sequence
  Synthetic oligonucleotide; GGAGAAT chr2 60478577 60478596 60478580 -
acataataggttttaattct

SEQ ID NO: 189624 - DNA, 20 bp, Artificial Sequence
  Synthetic oligonucleotide; TCAGAAT chr2 60478555 60478574 60478558 -
agaatggccagttctggttc

SEQ ID NO: 189625 - DNA, 20 bp, Artificial Sequence
  Synthetic oligonucleotide; CCAGAAA chr2 60478460 60478479 60478463 -
acaccagtcactcaatagtg

SEQ ID NO: 189626 - DNA, 20 bp, Artificial Sequence
  Synthetic oligonucleotide; GCAGAAT chr2 60477573 60477592 60477576 -
ctaagttctgggatacatgt

SEQ ID NO: 189627 - DNA, 20 bp, Artificial Sequence
  Synthetic oligonucleotide; TCAGAAT chr2 60477262 60477281 60477265 -
ctctgctctggcaggtgtta

SEQ ID NO: 189628 - DNA, 20 bp, Artificial Sequence
  Synthetic oligonucleotide; GGAGAAA chr2 60477138 60477157 60477141 -
ggtatctaatacttaacctg

SEQ ID NO: 189629 - DNA, 20 bp, Artificial Sequence
  Synthetic oligonucleotide; ACAGAAA chr2 60476999 60477018 60477002 -
gaagctggacaattcgggtg

SEQ ID NO: 189630 - DNA, 20 bp, Artificial Sequence
  Synthetic oligonucleotide; ACAGAAA chr2 60476852 60476871 60476855 -
agagagtgatttttcacatt

SEQ ID NO: 189631 - DNA, 20 bp, Artificial Sequence
  Synthetic oligonucleotide; ACAGAAA chr2 60476606 60476625 60476609 -
tagcaaatatgatttatttt

SEQ ID NO: 189632 - DNA, 20 bp, Artificial Sequence
  Synthetic oligonucleotide; CCAGAAA chr2 60475979 60475998 60475982 -
aaagatggaaacacttaggg

SEQ ID NO: 189633 - DNA, 20 bp, Artificial Sequence
  Synthetic oligonucleotide; AAAGAAA chr2 60475975 60475994 60475978 -
atggaaacacttagggccag

SEQ ID NO: 189634 - DNA, 20 bp, Artificial Sequence
  Synthetic oligonucleotide; GAAGAAA chr2 60475852 60475871 60475855 -
caagtccctgcttcctaaag

SEQ ID NO: 189635 - DNA, 20 bp, Artificial Sequence
  Synthetic oligonucleotide; AAAGAAT chr2 60475847 60475866 60475850 -
ccctgcttcctaaaggaaga

SEQ ID NO: 189636 - DNA, 20 bp, Artificial Sequence
  Synthetic oligonucleotide; GAAGAAA chr2 60475646 60475665 60475649 -
cctccccatggctttgaaaa

SEQ ID NO: 189637 - DNA, 20 bp, Artificial Sequence
  Synthetic oligonucleotide; GAAGAAA chr2 60475369 60475388 60475372 -
gccacccacattcattgggg

SEQ ID NO: 189638 - DNA, 20 bp, Artificial Sequence
  Synthetic oligonucleotide; TCAGAAA chr2 60475283 60475302 60475286 -
catggttgtgtcccttattt

SEQ ID NO: 189639 - DNA, 20 bp, Artificial Sequence
  Synthetic oligonucleotide; ACAGAAA chr2 60475233 60475252 60475236 -
ttgtgaaagctgaagatgtc

SEQ ID NO: 189640 - DNA, 20 bp, Artificial Sequence
  Synthetic oligonucleotide; GGAGAAA chr2 60474849 60474868 60474852 -
actaaatgaagcctgctgtg

SEQ ID NO: 189641 - DNA, 20 bp, Artificial Sequence
  Synthetic oligonucleotide; AGAGAAT chr2 60474727 60474746 60474730 -
agaggttgaatgaatgcatg

SEQ ID NO: 189642 - DNA, 20 bp, Artificial Sequence
  Synthetic oligonucleotide; AAAGAAT chr2 60474507 60474526 60474510 -
aatactttgggcccagagcc

SEQ ID NO: 189643 - DNA, 20 bp, Artificial Sequence
  Synthetic oligonucleotide; TCAGAAA chr2 60474337 60474356 60474340 -
gtctttggcttagttgcttt

SEQ ID NO: 189644 - DNA, 20 bp, Artificial Sequence
  Synthetic oligonucleotide; GCAGAAA chr2 60474274 60474293 60474277 -
ttatgttaaagacacagctt

SEQ ID NO: 189645 - DNA, 20 bp, Artificial Sequence
  Synthetic oligonucleotide; TGAGAAA chr2 60474180 60474199 60474183 -
tctctacttcctccctttat

SEQ ID NO: 189646 - DNA, 20 bp, Artificial Sequence
  Synthetic oligonucleotide; GAAGAAA chr2 60474003 60474022 60474006 -
gaccatgagagagtttcagg

SEQ ID NO: 189647 - DNA, 20 bp, Artificial Sequence
  Synthetic oligonucleotide; GCAGAAT chr2 60473953 60473972 60473956 -
tattgctttcttttgttttt

SEQ ID NO: 189648 - DNA, 20 bp, Artificial Sequence
  Synthetic oligonucleotide; AGAGAAT chr2 60473709 60473728 60473712 -
ctataatactctgataagtc

SEQ ID NO: 189649 - DNA, 20 bp, Artificial Sequence
  Synthetic oligonucleotide; ATAGAAA chr2 60473643 60473662 60473646 -
caagagctagatgcggctga

SEQ ID NO: 189650 - DNA, 20 bp, Artificial Sequence
  Synthetic oligonucleotide; AAAGAAA chr2 60473334 60473353 60473337 -
ctttttgaagacccagggtg

SEQ ID NO: 189651 - DNA, 20 bp, Artificial Sequence
  Synthetic oligonucleotide; TCAGAAA chr2 60472774 60472793 60472777 -
tacacacccagtgattagtt

SEQ ID NO: 189652 - DNA, 20 bp, Artificial Sequence
  Synthetic oligonucleotide; GTAGAAA chr2 60472633 60472652 60472636 -
aaagttggtacccaatatat

SEQ ID NO: 189653 - DNA, 20 bp, Artificial Sequence
  Synthetic oligonucleotide; CCAGAAA chr2 60472411 60472430 60472414 -
acaggttgaaacaccttcca

SEQ ID NO: 189654 - DNA, 20 bp, Artificial Sequence
  Synthetic oligonucleotide; TCAGAAA chr2 60472376 60472395 60472379 -
acatttgaaaaaagattgag

SEQ ID NO: 189655 - DNA, 20 bp, Artificial Sequence
  Synthetic oligonucleotide; CCAGAAA chr2 60472344 60472363 60472347 -
aatgtgtcccatttgagaga

SEQ ID NO: 189656 - DNA, 20 bp, Artificial Sequence
  Synthetic oligonucleotide; TGAGAAT chr2 60471929 60471948 60471932 -
tgattcagcttgagtgtgca

SEQ ID NO: 189657 - DNA, 20 bp, Artificial Sequence
  Synthetic oligonucleotide; GGAGAAT chr2 60471917 60471936 60471920 -
agtgtgcatgagaatcacct

SEQ ID NO: 189658 - DNA, 20 bp, Artificial Sequence
  Synthetic oligonucleotide; CAAGAAT chr2 60471845 60471864 60471848 -
agtaagtctgaggtggtgcc

SEQ ID NO: 189659 - DNA, 20 bp, Artificial Sequence
  Synthetic oligonucleotide; TGAGAAT chr2 60471779 60471798 60471782 -
gtgggcctgggtctgcgctg

SEQ ID NO: 189660 - DNA, 20 bp, Artificial Sequence
  Synthetic oligonucleotide; AAAGAAA chr2 60471751 60471770 60471754 -
acttgcctaagagcactaac

SEQ ID NO: 189661 - DNA, 20 bp, Artificial Sequence
  Synthetic oligonucleotide; GGAGAAT chr2 60471682 60471701 60471685 -
cagagcccatctctggctgg

SEQ ID NO: 189662 - DNA, 20 bp, Artificial Sequence
  Synthetic oligonucleotide; AGAGAAT chr2 60471434 60471453 60471437 -
atgtcgattttacttaccaa

SEQ ID NO: 189663 - DNA, 20 bp, Artificial Sequence
  Synthetic oligonucleotide; GCAGAAT chr2 60471399 60471418 60471402 -
tgtgtttagtggaagaagca

SEQ ID NO: 189664 - DNA, 20 bp, Artificial Sequence
  Synthetic oligonucleotide; ATAGAAA chr2 60471275 60471294 60471278 -
gtaaatagcttcttaggctg

SEQ ID NO: 189665 - DNA, 20 bp, Artificial Sequence
  Synthetic oligonucleotide; GTAGAAA chr2 60471064 60471083 60471067 -
aagtactgcttaatggatca

SEQ ID NO: 189666 - DNA, 20 bp, Artificial Sequence
  Synthetic oligonucleotide; TTAGAAA chr2 60470829 60470848 60470832 -
tagctagggttttttacaac

SEQ ID NO: 189667 - DNA, 20 bp, Artificial Sequence
  Synthetic oligonucleotide; AGAGAAT chr2 60470571 60470590 60470574 -
ctcttcccagagtaagtggc

SEQ ID NO: 189668 - DNA, 20 bp, Artificial Sequence
  Synthetic oligonucleotide; TAAGAAA chr2 60470476 60470495 60470479 -
cctgggttgcctgtgtttcc

SEQ ID NO: 189669 - DNA, 20 bp, Artificial Sequence
  Synthetic oligonucleotide; CCAGAAA chr2 60469417 60469436 60469420 -
agagtatggcccagctcagt

SEQ ID NO: 189670 - DNA, 20 bp, Artificial Sequence
  Synthetic oligonucleotide; AGAGAAA chr2 60469341 60469360 60469344 -
gaagaggggggcagagggac

SEQ ID NO: 189671 - DNA, 20 bp, Artificial Sequence
  Synthetic oligonucleotide; ACAGAAA chr2 60469017 60469036 60469020 -
agaccgaaattgaaaacaaa

SEQ ID NO: 189672 - DNA, 20 bp, Artificial Sequence
  Synthetic oligonucleotide; GCAGAAT chr2 60468757 60468776 60468760 -
tccccacgcctgggatgagt

SEQ ID NO: 189673 - DNA, 20 bp, Artificial Sequence
  Synthetic oligonucleotide; TGAGAAT chr2 60468686 60468705 60468689 -
aatgtccatgtgtatagaga

SEQ ID NO: 189674 - DNA, 20 bp, Artificial Sequence
  Synthetic oligonucleotide; CCAGAAT chr2 60468348 60468367 60468351 -
gcacacatctttagccaagg

SEQ ID NO: 189675 - DNA, 20 bp, Artificial Sequence
  Synthetic oligonucleotide; AGAGAAA chr2 60468205 60468224 60468208 -
ctaatttttctcctggtttt

SEQ ID NO: 189676 - DNA, 20 bp, Artificial Sequence
  Synthetic oligonucleotide; TTAGAAA chr2 60466970 60466989 60466973 -
gttttctgaaagatactgtt

SEQ ID NO: 189677 - DNA, 20 bp, Artificial Sequence
  Synthetic oligonucleotide; GAAGAAA chr2 60466854 60466873 60466857 -
acacaaaaaagcaggttcaa

SEQ ID NO: 189678 - DNA, 20 bp, Artificial Sequence
  Synthetic oligonucleotide; AAAGAAA chr2 60466792 60466811 60466795 -
tgaaaaataacctgctgtgg

SEQ ID NO: 189679 - DNA, 20 bp, Artificial Sequence
  Synthetic oligonucleotide; AAAGAAA chr2 60466782 60466801 60466785 -
cctgctgtggaaagaaaaaa

SEQ ID NO: 189680 - DNA, 20 bp, Artificial Sequence
  Synthetic oligonucleotide; AGAGAAT chr2 60466757 60466776 60466760 -
aaaggaaaaaggtcatggag

SEQ ID NO: 189681 - DNA, 20 bp, Artificial Sequence
  Synthetic oligonucleotide; CCAGAAA chr2 60466053 60466072 60466056 -
tggaagtgggttgtgggggt

SEQ ID NO: 189682 - DNA, 20 bp, Artificial Sequence
  Synthetic oligonucleotide; AGAGAAA chr2 60465676 60465695 60465679 -
agataggaattccaagactc

SEQ ID NO: 189683 - DNA, 20 bp, Artificial Sequence
  Synthetic oligonucleotide; CTAGAAA chr2 60465547 60465566 60465550 -
tttttcacattggtgacata

SEQ ID NO: 189684 - DNA, 20 bp, Artificial Sequence
  Synthetic oligonucleotide; GAAGAAT chr2 60465339 60465358 60465342 -
tgattttcatcagagtaaat

SEQ ID NO: 189685 - DNA, 20 bp, Artificial Sequence
  Synthetic oligonucleotide; TTAGAAT chr2 60465175 60465194 60465178 -
gatgactgcagtttaggaat

SEQ ID NO: 189686 - DNA, 20 bp, Artificial Sequence
  Synthetic oligonucleotide; CTAGAAT chr2 60464965 60464984 60464968 -
acactagctgccctcatgat

SEQ ID NO: 189687 - DNA, 20 bp, Artificial Sequence
  Synthetic oligonucleotide; TTAGAAA chr2 60463918 60463937 60463921 -
attttttttttttttccttc

SEQ ID NO: 189688 - DNA, 20 bp, Artificial Sequence
  Synthetic oligonucleotide; GGAGAAA chr2 60463851 60463870 60463854 -
cagcccttcttttaaaagaa

SEQ ID NO: 189689 - DNA, 20 bp, Artificial Sequence
  Synthetic oligonucleotide; TCAGAAT chr2 60463805 60463824 60463808 -
atattttaaggctttttttt

SEQ ID NO: 189690 - DNA, 20 bp, Artificial Sequence
  Synthetic oligonucleotide; TGAGAAT chr2 60463084 60463103 60463087 -
tcctcccacagtctggggtg

SEQ ID NO: 189691 - DNA, 20 bp, Artificial Sequence
  Synthetic oligonucleotide; TTAGAAA chr2 60462907 60462926 60462910 -
tctatgaaatgtttgcctat

SEQ ID NO: 189692 - DNA, 20 bp, Artificial Sequence
  Synthetic oligonucleotide; ATAGAAA chr2 60462877 60462896 60462880 -
cacctgtcacccagggggga

SEQ ID NO: 189693 - DNA, 20 bp, Artificial Sequence
  Synthetic oligonucleotide; CTAGAAT chr2 60462717 60462736 60462720 -
gaagacatttgttgaggtgc

SEQ ID NO: 189694 - DNA, 20 bp, Artificial Sequence
  Synthetic oligonucleotide; TAAGAAT chr2 60462329 60462348 60462332 -
cgcacagaacactcatggat

SEQ ID NO: 189695 - DNA, 20 bp, Artificial Sequence
  Synthetic oligonucleotide; TTAGAAA chr2 60462318 60462337 60462321 -
ctcatggattaagaatctac

SEQ ID NO: 189696 - DNA, 20 bp, Artificial Sequence
  Synthetic oligonucleotide; GCAGAAT chr2 60462258 60462277 60462261 -
gtatcccttcaggactaggt

SEQ ID NO: 189697 - DNA, 20 bp, Artificial Sequence
  Synthetic oligonucleotide; TAAGAAT chr2 60462191 60462210 60462194 -
caataacccctttaacctgc

SEQ ID NO: 189698 - DNA, 20 bp, Artificial Sequence
  Synthetic oligonucleotide; GGAGAAA chr2 60460468 60460487 60460471 -
tttagcgtgtacagtaccct

SEQ ID NO: 189699 - DNA, 20 bp, Artificial Sequence
  Synthetic oligonucleotide; TAAGAAT chr2 60460253 60460272 60460256 -
acaaacagaagtaacgaagc

SEQ ID NO: 189700 - DNA, 20 bp, Artificial Sequence
  Synthetic oligonucleotide; AGAGAAA chr2 60459958 60459977 60459961 -
ctgtttccagttccgttctg

SEQ ID NO: 189701 - DNA, 20 bp, Artificial Sequence
  Synthetic oligonucleotide; AGAGAAA chr2 60459940 60459959 60459943 -
tgagagaaaaagagagagag

SEQ ID NO: 189702 - DNA, 20 bp, Artificial Sequence
  Synthetic oligonucleotide; ACAGAAT chr2 60459838 60459857 60459841 -
tttggattaaccctctatag

SEQ ID NO: 189703 - DNA, 20 bp, Artificial Sequence
  Synthetic oligonucleotide; GAAGAAA chr2 60459759 60459778 60459762 -
taaatgtatcaattggaaag

SEQ ID NO: 189704 - DNA, 20 bp, Artificial Sequence
  Synthetic oligonucleotide; ACAGAAA chr2 60459729 60459748 60459732 -
ggccttgaattgacaaatta

SEQ ID NO: 189705 - DNA, 20 bp, Artificial Sequence
  Synthetic oligonucleotide; AAAGAAA chr2 60459427 60459446 60459430 -
ttgctcctggtgagagctta

SEQ ID NO: 189706 - DNA, 20 bp, Artificial Sequence
  Synthetic oligonucleotide; AAAGAAA chr2 60459264 60459283 60459267 -
ttttaaaaatactggcacca

SEQ ID NO: 189707 - DNA, 20 bp, Artificial Sequence
  Synthetic oligonucleotide; GAAGAAA chr2 60459146 60459165 60459149 -
aggtttgacagaggggaaca

SEQ ID NO: 189708 - DNA, 20 bp, Artificial Sequence
  Synthetic oligonucleotide; AGAGAAA chr2 60459001 60459020 60459004 -
gtgacattcttaaaaaaaga

SEQ ID NO: 189709 - DNA, 20 bp, Artificial Sequence
  Synthetic oligonucleotide; AAAGAAT chr2 60458997 60459016 60459000 -
cattcttaaaaaaagaagag

SEQ ID NO: 189710 - DNA, 20 bp, Artificial Sequence
  Synthetic oligonucleotide; CAAGAAT chr2 60458672 60458691 60458675 -
tatacttaagggaaaagttg

SEQ ID NO: 189711 - DNA, 20 bp, Artificial Sequence
  Synthetic oligonucleotide; ACAGAAT chr2 60458531 60458550 60458534 -
tgcaagcgctgtgaatggaa

SEQ ID NO: 189712 - DNA, 20 bp, Artificial Sequence
  Synthetic oligonucleotide; ATAGAAA chr2 60458515 60458534 60458518 -
ggaaacagaatacacttaac

SEQ ID NO: 189713 - DNA, 20 bp, Artificial Sequence
  Synthetic oligonucleotide; TAAGAAA chr2 60458441 60458460 60458444 -
acttttttaaatataaatgt

SEQ ID NO: 189714 - DNA, 20 bp, Artificial Sequence
  Synthetic oligonucleotide; CTAGAAT chr2 60458168 60458187 60458171 -
atggtcttttttctgtattt

SEQ ID NO: 189715 - DNA, 20 bp, Artificial Sequence
  Synthetic oligonucleotide; AGAGAAA chr2 60457952 60457971 60457955 -
gcttcaaaaaaaaaaaaaag

SEQ ID NO: 189716 - DNA, 20 bp, Artificial Sequence
  Synthetic oligonucleotide; CTAGAAT chr2 60457888 60457907 60457891 -
tggcggtttgggggagcctg

SEQ ID NO: 189717 - DNA, 20 bp, Artificial Sequence
  Synthetic oligonucleotide; AAAGAAA chr2 60457709 60457728 60457712 -
tcttaccttcatatgcagta

SEQ ID NO: 189718 - DNA, 20 bp, Artificial Sequence
  Synthetic oligonucleotide; AAAGAAA chr2 60457705 60457724 60457708 -
accttcatatgcagtaaaag

SEQ ID NO: 189719 - DNA, 20 bp, Artificial Sequence
  Synthetic oligonucleotide; AAAGAAA chr2 60457701 60457720 60457704 -
tcatatgcagtaaaagaaag

SEQ ID NO: 189720 - DNA, 20 bp, Artificial Sequence
  Synthetic oligonucleotide; AAAGAAT chr2 60457611 60457630 60457614 -
gtgctttatatttagattgg

SEQ ID NO: 189721 - DNA, 20 bp, Artificial Sequence
  Synthetic oligonucleotide; AGAGAAA chr2 60457583 60457602 60457586 -
tcatatgcaaagcatattaa

SEQ ID NO: 189722 - DNA, 20 bp, Artificial Sequence
  Synthetic oligonucleotide; GCAGAAT chr2 60457540 60457559 60457543 -
acttttttgtaaatggcaat

SEQ ID NO: 189723 - DNA, 20 bp, Artificial Sequence
  Synthetic oligonucleotide; CAAGAAA chr2 60457145 60457164 60457148 -
cacactctgtaaattacttg

SEQ ID NO: 189724 - DNA, 20 bp, Artificial Sequence
  Synthetic oligonucleotide; TTAGAAT chr2 60456984 60457003 60456987 -
tagttttaaggctttccagt

SEQ ID NO: 189725 - DNA, 20 bp, Artificial Sequence
  Synthetic oligonucleotide; CAAGAAA chr2 60456971 60456990 60456974 -
ttccagtttagaatagtttt

SEQ ID NO: 189726 - DNA, 20 bp, Artificial Sequence
  Synthetic oligonucleotide; GCAGAAA chr2 60456918 60456937 60456921 -
aaaacttactccatctctta

SEQ ID NO: 189727 - DNA, 20 bp, Artificial Sequence
  Synthetic oligonucleotide; GGAGAAA chr2 60456625 60456644 60456628 -
ttgttttgtttaaaaaagag

SEQ ID NO: 189728 - DNA, 20 bp, Artificial Sequence
  Synthetic oligonucleotide; AAAGAAA chr2 60456604 60456623 60456607 -
gagaaaaaaagagagagacg

SEQ ID NO: 189729 - DNA, 20 bp, Artificial Sequence
  Synthetic oligonucleotide; AAAGAAA chr2 60456599 60456618 60456602 -
aaaaagagagagacgaaaga

SEQ ID NO: 189730 - DNA, 20 bp, Artificial Sequence
  Synthetic oligonucleotide; TTAGAAA chr2 60456368 60456387 60456371 -
taggtctattttaaaaatcc

SEQ ID NO: 189731 - DNA, 20 bp, Artificial Sequence
  Synthetic oligonucleotide; CAAGAAT chr2 60456115 60456134 60456118 -
gtcatgccttttatctgagg

SEQ ID NO: 189732 - DNA, 20 bp, Artificial Sequence
  Synthetic oligonucleotide; AAAGAAA chr2 60456087 60456106 60456090 -
gttttatctttctaaagtat

SEQ ID NO: 189733 - DNA, 20 bp, Artificial Sequence
  Synthetic oligonucleotide; TGAGAAA chr2 60456018 60456037 60456021 -
gtggggctagaggaatccac

SEQ ID NO: 189734 - DNA, 20 bp, Artificial Sequence
  Synthetic oligonucleotide; GGAGAAT chr2 60456004 60456023 60456007 -
atccactgagaaaggatgtt

SEQ ID NO: 189735 - DNA, 20 bp, Artificial Sequence
  Synthetic oligonucleotide; TTAGAAA chr2 60455932 60455951 60455935 -
cttgatgtttgtcactgaac

SEQ ID NO: 189736 - DNA, 20 bp, Artificial Sequence
  Synthetic oligonucleotide; ATAGAAA chr2 60455859 60455878 60455862 -
caaaatgctgctcaagacag

SEQ ID NO: 189737 - DNA, 20 bp, Artificial Sequence
  Synthetic oligonucleotide; ACAGAAT chr2 60455654 60455673 60455657 -
taggttttgcatcctgacag

SEQ ID NO: 189738 - DNA, 20 bp, Artificial Sequence
  Synthetic oligonucleotide; ATAGAAA chr2 60455432 60455451 60455435 -
atttctgaagctgatgaaca

SEQ ID NO: 189739 - DNA, 20 bp, Artificial Sequence
  Synthetic oligonucleotide; CCAGAAA chr2 60455105 60455124 60455108 -
tatttctcacagattttaaa

SEQ ID NO: 189740 - DNA, 20 bp, Artificial Sequence
  Synthetic oligonucleotide; GCAGAAA chr2 60454954 60454973 60454957 -
cttcatttgcactggccatg

SEQ ID NO: 189741 - DNA, 20 bp, Artificial Sequence
  Synthetic oligonucleotide; GGAGAAA chr2 60454783 60454802 60454786 -
gcttaggtataattccaatt

SEQ ID NO: 189742 - DNA, 20 bp, Artificial Sequence
  Synthetic oligonucleotide; ATAGAAA chr2 60454291 60454310 60454294 -
aaagccctgcatatttccca

SEQ ID NO: 189743 - DNA, 20 bp, Artificial Sequence
  Synthetic oligonucleotide; AGAGAAA chr2 60454266 60454285 60454269 -
aaataaacgaacccattgtt

SEQ ID NO: 189744 - DNA, 20 bp, Artificial Sequence
  Synthetic oligonucleotide; GTAGAAA chr2 60453822 60453841 60453825 -
tcagatctttcatagggatg

SEQ ID NO: 189745 - DNA, 20 bp, Artificial Sequence
  Synthetic oligonucleotide; TTAGAAT chr2 60453698 60453717 60453701 -
cccatgatatactttgtcta

SEQ ID NO: 189746 - DNA, 20 bp, Artificial Sequence
  Synthetic oligonucleotide; AAAGAAA chr2 60453276 60453295 60453279 -
attgccttcccccttccaaa

SEQ ID NO: 189747 - DNA, 20 bp, Artificial Sequence
  Synthetic oligonucleotide; AAAGAAA chr2 60453271 60453290 60453274 -
cttcccccttccaaaaaaga

SEQ ID NO: 189748 - DNA, 20 bp, Artificial Sequence
  Synthetic oligonucleotide; AAAGAAA chr2 60453252 60453271 60453255 -
aaaagaaaactgcatgtttg

SEQ ID NO: 189749 - DNA, 20 bp, Artificial Sequence
  Synthetic oligonucleotide; ACAGAAA chr2 60452739 60452758 60452742 -
tttaaaaagctagttagaga

SEQ ID NO: 189750 - DNA, 20 bp, Artificial Sequence
  Synthetic oligonucleotide; TGAGAAA chr2 60452578 60452597 60452581 -
gctcgagagcccttaagttc

SEQ ID NO: 189751 - DNA, 20 bp, Artificial Sequence
  Synthetic oligonucleotide; TGAGAAA chr2 60452039 60452058 60452042 -
gtgggtaggaggaacagatt

SEQ ID NO: 189752 - DNA, 20 bp, Artificial Sequence
  Synthetic oligonucleotide; GGAGAAT chr2 60451972 60451991 60451975 -
cagatggcataaattttcaa

SEQ ID NO: 189753 - DNA, 20 bp, Artificial Sequence
  Synthetic oligonucleotide; TTAGAAA chr2 60451504 60451523 60451507 -
tcacagcaatgctctattcc

SEQ ID NO: 189754 - DNA, 20 bp, Artificial Sequence
  Synthetic oligonucleotide; AGAGAAT chr2 60451383 60451402 60451386 -
ttactgcttggagatccaga

SEQ ID NO: 189755 - DNA, 20 bp, Artificial Sequence
  Synthetic oligonucleotide; TTAGAAA chr2 60451377 60451396 60451380 -
cttggagatccagaagagaa

SEQ ID NO: 189756 - DNA, 20 bp, Artificial Sequence
  Synthetic oligonucleotide; AGAGAAA chr2 60451019 60451038 60451022 -
ccagaggccacatcagtaag

SEQ ID NO: 189757 - DNA, 20 bp, Artificial Sequence
  Synthetic oligonucleotide; TGAGAAA chr2 60450806 60450825 60450809 -
ctaccaacagatgtgtgcac

SEQ ID NO: 189758 - DNA, 20 bp, Artificial Sequence
  Synthetic oligonucleotide; AAAGAAA chr2 60450667 60450686 60450670 -
cagacaagaagttatttcat

SEQ ID NO: 189759 - DNA, 20 bp, Artificial Sequence
  Synthetic oligonucleotide; CTAGAAA chr2 60450556 60450575 60450559 -
gctgaactccttgctgatgc

SEQ ID NO: 189760 - DNA, 20 bp, Artificial Sequence
  Synthetic oligonucleotide; ACAGAAT chr2 60450212 60450231 60450215 -
aagacaacaaaaatttattt

SEQ ID NO: 189761 - DNA, 20 bp, Artificial Sequence
  Synthetic oligonucleotide; ACAGAAT chr2 60450143 60450162 60450146 -
tttttttttttttttttaag

SEQ ID NO: 189762 - DNA, 20 bp, Artificial Sequence
  Synthetic oligonucleotide; TTAGAAT chr2 60449213 60449232 60449216 -
cactgtataaaaaaggtctg

SEQ ID NO: 189763 - DNA, 20 bp, Artificial Sequence
  Synthetic oligonucleotide; AGAGAAA chr2 60449190 60449209 60449193 -
gaattggggtccatgatggg

SEQ ID NO: 189764 - DNA, 20 bp, Artificial Sequence
  Synthetic oligonucleotide; TGAGAAA chr2 60449128 60449147 60449131 -
atgttgaatatcagcctgtt

SEQ ID NO: 189765 - DNA, 20 bp, Artificial Sequence
  Synthetic oligonucleotide; AAAGAAA chr2 60449093 60449112 60449096 -
tcaaaaaccagtgatcattt

SEQ ID NO: 189766 - DNA, 20 bp, Artificial Sequence
  Synthetic oligonucleotide; TTAGAAT chr2 60448787 60448806 60448790 -
ccccggaagtaatagtagga

SEQ ID NO: 189767 - DNA, 20 bp, Artificial Sequence
  Synthetic oligonucleotide; AGAGAAA chr2 60448598 60448617 60448601 -
atcttgagttcctaaccagc

SEQ ID NO: 189768 - DNA, 20 bp, Artificial Sequence
  Synthetic oligonucleotide; ATAGAAT chr2 60448363 60448382 60448366 -
ccaggaagtacttaagcttt

SEQ ID NO: 189769 - DNA, 20 bp, Artificial Sequence
  Synthetic oligonucleotide; ATAGAAT chr2 60448341 60448360 60448344 -
agaatacttttatatacatg

SEQ ID NO: 189770 - DNA, 20 bp, Artificial Sequence
  Synthetic oligonucleotide; TAAGAAA chr2 60448305 60448324 60448308 -
ttgtgattctataaattaga

SEQ ID NO: 189771 - DNA, 20 bp, Artificial Sequence
  Synthetic oligonucleotide; AAAGAAT chr2 60448300 60448319 60448303 -
attctataaattagataaga

SEQ ID NO: 189772 - DNA, 20 bp, Artificial Sequence
  Synthetic oligonucleotide; TCAGAAT chr2 60448249 60448268 60448252 -
gtaatcactcattttagaga

SEQ ID NO: 189773 - DNA, 20 bp, Artificial Sequence
  Synthetic oligonucleotide; AAAAAC chr2 60448440 60448459 60448456 +
cctaatttaaactaagatag

SEQ ID NO: 189774 - DNA, 20 bp, Artificial Sequence
  Synthetic oligonucleotide; CAAAAC chr2 60448907 60448926 60448923 +
aaaaatcatgtcaacgcata

SEQ ID NO: 189775 - DNA, 20 bp, Artificial Sequence
  Synthetic oligonucleotide; AAAAAC chr2 60449578 60449597 60449594 +
cacaaaaggcttgggaaagt

SEQ ID NO: 189776 - DNA, 20 bp, Artificial Sequence
  Synthetic oligonucleotide; TAAAAC chr2 60450291 60450310 60450307 +
cttctccacagtgaagagga

SEQ ID NO: 189777 - DNA, 20 bp, Artificial Sequence
  Synthetic oligonucleotide; GAAAAC chr2 60450973 60450992 60450989 +
tagctctggacaagaaacca

SEQ ID NO: 189778 - DNA, 20 bp, Artificial Sequence
  Synthetic oligonucleotide; AAAAAC chr2 60451786 60451805 60451802 +
ccaccaaaagcatatatttg

SEQ ID NO: 189779 - DNA, 20 bp, Artificial Sequence
  Synthetic oligonucleotide; GAAAAC chr2 60451855 60451874 60451871 +
attataagtcagacagttag

SEQ ID NO: 189780 - DNA, 20 bp, Artificial Sequence
  Synthetic oligonucleotide; GAAAAC chr2 60452465 60452484 60452481 +
cttcttggaggctactgtca

SEQ ID NO: 189781 - DNA, 20 bp, Artificial Sequence
  Synthetic oligonucleotide; GAAAAC chr2 60452586 60452605 60452602 +
gggctctcgagcttccatcc

SEQ ID NO: 189782 - DNA, 20 bp, Artificial Sequence
  Synthetic oligonucleotide; GAAAAC chr2 60452965 60452984 60452981 +
acacttgcccttatgactga

SEQ ID NO: 189783 - DNA, 20 bp, Artificial Sequence
  Synthetic oligonucleotide; CAAAAC chr2 60453071 60453090 60453087 +
attataaagaaacaaaaaat

SEQ ID NO: 189784 - DNA, 20 bp, Artificial Sequence
  Synthetic oligonucleotide; GAAAAC chr2 60453097 60453116 60453113 +
tgatgtaaaagcagcacaac

SEQ ID NO: 189785 - DNA, 20 bp, Artificial Sequence
  Synthetic oligonucleotide; GAAAAC chr2 60453171 60453190 60453187 +
ggcgaacaaatctctgaaga

SEQ ID NO: 189786 - DNA, 20 bp, Artificial Sequence
  Synthetic oligonucleotide; AAAAAC chr2 60453210 60453229 60453226 +
agttgctctcaaattgcacc

SEQ ID NO: 189787 - DNA, 20 bp, Artificial Sequence
  Synthetic oligonucleotide; AAAAAC chr2 60453866 60453885 60453882 +
tttgccactttacagaaagg

SEQ ID NO: 189788 - DNA, 20 bp, Artificial Sequence
  Synthetic oligonucleotide; TAAAAC chr2 60454590 60454609 60454606 +
acggagggggaaaagaggct

SEQ ID NO: 189789 - DNA, 20 bp, Artificial Sequence
  Synthetic oligonucleotide; GAAAAC chr2 60454598 60454617 60454614 +
ggaaaagaggcttaaaacaa

SEQ ID NO: 189790 - DNA, 20 bp, Artificial Sequence
  Synthetic oligonucleotide; AAAAAC chr2 60454906 60454925 60454922 +
tatctacagaatgccctggg

SEQ ID NO: 189791 - DNA, 20 bp, Artificial Sequence
  Synthetic oligonucleotide; AAAAAC chr2 60455219 60455238 60455235 +
cagcacgtcaagcctgttac

SEQ ID NO: 189792 - DNA, 20 bp, Artificial Sequence
  Synthetic oligonucleotide; CAAAAC chr2 60455645 60455664 60455661 +
taattctgtctgtcaggatg

SEQ ID NO: 189793 - DNA, 20 bp, Artificial Sequence
  Synthetic oligonucleotide; TAAAAC chr2 60455703 60455722 60455719 +
attaaaatgaatactgtata

SEQ ID NO: 189794 - DNA, 20 bp, Artificial Sequence
  Synthetic oligonucleotide; CAAAAC chr2 60455884 60455903 60455900 +
agttttggagaaacctaatc

SEQ ID NO: 189795 - DNA, 20 bp, Artificial Sequence
  Synthetic oligonucleotide; GAAAAC chr2 60456048 60456067 60456064 +
ccacccaaactggcttttca

SEQ ID NO: 189796 - DNA, 20 bp, Artificial Sequence
  Synthetic oligonucleotide; TAAAAC chr2 60456081 60456100 60456097 +
ttctttatactttagaaaga

SEQ ID NO: 189797 - DNA, 20 bp, Artificial Sequence
  Synthetic oligonucleotide; CAAAAC chr2 60456436 60456455 60456452 +
gtcatccaggaagaccctat

SEQ ID NO: 189798 - DNA, 20 bp, Artificial Sequence
  Synthetic oligonucleotide; CAAAAC chr2 60456617 60456636 60456633 +
ttttctccctcttttttaaa

SEQ ID NO: 189799 - DNA, 20 bp, Artificial Sequence
  Synthetic oligonucleotide; CAAAAC chr2 60456622 60456641 60456638 +
tccctcttttttaaacaaaa

SEQ ID NO: 189800 - DNA, 20 bp, Artificial Sequence
  Synthetic oligonucleotide; CAAAAC chr2 60456627 60456646 60456643 +
cttttttaaacaaaacaaaa

SEQ ID NO: 189801 - DNA, 20 bp, Artificial Sequence
  Synthetic oligonucleotide; CAAAAC chr2 60456632 60456651 60456648 +
ttaaacaaaacaaaacaaaa

SEQ ID NO: 189802 - DNA, 20 bp, Artificial Sequence
  Synthetic oligonucleotide; CAAAAC chr2 60456637 60456656 60456653 +
caaaacaaaacaaaacaaaa

SEQ ID NO: 189803 - DNA, 20 bp, Artificial Sequence
  Synthetic oligonucleotide; GAAAAC chr2 60456930 60456949 60456946 +
taagtttttaacatcagact

SEQ ID NO: 189804 - DNA, 20 bp, Artificial Sequence
  Synthetic oligonucleotide; GAAAAC chr2 60456950 60456969 60456966 +
gaaaacaccttccatttctt

SEQ ID NO: 189805 - DNA, 20 bp, Artificial Sequence
  Synthetic oligonucleotide; TAAAAC chr2 60456976 60456995 60456992 +
tattctaaactggaaagcct

SEQ ID NO: 189806 - DNA, 20 bp, Artificial Sequence
  Synthetic oligonucleotide; TAAAAC chr2 60457105 60457124 60457121 +
aagactgactggccttctct

SEQ ID NO: 189807 - DNA, 20 bp, Artificial Sequence
  Synthetic oligonucleotide; AAAAAC chr2 60457251 60457270 60457267 +
ttaatgcagacaactgccaa

SEQ ID NO: 189808 - DNA, 20 bp, Artificial Sequence
  Synthetic oligonucleotide; AAAAAC chr2 60457359 60457378 60457375 +
atctaaataaaaaaaaaaat

SEQ ID NO: 189809 - DNA, 20 bp, Artificial Sequence
  Synthetic oligonucleotide; AAAAAC chr2 60457632 60457651 60457648 +
atttagtttttggcaatgaa

SEQ ID NO: 189810 - DNA, 20 bp, Artificial Sequence
  Synthetic oligonucleotide; CAAAAC chr2 60457640 60457659 60457656 +
tttggcaatgaaaaaaactg

SEQ ID NO: 189811 - DNA, 20 bp, Artificial Sequence
  Synthetic oligonucleotide; AAAAAC chr2 60458862 60458881 60458878 +
aaaattaaaaaaataaaaat

SEQ ID NO: 189812 - DNA, 20 bp, Artificial Sequence
  Synthetic oligonucleotide; TAAAAC chr2 60459376 60459395 60459392 +
taatcattgtttaaaaaaaa

SEQ ID NO: 189813 - DNA, 20 bp, Artificial Sequence
  Synthetic oligonucleotide; CAAAAC chr2 60459388 60459407 60459404 +
aaaaaaaataaaactttggg

SEQ ID NO: 189814 - DNA, 20 bp, Artificial Sequence
  Synthetic oligonucleotide; TAAAAC chr2 60459669 60459688 60459685 +
gatccaaggcactcatattt

SEQ ID NO: 189815 - DNA, 20 bp, Artificial Sequence
  Synthetic oligonucleotide; TAAAAC chr2 60459866 60459885 60459882 +
ttcctcctcacgttataaaa

SEQ ID NO: 189816 - DNA, 20 bp, Artificial Sequence
  Synthetic oligonucleotide; AAAAAC chr2 60460036 60460055 60460052 +
catgctgtctaagtttaaaa

SEQ ID NO: 189817 - DNA, 20 bp, Artificial Sequence
  Synthetic oligonucleotide; AAAAAC chr2 60460193 60460212 60460209 +
aaaagaaaaagaaaaagaaa

SEQ ID NO: 189818 - DNA, 20 bp, Artificial Sequence
  Synthetic oligonucleotide; AAAAAC chr2 60463166 60463185 60463182 +
atgtttaaaaaatctgaaag

SEQ ID NO: 189819 - DNA, 20 bp, Artificial Sequence
  Synthetic oligonucleotide; TAAAAC chr2 60463310 60463329 60463326 +
atcctagtttaaggaacagt

SEQ ID NO: 189820 - DNA, 20 bp, Artificial Sequence
  Synthetic oligonucleotide; AAAAAC chr2 60463758 60463777 60463774 +
agccaaaggacgaggatgag

SEQ ID NO: 189821 - DNA, 20 bp, Artificial Sequence
  Synthetic oligonucleotide; CAAAAC chr2 60463763 60463782 60463779 +
aaggacgaggatgagaaaaa

SEQ ID NO: 189822 - DNA, 20 bp, Artificial Sequence
  Synthetic oligonucleotide; GAAAAC chr2 60464247 60464266 60464263 +
aaggcagaaagattttgaaa

SEQ ID NO: 189823 - DNA, 20 bp, Artificial Sequence
  Synthetic oligonucleotide; AAAAAC chr2 60464392 60464411 60464408 +
ggtcccaaataggctggaaa

SEQ ID NO: 189824 - DNA, 20 bp, Artificial Sequence
  Synthetic oligonucleotide; TAAAAC chr2 60464578 60464597 60464594 +
taaaattatattttacctta

SEQ ID NO: 189825 - DNA, 20 bp, Artificial Sequence
  Synthetic oligonucleotide; AAAAAC chr2 60465689 60465708 60465705 +
cctatctgtaaaatgagcat

SEQ ID NO: 189826 - DNA, 20 bp, Artificial Sequence
  Synthetic oligonucleotide; AAAAAC chr2 60466682 60466701 60466698 +
gtgtcatctccctcccatct

SEQ ID NO: 189827 - DNA, 20 bp, Artificial Sequence
  Synthetic oligonucleotide; TAAAAC chr2 60466947 60466966 60466963 +
aagcaaactgtattattttc

SEQ ID NO: 189828 - DNA, 20 bp, Artificial Sequence
  Synthetic oligonucleotide; GAAAAC chr2 60466964 60466983 60466980 +
ttctaaaacagtatctttca

SEQ ID NO: 189829 - DNA, 20 bp, Artificial Sequence
  Synthetic oligonucleotide; TAAAAC chr2 60468184 60468203 60468200 +
caatgatgtgcatttttctc

SEQ ID NO: 189830 - DNA, 20 bp, Artificial Sequence
  Synthetic oligonucleotide; GAAAAC chr2 60469140 60469159 60469156 +
agatgtgtaagcagcaaggg

SEQ ID NO: 189831 - DNA, 20 bp, Artificial Sequence
  Synthetic oligonucleotide; AAAAAC chr2 60469890 60469909 60469906 +
tggggagggcgggagacaag

SEQ ID NO: 189832 - DNA, 20 bp, Artificial Sequence
  Synthetic oligonucleotide; CAAAAC chr2 60470224 60470243 60470240 +
acatttcatcctctctgacc

SEQ ID NO: 189833 - DNA, 20 bp, Artificial Sequence
  Synthetic oligonucleotide; CAAAAC chr2 60470434 60470453 60470450 +
ccgttcactaagtttgctgc

SEQ ID NO: 189834 - DNA, 20 bp, Artificial Sequence
  Synthetic oligonucleotide; AAAAAC chr2 60470815 60470834 60470831 +
tttttgttttctaagttgta

SEQ ID NO: 189835 - DNA, 20 bp, Artificial Sequence
  Synthetic oligonucleotide; GAAAAC chr2 60471148 60471167 60471164 +
ctgacttggtctcacaattg

SEQ ID NO: 189836 - DNA, 20 bp, Artificial Sequence
  Synthetic oligonucleotide; AAAAAC chr2 60471241 60471260 60471257 +
ccctgcagaattagacagct

SEQ ID NO: 189837 - DNA, 20 bp, Artificial Sequence
  Synthetic oligonucleotide; AAAAAC chr2 60472058 60472077 60472074 +
cctttaggactggaacagtc

SEQ ID NO: 189838 - DNA, 20 bp, Artificial Sequence
  Synthetic oligonucleotide; CAAAAC chr2 60472832 60472851 60472848 +
ctgcagatttccaaatgtgc

SEQ ID NO: 189839 - DNA, 20 bp, Artificial Sequence
  Synthetic oligonucleotide; TAAAAC chr2 60472905 60472924 60472921 +
agcccaactttaacaggtat

SEQ ID NO: 189840 - DNA, 20 bp, Artificial Sequence
  Synthetic oligonucleotide; AAAAAC chr2 60473933 60473952 60473949 +
ctttaaaaagtgtattctgc

SEQ ID NO: 189841 - DNA, 20 bp, Artificial Sequence
  Synthetic oligonucleotide; TAAAAC chr2 60474056 60474075 60474072 +
ataacatcaatcactcattt

SEQ ID NO: 189842 - DNA, 20 bp, Artificial Sequence
  Synthetic oligonucleotide; GAAAAC chr2 60474805 60474824 60474821 +
gccgctgtgggcagtacaaa

SEQ ID NO: 189843 - DNA, 20 bp, Artificial Sequence
  Synthetic oligonucleotide; GAAAAC chr2 60474994 60475013 60475010 +
agagaggctttgggaaagag

SEQ ID NO: 189844 - DNA, 20 bp, Artificial Sequence
  Synthetic oligonucleotide; GAAAAC chr2 60477419 60477438 60477435 +
aaatactagaataagctaaa

SEQ ID NO: 189845 - DNA, 20 bp, Artificial Sequence
  Synthetic oligonucleotide; TAAAAC chr2 60478562 60478581 60478578 +
aactggccattctccagaat

SEQ ID NO: 189846 - DNA, 20 bp, Artificial Sequence
  Synthetic oligonucleotide; TAAAAC chr2 60478686 60478705 60478702 +
ctctaacatttcttcaggaa

SEQ ID NO: 189847 - DNA, 20 bp, Artificial Sequence
  Synthetic oligonucleotide; GAAAAC chr2 60478786 60478805 60478802 +
gacggcaagtccttctttca

SEQ ID NO: 189848 - DNA, 20 bp, Artificial Sequence
  Synthetic oligonucleotide; CAAAAC chr2 60478910 60478929 60478926 +
tctggcaaagtcccacagaa

SEQ ID NO: 189849 - DNA, 20 bp, Artificial Sequence
  Synthetic oligonucleotide; CAAAAC chr2 60481169 60481188 60481185 +
agattgaggcttcccagccc

SEQ ID NO: 189850 - DNA, 20 bp, Artificial Sequence
  Synthetic oligonucleotide; GAAAAC chr2 60481294 60481313 60481310 +
agagaaacaagtaactcctt

SEQ ID NO: 189851 - DNA, 20 bp, Artificial Sequence
  Synthetic oligonucleotide; AAAAAC chr2 60481329 60481348 60481345 +
gcagggatcctaggaaaagt

SEQ ID NO: 189852 - DNA, 20 bp, Artificial Sequence
  Synthetic oligonucleotide; GAAAAC chr2 60482674 60482693 60482690 +
aaggttaagatcagcttcct

SEQ ID NO: 189853 - DNA, 20 bp, Artificial Sequence
  Synthetic oligonucleotide; GAAAAC chr2 60483015 60483034 60483031 +
tactgataaaggcactgcaa

SEQ ID NO: 189854 - DNA, 20 bp, Artificial Sequence
  Synthetic oligonucleotide; TAAAAC chr2 60483680 60483699 60483696 +
ggattacagtaaggaaaatc

SEQ ID NO: 189855 - DNA, 20 bp, Artificial Sequence
  Synthetic oligonucleotide; AAAAAC chr2 60484438 60484457 60484454 +
aactggggtcctctgctgtc

SEQ ID NO: 189856 - DNA, 20 bp, Artificial Sequence
  Synthetic oligonucleotide; TAAAAC chr2 60484763 60484782 60484779 +
cccttatcaccattccagta

SEQ ID NO: 189857 - DNA, 20 bp, Artificial Sequence
  Synthetic oligonucleotide; AAAAAC chr2 60484957 60484976 60484973 +
aggacttaaaaaaaaaaaaa

SEQ ID NO: 189858 - DNA, 20 bp, Artificial Sequence
  Synthetic oligonucleotide; AAAAAC chr2 60484977 60484996 60484993 +
aaaaaccaaccaaccaaaca

SEQ ID NO: 189859 - DNA, 20 bp, Artificial Sequence
  Synthetic oligonucleotide; AAAAAC chr2 60485010 60485029 60485026 +
aaatcaaaataggaaataca

SEQ ID NO: 189860 - DNA, 20 bp, Artificial Sequence
  Synthetic oligonucleotide; AAAAAC chr2 60485445 60485464 60485461 +
catgcctttaagctaactgc

SEQ ID NO: 189861 - DNA, 20 bp, Artificial Sequence
  Synthetic oligonucleotide; GAAAAC chr2 60485525 60485544 60485541 +
gaaaaataaacctagacctg

SEQ ID NO: 189862 - DNA, 20 bp, Artificial Sequence
  Synthetic oligonucleotide; AAAAAC chr2 60485572 60485591 60485588 +
caatcaactcatttaaaaag

SEQ ID NO: 189863 - DNA, 20 bp, Artificial Sequence
  Synthetic oligonucleotide; GAAAAC chr2 60486416 60486435 60486432 +
tactgaagtgagaaattcaa

SEQ ID NO: 189864 - DNA, 20 bp, Artificial Sequence
  Synthetic oligonucleotide; TAAAAC chr2 60487210 60487229 60487226 +
taagataatttgatatccta

SEQ ID NO: 189865 - DNA, 20 bp, Artificial Sequence
  Synthetic oligonucleotide; GAAAAC chr2 60487528 60487547 60487544 +
aatacagattcagattaagg

SEQ ID NO: 189866 - DNA, 20 bp, Artificial Sequence
  Synthetic oligonucleotide; CAAAAC chr2 60487561 60487580 60487577 +
tgcctttataaaatccagaa

SEQ ID NO: 189867 - DNA, 20 bp, Artificial Sequence
  Synthetic oligonucleotide; CAAAAC chr2 60487566 60487585 60487582 +
ttataaaatccagaacaaaa

SEQ ID NO: 189868 - DNA, 20 bp, Artificial Sequence
  Synthetic oligonucleotide; GAAAAC chr2 60487780 60487799 60487796 +
taaggaagctgcagaaaggt

SEQ ID NO: 189869 - DNA, 20 bp, Artificial Sequence
  Synthetic oligonucleotide; AAAAAC chr2 60488052 60488071 60488068 +
ttacttttgacctgggtttt

SEQ ID NO: 189870 - DNA, 20 bp, Artificial Sequence
  Synthetic oligonucleotide; TAAAAC chr2 60488608 60488627 60488624 +
tgtactgcaggggaattcgg

SEQ ID NO: 189871 - DNA, 20 bp, Artificial Sequence
  Synthetic oligonucleotide; AAAAAC chr2 60488682 60488701 60488698 +
gtatcaatagccaaagatcc

SEQ ID NO: 189872 - DNA, 20 bp, Artificial Sequence
  Synthetic oligonucleotide; CAAAAC chr2 60488708 60488727 60488724 +
agcctaaagccactgctacc

SEQ ID NO: 189873 - DNA, 20 bp, Artificial Sequence
  Synthetic oligonucleotide; CAAAAC chr2 60489045 60489064 60489061 +
ctaccacacccagccatacc

SEQ ID NO: 189874 - DNA, 20 bp, Artificial Sequence
  Synthetic oligonucleotide; AAAAAC chr2 60491221 60491240 60491237 +
aatgcaaaaagctaagttct

SEQ ID NO: 189875 - DNA, 20 bp, Artificial Sequence
  Synthetic oligonucleotide; CAAAAC chr2 60491732 60491751 60491748 +
gctgggctgactgcccacgt

SEQ ID NO: 189876 - DNA, 20 bp, Artificial Sequence
  Synthetic oligonucleotide; AAAAAC chr2 60491972 60491991 60491988 +
gagaggaagatggatgtagg

SEQ ID NO: 189877 - DNA, 20 bp, Artificial Sequence
  Synthetic oligonucleotide; AAAAAC chr2 60491978 60491997 60491994 +
aagatggatgtaggaaaaac

SEQ ID NO: 189878 - DNA, 20 bp, Artificial Sequence
  Synthetic oligonucleotide; AAAAAC chr2 60492347 60492366 60492363 +
acacagcgagaccctgtctc

SEQ ID NO: 189879 - DNA, 20 bp, Artificial Sequence
  Synthetic oligonucleotide; AAAAAC chr2 60492422 60492441 60492438 +
aatgtatttctagggaagaa

SEQ ID NO: 189880 - DNA, 20 bp, Artificial Sequence
  Synthetic oligonucleotide; GAAAAC chr2 60492481 60492500 60492497 +
gaagcctgctggaattctag

SEQ ID NO: 189881 - DNA, 20 bp, Artificial Sequence
  Synthetic oligonucleotide; CAAAAC chr2 60493529 60493548 60493545 +
gaaatgatgggaagagaccc

SEQ ID NO: 189882 - DNA, 20 bp, Artificial Sequence
  Synthetic oligonucleotide; GAAAAC chr2 60494050 60494069 60494066 +
tgcaagggggagaaactgaa

SEQ ID NO: 189883 - DNA, 20 bp, Artificial Sequence
  Synthetic oligonucleotide; GAAAAC chr2 60495750 60495769 60495766 +
atacacacaaaaggtacctg

SEQ ID NO: 189884 - DNA, 20 bp, Artificial Sequence
  Synthetic oligonucleotide; AAAAAC chr2 60495809 60495828 60495825 +
caataccccttcccccaacc

SEQ ID NO: 189885 - DNA, 20 bp, Artificial Sequence
  Synthetic oligonucleotide; TAAAAC chr2 60495949 60495968 60495965 +
cactattcttagctattttt

SEQ ID NO: 189886 - DNA, 20 bp, Artificial Sequence
  Synthetic oligonucleotide; GAAAAC chr2 60496147 60496166 60496163 +
gaattgttcatgaaatccca

SEQ ID NO: 189887 - DNA, 20 bp, Artificial Sequence
  Synthetic oligonucleotide; AAAAAC chr2 60496180 60496199 60496196 +
gggaaagttctggaagtcgg

SEQ ID NO: 189888 - DNA, 20 bp, Artificial Sequence
  Synthetic oligonucleotide; TAAAAC chr2 60497280 60497299 60497296 +
agaggggggaaaatcttttg

SEQ ID NO: 189889 - DNA, 20 bp, Artificial Sequence
  Synthetic oligonucleotide; GAAAAC chr2 60500166 60500185 60500182 +
ctgcggctgtgccctggatg

SEQ ID NO: 189890 - DNA, 20 bp, Artificial Sequence
  Synthetic oligonucleotide; GAAAAC chr2 60501843 60501862 60501859 +
cacataaaaatttaagacgg

SEQ ID NO: 189891 - DNA, 20 bp, Artificial Sequence
  Synthetic oligonucleotide; CAAAAC chr2 60501900 60501919 60501916 +
ccctctgcctctctacattc

SEQ ID NO: 189892 - DNA, 20 bp, Artificial Sequence
  Synthetic oligonucleotide; GAAAAC chr2 60502082 60502101 60502098 +
ctgtaccaccagaagtcctg

SEQ ID NO: 189893 - DNA, 20 bp, Artificial Sequence
  Synthetic oligonucleotide; TAAAAC chr2 60502378 60502397 60502394 +
cggaaaaagtctcagcctaa

SEQ ID NO: 189894 - DNA, 20 bp, Artificial Sequence
  Synthetic oligonucleotide; TAAAAC chr2 60502676 60502695 60502692 +
taatgttcttgatatgttaa

SEQ ID NO: 189895 - DNA, 20 bp, Artificial Sequence
  Synthetic oligonucleotide; AAAAAC chr2 60502703 60502722 60502719 +
gttttcaatcatcatcagag

SEQ ID NO: 189896 - DNA, 20 bp, Artificial Sequence
  Synthetic oligonucleotide; CAAAAC chr2 60503010 60503029 60503026 +
ggatggctactggcttggag

SEQ ID NO: 189897 - DNA, 20 bp, Artificial Sequence
  Synthetic oligonucleotide; AAAAAC chr2 60503330 60503349 60503346 +
aggcattgtgactttttatt

SEQ ID NO: 189898 - DNA, 20 bp, Artificial Sequence
  Synthetic oligonucleotide; CAAAAC chr2 60503985 60504004 60504001 +
gtattaaggcccaacccagc

SEQ ID NO: 189899 - DNA, 20 bp, Artificial Sequence
  Synthetic oligonucleotide; TAAAAC chr2 60504867 60504886 60504883 +
gcttccttgctccaaactat

SEQ ID NO: 189900 - DNA, 20 bp, Artificial Sequence
  Synthetic oligonucleotide; AAAAAC chr2 60504888 60504907 60504904 +
aaaacagagcgtccccccaa

SEQ ID NO: 189901 - DNA, 20 bp, Artificial Sequence
  Synthetic oligonucleotide; CAAAAC chr2 60505848 60505867 60505864 +
agggagggggaaatccctcc

SEQ ID NO: 189902 - DNA, 20 bp, Artificial Sequence
  Synthetic oligonucleotide; GAAAAC chr2 60506365 60506384 60506381 +
tctggtctgtcaaacccctg

SEQ ID NO: 189903 - DNA, 20 bp, Artificial Sequence
  Synthetic oligonucleotide; CAAAAC chr2 60506553 60506572 60506569 +
ccaggaaagccctggctata

SEQ ID NO: 189904 - DNA, 20 bp, Artificial Sequence
  Synthetic oligonucleotide; GAAAAC chr2 60506622 60506641 60506638 +
tgataaaggcagctcactaa

SEQ ID NO: 189905 - DNA, 20 bp, Artificial Sequence
  Synthetic oligonucleotide; CAAAAC chr2 60506809 60506828 60506825 +
tgatttcattatagcctctg

SEQ ID NO: 189906 - DNA, 20 bp, Artificial Sequence
  Synthetic oligonucleotide; AAAAAC chr2 60507105 60507124 60507121 +
tcataaacaagcactattaa

SEQ ID NO: 189907 - DNA, 20 bp, Artificial Sequence
  Synthetic oligonucleotide; GAAAAC chr2 60507399 60507418 60507415 +
ttgcctttcttgaaaagcta

SEQ ID NO: 189908 - DNA, 20 bp, Artificial Sequence
  Synthetic oligonucleotide; CAAAAC chr2 60507411 60507430 60507427 +
aaaagctagaaaactgtgtc

SEQ ID NO: 189909 - DNA, 20 bp, Artificial Sequence
  Synthetic oligonucleotide; TAAAAC chr2 60507476 60507495 60507492 +
tccgttcaagccagaaaagt

SEQ ID NO: 189910 - DNA, 20 bp, Artificial Sequence
  Synthetic oligonucleotide; AAAAAC chr2 60507778 60507797 60507794 +
gcggggagaagggaagaagt

SEQ ID NO: 189911 - DNA, 20 bp, Artificial Sequence
  Synthetic oligonucleotide; AAAAAC chr2 60508223 60508242 60508239 +
caacaacaaattacacaaat

SEQ ID NO: 189912 - DNA, 20 bp, Artificial Sequence
  Synthetic oligonucleotide; CAAAAC chr2 60508576 60508595 60508592 +
agcatttggcaggcaaagga

SEQ ID NO: 189913 - DNA, 20 bp, Artificial Sequence
  Synthetic oligonucleotide; GAAAAC chr2 60509411 60509430 60509427 +
agagccacacggacgtctca

SEQ ID NO: 189914 - DNA, 20 bp, Artificial Sequence
  Synthetic oligonucleotide; GAAAAC chr2 60509542 60509561 60509558 +
atggtctacctgagacctga

SEQ ID NO: 189915 - DNA, 20 bp, Artificial Sequence
  Synthetic oligonucleotide; AAAAAC chr2 60509668 60509687 60509684 +
aaaaagattaggaggaggag

SEQ ID NO: 189916 - DNA, 20 bp, Artificial Sequence
  Synthetic oligonucleotide; TAAAAC chr2 60510747 60510766 60510763 +
gccactcaatgccatatcta

SEQ ID NO: 189917 - DNA, 20 bp, Artificial Sequence
  Synthetic oligonucleotide; TAAAAC chr2 60510914 60510933 60510930 +
aacccttgacaggagccagt

SEQ ID NO: 189918 - DNA, 20 bp, Artificial Sequence
  Synthetic oligonucleotide; TAAAAC chr2 60511414 60511433 60511430 +
ccactcttttccgttaccaa

SEQ ID NO: 189919 - DNA, 20 bp, Artificial Sequence
  Synthetic oligonucleotide; CAAAAC chr2 60511574 60511593 60511590 +
aacagagcgctaatctgatt

SEQ ID NO: 189920 - DNA, 20 bp, Artificial Sequence
  Synthetic oligonucleotide; GAAAAC chr2 60511657 60511676 60511673 +
tacatgttgcaccatttcat

SEQ ID NO: 189921 - DNA, 20 bp, Artificial Sequence
  Synthetic oligonucleotide; GAAAAC chr2 60512621 60512640 60512637 +
tctaaattatttggtctaaa

SEQ ID NO: 189922 - DNA, 20 bp, Artificial Sequence
  Synthetic oligonucleotide; CAAAAC chr2 60513900 60513919 60513916 +
tgttcctggcttgtggtgag

SEQ ID NO: 189923 - DNA, 20 bp, Artificial Sequence
  Synthetic oligonucleotide; TAAAAC chr2 60514839 60514858 60514855 +
ggtcttgcatacacatacac

SEQ ID NO: 189924 - DNA, 20 bp, Artificial Sequence
  Synthetic oligonucleotide; TAAAAC chr2 60515404 60515423 60515420 +
caccaagaaggcacaaaaaa

SEQ ID NO: 189925 - DNA, 20 bp, Artificial Sequence
  Synthetic oligonucleotide; TAAAAC chr2 60516266 60516285 60516282 +
caatgacccactcctattat

SEQ ID NO: 189926 - DNA, 20 bp, Artificial Sequence
  Synthetic oligonucleotide; CAAAAC chr2 60516342 60516361 60516358 +
gaatctgggctccgctcttc

SEQ ID NO: 189927 - DNA, 20 bp, Artificial Sequence
  Synthetic oligonucleotide; GAAAAC chr2 60516796 60516815 60516812 +
acataagactaaagaatgtg

SEQ ID NO: 189928 - DNA, 20 bp, Artificial Sequence
  Synthetic oligonucleotide; GAAAAC chr2 60516863 60516882 60516879 +
atgtttgagtaaaagagctg

SEQ ID NO: 189929 - DNA, 20 bp, Artificial Sequence
  Synthetic oligonucleotide; GAAAAC chr2 60517372 60517391 60517388 +
cagccccgaaaaagggcaga

SEQ ID NO: 189930 - DNA, 20 bp, Artificial Sequence
  Synthetic oligonucleotide; TAAAAC chr2 60517929 60517948 60517945 +
gaggaacaagaaccttactc

SEQ ID NO: 189931 - DNA, 20 bp, Artificial Sequence
  Synthetic oligonucleotide; CAAAAC chr2 60518092 60518111 60518108 +
gaccagcctgggcaacatag

SEQ ID NO: 189932 - DNA, 20 bp, Artificial Sequence
  Synthetic oligonucleotide; TAAAAC chr2 60518265 60518284 60518281 +
tgctgagctctcataataca

SEQ ID NO: 189933 - DNA, 20 bp, Artificial Sequence
  Synthetic oligonucleotide; TAAAAC chr2 60519284 60519303 60519300 +
aacctccatattgagagaca

SEQ ID NO: 189934 - DNA, 20 bp, Artificial Sequence
  Synthetic oligonucleotide; AAAAAC chr2 60519387 60519406 60519403 +
tgatgtgaaagttaaagatt

SEQ ID NO: 189935 - DNA, 20 bp, Artificial Sequence
  Synthetic oligonucleotide; GAAAAC chr2 60519806 60519825 60519822 +
taaattactccaatgacaaa

SEQ ID NO: 189936 - DNA, 20 bp, Artificial Sequence
  Synthetic oligonucleotide; CAAAAC chr2 60520327 60520346 60520343 +
gacatgaggtgtgaatgatg

SEQ ID NO: 189937 - DNA, 20 bp, Artificial Sequence
  Synthetic oligonucleotide; AAAAAC chr2 60520800 60520819 60520816 +
gatcagccaccaaccgaacc

SEQ ID NO: 189938 - DNA, 20 bp, Artificial Sequence
  Synthetic oligonucleotide; TAAAAC chr2 60520955 60520974 60520971 +
cctttgtcaacccagcatga

SEQ ID NO: 189939 - DNA, 20 bp, Artificial Sequence
  Synthetic oligonucleotide; TAAAAC chr2 60521322 60521341 60521338 +
gagagagagcggacattttg

SEQ ID NO: 189940 - DNA, 20 bp, Artificial Sequence
  Synthetic oligonucleotide; CAAAAC chr2 60522337 60522356 60522353 +
ttttcttttaaatacaactg

SEQ ID NO: 189941 - DNA, 20 bp, Artificial Sequence
  Synthetic oligonucleotide; TAAAAC chr2 60522937 60522956 60522953 +
agagacagtgaggtctacaa

SEQ ID NO: 189942 - DNA, 20 bp, Artificial Sequence
  Synthetic oligonucleotide; AAAAAC chr2 60523413 60523432 60523429 +
tttctacatggatagctttc

SEQ ID NO: 189943 - DNA, 20 bp, Artificial Sequence
  Synthetic oligonucleotide; CAAAAC chr2 60523717 60523736 60523733 +
caaaatcattcattgccagg

SEQ ID NO: 189944 - DNA, 20 bp, Artificial Sequence
  Synthetic oligonucleotide; TAAAAC chr2 60523949 60523968 60523965 +
ttaaacttcagccagagatc

SEQ ID NO: 189945 - DNA, 20 bp, Artificial Sequence
  Synthetic oligonucleotide; GAAAAC chr2 60524043 60524062 60524059 +
cggaccacaggaactagtgt

SEQ ID NO: 189946 - DNA, 20 bp, Artificial Sequence
  Synthetic oligonucleotide; CAAAAC chr2 60524572 60524591 60524588 +
gcatgcctattaaaaatccc

SEQ ID NO: 189947 - DNA, 20 bp, Artificial Sequence
  Synthetic oligonucleotide; GAAAAC chr2 60524783 60524802 60524799 +
ccctttttcagcatgcttct

SEQ ID NO: 189948 - DNA, 20 bp, Artificial Sequence
  Synthetic oligonucleotide; GAAAAC chr2 60524841 60524860 60524857 +
ggtatttgctggacagtgtg

SEQ ID NO: 189949 - DNA, 20 bp, Artificial Sequence
  Synthetic oligonucleotide; AAAAAC chr2 60525200 60525219 60525216 +
aattcaactatttctttttc

SEQ ID NO: 189950 - DNA, 20 bp, Artificial Sequence
  Synthetic oligonucleotide; AAAAAC chr2 60525290 60525309 60525306 +
attctttggagtttttcaaa

SEQ ID NO: 189951 - DNA, 20 bp, Artificial Sequence
  Synthetic oligonucleotide; GAAAAC chr2 60525553 60525572 60525569 +
attccaaaaaatagcaggga

SEQ ID NO: 189952 - DNA, 20 bp, Artificial Sequence
  Synthetic oligonucleotide; TAAAAC chr2 60526095 60526114 60526111 +
atgatttcactttctagata

SEQ ID NO: 189953 - DNA, 20 bp, Artificial Sequence
  Synthetic oligonucleotide; GAAAAC chr2 60527222 60527241 60527238 +
gattttcaagggaagagaag

SEQ ID NO: 189954 - DNA, 20 bp, Artificial Sequence
  Synthetic oligonucleotide; TAAAAC chr2 60527325 60527344 60527341 +
agtctaggagacccagcaaa

SEQ ID NO: 189955 - DNA, 20 bp, Artificial Sequence
  Synthetic oligonucleotide; GAAAAC chr2 60527805 60527824 60527821 +
tgaaaggatggagaatacag

SEQ ID NO: 189956 - DNA, 20 bp, Artificial Sequence
  Synthetic oligonucleotide; GAAAAC chr2 60527935 60527954 60527951 +
ggagaggccaccacgcagct

SEQ ID NO: 189957 - DNA, 20 bp, Artificial Sequence
  Synthetic oligonucleotide; CAAAAC chr2 60527998 60528017 60528014 +
tgttgactgcagtttccatt

SEQ ID NO: 189958 - DNA, 20 bp, Artificial Sequence
  Synthetic oligonucleotide; GAAAAC chr2 60528067 60528086 60528083 +
agccttgttcagccagaaat

SEQ ID NO: 189959 - DNA, 20 bp, Artificial Sequence
  Synthetic oligonucleotide; TAAAAC chr2 60528332 60528351 60528348 +
accaagccacacacaaacag

SEQ ID NO: 189960 - DNA, 20 bp, Artificial Sequence
  Synthetic oligonucleotide; AAAAAC chr2 60528512 60528531 60528528 +
ttctctttcccagaagattg

SEQ ID NO: 189961 - DNA, 20 bp, Artificial Sequence
  Synthetic oligonucleotide; AAAAAC chr2 60530076 60530095 60530092 +
cataatgtcacaataaacta

SEQ ID NO: 189962 - DNA, 20 bp, Artificial Sequence
  Synthetic oligonucleotide; CAAAAC chr2 60530117 60530136 60530133 +
gaagataagaaaatcgagaa

SEQ ID NO: 189963 - DNA, 20 bp, Artificial Sequence
  Synthetic oligonucleotide; AAAAAC chr2 60530683 60530702 60530699 +
aaagaaagaaaaaggaaaaa

SEQ ID NO: 189964 - DNA, 20 bp, Artificial Sequence
  Synthetic oligonucleotide; AAAAAC chr2 60530855 60530874 60530871 +
cctacctctttcgagctcct

SEQ ID NO: 189965 - DNA, 20 bp, Artificial Sequence
  Synthetic oligonucleotide; CAAAAC chr2 60530947 60530966 60530963 +
gcgcaccctgggacccctga

SEQ ID NO: 189966 - DNA, 20 bp, Artificial Sequence
  Synthetic oligonucleotide; TAAAAC chr2 60532327 60532346 60532343 +
ggtttttttttttttccttt

SEQ ID NO: 189967 - DNA, 20 bp, Artificial Sequence
  Synthetic oligonucleotide; AAAAAC chr2 60532650 60532669 60532666 +
cattattatgactttacttg

SEQ ID NO: 189968 - DNA, 20 bp, Artificial Sequence
  Synthetic oligonucleotide; AAAAAC chr2 60532722 60532741 60532738 +
cactccctttaagtacttcg

SEQ ID NO: 189969 - DNA, 20 bp, Artificial Sequence
  Synthetic oligonucleotide; TAAAAC chr2 60532775 60532794 60532791 +
aagcattaactggtttggat

SEQ ID NO: 189970 - DNA, 20 bp, Artificial Sequence
  Synthetic oligonucleotide; CAAAAC chr2 60533220 60533239 60533236 +
agttaaataaaccgacatgg

SEQ ID NO: 189971 - DNA, 20 bp, Artificial Sequence
  Synthetic oligonucleotide; GAAAAC chr2 60534264 60534283 60534280 +
tcagagcagcagctgaatga

SEQ ID NO: 189972 - DNA, 20 bp, Artificial Sequence
  Synthetic oligonucleotide; TAAAAC chr2 60534467 60534486 60534483 +
tgccatcaaactgctaacaa

SEQ ID NO: 189973 - DNA, 20 bp, Artificial Sequence
  Synthetic oligonucleotide; GAAAAC chr2 60534627 60534646 60534643 +
aactgtacttaacgttaaaa

SEQ ID NO: 189974 - DNA, 20 bp, Artificial Sequence
  Synthetic oligonucleotide; TAAAAC chr2 60534636 60534655 60534652 +
taacgttaaaagaaaacgga

SEQ ID NO: 189975 - DNA, 20 bp, Artificial Sequence
  Synthetic oligonucleotide; CAAAAC chr2 60534771 60534790 60534787 +
ccactgaggcagctaataca

SEQ ID NO: 189976 - DNA, 20 bp, Artificial Sequence
  Synthetic oligonucleotide; AAAAAC chr2 60534894 60534913 60534910 +
aacttttaatcttgagaaga

SEQ ID NO: 189977 - DNA, 20 bp, Artificial Sequence
  Synthetic oligonucleotide; CAAAAC chr2 60535056 60535075 60535072 +
taataggccaatcaaaaatg

SEQ ID NO: 189978 - DNA, 20 bp, Artificial Sequence
  Synthetic oligonucleotide; TAAAAC chr2 60535387 60535406 60535403 +
atcgtcacggactttgttca

SEQ ID NO: 189979 - DNA, 20 bp, Artificial Sequence
  Synthetic oligonucleotide; AAAAAC chr2 60535438 60535457 60535454 +
tctaaacatggtaatttatc

SEQ ID NO: 189980 - DNA, 20 bp, Artificial Sequence
  Synthetic oligonucleotide; AAAAAC chr2 60535574 60535593 60535590 +
gtaaacatccactgtggtat

SEQ ID NO: 189981 - DNA, 20 bp, Artificial Sequence
  Synthetic oligonucleotide; AAAAAC chr2 60536554 60536573 60536570 +
gggcaaatcagaattagatt

SEQ ID NO: 189982 - DNA, 20 bp, Artificial Sequence
  Synthetic oligonucleotide; AAAAAC chr2 60537166 60537185 60537182 +
ttttttctccttaacataac

SEQ ID NO: 189983 - DNA, 20 bp, Artificial Sequence
  Synthetic oligonucleotide; TAAAAC chr2 60537542 60537561 60537558 +
tgcagggattggccaaatat

SEQ ID NO: 189984 - DNA, 20 bp, Artificial Sequence
  Synthetic oligonucleotide; TAAAAC chr2 60537899 60537918 60537915 +
tcagtggattcgcctctatc

SEQ ID NO: 189985 - DNA, 20 bp, Artificial Sequence
  Synthetic oligonucleotide; AAAAAC chr2 60537966 60537985 60537982 +
acaacagtgagaatacaaac

SEQ ID NO: 189986 - DNA, 20 bp, Artificial Sequence
  Synthetic oligonucleotide; TAAAAC chr2 60538562 60538581 60538578 +
cacattataaaaatcttctt

SEQ ID NO: 189987 - DNA, 20 bp, Artificial Sequence
  Synthetic oligonucleotide; TAAAAC chr2 60539554 60539573 60539570 +
atatggaataagttacattt

SEQ ID NO: 189988 - DNA, 20 bp, Artificial Sequence
  Synthetic oligonucleotide; AAAAAC chr2 60539809 60539828 60539825 +
aattaattaggtcatgttgt

SEQ ID NO: 189989 - DNA, 20 bp, Artificial Sequence
  Synthetic oligonucleotide; AAAAAC chr2 60540063 60540082 60540079 +
tccaaattgatacataacat

SEQ ID NO: 189990 - DNA, 20 bp, Artificial Sequence
  Synthetic oligonucleotide; AAAAAC chr2 60540303 60540322 60540319 +
aagctggtactactgtatgt

SEQ ID NO: 189991 - DNA, 20 bp, Artificial Sequence
  Synthetic oligonucleotide; CAAAAC chr2 60540839 60540858 60540855 +
ttcactaagagaaaggtgtg

SEQ ID NO: 189992 - DNA, 20 bp, Artificial Sequence
  Synthetic oligonucleotide; AAAAAC chr2 60541133 60541152 60541149 +
tctgtaacagcaggagacag

SEQ ID NO: 189993 - DNA, 20 bp, Artificial Sequence
  Synthetic oligonucleotide; CAAAAC chr2 60541195 60541214 60541211 +
atatcacgtggacctattct

SEQ ID NO: 189994 - DNA, 20 bp, Artificial Sequence
  Synthetic oligonucleotide; CAAAAC chr2 60541502 60541521 60541518 +
tctctgacattgtactttga

SEQ ID NO: 189995 - DNA, 20 bp, Artificial Sequence
  Synthetic oligonucleotide; GAAAAC chr2 60541650 60541669 60541666 +
aaaatcctaggtacttatta

SEQ ID NO: 189996 - DNA, 20 bp, Artificial Sequence
  Synthetic oligonucleotide; CAAAAC chr2 60542280 60542299 60542296 +
gattcctatgtgcaataagc

SEQ ID NO: 189997 - DNA, 20 bp, Artificial Sequence
  Synthetic oligonucleotide; GAAAAC chr2 60542405 60542424 60542421 +
aatatgagactaaaaaaaaa

SEQ ID NO: 189998 - DNA, 20 bp, Artificial Sequence
  Synthetic oligonucleotide; CAAAAC chr2 60542410 60542429 60542426 +
gagactaaaaaaaaagaaaa

SEQ ID NO: 189999 - DNA, 20 bp, Artificial Sequence
  Synthetic oligonucleotide; CAAAAC chr2 60542415 60542434 60542431 +
taaaaaaaaagaaaacaaaa

SEQ ID NO: 190000 - DNA, 20 bp, Artificial Sequence
  Synthetic oligonucleotide; CAAAAC chr2 60542420 60542439 60542436 +
aaaaagaaaacaaaacaaaa

SEQ ID NO: 190001 - DNA, 20 bp, Artificial Sequence
  Synthetic oligonucleotide; AAAAAC chr2 60542856 60542875 60542872 +
ctgcctctactgaaaataca

SEQ ID NO: 190002 - DNA, 20 bp, Artificial Sequence
  Synthetic oligonucleotide; CAAAAC chr2 60542997 60543016 60543013 +
tccagcctgggcaacaagag

SEQ ID NO: 190003 - DNA, 20 bp, Artificial Sequence
  Synthetic oligonucleotide; AAAAAC chr2 60543029 60543048 60543045 +
taaaaaaaaaaaaaaaaaaa

SEQ ID NO: 190004 - DNA, 20 bp, Artificial Sequence
  Synthetic oligonucleotide; TAAAAC chr2 60544705 60544724 60544721 +
atgatatgcactacctttcc

SEQ ID NO: 190005 - DNA, 20 bp, Artificial Sequence
  Synthetic oligonucleotide; CAAAAC chr2 60545128 60545147 60545144 +
caaaatcaagatacatctgt

SEQ ID NO: 190006 - DNA, 20 bp, Artificial Sequence
  Synthetic oligonucleotide; GAAAAC chr2 60545911 60545930 60545927 +
agcacctctgaaaatgaaaa

SEQ ID NO: 190007 - DNA, 20 bp, Artificial Sequence
  Synthetic oligonucleotide; GAAAAC chr2 60546502 60546521 60546518 +
caaatcatcacatatgtaaa

SEQ ID NO: 190008 - DNA, 20 bp, Artificial Sequence
  Synthetic oligonucleotide; AAAAAC chr2 60546663 60546682 60546679 +
gcttaaataataactacaag

SEQ ID NO: 190009 - DNA, 20 bp, Artificial Sequence
  Synthetic oligonucleotide; GAAAAC chr2 60546883 60546902 60546899 +
catttacactgctgtaataa

SEQ ID NO: 190010 - DNA, 20 bp, Artificial Sequence
  Synthetic oligonucleotide; AAAAAC chr2 60546952 60546971 60546968 +
gcagcataattcacactgcc

SEQ ID NO: 190011 - DNA, 20 bp, Artificial Sequence
  Synthetic oligonucleotide; CAAAAC chr2 60547518 60547537 60547534 +
aaaaaaaaaatcacaaaata

SEQ ID NO: 190012 - DNA, 20 bp, Artificial Sequence
  Synthetic oligonucleotide; TAAAAC chr2 60547545 60547564 60547561 +
tccaggatgctgccagttaa

SEQ ID NO: 190013 - DNA, 20 bp, Artificial Sequence
  Synthetic oligonucleotide; CAAAAC chr2 60548424 60548443 60548440 +
tagttaaaggtaatgtggtt

SEQ ID NO: 190014 - DNA, 20 bp, Artificial Sequence
  Synthetic oligonucleotide; CAAAAC chr2 60548478 60548497 60548494 +
tgactgaactgatttacaat

SEQ ID NO: 190015 - DNA, 20 bp, Artificial Sequence
  Synthetic oligonucleotide; TAAAAC chr2 60548597 60548616 60548613 +
gatgatcaaatgtacagata

SEQ ID NO: 190016 - DNA, 20 bp, Artificial Sequence
  Synthetic oligonucleotide; CAAAAC chr2 60548702 60548721 60548718 +
gtttaacatcggtctccttg

SEQ ID NO: 190017 - DNA, 20 bp, Artificial Sequence
  Synthetic oligonucleotide; CAAAAC chr2 60548736 60548755 60548752 +
agtggtgttcagagaaatac

SEQ ID NO: 190018 - DNA, 20 bp, Artificial Sequence
  Synthetic oligonucleotide; AAAAAC chr2 60548929 60548948 60548945 +
atgcaaattcccctttccct

SEQ ID NO: 190019 - DNA, 20 bp, Artificial Sequence
  Synthetic oligonucleotide; CAAAAC chr2 60549285 60549304 60549301 +
aaatgttggtaaggagcgag

SEQ ID NO: 190020 - DNA, 20 bp, Artificial Sequence
  Synthetic oligonucleotide; GAAAAC chr2 60549736 60549755 60549752 +
gaaaaaggaagtgaggtttg

SEQ ID NO: 190021 - DNA, 20 bp, Artificial Sequence
  Synthetic oligonucleotide; GAAAAC chr2 60550198 60550217 60550214 +
tgccggccccgaaagaaagc

SEQ ID NO: 190022 - DNA, 20 bp, Artificial Sequence
  Synthetic oligonucleotide; AAAAAC chr2 60551077 60551096 60551093 +
ccccaccaccacccctttaa

SEQ ID NO: 190023 - DNA, 20 bp, Artificial Sequence
  Synthetic oligonucleotide; TAAAAC chr2 60551108 60551127 60551124 +
accaagtataggtggtcctt

SEQ ID NO: 190024 - DNA, 20 bp, Artificial Sequence
  Synthetic oligonucleotide; CAAAAC chr2 60552858 60552877 60552874 +
tagcattgttcattattttg

SEQ ID NO: 190025 - DNA, 20 bp, Artificial Sequence
  Synthetic oligonucleotide; CAAAAC chr2 60553638 60553657 60553654 +
tctggatggacagagacaca

SEQ ID NO: 190026 - DNA, 20 bp, Artificial Sequence
  Synthetic oligonucleotide; TAAAAC chr2 60555051 60555070 60555067 +
tagggaagacctgttggaaa

SEQ ID NO: 190027 - DNA, 20 bp, Artificial Sequence
  Synthetic oligonucleotide; AAAAAC chr2 60556496 60556515 60556512 +
attgattttcctttttaaaa

SEQ ID NO: 190028 - DNA, 20 bp, Artificial Sequence
  Synthetic oligonucleotide; CAAAAC chr2 60555760 60555779 60555763 -
tctctctcaatgttgagcat

SEQ ID NO: 190029 - DNA, 20 bp, Artificial Sequence
  Synthetic oligonucleotide; TAAAAC chr2 60555589 60555608 60555592 -
gcaagcccggggccctcgct

SEQ ID NO: 190030 - DNA, 20 bp, Artificial Sequence
  Synthetic oligonucleotide; TAAAAC chr2 60555169 60555188 60555172 -
ctgttgctgtacattttacg

SEQ ID NO: 190031 - DNA, 20 bp, Artificial Sequence
  Synthetic oligonucleotide; AAAAAC chr2 60553099 60553118 60553102 -
atttttaaatttttcacgag

SEQ ID NO: 190032 - DNA, 20 bp, Artificial Sequence
  Synthetic oligonucleotide; AAAAAC chr2 60553059 60553078 60553062 -
gtaaaagagataaaggggga

SEQ ID NO: 190033 - DNA, 20 bp, Artificial Sequence
  Synthetic oligonucleotide; AAAAAC chr2 60552743 60552762 60552746 -
agggagtgagtacaagtcta

SEQ ID NO: 190034 - DNA, 20 bp, Artificial Sequence
  Synthetic oligonucleotide; TAAAAC chr2 60552247 60552266 60552250 -
atacataaaaataaaataaa

SEQ ID NO: 190035 - DNA, 20 bp, Artificial Sequence
  Synthetic oligonucleotide; AAAAAC chr2 60548770 60548789 60548773 -
aataatataccagcaatgat

SEQ ID NO: 190036 - DNA, 20 bp, Artificial Sequence
  Synthetic oligonucleotide; CAAAAC chr2 60544867 60544886 60544870 -
taacactatatagtgaccct

SEQ ID NO: 190037 - DNA, 20 bp, Artificial Sequence
  Synthetic oligonucleotide; TAAAAC chr2 60544578 60544597 60544581 -
cccctctagaatttgatcat

SEQ ID NO: 190038 - DNA, 20 bp, Artificial Sequence
  Synthetic oligonucleotide; CAAAAC chr2 60544185 60544204 60544188 -
cgagctgctcgtttaaaaga

SEQ ID NO: 190039 - DNA, 20 bp, Artificial Sequence
  Synthetic oligonucleotide; TAAAAC chr2 60544157 60544176 60544160 -
agtgtctgtcaagcaagaat

SEQ ID NO: 190040 - DNA, 20 bp, Artificial Sequence
  Synthetic oligonucleotide; CAAAAC chr2 60543900 60543919 60543903 -
atagcagagcctagagaagc

SEQ ID NO: 190041 - DNA, 20 bp, Artificial Sequence
  Synthetic oligonucleotide; TAAAAC chr2 60543194 60543213 60543197 -
ttataggcaggaagcaagaa

SEQ ID NO: 190042 - DNA, 20 bp, Artificial Sequence
  Synthetic oligonucleotide; AAAAAC chr2 60541803 60541822 60541806 -
ttatttatgtgattctgaat

SEQ ID NO: 190043 - DNA, 20 bp, Artificial Sequence
  Synthetic oligonucleotide; TAAAAC chr2 60541762 60541781 60541765 -
tgaattttcagcatggcagt

SEQ ID NO: 190044 - DNA, 20 bp, Artificial Sequence
  Synthetic oligonucleotide; AAAAAC chr2 60541754 60541773 60541757 -
cagcatggcagttaaaacaa

SEQ ID NO: 190045 - DNA, 20 bp, Artificial Sequence
  Synthetic oligonucleotide; AAAAAC chr2 60541736 60541755 60541739 -
aaaaaaacaccactaccaca

SEQ ID NO: 190046 - DNA, 20 bp, Artificial Sequence
  Synthetic oligonucleotide; AAAAAC chr2 60541015 60541034 60541018 -
tttattctgtgaaagcttaa

SEQ ID NO: 190047 - DNA, 20 bp, Artificial Sequence
  Synthetic oligonucleotide; AAAAAC chr2 60541007 60541026 60541010 -
gtgaaagcttaaaaaaacaa

SEQ ID NO: 190048 - DNA, 20 bp, Artificial Sequence
  Synthetic oligonucleotide; CAAAAC chr2 60540949 60540968 60540952 -
cacacacacacacacacaca

SEQ ID NO: 190049 - DNA, 20 bp, Artificial Sequence
  Synthetic oligonucleotide; AAAAAC chr2 60540625 60540644 60540628 -
gtactaaattggggtacata

SEQ ID NO: 190050 - DNA, 20 bp, Artificial Sequence
  Synthetic oligonucleotide; TAAAAC chr2 60539493 60539512 60539496 -
ctgcactccctatgcatttt

SEQ ID NO: 190051 - DNA, 20 bp, Artificial Sequence
  Synthetic oligonucleotide; GAAAAC chr2 60539043 60539062 60539046 -
cctttgatctatagcgaaat

SEQ ID NO: 190052 - DNA, 20 bp, Artificial Sequence
  Synthetic oligonucleotide; AAAAAC chr2 60538658 60538677 60538661 -
cttcatttgtacttttttta

SEQ ID NO: 190053 - DNA, 20 bp, Artificial Sequence
  Synthetic oligonucleotide; CAAAAC chr2 60538514 60538533 60538517 -
aagcagttgtggtagatcca

SEQ ID NO: 190054 - DNA, 20 bp, Artificial Sequence
  Synthetic oligonucleotide; CAAAAC chr2 60538479 60538498 60538482 -
aaaatacacgtttcctgaaa

SEQ ID NO: 190055 - DNA, 20 bp, Artificial Sequence
  Synthetic oligonucleotide; AAAAAC chr2 60537897 60537916 60537900 -
tagaggcgaatccactgatt

SEQ ID NO: 190056 - DNA, 20 bp, Artificial Sequence
  Synthetic oligonucleotide; GAAAAC chr2 60537835 60537854 60537838 -
tgcaagggtgccttcaaaaa

SEQ ID NO: 190057 - DNA, 20 bp, Artificial Sequence
  Synthetic oligonucleotide; AAAAAC chr2 60537777 60537796 60537780 -
tttgctttttgaactttcta

SEQ ID NO: 190058 - DNA, 20 bp, Artificial Sequence
  Synthetic oligonucleotide; AAAAAC chr2 60537531 60537550 60537534 -
atccctgcacctcctcaaac

SEQ ID NO: 190059 - DNA, 20 bp, Artificial Sequence
  Synthetic oligonucleotide; AAAAAC chr2 60537517 60537536 60537520 -
tcaaacaaaaacaaacctca

SEQ ID NO: 190060 - DNA, 20 bp, Artificial Sequence
  Synthetic oligonucleotide; TAAAAC chr2 60537365 60537384 60537368 -
cgatcctttcagtttccagt

SEQ ID NO: 190061 - DNA, 20 bp, Artificial Sequence
  Synthetic oligonucleotide; TAAAAC chr2 60537273 60537292 60537276 -
aaaaattattcctttacatt

SEQ ID NO: 190062 - DNA, 20 bp, Artificial Sequence
  Synthetic oligonucleotide; GAAAAC chr2 60537119 60537138 60537122 -
aaagatactcttggatcttt

SEQ ID NO: 190063 - DNA, 20 bp, Artificial Sequence
  Synthetic oligonucleotide; TAAAAC chr2 60537095 60537114 60537098 -
acaactgctgtccttttaac

SEQ ID NO: 190064 - DNA, 20 bp, Artificial Sequence
  Synthetic oligonucleotide; AAAAAC chr2 60535266 60535285 60535269 -
aatgaggaaatcataggaag

SEQ ID NO: 190065 - DNA, 20 bp, Artificial Sequence
  Synthetic oligonucleotide; GAAAAC chr2 60534165 60534184 60534168 -
tacacgagtgccctggtggt

SEQ ID NO: 190066 - DNA, 20 bp, Artificial Sequence
  Synthetic oligonucleotide; TAAAAC chr2 60533999 60534018 60534002 -
agtgtaactgatattctgat

SEQ ID NO: 190067 - DNA, 20 bp, Artificial Sequence
  Synthetic oligonucleotide; GAAAAC chr2 60533493 60533512 60533496 -
tcagctgacccggtatttaa

SEQ ID NO: 190068 - DNA, 20 bp, Artificial Sequence
  Synthetic oligonucleotide; CAAAAC chr2 60533488 60533507 60533491 -
tgacccggtatttaagaaaa

SEQ ID NO: 190069 - DNA, 20 bp, Artificial Sequence
  Synthetic oligonucleotide; AAAAAC chr2 60533158 60533177 60533161 -
aagattacagtattagagtt

SEQ ID NO: 190070 - DNA, 20 bp, Artificial Sequence
  Synthetic oligonucleotide; AAAAAC chr2 60532423 60532442 60532426 -
gccaccaccaccaaaaaaag

SEQ ID NO: 190071 - DNA, 20 bp, Artificial Sequence
  Synthetic oligonucleotide; AAAAAC chr2 60532415 60532434 60532418 -
caccaaaaaaagaaaaacaa

SEQ ID NO: 190072 - DNA, 20 bp, Artificial Sequence
  Synthetic oligonucleotide; AAAAAC chr2 60532408 60532427 60532411 -
aaaagaaaaacaaaaaaaca

SEQ ID NO: 190073 - DNA, 20 bp, Artificial Sequence
  Synthetic oligonucleotide; CAAAAC chr2 60532398 60532417 60532401 -
caaaaaaacaaaaaacaaag

SEQ ID NO: 190074 - DNA, 20 bp, Artificial Sequence
  Synthetic oligonucleotide; CAAAAC chr2 60532393 60532412 60532396 -
aaacaaaaaacaaagcaaaa

SEQ ID NO: 190075 - DNA, 20 bp, Artificial Sequence
  Synthetic oligonucleotide; CAAAAC chr2 60532388 60532407 60532391 -
aaaaacaaagcaaaacaaaa

SEQ ID NO: 190076 - DNA, 20 bp, Artificial Sequence
  Synthetic oligonucleotide; AAAAAC chr2 60532375 60532394 60532378 -
aacaaaacaaaaccttttta

SEQ ID NO: 190077 - DNA, 20 bp, Artificial Sequence
  Synthetic oligonucleotide; AAAAAC chr2 60532334 60532353 60532337 -
agttttaaaaggaaaaaaaa

SEQ ID NO: 190078 - DNA, 20 bp, Artificial Sequence
  Synthetic oligonucleotide; AAAAAC chr2 60532326 60532345 60532329 -
aaggaaaaaaaaaaaaaccc

SEQ ID NO: 190079 - DNA, 20 bp, Artificial Sequence
  Synthetic oligonucleotide; CAAAAC chr2 60532292 60532311 60532295 -
aacaaccaccttctgacgct

SEQ ID NO: 190080 - DNA, 20 bp, Artificial Sequence
  Synthetic oligonucleotide; CAAAAC chr2 60531674 60531693 60531677 -
ccccaatgccagggcactgc

SEQ ID NO: 190081 - DNA, 20 bp, Artificial Sequence
  Synthetic oligonucleotide; TAAAAC chr2 60531381 60531400 60531384 -
gtaaattaatggatatgatt

SEQ ID NO: 190082 - DNA, 20 bp, Artificial Sequence
  Synthetic oligonucleotide; CAAAAC chr2 60531376 60531395 60531379 -
ttaatggatatgatttaaaa

SEQ ID NO: 190083 - DNA, 20 bp, Artificial Sequence
  Synthetic oligonucleotide; AAAAAC chr2 60531210 60531229 60531213 -
gggcaacacagagggaggag

SEQ ID NO: 190084 - DNA, 20 bp, Artificial Sequence
  Synthetic oligonucleotide; AAAAAC chr2 60529675 60529694 60529678 -
ctccttttctagtagcaaat

SEQ ID NO: 190085 - DNA, 20 bp, Artificial Sequence
  Synthetic oligonucleotide; TAAAAC chr2 60529263 60529282 60529266 -
gctcagtgctgggcacatgg

SEQ ID NO: 190086 - DNA, 20 bp, Artificial Sequence
  Synthetic oligonucleotide; CAAAAC chr2 60527848 60527867 60527851 -
atggattacacaatgtattc

SEQ ID NO: 190087 - DNA, 20 bp, Artificial Sequence
  Synthetic oligonucleotide; GAAAAC chr2 60526295 60526314 60526298 -
gttgaaatccttttaaagat

SEQ ID NO: 190088 - DNA, 20 bp, Artificial Sequence
  Synthetic oligonucleotide; AAAAAC chr2 60526086 60526105 60526089 -
agtgaaatcattgttataga

SEQ ID NO: 190089 - DNA, 20 bp, Artificial Sequence
  Synthetic oligonucleotide; AAAAAC chr2 60526065 60526084 60526068 -
aaaacctactgtggttagaa

SEQ ID NO: 190090 - DNA, 20 bp, Artificial Sequence
  Synthetic oligonucleotide; GAAAAC chr2 60525755 60525774 60525758 -
taacagagagacactgatct

SEQ ID NO: 190091 - DNA, 20 bp, Artificial Sequence
  Synthetic oligonucleotide; AAAAAC chr2 60525306 60525325 60525309 -
gttgcaagctgttttttttg

SEQ ID NO: 190092 - DNA, 20 bp, Artificial Sequence
  Synthetic oligonucleotide; TAAAAC chr2 60524751 60524770 60524754 -
tcctttggataatgatgatc

SEQ ID NO: 190093 - DNA, 20 bp, Artificial Sequence
  Synthetic oligonucleotide; AAAAAC chr2 60524497 60524516 60524500 -
ggtaacaaaataaaatctta

SEQ ID NO: 190094 - DNA, 20 bp, Artificial Sequence
  Synthetic oligonucleotide; AAAAAC chr2 60524477 60524496 60524480 -
aaaaacaagaaaaaagaaaa

SEQ ID NO: 190095 - DNA, 20 bp, Artificial Sequence
  Synthetic oligonucleotide; AAAAAC chr2 60524471 60524490 60524474 -
aagaaaaaagaaaaaaaaac

SEQ ID NO: 190096 - DNA, 20 bp, Artificial Sequence
  Synthetic oligonucleotide; AAAAAC chr2 60524465 60524484 60524468 -
aaagaaaaaaaaacaaaaac

SEQ ID NO: 190097 - DNA, 20 bp, Artificial Sequence
  Synthetic oligonucleotide; GAAAAC chr2 60523036 60523055 60523039 -
ttacccacagagtctacaga

SEQ ID NO: 190098 - DNA, 20 bp, Artificial Sequence
  Synthetic oligonucleotide; GAAAAC chr2 60522871 60522890 60522874 -
cctgcagaaccttgacctgt

SEQ ID NO: 190099 - DNA, 20 bp, Artificial Sequence
  Synthetic oligonucleotide; CAAAAC chr2 60522470 60522489 60522473 -
cctcactggaagggatcctc

SEQ ID NO: 190100 - DNA, 20 bp, Artificial Sequence
  Synthetic oligonucleotide; AAAAAC chr2 60522338 60522357 60522341 -
gcagttgtatttaaaagaaa

SEQ ID NO: 190101 - DNA, 20 bp, Artificial Sequence
  Synthetic oligonucleotide; GAAAAC chr2 60520866 60520885 60520869 -
agaaggggctaagcttgcac

SEQ ID NO: 190102 - DNA, 20 bp, Artificial Sequence
  Synthetic oligonucleotide; CAAAAC chr2 60520613 60520632 60520616 -
ctcatagtgttgagtcagag

SEQ ID NO: 190103 - DNA, 20 bp, Artificial Sequence
  Synthetic oligonucleotide; GAAAAC chr2 60520571 60520590 60520574 -
cacttatttaattttcctca

SEQ ID NO: 190104 - DNA, 20 bp, Artificial Sequence
  Synthetic oligonucleotide; CAAAAC chr2 60520292 60520311 60520295 -
aaatgtttcctcaaaataaa

SEQ ID NO: 190105 - DNA, 20 bp, Artificial Sequence
  Synthetic oligonucleotide; GAAAAC chr2 60519858 60519877 60519861 -
tggcaaatgacaatgcctat

SEQ ID NO: 190106 - DNA, 20 bp, Artificial Sequence
  Synthetic oligonucleotide; TAAAAC chr2 60518683 60518702 60518686 -
tctgatgatgagtaggctct

SEQ ID NO: 190107 - DNA, 20 bp, Artificial Sequence
  Synthetic oligonucleotide; TAAAAC chr2 60518412 60518431 60518415 -
ctgctctatcgcagacattt

SEQ ID NO: 190108 - DNA, 20 bp, Artificial Sequence
  Synthetic oligonucleotide; AAAAAC chr2 60518211 60518230 60518214 -
aggtctaggtttgatagata

SEQ ID NO: 190109 - DNA, 20 bp, Artificial Sequence
  Synthetic oligonucleotide; TAAAAC chr2 60517489 60517508 60517492 -
ctaacctggggagcccatgg

SEQ ID NO: 190110 - DNA, 20 bp, Artificial Sequence
  Synthetic oligonucleotide; CAAAAC chr2 60517475 60517494 60517478 -
ccatggtaaaacccaagcaa

SEQ ID NO: 190111 - DNA, 20 bp, Artificial Sequence
  Synthetic oligonucleotide; AAAAAC chr2 60516767 60516786 60516770 -
tatgtcctgcttgctttttt

SEQ ID NO: 190112 - DNA, 20 bp, Artificial Sequence
  Synthetic oligonucleotide; CAAAAC chr2 60516302 60516321 60516305 -
agtcttttttgagtttccag

SEQ ID NO: 190113 - DNA, 20 bp, Artificial Sequence
  Synthetic oligonucleotide; CAAAAC chr2 60516251 60516270 60516254 -
cattgtgtttaatagtacaa

SEQ ID NO: 190114 - DNA, 20 bp, Artificial Sequence
  Synthetic oligonucleotide; TAAAAC chr2 60512844 60512863 60512847 -
actttaggtgtgtattgtag

SEQ ID NO: 190115 - DNA, 20 bp, Artificial Sequence
  Synthetic oligonucleotide; TAAAAC chr2 60512214 60512233 60512217 -
gggctctaggtggcttcctt

SEQ ID NO: 190116 - DNA, 20 bp, Artificial Sequence
  Synthetic oligonucleotide; AAAAAC chr2 60510638 60510657 60510641 -
tgttgggcatagaaagcctt

SEQ ID NO: 190117 - DNA, 20 bp, Artificial Sequence
  Synthetic oligonucleotide; GAAAAC chr2 60510026 60510045 60510029 -
ttctggacatacttcgaagg

SEQ ID NO: 190118 - DNA, 20 bp, Artificial Sequence
  Synthetic oligonucleotide; CAAAAC chr2 60507536 60507555 60507539 -
cctcatttcttgagagactc

SEQ ID NO: 190119 - DNA, 20 bp, Artificial Sequence
  Synthetic oligonucleotide; GAAAAC chr2 60502709 60502728 60502712 -
gtttttctctgatgatgatt

SEQ ID NO: 190120 - DNA, 20 bp, Artificial Sequence
  Synthetic oligonucleotide; AAAAAC chr2 60498597 60498616 60498600 -
ctatttgctattaaaatttg

SEQ ID NO: 190121 - DNA, 20 bp, Artificial Sequence
  Synthetic oligonucleotide; GAAAAC chr2 60495950 60495969 60495953 -
aaaaaatagctaagaatagt

SEQ ID NO: 190122 - DNA, 20 bp, Artificial Sequence
  Synthetic oligonucleotide; GAAAAC chr2 60495603 60495622 60495606 -
aatgtctgcaccccaccctg

SEQ ID NO: 190123 - DNA, 20 bp, Artificial Sequence
  Synthetic oligonucleotide; CAAAAC chr2 60493367 60493386 60493370 -
gggctccctggactcaaact

SEQ ID NO: 190124 - DNA, 20 bp, Artificial Sequence
  Synthetic oligonucleotide; CAAAAC chr2 60492809 60492828 60492812 -
ttaataaagctaaagcgaaa

SEQ ID NO: 190125 - DNA, 20 bp, Artificial Sequence
  Synthetic oligonucleotide; CAAAAC chr2 60492804 60492823 60492807 -
aaagctaaagcgaaacaaaa

SEQ ID NO: 190126 - DNA, 20 bp, Artificial Sequence
  Synthetic oligonucleotide; GAAAAC chr2 60491835 60491854 60491838 -
ggatttgggttcttaacatg

SEQ ID NO: 190127 - DNA, 20 bp, Artificial Sequence
  Synthetic oligonucleotide; TAAAAC chr2 60491267 60491286 60491270 -
ctttttagtagtgctgcatt

SEQ ID NO: 190128 - DNA, 20 bp, Artificial Sequence
  Synthetic oligonucleotide; AAAAAC chr2 60488770 60488789 60488773 -
gaaactccacctcagaaaca

SEQ ID NO: 190129 - DNA, 20 bp, Artificial Sequence
  Synthetic oligonucleotide; CAAAAC chr2 60488646 60488665 60488649 -
gttattattttcatgttaag

SEQ ID NO: 190130 - DNA, 20 bp, Artificial Sequence
  Synthetic oligonucleotide; AAAAAC chr2 60488502 60488521 60488505 -
gtgtcagcaaaaaatgaaac

SEQ ID NO: 190131 - DNA, 20 bp, Artificial Sequence
  Synthetic oligonucleotide; TAAAAC chr2 60488073 60488092 60488076 -
tgtaagtgttactgtgtttt

SEQ ID NO: 190132 - DNA, 20 bp, Artificial Sequence
  Synthetic oligonucleotide; GAAAAC chr2 60487962 60487981 60487965 -
gggctccattctagagttgg

SEQ ID NO: 190133 - DNA, 20 bp, Artificial Sequence
  Synthetic oligonucleotide; GAAAAC chr2 60487410 60487429 60487413 -
ccaatttccatacagatgac

SEQ ID NO: 190134 - DNA, 20 bp, Artificial Sequence
  Synthetic oligonucleotide; AAAAAC chr2 60484662 60484681 60484665 -
aattcccccttctcttaaga

SEQ ID NO: 190135 - DNA, 20 bp, Artificial Sequence
  Synthetic oligonucleotide; TAAAAC chr2 60484497 60484516 60484500 -
aaagcaacccggtttatctg

SEQ ID NO: 190136 - DNA, 20 bp, Artificial Sequence
  Synthetic oligonucleotide; CAAAAC chr2 60483544 60483563 60483547 -
cctaacttaaatattacaat

SEQ ID NO: 190137 - DNA, 20 bp, Artificial Sequence
  Synthetic oligonucleotide; GAAAAC chr2 60483238 60483257 60483241 -
acgggatatatattagaggg

SEQ ID NO: 190138 - DNA, 20 bp, Artificial Sequence
  Synthetic oligonucleotide; AAAAAC chr2 60482206 60482225 60482209 -
gagaaaccacaacccgaaca

SEQ ID NO: 190139 - DNA, 20 bp, Artificial Sequence
  Synthetic oligonucleotide; AAAAAC chr2 60482198 60482217 60482201 -
acaacccgaacaaaaaactc

SEQ ID NO: 190140 - DNA, 20 bp, Artificial Sequence
  Synthetic oligonucleotide; TAAAAC chr2 60481730 60481749 60481733 -
ttgtggaaaaaaaatgccct

SEQ ID NO: 190141 - DNA, 20 bp, Artificial Sequence
  Synthetic oligonucleotide; AAAAAC chr2 60481655 60481674 60481658 -
gtagggggtggagcgtcaag

SEQ ID NO: 190142 - DNA, 20 bp, Artificial Sequence
  Synthetic oligonucleotide; AAAAAC chr2 60480951 60480970 60480954 -
ttaagcccttttagtggagc

SEQ ID NO: 190143 - DNA, 20 bp, Artificial Sequence
  Synthetic oligonucleotide; TAAAAC chr2 60480820 60480839 60480823 -
aggaaaatgtggaggattgc

SEQ ID NO: 190144 - DNA, 20 bp, Artificial Sequence
  Synthetic oligonucleotide; AAAAAC chr2 60479914 60479933 60479917 -
ttcctcctccccataaatca

SEQ ID NO: 190145 - DNA, 20 bp, Artificial Sequence
  Synthetic oligonucleotide; CAAAAC chr2 60479349 60479368 60479352 -
caagcagtcttagagagact

SEQ ID NO: 190146 - DNA, 20 bp, Artificial Sequence
  Synthetic oligonucleotide; AAAAAC chr2 60478974 60478993 60478977 -
ccagggaggagggaaaaaaa

SEQ ID NO: 190147 - DNA, 20 bp, Artificial Sequence
  Synthetic oligonucleotide; AAAAAC chr2 60478967 60478986 60478970 -
ggagggaaaaaaaaaaaaca

SEQ ID NO: 190148 - DNA, 20 bp, Artificial Sequence
  Synthetic oligonucleotide; CAAAAC chr2 60477668 60477687 60477671 -
gtttccacagtgcccacgaa

SEQ ID NO: 190149 - DNA, 20 bp, Artificial Sequence
  Synthetic oligonucleotide; TAAAAC chr2 60475417 60475436 60475420 -
gtttgtctgactcagaggaa

SEQ ID NO: 190150 - DNA, 20 bp, Artificial Sequence
  Synthetic oligonucleotide; GAAAAC chr2 60475347 60475366 60475350 -
agaaacaattgaggtggggg

SEQ ID NO: 190151 - DNA, 20 bp, Artificial Sequence
  Synthetic oligonucleotide; TAAAAC chr2 60473918 60473937 60473921 -
taaagaacatcaggatttgg

SEQ ID NO: 190152 - DNA, 20 bp, Artificial Sequence
  Synthetic oligonucleotide; AAAAAC chr2 60473246 60473265 60473249 -
tgtctcactgaaaaaaaaaa

SEQ ID NO: 190153 - DNA, 20 bp, Artificial Sequence
  Synthetic oligonucleotide; AAAAAC chr2 60473227 60473246 60473230 -
aaaaaacagggaaattatct

SEQ ID NO: 190154 - DNA, 20 bp, Artificial Sequence
  Synthetic oligonucleotide; AAAAAC chr2 60472715 60472734 60472718 -
agatgttcttgaggaaacca

SEQ ID NO: 190155 - DNA, 20 bp, Artificial Sequence
  Synthetic oligonucleotide; GAAAAC chr2 60472037 60472056 60472040 -
ggtgggtcctggacaggagg

SEQ ID NO: 190156 - DNA, 20 bp, Artificial Sequence
  Synthetic oligonucleotide; GAAAAC chr2 60470826 60470845 60470829 -
ctagggttttttacaactta

SEQ ID NO: 190157 - DNA, 20 bp, Artificial Sequence
  Synthetic oligonucleotide; AAAAAC chr2 60470820 60470839 60470823 -
ttttttacaacttagaaaac

SEQ ID NO: 190158 - DNA, 20 bp, Artificial Sequence
  Synthetic oligonucleotide; AAAAAC chr2 60470814 60470833 60470817 -
acaacttagaaaacaaaaac

SEQ ID NO: 190159 - DNA, 20 bp, Artificial Sequence
  Synthetic oligonucleotide; AAAAAC chr2 60470808 60470827 60470811 -
tagaaaacaaaaacaaaaac

SEQ ID NO: 190160 - DNA, 20 bp, Artificial Sequence
  Synthetic oligonucleotide; AAAAAC chr2 60470802 60470821 60470805 -
acaaaaacaaaaacaaaaac

SEQ ID NO: 190161 - DNA, 20 bp, Artificial Sequence
  Synthetic oligonucleotide; AAAAAC chr2 60470427 60470446 60470430 -
acttagtgaacggctgaggc

SEQ ID NO: 190162 - DNA, 20 bp, Artificial Sequence
  Synthetic oligonucleotide; GAAAAC chr2 60469948 60469967 60469951 -
ctcttaatattaagctaatg

SEQ ID NO: 190163 - DNA, 20 bp, Artificial Sequence
  Synthetic oligonucleotide; AAAAAC chr2 60469311 60469330 60469314 -
aagtgggactctgtcccata

SEQ ID NO: 190164 - DNA, 20 bp, Artificial Sequence
  Synthetic oligonucleotide; TAAAAC chr2 60469066 60469085 60469069 -
agaccacctctcccctttcc

SEQ ID NO: 190165 - DNA, 20 bp, Artificial Sequence
  Synthetic oligonucleotide; GAAAAC chr2 60469026 60469045 60469029 -
ttgtcaaaaagaccgaaatt

SEQ ID NO: 190166 - DNA, 20 bp, Artificial Sequence
  Synthetic oligonucleotide; CAAAAC chr2 60469021 60469040 60469024 -
aaaaagaccgaaattgaaaa

SEQ ID NO: 190167 - DNA, 20 bp, Artificial Sequence
  Synthetic oligonucleotide; GAAAAC chr2 60465806 60465825 60465809 -
taatcacccctggtagtaat

SEQ ID NO: 190168 - DNA, 20 bp, Artificial Sequence
  Synthetic oligonucleotide; CAAAAC chr2 60465406 60465425 60465409 -
gtcagtttattgctctaaat

SEQ ID NO: 190169 - DNA, 20 bp, Artificial Sequence
  Synthetic oligonucleotide; GAAAAC chr2 60464925 60464944 60464928 -
gaatactaaaatgcgatagt

SEQ ID NO: 190170 - DNA, 20 bp, Artificial Sequence
  Synthetic oligonucleotide; CAAAAC chr2 60463399 60463418 60463402 -
ggttcacgttgttagcctct

SEQ ID NO: 190171 - DNA, 20 bp, Artificial Sequence
  Synthetic oligonucleotide; GAAAAC chr2 60460546 60460565 60460549 -
agcaagctcaccaggcacat

SEQ ID NO: 190172 - DNA, 20 bp, Artificial Sequence
  Synthetic oligonucleotide; AAAAAC chr2 60460417 60460436 60460420 -
cgagtgttgaataatgatat

SEQ ID NO: 190173 - DNA, 20 bp, Artificial Sequence
  Synthetic oligonucleotide; AAAAAC chr2 60459868 60459887 60459871 -
tattttataacgtgaggagg

SEQ ID NO: 190174 - DNA, 20 bp, Artificial Sequence
  Synthetic oligonucleotide; AAAAAC chr2 60459725 60459744 60459728 -
ttgaattgacaaattaacag

SEQ ID NO: 190175 - DNA, 20 bp, Artificial Sequence
  Synthetic oligonucleotide; TAAAAC chr2 60459666 60459685 60459669 -
tatgagtgccttggatctat

SEQ ID NO: 190176 - DNA, 20 bp, Artificial Sequence
  Synthetic oligonucleotide; CAAAAC chr2 60459478 60459497 60459481 -
ctttagtttaattttataaa

SEQ ID NO: 190177 - DNA, 20 bp, Artificial Sequence
  Synthetic oligonucleotide; TAAAAC chr2 60459098 60459117 60459101 -
acgtggtactatttgccatt

SEQ ID NO: 190178 - DNA, 20 bp, Artificial Sequence
  Synthetic oligonucleotide; AAAAAC chr2 60458622 60458641 60458625 -
ctcattgaggagcatttttt

SEQ ID NO: 190179 - DNA, 20 bp, Artificial Sequence
  Synthetic oligonucleotide; AAAAAC chr2 60458607 60458626 60458610 -
tttttaaaaactaaaaaaaa

SEQ ID NO: 190180 - DNA, 20 bp, Artificial Sequence
  Synthetic oligonucleotide; CAAAAC chr2 60458465 60458484 60458468 -
agtgcaaggatttttttgta

SEQ ID NO: 190181 - DNA, 20 bp, Artificial Sequence
  Synthetic oligonucleotide; AAAAAC chr2 60458423 60458442 60458426 -
gttaagaaaaatttttttta

SEQ ID NO: 190182 - DNA, 20 bp, Artificial Sequence
  Synthetic oligonucleotide; AAAAAC chr2 60458280 60458299 60458283 -
ctcttcaggttgtaaaaaaa

SEQ ID NO: 190183 - DNA, 20 bp, Artificial Sequence
  Synthetic oligonucleotide; AAAAAC chr2 60457676 60457695 60457679 -
aaaaaaaaggaaaaaaaaaa

SEQ ID NO: 190184 - DNA, 20 bp, Artificial Sequence
  Synthetic oligonucleotide; AAAAAC chr2 60457643 60457662 60457646 -
ttgcagtttttttcattgcc

SEQ ID NO: 190185 - DNA, 20 bp, Artificial Sequence
  Synthetic oligonucleotide; CAAAAC chr2 60457424 60457443 60457427 -
tattgcttatgtgccctgtt

SEQ ID NO: 190186 - DNA, 20 bp, Artificial Sequence
  Synthetic oligonucleotide; AAAAAC chr2 60457293 60457312 60457296 -
tctttgttaagttctattgg

SEQ ID NO: 190187 - DNA, 20 bp, Artificial Sequence
  Synthetic oligonucleotide; AAAAAC chr2 60456939 60456958 60456942 -
ggtgttttcagtctgatgtt

SEQ ID NO: 190188 - DNA, 20 bp, Artificial Sequence
  Synthetic oligonucleotide; AAAAAC chr2 60456892 60456911 60456895 -
atccattcaaacataagtga

SEQ ID NO: 190189 - DNA, 20 bp, Artificial Sequence
  Synthetic oligonucleotide; AAAAAC chr2 60456231 60456250 60456234 -
acattgttcttatttttgta

SEQ ID NO: 190190 - DNA, 20 bp, Artificial Sequence
  Synthetic oligonucleotide; CAAAAC chr2 60456225 60456244 60456228 -
ttcttatttttgtaaaaaac

SEQ ID NO: 190191 - DNA, 20 bp, Artificial Sequence
  Synthetic oligonucleotide; CAAAAC chr2 60455891 60455910 60455894 -
tgttttggattaggtttctc

SEQ ID NO: 190192 - DNA, 20 bp, Artificial Sequence
  Synthetic oligonucleotide; TAAAAC chr2 60455788 60455807 60455791 -
tccaccctattaaatgtcca

SEQ ID NO: 190193 - DNA, 20 bp, Artificial Sequence
  Synthetic oligonucleotide; AAAAAC chr2 60453869 60453888 60453872 -
tttcctttctgtaaagtggc

SEQ ID NO: 190194 - DNA, 20 bp, Artificial Sequence
  Synthetic oligonucleotide; GAAAAC chr2 60453268 60453287 60453271 -
cccccttccaaaaaagaaaa

SEQ ID NO: 190195 - DNA, 20 bp, Artificial Sequence
  Synthetic oligonucleotide; AAAAAC chr2 60452382 60452401 60452385 -
tatattttttaataaaaagt

SEQ ID NO: 190196 - DNA, 20 bp, Artificial Sequence
  Synthetic oligonucleotide; AAAAAC chr2 60452374 60452393 60452377 -
ttaataaaaagtaaaaacaa

SEQ ID NO: 190197 - DNA, 20 bp, Artificial Sequence
  Synthetic oligonucleotide; CAAAAC chr2 60451958 60451977 60451961 -
tttcaaggagaatcaaaatg

SEQ ID NO: 190198 - DNA, 20 bp, Artificial Sequence
  Synthetic oligonucleotide; TAAAAC chr2 60451617 60451636 60451620 -
ttaatgcagacaaacaaaca

SEQ ID NO: 190199 - DNA, 20 bp, Artificial Sequence
  Synthetic oligonucleotide; CAAAAC chr2 60450283 60450302 60450286 -
actgtggagaagaaccccct

SEQ ID NO: 190200 - DNA, 20 bp, Artificial Sequence
  Synthetic oligonucleotide; AAAAAC chr2 60449111 60449130 60449114 -
gtttgagaaataattgtttc

SEQ ID NO: 190201 - DNA, 20 bp, Artificial Sequence
  Synthetic oligonucleotide; GAAAAC chr2 60449090 60449109 60449093 -
aaaaccagtgatcatttaaa

SEQ ID NO: 190202 - DNA, 20 bp, Artificial Sequence
  Synthetic oligonucleotide; TAAAAC chr2 60448972 60448991 60448975 -
gtttccaagagcattcagat

SEQ ID NO: 190203 - DNA, 20 bp, Artificial Sequence
  Synthetic oligonucleotide; AAAAAC chr2 60448195 60448214 60448198 -
acctaagatcacagtgtgaa

SEQ ID NO: 190204 - DNA, 20 bp, Artificial Sequence
  Synthetic oligonucleotide; GAGTGATT chr2 60448239 60448258 60448255 +
attattctgatctctaaaat

SEQ ID NO: 190205 - DNA, 20 bp, Artificial Sequence
  Synthetic oligonucleotide; CTAGGATT chr2 60448248 60448267 60448264 +
atctctaaaatgagtgatta

SEQ ID NO: 190206 - DNA, 20 bp, Artificial Sequence
  Synthetic oligonucleotide; AATTGATT chr2 60448309 60448328 60448325 +
atttatagaatcacaaggaa

SEQ ID NO: 190207 - DNA, 20 bp, Artificial Sequence
  Synthetic oligonucleotide; TAAAGCTT chr2 60448342 60448361 60448358 +
atgtatataaaagtattcta

SEQ ID NO: 190208 - DNA, 20 bp, Artificial Sequence
  Synthetic oligonucleotide; GACTGCTT chr2 60448453 60448472 60448469 +
aagatagaaaaacagacaat

SEQ ID NO: 190209 - DNA, 20 bp, Artificial Sequence
  Synthetic oligonucleotide; TCTGGATT chr2 60448460 60448479 60448476 +
aaaaacagacaatgactgct

SEQ ID NO: 190210 - DNA, 20 bp, Artificial Sequence
  Synthetic oligonucleotide; TATTGTTT chr2 60448566 60448585 60448582 +
gtcagaggaaagaaatataa

SEQ ID NO: 190211 - DNA, 20 bp, Artificial Sequence
  Synthetic oligonucleotide; GTGTGCTT chr2 60448617 60448636 60448633 +
tgaactcttgaagaaggaag

SEQ ID NO: 190212 - DNA, 20 bp, Artificial Sequence
  Synthetic oligonucleotide; ATCTGCTT chr2 60448672 60448691 60448688 +
ccagactcaaaattcctcaa

SEQ ID NO: 190213 - DNA, 20 bp, Artificial Sequence
  Synthetic oligonucleotide; CACTGATT chr2 60448788 60448807 60448804 +
cctactattacttccgggga

SEQ ID NO: 190214 - DNA, 20 bp, Artificial Sequence
  Synthetic oligonucleotide; AAGGGCTT chr2 60448937 60448956 60448953 +
aagatattcctgaccacttg

SEQ ID NO: 190215 - DNA, 20 bp, Artificial Sequence
  Synthetic oligonucleotide; CTTGGTTT chr2 60448942 60448961 60448958 +
attcctgaccacttgaaggg

SEQ ID NO: 190216 - DNA, 20 bp, Artificial Sequence
  Synthetic oligonucleotide; CAAGGTTT chr2 60449003 60449022 60449019 +
gtgcccagaaaatatgctgc

SEQ ID NO: 190217 - DNA, 20 bp, Artificial Sequence
  Synthetic oligonucleotide; AGCAGATT chr2 60449031 60449050 60449047 +
ggggcactcagttagacctc

SEQ ID NO: 190218 - DNA, 20 bp, Artificial Sequence
  Synthetic oligonucleotide; CCAAGATT chr2 60449039 60449058 60449055 +
cagttagacctcagcagatt

SEQ ID NO: 190219 - DNA, 20 bp, Artificial Sequence
  Synthetic oligonucleotide; AAGAGTTT chr2 60449060 60449079 60449076 +
caagattgcactccttgcct

SEQ ID NO: 190220 - DNA, 20 bp, Artificial Sequence
  Synthetic oligonucleotide; ACTGGTTT chr2 60449081 60449100 60449097 +
agagttttctttaaatgatc

SEQ ID NO: 190221 - DNA, 20 bp, Artificial Sequence
  Synthetic oligonucleotide; AGGGGCTT chr2 60449147 60449166 60449163 +
tgctggatgctgggtgctgc

SEQ ID NO: 190222 - DNA, 20 bp, Artificial Sequence
  Synthetic oligonucleotide; GGTGGCTT chr2 60449232 60449251 60449248 +
gtaataatctgtccgggcgc

SEQ ID NO: 190223 - DNA, 20 bp, Artificial Sequence
  Synthetic oligonucleotide; AAAGGCTT chr2 60449562 60449581 60449578 +
aataatctgaacagcccaca

SEQ ID NO: 190224 - DNA, 20 bp, Artificial Sequence
  Synthetic oligonucleotide; GGCAGATT chr2 60449718 60449737 60449734 +
aggacacagtgagaacccct

SEQ ID NO: 190225 - DNA, 20 bp, Artificial Sequence
  Synthetic oligonucleotide; CCCTGCTT chr2 60449738 60449757 60449754 +
ggcagatttgtgagcctctt

SEQ ID NO: 190226 - DNA, 20 bp, Artificial Sequence
  Synthetic oligonucleotide; TGGGGTTT chr2 60449818 60449837 60449834 +
cccaaattgtcaatcttgta

SEQ ID NO: 190227 - DNA, 20 bp, Artificial Sequence
  Synthetic oligonucleotide; GCGAGATT chr2 60450111 60450130 60450127 +
actccagcctgggtgacaga

SEQ ID NO: 190228 - DNA, 20 bp, Artificial Sequence
  Synthetic oligonucleotide; TACCGTTT chr2 60450169 60450188 60450185 +
aatggctagccctaacacaa

SEQ ID NO: 190229 - DNA, 20 bp, Artificial Sequence
  Synthetic oligonucleotide; TTCTGTTT chr2 60450249 60450268 60450265 +
gggaaaagacagtctttttg

SEQ ID NO: 190230 - DNA, 20 bp, Artificial Sequence
  Synthetic oligonucleotide; GTTTGTTT chr2 60450253 60450272 60450269 +
aaagacagtctttttgttct

SEQ ID NO: 190231 - DNA, 20 bp, Artificial Sequence
  Synthetic oligonucleotide; CCAGGATT chr2 60450480 60450499 60450496 +
ggctgaacttgtctcaagac

SEQ ID NO: 190232 - DNA, 20 bp, Artificial Sequence
  Synthetic oligonucleotide; TGTTGTTT chr2 60450487 60450506 60450503 +
cttgtctcaagacccaggat

SEQ ID NO: 190233 - DNA, 20 bp, Artificial Sequence
  Synthetic oligonucleotide; TTATGTTT chr2 60450595 60450614 60450611 +
tcacagaaaccctaatggtc

SEQ ID NO: 190234 - DNA, 20 bp, Artificial Sequence
  Synthetic oligonucleotide; GAGGGTTT chr2 60450635 60450654 60450651 +
ggcagagcatggggcaggga

SEQ ID NO: 190235 - DNA, 20 bp, Artificial Sequence
  Synthetic oligonucleotide; CAGAGTTT chr2 60450937 60450956 60450953 +
actccctttgatcagttaaa

SEQ ID NO: 190236 - DNA, 20 bp, Artificial Sequence
  Synthetic oligonucleotide; CCTGGCTT chr2 60450978 60450997 60450994 +
ctggacaagaaaccagaaaa

SEQ ID NO: 190237 - DNA, 20 bp, Artificial Sequence
  Synthetic oligonucleotide; CTCTGCTT chr2 60450986 60451005 60451002 +
gaaaccagaaaacctggctt

SEQ ID NO: 190238 - DNA, 20 bp, Artificial Sequence
  Synthetic oligonucleotide; GTAGGATT chr2 60451249 60451268 60451265 +
tctagccagaaggtggatag

SEQ ID NO: 190239 - DNA, 20 bp, Artificial Sequence
  Synthetic oligonucleotide; TGTTGTTT chr2 60451345 60451364 60451361 +
aaacctattttaatttgcta

SEQ ID NO: 190240 - DNA, 20 bp, Artificial Sequence
  Synthetic oligonucleotide; ACCTGTTT chr2 60451442 60451461 60451458 +
ggccagaaagaatttttacc

SEQ ID NO: 190241 - DNA, 20 bp, Artificial Sequence
  Synthetic oligonucleotide; CTGTGATT chr2 60451498 60451517 60451514 +
ttctaaggaatagagcattg

SEQ ID NO: 190242 - DNA, 20 bp, Artificial Sequence
  Synthetic oligonucleotide; AGAAGTTT chr2 60451587 60451606 60451603 +
tttcctgatgtaagtactaa

SEQ ID NO: 190243 - DNA, 20 bp, Artificial Sequence
  Synthetic oligonucleotide; TTATGTTT chr2 60451594 60451613 60451610 +
atgtaagtactaaagaagtt

SEQ ID NO: 190244 - DNA, 20 bp, Artificial Sequence
  Synthetic oligonucleotide; GTTTGTTT chr2 60451598 60451617 60451614 +
aagtactaaagaagttttat

SEQ ID NO: 190245 - DNA, 20 bp, Artificial Sequence
  Synthetic oligonucleotide; GAAGGTTT chr2 60451629 60451648 60451645 +
tgcattaagatatatttcct

SEQ ID NO: 190246 - DNA, 20 bp, Artificial Sequence
  Synthetic oligonucleotide; TTAGGATT chr2 60451691 60451710 60451707 +
actgacatttatcaccttct

SEQ ID NO: 190247 - DNA, 20 bp, Artificial Sequence
  Synthetic oligonucleotide; ACAGGATT chr2 60451790 60451809 60451806 +
caaaagcatatatttgaaaa

SEQ ID NO: 190248 - DNA, 20 bp, Artificial Sequence
  Synthetic oligonucleotide; CTATGATT chr2 60451915 60451934 60451931 +
ctacattaattatgatattg

SEQ ID NO: 190249 - DNA, 20 bp, Artificial Sequence
  Synthetic oligonucleotide; CCAAGTTT chr2 60451928 60451947 60451944 +
gatattgctatgatttattc

SEQ ID NO: 190250 - DNA, 20 bp, Artificial Sequence
  Synthetic oligonucleotide; TTTTGATT chr2 60451940 60451959 60451956 +
atttattcccaagttttgca

SEQ ID NO: 190251 - DNA, 20 bp, Artificial Sequence
  Synthetic oligonucleotide; GCTGGTTT chr2 60452257 60452276 60452273 +
caatacaggtaattaggttg

SEQ ID NO: 190252 - DNA, 20 bp, Artificial Sequence
  Synthetic oligonucleotide; GACTGATT chr2 60452320 60452339 60452336 +
tccacgggccctctctatgg

SEQ ID NO: 190253 - DNA, 20 bp, Artificial Sequence
  Synthetic oligonucleotide; GTCTGTTT chr2 60452344 60452363 60452360 +
gattcactgttccaatgtgg

SEQ ID NO: 190254 - DNA, 20 bp, Artificial Sequence
  Synthetic oligonucleotide; TTTTGTTT chr2 60452352 60452371 60452368 +
gttccaatgtgggtctgttt

SEQ ID NO: 190255 - DNA, 20 bp, Artificial Sequence
  Synthetic oligonucleotide; AACGGCTT chr2 60452440 60452459 60452456 +
gcaggactctgtcttcgcac

SEQ ID NO: 190256 - DNA, 20 bp, Artificial Sequence
  Synthetic oligonucleotide; GGGGGCTT chr2 60452538 60452557 60452554 +
cacgcgtccaccccacccct

SEQ ID NO: 190257 - DNA, 20 bp, Artificial Sequence
  Synthetic oligonucleotide; TCGAGCTT chr2 60452572 60452591 60452588 +
ttctcagaacttaagggctc

SEQ ID NO: 190258 - DNA, 20 bp, Artificial Sequence
  Synthetic oligonucleotide; CAATGATT chr2 60452705 60452724 60452721 +
agtacaggtgtgacttggcc

SEQ ID NO: 190259 - DNA, 20 bp, Artificial Sequence
  Synthetic oligonucleotide; ACTAGCTT chr2 60452725 60452744 60452741 +
caatgattttctgttctcta

SEQ ID NO: 190260 - DNA, 20 bp, Artificial Sequence
  Synthetic oligonucleotide; GCATGATT chr2 60452784 60452803 60452800 +
tcgagccactggcatcttaa

SEQ ID NO: 190261 - DNA, 20 bp, Artificial Sequence
  Synthetic oligonucleotide; CAATGATT chr2 60453136 60453155 60453152 +
aagttcaacgtcaaagcagc

SEQ ID NO: 190262 - DNA, 20 bp, Artificial Sequence
  Synthetic oligonucleotide; TGTAGTTT chr2 60453220 60453239 60453236 +
aaattgcaccaaaaactgcc

SEQ ID NO: 190263 - DNA, 20 bp, Artificial Sequence
  Synthetic oligonucleotide; TGCAGTTT chr2 60453238 60453257 60453254 +
cctgtagtttctttcaaaca

SEQ ID NO: 190264 - DNA, 20 bp, Artificial Sequence
  Synthetic oligonucleotide; ATGGGTTT chr2 60453739 60453758 60453755 +
tttaaaagcacagcccccct

SEQ ID NO: 190265 - DNA, 20 bp, Artificial Sequence
  Synthetic oligonucleotide; TCCCGCTT chr2 60453753 60453772 60453769 +
ccccctatgggtttaggggc

SEQ ID NO: 190266 - DNA, 20 bp, Artificial Sequence
  Synthetic oligonucleotide; AATGGCTT chr2 60453778 60453797 60453794 +
ctttagaggatacttgggga

SEQ ID NO: 190267 - DNA, 20 bp, Artificial Sequence
  Synthetic oligonucleotide; AATAGTTT chr2 60453839 60453858 60453855 +
tgatacacgtgctcccttga

SEQ ID NO: 190268 - DNA, 20 bp, Artificial Sequence
  Synthetic oligonucleotide; CCAAGTTT chr2 60453903 60453922 60453919 +
aaccatcgagctgtgttcag

SEQ ID NO: 190269 - DNA, 20 bp, Artificial Sequence
  Synthetic oligonucleotide; ACTGGATT chr2 60453939 60453958 60453955 +
aagtacaatgacccgtgtga

SEQ ID NO: 190270 - DNA, 20 bp, Artificial Sequence
  Synthetic oligonucleotide; GTTCGTTT chr2 60454254 60454273 60454270 +
gtccatttctctaacaatgg

SEQ ID NO: 190271 - DNA, 20 bp, Artificial Sequence
  Synthetic oligonucleotide; CAGGGCTT chr2 60454282 60454301 60454298 +
attttctattgggaaatatg

SEQ ID NO: 190272 - DNA, 20 bp, Artificial Sequence
  Synthetic oligonucleotide; AGAGGCTT chr2 60454583 60454602 60454599 +
tgtgtgtacggagggggaaa

SEQ ID NO: 190273 - DNA, 20 bp, Artificial Sequence
  Synthetic oligonucleotide; TGAGGCTT chr2 60454664 60454683 60454680 +
aagcaggagaggatggggcc

SEQ ID NO: 190274 - DNA, 20 bp, Artificial Sequence
  Synthetic oligonucleotide; TTATGATT chr2 60454822 60454841 60454838 +
tcaagttctcacttctagca

SEQ ID NO: 190275 - DNA, 20 bp, Artificial Sequence
  Synthetic oligonucleotide; AAGAGTTT chr2 60455073 60455092 60455089 +
ggaggtaatataggcactgg

SEQ ID NO: 190276 - DNA, 20 bp, Artificial Sequence
  Synthetic oligonucleotide; TCTGGTTT chr2 60455080 60455099 60455096 +
atataggcactggaagagtt

SEQ ID NO: 190277 - DNA, 20 bp, Artificial Sequence
  Synthetic oligonucleotide; TCCTGTTT chr2 60455118 60455137 60455134 +
agaaatagaatttgcggtat

SEQ ID NO: 190278 - DNA, 20 bp, Artificial Sequence
  Synthetic oligonucleotide; TGAAGATT chr2 60455143 60455162 60455159 +
tttattaagttgttctcaaa

SEQ ID NO: 190279 - DNA, 20 bp, Artificial Sequence
  Synthetic oligonucleotide; TGAGGATT chr2 60455230 60455249 60455246 +
gcctgttacaaaaacttact

SEQ ID NO: 190280 - DNA, 20 bp, Artificial Sequence
  Synthetic oligonucleotide; TTAAGATT chr2 60455330 60455349 60455346 +
aatgtgcatgttattttata

SEQ ID NO: 190281 - DNA, 20 bp, Artificial Sequence
  Synthetic oligonucleotide; TCATGTTT chr2 60455400 60455419 60455416 +
atatcatgttggctaggttc

SEQ ID NO: 190282 - DNA, 20 bp, Artificial Sequence
  Synthetic oligonucleotide; ATCAGCTT chr2 60455417 60455436 60455433 +
ttctcatgtttctattgttc

SEQ ID NO: 190283 - DNA, 20 bp, Artificial Sequence
  Synthetic oligonucleotide; CTGTGATT chr2 60455537 60455556 60455553 +
ccatgtaaatcaaacataat

SEQ ID NO: 190284 - DNA, 20 bp, Artificial Sequence
  Synthetic oligonucleotide; AGATGTTT chr2 60455552 60455571 60455568 +
ataatctgtgatttatcacc

SEQ ID NO: 190285 - DNA, 20 bp, Artificial Sequence
  Synthetic oligonucleotide; ATTTGATT chr2 60455579 60455598 60455595 +
tgcactcctccccattcccc

SEQ ID NO: 190286 - DNA, 20 bp, Artificial Sequence
  Synthetic oligonucleotide; AGAGGTTT chr2 60455758 60455777 60455774 +
aaagagtaatagggacacac

SEQ ID NO: 190287 - DNA, 20 bp, Artificial Sequence
  Synthetic oligonucleotide; TTTGGATT chr2 60455855 60455874 60455871 +
ctatctgtcttgagcagcat

SEQ ID NO: 190288 - DNA, 20 bp, Artificial Sequence
  Synthetic oligonucleotide; TTCAGTTT chr2 60455861 60455880 60455877 +
gtcttgagcagcattttgga

SEQ ID NO: 190289 - DNA, 20 bp, Artificial Sequence
  Synthetic oligonucleotide; AGTGGATT chr2 60455997 60456016 60456013 +
attctccaacatcctttctc

SEQ ID NO: 190290 - DNA, 20 bp, Artificial Sequence
  Synthetic oligonucleotide; ACTGGCTT chr2 60456036 60456055 60456052 +
actctctccttcccacccaa

SEQ ID NO: 190291 - DNA, 20 bp, Artificial Sequence
  Synthetic oligonucleotide; AACGGCTT chr2 60456189 60456208 60456205 +
ctaccacaagaagacaacag

SEQ ID NO: 190292 - DNA, 20 bp, Artificial Sequence
  Synthetic oligonucleotide; TTTTGTTT chr2 60456195 60456214 60456211 +
caagaagacaacagaacggc

SEQ ID NO: 190293 - DNA, 20 bp, Artificial Sequence
  Synthetic oligonucleotide; TTTGGTTT chr2 60456201 60456220 60456217 +
gacaacagaacggcttttgt

SEQ ID NO: 190294 - DNA, 20 bp, Artificial Sequence
  Synthetic oligonucleotide; ATGTGTTT chr2 60456279 60456298 60456295 +
ggacacgatatcacagaggt

SEQ ID NO: 190295 - DNA, 20 bp, Artificial Sequence
  Synthetic oligonucleotide; CACAGATT chr2 60456335 60456354 60456351 +
agtatttgtaaaagtgacaa

SEQ ID NO: 190296 - DNA, 20 bp, Artificial Sequence
  Synthetic oligonucleotide; TAAGGATT chr2 60456345 60456364 60456361 +
aaagtgacaacacagatttc

SEQ ID NO: 190297 - DNA, 20 bp, Artificial Sequence
  Synthetic oligonucleotide; GGCTGATT chr2 60456523 60456542 60456539 +
atgcatctcaggaaatcagt

SEQ ID NO: 190298 - DNA, 20 bp, Artificial Sequence
  Synthetic oligonucleotide; CAAAGATT chr2 60456532 60456551 60456548 +
aggaaatcagtggctgattc

SEQ ID NO: 190299 - DNA, 20 bp, Artificial Sequence
  Synthetic oligonucleotide; GGCTGCTT chr2 60456566 60456585 60456582 +
tgtctggctacacccctagt

SEQ ID NO: 190300 - DNA, 20 bp, Artificial Sequence
  Synthetic oligonucleotide; CTTTGTTT chr2 60456650 60456669 60456666 +
aacaaaacaaaacctgatgc

SEQ ID NO: 190301 - DNA, 20 bp, Artificial Sequence
  Synthetic oligonucleotide; TCCAGATT chr2 60456657 60456676 60456673 +
caaaacctgatgcctttgtt

SEQ ID NO: 190302 - DNA, 20 bp, Artificial Sequence
  Synthetic oligonucleotide; TTTAGATT chr2 60456665 60456684 60456681 +
gatgcctttgtttccagatt

SEQ ID NO: 190303 - DNA, 20 bp, Artificial Sequence
  Synthetic oligonucleotide; AGCTGATT chr2 60456726 60456745 60456742 +
ctcttacatggaaaccaaag

SEQ ID NO: 190304 - DNA, 20 bp, Artificial Sequence
  Synthetic oligonucleotide; AAAAGTTT chr2 60456839 60456858 60456855 +
gcaaaaaatttaaaggaaat

SEQ ID NO: 190305 - DNA, 20 bp, Artificial Sequence
  Synthetic oligonucleotide; GCAAGTTT chr2 60456862 60456881 60456878 +
agtttaagatgctattacca

SEQ ID NO: 190306 - DNA, 20 bp, Artificial Sequence
  Synthetic oligonucleotide; TTATGTTT chr2 60456876 60456895 60456892 +
ttaccagcaagttttttcac

SEQ ID NO: 190307 - DNA, 20 bp, Artificial Sequence
  Synthetic oligonucleotide; AATGGATT chr2 60456885 60456904 60456901 +
agttttttcacttatgtttg

SEQ ID NO: 190308 - DNA, 20 bp, Artificial Sequence
  Synthetic oligonucleotide; GTAAGTTT chr2 60456909 60456928 60456925 +
gatttctgctaagagatgga

SEQ ID NO: 190309 - DNA, 20 bp, Artificial Sequence
  Synthetic oligonucleotide; CAGGGTTT chr2 60456988 60457007 60457004 +
gaaagccttaaaactatgtc

SEQ ID NO: 190310 - DNA, 20 bp, Artificial Sequence
  Synthetic oligonucleotide; AGAAGCTT chr2 60457160 60457179 60457176 +
gtgtgtcaaatgaggacaca

SEQ ID NO: 190311 - DNA, 20 bp, Artificial Sequence
  Synthetic oligonucleotide; AGTGGTTT chr2 60457263 60457282 60457279 +
actgccaaaaaaacacagac

SEQ ID NO: 190312 - DNA, 20 bp, Artificial Sequence
  Synthetic oligonucleotide; CTCTGTTT chr2 60457394 60457413 60457410 +
taaaagatcaaattaagtgc

SEQ ID NO: 190313 - DNA, 20 bp, Artificial Sequence
  Synthetic oligonucleotide; AACAGCTT chr2 60457471 60457490 60457487 +
taaaatttcaagttacgaca

SEQ ID NO: 190314 - DNA, 20 bp, Artificial Sequence
  Synthetic oligonucleotide; GCGGGCTT chr2 60457550 60457569 60457566 +
acaaaaaagtattgactaaa

SEQ ID NO: 190315 - DNA, 20 bp, Artificial Sequence
  Synthetic oligonucleotide; ATATGCTT chr2 60457566 60457585 60457582 +
taaagcgggctttctcttta

SEQ ID NO: 190316 - DNA, 20 bp, Artificial Sequence
  Synthetic oligonucleotide; TTTAGTTT chr2 60457613 60457632 60457629 +
aatctaaatataaagcacca

SEQ ID NO: 190317 - DNA, 20 bp, Artificial Sequence
  Synthetic oligonucleotide; ATTGGTTT chr2 60457646 60457665 60457662 +
aatgaaaaaaactgcaaaac

SEQ ID NO: 190318 - DNA, 20 bp, Artificial Sequence
  Synthetic oligonucleotide; ATTAGCTT chr2 60457772 60457791 60457788 +
ctacataacaaaccaacgtt

SEQ ID NO: 190319 - DNA, 20 bp, Artificial Sequence
  Synthetic oligonucleotide; TATGGCTT chr2 60457891 60457910 60457907 +
gctcccccaaaccgccatta

SEQ ID NO: 190320 - DNA, 20 bp, Artificial Sequence
  Synthetic oligonucleotide; TTTTGTTT chr2 60457920 60457939 60457936 +
tcatctgtaatgtcacactt

SEQ ID NO: 190321 - DNA, 20 bp, Artificial Sequence
  Synthetic oligonucleotide; ACAAGCTT chr2 60458081 60458100 60458097 +
aacaagcaacagttaaaaat

SEQ ID NO: 190322 - DNA, 20 bp, Artificial Sequence
  Synthetic oligonucleotide; GTATGTTT chr2 60458250 60458269 60458266 +
atcttaaacctttccccaat

SEQ ID NO: 190323 - DNA, 20 bp, Artificial Sequence
  Synthetic oligonucleotide; AAGTGTTT chr2 60458393 60458412 60458409 +
gttcccccctaaacataatg

SEQ ID NO: 190324 - DNA, 20 bp, Artificial Sequence
  Synthetic oligonucleotide; AAAAGTTT chr2 60458435 60458454 60458451 +
ttcttaacatttatatttaa

SEQ ID NO: 190325 - DNA, 20 bp, Artificial Sequence
  Synthetic oligonucleotide; TTCTGTTT chr2 60458505 60458524 60458521 +
tcatttctatgttaagtgta

SEQ ID NO: 190326 - DNA, 20 bp, Artificial Sequence
  Synthetic oligonucleotide; CAGCGCTT chr2 60458520 60458539 60458536 +
gtgtattctgtttccattca

SEQ ID NO: 190327 - DNA, 20 bp, Artificial Sequence
  Synthetic oligonucleotide; CAAAGTTT chr2 60458577 60458596 60458593 +
atagtcaagtaaatggctgg

SEQ ID NO: 190328 - DNA, 20 bp, Artificial Sequence
  Synthetic oligonucleotide; TTTAGTTT chr2 60458592 60458611 60458608 +
gctggcaaagtttttttttt

SEQ ID NO: 190329 - DNA, 20 bp, Artificial Sequence
  Synthetic oligonucleotide; ATGAGATT chr2 60458617 60458636 60458633 +
tttttaaaaaatgctcctca

SEQ ID NO: 190330 - DNA, 20 bp, Artificial Sequence
  Synthetic oligonucleotide; GCAGGTTT chr2 60458721 60458740 60458737 +
cacttaattgtcctatctga

SEQ ID NO: 190331 - DNA, 20 bp, Artificial Sequence
  Synthetic oligonucleotide; CTCTGATT chr2 60458751 60458770 60458767 +
tttatactcaacctctgtat

SEQ ID NO: 190332 - DNA, 20 bp, Artificial Sequence
  Synthetic oligonucleotide; GCTAGCTT chr2 60458822 60458841 60458838 +
gaacaccaactggggcagat

SEQ ID NO: 190333 - DNA, 20 bp, Artificial Sequence
  Synthetic oligonucleotide; ATTAGCTT chr2 60459050 60459069 60459066 +
ttaatcatcattgtatcaat

SEQ ID NO: 190334 - DNA, 20 bp, Artificial Sequence
  Synthetic oligonucleotide; TCTAGTTT chr2 60459068 60459087 60459084 +
atattagcttatatacctgt

SEQ ID NO: 190335 - DNA, 20 bp, Artificial Sequence
  Synthetic oligonucleotide; TAAAGTTT chr2 60459186 60459205 60459202 +
caatatggtatacaaggtct

SEQ ID NO: 190336 - DNA, 20 bp, Artificial Sequence
  Synthetic oligonucleotide; ATTTGATT chr2 60459197 60459216 60459213 +
acaaggtcttaaagtttatc

SEQ ID NO: 190337 - DNA, 20 bp, Artificial Sequence
  Synthetic oligonucleotide; CAGGGCTT chr2 60459327 60459346 60459343 +
tagtgtatttaattgcgttc

SEQ ID NO: 190338 - DNA, 20 bp, Artificial Sequence
  Synthetic oligonucleotide; CATTGTTT chr2 60459360 60459379 60459376 +
cattacacattcaatttaat

SEQ ID NO: 190339 - DNA, 20 bp, Artificial Sequence
  Synthetic oligonucleotide; AGTAGCTT chr2 60459427 60459446 60459443 +
taagctctcaccaggagcaa

SEQ ID NO: 190340 - DNA, 20 bp, Artificial Sequence
  Synthetic oligonucleotide; ATCAGTTT chr2 60459448 60459467 60459464 +
gtagcttttatactggtata

SEQ ID NO: 190341 - DNA, 20 bp, Artificial Sequence
  Synthetic oligonucleotide; TTTTGTTT chr2 60459453 60459472 60459469 +
ttttatactggtataatcag

SEQ ID NO: 190342 - DNA, 20 bp, Artificial Sequence
  Synthetic oligonucleotide; TGATGATT chr2 60459484 60459503 60459500 +
aaattaaactaaaggaaaaa

SEQ ID NO: 190343 - DNA, 20 bp, Artificial Sequence
  Synthetic oligonucleotide; TAAGGTTT chr2 60459568 60459587 60459584 +
tagaattatatgctagttcc

SEQ ID NO: 190344 - DNA, 20 bp, Artificial Sequence
  Synthetic oligonucleotide; ACAAGTTT chr2 60459604 60459623 60459620 +
acccaatgctgaattaagct

SEQ ID NO: 190345 - DNA, 20 bp, Artificial Sequence
  Synthetic oligonucleotide; TGTGGTTT chr2 60459636 60459655 60459652 +
caagtagaaagaaccatcga

SEQ ID NO: 190346 - DNA, 20 bp, Artificial Sequence
  Synthetic oligonucleotide; TTCTGTTT chr2 60459695 60459714 60459711 +
caaatgatagaataaacttg

SEQ ID NO: 190347 - DNA, 20 bp, Artificial Sequence
  Synthetic oligonucleotide; TAGAGATT chr2 60459786 60459805 60459802 +
agagacagacatttagctca

SEQ ID NO: 190348 - DNA, 20 bp, Artificial Sequence
  Synthetic oligonucleotide; GACTGTTT chr2 60459838 60459857 60459854 +
ctatagagggttaatccaaa

SEQ ID NO: 190349 - DNA, 20 bp, Artificial Sequence
  Synthetic oligonucleotide; ACATGTTT chr2 60459960 60459979 60459976 +
gaacggaactggaaacagca

SEQ ID NO: 190350 - DNA, 20 bp, Artificial Sequence
  Synthetic oligonucleotide; CTAAGTTT chr2 60460024 60460043 60460040 +
taacataccatacatgctgt

SEQ ID NO: 190351 - DNA, 20 bp, Artificial Sequence
  Synthetic oligonucleotide; CAAAGTTT chr2 60460079 60460098 60460095 +
tattgcacaagagaaaggct

SEQ ID NO: 190352 - DNA, 20 bp, Artificial Sequence
  Synthetic oligonucleotide; CTTAGCTT chr2 60460229 60460248 60460245 +
gtgacaagcactctcatatt

SEQ ID NO: 190353 - DNA, 20 bp, Artificial Sequence
  Synthetic oligonucleotide; TTCTGTTT chr2 60460243 60460262 60460259 +
catattcttagcttcgttac

SEQ ID NO: 190354 - DNA, 20 bp, Artificial Sequence
  Synthetic oligonucleotide; GTTTGTTT chr2 60460247 60460266 60460263 +
ttcttagcttcgttacttct

SEQ ID NO: 190355 - DNA, 20 bp, Artificial Sequence
  Synthetic oligonucleotide; GTTTGTTT chr2 60460251 60460270 60460267 +
tagcttcgttacttctgttt

SEQ ID NO: 190356 - DNA, 20 bp, Artificial Sequence
  Synthetic oligonucleotide; GTTTGTTT chr2 60460255 60460274 60460271 +
ttcgttacttctgtttgttt

SEQ ID NO: 190357 - DNA, 20 bp, Artificial Sequence
  Synthetic oligonucleotide; GTTTGTTT chr2 60460259 60460278 60460275 +
ttacttctgtttgtttgttt

SEQ ID NO: 190358 - DNA, 20 bp, Artificial Sequence
  Synthetic oligonucleotide; TTCAGTTT chr2 60460387 60460406 60460403 +
ggggtattaatatacctcta

SEQ ID NO: 190359 - DNA, 20 bp, Artificial Sequence
  Synthetic oligonucleotide; ATGTGTTT chr2 60460436 60460455 60460452 +
gatcactgtgccattttttc

SEQ ID NO: 190360 - DNA, 20 bp, Artificial Sequence
  Synthetic oligonucleotide; ATGCGTTT chr2 60460516 60460535 60460532 +
acgtccttccccacctggcc

SEQ ID NO: 190361 - DNA, 20 bp, Artificial Sequence
  Synthetic oligonucleotide; GTGAGCTT chr2 60460535 60460554 60460551 +
catgcgttttcatgtgcctg

SEQ ID NO: 190362 - DNA, 20 bp, Artificial Sequence
  Synthetic oligonucleotide; TGTGGCTT chr2 60460599 60460618 60460615 +
tttataaggcctttcgcccg

SEQ ID NO: 190363 - DNA, 20 bp, Artificial Sequence
  Synthetic oligonucleotide; GTGAGATT chr2 60460619 60460638 60460635 +
tgtggcttctcctgtggaca

SEQ ID NO: 190364 - DNA, 20 bp, Artificial Sequence
  Synthetic oligonucleotide; AGGCGATT chr2 60460843 60460862 60460859 +
tgctccgacgaggaggcaaa

SEQ ID NO: 190365 - DNA, 20 bp, Artificial Sequence
  Synthetic oligonucleotide; TCGAGCTT chr2 60460976 60460995 60460992 +
ggggcaggtcgaactccttc

SEQ ID NO: 190366 - DNA, 20 bp, Artificial Sequence
  Synthetic oligonucleotide; ATGCGCTT chr2 60460985 60461004 60461001 +
cgaactccttctcgagcttg

SEQ ID NO: 190367 - DNA, 20 bp, Artificial Sequence
  Synthetic oligonucleotide; AGCAGCTT chr2 60461027 60461046 60461043 +
gcgagctggggctgcccagc

SEQ ID NO: 190368 - DNA, 20 bp, Artificial Sequence
  Synthetic oligonucleotide; CCGCGCTT chr2 60461174 60461193 60461190 +
cctcggcctcggccaggtgg

SEQ ID NO: 190369 - DNA, 20 bp, Artificial Sequence
  Synthetic oligonucleotide; TTATGCTT chr2 60461180 60461199 60461196 +
cctcggccaggtggccgcgc

SEQ ID NO: 190370 - DNA, 20 bp, Artificial Sequence
  Synthetic oligonucleotide; GGACGATT chr2 60461596 60461615 60461612 +
tcggacttgaccgtcatggg

SEQ ID NO: 190371 - DNA, 20 bp, Artificial Sequence
  Synthetic oligonucleotide; TGGCGCTT chr2 60461624 60461643 60461640 +
tgtgcatgtgcgtcttcatg

SEQ ID NO: 190372 - DNA, 20 bp, Artificial Sequence
  Synthetic oligonucleotide; TTCAGCTT chr2 60461630 60461649 60461646 +
tgtgcgtcttcatgtggcgc

SEQ ID NO: 190373 - DNA, 20 bp, Artificial Sequence
  Synthetic oligonucleotide; TAGGGCTT chr2 60461678 60461697 60461694 +
ggtcgcacaggttgcacttg

SEQ ID NO: 190374 - DNA, 20 bp, Artificial Sequence
  Synthetic oligonucleotide; GGCGGATT chr2 60461794 60461813 60461810 +
gggggctgggagggaggagg

SEQ ID NO: 190375 - DNA, 20 bp, Artificial Sequence
  Synthetic oligonucleotide; GGCGGCTT chr2 60461834 60461853 60461850 +
gggggggcgtcgccaggaag

SEQ ID NO: 190376 - DNA, 20 bp, Artificial Sequence
  Synthetic oligonucleotide; ATTGGATT chr2 60461975 60461994 60461991 +
tggcgggaggctccatagcc

SEQ ID NO: 190377 - DNA, 20 bp, Artificial Sequence
  Synthetic oligonucleotide; GTTCGCTT chr2 60462285 60462304 60462301 +
cggggtcaggggacttccgt

SEQ ID NO: 190378 - DNA, 20 bp, Artificial Sequence
  Synthetic oligonucleotide; AGTAGATT chr2 60462297 60462316 60462313 +
acttccgtgttcgctttcta

SEQ ID NO: 190379 - DNA, 20 bp, Artificial Sequence
  Synthetic oligonucleotide; GGCTGTTT chr2 60462359 60462378 60462375 +
gaaaccatgcactggtgaat

SEQ ID NO: 190380 - DNA, 20 bp, Artificial Sequence
  Synthetic oligonucleotide; CAATGTTT chr2 60462430 60462449 60462446 +
aaataatacaacaccaacat

SEQ ID NO: 190381 - DNA, 20 bp, Artificial Sequence
  Synthetic oligonucleotide; AATTGCTT chr2 60462460 60462479 60462476 +
tcactgaggcgggcatcagc

SEQ ID NO: 190382 - DNA, 20 bp, Artificial Sequence
  Synthetic oligonucleotide; TCTGGCTT chr2 60462664 60462683 60462680 +
gcagaaaaatcctgaccagt

SEQ ID NO: 190383 - DNA, 20 bp, Artificial Sequence
  Synthetic oligonucleotide; TGTAGTTT chr2 60462739 60462758 60462755 +
aactttccagttccatcagc

SEQ ID NO: 190384 - DNA, 20 bp, Artificial Sequence
  Synthetic oligonucleotide; CTCTGTTT chr2 60462774 60462793 60462790 +
gccatctcatctccatgtgc

SEQ ID NO: 190385 - DNA, 20 bp, Artificial Sequence
  Synthetic oligonucleotide; TTTGGCTT chr2 60462829 60462848 60462845 +
aaggtgacccaaggaaactt

SEQ ID NO: 190386 - DNA, 20 bp, Artificial Sequence
  Synthetic oligonucleotide; CCCAGCTT chr2 60462844 60462863 60462860 +
aactttttggcttcctaaat

SEQ ID NO: 190387 - DNA, 20 bp, Artificial Sequence
  Synthetic oligonucleotide; AGATGCTT chr2 60462960 60462979 60462976 +
acaatgttctatggccctaa

SEQ ID NO: 190388 - DNA, 20 bp, Artificial Sequence
  Synthetic oligonucleotide; GAATGTTT chr2 60463144 60463163 60463160 +
acgtccatttttatctcaaa

SEQ ID NO: 190389 - DNA, 20 bp, Artificial Sequence
  Synthetic oligonucleotide; TTCAGATT chr2 60463176 60463195 60463192 +
aatctgaaagaaaaacttca

SEQ ID NO: 190390 - DNA, 20 bp, Artificial Sequence
  Synthetic oligonucleotide; CCTAGTTT chr2 60463292 60463311 60463308 +
gacttaagcagacacagcat

SEQ ID NO: 190391 - DNA, 20 bp, Artificial Sequence
  Synthetic oligonucleotide; CATTGTTT chr2 60463369 60463388 60463385 +
tgctacactatcctcctcct

SEQ ID NO: 190392 - DNA, 20 bp, Artificial Sequence
  Synthetic oligonucleotide; CCCTGCTT chr2 60463514 60463533 60463530 +
ccaagccgtctggagagggg

SEQ ID NO: 190393 - DNA, 20 bp, Artificial Sequence
  Synthetic oligonucleotide; GCCAGCTT chr2 60463587 60463606 60463603 +
tgccactttggcaaagaagg

SEQ ID NO: 190394 - DNA, 20 bp, Artificial Sequence
  Synthetic oligonucleotide; AACAGTTT chr2 60463690 60463709 60463706 +
tatatatggaataactgacc

SEQ ID NO: 190395 - DNA, 20 bp, Artificial Sequence
  Synthetic oligonucleotide; CAGAGATT chr2 60463773 60463792 60463789 +
atgagaaaaacaaaacttcc

SEQ ID NO: 190396 - DNA, 20 bp, Artificial Sequence
  Synthetic oligonucleotide; ACAAGATT chr2 60464161 60464180 60464177 +
ctcctgggtaaatctcttaa

SEQ ID NO: 190397 - DNA, 20 bp, Artificial Sequence
  Synthetic oligonucleotide; TTAGGTTT chr2 60464188 60464207 60464204 +
tagatggtaagataccaaaa

SEQ ID NO: 190398 - DNA, 20 bp, Artificial Sequence
  Synthetic oligonucleotide; GAAAGATT chr2 60464233 60464252 60464249 +
tggaagggggaaaaaaggca

SEQ ID NO: 190399 - DNA, 20 bp, Artificial Sequence
  Synthetic oligonucleotide; TTTTGTTT chr2 60464283 60464302 60464299 +
gtatcacattatctgcctat

SEQ ID NO: 190400 - DNA, 20 bp, Artificial Sequence
  Synthetic oligonucleotide; AAAAGCTT chr2 60464315 60464334 60464331 +
cctctcttcaaagggaaata

SEQ ID NO: 190401 - DNA, 20 bp, Artificial Sequence
  Synthetic oligonucleotide; TGTGGCTT chr2 60464424 60464443 60464440 +
gttccaactacatgatcctc

SEQ ID NO: 190402 - DNA, 20 bp, Artificial Sequence
  Synthetic oligonucleotide; AAAAGATT chr2 60464504 60464523 60464520 +
cgatctgagttgggcaagta

SEQ ID NO: 190403 - DNA, 20 bp, Artificial Sequence
  Synthetic oligonucleotide; CATCGATT chr2 60464583 60464602 60464599 +
ttatattttaccttataaaa

SEQ ID NO: 190404 - DNA, 20 bp, Artificial Sequence
  Synthetic oligonucleotide; GCTGGTTT chr2 60464622 60464641 60464638 +
ctagactcataattagtggt

SEQ ID NO: 190405 - DNA, 20 bp, Artificial Sequence
  Synthetic oligonucleotide; AAAGGCTT chr2 60464718 60464737 60464734 +
tctcatttgtatcctttcaa

SEQ ID NO: 190406 - DNA, 20 bp, Artificial Sequence
  Synthetic oligonucleotide; TACAGTTT chr2 60464895 60464914 60464911 +
cttataatgagcatacaaca

SEQ ID NO: 190407 - DNA, 20 bp, Artificial Sequence
  Synthetic oligonucleotide; TTACGATT chr2 60464991 60465010 60465007 +
aatgtcaatgagaagggctg

SEQ ID NO: 190408 - DNA, 20 bp, Artificial Sequence
  Synthetic oligonucleotide; TAAAGATT chr2 60465004 60465023 60465020 +
agggctgttacgattgagac

SEQ ID NO: 190409 - DNA, 20 bp, Artificial Sequence
  Synthetic oligonucleotide; AGCTGCTT chr2 60465022 60465041 60465038 +
actaaagattacatggagag

SEQ ID NO: 190410 - DNA, 20 bp, Artificial Sequence
  Synthetic oligonucleotide; CACAGATT chr2 60465143 60465162 60465159 +
ccatattatattacagtgct

SEQ ID NO: 190411 - DNA, 20 bp, Artificial Sequence
  Synthetic oligonucleotide; TGATGATT chr2 60465228 60465247 60465244 +
tactttgttcataacatctt

SEQ ID NO: 190412 - DNA, 20 bp, Artificial Sequence
  Synthetic oligonucleotide; AATTGATT chr2 60465248 60465267 60465264 +
tgatgatttagaaagactgg

SEQ ID NO: 190413 - DNA, 20 bp, Artificial Sequence
  Synthetic oligonucleotide; CATTGATT chr2 60465280 60465299 60465296 +
gtgtggcaaaattagggcta

SEQ ID NO: 190414 - DNA, 20 bp, Artificial Sequence
  Synthetic oligonucleotide; CGGGGATT chr2 60465372 60465391 60465388 +
agagcctcattgggcattta

SEQ ID NO: 190415 - DNA, 20 bp, Artificial Sequence
  Synthetic oligonucleotide; GATTGTTT chr2 60465376 60465395 60465392 +
cctcattgggcatttacggg

SEQ ID NO: 190416 - DNA, 20 bp, Artificial Sequence
  Synthetic oligonucleotide; TTTTGATT chr2 60465381 60465400 60465397 +
ttgggcatttacggggattg

SEQ ID NO: 190417 - DNA, 20 bp, Artificial Sequence
  Synthetic oligonucleotide; ACTGGCTT chr2 60465470 60465489 60465486 +
aatcagctattagcccacct

SEQ ID NO: 190418 - DNA, 20 bp, Artificial Sequence
  Synthetic oligonucleotide; TCAAGATT chr2 60465564 60465583 60465580 +
aaagtcatgtgatctaagcc

SEQ ID NO: 190419 - DNA, 20 bp, Artificial Sequence
  Synthetic oligonucleotide; ACTAGATT chr2 60465618 60465637 60465634 +
gaggcctagctctattatcc

SEQ ID NO: 190420 - DNA, 20 bp, Artificial Sequence
  Synthetic oligonucleotide; ATTTGATT chr2 60465643 60465662 60465659 +
attgtaactctgggatagtc

SEQ ID NO: 190421 - DNA, 20 bp, Artificial Sequence
  Synthetic oligonucleotide; GTGAGTTT chr2 60465776 60465795 60465792 +
ctatcaggtcgaatgtgaat

SEQ ID NO: 190422 - DNA, 20 bp, Artificial Sequence
  Synthetic oligonucleotide; GGGTGATT chr2 60465797 60465816 60465813 +
tgagttttcattactaccag

SEQ ID NO: 190423 - DNA, 20 bp, Artificial Sequence
  Synthetic oligonucleotide; AACGGCTT chr2 60465844 60465863 60465860 +
taaccacattacacaccccg

SEQ ID NO: 190424 - DNA, 20 bp, Artificial Sequence
  Synthetic oligonucleotide; TCAGGTTT chr2 60466008 60466027 60466024 +
gccgccaagtggaatgggca

SEQ ID NO: 190425 - DNA, 20 bp, Artificial Sequence
  Synthetic oligonucleotide; TAGAGCTT chr2 60466020 60466039 60466036 +
aatgggcatcaggtttgttc

SEQ ID NO: 190426 - DNA, 20 bp, Artificial Sequence
  Synthetic oligonucleotide; CTATGTTT chr2 60466228 60466247 60466244 +
accaggctgaagaccgagaa

SEQ ID NO: 190427 - DNA, 20 bp, Artificial Sequence
  Synthetic oligonucleotide; CTCCGTTT chr2 60466318 60466337 60466334 +
tcccttccctccaaaagtgg

SEQ ID NO: 190428 - DNA, 20 bp, Artificial Sequence
  Synthetic oligonucleotide; CCAGGCTT chr2 60466449 60466468 60466465 +
tctgcaatctgtgacctaac

SEQ ID NO: 190429 - DNA, 20 bp, Artificial Sequence
  Synthetic oligonucleotide; CCCAGCTT chr2 60466460 60466479 60466476 +
tgacctaacccaggcttagg

SEQ ID NO: 190430 - DNA, 20 bp, Artificial Sequence
  Synthetic oligonucleotide; AGGTGCTT chr2 60466486 60466505 60466502 +
ttgggggaagggagcagatg

SEQ ID NO: 190431 - DNA, 20 bp, Artificial Sequence
  Synthetic oligonucleotide; GAGGGCTT chr2 60466526 60466545 60466542 +
ccacccagccctcaggacct

SEQ ID NO: 190432 - DNA, 20 bp, Artificial Sequence
  Synthetic oligonucleotide; CTAGGATT chr2 60466563 60466582 60466579 +
acacaataactctttgttac

SEQ ID NO: 190433 - DNA, 20 bp, Artificial Sequence
  Synthetic oligonucleotide; ACTGGCTT chr2 60466596 60466615 60466612 +
ggagttaacaaaaataaaca

SEQ ID NO: 190434 - DNA, 20 bp, Artificial Sequence
  Synthetic oligonucleotide; ACCTGCTT chr2 60466838 60466857 60466854 +
cacacttcttttcttcttga

SEQ ID NO: 190435 - DNA, 20 bp, Artificial Sequence
  Synthetic oligonucleotide; TTGTGTTT chr2 60466848 60466867 60466864 +
ttcttcttgaacctgctttt

SEQ ID NO: 190436 - DNA, 20 bp, Artificial Sequence
  Synthetic oligonucleotide; GCATGATT chr2 60466895 60466914 60466911 +
ccccctaaccttttagccat

SEQ ID NO: 190437 - DNA, 20 bp, Artificial Sequence
  Synthetic oligonucleotide; TTAAGTTT chr2 60466990 60467009 60467006 +
atttgtataaatggacaaat

SEQ ID NO: 190438 - DNA, 20 bp, Artificial Sequence
  Synthetic oligonucleotide; TTTTGATT chr2 60468316 60468335 60468332 +
aataaccctaaactgactcc

SEQ ID NO: 190439 - DNA, 20 bp, Artificial Sequence
  Synthetic oligonucleotide; TGGGGATT chr2 60468751 60468770 60468767 +
ttctgcactcatcccaggcg

SEQ ID NO: 190440 - DNA, 20 bp, Artificial Sequence
  Synthetic oligonucleotide; AGAAGTTT chr2 60468804 60468823 60468820 +
aggagaggcccctccagtgc

SEQ ID NO: 190441 - DNA, 20 bp, Artificial Sequence
  Synthetic oligonucleotide; AATAGATT chr2 60468899 60468918 60468915 +
tcacatttcaattccattaa

SEQ ID NO: 190442 - DNA, 20 bp, Artificial Sequence
  Synthetic oligonucleotide; CAGAGTTT chr2 60468985 60469004 60469001 +
aagagtggtgagttatttcc

SEQ ID NO: 190443 - DNA, 20 bp, Artificial Sequence
  Synthetic oligonucleotide; TTCTGTTT chr2 60468991 60469010 60469007 +
ggtgagttatttcccagagt

SEQ ID NO: 190444 - DNA, 20 bp, Artificial Sequence
  Synthetic oligonucleotide; TTTTGTTT chr2 60468996 60469015 60469012 +
gttatttcccagagtttctg

SEQ ID NO: 190445 - DNA, 20 bp, Artificial Sequence
  Synthetic oligonucleotide; AAGGGTTT chr2 60469032 60469051 60469048 +
ggtctttttgacaaaagtga

SEQ ID NO: 190446 - DNA, 20 bp, Artificial Sequence
  Synthetic oligonucleotide; GTTTGTTT chr2 60469036 60469055 60469052 +
tttttgacaaaagtgaaagg

SEQ ID NO: 190447 - DNA, 20 bp, Artificial Sequence
  Synthetic oligonucleotide; ATTTGCTT chr2 60469073 60469092 60469089 +
ggagaggtggtctttggttc

SEQ ID NO: 190448 - DNA, 20 bp, Artificial Sequence
  Synthetic oligonucleotide; TGTTGTTT chr2 60469091 60469110 60469107 +
tcatttgcttatttatttgt

SEQ ID NO: 190449 - DNA, 20 bp, Artificial Sequence
  Synthetic oligonucleotide; GTTTGATT chr2 60469095 60469114 60469111 +
ttgcttatttatttgttgtt

SEQ ID NO: 190450 - DNA, 20 bp, Artificial Sequence
  Synthetic oligonucleotide; GGGGGATT chr2 60469176 60469195 60469192 +
gtgggtagcctggaaacatg

SEQ ID NO: 190451 - DNA, 20 bp, Artificial Sequence
  Synthetic oligonucleotide; GCTGGTTT chr2 60469195 60469214 60469211 +
ggggggattttatctgcaag

SEQ ID NO: 190452 - DNA, 20 bp, Artificial Sequence
  Synthetic oligonucleotide; AGTAGATT chr2 60469269 60469288 60469285 +
caaaatgctgataggaaatg

SEQ ID NO: 190453 - DNA, 20 bp, Artificial Sequence
  Synthetic oligonucleotide; AATCGTTT chr2 60469281 60469300 60469297 +
aggaaatgagtagatttgtg

SEQ ID NO: 190454 - DNA, 20 bp, Artificial Sequence
  Synthetic oligonucleotide; CTTTGCTT chr2 60469308 60469327 60469324 +
ttttatgggacagagtccca

SEQ ID NO: 190455 - DNA, 20 bp, Artificial Sequence
  Synthetic oligonucleotide; TGTGGCTT chr2 60469448 60469467 60469464 +
aactggaaaccttacacaga

SEQ ID NO: 190456 - DNA, 20 bp, Artificial Sequence
  Synthetic oligonucleotide; TAAAGATT chr2 60469480 60469499 60469496 +
caatacaaagcaatggaaga

SEQ ID NO: 190457 - DNA, 20 bp, Artificial Sequence
  Synthetic oligonucleotide; CTGAGATT chr2 60469676 60469695 60469692 +
tcaatgaaacatttgtagca

SEQ ID NO: 190458 - DNA, 20 bp, Artificial Sequence
  Synthetic oligonucleotide; TTTGGTTT chr2 60469702 60469721 60469718 +
tttttttgagaagaggaaaa

SEQ ID NO: 190459 - DNA, 20 bp, Artificial Sequence
  Synthetic oligonucleotide; TGGGGATT chr2 60469718 60469737 60469734 +
aaaatttggtttgtgcaatc

SEQ ID NO: 190460 - DNA, 20 bp, Artificial Sequence
  Synthetic oligonucleotide; TACGGTTT chr2 60469727 60469746 60469743 +
tttgtgcaatctggggattt

SEQ ID NO: 190461 - DNA, 20 bp, Artificial Sequence
  Synthetic oligonucleotide; CCTAGCTT chr2 60469747 60469766 60469763 +
tacggtttatgtggtaagtg

SEQ ID NO: 190462 - DNA, 20 bp, Artificial Sequence
  Synthetic oligonucleotide; AGAGGTTT chr2 60469847 60469866 60469863 +
ggagacgctctgtgtgttct

SEQ ID NO: 190463 - DNA, 20 bp, Artificial Sequence
  Synthetic oligonucleotide; TGATGATT chr2 60469863 60469882 60469879 +
ttctagaggtttggagttca

SEQ ID NO: 190464 - DNA, 20 bp, Artificial Sequence
  Synthetic oligonucleotide; GTATGTTT chr2 60469918 60469937 60469934 +
actttgatggtgaacaaaca

SEQ ID NO: 190465 - DNA, 20 bp, Artificial Sequence
  Synthetic oligonucleotide; ATTAGCTT chr2 60469929 60469948 60469945 +
gaacaaacagtatgttttcc

SEQ ID NO: 190466 - DNA, 20 bp, Artificial Sequence
  Synthetic oligonucleotide; ACAAGATT chr2 60470056 60470075 60470072 +
gcacagccaaggcagttggg

SEQ ID NO: 190467 - DNA, 20 bp, Artificial Sequence
  Synthetic oligonucleotide; GACTGTTT chr2 60470301 60470320 60470317 +
aaacaagtatgtctacattt

SEQ ID NO: 190468 - DNA, 20 bp, Artificial Sequence
  Synthetic oligonucleotide; TACAGATT chr2 60470344 60470363 60470360 +
agagtgtggcgtaaaattac

SEQ ID NO: 190469 - DNA, 20 bp, Artificial Sequence
  Synthetic oligonucleotide; ACTTGTTT chr2 60470397 60470416 60470413 +
atctgagaatccatctttgc

SEQ ID NO: 190470 - DNA, 20 bp, Artificial Sequence
  Synthetic oligonucleotide; CTAAGTTT chr2 60470421 60470440 60470437 +
gtttttgcctcagccgttca

SEQ ID NO: 190471 - DNA, 20 bp, Artificial Sequence
  Synthetic oligonucleotide; AAGTGCTT chr2 60470577 60470596 60470593 +
tactctgggaagagaccctg

SEQ ID NO: 190472 - DNA, 20 bp, Artificial Sequence
  Synthetic oligonucleotide; CATAGTTT chr2 60470768 60470787 60470784 +
ctcatctgactatctggcag

SEQ ID NO: 190473 - DNA, 20 bp, Artificial Sequence
  Synthetic oligonucleotide; GTTTGTTT chr2 60470772 60470791 60470788 +
tctgactatctggcagcata

SEQ ID NO: 190474 - DNA, 20 bp, Artificial Sequence
  Synthetic oligonucleotide; TTTTGTTT chr2 60470778 60470797 60470794 +
tatctggcagcatagtttgt

SEQ ID NO: 190475 - DNA, 20 bp, Artificial Sequence
  Synthetic oligonucleotide; TTTTGTTT chr2 60470784 60470803 60470800 +
gcagcatagtttgtttttgt

SEQ ID NO: 190476 - DNA, 20 bp, Artificial Sequence
  Synthetic oligonucleotide; TTTTGTTT chr2 60470790 60470809 60470806 +
tagtttgtttttgtttttgt

SEQ ID NO: 190477 - DNA, 20 bp, Artificial Sequence
  Synthetic oligonucleotide; TTTTGTTT chr2 60470796 60470815 60470812 +
gtttttgtttttgtttttgt

SEQ ID NO: 190478 - DNA, 20 bp, Artificial Sequence
  Synthetic oligonucleotide; TGATGATT chr2 60470907 60470926 60470923 +
tgacttgcccatggctacac

SEQ ID NO: 190479 - DNA, 20 bp, Artificial Sequence
  Synthetic oligonucleotide; TGAAGATT chr2 60470925 60470944 60470941 +
actgatgattaaccacaatg

SEQ ID NO: 190480 - DNA, 20 bp, Artificial Sequence
  Synthetic oligonucleotide; TCCTGTTT chr2 60471032 60471051 60471048 +
ttcactgcccaacaagaagg

SEQ ID NO: 190481 - DNA, 20 bp, Artificial Sequence
  Synthetic oligonucleotide; TGGGGCTT chr2 60471102 60471121 60471118 +
tccagcccagcagcgctaca

SEQ ID NO: 190482 - DNA, 20 bp, Artificial Sequence
  Synthetic oligonucleotide; CTCTGCTT chr2 60471212 60471231 60471228 +
ttgctgtgttcaccctctac

SEQ ID NO: 190483 - DNA, 20 bp, Artificial Sequence
  Synthetic oligonucleotide; AGCTGATT chr2 60471367 60471386 60471383 +
caaagccaactggggacccc

SEQ ID NO: 190484 - DNA, 20 bp, Artificial Sequence
  Synthetic oligonucleotide; TGCTGCTT chr2 60471376 60471395 60471392 +
ctggggaccccagctgattc

SEQ ID NO: 190485 - DNA, 20 bp, Artificial Sequence
  Synthetic oligonucleotide; TAGGGCTT chr2 60471475 60471494 60471491 +
taaattgttaatagcctccc

SEQ ID NO: 190486 - DNA, 20 bp, Artificial Sequence
  Synthetic oligonucleotide; CACGGCTT chr2 60471516 60471535 60471532 +
gatgccttcaattatttcat

SEQ ID NO: 190487 - DNA, 20 bp, Artificial Sequence
  Synthetic oligonucleotide; TAATGCTT chr2 60471546 60471565 60471562 +
gcaaagtaaagtatcacaat

SEQ ID NO: 190488 - DNA, 20 bp, Artificial Sequence
  Synthetic oligonucleotide; CTTCGCTT chr2 60471645 60471664 60471661 +
agggcctcttcttttcccac

SEQ ID NO: 190489 - DNA, 20 bp, Artificial Sequence
  Synthetic oligonucleotide; AAGTGATT chr2 60471747 60471766 60471763 +
ctttgttagtgctcttaggc

SEQ ID NO: 190490 - DNA, 20 bp, Artificial Sequence
  Synthetic oligonucleotide; GGGAGTTT chr2 60471797 60471816 60471813 +
acccccgatcagcatcacct

SEQ ID NO: 190491 - DNA, 20 bp, Artificial Sequence
  Synthetic oligonucleotide; AGGTGATT chr2 60471897 60471916 60471913 +
ctatgttgaataaattctcc

SEQ ID NO: 190492 - DNA, 20 bp, Artificial Sequence
  Synthetic oligonucleotide; GGAAGCTT chr2 60471965 60471984 60471981 +
gtaagggaagtatgaacgct

SEQ ID NO: 190493 - DNA, 20 bp, Artificial Sequence
  Synthetic oligonucleotide; GGCTGTTT chr2 60472007 60472026 60472023 +
cagagacccatgggccatga

SEQ ID NO: 190494 - DNA, 20 bp, Artificial Sequence
  Synthetic oligonucleotide; TTAAGCTT chr2 60472067 60472086 60472083 +
ctggaacagtcaaaaacaaa

SEQ ID NO: 190495 - DNA, 20 bp, Artificial Sequence
  Synthetic oligonucleotide; ACCAGCTT chr2 60472204 60472223 60472220 +
tagcatgagacaacacccaa

SEQ ID NO: 190496 - DNA, 20 bp, Artificial Sequence
  Synthetic oligonucleotide; GACAGATT chr2 60472218 60472237 60472234 +
acccaaaccagcttgtgcca

SEQ ID NO: 190497 - DNA, 20 bp, Artificial Sequence
  Synthetic oligonucleotide; CACTGCTT chr2 60472233 60472252 60472249 +
tgccagacagattgtgtcct

SEQ ID NO: 190498 - DNA, 20 bp, Artificial Sequence
  Synthetic oligonucleotide; TCTTGTTT chr2 60472306 60472325 60472322 +
ggacacagcaggaactggac

SEQ ID NO: 190499 - DNA, 20 bp, Artificial Sequence
  Synthetic oligonucleotide; AGGTGTTT chr2 60472395 60472414 60472411 +
tcttacacttttctggtgga

SEQ ID NO: 190500 - DNA, 20 bp, Artificial Sequence
  Synthetic oligonucleotide; CAAAGTTT chr2 60472487 60472506 60472503 +
ccttacacattattaggttg

SEQ ID NO: 190501 - DNA, 20 bp, Artificial Sequence
  Synthetic oligonucleotide; TCAGGTTT chr2 60472532 60472551 60472548 +
aaaatagtgactcttatttt

SEQ ID NO: 190502 - DNA, 20 bp, Artificial Sequence
  Synthetic oligonucleotide; AATGGCTT chr2 60472566 60472585 60472582 +
aaaatatgcagcaaactggg

SEQ ID NO: 190503 - DNA, 20 bp, Artificial Sequence
  Synthetic oligonucleotide; CTTTGATT chr2 60472571 60472590 60472587 +
atgcagcaaactgggaatgg

SEQ ID NO: 190504 - DNA, 20 bp, Artificial Sequence
  Synthetic oligonucleotide; TCAAGTTT chr2 60472685 60472704 60472701 +
ctggaatttaagtcattaaa

SEQ ID NO: 190505 - DNA, 20 bp, Artificial Sequence
  Synthetic oligonucleotide; TTTGGTTT chr2 60472693 60472712 60472709 +
taagtcattaaatcaagttt

SEQ ID NO: 190506 - DNA, 20 bp, Artificial Sequence
  Synthetic oligonucleotide; CAAAGATT chr2 60472715 60472734 60472731 +
tggtttcctcaagaacatct

SEQ ID NO: 190507 - DNA, 20 bp, Artificial Sequence
  Synthetic oligonucleotide; ATTTGTTT chr2 60472742 60472761 60472758 +
tccttgactattaacatgct

SEQ ID NO: 190508 - DNA, 20 bp, Artificial Sequence
  Synthetic oligonucleotide; TGCAGATT chr2 60472813 60472832 60472829 +
tactaatcaacaggtaatac

SEQ ID NO: 190509 - DNA, 20 bp, Artificial Sequence
  Synthetic oligonucleotide; ACACGTTT chr2 60472862 60472881 60472878 +
aagcaaaaagcatcattcca

SEQ ID NO: 190510 - DNA, 20 bp, Artificial Sequence
  Synthetic oligonucleotide; GACTGCTT chr2 60472873 60472892 60472889 +
atcattccaacacgtttaat

SEQ ID NO: 190511 - DNA, 20 bp, Artificial Sequence
  Synthetic oligonucleotide; GTGTGTTT chr2 60472969 60472988 60472985 +
tcactaaaatgtacgtgtgt

SEQ ID NO: 190512 - DNA, 20 bp, Artificial Sequence
  Synthetic oligonucleotide; ATGTGTTT chr2 60473021 60473040 60473037 +
gtgttagcgtgtgcatgcat

SEQ ID NO: 190513 - DNA, 20 bp, Artificial Sequence
  Synthetic oligonucleotide; GTATGCTT chr2 60473074 60473093 60473090 +
gtgactgtgtgcatgtgtgt

SEQ ID NO: 190514 - DNA, 20 bp, Artificial Sequence
  Synthetic oligonucleotide; ATATGTTT chr2 60473197 60473216 60473213 +
tgtgtgtatatttcctaaac

SEQ ID NO: 190515 - DNA, 20 bp, Artificial Sequence
  Synthetic oligonucleotide; CCCTGTTT chr2 60473216 60473235 60473232 +
catatgtttttagataattt

SEQ ID NO: 190516 - DNA, 20 bp, Artificial Sequence
  Synthetic oligonucleotide; GAACGTTT chr2 60473483 60473502 60473499 +
ctacacttaaaatgcatcct

SEQ ID NO: 190517 - DNA, 20 bp, Artificial Sequence
  Synthetic oligonucleotide; ATCCGATT chr2 60473526 60473545 60473542 +
ggaacccattccagttctga

SEQ ID NO: 190518 - DNA, 20 bp, Artificial Sequence
  Synthetic oligonucleotide; AGAGGCTT chr2 60473581 60473600 60473597 +
cagtgcagctagtctgagct

SEQ ID NO: 190519 - DNA, 20 bp, Artificial Sequence
  Synthetic oligonucleotide; CTATGTTT chr2 60473646 60473665 60473662 +
gccgcatctagctcttgacc

SEQ ID NO: 190520 - DNA, 20 bp, Artificial Sequence
  Synthetic oligonucleotide; CTTAGATT chr2 60473677 60473696 60473693 +
atagataccagttcttctca

SEQ ID NO: 190521 - DNA, 20 bp, Artificial Sequence
  Synthetic oligonucleotide; GCCAGCTT chr2 60473764 60473783 60473780 +
tcaatctgtaatgaaaatgt

SEQ ID NO: 190522 - DNA, 20 bp, Artificial Sequence
  Synthetic oligonucleotide; CATTGCTT chr2 60473873 60473892 60473889 +
catgtgcattttttttcctt

SEQ ID NO: 190523 - DNA, 20 bp, Artificial Sequence
  Synthetic oligonucleotide; GGCTGTTT chr2 60473888 60473907 60473904 +
tccttcattgcttttttact

SEQ ID NO: 190524 - DNA, 20 bp, Artificial Sequence
  Synthetic oligonucleotide; CTTAGATT chr2 60474003 60474022 60474019 +
cctgaaactctctcatggtc

SEQ ID NO: 190525 - DNA, 20 bp, Artificial Sequence
  Synthetic oligonucleotide; CCTTGATT chr2 60474092 60474111 60474108 +
tcaatgctatcctcttagag

SEQ ID NO: 190526 - DNA, 20 bp, Artificial Sequence
  Synthetic oligonucleotide; CTAGGCTT chr2 60474145 60474164 60474161 +
accttttaagagttctcctc

SEQ ID NO: 190527 - DNA, 20 bp, Artificial Sequence
  Synthetic oligonucleotide; TCTTGCTT chr2 60474303 60474322 60474319 +
ataattccaaaaaaaaaaaa

SEQ ID NO: 190528 - DNA, 20 bp, Artificial Sequence
  Synthetic oligonucleotide; TGCAGATT chr2 60474362 60474381 60474378 +
gttccatctttgtgttgaaa

SEQ ID NO: 190529 - DNA, 20 bp, Artificial Sequence
  Synthetic oligonucleotide; TTAAGCTT chr2 60474545 60474564 60474561 +
agataaatttttattacact

SEQ ID NO: 190530 - DNA, 20 bp, Artificial Sequence
  Synthetic oligonucleotide; TTTTGTTT chr2 60474633 60474652 60474649 +
attgtcttaggacaattttt

SEQ ID NO: 190531 - DNA, 20 bp, Artificial Sequence
  Synthetic oligonucleotide; GTTTGTTT chr2 60474637 60474656 60474653 +
tcttaggacaattttttttt

SEQ ID NO: 190532 - DNA, 20 bp, Artificial Sequence
  Synthetic oligonucleotide; CACAGATT chr2 60474816 60474835 60474832 +
cagtacaaagaaaacacgga

SEQ ID NO: 190533 - DNA, 20 bp, Artificial Sequence
  Synthetic oligonucleotide; GCAGGCTT chr2 60474833 60474852 60474849 +
ggacacagatttctcccaca

SEQ ID NO: 190534 - DNA, 20 bp, Artificial Sequence
  Synthetic oligonucleotide; AGAGGCTT chr2 60474976 60474995 60474992 +
tccatttggaagggagggag

SEQ ID NO: 190535 - DNA, 20 bp, Artificial Sequence
  Synthetic oligonucleotide; AGATGCTT chr2 60475063 60475082 60475079 +
taaaaagaaaaagcaggtaa

SEQ ID NO: 190536 - DNA, 20 bp, Artificial Sequence
  Synthetic oligonucleotide; CACTGATT chr2 60475148 60475167 60475164 +
attcacatcaaaatattgca

SEQ ID NO: 190537 - DNA, 20 bp, Artificial Sequence
  Synthetic oligonucleotide; TGAAGATT chr2 60475200 60475219 60475216 +
gaccatctaaataaatcctc

SEQ ID NO: 190538 - DNA, 20 bp, Artificial Sequence
  Synthetic oligonucleotide; TTCAGCTT chr2 60475219 60475238 60475235 +
ctgaagatttctgtgacatc

SEQ ID NO: 190539 - DNA, 20 bp, Artificial Sequence
  Synthetic oligonucleotide; TTCTGTTT chr2 60475317 60475336 60475333 +
actccatgaaggttcatctg

SEQ ID NO: 190540 - DNA, 20 bp, Artificial Sequence
  Synthetic oligonucleotide; AATTGTTT chr2 60475337 60475356 60475353 +
ttctgttttccccccacctc

SEQ ID NO: 190541 - DNA, 20 bp, Artificial Sequence
  Synthetic oligonucleotide; CTATGTTT chr2 60475387 60475406 60475403 +
gcccgctaaggcaaaattta

SEQ ID NO: 190542 - DNA, 20 bp, Artificial Sequence
  Synthetic oligonucleotide; CCTGGCTT chr2 60475456 60475475 60475472 +
cttccttgcaatactgcctc

SEQ ID NO: 190543 - DNA, 20 bp, Artificial Sequence
  Synthetic oligonucleotide; GCCAGTTT chr2 60475490 60475509 60475506 +
tctatttcagatgtctcatt

SEQ ID NO: 190544 - DNA, 20 bp, Artificial Sequence
  Synthetic oligonucleotide; ATGGGCTT chr2 60475501 60475520 60475517 +
tgtctcattgccagtttaag

SEQ ID NO: 190545 - DNA, 20 bp, Artificial Sequence
  Synthetic oligonucleotide; TTGAGATT chr2 60475552 60475571 60475568 +
aaatgactgtgcaagaaaca

SEQ ID NO: 190546 - DNA, 20 bp, Artificial Sequence
  Synthetic oligonucleotide; TCTTGTTT chr2 60475688 60475707 60475704 +
tctgagtcctcagctgagga

SEQ ID NO: 190547 - DNA, 20 bp, Artificial Sequence
  Synthetic oligonucleotide; CCCGGATT chr2 60475815 60475834 60475831 +
tattcccactgccaccactc

SEQ ID NO: 190548 - DNA, 20 bp, Artificial Sequence
  Synthetic oligonucleotide; AGCTGTTT chr2 60475921 60475940 60475937 +
ccccaactctgccactcacc

SEQ ID NO: 190549 - DNA, 20 bp, Artificial Sequence
  Synthetic oligonucleotide; AAGTGTTT chr2 60475963 60475982 60475979 +
aatcctttctttctggccct

SEQ ID NO: 190550 - DNA, 20 bp, Artificial Sequence
  Synthetic oligonucleotide; ACTGGATT chr2 60475990 60476009 60476006 +
tccatctttaaaaggagaag

SEQ ID NO: 190551 - DNA, 20 bp, Artificial Sequence
  Synthetic oligonucleotide; GGTGGCTT chr2 60476004 60476023 60476020 +
gagaagactggattagatgg

SEQ ID NO: 190552 - DNA, 20 bp, Artificial Sequence
  Synthetic oligonucleotide; CTGGGCTT chr2 60476158 60476177 60476174 +
ccttataggagagttcaggg

SEQ ID NO: 190553 - DNA, 20 bp, Artificial Sequence
  Synthetic oligonucleotide; TTAGGCTT chr2 60476183 60476202 60476199 +
cttggtccccaggctaatcc

SEQ ID NO: 190554 - DNA, 20 bp, Artificial Sequence
  Synthetic oligonucleotide; GATGGATT chr2 60476207 60476226 60476223 +
gcttagagagtgagcctgat

SEQ ID NO: 190555 - DNA, 20 bp, Artificial Sequence
  Synthetic oligonucleotide; CAAAGTTT chr2 60476239 60476258 60476255 +
cctcctgggacacagtcttg

SEQ ID NO: 190556 - DNA, 20 bp, Artificial Sequence
  Synthetic oligonucleotide; CTGAGCTT chr2 60476253 60476272 60476269 +
gtcttgcaaagtttacatgt

SEQ ID NO: 190557 - DNA, 20 bp, Artificial Sequence
  Synthetic oligonucleotide; AGATGTTT chr2 60476622 60476641 60476638 +
gctaaccaacataatttcag

SEQ ID NO: 190558 - DNA, 20 bp, Artificial Sequence
  Synthetic oligonucleotide; CAGGGCTT chr2 60476660 60476679 60476676 +
ccaggctcattgaaaattgg

SEQ ID NO: 190559 - DNA, 20 bp, Artificial Sequence
  Synthetic oligonucleotide; ATCAGTTT chr2 60476857 60476876 60476873 +
gaaaaatcactctctaattt

SEQ ID NO: 190560 - DNA, 20 bp, Artificial Sequence
  Synthetic oligonucleotide; ATGAGATT chr2 60476871 60476890 60476887 +
taatttatcagtttccatta

SEQ ID NO: 190561 - DNA, 20 bp, Artificial Sequence
  Synthetic oligonucleotide; TCCAGCTT chr2 60476990 60477009 60477006 +
tatttctgtcacccgaattg

SEQ ID NO: 190562 - DNA, 20 bp, Artificial Sequence
  Synthetic oligonucleotide; TTGCGTTT chr2 60477106 60477125 60477122 +
gaaagccttgcaaaccacac

SEQ ID NO: 190563 - DNA, 20 bp, Artificial Sequence
  Synthetic oligonucleotide; AAACGTTT chr2 60477226 60477245 60477242 +
cgatgagaatgatcatttgc

SEQ ID NO: 190564 - DNA, 20 bp, Artificial Sequence
  Synthetic oligonucleotide; GTTTGATT chr2 60477230 60477249 60477246 +
gagaatgatcatttgcaaac

SEQ ID NO: 190565 - DNA, 20 bp, Artificial Sequence
  Synthetic oligonucleotide; AAGGGCTT chr2 60477262 60477281 60477278 +
taacacctgccagagcagag

SEQ ID NO: 190566 - DNA, 20 bp, Artificial Sequence
  Synthetic oligonucleotide; ATGTGCTT chr2 60477355 60477374 60477371 +
tctgcatcaactcacaacaa

SEQ ID NO: 190567 - DNA, 20 bp, Artificial Sequence
  Synthetic oligonucleotide; TGGTGTTT chr2 60477618 60477637 60477634 +
aagaaagaaataatcaaaca

SEQ ID NO: 190568 - DNA, 20 bp, Artificial Sequence
  Synthetic oligonucleotide; TGATGTTT chr2 60477638 60477657 60477654 +
tggtgtttccaagagactcc

SEQ ID NO: 190569 - DNA, 20 bp, Artificial Sequence
  Synthetic oligonucleotide; GAGGGCTT chr2 60477758 60477777 60477774 +
cactgcagcccggccaggtg

SEQ ID NO: 190570 - DNA, 20 bp, Artificial Sequence
  Synthetic oligonucleotide; GAAAGCTT chr2 60477933 60477952 60477949 +
catctgtcctggcctttatg

SEQ ID NO: 190571 - DNA, 20 bp, Artificial Sequence
  Synthetic oligonucleotide; CTGGGCTT chr2 60478309 60478328 60478325 +
tgtggacagggaggacaggg

SEQ ID NO: 190572 - DNA, 20 bp, Artificial Sequence
  Synthetic oligonucleotide; AAGAGATT chr2 60478523 60478542 60478539 +
actctgtgacagtcttggcc

SEQ ID NO: 190573 - DNA, 20 bp, Artificial Sequence
  Synthetic oligonucleotide; TAAGGCTT chr2 60478621 60478640 60478637 +
agaaattatgagaactaatt

SEQ ID NO: 190574 - DNA, 20 bp, Artificial Sequence
  Synthetic oligonucleotide; AGCTGCTT chr2 60478816 60478835 60478832 +
ctctgcccggggcatgctgc

SEQ ID NO: 190575 - DNA, 20 bp, Artificial Sequence
  Synthetic oligonucleotide; CTTGGCTT chr2 60478922 60478941 60478938 +
ccacagaacaaaacacaggc

SEQ ID NO: 190576 - DNA, 20 bp, Artificial Sequence
  Synthetic oligonucleotide; ACGTGCTT chr2 60478932 60478951 60478948 +
aaacacaggccttggctttg

SEQ ID NO: 190577 - DNA, 20 bp, Artificial Sequence
  Synthetic oligonucleotide; CTTTGTTT chr2 60478937 60478956 60478953 +
caggccttggctttgacgtg

SEQ ID NO: 190578 - DNA, 20 bp, Artificial Sequence
  Synthetic oligonucleotide; TTTTGTTT chr2 60478944 60478963 60478960 +
tggctttgacgtgctttgtt

SEQ ID NO: 190579 - DNA, 20 bp, Artificial Sequence
  Synthetic oligonucleotide; CCTGGCTT chr2 60478969 60478988 60478985 +
ttttttttttttccctcctc

SEQ ID NO: 190580 - DNA, 20 bp, Artificial Sequence
  Synthetic oligonucleotide; TGCTGATT chr2 60479138 60479157 60479154 +
gttcttggctctactaattc

SEQ ID NO: 190581 - DNA, 20 bp, Artificial Sequence
  Synthetic oligonucleotide; TTTTGTTT chr2 60479319 60479338 60479335 +
ggtgggacccggagaccatt

SEQ ID NO: 190582 - DNA, 20 bp, Artificial Sequence
  Synthetic oligonucleotide; GACTGCTT chr2 60479340 60479359 60479356 +
tttgttttgagtctctctaa

SEQ ID NO: 190583 - DNA, 20 bp, Artificial Sequence
  Synthetic oligonucleotide; TTTTGCTT chr2 60479492 60479511 60479508 +
agcccctcaggctgaaatcc

SEQ ID NO: 190584 - DNA, 20 bp, Artificial Sequence
  Synthetic oligonucleotide; CGCGGTTT chr2 60479618 60479637 60479634 +
gagtgtggacggcaggctga

SEQ ID NO: 190585 - DNA, 20 bp, Artificial Sequence
  Synthetic oligonucleotide; AGAGGCTT chr2 60479742 60479761 60479758 +
agggtctgtcaccattttaa

SEQ ID NO: 190586 - DNA, 20 bp, Artificial Sequence
  Synthetic oligonucleotide; TTTTGATT chr2 60479819 60479838 60479835 +
tatcagcgtgggacaggttc

SEQ ID NO: 190587 - DNA, 20 bp, Artificial Sequence
  Synthetic oligonucleotide; AAACGCTT chr2 60479858 60479877 60479874 +
tcttacaaaatctgaaaatg

SEQ ID NO: 190588 - DNA, 20 bp, Artificial Sequence
  Synthetic oligonucleotide; AACCGTTT chr2 60479884 60479903 60479900 +
ttctgtccctcccttccacc

SEQ ID NO: 190589 - DNA, 20 bp, Artificial Sequence
  Synthetic oligonucleotide; TTTTGATT chr2 60479891 60479910 60479907 +
cctcccttccaccaaccgtt

SEQ ID NO: 190590 - DNA, 20 bp, Artificial Sequence
  Synthetic oligonucleotide; CTCAGCTT chr2 60479948 60479967 60479964 +
gacaggttgggacaactcca

SEQ ID NO: 190591 - DNA, 20 bp, Artificial Sequence
  Synthetic oligonucleotide; AGCTGCTT chr2 60479967 60479986 60479983 +
actcagctttctcactcaaa

SEQ ID NO: 190592 - DNA, 20 bp, Artificial Sequence
  Synthetic oligonucleotide; CAAGGCTT chr2 60480304 60480323 60480320 +
tggttctccaactaaaagtt

SEQ ID NO: 190593 - DNA, 20 bp, Artificial Sequence
  Synthetic oligonucleotide; TTAGGATT chr2 60480389 60480408 60480405 +
aagagcccctcaataaataa

SEQ ID NO: 190594 - DNA, 20 bp, Artificial Sequence
  Synthetic oligonucleotide; AAATGATT chr2 60480506 60480525 60480522 +
caggggaaaccttccctagt

SEQ ID NO: 190595 - DNA, 20 bp, Artificial Sequence
  Synthetic oligonucleotide; AGAGGATT chr2 60480552 60480571 60480568 +
tgggtcagccttgacccagg

SEQ ID NO: 190596 - DNA, 20 bp, Artificial Sequence
  Synthetic oligonucleotide; CATCGCTT chr2 60480587 60480606 60480603 +
cttgaaagtggctgctggtc

SEQ ID NO: 190597 - DNA, 20 bp, Artificial Sequence
  Synthetic oligonucleotide; ATTTGTTT chr2 60480790 60480809 60480806 +
ctttcttccttcctctctca

SEQ ID NO: 190598 - DNA, 20 bp, Artificial Sequence
  Synthetic oligonucleotide; CTCCGCTT chr2 60480882 60480901 60480898 +
gaaagaacagtgtgaagtac

SEQ ID NO: 190599 - DNA, 20 bp, Artificial Sequence
  Synthetic oligonucleotide; AATAGTTT chr2 60480921 60480940 60480937 +
tttttgaactcatagttcta

SEQ ID NO: 190600 - DNA, 20 bp, Artificial Sequence
  Synthetic oligonucleotide; AAGGGCTT chr2 60480941 60480960 60480957 +
aatagtttttgctccactaa

SEQ ID NO: 190601 - DNA, 20 bp, Artificial Sequence
  Synthetic oligonucleotide; AGGAGATT chr2 60481146 60481165 60481162 +
gcaaagccctgctgtgctca

SEQ ID NO: 190602 - DNA, 20 bp, Artificial Sequence
  Synthetic oligonucleotide; TGAGGCTT chr2 60481153 60481172 60481169 +
cctgctgtgctcaaggagat

SEQ ID NO: 190603 - DNA, 20 bp, Artificial Sequence
  Synthetic oligonucleotide; CTCTGCTT chr2 60481243 60481262 60481259 +
tcccaaacctagccacccat

SEQ ID NO: 190604 - DNA, 20 bp, Artificial Sequence
  Synthetic oligonucleotide; CTCTGCTT chr2 60481392 60481411 60481408 +
ctacaccaggcccttcgcac

SEQ ID NO: 190605 - DNA, 20 bp, Artificial Sequence
  Synthetic oligonucleotide; TGCGGCTT chr2 60481400 60481419 60481416 +
ggcccttcgcacctctgctt

SEQ ID NO: 190606 - DNA, 20 bp, Artificial Sequence
  Synthetic oligonucleotide; CAGTGTTT chr2 60481584 60481603 60481600 +
aagagcaactgcagcagaaa

SEQ ID NO: 190607 - DNA, 20 bp, Artificial Sequence
  Synthetic oligonucleotide; TCTTGTTT chr2 60481625 60481644 60481641 +
atggctcgtgaatttttttg

SEQ ID NO: 190608 - DNA, 20 bp, Artificial Sequence
  Synthetic oligonucleotide; CAGTGTTT chr2 60481700 60481719 60481716 +
gcacatacaactcagggctc

SEQ ID NO: 190609 - DNA, 20 bp, Artificial Sequence
  Synthetic oligonucleotide; GTGAGATT chr2 60481730 60481749 60481746 +
agggcattttttttccacaa

SEQ ID NO: 190610 - DNA, 20 bp, Artificial Sequence
  Synthetic oligonucleotide; TGATGTTT chr2 60481984 60482003 60482000 +
tcaaaagaaaggggttggac

SEQ ID NO: 190611 - DNA, 20 bp, Artificial Sequence
  Synthetic oligonucleotide; GAGGGCTT chr2 60481999 60482018 60482015 +
tggactgatgtttcccagtg

SEQ ID NO: 190612 - DNA, 20 bp, Artificial Sequence
  Synthetic oligonucleotide; GCTTGTTT chr2 60482003 60482022 60482019 +
ctgatgtttcccagtggagg

SEQ ID NO: 190613 - DNA, 20 bp, Artificial Sequence
  Synthetic oligonucleotide; GGTGGTTT chr2 60482089 60482108 60482105 +
ggcagacctgttaaggggcg

SEQ ID NO: 190614 - DNA, 20 bp, Artificial Sequence
  Synthetic oligonucleotide; TCATGATT chr2 60482132 60482151 60482148 +
ttttggacattttgcatctc

SEQ ID NO: 190615 - DNA, 20 bp, Artificial Sequence
  Synthetic oligonucleotide; GAGAGTTT chr2 60482147 60482166 60482163 +
atctctcatgattctatctt

SEQ ID NO: 190616 - DNA, 20 bp, Artificial Sequence
  Synthetic oligonucleotide; TTTAGTTT chr2 60482152 60482171 60482168 +
tcatgattctatcttgagag

SEQ ID NO: 190617 - DNA, 20 bp, Artificial Sequence
  Synthetic oligonucleotide; TGGAGTTT chr2 60482163 60482182 60482179 +
tcttgagagtttagtttggt

SEQ ID NO: 190618 - DNA, 20 bp, Artificial Sequence
  Synthetic oligonucleotide; TTTAGTTT chr2 60482168 60482187 60482184 +
agagtttagtttggttggag

SEQ ID NO: 190619 - DNA, 20 bp, Artificial Sequence
  Synthetic oligonucleotide; TTGAGTTT chr2 60482176 60482195 60482192 +
gtttggttggagtttagttt

SEQ ID NO: 190620 - DNA, 20 bp, Artificial Sequence
  Synthetic oligonucleotide; TGTGGTTT chr2 60482195 60482214 60482211 +
tttgagttttttgttcgggt

SEQ ID NO: 190621 - DNA, 20 bp, Artificial Sequence
  Synthetic oligonucleotide; TTCTGTTT chr2 60482239 60482258 60482255 +
aaaaaaaattggagctgtat

SEQ ID NO: 190622 - DNA, 20 bp, Artificial Sequence
  Synthetic oligonucleotide; TGGAGCTT chr2 60482358 60482377 60482374 +
aactggagaaaagtgagaaa

SEQ ID NO: 190623 - DNA, 20 bp, Artificial Sequence
  Synthetic oligonucleotide; CTTGGCTT chr2 60482370 60482389 60482386 +
gtgagaaatggagctttttt

SEQ ID NO: 190624 - DNA, 20 bp, Artificial Sequence
  Synthetic oligonucleotide; CACTGCTT chr2 60482402 60482421 60482418 +
acagttgtaatttccactgc

SEQ ID NO: 190625 - DNA, 20 bp, Artificial Sequence
  Synthetic oligonucleotide; TCAGGATT chr2 60482469 60482488 60482485 +
tgtgacaactttgccacaaa

SEQ ID NO: 190626 - DNA, 20 bp, Artificial Sequence
  Synthetic oligonucleotide; GACTGCTT chr2 60482514 60482533 60482530 +
ggaagcaagaagaatagagg

SEQ ID NO: 190627 - DNA, 20 bp, Artificial Sequence
  Synthetic oligonucleotide; TATAGATT chr2 60482525 60482544 60482541 +
gaatagagggactgcttatt

SEQ ID NO: 190628 - DNA, 20 bp, Artificial Sequence
  Synthetic oligonucleotide; ATCAGCTT chr2 60482663 60482682 60482679 +
cactgcatcccaaggttaag

SEQ ID NO: 190629 - DNA, 20 bp, Artificial Sequence
  Synthetic oligonucleotide; TGCTGCTT chr2 60482692 60482711 60482708 +
ctgaaaacagggcagaagac

SEQ ID NO: 190630 - DNA, 20 bp, Artificial Sequence
  Synthetic oligonucleotide; ACTGGATT chr2 60482756 60482775 60482772 +
ttagtaccacactacattta

SEQ ID NO: 190631 - DNA, 20 bp, Artificial Sequence
  Synthetic oligonucleotide; ATGTGATT chr2 60482770 60482789 60482786 +
catttaactggattcagttc

SEQ ID NO: 190632 - DNA, 20 bp, Artificial Sequence
  Synthetic oligonucleotide; CCTTGCTT chr2 60482786 60482805 60482802 +
gttcatgtgattatacagtg

SEQ ID NO: 190633 - DNA, 20 bp, Artificial Sequence
  Synthetic oligonucleotide; CATTGATT chr2 60482891 60482910 60482907 +
gcagagtcaagctggaagat

SEQ ID NO: 190634 - DNA, 20 bp, Artificial Sequence
  Synthetic oligonucleotide; TGATGTTT chr2 60482949 60482968 60482965 +
ttcaaacattacagaaatga

SEQ ID NO: 190635 - DNA, 20 bp, Artificial Sequence
  Synthetic oligonucleotide; ATCTGATT chr2 60482987 60483006 60483003 +
tttgctgataaatgctcaaa

SEQ ID NO: 190636 - DNA, 20 bp, Artificial Sequence
  Synthetic oligonucleotide; CCATGATT chr2 60483033 60483052 60483049 +
aagaaaacctgcacttcagc

SEQ ID NO: 190637 - DNA, 20 bp, Artificial Sequence
  Synthetic oligonucleotide; AGATGTTT chr2 60483049 60483068 60483065 +
cagcccatgattactttgcg

SEQ ID NO: 190638 - DNA, 20 bp, Artificial Sequence
  Synthetic oligonucleotide; GTGTGATT chr2 60483072 60483091 60483088 +
tgtttgagaagaatcaggca

SEQ ID NO: 190639 - DNA, 20 bp, Artificial Sequence
  Synthetic oligonucleotide; CAGGGTTT chr2 60483198 60483217 60483214 +
gaacaatgctagccaacaat

SEQ ID NO: 190640 - DNA, 20 bp, Artificial Sequence
  Synthetic oligonucleotide; AGCCGTTT chr2 60483208 60483227 60483224 +
agccaacaatcagggtttac

SEQ ID NO: 190641 - DNA, 20 bp, Artificial Sequence
  Synthetic oligonucleotide; AGTGGTTT chr2 60483317 60483336 60483333 +
ctccattcaggcctttgaaa

SEQ ID NO: 190642 - DNA, 20 bp, Artificial Sequence
  Synthetic oligonucleotide; GTCTGTTT chr2 60483465 60483484 60483481 +
ctgcagtccctttagcccca

SEQ ID NO: 190643 - DNA, 20 bp, Artificial Sequence
  Synthetic oligonucleotide; ATGTGTTT chr2 60483514 60483533 60483530 +
aatcaactgctgtctatgtc

SEQ ID NO: 190644 - DNA, 20 bp, Artificial Sequence
  Synthetic oligonucleotide; TTTTGATT chr2 60483519 60483538 60483535 +
actgctgtctatgtcatgtg

SEQ ID NO: 190645 - DNA, 20 bp, Artificial Sequence
  Synthetic oligonucleotide; CGTGGATT chr2 60483657 60483676 60483673 +
tgagctggcatattagcaga

SEQ ID NO: 190646 - DNA, 20 bp, Artificial Sequence
  Synthetic oligonucleotide; GGATGCTT chr2 60483699 60483718 60483715 +
ctaaaacagaagatgtatct

SEQ ID NO: 190647 - DNA, 20 bp, Artificial Sequence
  Synthetic oligonucleotide; GGAGGATT chr2 60483768 60483787 60483784 +
actcgcccaaagcactagaa

SEQ ID NO: 190648 - DNA, 20 bp, Artificial Sequence
  Synthetic oligonucleotide; GGTTGCTT chr2 60483867 60483886 60483883 +
tttccttctttttctttctt

SEQ ID NO: 190649 - DNA, 20 bp, Artificial Sequence
  Synthetic oligonucleotide; CATAGCTT chr2 60483919 60483938 60483935 +
cattataaatgagttggtct

SEQ ID NO: 190650 - DNA, 20 bp, Artificial Sequence
  Synthetic oligonucleotide; AGAAGCTT chr2 60483939 60483958 60483955 +
catagcttctgttaaaaatc

SEQ ID NO: 190651 - DNA, 20 bp, Artificial Sequence
  Synthetic oligonucleotide; TAATGATT chr2 60483955 60483974 60483971 +
aatcagaagcttgttagatg

SEQ ID NO: 190652 - DNA, 20 bp, Artificial Sequence
  Synthetic oligonucleotide; AACAGCTT chr2 60484004 60484023 60484020 +
gcgtatgaggggtcttgtcg

SEQ ID NO: 190653 - DNA, 20 bp, Artificial Sequence
  Synthetic oligonucleotide; CTCAGATT chr2 60484049 60484068 60484065 +
cctctgttaattagaaagcc

SEQ ID NO: 190654 - DNA, 20 bp, Artificial Sequence
  Synthetic oligonucleotide; TCATGCTT chr2 60484086 60484105 60484102 +
tgcaggtcactatcgacagc

SEQ ID NO: 190655 - DNA, 20 bp, Artificial Sequence
  Synthetic oligonucleotide; TGATGCTT chr2 60484095 60484114 60484111 +
ctatcgacagctcatgcttt

SEQ ID NO: 190656 - DNA, 20 bp, Artificial Sequence
  Synthetic oligonucleotide; GGCTGCTT chr2 60484187 60484206 60484203 +
tcagaaaatgcagtcaccac

SEQ ID NO: 190657 - DNA, 20 bp, Artificial Sequence
  Synthetic oligonucleotide; GTCAGTTT chr2 60484226 60484245 60484242 +
acacgcaaggtccgcacaca

SEQ ID NO: 190658 - DNA, 20 bp, Artificial Sequence
  Synthetic oligonucleotide; CTCTGTTT chr2 60484368 60484387 60484384 +
cttgcctctctttctccaac

SEQ ID NO: 190659 - DNA, 20 bp, Artificial Sequence
  Synthetic oligonucleotide; GTAGGTTT chr2 60484467 60484486 60484483 +
cacattcaccagaaagggaa

SEQ ID NO: 190660 - DNA, 20 bp, Artificial Sequence
  Synthetic oligonucleotide; GGTTGCTT chr2 60484488 60484507 60484504 +
taggttttacagataaaccg

SEQ ID NO: 190661 - DNA, 20 bp, Artificial Sequence
  Synthetic oligonucleotide; CAGTGATT chr2 60484509 60484528 60484525 +
gttgcttttcactgaaacag

SEQ ID NO: 190662 - DNA, 20 bp, Artificial Sequence
  Synthetic oligonucleotide; ACGTGTTT chr2 60484632 60484651 60484648 +
ctgtacttccaacatggctc

SEQ ID NO: 190663 - DNA, 20 bp, Artificial Sequence
  Synthetic oligonucleotide; TGAGGTTT chr2 60484731 60484750 60484747 +
gagaaaaaatgcacatgggc

SEQ ID NO: 190664 - DNA, 20 bp, Artificial Sequence
  Synthetic oligonucleotide; ACTTGTTT chr2 60484929 60484948 60484945 +
aaaaagaaatcctctgtggc

SEQ ID NO: 190665 - DNA, 20 bp, Artificial Sequence
  Synthetic oligonucleotide; ACTGGCTT chr2 60485208 60485227 60485224 +
ggaagtctggccttggagtt

SEQ ID NO: 190666 - DNA, 20 bp, Artificial Sequence
  Synthetic oligonucleotide; CAACGCTT chr2 60485652 60485671 60485668 +
agcaacctagatatgagaaa

SEQ ID NO: 190667 - DNA, 20 bp, Artificial Sequence
  Synthetic oligonucleotide; AAGTGTTT chr2 60485773 60485792 60485789 +
gagctcaacccagagaaggc

SEQ ID NO: 190668 - DNA, 20 bp, Artificial Sequence
  Synthetic oligonucleotide; ATCTGATT chr2 60485877 60485896 60485893 +
tggaaataatacattgctgc

SEQ ID NO: 190669 - DNA, 20 bp, Artificial Sequence
  Synthetic oligonucleotide; ATGAGATT chr2 60485911 60485930 60485927 +
ttcaacaagaaggctgagga

SEQ ID NO: 190670 - DNA, 20 bp, Artificial Sequence
  Synthetic oligonucleotide; TTTAGTTT chr2 60485925 60485944 60485941 +
tgaggaatgagattgcacat

SEQ ID NO: 190671 - DNA, 20 bp, Artificial Sequence
  Synthetic oligonucleotide; GTATGTTT chr2 60486011 60486030 60486027 +
gtacaaaaaaaatcttttta

SEQ ID NO: 190672 - DNA, 20 bp, Artificial Sequence
  Synthetic oligonucleotide; AATGGATT chr2 60486115 60486134 60486131 +
caagctgttctccattctga

SEQ ID NO: 190673 - DNA, 20 bp, Artificial Sequence
  Synthetic oligonucleotide; TGGGGATT chr2 60486170 60486189 60486186 +
catcctagggagactggtac

SEQ ID NO: 190674 - DNA, 20 bp, Artificial Sequence
  Synthetic oligonucleotide; TTGTGATT chr2 60486228 60486247 60486244 +
gctcctttccagagaatgac

SEQ ID NO: 190675 - DNA, 20 bp, Artificial Sequence
  Synthetic oligonucleotide; TCTGGCTT chr2 60486573 60486592 60486589 +
ctgtgatggacatgagatcc

SEQ ID NO: 190676 - DNA, 20 bp, Artificial Sequence
  Synthetic oligonucleotide; GATGGATT chr2 60486613 60486632 60486629 +
tgcacagaaatgagcagcat

SEQ ID NO: 190677 - DNA, 20 bp, Artificial Sequence
  Synthetic oligonucleotide; GGCAGATT chr2 60486625 60486644 60486641 +
agcagcatgatggattagct

SEQ ID NO: 190678 - DNA, 20 bp, Artificial Sequence
  Synthetic oligonucleotide; TCAGGATT chr2 60486665 60486684 60486681 +
gtgaacatgccaactcaaca

SEQ ID NO: 190679 - DNA, 20 bp, Artificial Sequence
  Synthetic oligonucleotide; TTAAGATT chr2 60486931 60486950 60486947 +
gaacaaattaatatttaatt

SEQ ID NO: 190680 - DNA, 20 bp, Artificial Sequence
  Synthetic oligonucleotide; GGGAGATT chr2 60486966 60486985 60486982 +
tatcagaataaaaaagactc

SEQ ID NO: 190681 - DNA, 20 bp, Artificial Sequence
  Synthetic oligonucleotide; GTGAGTTT chr2 60487044 60487063 60487060 +
atttaggagcgctagacaca

SEQ ID NO: 190682 - DNA, 20 bp, Artificial Sequence
  Synthetic oligonucleotide; CTGTGATT chr2 60487065 60487084 60487081 +
tgagtttccctgcctccaac

SEQ ID NO: 190683 - DNA, 20 bp, Artificial Sequence
  Synthetic oligonucleotide; AGTCGATT chr2 60487236 60487255 60487252 +
tccctaacctatattttgca

SEQ ID NO: 190684 - DNA, 20 bp, Artificial Sequence
  Synthetic oligonucleotide; TCAGGCTT chr2 60487293 60487312 60487309 +
agcccatgttacatctccag

SEQ ID NO: 190685 - DNA, 20 bp, Artificial Sequence
  Synthetic oligonucleotide; TTACGTTT chr2 60487380 60487399 60487396 +
gggagcagtgtagtgggcag

SEQ ID NO: 190686 - DNA, 20 bp, Artificial Sequence
  Synthetic oligonucleotide; TGTAGATT chr2 60487427 60487446 60487443 +
tgggaaatcgtcttctcaaa

SEQ ID NO: 190687 - DNA, 20 bp, Artificial Sequence
  Synthetic oligonucleotide; TACAGATT chr2 60487510 60487529 60487526 +
attagatatttaaaaatgaa

SEQ ID NO: 190688 - DNA, 20 bp, Artificial Sequence
  Synthetic oligonucleotide; TTCAGATT chr2 60487516 60487535 60487532 +
tatttaaaaatgaatacaga

SEQ ID NO: 190689 - DNA, 20 bp, Artificial Sequence
  Synthetic oligonucleotide; GAAGGCTT chr2 60487590 60487609 60487606 +
acaaaaaaaggcatgaaaaa

SEQ ID NO: 190690 - DNA, 20 bp, Artificial Sequence
  Synthetic oligonucleotide; AGAGGCTT chr2 60487714 60487733 60487730 +
gcagcagaatgtaaaaagca

SEQ ID NO: 190691 - DNA, 20 bp, Artificial Sequence
  Synthetic oligonucleotide; AAAGGTTT chr2 60487919 60487938 60487935 +
ccctgataacatctgccact

SEQ ID NO: 190692 - DNA, 20 bp, Artificial Sequence
  Synthetic oligonucleotide; CTTGGTTT chr2 60487932 60487951 60487948 +
tgccactaaaggtttactga

SEQ ID NO: 190693 - DNA, 20 bp, Artificial Sequence
  Synthetic oligonucleotide; AAATGCTT chr2 60488004 60488023 60488020 +
tatatgaacaattagatatt

SEQ ID NO: 190694 - DNA, 20 bp, Artificial Sequence
  Synthetic oligonucleotide; CTGGGTTT chr2 60488043 60488062 60488059 +
tctgtgctattacttttgac

SEQ ID NO: 190695 - DNA, 20 bp, Artificial Sequence
  Synthetic oligonucleotide; AAGAGTTT chr2 60488112 60488131 60488128 +
aaacatttaaattatcctgg

SEQ ID NO: 190696 - DNA, 20 bp, Artificial Sequence
  Synthetic oligonucleotide; GAGTGTTT chr2 60488139 60488158 60488155 +
tgtctcacgggctgttcaaa

SEQ ID NO: 190697 - DNA, 20 bp, Artificial Sequence
  Synthetic oligonucleotide; TCATGATT chr2 60488217 60488236 60488233 +
gcctgtaaaagatacctgag

SEQ ID NO: 190698 - DNA, 20 bp, Artificial Sequence
  Synthetic oligonucleotide; ACAGGATT chr2 60488404 60488423 60488420 +
gataataggacaatgccata

SEQ ID NO: 190699 - DNA, 20 bp, Artificial Sequence
  Synthetic oligonucleotide; ATCAGTTT chr2 60488472 60488491 60488488 +
tttaggtaatgtcatctatg

SEQ ID NO: 190700 - DNA, 20 bp, Artificial Sequence
  Synthetic oligonucleotide; TTTTGTTT chr2 60488478 60488497 60488494 +
taatgtcatctatgatcagt

SEQ ID NO: 190701 - DNA, 20 bp, Artificial Sequence
  Synthetic oligonucleotide; AATAGTTT chr2 60488552 60488571 60488568 +
gaaaccctgttatggctgta

SEQ ID NO: 190702 - DNA, 20 bp, Artificial Sequence
  Synthetic oligonucleotide; GTTTGCTT chr2 60488556 60488575 60488572 +
ccctgttatggctgtaaata

SEQ ID NO: 190703 - DNA, 20 bp, Artificial Sequence
  Synthetic oligonucleotide; TCTAGTTT chr2 60488616 60488635 60488632 +
aggggaattcggtaaaactt

SEQ ID NO: 190704 - DNA, 20 bp, Artificial Sequence
  Synthetic oligonucleotide; TTTTGCTT chr2 60488621 60488640 60488637 +
aattcggtaaaactttctag

SEQ ID NO: 190705 - DNA, 20 bp, Artificial Sequence
  Synthetic oligonucleotide; AAACGATT chr2 60488710 60488729 60488726 +
cctaaagccactgctaccca

SEQ ID NO: 190706 - DNA, 20 bp, Artificial Sequence
  Synthetic oligonucleotide; TTTTGTTT chr2 60488716 60488735 60488732 +
gccactgctacccaaaacga

SEQ ID NO: 190707 - DNA, 20 bp, Artificial Sequence
  Synthetic oligonucleotide; GTTTGTTT chr2 60488720 60488739 60488736 +
ctgctacccaaaacgatttt

SEQ ID NO: 190708 - DNA, 20 bp, Artificial Sequence
  Synthetic oligonucleotide; GTTTGTTT chr2 60488724 60488743 60488740 +
tacccaaaacgattttgttt

SEQ ID NO: 190709 - DNA, 20 bp, Artificial Sequence
  Synthetic oligonucleotide; GTTTGTTT chr2 60488728 60488747 60488744 +
caaaacgattttgtttgttt

SEQ ID NO: 190710 - DNA, 20 bp, Artificial Sequence
  Synthetic oligonucleotide; GTTTGTTT chr2 60488732 60488751 60488748 +
acgattttgtttgtttgttt

SEQ ID NO: 190711 - DNA, 20 bp, Artificial Sequence
  Synthetic oligonucleotide; GTTTGTTT chr2 60488736 60488755 60488752 +
ttttgtttgtttgtttgttt

SEQ ID NO: 190712 - DNA, 20 bp, Artificial Sequence
  Synthetic oligonucleotide; GTTTGTTT chr2 60488740 60488759 60488756 +
gtttgtttgtttgtttgttt

SEQ ID NO: 190713 - DNA, 20 bp, Artificial Sequence
  Synthetic oligonucleotide; TTTTGTTT chr2 60488747 60488766 60488763 +
tgtttgtttgtttgtttgtt

SEQ ID NO: 190714 - DNA, 20 bp, Artificial Sequence
  Synthetic oligonucleotide; TGGAGTTT chr2 60488761 60488780 60488777 +
tttgttttttgtttctgagg

SEQ ID NO: 190715 - DNA, 20 bp, Artificial Sequence
  Synthetic oligonucleotide; AAGCGATT chr2 60488839 60488858 60488855 +
aatctccgcctcccgggttc

SEQ ID NO: 190716 - DNA, 20 bp, Artificial Sequence
  Synthetic oligonucleotide; CTGGGATT chr2 60488871 60488890 60488887 +
tgcctcagcctcccaagtag

SEQ ID NO: 190717 - DNA, 20 bp, Artificial Sequence
  Synthetic oligonucleotide; CGGGGTTT chr2 60488928 60488947 60488944 +
ttctgtatttttggtagaga

SEQ ID NO: 190718 - DNA, 20 bp, Artificial Sequence
  Synthetic oligonucleotide; CTGGGATT chr2 60489006 60489025 60489022 +
cacctcagcctcccaaagtg

SEQ ID NO: 190719 - DNA, 20 bp, Artificial Sequence
  Synthetic oligonucleotide; AAATGTTT chr2 60489104 60489123 60489120 +
tcctaaataataggtggtca

SEQ ID NO: 190720 - DNA, 20 bp, Artificial Sequence
  Synthetic oligonucleotide; TGTTGCTT chr2 60489141 60489160 60489157 +
accttagaccccaattaaac

SEQ ID NO: 190721 - DNA, 20 bp, Artificial Sequence
  Synthetic oligonucleotide; TAGAGTTT chr2 60489149 60489168 60489165 +
ccccaattaaactgttgctt

SEQ ID NO: 190722 - DNA, 20 bp, Artificial Sequence
  Synthetic oligonucleotide; CTCTGCTT chr2 60489338 60489357 60489354 +
gcatttggaacccagtgcta

SEQ ID NO: 190723 - DNA, 20 bp, Artificial Sequence
  Synthetic oligonucleotide; GGAAGTTT chr2 60489366 60489385 60489382 +
cctaactaatttctgccgct

SEQ ID NO: 190724 - DNA, 20 bp, Artificial Sequence
  Synthetic oligonucleotide; AAAAGCTT chr2 60489515 60489534 60489531 +
ccaagtgaccagccacaaac

SEQ ID NO: 190725 - DNA, 20 bp, Artificial Sequence
  Synthetic oligonucleotide; GCTTGTTT chr2 60489519 60489538 60489535 +
gtgaccagccacaaacaaaa

SEQ ID NO: 190726 - DNA, 20 bp, Artificial Sequence
  Synthetic oligonucleotide; CTCTGCTT chr2 60489658 60489677 60489674 +
acactctgggtcactagcat

SEQ ID NO: 190727 - DNA, 20 bp, Artificial Sequence
  Synthetic oligonucleotide; AAATGTTT chr2 60489766 60489785 60489782 +
ccccctctcaccccatccaa

SEQ ID NO: 190728 - DNA, 20 bp, Artificial Sequence
  Synthetic oligonucleotide; GCTAGCTT chr2 60489786 60489805 60489802 +
aaatgtttactcaagttcag

SEQ ID NO: 190729 - DNA, 20 bp, Artificial Sequence
  Synthetic oligonucleotide; CCTTGATT chr2 60489983 60490002 60489999 +
caatacagaccctgatgggc

SEQ ID NO: 190730 - DNA, 20 bp, Artificial Sequence
  Synthetic oligonucleotide; GAAAGCTT chr2 60490043 60490062 60490059 +
aatgggggcaaaggcaaaag

SEQ ID NO: 190731 - DNA, 20 bp, Artificial Sequence
  Synthetic oligonucleotide; CCAAGATT chr2 60490052 60490071 60490068 +
aaaggcaaaaggaaagcttt

SEQ ID NO: 190732 - DNA, 20 bp, Artificial Sequence
  Synthetic oligonucleotide; CCTGGCTT chr2 60490463 60490482 60490479 +
ccttccgttctcatttcctt

SEQ ID NO: 190733 - DNA, 20 bp, Artificial Sequence
  Synthetic oligonucleotide; ATGAGTTT chr2 60490677 60490696 60490693 +
attaatttcatgtgttccca

SEQ ID NO: 190734 - DNA, 20 bp, Artificial Sequence
  Synthetic oligonucleotide; ACTTGCTT chr2 60490710 60490729 60490726 +
atacagggactctttctcct

SEQ ID NO: 190735 - DNA, 20 bp, Artificial Sequence
  Synthetic oligonucleotide; GACTGATT chr2 60490797 60490816 60490813 +
tcaacaaatagcatataaat

SEQ ID NO: 190736 - DNA, 20 bp, Artificial Sequence
  Synthetic oligonucleotide; CAAAGATT chr2 60490961 60490980 60490977 +
cagtaacatgttatgctaca

SEQ ID NO: 190737 - DNA, 20 bp, Artificial Sequence
  Synthetic oligonucleotide; TGAAGTTT chr2 60491026 60491045 60491042 +
accctggagaagagcaaatg

SEQ ID NO: 190738 - DNA, 20 bp, Artificial Sequence
  Synthetic oligonucleotide; TGCTGTTT chr2 60491237 60491256 60491253 +
ttctaaaaacgtattcttaa

SEQ ID NO: 190739 - DNA, 20 bp, Artificial Sequence
  Synthetic oligonucleotide; ATCAGTTT chr2 60491454 60491473 60491470 +
cctgaggtcaggagttcaag

SEQ ID NO: 190740 - DNA, 20 bp, Artificial Sequence
  Synthetic oligonucleotide; GATCGCTT chr2 60491562 60491581 60491578 +
ctcgggaggctgaggcagga

SEQ ID NO: 190741 - DNA, 20 bp, Artificial Sequence
  Synthetic oligonucleotide; AGACGTTT chr2 60491805 60491824 60491821 +
acccaacactacgcaggcac

SEQ ID NO: 190742 - DNA, 20 bp, Artificial Sequence
  Synthetic oligonucleotide; CTCCGCTT chr2 60492031 60492050 60492047 +
agatgctacattgttagcat

SEQ ID NO: 190743 - DNA, 20 bp, Artificial Sequence
  Synthetic oligonucleotide; GATGGCTT chr2 60492258 60492277 60492274 +
tcaggaggctgaggtgacag

SEQ ID NO: 190744 - DNA, 20 bp, Artificial Sequence
  Synthetic oligonucleotide; TAATGTTT chr2 60492388 60492407 60492404 +
caaaagacaactaattgggc

SEQ ID NO: 190745 - DNA, 20 bp, Artificial Sequence
  Synthetic oligonucleotide; AACAGATT chr2 60492484 60492503 60492500 +
gcctgctggaattctaggaa

SEQ ID NO: 190746 - DNA, 20 bp, Artificial Sequence
  Synthetic oligonucleotide; ATGCGCTT chr2 60492535 60492554 60492551 +
tcacatactcaccagtactc

SEQ ID NO: 190747 - DNA, 20 bp, Artificial Sequence
  Synthetic oligonucleotide; CTCTGCTT chr2 60492557 60492576 60492573 +
gcgcttctcagacccaaatg

SEQ ID NO: 190748 - DNA, 20 bp, Artificial Sequence
  Synthetic oligonucleotide; GGGTGTTT chr2 60492774 60492793 60492790 +
cttggttccactccagtggt

SEQ ID NO: 190749 - DNA, 20 bp, Artificial Sequence
  Synthetic oligonucleotide; TTTTGTTT chr2 60492779 60492798 60492795 +
ttccactccagtggtgggtg

SEQ ID NO: 190750 - DNA, 20 bp, Artificial Sequence
  Synthetic oligonucleotide; TTTTGTTT chr2 60492784 60492803 60492800 +
ctccagtggtgggtgttttg

SEQ ID NO: 190751 - DNA, 20 bp, Artificial Sequence
  Synthetic oligonucleotide; TTTCGCTT chr2 60492789 60492808 60492805 +
gtggtgggtgttttgttttg

SEQ ID NO: 190752 - DNA, 20 bp, Artificial Sequence
  Synthetic oligonucleotide; TTTAGCTT chr2 60492795 60492814 60492811 +
ggtgttttgttttgtttcgc

SEQ ID NO: 190753 - DNA, 20 bp, Artificial Sequence
  Synthetic oligonucleotide; GTTGGATT chr2 60492853 60492872 60492869 +
tcattcattttaagtgtaca

SEQ ID NO: 190754 - DNA, 20 bp, Artificial Sequence
  Synthetic oligonucleotide; TTGTGTTT chr2 60493075 60493094 60493091 +
ctcatacaggatatcgtctt

SEQ ID NO: 190755 - DNA, 20 bp, Artificial Sequence
  Synthetic oligonucleotide; GAATGATT chr2 60493101 60493120 60493117 +
ttaatttcttccacagagca

SEQ ID NO: 190756 - DNA, 20 bp, Artificial Sequence
  Synthetic oligonucleotide; CTGGGATT chr2 60493109 60493128 60493125 +
ttccacagagcagaatgatt

SEQ ID NO: 190757 - DNA, 20 bp, Artificial Sequence
  Synthetic oligonucleotide; GGGCGTTT chr2 60493179 60493198 60493195 +
ttgagttgtattccaccata

SEQ ID NO: 190758 - DNA, 20 bp, Artificial Sequence
  Synthetic oligonucleotide; ATGTGTTT chr2 60493269 60493288 60493285 +
ctacaatggacactgtgtag

SEQ ID NO: 190759 - DNA, 20 bp, Artificial Sequence
  Synthetic oligonucleotide; AAAGGTTT chr2 60493337 60493356 60493353 +
aggcatttcgagaacacaga

SEQ ID NO: 190760 - DNA, 20 bp, Artificial Sequence
  Synthetic oligonucleotide; TTGAGTTT chr2 60493344 60493363 60493360 +
tcgagaacacagaaaaggtt

SEQ ID NO: 190761 - DNA, 20 bp, Artificial Sequence
  Synthetic oligonucleotide; ATCTGTTT chr2 60493445 60493464 60493461 +
ccaaaccctatatcccagct

SEQ ID NO: 190762 - DNA, 20 bp, Artificial Sequence
  Synthetic oligonucleotide; CAAAGCTT chr2 60493787 60493806 60493803 +
ctgcccagtgctgtggacag

SEQ ID NO: 190763 - DNA, 20 bp, Artificial Sequence
  Synthetic oligonucleotide; TTAAGATT chr2 60493807 60493826 60493823 +
caaagcttcagtgcaggaaa

SEQ ID NO: 190764 - DNA, 20 bp, Artificial Sequence
  Synthetic oligonucleotide; ATCAGCTT chr2 60493842 60493861 60493858 +
cctccccctcccccatcctc

SEQ ID NO: 190765 - DNA, 20 bp, Artificial Sequence
  Synthetic oligonucleotide; AGCTGATT chr2 60493958 60493977 60493974 +
tggcctcaggcagtggcgga

SEQ ID NO: 190766 - DNA, 20 bp, Artificial Sequence
  Synthetic oligonucleotide; GGGAGTTT chr2 60494258 60494277 60494274 +
gaagacgtgggctgggagct

SEQ ID NO: 190767 - DNA, 20 bp, Artificial Sequence
  Synthetic oligonucleotide; TTTGGCTT chr2 60494263 60494282 60494279 +
cgtgggctgggagctgggag

SEQ ID NO: 190768 - DNA, 20 bp, Artificial Sequence
  Synthetic oligonucleotide; TAATGATT chr2 60494590 60494609 60494606 +
aataactcctagctcattcc

SEQ ID NO: 190769 - DNA, 20 bp, Artificial Sequence
  Synthetic oligonucleotide; ATATGCTT chr2 60494670 60494689 60494686 +
aaaataggaataataatagt

SEQ ID NO: 190770 - DNA, 20 bp, Artificial Sequence
  Synthetic oligonucleotide; TAGGGTTT chr2 60494680 60494699 60494696 +
taataatagtatatgcttca

SEQ ID NO: 190771 - DNA, 20 bp, Artificial Sequence
  Synthetic oligonucleotide; CCGAGCTT chr2 60494743 60494762 60494759 +
cctagagcagagtaagtgct

SEQ ID NO: 190772 - DNA, 20 bp, Artificial Sequence
  Synthetic oligonucleotide; CCTAGTTT chr2 60494829 60494848 60494845 +
atcaggccctttccccaatt

SEQ ID NO: 190773 - DNA, 20 bp, Artificial Sequence
  Synthetic oligonucleotide; GGAAGCTT chr2 60495026 60495045 60495042 +
gaggggagagtgcagacagg

SEQ ID NO: 190774 - DNA, 20 bp, Artificial Sequence
  Synthetic oligonucleotide; GTTAGCTT chr2 60495259 60495278 60495275 +
agcctgtgataaaagcaact

SEQ ID NO: 190775 - DNA, 20 bp, Artificial Sequence
  Synthetic oligonucleotide; ACTAGCTT chr2 60495274 60495293 60495290 +
caactgttagcttgcactag

SEQ ID NO: 190776 - DNA, 20 bp, Artificial Sequence
  Synthetic oligonucleotide; TATCGCTT chr2 60495427 60495446 60495443 +
ggggcatagagccagccctg

SEQ ID NO: 190777 - DNA, 20 bp, Artificial Sequence
  Synthetic oligonucleotide; TCTGGTTT chr2 60495547 60495566 60495563 +
tagaaccccctataaactag

SEQ ID NO: 190778 - DNA, 20 bp, Artificial Sequence
  Synthetic oligonucleotide; GGCTGTTT chr2 60495573 60495592 60495589 +
ttgcccatggggcacagtca

SEQ ID NO: 190779 - DNA, 20 bp, Artificial Sequence
  Synthetic oligonucleotide; TGATGCTT chr2 60495615 60495634 60495631 +
cagacattctctgcctgttg

SEQ ID NO: 190780 - DNA, 20 bp, Artificial Sequence
  Synthetic oligonucleotide; TGTGGTTT chr2 60495665 60495684 60495681 +
cacgtatgtgttgtgatccc

SEQ ID NO: 190781 - DNA, 20 bp, Artificial Sequence
  Synthetic oligonucleotide; GAGAGTTT chr2 60495673 60495692 60495689 +
tgttgtgatccctgtggttt

SEQ ID NO: 190782 - DNA, 20 bp, Artificial Sequence
  Synthetic oligonucleotide; TGGAGCTT chr2 60495680 60495699 60495696 +
atccctgtggtttgagagtt

SEQ ID NO: 190783 - DNA, 20 bp, Artificial Sequence
  Synthetic oligonucleotide; GGGTGTTT chr2 60495920 60495939 60495936 +
tgagagtctctaaattacaa

SEQ ID NO: 190784 - DNA, 20 bp, Artificial Sequence
  Synthetic oligonucleotide; GAAGGCTT chr2 60496052 60496071 60496068 +
gtgaaaagtcaattgataat

SEQ ID NO: 190785 - DNA, 20 bp, Artificial Sequence
  Synthetic oligonucleotide; AGATGATT chr2 60496077 60496096 60496093 +
ctttaggataaccggagggg

SEQ ID NO: 190786 - DNA, 20 bp, Artificial Sequence
  Synthetic oligonucleotide; AATGGATT chr2 60496108 60496127 60496124 +
agcaatgcacctgtgcagga

SEQ ID NO: 190787 - DNA, 20 bp, Artificial Sequence
  Synthetic oligonucleotide; ACACGTTT chr2 60496216 60496235 60496232 +
ttaagcaatggaagtccaat

SEQ ID NO: 190788 - DNA, 20 bp, Artificial Sequence
  Synthetic oligonucleotide; TGGAGCTT chr2 60496353 60496372 60496369 +
gcaagtgtccagggcagaac

SEQ ID NO: 190789 - DNA, 20 bp, Artificial Sequence
  Synthetic oligonucleotide; CAAGGATT chr2 60496545 60496564 60496561 +
actttgctgcaggttcaagg

SEQ ID NO: 190790 - DNA, 20 bp, Artificial Sequence
  Synthetic oligonucleotide; TCACGATT chr2 60496952 60496971 60496968 +
gtagcacttaatttctgtct

SEQ ID NO: 190791 - DNA, 20 bp, Artificial Sequence
  Synthetic oligonucleotide; TCTGGATT chr2 60496973 60496992 60496989 +
cacgattacttcacgataaa

SEQ ID NO: 190792 - DNA, 20 bp, Artificial Sequence
  Synthetic oligonucleotide; CTCTGTTT chr2 60497305 60497324 60497321 +
cgaagcatcgcctttaactg

SEQ ID NO: 190793 - DNA, 20 bp, Artificial Sequence
  Synthetic oligonucleotide; GTCAGATT chr2 60497319 60497338 60497335 +
taactgctctgtttgatcaa

SEQ ID NO: 190794 - DNA, 20 bp, Artificial Sequence
  Synthetic oligonucleotide; GAGTGCTT chr2 60497429 60497448 60497445 +
agcaggccaaggatatatga

SEQ ID NO: 190795 - DNA, 20 bp, Artificial Sequence
  Synthetic oligonucleotide; GACAGATT chr2 60497490 60497509 60497506 +
gaattagaacattccaggta

SEQ ID NO: 190796 - DNA, 20 bp, Artificial Sequence
  Synthetic oligonucleotide; AATAGCTT chr2 60497620 60497639 60497636 +
atgatgatgataataataat

SEQ ID NO: 190797 - DNA, 20 bp, Artificial Sequence
  Synthetic oligonucleotide; CCAAGCTT chr2 60497855 60497874 60497871 +
gcacattgtcctaaatgaaa

SEQ ID NO: 190798 - DNA, 20 bp, Artificial Sequence
  Synthetic oligonucleotide; CACCGCTT chr2 60497912 60497931 60497928 +
tagaagggggagcctggacc

SEQ ID NO: 190799 - DNA, 20 bp, Artificial Sequence
  Synthetic oligonucleotide; CAGAGATT chr2 60497958 60497977 60497974 +
ccataaaggtcagggtgttg

SEQ ID NO: 190800 - DNA, 20 bp, Artificial Sequence
  Synthetic oligonucleotide; ATTTGTTT chr2 60498567 60498586 60498583 +
tagccacctctggcacctgc

SEQ ID NO: 190801 - DNA, 20 bp, Artificial Sequence
  Synthetic oligonucleotide; ATAGGCTT chr2 60498593 60498612 60498609 +
ttttcaaattttaatagcaa

SEQ ID NO: 190802 - DNA, 20 bp, Artificial Sequence
  Synthetic oligonucleotide; TGTGGCTT chr2 60498779 60498798 60498795 +
tctctgaggagctagagact

SEQ ID NO: 190803 - DNA, 20 bp, Artificial Sequence
  Synthetic oligonucleotide; CTACGTTT chr2 60498895 60498914 60498911 +
ctgtccaactcatccagaaa

SEQ ID NO: 190804 - DNA, 20 bp, Artificial Sequence
  Synthetic oligonucleotide; CAGTGTTT chr2 60498968 60498987 60498984 +
gcattgatgagaggcagggc

SEQ ID NO: 190805 - DNA, 20 bp, Artificial Sequence
  Synthetic oligonucleotide; CACTGATT chr2 60498994 60499013 60499010 +
ttcttcttcattttccattc

SEQ ID NO: 190806 - DNA, 20 bp, Artificial Sequence
  Synthetic oligonucleotide; GCTGGCTT chr2 60499057 60499076 60499073 +
acagctacagtccatttctc

SEQ ID NO: 190807 - DNA, 20 bp, Artificial Sequence
  Synthetic oligonucleotide; TCAGGTTT chr2 60499101 60499120 60499117 +
tacaatgtgttccccagtat

SEQ ID NO: 190808 - DNA, 20 bp, Artificial Sequence
  Synthetic oligonucleotide; GGCTGATT chr2 60499461 60499480 60499477 +
aaagagcctgaggcccaata

SEQ ID NO: 190809 - DNA, 20 bp, Artificial Sequence
  Synthetic oligonucleotide; CAGTGTTT chr2 60499562 60499581 60499578 +
aacgtcccactttctcaaga

SEQ ID NO: 190810 - DNA, 20 bp, Artificial Sequence
  Synthetic oligonucleotide; CTAAGATT chr2 60499889 60499908 60499905 +
ctgctagacctcaagcagga

SEQ ID NO: 190811 - DNA, 20 bp, Artificial Sequence
  Synthetic oligonucleotide; GGCTGTTT chr2 60499981 60500000 60499997 +
aggcactcaccccactgcca

SEQ ID NO: 190812 - DNA, 20 bp, Artificial Sequence
  Synthetic oligonucleotide; TGGTGTTT chr2 60499998 60500017 60500014 +
ccaggctgtttactcttagc

SEQ ID NO: 190813 - DNA, 20 bp, Artificial Sequence
  Synthetic oligonucleotide; GTGAGATT chr2 60500089 60500108 60500105 +
ctgcctgaggctgcctgcca

SEQ ID NO: 190814 - DNA, 20 bp, Artificial Sequence
  Synthetic oligonucleotide; CAGGGCTT chr2 60500103 60500122 60500119 +
ctgccagtgagattgcatgt

SEQ ID NO: 190815 - DNA, 20 bp, Artificial Sequence
  Synthetic oligonucleotide; CTCTGCTT chr2 60500334 60500353 60500350 +
gttcccccattatgcactgc

SEQ ID NO: 190816 - DNA, 20 bp, Artificial Sequence
  Synthetic oligonucleotide; CTCAGTTT chr2 60500836 60500855 60500852 +
gctctttaacctctccaagc

SEQ ID NO: 190817 - DNA, 20 bp, Artificial Sequence
  Synthetic oligonucleotide; GTGGGCTT chr2 60500940 60500959 60500956 +
tgtgaagcaagcctagctgg

SEQ ID NO: 190818 - DNA, 20 bp, Artificial Sequence
  Synthetic oligonucleotide; ACCTGTTT chr2 60501098 60501117 60501114 +
ggcacatcttctgaaacaag

SEQ ID NO: 190819 - DNA, 20 bp, Artificial Sequence
  Synthetic oligonucleotide; TATTGTTT chr2 60501150 60501169 60501166 +
aattttgcacttatttatat

SEQ ID NO: 190820 - DNA, 20 bp, Artificial Sequence
  Synthetic oligonucleotide; TTCTGCTT chr2 60501175 60501194 60501191 +
tttcagaaacactaccttca

SEQ ID NO: 190821 - DNA, 20 bp, Artificial Sequence
  Synthetic oligonucleotide; CTTTGATT chr2 60501180 60501199 60501196 +
gaaacactaccttcattctg

SEQ ID NO: 190822 - DNA, 20 bp, Artificial Sequence
  Synthetic oligonucleotide; ATATGATT chr2 60501378 60501397 60501394 +
aaatgaagaacactcttgta

SEQ ID NO: 190823 - DNA, 20 bp, Artificial Sequence
  Synthetic oligonucleotide; CCTGGTTT chr2 60501406 60501425 60501422 +
aatcacttccaaatacttta

SEQ ID NO: 190824 - DNA, 20 bp, Artificial Sequence
  Synthetic oligonucleotide; GGGTGCTT chr2 60501428 60501447 60501444 +
tggtttgtaagttctctttc

SEQ ID NO: 190825 - DNA, 20 bp, Artificial Sequence
  Synthetic oligonucleotide; CACCGCTT chr2 60501476 60501495 60501492 +
aggccttttgcaagtactga

SEQ ID NO: 190826 - DNA, 20 bp, Artificial Sequence
  Synthetic oligonucleotide; CAGAGTTT chr2 60501511 60501530 60501527 +
ttttttttttttttttgaga

SEQ ID NO: 190827 - DNA, 20 bp, Artificial Sequence
  Synthetic oligonucleotide; CTGGGATT chr2 60501618 60501637 60501634 +
tccctcagcctcctgagtag

SEQ ID NO: 190828 - DNA, 20 bp, Artificial Sequence
  Synthetic oligonucleotide; CTAAGTTT chr2 60501650 60501669 60501666 +
gcatgtgcgaccatgcctgg

SEQ ID NO: 190829 - DNA, 20 bp, Artificial Sequence
  Synthetic oligonucleotide; TGAGGTTT chr2 60501674 60501693 60501690 +
gtttatatttttaatagaga

SEQ ID NO: 190830 - DNA, 20 bp, Artificial Sequence
  Synthetic oligonucleotide; CACTGCTT chr2 60501789 60501808 60501805 +
agccactgcgcccagcctta

SEQ ID NO: 190831 - DNA, 20 bp, Artificial Sequence
  Synthetic oligonucleotide; TTATGTTT chr2 60501955 60501974 60501971 +
aattatggaataaagtagta

SEQ ID NO: 190832 - DNA, 20 bp, Artificial Sequence
  Synthetic oligonucleotide; CAGAGCTT chr2 60502007 60502026 60502023 +
taggtgaaatctcaggctaa

SEQ ID NO: 190833 - DNA, 20 bp, Artificial Sequence
  Synthetic oligonucleotide; AGAGGTTT chr2 60502090 60502109 60502106 +
ccagaagtcctggaaaactg

SEQ ID NO: 190834 - DNA, 20 bp, Artificial Sequence
  Synthetic oligonucleotide; ATGAGCTT chr2 60502193 60502212 60502209 +
cagagatcaggtccctccaa

SEQ ID NO: 190835 - DNA, 20 bp, Artificial Sequence
  Synthetic oligonucleotide; TACAGTTT chr2 60502200 60502219 60502216 +
caggtccctccaaatgagct

SEQ ID NO: 190836 - DNA, 20 bp, Artificial Sequence
  Synthetic oligonucleotide; TCCTGCTT chr2 60502212 60502231 60502228 +
aatgagcttacagtttatga

SEQ ID NO: 190837 - DNA, 20 bp, Artificial Sequence
  Synthetic oligonucleotide; AGCAGATT chr2 60502250 60502269 60502266 +
ggtgaaacaaaatgatggat

SEQ ID NO: 190838 - DNA, 20 bp, Artificial Sequence
  Synthetic oligonucleotide; ATCAGATT chr2 60502407 60502426 60502423 +
acagacagaataacttcttc

SEQ ID NO: 190839 - DNA, 20 bp, Artificial Sequence
  Synthetic oligonucleotide; GGGGGTTT chr2 60502428 60502447 60502444 +
tcagattcagaagagtagca

SEQ ID NO: 190840 - DNA, 20 bp, Artificial Sequence
  Synthetic oligonucleotide; CACAGATT chr2 60502444 60502463 60502460 +
agcagggggtttctcgctag

SEQ ID NO: 190841 - DNA, 20 bp, Artificial Sequence
  Synthetic oligonucleotide; GCCAGCTT chr2 60502519 60502538 60502535 +
gtattgctcctaaagaaaga

SEQ ID NO: 190842 - DNA, 20 bp, Artificial Sequence
  Synthetic oligonucleotide; CCATGCTT chr2 60502576 60502595 60502592 +
agcagtgttcacacccaatc

SEQ ID NO: 190843 - DNA, 20 bp, Artificial Sequence
  Synthetic oligonucleotide; AAGAGATT chr2 60502622 60502641 60502638 +
atttaagaaataccagtgaa

SEQ ID NO: 190844 - DNA, 20 bp, Artificial Sequence
  Synthetic oligonucleotide; AACTGTTT chr2 60502679 60502698 60502695 +
tgttcttgatatgttaataa

SEQ ID NO: 190845 - DNA, 20 bp, Artificial Sequence
  Synthetic oligonucleotide; ACTGGCTT chr2 60502998 60503017 60503014 +
ggctgtctagggggatggct

SEQ ID NO: 190846 - DNA, 20 bp, Artificial Sequence
  Synthetic oligonucleotide; TATTGCTT chr2 60503409 60503428 60503425 +
gtccctggaagacagtaggc

SEQ ID NO: 190847 - DNA, 20 bp, Artificial Sequence
  Synthetic oligonucleotide; ATTAGATT chr2 60503496 60503515 60503512 +
cataaccctccctcctatcc

SEQ ID NO: 190848 - DNA, 20 bp, Artificial Sequence
  Synthetic oligonucleotide; TCAGGCTT chr2 60503577 60503596 60503593 +
tcccaataccagtggctctt

SEQ ID NO: 190849 - DNA, 20 bp, Artificial Sequence
  Synthetic oligonucleotide; GGTGGTTT chr2 60503595 60503614 60503611 +
tttcaggcttacaaagcctt

SEQ ID NO: 190850 - DNA, 20 bp, Artificial Sequence
  Synthetic oligonucleotide; AGAAGATT chr2 60503734 60503753 60503750 +
aggactaatttaacccgcct

SEQ ID NO: 190851 - DNA, 20 bp, Artificial Sequence
  Synthetic oligonucleotide; CAGAGCTT chr2 60503801 60503820 60503817 +
caatattctggatcttttgt

SEQ ID NO: 190852 - DNA, 20 bp, Artificial Sequence
  Synthetic oligonucleotide; GGCTGCTT chr2 60503880 60503899 60503896 +
cctcctgaaaattggttatt

SEQ ID NO: 190853 - DNA, 20 bp, Artificial Sequence
  Synthetic oligonucleotide; CGTTGATT chr2 60503888 60503907 60503904 +
aaattggttattggctgctt

SEQ ID NO: 190854 - DNA, 20 bp, Artificial Sequence
  Synthetic oligonucleotide; CATGGCTT chr2 60504021 60504040 60504037 +
agaagcctgctggaagccta

SEQ ID NO: 190855 - DNA, 20 bp, Artificial Sequence
  Synthetic oligonucleotide; TGTGGTTT chr2 60504198 60504217 60504214 +
ccccagggctcatgctgcac

SEQ ID NO: 190856 - DNA, 20 bp, Artificial Sequence
  Synthetic oligonucleotide; GCAAGATT chr2 60504313 60504332 60504329 +
cccttcctttcttagtcact

SEQ ID NO: 190857 - DNA, 20 bp, Artificial Sequence
  Synthetic oligonucleotide; TCTGGTTT chr2 60504464 60504483 60504480 +
aaagtcaacctctgactact

SEQ ID NO: 190858 - DNA, 20 bp, Artificial Sequence
  Synthetic oligonucleotide; AGAAGCTT chr2 60504682 60504701 60504698 +
tacagctgatgtatttactg

SEQ ID NO: 190859 - DNA, 20 bp, Artificial Sequence
  Synthetic oligonucleotide; TCAAGCTT chr2 60504692 60504711 60504708 +
gtatttactgagaagcttct

SEQ ID NO: 190860 - DNA, 20 bp, Artificial Sequence
  Synthetic oligonucleotide; TGGTGCTT chr2 60504705 60504724 60504721 +
agcttcttcaagctttctac

SEQ ID NO: 190861 - DNA, 20 bp, Artificial Sequence
  Synthetic oligonucleotide; AAATGCTT chr2 60504782 60504801 60504798 +
aggtacatatctgtccctga

SEQ ID NO: 190862 - DNA, 20 bp, Artificial Sequence
  Synthetic oligonucleotide; AACTGATT chr2 60504799 60504818 60504815 +
tgaaaatgcttaaaagatca

SEQ ID NO: 190863 - DNA, 20 bp, Artificial Sequence
  Synthetic oligonucleotide; ACTAGCTT chr2 60504843 60504862 60504859 +
cctaccagtgagcgcccacc

SEQ ID NO: 190864 - DNA, 20 bp, Artificial Sequence
  Synthetic oligonucleotide; CTAAGCTT chr2 60505036 60505055 60505052 +
agacctgccatttaacctct

SEQ ID NO: 190865 - DNA, 20 bp, Artificial Sequence
  Synthetic oligonucleotide; AAGGGCTT chr2 60505114 60505133 60505130 +
caatttgacaatactcctca

SEQ ID NO: 190866 - DNA, 20 bp, Artificial Sequence
  Synthetic oligonucleotide; ATGTGATT chr2 60505135 60505154 60505151 +
agggcttactcaaaaaaaaa

SEQ ID NO: 190867 - DNA, 20 bp, Artificial Sequence
  Synthetic oligonucleotide; AACGGCTT chr2 60505258 60505277 60505274 +
agaagggacggatactcaga

SEQ ID NO: 190868 - DNA, 20 bp, Artificial Sequence
  Synthetic oligonucleotide; TCCAGATT chr2 60505293 60505312 60505309 +
gtcctttggcaccccattct

SEQ ID NO: 190869 - DNA, 20 bp, Artificial Sequence
  Synthetic oligonucleotide; GTCAGCTT chr2 60505387 60505406 60505403 +
tgaaatgtgttggagcagct

SEQ ID NO: 190870 - DNA, 20 bp, Artificial Sequence
  Synthetic oligonucleotide; GGGTGCTT chr2 60505476 60505495 60505492 +
catccacacagggaacaagc

SEQ ID NO: 190871 - DNA, 20 bp, Artificial Sequence
  Synthetic oligonucleotide; TAGGGCTT chr2 60505970 60505989 60505986 +
catttggtaaataacccaaa

SEQ ID NO: 190872 - DNA, 20 bp, Artificial Sequence
  Synthetic oligonucleotide; CTAGGCTT chr2 60505999 60506018 60506015 +
gcagggtatgggacaccaca

SEQ ID NO: 190873 - DNA, 20 bp, Artificial Sequence
  Synthetic oligonucleotide; GGCTGCTT chr2 60506584 60506603 60506600 +
acccacgtgcctttgtgcat

SEQ ID NO: 190874 - DNA, 20 bp, Artificial Sequence
  Synthetic oligonucleotide; GCATGTTT chr2 60506689 60506708 60506705 +
accactgatgacagcccccc

SEQ ID NO: 190875 - DNA, 20 bp, Artificial Sequence
  Synthetic oligonucleotide; CTGAGATT chr2 60506759 60506778 60506775 +
ctcaaataatgtctataatg

SEQ ID NO: 190876 - DNA, 20 bp, Artificial Sequence
  Synthetic oligonucleotide; ATGTGATT chr2 60506786 60506805 60506802 +
ttatacatgggtacttataa

SEQ ID NO: 190877 - DNA, 20 bp, Artificial Sequence
  Synthetic oligonucleotide; AGCTGTTT chr2 60506975 60506994 60506991 +
taaacatgttggcgtaactg

SEQ ID NO: 190878 - DNA, 20 bp, Artificial Sequence
  Synthetic oligonucleotide; CAAGGATT chr2 60507135 60507154 60507151 +
tatcccaacagacagagggc

SEQ ID NO: 190879 - DNA, 20 bp, Artificial Sequence
  Synthetic oligonucleotide; AGCTGCTT chr2 60507449 60507468 60507465 +
ttgtgctcttgttgacttga

SEQ ID NO: 190880 - DNA, 20 bp, Artificial Sequence
  Synthetic oligonucleotide; AAGTGCTT chr2 60507488 60507507 60507504 +
agaaaagttaaaaccttgtg

SEQ ID NO: 190881 - DNA, 20 bp, Artificial Sequence
  Synthetic oligonucleotide; AGATGTTT chr2 60507506 60507525 60507522 +
tgaagtgcttttacattttc

SEQ ID NO: 190882 - DNA, 20 bp, Artificial Sequence
  Synthetic oligonucleotide; AACTGTTT chr2 60507551 60507570 60507567 +
tgaggacaggcaaggggaag

SEQ ID NO: 190883 - DNA, 20 bp, Artificial Sequence
  Synthetic oligonucleotide; AGCTGTTT chr2 60507567 60507586 60507583 +
gaagaactgtttccacatgc

SEQ ID NO: 190884 - DNA, 20 bp, Artificial Sequence
  Synthetic oligonucleotide; CTGAGCTT chr2 60507629 60507648 60507645 +
gggctgcctccgcacctgag

SEQ ID NO: 190885 - DNA, 20 bp, Artificial Sequence
  Synthetic oligonucleotide; TACTGCTT chr2 60507653 60507672 60507669 +
gcttgctgtcctaagtcggc

SEQ ID NO: 190886 - DNA, 20 bp, Artificial Sequence
  Synthetic oligonucleotide; CCCAGCTT chr2 60507668 60507687 60507684 +
tcggctactgcttctaagtc

SEQ ID NO: 190887 - DNA, 20 bp, Artificial Sequence
  Synthetic oligonucleotide; TATGGATT chr2 60507869 60507888 60507885 +
gcatactatgggataattac

SEQ ID NO: 190888 - DNA, 20 bp, Artificial Sequence
  Synthetic oligonucleotide; TACAGTTT chr2 60507882 60507901 60507898 +
taattactatggattattat

SEQ ID NO: 190889 - DNA, 20 bp, Artificial Sequence
  Synthetic oligonucleotide; CGCAGATT chr2 60507936 60507955 60507952 +
cacaaaagacatattacaca

SEQ ID NO: 190890 - DNA, 20 bp, Artificial Sequence
  Synthetic oligonucleotide; TAAAGCTT chr2 60507946 60507965 60507962 +
atattacacacgcagatttc

SEQ ID NO: 190891 - DNA, 20 bp, Artificial Sequence
  Synthetic oligonucleotide; TGGTGCTT chr2 60508072 60508091 60508088 +
cctgaaattctctcatgtca

SEQ ID NO: 190892 - DNA, 20 bp, Artificial Sequence
  Synthetic oligonucleotide; AGAAGCTT chr2 60508300 60508319 60508316 +
tgatgtgaaagaggagacag

SEQ ID NO: 190893 - DNA, 20 bp, Artificial Sequence
  Synthetic oligonucleotide; CTTTGCTT chr2 60508533 60508552 60508549 +
ttttcctgttctgaagagga

SEQ ID NO: 190894 - DNA, 20 bp, Artificial Sequence
  Synthetic oligonucleotide; CTCAGCTT chr2 60508653 60508672 60508669 +
tggacacggcaggaaacagc

SEQ ID NO: 190895 - DNA, 20 bp, Artificial Sequence
  Synthetic oligonucleotide; CTATGATT chr2 60508805 60508824 60508821 +
tgagctcccccttgggttac

SEQ ID NO: 190896 - DNA, 20 bp, Artificial Sequence
  Synthetic oligonucleotide; AAGAGTTT chr2 60508817 60508836 60508833 +
tgggttacctatgattccag

SEQ ID NO: 190897 - DNA, 20 bp, Artificial Sequence
  Synthetic oligonucleotide; CTGTGATT chr2 60508989 60509008 60509005 +
ggaacctgtcactggttctt

SEQ ID NO: 190898 - DNA, 20 bp, Artificial Sequence
  Synthetic oligonucleotide; ACAGGCTT chr2 60509079 60509098 60509095 +
tctcatcagactccgaaatc

SEQ ID NO: 190899 - DNA, 20 bp, Artificial Sequence
  Synthetic oligonucleotide; TAAAGATT chr2 60509093 60509112 60509109 +
gaaatcacaggcttctggtc

SEQ ID NO: 190900 - DNA, 20 bp, Artificial Sequence
  Synthetic oligonucleotide; ATTTGTTT chr2 60509123 60509142 60509139 +
agctgagaaacaagaaagca

SEQ ID NO: 190901 - DNA, 20 bp, Artificial Sequence
  Synthetic oligonucleotide; GTTTGATT chr2 60509127 60509146 60509143 +
gagaaacaagaaagcaattt

SEQ ID NO: 190902 - DNA, 20 bp, Artificial Sequence
  Synthetic oligonucleotide; CTCAGCTT chr2 60509173 60509192 60509189 +
cccccaataatttacttggt

SEQ ID NO: 190903 - DNA, 20 bp, Artificial Sequence
  Synthetic oligonucleotide; GCTGGCTT chr2 60509183 60509202 60509199 +
tttacttggtctcagctttg

SEQ ID NO: 190904 - DNA, 20 bp, Artificial Sequence
  Synthetic oligonucleotide; TGAGGATT chr2 60509199 60509218 60509215 +
tttggctggcttggatgtta

SEQ ID NO: 190905 - DNA, 20 bp, Artificial Sequence
  Synthetic oligonucleotide; AACGGATT chr2 60509335 60509354 60509351 +
gaacctgtggaaaagaggac

SEQ ID NO: 190906 - DNA, 20 bp, Artificial Sequence
  Synthetic oligonucleotide; TGCAGCTT chr2 60509475 60509494 60509491 +
ctgagaagtccaggaaaaga

SEQ ID NO: 190907 - DNA, 20 bp, Artificial Sequence
  Synthetic oligonucleotide; AAAAGATT chr2 60509649 60509668 60509665 +
acagagaaggaaaaagaaca

SEQ ID NO: 190908 - DNA, 20 bp, Artificial Sequence
  Synthetic oligonucleotide; GCCGGTTT chr2 60509996 60510015 60510012 +
cccaccagtcagcaaatcct

SEQ ID NO: 190909 - DNA, 20 bp, Artificial Sequence
  Synthetic oligonucleotide; GACTGCTT chr2 60510094 60510113 60510110 +
ttgcctaaaatttgccttct

SEQ ID NO: 190910 - DNA, 20 bp, Artificial Sequence
  Synthetic oligonucleotide; CCATGCTT chr2 60510115 60510134 60510131 +
actgcttctgcctcactttc

SEQ ID NO: 190911 - DNA, 20 bp, Artificial Sequence
  Synthetic oligonucleotide; AGTGGCTT chr2 60510185 60510204 60510201 +
tcatatgacatcactcctcc

SEQ ID NO: 190912 - DNA, 20 bp, Artificial Sequence
  Synthetic oligonucleotide; CTTTGCTT chr2 60510419 60510438 60510435 +
cttcctcacctctttggagc

SEQ ID NO: 190913 - DNA, 20 bp, Artificial Sequence
  Synthetic oligonucleotide; GGCAGTTT chr2 60510512 60510531 60510528 +
ccccaccttattttcgtgca

SEQ ID NO: 190914 - DNA, 20 bp, Artificial Sequence
  Synthetic oligonucleotide; GGGAGTTT chr2 60510608 60510627 60510624 +
aagggggtgccacaagagca

SEQ ID NO: 190915 - DNA, 20 bp, Artificial Sequence
  Synthetic oligonucleotide; TAAGGCTT chr2 60510617 60510636 60510633 +
ccacaagagcagggagtttt

SEQ ID NO: 190916 - DNA, 20 bp, Artificial Sequence
  Synthetic oligonucleotide; TTTAGCTT chr2 60510779 60510798 60510795 +
gcagcccaacctgggggcac

SEQ ID NO: 190917 - DNA, 20 bp, Artificial Sequence
  Synthetic oligonucleotide; TTGGGTTT chr2 60510793 60510812 60510809 +
gggcactttagctttggatc

SEQ ID NO: 190918 - DNA, 20 bp, Artificial Sequence
  Synthetic oligonucleotide; GCCAGATT chr2 60510803 60510822 60510819 +
gctttggatcttgggtttga

SEQ ID NO: 190919 - DNA, 20 bp, Artificial Sequence
  Synthetic oligonucleotide; AAGAGCTT chr2 60510844 60510863 60510860 +
aggccctgagacccacaggg

SEQ ID NO: 190920 - DNA, 20 bp, Artificial Sequence
  Synthetic oligonucleotide; GCTGGTTT chr2 60510881 60510900 60510897 +
aatgtaaatggaggggttga

SEQ ID NO: 190921 - DNA, 20 bp, Artificial Sequence
  Synthetic oligonucleotide; TAAGGCTT chr2 60510937 60510956 60510953 +
aaccaaacgaaagtctttcc

SEQ ID NO: 190922 - DNA, 20 bp, Artificial Sequence
  Synthetic oligonucleotide; CTGCGTTT chr2 60511039 60511058 60511055 +
cactggggctgtgcagccaa

SEQ ID NO: 190923 - DNA, 20 bp, Artificial Sequence
  Synthetic oligonucleotide; TCTTGCTT chr2 60511146 60511165 60511162 +
cggcattactctccctccat

SEQ ID NO: 190924 - DNA, 20 bp, Artificial Sequence
  Synthetic oligonucleotide; TTCAGATT chr2 60511153 60511172 60511169 +
actctccctccattcttgct

SEQ ID NO: 190925 - DNA, 20 bp, Artificial Sequence
  Synthetic oligonucleotide; CCATGTTT chr2 60511470 60511489 60511486 +
gtgctaatggccacttgtta

SEQ ID NO: 190926 - DNA, 20 bp, Artificial Sequence
  Synthetic oligonucleotide; CTCTGATT chr2 60511496 60511515 60511512 +
ttcataatgctaatatttcc

SEQ ID NO: 190927 - DNA, 20 bp, Artificial Sequence
  Synthetic oligonucleotide; ATCTGATT chr2 60511566 60511585 60511582 +
tttaagttaacagagcgcta

SEQ ID NO: 190928 - DNA, 20 bp, Artificial Sequence
  Synthetic oligonucleotide; CATTGCTT chr2 60511629 60511648 60511645 +
actgcactattaatgacaac

SEQ ID NO: 190929 - DNA, 20 bp, Artificial Sequence
  Synthetic oligonucleotide; CCAAGCTT chr2 60511790 60511809 60511806 +
ggggagtcattaattcttct

SEQ ID NO: 190930 - DNA, 20 bp, Artificial Sequence
  Synthetic oligonucleotide; CTCTGTTT chr2 60511804 60511823 60511820 +
tcttctccaagctttcaaca

SEQ ID NO: 190931 - DNA, 20 bp, Artificial Sequence
  Synthetic oligonucleotide; GGGAGCTT chr2 60511832 60511851 60511848 +
ctatgaaggcaagggttgga

SEQ ID NO: 190932 - DNA, 20 bp, Artificial Sequence
  Synthetic oligonucleotide; AGGTGCTT chr2 60511870 60511889 60511886 +
aataaatcagtaaaatgatg

SEQ ID NO: 190933 - DNA, 20 bp, Artificial Sequence
  Synthetic oligonucleotide; TAACGCTT chr2 60512000 60512019 60512016 +
ttgctcggccaaagacatag

SEQ ID NO: 190934 - DNA, 20 bp, Artificial Sequence
  Synthetic oligonucleotide; CTGGGCTT chr2 60512061 60512080 60512077 +
atgaatatgtgtgcagccac

SEQ ID NO: 190935 - DNA, 20 bp, Artificial Sequence
  Synthetic oligonucleotide; GCCTGCTT chr2 60512171 60512190 60512187 +
ggagagcagtcagagaggaa

SEQ ID NO: 190936 - DNA, 20 bp, Artificial Sequence
  Synthetic oligonucleotide; AGATGTTT chr2 60512184 60512203 60512200 +
agaggaagcctgctttcctc

SEQ ID NO: 190937 - DNA, 20 bp, Artificial Sequence
  Synthetic oligonucleotide; TTGGGCTT chr2 60512282 60512301 60512298 +
tggaactcagaatcattcat

SEQ ID NO: 190938 - DNA, 20 bp, Artificial Sequence
  Synthetic oligonucleotide; TTGAGCTT chr2 60512357 60512376 60512373 +
acctcccttggcctgtgtcc

SEQ ID NO: 190939 - DNA, 20 bp, Artificial Sequence
  Synthetic oligonucleotide; GGCAGCTT chr2 60512455 60512474 60512471 +
ctcgcctctcaaatgagaaa

SEQ ID NO: 190940 - DNA, 20 bp, Artificial Sequence
  Synthetic oligonucleotide; GGATGCTT chr2 60512470 60512489 60512486 +
agaaaggcagctttgagaga

SEQ ID NO: 190941 - DNA, 20 bp, Artificial Sequence
  Synthetic oligonucleotide; GATGGTTT chr2 60512666 60512685 60512682 +
attttgcatatctaattgga

SEQ ID NO: 190942 - DNA, 20 bp, Artificial Sequence
  Synthetic oligonucleotide; GACAGTTT chr2 60512751 60512770 60512767 +
gacgttcacagccttatgaa

SEQ ID NO: 190943 - DNA, 20 bp, Artificial Sequence
  Synthetic oligonucleotide; GCAGGTTT chr2 60512814 60512833 60512830 +
gatgacggataggagaacaa

SEQ ID NO: 190944 - DNA, 20 bp, Artificial Sequence
  Synthetic oligonucleotide; AGGAGTTT chr2 60512907 60512926 60512923 +
tttggaggagacacagagaa

SEQ ID NO: 190945 - DNA, 20 bp, Artificial Sequence
  Synthetic oligonucleotide; CAGAGATT chr2 60512931 60512950 60512947 +
gtttcacctcttagacgtct

SEQ ID NO: 190946 - DNA, 20 bp, Artificial Sequence
  Synthetic oligonucleotide; CTAGGTTT chr2 60513200 60513219 60513216 +
cagagtcaggatgactctca

SEQ ID NO: 190947 - DNA, 20 bp, Artificial Sequence
  Synthetic oligonucleotide; GGGTGCTT chr2 60513354 60513373 60513370 +
tccctcaggagccatctgcc

SEQ ID NO: 190948 - DNA, 20 bp, Artificial Sequence
  Synthetic oligonucleotide; TGCTGCTT chr2 60513497 60513516 60513513 +
tagcctctagccagaactcc

SEQ ID NO: 190949 - DNA, 20 bp, Artificial Sequence
  Synthetic oligonucleotide; CAGAGATT chr2 60513835 60513854 60513851 +
actctctcttctcaacaagc

SEQ ID NO: 190950 - DNA, 20 bp, Artificial Sequence
  Synthetic oligonucleotide; CCTGGCTT chr2 60513884 60513903 60513900 +
ctccatgaagagaagctgtt

SEQ ID NO: 190951 - DNA, 20 bp, Artificial Sequence
  Synthetic oligonucleotide; CCTGGATT chr2 60513908 60513927 60513924 +
gcttgtggtgagcaaaactc

SEQ ID NO: 190952 - DNA, 20 bp, Artificial Sequence
  Synthetic oligonucleotide; CCTGGATT chr2 60513925 60513944 60513941 +
ctccctggattgagtcgaga

SEQ ID NO: 190953 - DNA, 20 bp, Artificial Sequence
  Synthetic oligonucleotide; AGAGGCTT chr2 60514125 60514144 60514141 +
agtgctccaagcactctctg

SEQ ID NO: 190954 - DNA, 20 bp, Artificial Sequence
  Synthetic oligonucleotide; AGAGGCTT chr2 60514149 60514168 60514165 +
gcttccaggctggagctctg

SEQ ID NO: 190955 - DNA, 20 bp, Artificial Sequence
  Synthetic oligonucleotide; GGGAGTTT chr2 60514676 60514695 60514692 +
aaaaaaattaaattgggtgg

SEQ ID NO: 190956 - DNA, 20 bp, Artificial Sequence
  Synthetic oligonucleotide; AGAGGATT chr2 60514792 60514811 60514808 +
ctgtgaattccattgataag

SEQ ID NO: 190957 - DNA, 20 bp, Artificial Sequence
  Synthetic oligonucleotide; TCTAGCTT chr2 60514995 60515014 60515011 +
ctccctctggtgagacaggc

SEQ ID NO: 190958 - DNA, 20 bp, Artificial Sequence
  Synthetic oligonucleotide; GCTTGTTT chr2 60514999 60515018 60515015 +
ctctggtgagacaggctcta

SEQ ID NO: 190959 - DNA, 20 bp, Artificial Sequence
  Synthetic oligonucleotide; ACCAGCTT chr2 60515020 60515039 60515036 +
cttgtttccagaatgccact

SEQ ID NO: 190960 - DNA, 20 bp, Artificial Sequence
  Synthetic oligonucleotide; ACTGGCTT chr2 60515107 60515126 60515123 +
ccacgtgctccttccccaac

SEQ ID NO: 190961 - DNA, 20 bp, Artificial Sequence
  Synthetic oligonucleotide; CACTGCTT chr2 60515149 60515168 60515165 +
cagaatctgcaagcagagtt

SEQ ID NO: 190962 - DNA, 20 bp, Artificial Sequence
  Synthetic oligonucleotide; TACAGATT chr2 60515344 60515363 60515360 +
atcaagcagcgtgagcaaag

SEQ ID NO: 190963 - DNA, 20 bp, Artificial Sequence
  Synthetic oligonucleotide; CAGTGCTT chr2 60515666 60515685 60515682 +
tacctctctgaaacacagcc

SEQ ID NO: 190964 - DNA, 20 bp, Artificial Sequence
  Synthetic oligonucleotide; GGGGGCTT chr2 60515736 60515755 60515752 +
gagtggactgacacagacat

SEQ ID NO: 190965 - DNA, 20 bp, Artificial Sequence
  Synthetic oligonucleotide; TCCAGCTT chr2 60515770 60515789 60515786 +
gactcttgatcacccaactt

SEQ ID NO: 190966 - DNA, 20 bp, Artificial Sequence
  Synthetic oligonucleotide; TGGGGATT chr2 60515838 60515857 60515854 +
cccactgtgaggtcttactg

SEQ ID NO: 190967 - DNA, 20 bp, Artificial Sequence
  Synthetic oligonucleotide; CAGGGATT chr2 60516052 60516071 60516068 +
tgggttatgaaaaagggaag

SEQ ID NO: 190968 - DNA, 20 bp, Artificial Sequence
  Synthetic oligonucleotide; GCCAGCTT chr2 60516100 60516119 60516116 +
ataagcctgtgatgactcat

SEQ ID NO: 190969 - DNA, 20 bp, Artificial Sequence
  Synthetic oligonucleotide; AGATGCTT chr2 60516119 60516138 60516135 +
tgccagctttgggtgctcta

SEQ ID NO: 190970 - DNA, 20 bp, Artificial Sequence
  Synthetic oligonucleotide; TAATGCTT chr2 60516138 60516157 60516154 +
aagatgctttcccatgtctg

SEQ ID NO: 190971 - DNA, 20 bp, Artificial Sequence
  Synthetic oligonucleotide; ATGTGCTT chr2 60516202 60516221 60516218 +
caccccagcacacagaaaag

SEQ ID NO: 190972 - DNA, 20 bp, Artificial Sequence
  Synthetic oligonucleotide; TTAGGTTT chr2 60516221 60516240 60516237 +
gatgtgcttattatgtgcac

SEQ ID NO: 190973 - DNA, 20 bp, Artificial Sequence
  Synthetic oligonucleotide; ACAGGTTT chr2 60516272 60516291 60516288 +
cccactcctattattaaaac

SEQ ID NO: 190974 - DNA, 20 bp, Artificial Sequence
  Synthetic oligonucleotide; GAAAGTTT chr2 60516652 60516671 60516668 +
gcatcaggacaactgggagt

SEQ ID NO: 190975 - DNA, 20 bp, Artificial Sequence
  Synthetic oligonucleotide; ACTGGTTT chr2 60516737 60516756 60516753 +
gcatgagtcatcaatgaagc

SEQ ID NO: 190976 - DNA, 20 bp, Artificial Sequence
  Synthetic oligonucleotide; TAATGTTT chr2 60516841 60516860 60516857 +
ggactctgtagttatcagac

SEQ ID NO: 190977 - DNA, 20 bp, Artificial Sequence
  Synthetic oligonucleotide; AGCAGATT chr2 60516870 60516889 60516886 +
agtaaaagagctggaaaacc

SEQ ID NO: 190978 - DNA, 20 bp, Artificial Sequence
  Synthetic oligonucleotide; AAGAGATT chr2 60516944 60516963 60516960 +
ccatgagttcaggttcagga

SEQ ID NO: 190979 - DNA, 20 bp, Artificial Sequence
  Synthetic oligonucleotide; ATGGGTTT chr2 60517060 60517079 60517076 +
gtctctggaatgaagaggaa

SEQ ID NO: 190980 - DNA, 20 bp, Artificial Sequence
  Synthetic oligonucleotide; GAAGGATT chr2 60517103 60517122 60517119 +
ggatcgaaggtagacaaaag

SEQ ID NO: 190981 - DNA, 20 bp, Artificial Sequence
  Synthetic oligonucleotide; CTGCGATT chr2 60517113 60517132 60517129 +
tagacaaaaggaaggatttc

SEQ ID NO: 190982 - DNA, 20 bp, Artificial Sequence
  Synthetic oligonucleotide; AGGTGATT chr2 60517433 60517452 60517449 +
accattctctgcaacagcac

SEQ ID NO: 190983 - DNA, 20 bp, Artificial Sequence
  Synthetic oligonucleotide; GGTGGTTT chr2 60517445 60517464 60517461 +
aacagcacaggtgattgggt

SEQ ID NO: 190984 - DNA, 20 bp, Artificial Sequence
  Synthetic oligonucleotide; TGTTGCTT chr2 60517453 60517472 60517469 +
aggtgattgggtggtggttt

SEQ ID NO: 190985 - DNA, 20 bp, Artificial Sequence
  Synthetic oligonucleotide; TTGGGTTT chr2 60517459 60517478 60517475 +
ttgggtggtggttttgttgc

SEQ ID NO: 190986 - DNA, 20 bp, Artificial Sequence
  Synthetic oligonucleotide; GTGCGATT chr2 60517633 60517652 60517649 +
gctggccatggagaggccat

SEQ ID NO: 190987 - DNA, 20 bp, Artificial Sequence
  Synthetic oligonucleotide; TTTGGCTT chr2 60517828 60517847 60517844 +
gatgctcaataagtattcac

SEQ ID NO: 190988 - DNA, 20 bp, Artificial Sequence
  Synthetic oligonucleotide; CTGTGCTT chr2 60517867 60517886 60517883 +
aactatctatgctcaaagag

SEQ ID NO: 190989 - DNA, 20 bp, Artificial Sequence
  Synthetic oligonucleotide; CTATGATT chr2 60517879 60517898 60517895 +
tcaaagagctgtgctttctt

SEQ ID NO: 190990 - DNA, 20 bp, Artificial Sequence
  Synthetic oligonucleotide; ATTTGCTT chr2 60518000 60518019 60518016 +
attacttgaaggccagaggc

SEQ ID NO: 190991 - DNA, 20 bp, Artificial Sequence
  Synthetic oligonucleotide; GGAAGATT chr2 60518044 60518063 60518060 +
aaatttggaaggccacagag

SEQ ID NO: 190992 - DNA, 20 bp, Artificial Sequence
  Synthetic oligonucleotide; GATTGCTT chr2 60518048 60518067 60518064 +
ttggaaggccacagagggaa

SEQ ID NO: 190993 - DNA, 20 bp, Artificial Sequence
  Synthetic oligonucleotide; AAAAGCTT chr2 60518110 60518129 60518126 +
agcaaaaccctgtctctaca

SEQ ID NO: 190994 - DNA, 20 bp, Artificial Sequence
  Synthetic oligonucleotide; CTGAGATT chr2 60518140 60518159 60518156 +
taaataaaataaaataattg

SEQ ID NO: 190995 - DNA, 20 bp, Artificial Sequence
  Synthetic oligonucleotide; CCCAGTTT chr2 60518181 60518200 60518197 +
aaagaaaatataaaatttgg

SEQ ID NO: 190996 - DNA, 20 bp, Artificial Sequence
  Synthetic oligonucleotide; ACAGGATT chr2 60518289 60518308 60518305 +
acatcatagataaaggagtc

SEQ ID NO: 190997 - DNA, 20 bp, Artificial Sequence
  Synthetic oligonucleotide; TTTAGTTT chr2 60518382 60518401 60518398 +
tacttagtactaacatttaa

SEQ ID NO: 190998 - DNA, 20 bp, Artificial Sequence
  Synthetic oligonucleotide; AGCAGATT chr2 60518407 60518426 60518423 +
ttttaaaatgtctgcgatag

SEQ ID NO: 190999 - DNA, 20 bp, Artificial Sequence
  Synthetic oligonucleotide; TCAGGATT chr2 60518414 60518433 60518430 +
atgtctgcgatagagcagat

SEQ ID NO: 191000 - DNA, 20 bp, Artificial Sequence
  Synthetic oligonucleotide; TTTAGCTT chr2 60518529 60518548 60518545 +
agggcatcgcacatgtgaat

SEQ ID NO: 191001 - DNA, 20 bp, Artificial Sequence
  Synthetic oligonucleotide; AAGAGTTT chr2 60518653 60518672 60518669 +
cccagcagagaacgttgaga

SEQ ID NO: 191002 - DNA, 20 bp, Artificial Sequence
  Synthetic oligonucleotide; CGTGGATT chr2 60518752 60518771 60518768 +
aggcattcctgggggccggg

SEQ ID NO: 191003 - DNA, 20 bp, Artificial Sequence
  Synthetic oligonucleotide; GGCTGCTT chr2 60518879 60518898 60518895 +
ccaccagccgtatttcctgg

SEQ ID NO: 191004 - DNA, 20 bp, Artificial Sequence
  Synthetic oligonucleotide; GTGGGATT chr2 60519033 60519052 60519049 +
ttgagagaaaatggacagaa

SEQ ID NO: 191005 - DNA, 20 bp, Artificial Sequence
  Synthetic oligonucleotide; AGAAGCTT chr2 60519097 60519116 60519113 +
tggtaggtactaccaaacca

SEQ ID NO: 191006 - DNA, 20 bp, Artificial Sequence
  Synthetic oligonucleotide; TTTTGATT chr2 60519252 60519271 60519268 +
tttaaggcattttgcggtct

SEQ ID NO: 191007 - DNA, 20 bp, Artificial Sequence
  Synthetic oligonucleotide; ATCAGCTT chr2 60519354 60519373 60519370 +
aggcagctgaaagtcagtac

SEQ ID NO: 191008 - DNA, 20 bp, Artificial Sequence
  Synthetic oligonucleotide; TAAAGATT chr2 60519379 60519398 60519395 +
ctttttaatgatgtgaaagt

SEQ ID NO: 191009 - DNA, 20 bp, Artificial Sequence
  Synthetic oligonucleotide; GAACGCTT chr2 60519399 60519418 60519415 +
taaagattaaaaacatgttg

SEQ ID NO: 191010 - DNA, 20 bp, Artificial Sequence
  Synthetic oligonucleotide; ACGTGCTT chr2 60519600 60519619 60519616 +
gaaatcgctcctgaaatctg

SEQ ID NO: 191011 - DNA, 20 bp, Artificial Sequence
  Synthetic oligonucleotide; TGTAGATT chr2 60519663 60519682 60519679 +
ggctggaaccactggaatct

SEQ ID NO: 191012 - DNA, 20 bp, Artificial Sequence
  Synthetic oligonucleotide; ACTGGTTT chr2 60519711 60519730 60519727 +
gacacatgcagctgggagcc

SEQ ID NO: 191013 - DNA, 20 bp, Artificial Sequence
  Synthetic oligonucleotide; CTGTGCTT chr2 60519741 60519760 60519757 +
gaattcacgtgggcatggga

SEQ ID NO: 191014 - DNA, 20 bp, Artificial Sequence
  Synthetic oligonucleotide; GATCGTTT chr2 60519828 60519847 60519844 +
aaactcagtgaagacaaaga

SEQ ID NO: 191015 - DNA, 20 bp, Artificial Sequence
  Synthetic oligonucleotide; CTATGCTT chr2 60519881 60519900 60519897 +
cataactcaggaattcatgg

SEQ ID NO: 191016 - DNA, 20 bp, Artificial Sequence
  Synthetic oligonucleotide; AAAAGTTT chr2 60519917 60519936 60519933 +
ctctctagacttggagtgtt

SEQ ID NO: 191017 - DNA, 20 bp, Artificial Sequence
  Synthetic oligonucleotide; TATGGCTT chr2 60520064 60520083 60520080 +
atgtgtgtatgatatagtat

SEQ ID NO: 191018 - DNA, 20 bp, Artificial Sequence
  Synthetic oligonucleotide; TATTGATT chr2 60520138 60520157 60520154 +
ataccttgcgtggcaaggta

SEQ ID NO: 191019 - DNA, 20 bp, Artificial Sequence
  Synthetic oligonucleotide; GCAGGTTT chr2 60520262 60520281 60520278 +
cccttacaataaactcttct

SEQ ID NO: 191020 - DNA, 20 bp, Artificial Sequence
  Synthetic oligonucleotide; TTTTGTTT chr2 60520267 60520286 60520283 +
acaataaactcttctgcagg

SEQ ID NO: 191021 - DNA, 20 bp, Artificial Sequence
  Synthetic oligonucleotide; TCTAGATT chr2 60520441 60520460 60520457 +
tgccaccaaattttttaaaa

SEQ ID NO: 191022 - DNA, 20 bp, Artificial Sequence
  Synthetic oligonucleotide; TTCCGTTT chr2 60520510 60520529 60520526 +
catttgtgtacacattcgca

SEQ ID NO: 191023 - DNA, 20 bp, Artificial Sequence
  Synthetic oligonucleotide; CAGAGTTT chr2 60520541 60520560 60520557 +
agaaggagaaattatcctca

SEQ ID NO: 191024 - DNA, 20 bp, Artificial Sequence
  Synthetic oligonucleotide; AACTGTTT chr2 60520583 60520602 60520599 +
aataagtggcctttgatgta

SEQ ID NO: 191025 - DNA, 20 bp, Artificial Sequence
  Synthetic oligonucleotide; CGGTGTTT chr2 60520836 60520855 60520852 +
cttctccagtgggttcccac

SEQ ID NO: 191026 - DNA, 20 bp, Artificial Sequence
  Synthetic oligonucleotide; GCAAGCTT chr2 60520848 60520867 60520864 +
gttcccaccggtgttttcgt

SEQ ID NO: 191027 - DNA, 20 bp, Artificial Sequence
  Synthetic oligonucleotide; CTCAGCTT chr2 60521391 60521410 60521407 +
tgtgatgtggttaggccagt

SEQ ID NO: 191028 - DNA, 20 bp, Artificial Sequence
  Synthetic oligonucleotide; CCTAGCTT chr2 60521473 60521492 60521489 +
tgcacgaagcccaccagtga

SEQ ID NO: 191029 - DNA, 20 bp, Artificial Sequence
  Synthetic oligonucleotide; CCTGGCTT chr2 60521501 60521520 60521517 +
tcaagtcacacagcgacagt

SEQ ID NO: 191030 - DNA, 20 bp, Artificial Sequence
  Synthetic oligonucleotide; GGCTGCTT chr2 60521609 60521628 60521625 +
cagtcctcccttaaagggaa

SEQ ID NO: 191031 - DNA, 20 bp, Artificial Sequence
  Synthetic oligonucleotide; AGCTGCTT chr2 60521771 60521790 60521787 +
cagccacgtgagcacgtccc

SEQ ID NO: 191032 - DNA, 20 bp, Artificial Sequence
  Synthetic oligonucleotide; ACTCGTTT chr2 60522308 60522327 60522324 +
tgtattttttaaacatagga

SEQ ID NO: 191033 - DNA, 20 bp, Artificial Sequence
  Synthetic oligonucleotide; TCATGTTT chr2 60522440 60522459 60522456 +
aatacttctttccatctggg

SEQ ID NO: 191034 - DNA, 20 bp, Artificial Sequence
  Synthetic oligonucleotide; AAAAGCTT chr2 60522491 60522510 60522507 +
tcaagactgaagctgccaag

SEQ ID NO: 191035 - DNA, 20 bp, Artificial Sequence
  Synthetic oligonucleotide; ATGGGTTT chr2 60522841 60522860 60522857 +
atatgtcagttatgttccaa

SEQ ID NO: 191036 - DNA, 20 bp, Artificial Sequence
  Synthetic oligonucleotide; AAATGCTT chr2 60522907 60522926 60522923 +
ttttagacaggataaggtca

SEQ ID NO: 191037 - DNA, 20 bp, Artificial Sequence
  Synthetic oligonucleotide; CAGAGATT chr2 60522982 60523001 60522998 +
actagtgctccagagagaca

SEQ ID NO: 191038 - DNA, 20 bp, Artificial Sequence
  Synthetic oligonucleotide; GGCCGTTT chr2 60523006 60523025 60523022 +
gattgaaacaaaaattgcct

SEQ ID NO: 191039 - DNA, 20 bp, Artificial Sequence
  Synthetic oligonucleotide; AAAAGCTT chr2 60523034 60523053 60523050 +
tctctgtagactctgtgggt

SEQ ID NO: 191040 - DNA, 20 bp, Artificial Sequence
  Synthetic oligonucleotide; TACAGATT chr2 60523091 60523110 60523107 +
ataagtaagaagtaactgtg

SEQ ID NO: 191041 - DNA, 20 bp, Artificial Sequence
  Synthetic oligonucleotide; GGGAGATT chr2 60523168 60523187 60523184 +
catggcagaaccgtaaagaa

SEQ ID NO: 191042 - DNA, 20 bp, Artificial Sequence
  Synthetic oligonucleotide; CCAGGATT chr2 60523260 60523279 60523276 +
cacaaaggacagcctgccat

SEQ ID NO: 191043 - DNA, 20 bp, Artificial Sequence
  Synthetic oligonucleotide; TCCTGCTT chr2 60523267 60523286 60523283 +
gacagcctgccatccaggat

SEQ ID NO: 191044 - DNA, 20 bp, Artificial Sequence
  Synthetic oligonucleotide; ATTTGCTT chr2 60523361 60523380 60523377 +
agataaatagtatggagata

SEQ ID NO: 191045 - DNA, 20 bp, Artificial Sequence
  Synthetic oligonucleotide; GTCAGATT chr2 60523371 60523390 60523387 +
tatggagataatttgcttaa

SEQ ID NO: 191046 - DNA, 20 bp, Artificial Sequence
  Synthetic oligonucleotide; AGTGGTTT chr2 60523388 60523407 60523404 +
taagtcagattttgatgaaa

SEQ ID NO: 191047 - DNA, 20 bp, Artificial Sequence
  Synthetic oligonucleotide; GATAGCTT chr2 60523403 60523422 60523419 +
tgaaaagtggtttctacatg

SEQ ID NO: 191048 - DNA, 20 bp, Artificial Sequence
  Synthetic oligonucleotide; TATTGATT chr2 60523424 60523443 60523440 +
atagctttcaaaaacttcta

SEQ ID NO: 191049 - DNA, 20 bp, Artificial Sequence
  Synthetic oligonucleotide; ATATGCTT chr2 60523590 60523609 60523606 +
gtatatagatgcatatgtat

SEQ ID NO: 191050 - DNA, 20 bp, Artificial Sequence
  Synthetic oligonucleotide; ATGTGTTT chr2 60523619 60523638 60523635 +
atcttatgatgacagtgttg

SEQ ID NO: 191051 - DNA, 20 bp, Artificial Sequence
  Synthetic oligonucleotide; TGGGGATT chr2 60523626 60523645 60523642 +
gatgacagtgttgatgtgtt

SEQ ID NO: 191052 - DNA, 20 bp, Artificial Sequence
  Synthetic oligonucleotide; CAAGGTTT chr2 60523842 60523861 60523858 +
ccaaacgttcaagaattgac

SEQ ID NO: 191053 - DNA, 20 bp, Artificial Sequence
  Synthetic oligonucleotide; AGGAGCTT chr2 60523886 60523905 60523902 +
ataatttatttaagccaaat

SEQ ID NO: 191054 - DNA, 20 bp, Artificial Sequence
  Synthetic oligonucleotide; GGGTGCTT chr2 60523998 60524017 60524014 +
aaatacctctccattatcag

SEQ ID NO: 191055 - DNA, 20 bp, Artificial Sequence
  Synthetic oligonucleotide; TATTGTTT chr2 60524006 60524025 60524022 +
ctccattatcaggggtgctt

SEQ ID NO: 191056 - DNA, 20 bp, Artificial Sequence
  Synthetic oligonucleotide; GGCAGCTT chr2 60524171 60524190 60524187 +
tgagccaagactgtcctagc

SEQ ID NO: 191057 - DNA, 20 bp, Artificial Sequence
  Synthetic oligonucleotide; TCATGCTT chr2 60524323 60524342 60524339 +
tatctctggcatgaatgtta

SEQ ID NO: 191058 - DNA, 20 bp, Artificial Sequence
  Synthetic oligonucleotide; ATTTGCTT chr2 60524397 60524416 60524413 +
tgccattcattcggcctgtt

SEQ ID NO: 191059 - DNA, 20 bp, Artificial Sequence
  Synthetic oligonucleotide; CCTTGTTT chr2 60524435 60524454 60524451 +
ttagggctaaactttatgtt

SEQ ID NO: 191060 - DNA, 20 bp, Artificial Sequence
  Synthetic oligonucleotide; TTTTGTTT chr2 60524441 60524460 60524457 +
ctaaactttatgttccttgt

SEQ ID NO: 191061 - DNA, 20 bp, Artificial Sequence
  Synthetic oligonucleotide; TTTTGTTT chr2 60524447 60524466 60524463 +
tttatgttccttgtttttgt

SEQ ID NO: 191062 - DNA, 20 bp, Artificial Sequence
  Synthetic oligonucleotide; TCTTGTTT chr2 60524467 60524486 60524483 +
ttttgtttttttttcttttt

SEQ ID NO: 191063 - DNA, 20 bp, Artificial Sequence
  Synthetic oligonucleotide; TTAAGATT chr2 60524476 60524495 60524492 +
tttttcttttttcttgtttt

SEQ ID NO: 191064 - DNA, 20 bp, Artificial Sequence
  Synthetic oligonucleotide; AGCTGATT chr2 60524527 60524546 60524543 +
gagcatgcaaaatcagaaac

SEQ ID NO: 191065 - DNA, 20 bp, Artificial Sequence
  Synthetic oligonucleotide; AACTGATT chr2 60524676 60524695 60524692 +
acaaggaacacatatttcac

SEQ ID NO: 191066 - DNA, 20 bp, Artificial Sequence
  Synthetic oligonucleotide; GAAAGTTT chr2 60524721 60524740 60524737 +
gagcacatgggataataaaa

SEQ ID NO: 191067 - DNA, 20 bp, Artificial Sequence
  Synthetic oligonucleotide; GCATGCTT chr2 60524773 60524792 60524789 +
actttgaatgccctttttca

SEQ ID NO: 191068 - DNA, 20 bp, Artificial Sequence
  Synthetic oligonucleotide; CCAAGTTT chr2 60524880 60524899 60524896 +
ctaaaagccaatggtaaaca

SEQ ID NO: 191069 - DNA, 20 bp, Artificial Sequence
  Synthetic oligonucleotide; AATGGATT chr2 60524892 60524911 60524908 +
ggtaaacaccaagtttaaaa

SEQ ID NO: 191070 - DNA, 20 bp, Artificial Sequence
  Synthetic oligonucleotide; ATATGCTT chr2 60524928 60524947 60524944 +
cgcatgtcccagaacaggcc

SEQ ID NO: 191071 - DNA, 20 bp, Artificial Sequence
  Synthetic oligonucleotide; ACCAGCTT chr2 60525101 60525120 60525117 +
ggctatgtccatacagagaa

SEQ ID NO: 191072 - DNA, 20 bp, Artificial Sequence
  Synthetic oligonucleotide; GGTTGTTT chr2 60525171 60525190 60525187 +
taattgaatttaaaatacct

SEQ ID NO: 191073 - DNA, 20 bp, Artificial Sequence
  Synthetic oligonucleotide; TGGAGTTT chr2 60525276 60525295 60525292 +
aaaatacacattacattctt

SEQ ID NO: 191074 - DNA, 20 bp, Artificial Sequence
  Synthetic oligonucleotide; AACAGCTT chr2 60525293 60525312 60525309 +
ctttggagtttttcaaaaaa

SEQ ID NO: 191075 - DNA, 20 bp, Artificial Sequence
  Synthetic oligonucleotide; TTTTGCTT chr2 60525381 60525400 60525397 +
tccattatactgcacttcaa

SEQ ID NO: 191076 - DNA, 20 bp, Artificial Sequence
  Synthetic oligonucleotide; TTAAGCTT chr2 60525410 60525429 60525426 +
cagcaatttgaaagatgcct

SEQ ID NO: 191077 - DNA, 20 bp, Artificial Sequence
  Synthetic oligonucleotide; CATAGCTT chr2 60525456 60525475 60525472 +
atccaagccttaatctccac

SEQ ID NO: 191078 - DNA, 20 bp, Artificial Sequence
  Synthetic oligonucleotide; ACTAGATT chr2 60525528 60525547 60525544 +
caggtgagccccattcagca

SEQ ID NO: 191079 - DNA, 20 bp, Artificial Sequence
  Synthetic oligonucleotide; CCTGGTTT chr2 60525725 60525744 60525741 +
aagggtcagaacccaggtgt

SEQ ID NO: 191080 - DNA, 20 bp, Artificial Sequence
  Synthetic oligonucleotide; CAAAGTTT chr2 60525766 60525785 60525782 +
tctctgttaacactaaaagt

SEQ ID NO: 191081 - DNA, 20 bp, Artificial Sequence
  Synthetic oligonucleotide; CATGGCTT chr2 60525845 60525864 60525861 +
accagtcttggtaatttctc

SEQ ID NO: 191082 - DNA, 20 bp, Artificial Sequence
  Synthetic oligonucleotide; TCGTGTTT chr2 60525918 60525937 60525934 +
atgttatcttcttccttcat

SEQ ID NO: 191083 - DNA, 20 bp, Artificial Sequence
  Synthetic oligonucleotide; AATAGTTT chr2 60525936 60525955 60525952 +
attcgtgtttggtaatcaaa

SEQ ID NO: 191084 - DNA, 20 bp, Artificial Sequence
  Synthetic oligonucleotide; TGTGGTTT chr2 60526035 60526054 60526051 +
gcagggctgggaaaaaagaa

SEQ ID NO: 191085 - DNA, 20 bp, Artificial Sequence
  Synthetic oligonucleotide; GTAGGTTT chr2 60526056 60526075 60526072 +
gtggtttttttctaaccaca

SEQ ID NO: 191086 - DNA, 20 bp, Artificial Sequence
  Synthetic oligonucleotide; CAATGATT chr2 60526073 60526092 60526089 +
acagtaggttttttctataa

SEQ ID NO: 191087 - DNA, 20 bp, Artificial Sequence
  Synthetic oligonucleotide; CATGGTTT chr2 60526104 60526123 60526120 +
ctttctagatataaaacagg

SEQ ID NO: 191088 - DNA, 20 bp, Artificial Sequence
  Synthetic oligonucleotide; TCTAGATT chr2 60526136 60526155 60526152 +
caccctgaacttctgcaaaa

SEQ ID NO: 191089 - DNA, 20 bp, Artificial Sequence
  Synthetic oligonucleotide; TGGTGATT chr2 60526161 60526180 60526177 +
atttgatcaaattcagaaac

SEQ ID NO: 191090 - DNA, 20 bp, Artificial Sequence
  Synthetic oligonucleotide; AAAAGATT chr2 60526253 60526272 60526269 +
tattttgctctttcttcccc

SEQ ID NO: 191091 - DNA, 20 bp, Artificial Sequence
  Synthetic oligonucleotide; AATAGTTT chr2 60526265 60526284 60526281 +
tcttccccaaaagattttta

SEQ ID NO: 191092 - DNA, 20 bp, Artificial Sequence
  Synthetic oligonucleotide; AAAGGATT chr2 60526282 60526301 60526298 +
ttaaatagttttcatcttta

SEQ ID NO: 191093 - DNA, 20 bp, Artificial Sequence
  Synthetic oligonucleotide; TTCAGATT chr2 60526295 60526314 60526311 +
atctttaaaaggatttcaac

SEQ ID NO: 191094 - DNA, 20 bp, Artificial Sequence
  Synthetic oligonucleotide; ATATGTTT chr2 60526363 60526382 60526379 +
aataagacaaacaaagcagc

SEQ ID NO: 191095 - DNA, 20 bp, Artificial Sequence
  Synthetic oligonucleotide; TGCAGATT chr2 60526405 60526424 60526421 +
gggaagtgtacattaattac

SEQ ID NO: 191096 - DNA, 20 bp, Artificial Sequence
  Synthetic oligonucleotide; CTCTGATT chr2 60526551 60526570 60526567 +
ttgcatcagggacaaatgag

SEQ ID NO: 191097 - DNA, 20 bp, Artificial Sequence
  Synthetic oligonucleotide; TTTAGATT chr2 60526574 60526593 60526590 +
tgattttaatctgcagcgca

SEQ ID NO: 191098 - DNA, 20 bp, Artificial Sequence
  Synthetic oligonucleotide; GATGGTTT chr2 60526603 60526622 60526619 +
gcccaaagatagtgtaattt

SEQ ID NO: 191099 - DNA, 20 bp, Artificial Sequence
  Synthetic oligonucleotide; CTCGGATT chr2 60526622 60526641 60526638 +
tgatggtttataggcctcct

SEQ ID NO: 191100 - DNA, 20 bp, Artificial Sequence
  Synthetic oligonucleotide; AAATGTTT chr2 60526701 60526720 60526717 +
taaagaagaagatgcaatga

SEQ ID NO: 191101 - DNA, 20 bp, Artificial Sequence
  Synthetic oligonucleotide; GTCTGATT chr2 60526790 60526809 60526806 +
aaagggctgacctataatgc

SEQ ID NO: 191102 - DNA, 20 bp, Artificial Sequence
  Synthetic oligonucleotide; CATTGATT chr2 60526905 60526924 60526921 +
aaattatcactagtcaacag

SEQ ID NO: 191103 - DNA, 20 bp, Artificial Sequence
  Synthetic oligonucleotide; TATGGCTT chr2 60527009 60527028 60527025 +
ccctctgaggtctccccggt

SEQ ID NO: 191104 - DNA, 20 bp, Artificial Sequence
  Synthetic oligonucleotide; TGTAGCTT chr2 60527054 60527073 60527070 +
tctcaccattcgatatttat

SEQ ID NO: 191105 - DNA, 20 bp, Artificial Sequence
  Synthetic oligonucleotide; TTGTGCTT chr2 60527120 60527139 60527136 +
tgcctcttgggacatcaaat

SEQ ID NO: 191106 - DNA, 20 bp, Artificial Sequence
  Synthetic oligonucleotide; GCCTGATT chr2 60527188 60527207 60527204 +
aggccatcatcagagatgtg

SEQ ID NO: 191107 - DNA, 20 bp, Artificial Sequence
  Synthetic oligonucleotide; CACTGATT chr2 60527198 60527217 60527214 +
cagagatgtggcctgatttt

SEQ ID NO: 191108 - DNA, 20 bp, Artificial Sequence
  Synthetic oligonucleotide; TTCAGCTT chr2 60527288 60527307 60527304 +
catgatacgccttttatcat

SEQ ID NO: 191109 - DNA, 20 bp, Artificial Sequence
  Synthetic oligonucleotide; AAGAGCTT chr2 60527332 60527351 60527348 +
gagacccagcaaataaaact

SEQ ID NO: 191110 - DNA, 20 bp, Artificial Sequence
  Synthetic oligonucleotide; AAGGGCTT chr2 60527430 60527449 60527446 +
caagagaaggggtgaggggg

SEQ ID NO: 191111 - DNA, 20 bp, Artificial Sequence
  Synthetic oligonucleotide; TGAAGCTT chr2 60527491 60527510 60527507 +
gacagagtgcgaagtaaaag

SEQ ID NO: 191112 - DNA, 20 bp, Artificial Sequence
  Synthetic oligonucleotide; CATGGATT chr2 60527515 60527534 60527531 +
gctttggagctcttgaccca

SEQ ID NO: 191113 - DNA, 20 bp, Artificial Sequence
  Synthetic oligonucleotide; AGGCGCTT chr2 60527717 60527736 60527733 +
acggggcctccgcatgaagt

SEQ ID NO: 191114 - DNA, 20 bp, Artificial Sequence
  Synthetic oligonucleotide; AAATGATT chr2 60527735 60527754 60527751 +
gtaggcgcttctcaactacc

SEQ ID NO: 191115 - DNA, 20 bp, Artificial Sequence
  Synthetic oligonucleotide; TTTGGTTT chr2 60527818 60527837 60527834 +
aatacaggaaaacagtaaca

SEQ ID NO: 191116 - DNA, 20 bp, Artificial Sequence
  Synthetic oligonucleotide; TCTTGCTT chr2 60527865 60527884 60527881 +
catctgcaacgaacctcagg

SEQ ID NO: 191117 - DNA, 20 bp, Artificial Sequence
  Synthetic oligonucleotide; TGCAGTTT chr2 60527985 60528004 60528001 +
gatcatatggagctgttgac

SEQ ID NO: 191118 - DNA, 20 bp, Artificial Sequence
  Synthetic oligonucleotide; TCAAGTTT chr2 60528009 60528028 60528025 +
gtttccattcaaaacttccc

SEQ ID NO: 191119 - DNA, 20 bp, Artificial Sequence
  Synthetic oligonucleotide; AGCAGATT chr2 60528081 60528100 60528097 +
agaaatgaaaacctcctcga

SEQ ID NO: 191120 - DNA, 20 bp, Artificial Sequence
  Synthetic oligonucleotide; TTCTGATT chr2 60528171 60528190 60528187 +
gtctctccctccctgtataa

SEQ ID NO: 191121 - DNA, 20 bp, Artificial Sequence
  Synthetic oligonucleotide; CCGAGCTT chr2 60528273 60528292 60528289 +
cctcaccacttcttaaaagt

SEQ ID NO: 191122 - DNA, 20 bp, Artificial Sequence
  Synthetic oligonucleotide; CTTAGTTT chr2 60528278 60528297 60528294 +
ccacttcttaaaagtccgag

SEQ ID NO: 191123 - DNA, 20 bp, Artificial Sequence
  Synthetic oligonucleotide; CTCTGTTT chr2 60528345 60528364 60528361 +
caaacagtaaaacctcctcc

SEQ ID NO: 191124 - DNA, 20 bp, Artificial Sequence
  Synthetic oligonucleotide; ACTTGATT chr2 60528365 60528384 60528381 +
ctctgtttctcaggaccctc

SEQ ID NO: 191125 - DNA, 20 bp, Artificial Sequence
  Synthetic oligonucleotide; GCAGGATT chr2 60528415 60528434 60528431 +
gggaaatgactacttgcaaa

SEQ ID NO: 191126 - DNA, 20 bp, Artificial Sequence
  Synthetic oligonucleotide; AGAAGATT chr2 60528503 60528522 60528519 +
ggaacattcttctctttccc

SEQ ID NO: 191127 - DNA, 20 bp, Artificial Sequence
  Synthetic oligonucleotide; CAGAGCTT chr2 60528557 60528576 60528573 +
gagggacaactgtccagcac

SEQ ID NO: 191128 - DNA, 20 bp, Artificial Sequence
  Synthetic oligonucleotide; AAAGGATT chr2 60528645 60528664 60528661 +
gagggtggcggccgcaggcc

SEQ ID NO: 191129 - DNA, 20 bp, Artificial Sequence
  Synthetic oligonucleotide; GAGTGTTT chr2 60528732 60528751 60528748 +
ctaccaaatgaggctaatgg

SEQ ID NO: 191130 - DNA, 20 bp, Artificial Sequence
  Synthetic oligonucleotide; CTGTGCTT chr2 60528840 60528859 60528856 +
gcccccggagcgagtaatgt

SEQ ID NO: 191131 - DNA, 20 bp, Artificial Sequence
  Synthetic oligonucleotide; AAATGATT chr2 60528920 60528939 60528936 +
ctccatttcacagagaggtg

SEQ ID NO: 191132 - DNA, 20 bp, Artificial Sequence
  Synthetic oligonucleotide; ATGAGCTT chr2 60529220 60529239 60529236 +
gagtcataaccgtaatagta

SEQ ID NO: 191133 - DNA, 20 bp, Artificial Sequence
  Synthetic oligonucleotide; ACATGTTT chr2 60529233 60529252 60529249 +
aatagtaatgagcttttgtg

SEQ ID NO: 191134 - DNA, 20 bp, Artificial Sequence
  Synthetic oligonucleotide; CCGTGATT chr2 60529316 60529335 60529332 +
aaggccctatgaggcaagcc

SEQ ID NO: 191135 - DNA, 20 bp, Artificial Sequence
  Synthetic oligonucleotide; TACAGATT chr2 60529334 60529353 60529350 +
ccccgtgattctccccactt

SEQ ID NO: 191136 - DNA, 20 bp, Artificial Sequence
  Synthetic oligonucleotide; GGAGGCTT chr2 60529350 60529369 60529366 +
actttacagattgaggaagc

SEQ ID NO: 191137 - DNA, 20 bp, Artificial Sequence
  Synthetic oligonucleotide; AAGGGCTT chr2 60529571 60529590 60529587 +
tgggagagaagactgcctct

SEQ ID NO: 191138 - DNA, 20 bp, Artificial Sequence
  Synthetic oligonucleotide; CCCAGTTT chr2 60529645 60529664 60529661 +
cccagaggcccccaaatttt

SEQ ID NO: 191139 - DNA, 20 bp, Artificial Sequence
  Synthetic oligonucleotide; ATGTGATT chr2 60529719 60529738 60529735 +
ggcctagccaggggaagtaa

SEQ ID NO: 191140 - DNA, 20 bp, Artificial Sequence
  Synthetic oligonucleotide; GTGGGATT chr2 60529855 60529874 60529871 +
aaagccctggtgtcccctag

SEQ ID NO: 191141 - DNA, 20 bp, Artificial Sequence
  Synthetic oligonucleotide; CCCAGCTT chr2 60529870 60529889 60529886 +
cctaggtgggattctatgaa

SEQ ID NO: 191142 - DNA, 20 bp, Artificial Sequence
  Synthetic oligonucleotide; TCCTGCTT chr2 60530027 60530046 60530043 +
gaagttattgggatgatgac

SEQ ID NO: 191143 - DNA, 20 bp, Artificial Sequence
  Synthetic oligonucleotide; ATGGGTTT chr2 60530135 60530154 60530151 +
aacaaaacaagcccaaacac

SEQ ID NO: 191144 - DNA, 20 bp, Artificial Sequence
  Synthetic oligonucleotide; GACAGCTT chr2 60530265 60530284 60530281 +
tattatcgttctcagccacc

SEQ ID NO: 191145 - DNA, 20 bp, Artificial Sequence
  Synthetic oligonucleotide; AAGAGTTT chr2 60530329 60530348 60530345 +
atttaaaaaaaaaaaaaaaa

SEQ ID NO: 191146 - DNA, 20 bp, Artificial Sequence
  Synthetic oligonucleotide; CACTGATT chr2 60530338 60530357 60530354 +
aaaaaaaaaaaaagagtttc

SEQ ID NO: 191147 - DNA, 20 bp, Artificial Sequence
  Synthetic oligonucleotide; AAAGGCTT chr2 60530694 60530713 60530710 +
aaggaaaaaaaaaacactga

SEQ ID NO: 191148 - DNA, 20 bp, Artificial Sequence
  Synthetic oligonucleotide; CATCGATT chr2 60530865 60530884 60530881 +
tcgagctcctaaaaactaga

SEQ ID NO: 191149 - DNA, 20 bp, Artificial Sequence
  Synthetic oligonucleotide; CTGCGCTT chr2 60530877 60530896 60530893 +
aaactagacatcgattatgt

SEQ ID NO: 191150 - DNA, 20 bp, Artificial Sequence
  Synthetic oligonucleotide; AAGTGCTT chr2 60530909 60530928 60530925 +
ctttctattcaagataaaca

SEQ ID NO: 191151 - DNA, 20 bp, Artificial Sequence
  Synthetic oligonucleotide; CTTTGCTT chr2 60531103 60531122 60531119 +
ggagcagatggacttgacca

SEQ ID NO: 191152 - DNA, 20 bp, Artificial Sequence
  Synthetic oligonucleotide; CCAGGTTT chr2 60531180 60531199 60531196 +
cctggctaccctactccggt

SEQ ID NO: 191153 - DNA, 20 bp, Artificial Sequence
  Synthetic oligonucleotide; GTGAGTTT chr2 60531346 60531365 60531362 +
gttctgcaagaatattttaa

SEQ ID NO: 191154 - DNA, 20 bp, Artificial Sequence
  Synthetic oligonucleotide; TTTTGTTT chr2 60531351 60531370 60531367 +
gcaagaatattttaagtgag

SEQ ID NO: 191155 - DNA, 20 bp, Artificial Sequence
  Synthetic oligonucleotide; AATAGATT chr2 60531522 60531541 60531538 +
aataatattaatgaaacaaa

SEQ ID NO: 191156 - DNA, 20 bp, Artificial Sequence
  Synthetic oligonucleotide; CAGGGCTT chr2 60531543 60531562 60531559 +
atagattcataagccttggc

SEQ ID NO: 191157 - DNA, 20 bp, Artificial Sequence
  Synthetic oligonucleotide; GCGTGTTT chr2 60531644 60531663 60531660 +
cactaccattaaactcaaga

SEQ ID NO: 191158 - DNA, 20 bp, Artificial Sequence
  Synthetic oligonucleotide; GGCTGCTT chr2 60531775 60531794 60531791 +
tggtcgggaagttacccaca

SEQ ID NO: 191159 - DNA, 20 bp, Artificial Sequence
  Synthetic oligonucleotide; AATAGTTT chr2 60532255 60532274 60532271 +
tatctcactggtggtctatt

SEQ ID NO: 191160 - DNA, 20 bp, Artificial Sequence
  Synthetic oligonucleotide; TGAAGTTT chr2 60532262 60532281 60532278 +
ctggtggtctattaatagtt

SEQ ID NO: 191161 - DNA, 20 bp, Artificial Sequence
  Synthetic oligonucleotide; TGTTGCTT chr2 60532288 60532307 60532304 +
tttgagcgtcagaaggtggt

SEQ ID NO: 191162 - DNA, 20 bp, Artificial Sequence
  Synthetic oligonucleotide; TTTGGTTT chr2 60532296 60532315 60532312 +
tcagaaggtggttgttgctt

SEQ ID NO: 191163 - DNA, 20 bp, Artificial Sequence
  Synthetic oligonucleotide; TTGGGTTT chr2 60532304 60532323 60532320 +
tggttgttgctttttggttt

SEQ ID NO: 191164 - DNA, 20 bp, Artificial Sequence
  Synthetic oligonucleotide; TCCAGTTT chr2 60532345 60532364 60532361 +
tttaaaactattctgtcatt

SEQ ID NO: 191165 - DNA, 20 bp, Artificial Sequence
  Synthetic oligonucleotide; AAAGGTTT chr2 60532358 60532377 60532374 +
tgtcatttccagttttttaa

SEQ ID NO: 191166 - DNA, 20 bp, Artificial Sequence
  Synthetic oligonucleotide; TTTTGTTT chr2 60532363 60532382 60532379 +
tttccagttttttaaaaagg

SEQ ID NO: 191167 - DNA, 20 bp, Artificial Sequence
  Synthetic oligonucleotide; TTTTGTTT chr2 60532368 60532387 60532384 +
agttttttaaaaaggttttg

SEQ ID NO: 191168 - DNA, 20 bp, Artificial Sequence
  Synthetic oligonucleotide; TTTTGCTT chr2 60532373 60532392 60532389 +
tttaaaaaggttttgttttg

SEQ ID NO: 191169 - DNA, 20 bp, Artificial Sequence
  Synthetic oligonucleotide; CTTTGTTT chr2 60532378 60532397 60532394 +
aaaggttttgttttgttttg

SEQ ID NO: 191170 - DNA, 20 bp, Artificial Sequence
  Synthetic oligonucleotide; TTTTGTTT chr2 60532385 60532404 60532401 +
ttgttttgttttgctttgtt

SEQ ID NO: 191171 - DNA, 20 bp, Artificial Sequence
  Synthetic oligonucleotide; TTTTGTTT chr2 60532393 60532412 60532409 +
ttttgctttgttttttgttt

SEQ ID NO: 191172 - DNA, 20 bp, Artificial Sequence
  Synthetic oligonucleotide; TAATGTTT chr2 60532425 60532444 60532441 +
ttttttggtggtggtggcgt

SEQ ID NO: 191173 - DNA, 20 bp, Artificial Sequence
  Synthetic oligonucleotide; GACAGCTT chr2 60532442 60532461 60532458 +
cgttaatgtttcttcagaaa

SEQ ID NO: 191174 - DNA, 20 bp, Artificial Sequence
  Synthetic oligonucleotide; TTATGATT chr2 60532467 60532486 60532483 +
cttctgggccactctgggta

SEQ ID NO: 191175 - DNA, 20 bp, Artificial Sequence
  Synthetic oligonucleotide; TTTGGTTT chr2 60532473 60532492 60532489 +
ggccactctgggtattatga

SEQ ID NO: 191176 - DNA, 20 bp, Artificial Sequence
  Synthetic oligonucleotide; CCTGGTTT chr2 60532505 60532524 60532521 +
cttacaatagttactctctg

SEQ ID NO: 191177 - DNA, 20 bp, Artificial Sequence
  Synthetic oligonucleotide; TACTGATT chr2 60532512 60532531 60532528 +
tagttactctctgcctggtt

SEQ ID NO: 191178 - DNA, 20 bp, Artificial Sequence
  Synthetic oligonucleotide; ATATGTTT chr2 60532593 60532612 60532609 +
gaaaattccttggcataagg

SEQ ID NO: 191179 - DNA, 20 bp, Artificial Sequence
  Synthetic oligonucleotide; AACAGTTT chr2 60532653 60532672 60532669 +
tattatgactttacttgaaa

SEQ ID NO: 191180 - DNA, 20 bp, Artificial Sequence
  Synthetic oligonucleotide; GATGGATT chr2 60532671 60532690 60532687 +
aaaacagtttgccacagtga

SEQ ID NO: 191181 - DNA, 20 bp, Artificial Sequence
  Synthetic oligonucleotide; ATATGCTT chr2 60532684 60532703 60532700 +
acagtgagatggattcactt

SEQ ID NO: 191182 - DNA, 20 bp, Artificial Sequence
  Synthetic oligonucleotide; GGTAGATT chr2 60532745 60532764 60532761 +
aacagtacaatttttttaaa

SEQ ID NO: 191183 - DNA, 20 bp, Artificial Sequence
  Synthetic oligonucleotide; ACTGGTTT chr2 60532763 60532782 60532779 +
aaggtagatttaaagcatta

SEQ ID NO: 191184 - DNA, 20 bp, Artificial Sequence
  Synthetic oligonucleotide; TTTGGATT chr2 60532768 60532787 60532784 +
agatttaaagcattaactgg

SEQ ID NO: 191185 - DNA, 20 bp, Artificial Sequence
  Synthetic oligonucleotide; CAATGTTT chr2 60532780 60532799 60532796 +
ttaactggtttggattaaaa

SEQ ID NO: 191186 - DNA, 20 bp, Artificial Sequence
  Synthetic oligonucleotide; ACATGATT chr2 60532840 60532859 60532856 +
caaaagacttatgcaaagcc

SEQ ID NO: 191187 - DNA, 20 bp, Artificial Sequence
  Synthetic oligonucleotide; ATGAGATT chr2 60532860 60532879 60532876 +
acatgattttgaaggagcta

SEQ ID NO: 191188 - DNA, 20 bp, Artificial Sequence
  Synthetic oligonucleotide; TACAGTTT chr2 60532956 60532975 60532972 +
atttgtgtacttgacattta

SEQ ID NO: 191189 - DNA, 20 bp, Artificial Sequence
  Synthetic oligonucleotide; ACTAGATT chr2 60532994 60533013 60533010 +
taacaatctaccctgggtac

SEQ ID NO: 191190 - DNA, 20 bp, Artificial Sequence
  Synthetic oligonucleotide; AGAAGTTT chr2 60533042 60533061 60533058 +
aatttgtactccatataagc

SEQ ID NO: 191191 - DNA, 20 bp, Artificial Sequence
  Synthetic oligonucleotide; TTATGTTT chr2 60533071 60533090 60533087 +
cagtcacttttgacttacca

SEQ ID NO: 191192 - DNA, 20 bp, Artificial Sequence
  Synthetic oligonucleotide; TCACGTTT chr2 60533128 60533147 60533144 +
aaagcacagctcctccatgc

SEQ ID NO: 191193 - DNA, 20 bp, Artificial Sequence
  Synthetic oligonucleotide; TGCTGCTT chr2 60533161 60533180 60533177 +
tctaatactgtaatctttct

SEQ ID NO: 191194 - DNA, 20 bp, Artificial Sequence
  Synthetic oligonucleotide; CAGTGTTT chr2 60533181 60533200 60533197 +
tgctgcttctagggctgtgt

SEQ ID NO: 191195 - DNA, 20 bp, Artificial Sequence
  Synthetic oligonucleotide; TAAGGCTT chr2 60533245 60533264 60533261 +
ctcctggatagactgaataa

SEQ ID NO: 191196 - DNA, 20 bp, Artificial Sequence
  Synthetic oligonucleotide; AATTGTTT chr2 60533263 60533282 60533279 +
aataaggcttgtgatgacta

SEQ ID NO: 191197 - DNA, 20 bp, Artificial Sequence
  Synthetic oligonucleotide; TAAAGTTT chr2 60533301 60533320 60533317 +
ttgttaggatccctttcttg

SEQ ID NO: 191198 - DNA, 20 bp, Artificial Sequence
  Synthetic oligonucleotide; GAGAGATT chr2 60533370 60533389 60533386 +
ggtgatgcaagatagaagga

SEQ ID NO: 191199 - DNA, 20 bp, Artificial Sequence
  Synthetic oligonucleotide; ACTGGCTT chr2 60533383 60533402 60533399 +
agaaggagagagatttatac

SEQ ID NO: 191200 - DNA, 20 bp, Artificial Sequence
  Synthetic oligonucleotide; TGTTGCTT chr2 60533454 60533473 60533470 +
aagcagcatgcataagttag

SEQ ID NO: 191201 - DNA, 20 bp, Artificial Sequence
  Synthetic oligonucleotide; GCTTGTTT chr2 60533458 60533477 60533474 +
agcatgcataagttagtgtt

SEQ ID NO: 191202 - DNA, 20 bp, Artificial Sequence
  Synthetic oligonucleotide; TTTTGTTT chr2 60533463 60533482 60533479 +
gcataagttagtgttgcttg

SEQ ID NO: 191203 - DNA, 20 bp, Artificial Sequence
  Synthetic oligonucleotide; TGAAGATT chr2 60533534 60533553 60533550 +
actcagccccacataaagta

SEQ ID NO: 191204 - DNA, 20 bp, Artificial Sequence
  Synthetic oligonucleotide; ATTAGATT chr2 60533574 60533593 60533590 +
tttcaaatagcaaattatcc

SEQ ID NO: 191205 - DNA, 20 bp, Artificial Sequence
  Synthetic oligonucleotide; TACTGTTT chr2 60533801 60533820 60533817 +
taatttatttgtgttctgga

SEQ ID NO: 191206 - DNA, 20 bp, Artificial Sequence
  Synthetic oligonucleotide; GCATGCTT chr2 60533840 60533859 60533856 +
attaacaactttaaactgaa

SEQ ID NO: 191207 - DNA, 20 bp, Artificial Sequence
  Synthetic oligonucleotide; TTATGTTT chr2 60533913 60533932 60533929 +
ctcggaggttaaaattatag

SEQ ID NO: 191208 - DNA, 20 bp, Artificial Sequence
  Synthetic oligonucleotide; ATTCGTTT chr2 60533969 60533988 60533985 +
tttattttctttcattaaac

SEQ ID NO: 191209 - DNA, 20 bp, Artificial Sequence
  Synthetic oligonucleotide; TTCTGATT chr2 60534000 60534019 60534016 +
tcagaatatcagttacactg

SEQ ID NO: 191210 - DNA, 20 bp, Artificial Sequence
  Synthetic oligonucleotide; TTCTGCTT chr2 60534006 60534025 60534022 +
tatcagttacactgttctga

SEQ ID NO: 191211 - DNA, 20 bp, Artificial Sequence
  Synthetic oligonucleotide; CCTTGTTT chr2 60534135 60534154 60534151 +
tcggaaaccgttagttagca

SEQ ID NO: 191212 - DNA, 20 bp, Artificial Sequence
  Synthetic oligonucleotide; AAAGGTTT chr2 60534367 60534386 60534383 +
gaaacctaaagcattgttag

SEQ ID NO: 191213 - DNA, 20 bp, Artificial Sequence
  Synthetic oligonucleotide; CAAGGCTT chr2 60534437 60534456 60534453 +
tcttaatacactataatagc

SEQ ID NO: 191214 - DNA, 20 bp, Artificial Sequence
  Synthetic oligonucleotide; GAACGATT chr2 60534580 60534599 60534596 +
acagtcttctccccaaatga

SEQ ID NO: 191215 - DNA, 20 bp, Artificial Sequence
  Synthetic oligonucleotide; AAGTGATT chr2 60534785 60534804 60534801 +
aatacacaaaacatgatcaa

SEQ ID NO: 191216 - DNA, 20 bp, Artificial Sequence
  Synthetic oligonucleotide; AACAGCTT chr2 60534796 60534815 60534812 +
catgatcaaaagtgattaac

SEQ ID NO: 191217 - DNA, 20 bp, Artificial Sequence
  Synthetic oligonucleotide; CACTGCTT chr2 60534899 60534918 60534915 +
ttaatcttgagaagaaaaaa

SEQ ID NO: 191218 - DNA, 20 bp, Artificial Sequence
  Synthetic oligonucleotide; GCAAGATT chr2 60534931 60534950 60534947 +
ttttttacatcatcaatttt

SEQ ID NO: 191219 - DNA, 20 bp, Artificial Sequence
  Synthetic oligonucleotide; TGAAGATT chr2 60535165 60535184 60535181 +
tcataaagcaatttagcctt

SEQ ID NO: 191220 - DNA, 20 bp, Artificial Sequence
  Synthetic oligonucleotide; AAGTGCTT chr2 60535177 60535196 60535193 +
ttagcctttgaagattaaag

SEQ ID NO: 191221 - DNA, 20 bp, Artificial Sequence
  Synthetic oligonucleotide; ATGAGCTT chr2 60535194 60535213 60535210 +
aagaagtgcttaaaattcaa

SEQ ID NO: 191222 - DNA, 20 bp, Artificial Sequence
  Synthetic oligonucleotide; GTAAGATT chr2 60535215 60535234 60535231 +
tgagctttagcaaattatca

SEQ ID NO: 191223 - DNA, 20 bp, Artificial Sequence
  Synthetic oligonucleotide; AAGGGTTT chr2 60535236 60535255 60535252 +
taagattcatccaaaaagca

SEQ ID NO: 191224 - DNA, 20 bp, Artificial Sequence
  Synthetic oligonucleotide; CTATGATT chr2 60535250 60535269 60535266 +
aaagcaaagggtttttcttc

SEQ ID NO: 191225 - DNA, 20 bp, Artificial Sequence
  Synthetic oligonucleotide; CTGAGCTT chr2 60535297 60535316 60535313 +
aaattgtaatatcttccaga

SEQ ID NO: 191226 - DNA, 20 bp, Artificial Sequence
  Synthetic oligonucleotide; TAGAGCTT chr2 60535315 60535334 60535331 +
gactgagcttaaactaaaca

SEQ ID NO: 191227 - DNA, 20 bp, Artificial Sequence
  Synthetic oligonucleotide; AACAGATT chr2 60535488 60535507 60535504 +
actgcatagtcctccaacag

SEQ ID NO: 191228 - DNA, 20 bp, Artificial Sequence
  Synthetic oligonucleotide; AACAGCTT chr2 60535577 60535596 60535593 +
aacatccactgtggtataaa

SEQ ID NO: 191229 - DNA, 20 bp, Artificial Sequence
  Synthetic oligonucleotide; ATTGGCTT chr2 60535589 60535608 60535605 +
ggtataaaaacagctttttc

SEQ ID NO: 191230 - DNA, 20 bp, Artificial Sequence
  Synthetic oligonucleotide; AGAAGTTT chr2 60535614 60535633 60535630 +
cttggagtggcattaatttt

SEQ ID NO: 191231 - DNA, 20 bp, Artificial Sequence
  Synthetic oligonucleotide; TTCTGCTT chr2 60535620 60535639 60535636 +
gtggcattaattttagaagt

SEQ ID NO: 191232 - DNA, 20 bp, Artificial Sequence
  Synthetic oligonucleotide; TCTGGTTT chr2 60535679 60535698 60535695 +
caggagggagaggagcaagg

SEQ ID NO: 191233 - DNA, 20 bp, Artificial Sequence
  Synthetic oligonucleotide; TGTTGCTT chr2 60535708 60535727 60535724 +
cttctgaggagtgcaaatcc

SEQ ID NO: 191234 - DNA, 20 bp, Artificial Sequence
  Synthetic oligonucleotide; TTGAGATT chr2 60535714 60535733 60535730 +
aggagtgcaaatcctgttgc

SEQ ID NO: 191235 - DNA, 20 bp, Artificial Sequence
  Synthetic oligonucleotide; TTCTGATT chr2 60535727 60535746 60535743 +
ctgttgcttgagatttgcct

SEQ ID NO: 191236 - DNA, 20 bp, Artificial Sequence
  Synthetic oligonucleotide; CCTGGATT chr2 60535866 60535885 60535882 +
attagagagtatcgtgggaa

SEQ ID NO: 191237 - DNA, 20 bp, Artificial Sequence
  Synthetic oligonucleotide; GCAGGCTT chr2 60535875 60535894 60535891 +
tatcgtgggaacctggattt

SEQ ID NO: 191238 - DNA, 20 bp, Artificial Sequence
  Synthetic oligonucleotide; CTTTGCTT chr2 60535909 60535928 60535925 +
tactagtctggagaagaatc

SEQ ID NO: 191239 - DNA, 20 bp, Artificial Sequence
  Synthetic oligonucleotide; AACAGCTT chr2 60536086 60536105 60536102 +
gtgcaagtcagactgagaat

SEQ ID NO: 191240 - DNA, 20 bp, Artificial Sequence
  Synthetic oligonucleotide; CCCAGCTT chr2 60536109 60536128 60536125 +
agcttcgaaaggccacgtgt

SEQ ID NO: 191241 - DNA, 20 bp, Artificial Sequence
  Synthetic oligonucleotide; TGGGGATT chr2 60536152 60536171 60536168 +
gacccaaaagctctctgctg

SEQ ID NO: 191242 - DNA, 20 bp, Artificial Sequence
  Synthetic oligonucleotide; CCCTGATT chr2 60536322 60536341 60536338 +
gaaaaatctcaggtactacc

SEQ ID NO: 191243 - DNA, 20 bp, Artificial Sequence
  Synthetic oligonucleotide; TTCCGTTT chr2 60536468 60536487 60536484 +
aggtccacagtcctgaccaa

SEQ ID NO: 191244 - DNA, 20 bp, Artificial Sequence
  Synthetic oligonucleotide; ATTAGATT chr2 60536546 60536565 60536562 +
atgtgacagggcaaatcaga

SEQ ID NO: 191245 - DNA, 20 bp, Artificial Sequence
  Synthetic oligonucleotide; AAAAGTTT chr2 60536560 60536579 60536576 +
atcagaattagattaaaaac

SEQ ID NO: 191246 - DNA, 20 bp, Artificial Sequence
  Synthetic oligonucleotide; AAGTGATT chr2 60536632 60536651 60536648 +
aatttcccctaactgccttc

SEQ ID NO: 191247 - DNA, 20 bp, Artificial Sequence
  Synthetic oligonucleotide; GAGCGTTT chr2 60536650 60536669 60536666 +
tcaagtgattttccctatta

SEQ ID NO: 191248 - DNA, 20 bp, Artificial Sequence
  Synthetic oligonucleotide; ATAAGATT chr2 60536988 60537007 60537004 +
gcaatccacttgtatgtaga

SEQ ID NO: 191249 - DNA, 20 bp, Artificial Sequence
  Synthetic oligonucleotide; AAATGTTT chr2 60537065 60537084 60537081 +
catagtctttgaagctgctc

SEQ ID NO: 191250 - DNA, 20 bp, Artificial Sequence
  Synthetic oligonucleotide; AGTTGTTT chr2 60537089 60537108 60537105 +
gttttagttaaaaggacagc

SEQ ID NO: 191251 - DNA, 20 bp, Artificial Sequence
  Synthetic oligonucleotide; TATTGATT chr2 60537139 60537158 60537155 +
atcagaattaaatttttcct

SEQ ID NO: 191252 - DNA, 20 bp, Artificial Sequence
  Synthetic oligonucleotide; TTACGATT chr2 60537186 60537205 60537202 +
aaaaacataacatgagaagg

SEQ ID NO: 191253 - DNA, 20 bp, Artificial Sequence
  Synthetic oligonucleotide; TTCAGTTT chr2 60537243 60537262 60537259 +
tcattcttcagtagccaatg

SEQ ID NO: 191254 - DNA, 20 bp, Artificial Sequence
  Synthetic oligonucleotide; ACGAGATT chr2 60537305 60537324 60537321 +
ggtgtgatggagagaaactc

SEQ ID NO: 191255 - DNA, 20 bp, Artificial Sequence
  Synthetic oligonucleotide; TTAAGATT chr2 60537312 60537331 60537328 +
tggagagaaactcacgagat

SEQ ID NO: 191256 - DNA, 20 bp, Artificial Sequence
  Synthetic oligonucleotide; CATTGTTT chr2 60537335 60537354 60537351 +
agatttaacattggttaatg

SEQ ID NO: 191257 - DNA, 20 bp, Artificial Sequence
  Synthetic oligonucleotide; TCAGGTTT chr2 60537473 60537492 60537489 +
agttggtgaaggagaatact

SEQ ID NO: 191258 - DNA, 20 bp, Artificial Sequence
  Synthetic oligonucleotide; CTTAGTTT chr2 60537487 60537506 60537503 +
aatacttcaggtttggttct

SEQ ID NO: 191259 - DNA, 20 bp, Artificial Sequence
  Synthetic oligonucleotide; TGAGGTTT chr2 60537497 60537516 60537513 +
gtttggttctcttagttttt

SEQ ID NO: 191260 - DNA, 20 bp, Artificial Sequence
  Synthetic oligonucleotide; GTTTGTTT chr2 60537501 60537520 60537517 +
ggttctcttagttttttgag

SEQ ID NO: 191261 - DNA, 20 bp, Artificial Sequence
  Synthetic oligonucleotide; TTTTGTTT chr2 60537507 60537526 60537523 +
cttagttttttgaggtttgt

SEQ ID NO: 191262 - DNA, 20 bp, Artificial Sequence
  Synthetic oligonucleotide; CAGGGATT chr2 60537524 60537543 60537540 +
tgtttttgtttgaggaggtg

SEQ ID NO: 191263 - DNA, 20 bp, Artificial Sequence
  Synthetic oligonucleotide; TAGTGCTT chr2 60537584 60537603 60537600 +
acaggaacagacttggcaca

SEQ ID NO: 191264 - DNA, 20 bp, Artificial Sequence
  Synthetic oligonucleotide; ATGTGATT chr2 60537645 60537664 60537661 +
atttccctaaaaattaacag

SEQ ID NO: 191265 - DNA, 20 bp, Artificial Sequence
  Synthetic oligonucleotide; TGATGCTT chr2 60537725 60537744 60537741 +
gaatataaatttaaatgccc

SEQ ID NO: 191266 - DNA, 20 bp, Artificial Sequence
  Synthetic oligonucleotide; AAAAGCTT chr2 60537737 60537756 60537753 +
aaatgccctgatgcttagca

SEQ ID NO: 191267 - DNA, 20 bp, Artificial Sequence
  Synthetic oligonucleotide; TTGTGTTT chr2 60537747 60537766 60537763 +
atgcttagcaaaaagcttcc

SEQ ID NO: 191268 - DNA, 20 bp, Artificial Sequence
  Synthetic oligonucleotide; ACTGGTTT chr2 60537805 60537824 60537821 +
cgaggtaggtatacaacagc

SEQ ID NO: 191269 - DNA, 20 bp, Artificial Sequence
  Synthetic oligonucleotide; GCAGGTTT chr2 60537832 60537851 60537848 +
ttctttttgaaggcaccctt

SEQ ID NO: 191270 - DNA, 20 bp, Artificial Sequence
  Synthetic oligonucleotide; GGGAGTTT chr2 60537867 60537886 60537883 +
attccattctttattttaat

SEQ ID NO: 191271 - DNA, 20 bp, Artificial Sequence
  Synthetic oligonucleotide; AGTGGATT chr2 60537881 60537900 60537897 +
tttaatgggagtttttaatc

SEQ ID NO: 191272 - DNA, 20 bp, Artificial Sequence
  Synthetic oligonucleotide; GACTGATT chr2 60538055 60538074 60538071 +
actgggaattctctggcaga

SEQ ID NO: 191273 - DNA, 20 bp, Artificial Sequence
  Synthetic oligonucleotide; GGAAGTTT chr2 60538134 60538153 60538150 +
gccttctcgcctcttttaca

SEQ ID NO: 191274 - DNA, 20 bp, Artificial Sequence
  Synthetic oligonucleotide; TGTTGTTT chr2 60538177 60538196 60538193 +
acctttaggtatatataatt

SEQ ID NO: 191275 - DNA, 20 bp, Artificial Sequence
  Synthetic oligonucleotide; AGCAGCTT chr2 60538433 60538452 60538449 +
cttctaattcgccagttctt

SEQ ID NO: 191276 - DNA, 20 bp, Artificial Sequence
  Synthetic oligonucleotide; AAGTGTTT chr2 60538449 60538468 60538465 +
tcttagcagcttatttttcc

SEQ ID NO: 191277 - DNA, 20 bp, Artificial Sequence
  Synthetic oligonucleotide; TTTTGTTT chr2 60538454 60538473 60538470 +
gcagcttatttttccaagtg

SEQ ID NO: 191278 - DNA, 20 bp, Artificial Sequence
  Synthetic oligonucleotide; ATACGTTT chr2 60538484 60538503 60538500 +
ggaaacgtgtatttttcttt

SEQ ID NO: 191279 - DNA, 20 bp, Artificial Sequence
  Synthetic oligonucleotide; AACTGCTT chr2 60538506 60538525 60538522 +
acgttttgtggatctaccac

SEQ ID NO: 191280 - DNA, 20 bp, Artificial Sequence
  Synthetic oligonucleotide; TGTTGATT chr2 60538522 60538541 60538538 +
ccacaactgcttctgacagc

SEQ ID NO: 191281 - DNA, 20 bp, Artificial Sequence
  Synthetic oligonucleotide; AGTTGTTT chr2 60538628 60538647 60538644 +
ttaatggaattccagttgaa

SEQ ID NO: 191282 - DNA, 20 bp, Artificial Sequence
  Synthetic oligonucleotide; ACTAGATT chr2 60538681 60538700 60538697 +
cagaagtcctttagatcagt

SEQ ID NO: 191283 - DNA, 20 bp, Artificial Sequence
  Synthetic oligonucleotide; TGATGTTT chr2 60539013 60539032 60539029 +
actccaagagaagaaaagga

SEQ ID NO: 191284 - DNA, 20 bp, Artificial Sequence
  Synthetic oligonucleotide; CTAAGTTT chr2 60539108 60539127 60539124 +
tgtctttcacactgggctat

SEQ ID NO: 191285 - DNA, 20 bp, Artificial Sequence
  Synthetic oligonucleotide; TTAAGCTT chr2 60539142 60539161 60539158 +
ttccccagactagctgcata

SEQ ID NO: 191286 - DNA, 20 bp, Artificial Sequence
  Synthetic oligonucleotide; TACAGCTT chr2 60539156 60539175 60539172 +
tgcatattaagcttgctgtg

SEQ ID NO: 191287 - DNA, 20 bp, Artificial Sequence
  Synthetic oligonucleotide; AAATGTTT chr2 60539463 60539482 60539479 +
aacagcaaaagcctttgctg

SEQ ID NO: 191288 - DNA, 20 bp, Artificial Sequence
  Synthetic oligonucleotide; AACTGATT chr2 60539557 60539576 60539573 +
tggaataagttacattttaa

SEQ ID NO: 191289 - DNA, 20 bp, Artificial Sequence
  Synthetic oligonucleotide; TGATGTTT chr2 60539577 60539596 60539593 +
aactgattagaaatacagtc

SEQ ID NO: 191290 - DNA, 20 bp, Artificial Sequence
  Synthetic oligonucleotide; ACTGGCTT chr2 60539585 60539604 60539601 +
agaaatacagtctgatgttt

SEQ ID NO: 191291 - DNA, 20 bp, Artificial Sequence
  Synthetic oligonucleotide; TTGAGTTT chr2 60539597 60539616 60539613 +
tgatgtttactggcttcaaa

SEQ ID NO: 191292 - DNA, 20 bp, Artificial Sequence
  Synthetic oligonucleotide; ACTGGCTT chr2 60539617 60539636 60539633 +
ttgagtttggcatcaagtat

SEQ ID NO: 191293 - DNA, 20 bp, Artificial Sequence
  Synthetic oligonucleotide; TTAAGTTT chr2 60539737 60539756 60539753 +
caggttacatttcctggaaa

SEQ ID NO: 191294 - DNA, 20 bp, Artificial Sequence
  Synthetic oligonucleotide; AGCTGTTT chr2 60539886 60539905 60539902 +
ccctggtcgtaaaggggaga

SEQ ID NO: 191295 - DNA, 20 bp, Artificial Sequence
  Synthetic oligonucleotide; ACCTGCTT chr2 60540067 60540086 60540083 +
aattgatacataacataaaa

SEQ ID NO: 191296 - DNA, 20 bp, Artificial Sequence
  Synthetic oligonucleotide; GCTTGATT chr2 60540071 60540090 60540087 +
gatacataacataaaaacct

SEQ ID NO: 191297 - DNA, 20 bp, Artificial Sequence
  Synthetic oligonucleotide; AGATGCTT chr2 60540196 60540215 60540212 +
aacaagcagaaaggtactaa

SEQ ID NO: 191298 - DNA, 20 bp, Artificial Sequence
  Synthetic oligonucleotide; TGGTGATT chr2 60540203 60540222 60540219 +
agaaaggtactaaagatgct

SEQ ID NO: 191299 - DNA, 20 bp, Artificial Sequence
  Synthetic oligonucleotide; TCCAGCTT chr2 60540250 60540269 60540266 +
tggcaaggtgccaggctggg

SEQ ID NO: 191300 - DNA, 20 bp, Artificial Sequence
  Synthetic oligonucleotide; AAGTGCTT chr2 60540264 60540283 60540280 +
gctgggtccagcttgatgct

SEQ ID NO: 191301 - DNA, 20 bp, Artificial Sequence
  Synthetic oligonucleotide; TTGGGCTT chr2 60540313 60540332 60540329 +
tactgtatgtaaaaacagac

SEQ ID NO: 191302 - DNA, 20 bp, Artificial Sequence
  Synthetic oligonucleotide; AGTAGATT chr2 60540380 60540399 60540396 +
ggtgtgaacagaccaaccaa

SEQ ID NO: 191303 - DNA, 20 bp, Artificial Sequence
  Synthetic oligonucleotide; CTGTGCTT chr2 60540429 60540448 60540445 +
atcttggtgcatctccctag

SEQ ID NO: 191304 - DNA, 20 bp, Artificial Sequence
  Synthetic oligonucleotide; ATTTGTTT chr2 60540482 60540501 60540498 +
ccccccaaaggaaagccaaa

SEQ ID NO: 191305 - DNA, 20 bp, Artificial Sequence
  Synthetic oligonucleotide; AAATGTTT chr2 60540576 60540595 60540592 +
agaaatcacaaaaatctaaa

SEQ ID NO: 191306 - DNA, 20 bp, Artificial Sequence
  Synthetic oligonucleotide; CTAGGATT chr2 60540586 60540605 60540602 +
aaaatctaaaaaatgtttcc

SEQ ID NO: 191307 - DNA, 20 bp, Artificial Sequence
  Synthetic oligonucleotide; GCATGTTT chr2 60540595 60540614 60540611 +
aaaatgtttccctaggattt

SEQ ID NO: 191308 - DNA, 20 bp, Artificial Sequence
  Synthetic oligonucleotide; TAATGATT chr2 60540666 60540685 60540682 +
tggaagctgcagtgtgaaat

SEQ ID NO: 191309 - DNA, 20 bp, Artificial Sequence
  Synthetic oligonucleotide; GCACGTTT chr2 60540757 60540776 60540773 +
tgcctgtcctgaccctgcct

SEQ ID NO: 191310 - DNA, 20 bp, Artificial Sequence
  Synthetic oligonucleotide; GGGTGATT chr2 60540897 60540916 60540913 +
ttgcaacacaacaaggaatg

SEQ ID NO: 191311 - DNA, 20 bp, Artificial Sequence
  Synthetic oligonucleotide; ACTGGTTT chr2 60540919 60540938 60540935 +
gtgatttaagaaattacagc

SEQ ID NO: 191312 - DNA, 20 bp, Artificial Sequence
  Synthetic oligonucleotide; TTTTGTTT chr2 60540977 60540996 60540993 +
tgtgtgtgtgtgtgtggtta

SEQ ID NO: 191313 - DNA, 20 bp, Artificial Sequence
  Synthetic oligonucleotide; TTTTGTTT chr2 60540985 60541004 60541001 +
tgtgtgtggttattttgttt

SEQ ID NO: 191314 - DNA, 20 bp, Artificial Sequence
  Synthetic oligonucleotide; TTAAGCTT chr2 60540995 60541014 60541011 +
tattttgtttttttgttttt

SEQ ID NO: 191315 - DNA, 20 bp, Artificial Sequence
  Synthetic oligonucleotide; TTGTGTTT chr2 60541076 60541095 60541092 +
ttcttgaagtgaatacatat

SEQ ID NO: 191316 - DNA, 20 bp, Artificial Sequence
  Synthetic oligonucleotide; AGAAGTTT chr2 60541272 60541291 60541288 +
accacaagggtaatgtctga

SEQ ID NO: 191317 - DNA, 20 bp, Artificial Sequence
  Synthetic oligonucleotide; TTTGGCTT chr2 60541326 60541345 60541342 +
agatatattttttttttcct

SEQ ID NO: 191318 - DNA, 20 bp, Artificial Sequence
  Synthetic oligonucleotide; GTAAGTTT chr2 60541340 60541359 60541356 +
tttccttttggctttcctta

SEQ ID NO: 191319 - DNA, 20 bp, Artificial Sequence
  Synthetic oligonucleotide; CTGTGTTT chr2 60541365 60541384 60541381 +
tttagcagccatgcgggcca

SEQ ID NO: 191320 - DNA, 20 bp, Artificial Sequence
  Synthetic oligonucleotide; TTAAGCTT chr2 60541375 60541394 60541391 +
atgcgggccactgtgtttaa

SEQ ID NO: 191321 - DNA, 20 bp, Artificial Sequence
  Synthetic oligonucleotide; AAGAGTTT chr2 60541475 60541494 60541491 +
tatttacaatttgtcttaga

SEQ ID NO: 191322 - DNA, 20 bp, Artificial Sequence
  Synthetic oligonucleotide; TACAGCTT chr2 60541552 60541571 60541568 +
ttctctgtcttatttacaaa

SEQ ID NO: 191323 - DNA, 20 bp, Artificial Sequence
  Synthetic oligonucleotide; CCCAGTTT chr2 60541572 60541591 60541588 +
tacagcttgtatataggact

SEQ ID NO: 191324 - DNA, 20 bp, Artificial Sequence
  Synthetic oligonucleotide; TCTGGATT chr2 60541670 60541689 60541686 +
gaaaacaatattctctactc

SEQ ID NO: 191325 - DNA, 20 bp, Artificial Sequence
  Synthetic oligonucleotide; TATTGTTT chr2 60541706 60541725 60541722 +
aagtaaaatgttcaccagta

SEQ ID NO: 191326 - DNA, 20 bp, Artificial Sequence
  Synthetic oligonucleotide; TGGTGTTT chr2 60541724 60541743 60541740 +
tatattgttttttgtggtag

SEQ ID NO: 191327 - DNA, 20 bp, Artificial Sequence
  Synthetic oligonucleotide; TTTTGTTT chr2 60541732 60541751 60541748 +
tttttgtggtagtggtgttt

SEQ ID NO: 191328 - DNA, 20 bp, Artificial Sequence
  Synthetic oligonucleotide; AGTCGTTT chr2 60541773 60541792 60541789 +
gaaaattcacttcagaagtc

SEQ ID NO: 191329 - DNA, 20 bp, Artificial Sequence
  Synthetic oligonucleotide; ATTTGATT chr2 60541977 60541996 60541993 +
aattctgaaaagcatattgt

SEQ ID NO: 191330 - DNA, 20 bp, Artificial Sequence
  Synthetic oligonucleotide; TCATGATT chr2 60542130 60542149 60542146 +
cctgatataaatgtctatgt

SEQ ID NO: 191331 - DNA, 20 bp, Artificial Sequence
  Synthetic oligonucleotide; TAAAGATT chr2 60542256 60542275 60542272 +
atgacagcccaaacctaatt

SEQ ID NO: 191332 - DNA, 20 bp, Artificial Sequence
  Synthetic oligonucleotide; TAATGTTT chr2 60542307 60542326 60542323 +
tcaaatctgacatgatggga

SEQ ID NO: 191333 - DNA, 20 bp, Artificial Sequence
  Synthetic oligonucleotide; AGCAGTTT chr2 60542336 60542355 60542352 +
ggtcttttctataagggaac

SEQ ID NO: 191334 - DNA, 20 bp, Artificial Sequence
  Synthetic oligonucleotide; ACCTGATT chr2 60542616 60542635 60542632 +
taaataaaatgaaaaaagca

SEQ ID NO: 191335 - DNA, 20 bp, Artificial Sequence
  Synthetic oligonucleotide; CTCAGTTT chr2 60542718 60542737 60542734 +
aaagaatcctctaaaaaata

SEQ ID NO: 191336 - DNA, 20 bp, Artificial Sequence
  Synthetic oligonucleotide; AATCGCTT chr2 60542921 60542940 60542937 +
ttgggaggctgaggcaggag

SEQ ID NO: 191337 - DNA, 20 bp, Artificial Sequence
  Synthetic oligonucleotide; CTCAGCTT chr2 60543034 60543053 60543050 +
aaaaaaaaaaaaaaaaaaaa

SEQ ID NO: 191338 - DNA, 20 bp, Artificial Sequence
  Synthetic oligonucleotide; TCAAGATT chr2 60543081 60543100 60543097 +
gaaaatgcataccattttac

SEQ ID NO: 191339 - DNA, 20 bp, Artificial Sequence
  Synthetic oligonucleotide; CTAAGCTT chr2 60543131 60543150 60543147 +
ctatctgaaagtcccgaatt

SEQ ID NO: 191340 - DNA, 20 bp, Artificial Sequence
  Synthetic oligonucleotide; CACTGTTT chr2 60543164 60543183 60543180 +
atcttaggaagaagatctgt

SEQ ID NO: 191341 - DNA, 20 bp, Artificial Sequence
  Synthetic oligonucleotide; TCTTGCTT chr2 60543175 60543194 60543191 +
aagatctgtcactgttttat

SEQ ID NO: 191342 - DNA, 20 bp, Artificial Sequence
  Synthetic oligonucleotide; GCACGCTT chr2 60543260 60543279 60543276 +
aataaagcctttcctaccca

SEQ ID NO: 191343 - DNA, 20 bp, Artificial Sequence
  Synthetic oligonucleotide; TAGAGATT chr2 60543307 60543326 60543323 +
ggttgccaaacacattcttc

SEQ ID NO: 191344 - DNA, 20 bp, Artificial Sequence
  Synthetic oligonucleotide; CATTGCTT chr2 60543345 60543364 60543361 +
tctctttccttaatacaagg

SEQ ID NO: 191345 - DNA, 20 bp, Artificial Sequence
  Synthetic oligonucleotide; GAATGATT chr2 60543389 60543408 60543405 +
acacaattcaaatatctact

SEQ ID NO: 191346 - DNA, 20 bp, Artificial Sequence
  Synthetic oligonucleotide; TATTGTTT chr2 60543402 60543421 60543418 +
atctactgaatgattactgt

SEQ ID NO: 191347 - DNA, 20 bp, Artificial Sequence
  Synthetic oligonucleotide; ACGTGCTT chr2 60543453 60543472 60543469 +
gcagacttggaattgtgcag

SEQ ID NO: 191348 - DNA, 20 bp, Artificial Sequence
  Synthetic oligonucleotide; CTTCGCTT chr2 60543504 60543523 60543520 +
cacacagccgtcttccagaa

SEQ ID NO: 191349 - DNA, 20 bp, Artificial Sequence
  Synthetic oligonucleotide; TCGTGATT chr2 60543613 60543632 60543629 +
ttactgtgaattatgagaag

SEQ ID NO: 191350 - DNA, 20 bp, Artificial Sequence
  Synthetic oligonucleotide; AGGTGATT chr2 60543690 60543709 60543706 +
gccagttccagggtgggaac

SEQ ID NO: 191351 - DNA, 20 bp, Artificial Sequence
  Synthetic oligonucleotide; AAAGGTTT chr2 60543742 60543761 60543758 +
tttgtaattattcatgcacg

SEQ ID NO: 191352 - DNA, 20 bp, Artificial Sequence
  Synthetic oligonucleotide; GAGAGCTT chr2 60543806 60543825 60543822 +
tgaatatcttagacatctta

SEQ ID NO: 191353 - DNA, 20 bp, Artificial Sequence
  Synthetic oligonucleotide; AAATGATT chr2 60543826 60543845 60543842 +
gagagcttttcgtctcagtt

SEQ ID NO: 191354 - DNA, 20 bp, Artificial Sequence
  Synthetic oligonucleotide; GATTGATT chr2 60543830 60543849 60543846 +
gcttttcgtctcagttaaat

SEQ ID NO: 191355 - DNA, 20 bp, Artificial Sequence
  Synthetic oligonucleotide; ATTTGCTT chr2 60543863 60543882 60543879 +
cgctataaaatatattttaa

SEQ ID NO: 191356 - DNA, 20 bp, Artificial Sequence
  Synthetic oligonucleotide; TTTGGTTT chr2 60543870 60543889 60543886 +
aaatatattttaaatttgct

SEQ ID NO: 191357 - DNA, 20 bp, Artificial Sequence
  Synthetic oligonucleotide; TTTGGCTT chr2 60543876 60543895 60543892 +
attttaaatttgcttttggt

SEQ ID NO: 191358 - DNA, 20 bp, Artificial Sequence
  Synthetic oligonucleotide; CATAGATT chr2 60543978 60543997 60543994 +
aaatatctcttatttcccta

SEQ ID NO: 191359 - DNA, 20 bp, Artificial Sequence
  Synthetic oligonucleotide; TTTAGATT chr2 60544038 60544057 60544054 +
gtaaggccttccccccagca

SEQ ID NO: 191360 - DNA, 20 bp, Artificial Sequence
  Synthetic oligonucleotide; TGTGGTTT chr2 60544127 60544146 60544143 +
tttgggacctcagtaagaag

SEQ ID NO: 191361 - DNA, 20 bp, Artificial Sequence
  Synthetic oligonucleotide; TCTTGCTT chr2 60544139 60544158 60544155 +
gtaagaagtgtggttttaat

SEQ ID NO: 191362 - DNA, 20 bp, Artificial Sequence
  Synthetic oligonucleotide; CTGTGTTT chr2 60544155 60544174 60544171 +
taattcttgcttgacagaca

SEQ ID NO: 191363 - DNA, 20 bp, Artificial Sequence
  Synthetic oligonucleotide; TGGTGATT chr2 60544229 60544248 60544245 +
cgcaagtgttactccatatt

SEQ ID NO: 191364 - DNA, 20 bp, Artificial Sequence
  Synthetic oligonucleotide; CAAGGCTT chr2 60544240 60544259 60544256 +
ctccatatttggtgatttag

SEQ ID NO: 191365 - DNA, 20 bp, Artificial Sequence
  Synthetic oligonucleotide; TCTTGCTT chr2 60544284 60544303 60544300 +
acaaatccccttccgcctgc

SEQ ID NO: 191366 - DNA, 20 bp, Artificial Sequence
  Synthetic oligonucleotide; GGTGGATT chr2 60544425 60544444 60544441 +
atgtcacataaggtaaatgt

SEQ ID NO: 191367 - DNA, 20 bp, Artificial Sequence
  Synthetic oligonucleotide; TGCAGCTT chr2 60544453 60544472 60544469 +
caagaaatacactccacaaa

SEQ ID NO: 191368 - DNA, 20 bp, Artificial Sequence
  Synthetic oligonucleotide; AGCAGATT chr2 60544468 60544487 60544484 +
acaaatgcagcttccctagc

SEQ ID NO: 191369 - DNA, 20 bp, Artificial Sequence
  Synthetic oligonucleotide; CCATGTTT chr2 60544543 60544562 60544559 +
ctaaaaaaagaaagaaaatg

SEQ ID NO: 191370 - DNA, 20 bp, Artificial Sequence
  Synthetic oligonucleotide; TTTGGTTT chr2 60544548 60544567 60544564 +
aaaagaaagaaaatgccatg

SEQ ID NO: 191371 - DNA, 20 bp, Artificial Sequence
  Synthetic oligonucleotide; AAATGTTT chr2 60544837 60544856 60544853 +
gtctaacatgctcaagcaaa

SEQ ID NO: 191372 - DNA, 20 bp, Artificial Sequence
  Synthetic oligonucleotide; TACTGTTT chr2 60544865 60544884 60544881 +
tgagggtcactatatagtgt

SEQ ID NO: 191373 - DNA, 20 bp, Artificial Sequence
  Synthetic oligonucleotide; GTGCGCTT chr2 60545272 60545291 60545288 +
cttttcgagtaagcatgtct

SEQ ID NO: 191374 - DNA, 20 bp, Artificial Sequence
  Synthetic oligonucleotide; CTGTGTTT chr2 60545363 60545382 60545379 +
ggtgtcatcccaccacgggg

SEQ ID NO: 191375 - DNA, 20 bp, Artificial Sequence
  Synthetic oligonucleotide; ATCTGATT chr2 60545744 60545763 60545760 +
tgtgtacctatcctgcctac

SEQ ID NO: 191376 - DNA, 20 bp, Artificial Sequence
  Synthetic oligonucleotide; AAATGATT chr2 60545802 60545821 60545818 +
gttctggacgtaagcaacag

SEQ ID NO: 191377 - DNA, 20 bp, Artificial Sequence
  Synthetic oligonucleotide; TACTGCTT chr2 60545877 60545896 60545893 +
gaaagcacttcacaactcct

SEQ ID NO: 191378 - DNA, 20 bp, Artificial Sequence
  Synthetic oligonucleotide; AACAGCTT chr2 60545922 60545941 60545938 +
aaatgaaaagaaaacatgca

SEQ ID NO: 191379 - DNA, 20 bp, Artificial Sequence
  Synthetic oligonucleotide; CCTTGCTT chr2 60545934 60545953 60545950 +
aacatgcaaacagcttttct

SEQ ID NO: 191380 - DNA, 20 bp, Artificial Sequence
  Synthetic oligonucleotide; TCCTGTTT chr2 60545962 60545981 60545978 +
ctcatttacctgctatgtgt

SEQ ID NO: 191381 - DNA, 20 bp, Artificial Sequence
  Synthetic oligonucleotide; ACGGGATT chr2 60546040 60546059 60546056 +
tgacctggatgccaacctcc

SEQ ID NO: 191382 - DNA, 20 bp, Artificial Sequence
  Synthetic oligonucleotide; GGATGCTT chr2 60546048 60546067 60546064 +
atgccaacctccacgggatt

SEQ ID NO: 191383 - DNA, 20 bp, Artificial Sequence
  Synthetic oligonucleotide; TCTCGATT chr2 60546062 60546081 60546078 +
gggattggatgcttttttca

SEQ ID NO: 191384 - DNA, 20 bp, Artificial Sequence
  Synthetic oligonucleotide; GGTGGCTT chr2 60546082 60546101 60546098 +
tctcgattggtgaaggggaa

SEQ ID NO: 191385 - DNA, 20 bp, Artificial Sequence
  Synthetic oligonucleotide; CACAGCTT chr2 60546093 60546112 60546109 +
gaaggggaaggtggcttatc

SEQ ID NO: 191386 - DNA, 20 bp, Artificial Sequence
  Synthetic oligonucleotide; CATTGTTT chr2 60546124 60546143 60546140 +
ctaagcagaggctgccattg

SEQ ID NO: 191387 - DNA, 20 bp, Artificial Sequence
  Synthetic oligonucleotide; TTCCGTTT chr2 60546130 60546149 60546146 +
agaggctgccattgcattgt

SEQ ID NO: 191388 - DNA, 20 bp, Artificial Sequence
  Synthetic oligonucleotide; AATGGCTT chr2 60546261 60546280 60546277 +
tctggttcatcatctgtaag

SEQ ID NO: 191389 - DNA, 20 bp, Artificial Sequence
  Synthetic oligonucleotide; AAGTGTTT chr2 60546380 60546399 60546396 +
ccatcccaccacatcatgta

SEQ ID NO: 191390 - DNA, 20 bp, Artificial Sequence
  Synthetic oligonucleotide; CTAGGCTT chr2 60546388 60546407 60546404 +
ccacatcatgtaaagtgttt

SEQ ID NO: 191391 - DNA, 20 bp, Artificial Sequence
  Synthetic oligonucleotide; TCTGGTTT chr2 60546582 60546601 60546598 +
cacccacagcaacaaatgtg

SEQ ID NO: 191392 - DNA, 20 bp, Artificial Sequence
  Synthetic oligonucleotide; GTAAGTTT chr2 60546590 60546609 60546606 +
gcaacaaatgtgtctggttt

SEQ ID NO: 191393 - DNA, 20 bp, Artificial Sequence
  Synthetic oligonucleotide; GAAAGCTT chr2 60546639 60546658 60546655 +
gttaacacagggaacataaa

SEQ ID NO: 191394 - DNA, 20 bp, Artificial Sequence
  Synthetic oligonucleotide; ATTTGTTT chr2 60546699 60546718 60546715 +
aaaaagtggatagaaaccaa

SEQ ID NO: 191395 - DNA, 20 bp, Artificial Sequence
  Synthetic oligonucleotide; CATGGCTT chr2 60546814 60546833 60546830 +
tatactcctaagtaaacaga

SEQ ID NO: 191396 - DNA, 20 bp, Artificial Sequence
  Synthetic oligonucleotide; ACATGTTT chr2 60547127 60547146 60547143 +
gaatgcctataatattctaa

SEQ ID NO: 191397 - DNA, 20 bp, Artificial Sequence
  Synthetic oligonucleotide; AAATGCTT chr2 60547278 60547297 60547294 +
aattttctgaatgagctcca

SEQ ID NO: 191398 - DNA, 20 bp, Artificial Sequence
  Synthetic oligonucleotide; TCCTGTTT chr2 60547354 60547373 60547370 +
aaggtagacatgtctttctt

SEQ ID NO: 191399 - DNA, 20 bp, Artificial Sequence
  Synthetic oligonucleotide; GTTTGCTT chr2 60547358 60547377 60547374 +
tagacatgtctttctttcct

SEQ ID NO: 191400 - DNA, 20 bp, Artificial Sequence
  Synthetic oligonucleotide; ACCAGCTT chr2 60547407 60547426 60547423 +
aatactccagcatctacttt

SEQ ID NO: 191401 - DNA, 20 bp, Artificial Sequence
  Synthetic oligonucleotide; TTAAGCTT chr2 60547425 60547444 60547441 +
ttaccagcttctatcatttt

SEQ ID NO: 191402 - DNA, 20 bp, Artificial Sequence
  Synthetic oligonucleotide; CTCTGCTT chr2 60547460 60547479 60547476 +
ggaaaagagagttggtaagt

SEQ ID NO: 191403 - DNA, 20 bp, Artificial Sequence
  Synthetic oligonucleotide; TTATGCTT chr2 60547476 60547495 60547492 +
aagtctctgcttgtgaaatc

SEQ ID NO: 191404 - DNA, 20 bp, Artificial Sequence
  Synthetic oligonucleotide; AATAGATT chr2 60547654 60547673 60547670 +
aaagccacagagaatcaaaa

SEQ ID NO: 191405 - DNA, 20 bp, Artificial Sequence
  Synthetic oligonucleotide; AACAGATT chr2 60547685 60547704 60547701 +
atttgagtgtagaatattgg

SEQ ID NO: 191406 - DNA, 20 bp, Artificial Sequence
  Synthetic oligonucleotide; TTATGTTT chr2 60547953 60547972 60547969 +
aaagacagtaaagtaagcac

SEQ ID NO: 191407 - DNA, 20 bp, Artificial Sequence
  Synthetic oligonucleotide; ATTTGCTT chr2 60548077 60548096 60548093 +
taatgtcattcttctcttac

SEQ ID NO: 191408 - DNA, 20 bp, Artificial Sequence
  Synthetic oligonucleotide; TAAGGATT chr2 60548144 60548163 60548160 +
aatattcctgttgtctgaat

SEQ ID NO: 191409 - DNA, 20 bp, Artificial Sequence
  Synthetic oligonucleotide; TGTGGCTT chr2 60548171 60548190 60548187 +
tttaagtacacattgataaa

SEQ ID NO: 191410 - DNA, 20 bp, Artificial Sequence
  Synthetic oligonucleotide; TTTTGTTT chr2 60548179 60548198 60548195 +
cacattgataaatgtggctt

SEQ ID NO: 191411 - DNA, 20 bp, Artificial Sequence
  Synthetic oligonucleotide; TGAGGTTT chr2 60548205 60548224 60548221 +
ttagcattagctacaagttc

SEQ ID NO: 191412 - DNA, 20 bp, Artificial Sequence
  Synthetic oligonucleotide; TTAAGATT chr2 60548302 60548321 60548318 +
aaaattttttatttccaccg

SEQ ID NO: 191413 - DNA, 20 bp, Artificial Sequence
  Synthetic oligonucleotide; AACTGATT chr2 60548464 60548483 60548480 +
tcttctaaatgtagtgactg

SEQ ID NO: 191414 - DNA, 20 bp, Artificial Sequence
  Synthetic oligonucleotide; TGCTGATT chr2 60548511 60548530 60548527 +
tgaagtggtaattcagaggt

SEQ ID NO: 191415 - DNA, 20 bp, Artificial Sequence
  Synthetic oligonucleotide; ATACGTTT chr2 60548678 60548697 60548694 +
attatattctaatgtatgaa

SEQ ID NO: 191416 - DNA, 20 bp, Artificial Sequence
  Synthetic oligonucleotide; ACGTGTTT chr2 60548740 60548759 60548756 +
gtgttcagagaaataccaaa

SEQ ID NO: 191417 - DNA, 20 bp, Artificial Sequence
  Synthetic oligonucleotide; TACTGATT chr2 60548830 60548849 60548846 +
acaattctcatggtgtagtc

SEQ ID NO: 191418 - DNA, 20 bp, Artificial Sequence
  Synthetic oligonucleotide; CCTCGATT chr2 60549049 60549068 60549065 +
ccggctacaaagcagggagt

SEQ ID NO: 191419 - DNA, 20 bp, Artificial Sequence
  Synthetic oligonucleotide; AAATGCTT chr2 60549136 60549155 60549152 +
ggaggaagaaatagaaaata

SEQ ID NO: 191420 - DNA, 20 bp, Artificial Sequence
  Synthetic oligonucleotide; TCAAGTTT chr2 60549338 60549357 60549354 +
ggggaaagggagatgtgtct

SEQ ID NO: 191421 - DNA, 20 bp, Artificial Sequence
  Synthetic oligonucleotide; GTTTGCTT chr2 60549342 60549361 60549358 +
aaagggagatgtgtcttcaa

SEQ ID NO: 191422 - DNA, 20 bp, Artificial Sequence
  Synthetic oligonucleotide; CCTTGATT chr2 60549363 60549382 60549379 +
tttgctttccaagtccttct

SEQ ID NO: 191423 - DNA, 20 bp, Artificial Sequence
  Synthetic oligonucleotide; CCGCGCTT chr2 60549557 60549576 60549573 +
gtgctggctgcaggctcccg

SEQ ID NO: 191424 - DNA, 20 bp, Artificial Sequence
  Synthetic oligonucleotide; TGAGGTTT chr2 60549727 60549746 60549743 +
ccagttggtgaaaaaggaag

SEQ ID NO: 191425 - DNA, 20 bp, Artificial Sequence
  Synthetic oligonucleotide; CTGAGATT chr2 60549799 60549818 60549815 +
acacacctcaagcgcgggtc

SEQ ID NO: 191426 - DNA, 20 bp, Artificial Sequence
  Synthetic oligonucleotide; ACAAGCTT chr2 60549819 60549838 60549835 +
ctgagattcattctgtgtcc

SEQ ID NO: 191427 - DNA, 20 bp, Artificial Sequence
  Synthetic oligonucleotide; TTGTGATT chr2 60549967 60549986 60549983 +
gatgataactattactattg

SEQ ID NO: 191428 - DNA, 20 bp, Artificial Sequence
  Synthetic oligonucleotide; CTGTGCTT chr2 60550047 60550066 60550063 +
ccagccgaggccaccgaggt

SEQ ID NO: 191429 - DNA, 20 bp, Artificial Sequence
  Synthetic oligonucleotide; GGTCGCTT chr2 60550271 60550290 60550287 +
ggggtgtcggccgcgcgccc

SEQ ID NO: 191430 - DNA, 20 bp, Artificial Sequence
  Synthetic oligonucleotide; CTGAGCTT chr2 60550471 60550490 60550487 +
ctggtacaggttcaagttcg

SEQ ID NO: 191431 - DNA, 20 bp, Artificial Sequence
  Synthetic oligonucleotide; GGGAGCTT chr2 60550992 60551011 60551008 +
cgcgcaacgtgccggggtgg

SEQ ID NO: 191432 - DNA, 20 bp, Artificial Sequence
  Synthetic oligonucleotide; ACGCGCTT chr2 60551576 60551595 60551592 +
gaggggaggggaggcgcaga

SEQ ID NO: 191433 - DNA, 20 bp, Artificial Sequence
  Synthetic oligonucleotide; AAATGCTT chr2 60551606 60551625 60551622 +
acagttgccctgcaaaataa

SEQ ID NO: 191434 - DNA, 20 bp, Artificial Sequence
  Synthetic oligonucleotide; CCGAGTTT chr2 60551621 60551640 60551637 +
aataaaaatgctttgcaaag

SEQ ID NO: 191435 - DNA, 20 bp, Artificial Sequence
  Synthetic oligonucleotide; AGCCGATT chr2 60551634 60551653 60551650 +
tgcaaagccgagtttcaccc

SEQ ID NO: 191436 - DNA, 20 bp, Artificial Sequence
  Synthetic oligonucleotide; GTCTGTTT chr2 60551880 60551899 60551896 +
cgcgccgcgctcggtcctct

SEQ ID NO: 191437 - DNA, 20 bp, Artificial Sequence
  Synthetic oligonucleotide; CGGTGCTT chr2 60551912 60551931 60551928 +
gcaggaggctcccgcacacg

SEQ ID NO: 191438 - DNA, 20 bp, Artificial Sequence
  Synthetic oligonucleotide; ACGAGATT chr2 60551934 60551953 60551950 +
gtgcttgtaaacattcagac

SEQ ID NO: 191439 - DNA, 20 bp, Artificial Sequence
  Synthetic oligonucleotide; CTAAGTTT chr2 60552038 60552057 60552054 +
ctctccgtgccgtcggcgcc

SEQ ID NO: 191440 - DNA, 20 bp, Artificial Sequence
  Synthetic oligonucleotide; AGGGGTTT chr2 60552054 60552073 60552070 +
cgccctaagtttgcaactga

SEQ ID NO: 191441 - DNA, 20 bp, Artificial Sequence
  Synthetic oligonucleotide; GGGTGATT chr2 60552071 60552090 60552087 +
tgaaggggtttgggggaaga

SEQ ID NO: 191442 - DNA, 20 bp, Artificial Sequence
  Synthetic oligonucleotide; GAGAGATT chr2 60552097 60552116 60552113 +
ttgtaaatttttttctagat

SEQ ID NO: 191443 - DNA, 20 bp, Artificial Sequence
  Synthetic oligonucleotide; GTGAGATT chr2 60552105 60552124 60552121 +
ttttttctagatgagagatt

SEQ ID NO: 191444 - DNA, 20 bp, Artificial Sequence
  Synthetic oligonucleotide; GAGCGTTT chr2 60552171 60552190 60552187 +
gtcacagaaaagggttggca

SEQ ID NO: 191445 - DNA, 20 bp, Artificial Sequence
  Synthetic oligonucleotide; TTTGGCTT chr2 60552176 60552195 60552192 +
agaaaagggttggcagagcg

SEQ ID NO: 191446 - DNA, 20 bp, Artificial Sequence
  Synthetic oligonucleotide; TTCGGTTT chr2 60552182 60552201 60552198 +
gggttggcagagcgtttggc

SEQ ID NO: 191447 - DNA, 20 bp, Artificial Sequence
  Synthetic oligonucleotide; CCTTGTTT chr2 60552217 60552236 60552233 +
agaaattgtacattctcttg

SEQ ID NO: 191448 - DNA, 20 bp, Artificial Sequence
  Synthetic oligonucleotide; AATCGTTT chr2 60552713 60552732 60552729 +
tcacctcttttctccccggg

SEQ ID NO: 191449 - DNA, 20 bp, Artificial Sequence
  Synthetic oligonucleotide; CCAGGTTT chr2 60552808 60552827 60552824 +
ttccccaccagctcccaccc

SEQ ID NO: 191450 - DNA, 20 bp, Artificial Sequence
  Synthetic oligonucleotide; GAGGGTTT chr2 60553029 60553048 60553045 +
gcaatggttccagatgggat

SEQ ID NO: 191451 - DNA, 20 bp, Artificial Sequence
  Synthetic oligonucleotide; GGAGGTTT chr2 60553069 60553088 60553085 +
tctcttttacctcgactctc

SEQ ID NO: 191452 - DNA, 20 bp, Artificial Sequence
  Synthetic oligonucleotide; CCTCGCTT chr2 60553122 60553141 60553138 +
tgcacacacccctctctccc

SEQ ID NO: 191453 - DNA, 20 bp, Artificial Sequence
  Synthetic oligonucleotide; TTTTGCTT chr2 60553128 60553147 60553144 +
cacccctctctccccctcgc

SEQ ID NO: 191454 - DNA, 20 bp, Artificial Sequence
  Synthetic oligonucleotide; TCGTGATT chr2 60553152 60553171 60553168 +
gcttctagtcctgcgcgctc

SEQ ID NO: 191455 - DNA, 20 bp, Artificial Sequence
  Synthetic oligonucleotide; TCCCGTTT chr2 60553204 60553223 60553220 +
tgggttacttacgcgagaat

SEQ ID NO: 191456 - DNA, 20 bp, Artificial Sequence
  Synthetic oligonucleotide; GTTTGCTT chr2 60553208 60553227 60553224 +
ttacttacgcgagaattccc

SEQ ID NO: 191457 - DNA, 20 bp, Artificial Sequence
  Synthetic oligonucleotide; TGGGGTTT chr2 60553222 60553241 60553238 +
attcccgtttgcttaagtgc

SEQ ID NO: 191458 - DNA, 20 bp, Artificial Sequence
  Synthetic oligonucleotide; CCTTGCTT chr2 60553231 60553250 60553247 +
tgcttaagtgctggggtttg

SEQ ID NO: 191459 - DNA, 20 bp, Artificial Sequence
  Synthetic oligonucleotide; CATGGCTT chr2 60553445 60553464 60553461 +
atgaattgtgggagagccgt

SEQ ID NO: 191460 - DNA, 20 bp, Artificial Sequence
  Synthetic oligonucleotide; GAAAGATT chr2 60553989 60554008 60554005 +
acacacgcggactctaaaat

SEQ ID NO: 191461 - DNA, 20 bp, Artificial Sequence
  Synthetic oligonucleotide; CTAAGTTT chr2 60554335 60554354 60554351 +
acggcaacgcggaatccagc

SEQ ID NO: 191462 - DNA, 20 bp, Artificial Sequence
  Synthetic oligonucleotide; AAATGTTT chr2 60554807 60554826 60554823 +
agcacagagggatgggaaga

SEQ ID NO: 191463 - DNA, 20 bp, Artificial Sequence
  Synthetic oligonucleotide; GCGGGCTT chr2 60555112 60555131 60555128 +
cgtgctgccgctgtcaaaaa

SEQ ID NO: 191464 - DNA, 20 bp, Artificial Sequence
  Synthetic oligonucleotide; TTCAGTTT chr2 60555139 60555158 60555155 +
tcactctggcgtgggatact

SEQ ID NO: 191465 - DNA, 20 bp, Artificial Sequence
  Synthetic oligonucleotide; CTGCGATT chr2 60555175 60555194 60555191 +
atgtacagcaacagcacccc

SEQ ID NO: 191466 - DNA, 20 bp, Artificial Sequence
  Synthetic oligonucleotide; GAAAGTTT chr2 60555184 60555203 60555200 +
aacagcaccccctgcgattg

SEQ ID NO: 191467 - DNA, 20 bp, Artificial Sequence
  Synthetic oligonucleotide; GTCCGATT chr2 60555297 60555316 60555313 +
ccgccgccggggagatcgca

SEQ ID NO: 191468 - DNA, 20 bp, Artificial Sequence
  Synthetic oligonucleotide; TGTCGCTT chr2 60555520 60555539 60555536 +
cccctcttcagtctaaaggg

SEQ ID NO: 191469 - DNA, 20 bp, Artificial Sequence
  Synthetic oligonucleotide; GGGGGCTT chr2 60555551 60555570 60555567 +
taaactcacccacccggtgg

SEQ ID NO: 191470 - DNA, 20 bp, Artificial Sequence
  Synthetic oligonucleotide; TATTGTTT chr2 60555559 60555578 60555575 +
cccacccggtgggggggctt

SEQ ID NO: 191471 - DNA, 20 bp, Artificial Sequence
  Synthetic oligonucleotide; CCGGGCTT chr2 60555579 60555598 60555595 +
tattgttttaagcgagggcc

SEQ ID NO: 191472 - DNA, 20 bp, Artificial Sequence
  Synthetic oligonucleotide; GGCTGTTT chr2 60555624 60555643 60555640 +
ccgcagccctgccggcaagc

SEQ ID NO: 191473 - DNA, 20 bp, Artificial Sequence
  Synthetic oligonucleotide; TCCTGTTT chr2 60555634 60555653 60555650 +
gccggcaagcggctgtttat

SEQ ID NO: 191474 - DNA, 20 bp, Artificial Sequence
  Synthetic oligonucleotide; TAAAGTTT chr2 60555650 60555669 60555666 +
ttattcctgtttcgtcttag

SEQ ID NO: 191475 - DNA, 20 bp, Artificial Sequence
  Synthetic oligonucleotide; ACTGGCTT chr2 60555681 60555700 60555697 +
gtctactgtgttagaaaatg

SEQ ID NO: 191476 - DNA, 20 bp, Artificial Sequence
  Synthetic oligonucleotide; CGGAGCTT chr2 60555700 60555719 60555716 +
gactggcttgcctagctcgg

SEQ ID NO: 191477 - DNA, 20 bp, Artificial Sequence
  Synthetic oligonucleotide; GGAGGTTT chr2 60555730 60555749 60555746 +
gacccctctaaggaagaaaa

SEQ ID NO: 191478 - DNA, 20 bp, Artificial Sequence
  Synthetic oligonucleotide; CTGGGATT chr2 60555771 60555790 60555787 +
tgagagagatgtgggctgta

SEQ ID NO: 191479 - DNA, 20 bp, Artificial Sequence
  Synthetic oligonucleotide; TGTGGTTT chr2 60555786 60555805 60555802 +
ctgtactgggattgtgtcaa

SEQ ID NO: 191480 - DNA, 20 bp, Artificial Sequence
  Synthetic oligonucleotide; TGTTGTTT chr2 60555793 60555812 60555809 +
gggattgtgtcaatgtggtt

SEQ ID NO: 191481 - DNA, 20 bp, Artificial Sequence
  Synthetic oligonucleotide; TGTTGTTT chr2 60555803 60555822 60555819 +
caatgtggtttgttgtttgt

SEQ ID NO: 191482 - DNA, 20 bp, Artificial Sequence
  Synthetic oligonucleotide; TCCAGTTT chr2 60555814 60555833 60555830 +
gttgtttgttgttgtttccc

SEQ ID NO: 191483 - DNA, 20 bp, Artificial Sequence
  Synthetic oligonucleotide; TTCTGTTT chr2 60555841 60555860 60555857 +
tgtgggagggagacctcaaa

SEQ ID NO: 191484 - DNA, 20 bp, Artificial Sequence
  Synthetic oligonucleotide; GGAGGATT chr2 60555857 60555876 60555873 +
caaattctgtttaagaagcg

SEQ ID NO: 191485 - DNA, 20 bp, Artificial Sequence
  Synthetic oligonucleotide; TGTAGCTT chr2 60555882 60555901 60555898 +
attcactagaagttaagctc

SEQ ID NO: 191486 - DNA, 20 bp, Artificial Sequence
  Synthetic oligonucleotide; GTCTGCTT chr2 60555957 60555976 60555973 +
agcatctctattccaccaca

SEQ ID NO: 191487 - DNA, 20 bp, Artificial Sequence
  Synthetic oligonucleotide; GCCAGATT chr2 60556144 60556163 60556160 +
ccttcaggtaacaatagtga

SEQ ID NO: 191488 - DNA, 20 bp, Artificial Sequence
  Synthetic oligonucleotide; CCAAGCTT chr2 60556161 60556180 60556177 +
tgagccagattctttcagaa

SEQ ID NO: 191489 - DNA, 20 bp, Artificial Sequence
  Synthetic oligonucleotide; TTCAGATT chr2 60556169 60556188 60556185 +
attctttcagaaccaagctt

SEQ ID NO: 191490 - DNA, 20 bp, Artificial Sequence
  Synthetic oligonucleotide; GTATGATT chr2 60556265 60556284 60556281 +
ttgtggaaatatatatatat

SEQ ID NO: 191491 - DNA, 20 bp, Artificial Sequence
  Synthetic oligonucleotide; TAAAGCTT chr2 60556291 60556310 60556307 +
tttatatataatggtgtgta

SEQ ID NO: 191492 - DNA, 20 bp, Artificial Sequence
  Synthetic oligonucleotide; TATTGATT chr2 60556475 60556494 60556491 +
ataaataactggcaacattt

SEQ ID NO: 191493 - DNA, 20 bp, Artificial Sequence
  Synthetic oligonucleotide; AAGTGCTT chr2 60556540 60556559 60556543 -
tagcagacctacttgtaact

SEQ ID NO: 191494 - DNA, 20 bp, Artificial Sequence
  Synthetic oligonucleotide; CTATGTTT chr2 60556526 60556545 60556529 -
gtaactaagtgcttaatttc

SEQ ID NO: 191495 - DNA, 20 bp, Artificial Sequence
  Synthetic oligonucleotide; AAAAGCTT chr2 60556321 60556340 60556324 -
ttacactacagccaaccccg

SEQ ID NO: 191496 - DNA, 20 bp, Artificial Sequence
  Synthetic oligonucleotide; AAAAGCTT chr2 60556191 60556210 60556194 -
gggaacaatattcaaatctg

SEQ ID NO: 191497 - DNA, 20 bp, Artificial Sequence
  Synthetic oligonucleotide; AGGGGCTT chr2 60556147 60556166 60556150 -
ggctcactattgttacctga

SEQ ID NO: 191498 - DNA, 20 bp, Artificial Sequence
  Synthetic oligonucleotide; GCTGGTTT chr2 60556004 60556023 60556007 -
attcttttggtgactccaag

SEQ ID NO: 191499 - DNA, 20 bp, Artificial Sequence
  Synthetic oligonucleotide; CAGAGCTT chr2 60555904 60555923 60555907 -
atggtgtcacacacaagcta

SEQ ID NO: 191500 - DNA, 20 bp, Artificial Sequence
  Synthetic oligonucleotide; TCCCGCTT chr2 60555880 60555899 60555883 -
gcttaacttctagtgaatcc

SEQ ID NO: 191501 - DNA, 20 bp, Artificial Sequence
  Synthetic oligonucleotide; AGCCGCTT chr2 60555648 60555667 60555651 -
aagacgaaacaggaataaac

SEQ ID NO: 191502 - DNA, 20 bp, Artificial Sequence
  Synthetic oligonucleotide; CCTCGCTT chr2 60555596 60555615 60555599 -
agcgcgtgcaagcccggggc

SEQ ID NO: 191503 - DNA, 20 bp, Artificial Sequence
  Synthetic oligonucleotide; GTGAGTTT chr2 60555560 60555579 60555563 -
aaagcccccccaccgggtgg

SEQ ID NO: 191504 - DNA, 20 bp, Artificial Sequence
  Synthetic oligonucleotide; TCCAGATT chr2 60555336 60555355 60555339 -
ctcctctccccccaactcct

SEQ ID NO: 191505 - DNA, 20 bp, Artificial Sequence
  Synthetic oligonucleotide; GCACGTTT chr2 60555226 60555245 60555229 -
ggcgccaggggactttacag

SEQ ID NO: 191506 - DNA, 20 bp, Artificial Sequence
  Synthetic oligonucleotide; GCCCGCTT chr2 60555138 60555157 60555141 -
gtatcccacgccagagtgaa

SEQ ID NO: 191507 - DNA, 20 bp, Artificial Sequence
  Synthetic oligonucleotide; CAGGGTTT chr2 60555081 60555100 60555084 -
gcgtgtgtgcattaaagaga

SEQ ID NO: 191508 - DNA, 20 bp, Artificial Sequence
  Synthetic oligonucleotide; CTGTGCTT chr2 60554814 60554833 60554817 -
aacattttcttcccatccct

SEQ ID NO: 191509 - DNA, 20 bp, Artificial Sequence
  Synthetic oligonucleotide; CCGCGCTT chr2 60554697 60554716 60554700 -
actgggactcccgggactgc

SEQ ID NO: 191510 - DNA, 20 bp, Artificial Sequence
  Synthetic oligonucleotide; CGGCGCTT chr2 60554548 60554567 60554551 -
acccttaggagccggggact

SEQ ID NO: 191511 - DNA, 20 bp, Artificial Sequence
  Synthetic oligonucleotide; AGTCGCTT chr2 60554522 60554541 60554525 -
tttcagttgcattcagaccc

SEQ ID NO: 191512 - DNA, 20 bp, Artificial Sequence
  Synthetic oligonucleotide; CTCAGATT chr2 60554505 60554524 60554508 -
cccagtcgcttggcggggcg

SEQ ID NO: 191513 - DNA, 20 bp, Artificial Sequence
  Synthetic oligonucleotide; GCTGGATT chr2 60554355 60554374 60554358 -
ccgcagccctccaaacttag

SEQ ID NO: 191514 - DNA, 20 bp, Artificial Sequence
  Synthetic oligonucleotide; GGGTGATT chr2 60554270 60554289 60554273 -
gaggctcagctctcaacttc

SEQ ID NO: 191515 - DNA, 20 bp, Artificial Sequence
  Synthetic oligonucleotide; CAAAGTTT chr2 60554238 60554257 60554241 -
tttgctgtcctctcctcggg

SEQ ID NO: 191516 - DNA, 20 bp, Artificial Sequence
  Synthetic oligonucleotide; CGGGGCTT chr2 60554210 60554229 60554213 -
cccgagcgcagccgcgggct

SEQ ID NO: 191517 - DNA, 20 bp, Artificial Sequence
  Synthetic oligonucleotide; CCTGGCTT chr2 60554101 60554120 60554104 -
ggtgtccgggagcaactcta

SEQ ID NO: 191518 - DNA, 20 bp, Artificial Sequence
  Synthetic oligonucleotide; CCGCGCTT chr2 60554085 60554104 60554088 -
tctacctggcttccctccgc

SEQ ID NO: 191519 - DNA, 20 bp, Artificial Sequence
  Synthetic oligonucleotide; ATTGGCTT chr2 60553768 60553787 60553771 -
tccccctccccgcactggcc

SEQ ID NO: 191520 - DNA, 20 bp, Artificial Sequence
  Synthetic oligonucleotide; GTGAGCTT chr2 60553713 60553732 60553716 -
cctgatgtgtgtccattggt

SEQ ID NO: 191521 - DNA, 20 bp, Artificial Sequence
  Synthetic oligonucleotide; CCATGTTT chr2 60553668 60553687 60553671 -
ttctctcctgctcgccctgc

SEQ ID NO: 191522 - DNA, 20 bp, Artificial Sequence
  Synthetic oligonucleotide; GGGGGCTT chr2 60553582 60553601 60553585 -
cacttgaacttgcagctcag

SEQ ID NO: 191523 - DNA, 20 bp, Artificial Sequence
  Synthetic oligonucleotide; TTTTGCTT chr2 60553487 60553506 60553490 -
tttttttttttttttttttt

SEQ ID NO: 191524 - DNA, 20 bp, Artificial Sequence
  Synthetic oligonucleotide; CGCCGCTT chr2 60552946 60552965 60552949 -
tcctcctctttcctcctttc

SEQ ID NO: 191525 - DNA, 20 bp, Artificial Sequence
  Synthetic oligonucleotide; CAATGATT chr2 60552914 60552933 60552917 -
tctcttttcgaaaaggaatg

SEQ ID NO: 191526 - DNA, 20 bp, Artificial Sequence
  Synthetic oligonucleotide; GCCAGTTT chr2 60552888 60552907 60552891 -
ttccactccccccccgcccc

SEQ ID NO: 191527 - DNA, 20 bp, Artificial Sequence
  Synthetic oligonucleotide; GGTTGCTT chr2 60552803 60552822 60552806 -
ggagctggtggggaaaggga

SEQ ID NO: 191528 - DNA, 20 bp, Artificial Sequence
  Synthetic oligonucleotide; AAACGATT chr2 60552741 60552760 60552744 -
ggagtgagtacaagtctaaa

SEQ ID NO: 191529 - DNA, 20 bp, Artificial Sequence
  Synthetic oligonucleotide; ACTGGCTT chr2 60552712 60552731 60552715 -
ccggggagaaaagaggtgag

SEQ ID NO: 191530 - DNA, 20 bp, Artificial Sequence
  Synthetic oligonucleotide; GGGTGTTT chr2 60552496 60552515 60552499 -
cttttgttccggccagaggt

SEQ ID NO: 191531 - DNA, 20 bp, Artificial Sequence
  Synthetic oligonucleotide; TCGCGCTT chr2 60552462 60552481 60552465 -
ctgccttttgtgccggctcc

SEQ ID NO: 191532 - DNA, 20 bp, Artificial Sequence
  Synthetic oligonucleotide; GGAAGATT chr2 60552005 60552024 60552008 -
ccctcctcttactatttttt

SEQ ID NO: 191533 - DNA, 20 bp, Artificial Sequence
  Synthetic oligonucleotide; AGTGGATT chr2 60551982 60552001 60551985 -
agattttcaaaaaaagtgga

SEQ ID NO: 191534 - DNA, 20 bp, Artificial Sequence
  Synthetic oligonucleotide; TTTTGATT chr2 60551976 60551995 60551979 -
tcaaaaaaagtggaagtgga

SEQ ID NO: 191535 - DNA, 20 bp, Artificial Sequence
  Synthetic oligonucleotide; GAATGTTT chr2 60551950 60551969 60551953 -
ttgggaaaaatctcgtgtct

SEQ ID NO: 191536 - DNA, 20 bp, Artificial Sequence
  Synthetic oligonucleotide; CTCGGCTT chr2 60551646 60551665 60551649 -
gcgaaatcggctgggtgaaa

SEQ ID NO: 191537 - DNA, 20 bp, Artificial Sequence
  Synthetic oligonucleotide; ACGTGCTT chr2 60551516 60551535 60551519 -
gggaccgcgaggaggtcacc

SEQ ID NO: 191538 - DNA, 20 bp, Artificial Sequence
  Synthetic oligonucleotide; GTGTGTTT chr2 60551405 60551424 60551408 -
cggggaagggcaggggagaa

SEQ ID NO: 191539 - DNA, 20 bp, Artificial Sequence
  Synthetic oligonucleotide; CCTGGCTT chr2 60551322 60551341 60551325 -
gtcttgccctcttccccagg

SEQ ID NO: 191540 - DNA, 20 bp, Artificial Sequence
  Synthetic oligonucleotide; GAAAGTTT chr2 60551223 60551242 60551226 -
ggcgggcggtgggcacttag

SEQ ID NO: 191541 - DNA, 20 bp, Artificial Sequence
  Synthetic oligonucleotide; TTATGATT chr2 60551164 60551183 60551167 -
acattccccccctactcaat

SEQ ID NO: 191542 - DNA, 20 bp, Artificial Sequence
  Synthetic oligonucleotide; TGCAGTTT chr2 60551138 60551157 60551141 -
ttcttactttaaatttttga

SEQ ID NO: 191543 - DNA, 20 bp, Artificial Sequence
  Synthetic oligonucleotide; CTGTGTTT chr2 60551107 60551126 60551110 -
aggaccacctatacttggtt

SEQ ID NO: 191544 - DNA, 20 bp, Artificial Sequence
  Synthetic oligonucleotide; GCCAGTTT chr2 60550666 60550685 60550669 -
tcctgtcccggggttaaagg

SEQ ID NO: 191545 - DNA, 20 bp, Artificial Sequence
  Synthetic oligonucleotide; CGGCGATT chr2 60550451 60550470 60550454 -
agcctcccccacctcctgcc

SEQ ID NO: 191546 - DNA, 20 bp, Artificial Sequence
  Synthetic oligonucleotide; ACGAGCTT chr2 60550428 60550447 60550431 -
cgattctcgtccggggagga

SEQ ID NO: 191547 - DNA, 20 bp, Artificial Sequence
  Synthetic oligonucleotide; AAATGCTT chr2 60550325 60550344 60550328 -
gttcttcattttgactttaa

SEQ ID NO: 191548 - DNA, 20 bp, Artificial Sequence
  Synthetic oligonucleotide; TGCAGTTT chr2 60550228 60550247 60550231 -
gcgccgggctcggagcacgg

SEQ ID NO: 191549 - DNA, 20 bp, Artificial Sequence
  Synthetic oligonucleotide; TTTCGCTT chr2 60550222 60550241 60550225 -
ggctcggagcacggtgcagt

SEQ ID NO: 191550 - DNA, 20 bp, Artificial Sequence
  Synthetic oligonucleotide; TAGGGCTT chr2 60550165 60550184 60550168 -
ggaaccgggagtgcgcgctc

SEQ ID NO: 191551 - DNA, 20 bp, Artificial Sequence
  Synthetic oligonucleotide; GCAAGTTT chr2 60550130 60550149 60550133 -
tggccgaagagggggatatg

SEQ ID NO: 191552 - DNA, 20 bp, Artificial Sequence
  Synthetic oligonucleotide; GCTGGCTT chr2 60550052 60550071 60550055 -
cacagacctcggtggcctcg

SEQ ID NO: 191553 - DNA, 20 bp, Artificial Sequence
  Synthetic oligonucleotide; GTAAGCTT chr2 60549849 60549868 60549852 -
gatcccccaaagtaaaaagt

SEQ ID NO: 191554 - DNA, 20 bp, Artificial Sequence
  Synthetic oligonucleotide; CCGCGCTT chr2 60549816 60549835 60549819 -
cacagaatgaatctcaggac

SEQ ID NO: 191555 - DNA, 20 bp, Artificial Sequence
  Synthetic oligonucleotide; CCGGGTTT chr2 60549766 60549785 60549769 -
gactgcaccaggttaaccag

SEQ ID NO: 191556 - DNA, 20 bp, Artificial Sequence
  Synthetic oligonucleotide; GCTCGCTT chr2 60549554 60549573 60549557 -
gagcctgcagccagcacgct

SEQ ID NO: 191557 - DNA, 20 bp, Artificial Sequence
  Synthetic oligonucleotide; CCCGGCTT chr2 60549466 60549485 60549469 -
cctgccccgggcctgtagcc

SEQ ID NO: 191558 - DNA, 20 bp, Artificial Sequence
  Synthetic oligonucleotide; CTTTGCTT chr2 60549461 60549480 60549464 -
cccgggcctgtagcccccgg

SEQ ID NO: 191559 - DNA, 20 bp, Artificial Sequence
  Synthetic oligonucleotide; TTTTGTTT chr2 60549455 60549474 60549458 -
cctgtagcccccggctttgc

SEQ ID NO: 191560 - DNA, 20 bp, Artificial Sequence
  Synthetic oligonucleotide; CTTTGCTT chr2 60549447 60549466 60549450 -
ccccggctttgcttttgttt

SEQ ID NO: 191561 - DNA, 20 bp, Artificial Sequence
  Synthetic oligonucleotide; CTCCGTTT chr2 60549420 60549439 60549423 -
tttcctctctgaatttcagc

SEQ ID NO: 191562 - DNA, 20 bp, Artificial Sequence
  Synthetic oligonucleotide; GTTTGCTT chr2 60549416 60549435 60549419 -
ctctctgaatttcagcctcc

SEQ ID NO: 191563 - DNA, 20 bp, Artificial Sequence
  Synthetic oligonucleotide; TCTCGTTT chr2 60549315 60549334 60549318 -
cccctccgctccccggcagc

SEQ ID NO: 191564 - DNA, 20 bp, Artificial Sequence
  Synthetic oligonucleotide; TAAGGATT chr2 60549281 60549300 60549284 -
ctccttaccaacatttccta

SEQ ID NO: 191565 - DNA, 20 bp, Artificial Sequence
  Synthetic oligonucleotide; TGCTGTTT chr2 60549180 60549199 60549183 -
tgagacgttccaggctgtct

SEQ ID NO: 191566 - DNA, 20 bp, Artificial Sequence
  Synthetic oligonucleotide; TTATGATT chr2 60549108 60549127 60549111 -
agagaattcgcggctaatta

SEQ ID NO: 191567 - DNA, 20 bp, Artificial Sequence
  Synthetic oligonucleotide; CCCTGCTT chr2 60549066 60549085 60549069 -
ttccacttcaatcgaggact

SEQ ID NO: 191568 - DNA, 20 bp, Artificial Sequence
  Synthetic oligonucleotide; CGGAGTTT chr2 60549052 60549071 60549055 -
aggactccctgctttgtagc

SEQ ID NO: 191569 - DNA, 20 bp, Artificial Sequence
  Synthetic oligonucleotide; CGGAGCTT chr2 60549040 60549059 60549043 -
tttgtagccggagtttaggc

SEQ ID NO: 191570 - DNA, 20 bp, Artificial Sequence
  Synthetic oligonucleotide; GAAGGTTT chr2 60548959 60548978 60548962 -
ggtaaatggctgagggttag

SEQ ID NO: 191571 - DNA, 20 bp, Artificial Sequence
  Synthetic oligonucleotide; TGTTGATT chr2 60548891 60548910 60548894 -
tcagatgcccagaaaggaaa

SEQ ID NO: 191572 - DNA, 20 bp, Artificial Sequence
  Synthetic oligonucleotide; GTCTGATT chr2 60548801 60548820 60548804 -
ttttctttgtgtcccacttt

SEQ ID NO: 191573 - DNA, 20 bp, Artificial Sequence
  Synthetic oligonucleotide; ACACGTTT chr2 60548766 60548785 60548769 -
atataccagcaatgataaaa

SEQ ID NO: 191574 - DNA, 20 bp, Artificial Sequence
  Synthetic oligonucleotide; AAATGTTT chr2 60548732 60548751 60548735 -
ttctctgaacaccactagcc

SEQ ID NO: 191575 - DNA, 20 bp, Artificial Sequence
  Synthetic oligonucleotide; ACAGGTTT chr2 60548627 60548646 60548630 -
gcatagaaaatgttgaggtt

SEQ ID NO: 191576 - DNA, 20 bp, Artificial Sequence
  Synthetic oligonucleotide; CCCGGTTT chr2 60548508 60548527 60548511 -
tctgaattaccacttcattt

SEQ ID NO: 191577 - DNA, 20 bp, Artificial Sequence
  Synthetic oligonucleotide; TTTTGATT chr2 60548503 60548522 60548506 -
attaccacttcatttcccgg

SEQ ID NO: 191578 - DNA, 20 bp, Artificial Sequence
  Synthetic oligonucleotide; GTCTGTTT chr2 60548454 60548473 60548457 -
atttagaagactttaaccaa

SEQ ID NO: 191579 - DNA, 20 bp, Artificial Sequence
  Synthetic oligonucleotide; GTAAGTTT chr2 60548276 60548295 60548279 -
tgcaaaggttctatgtacta

SEQ ID NO: 191580 - DNA, 20 bp, Artificial Sequence
  Synthetic oligonucleotide; TTCTGTTT chr2 60548058 60548077 60548061 -
aaggcacaatgcagaggcac

SEQ ID NO: 191581 - DNA, 20 bp, Artificial Sequence
  Synthetic oligonucleotide; AAGTGCTT chr2 60547975 60547994 60547978 -
tatgttgggcaaagaaacat

SEQ ID NO: 191582 - DNA, 20 bp, Artificial Sequence
  Synthetic oligonucleotide; ACTGGATT chr2 60547736 60547755 60547739 -
aataaatttaacctgagttc

SEQ ID NO: 191583 - DNA, 20 bp, Artificial Sequence
  Synthetic oligonucleotide; TTTTGATT chr2 60547674 60547693 60547677 -
cactcaaattaaaatctatt

SEQ ID NO: 191584 - DNA, 20 bp, Artificial Sequence
  Synthetic oligonucleotide; TGTGGCTT chr2 60547663 60547682 60547666 -
aaatctattttttgattctc

SEQ ID NO: 191585 - DNA, 20 bp, Artificial Sequence
  Synthetic oligonucleotide; GGCAGCTT chr2 60547633 60547652 60547636 -
agttcattaaatgtaaaatt

SEQ ID NO: 191586 - DNA, 20 bp, Artificial Sequence
  Synthetic oligonucleotide; GACTGATT chr2 60547611 60547630 60547614 -
cagcttgctaaagaaggtca

SEQ ID NO: 191587 - DNA, 20 bp, Artificial Sequence
  Synthetic oligonucleotide; AACTGTTT chr2 60547603 60547622 60547606 -
taaagaaggtcagactgatt

SEQ ID NO: 191588 - DNA, 20 bp, Artificial Sequence
  Synthetic oligonucleotide; TTCTGCTT chr2 60547581 60547600 60547584 -
ctgtttaagacttgtacatt

SEQ ID NO: 191589 - DNA, 20 bp, Artificial Sequence
  Synthetic oligonucleotide; TTCAGTTT chr2 60547575 60547594 60547578 -
aagacttgtacattttctgc

SEQ ID NO: 191590 - DNA, 20 bp, Artificial Sequence
  Synthetic oligonucleotide; GGATGTTT chr2 60547548 60547567 60547551 -
ttattaactggcagcatcct

SEQ ID NO: 191591 - DNA, 20 bp, Artificial Sequence
  Synthetic oligonucleotide; TTGTGATT chr2 60547534 60547553 60547537 -
catcctggatgttttgtatt

SEQ ID NO: 191592 - DNA, 20 bp, Artificial Sequence
  Synthetic oligonucleotide; ATAAGATT chr2 60547500 60547519 60547503 -
ttttttttgatagagcaagc

SEQ ID NO: 191593 - DNA, 20 bp, Artificial Sequence
  Synthetic oligonucleotide; GGAAGCTT chr2 60547455 60547474 60547458 -
ccaactctcttttccccttt

SEQ ID NO: 191594 - DNA, 20 bp, Artificial Sequence
  Synthetic oligonucleotide; TGGTGATT chr2 60547340 60547359 60547343 -
taccttgttataccatccgc

SEQ ID NO: 191595 - DNA, 20 bp, Artificial Sequence
  Synthetic oligonucleotide; TGGTGTTT chr2 60547206 60547225 60547209 -
ctcagccttgctctgaaatg

SEQ ID NO: 191596 - DNA, 20 bp, Artificial Sequence
  Synthetic oligonucleotide; GTTTGCTT chr2 60547202 60547221 60547205 -
gccttgctctgaaatgtggt

SEQ ID NO: 191597 - DNA, 20 bp, Artificial Sequence
  Synthetic oligonucleotide; TTCTGATT chr2 60547189 60547208 60547192 -
atgtggtgtttgcttgacca

SEQ ID NO: 191598 - DNA, 20 bp, Artificial Sequence
  Synthetic oligonucleotide; ACATGTTT chr2 60547153 60547172 60547156 -
atagatgccaccaagtgcaa

SEQ ID NO: 191599 - DNA, 20 bp, Artificial Sequence
  Synthetic oligonucleotide; ATTGGCTT chr2 60547098 60547117 60547101 -
gaataaaaaaaaaatgacta

SEQ ID NO: 191600 - DNA, 20 bp, Artificial Sequence
  Synthetic oligonucleotide; CTTTGATT chr2 60547017 60547036 60547020 -
tgcccgtgcatttggtattt

SEQ ID NO: 191601 - DNA, 20 bp, Artificial Sequence
  Synthetic oligonucleotide; AAAGGTTT chr2 60546982 60547001 60546985 -
actgctgagagtgagagcag

SEQ ID NO: 191602 - DNA, 20 bp, Artificial Sequence
  Synthetic oligonucleotide; ACATGATT chr2 60546951 60546970 60546954 -
gcagtgtgaattatgctgcg

SEQ ID NO: 191603 - DNA, 20 bp, Artificial Sequence
  Synthetic oligonucleotide; ATCCGTTT chr2 60546934 60546953 60546937 -
gcgacatgattattatttag

SEQ ID NO: 191604 - DNA, 20 bp, Artificial Sequence
  Synthetic oligonucleotide; AGTCGTTT chr2 60546913 60546932 60546916 -
tccgtttcataggtgcatgc

SEQ ID NO: 191605 - DNA, 20 bp, Artificial Sequence
  Synthetic oligonucleotide; AGTAGCTT chr2 60546861 60546880 60546864 -
gcacatttttcatgtgacat

SEQ ID NO: 191606 - DNA, 20 bp, Artificial Sequence
  Synthetic oligonucleotide; GTCTGTTT chr2 60546835 60546854 60546838 -
tttctaatttatgaagccat

SEQ ID NO: 191607 - DNA, 20 bp, Artificial Sequence
  Synthetic oligonucleotide; GTGTGTTT chr2 60546792 60546811 60546795 -
cattcacacacaaagggtgt

SEQ ID NO: 191608 - DNA, 20 bp, Artificial Sequence
  Synthetic oligonucleotide; TTTGGTTT chr2 60546720 60546739 60546723 -
tataggaaaaaagaaacaaa

SEQ ID NO: 191609 - DNA, 20 bp, Artificial Sequence
  Synthetic oligonucleotide; ACCAGTTT chr2 60546693 60546712 60546696 -
tctatccactttttttttta

SEQ ID NO: 191610 - DNA, 20 bp, Artificial Sequence
  Synthetic oligonucleotide; TTAAGCTT chr2 60546669 60546688 60546672 -
gtttttcttgtagttattat

SEQ ID NO: 191611 - DNA, 20 bp, Artificial Sequence
  Synthetic oligonucleotide; GACTGTTT chr2 60546532 60546551 60546535 -
ctctggagttatgcaaggaa

SEQ ID NO: 191612 - DNA, 20 bp, Artificial Sequence
  Synthetic oligonucleotide; TGATGATT chr2 60546512 60546531 60546515 -
gactgttttctttacatatg

SEQ ID NO: 191613 - DNA, 20 bp, Artificial Sequence
  Synthetic oligonucleotide; ATGTGCTT chr2 60546368 60546387 60546371 -
tgggatggcatggggttgag

SEQ ID NO: 191614 - DNA, 20 bp, Artificial Sequence
  Synthetic oligonucleotide; TTGTGCTT chr2 60546327 60546346 60546330 -
cctctctggcactctaataa

SEQ ID NO: 191615 - DNA, 20 bp, Artificial Sequence
  Synthetic oligonucleotide; TTTTGTTT chr2 60546321 60546340 60546324 -
tggcactctaataattgtgc

SEQ ID NO: 191616 - DNA, 20 bp, Artificial Sequence
  Synthetic oligonucleotide; CTCTGCTT chr2 60546134 60546153 60546137 -
ggaaacaatgcaatggcagc

SEQ ID NO: 191617 - DNA, 20 bp, Artificial Sequence
  Synthetic oligonucleotide; TGACGATT chr2 60546030 60546049 60546033 -
atccaggtcacgccagagga

SEQ ID NO: 191618 - DNA, 20 bp, Artificial Sequence
  Synthetic oligonucleotide; GATTGTTT chr2 60546026 60546045 60546029 -
aggtcacgccagaggatgac

SEQ ID NO: 191619 - DNA, 20 bp, Artificial Sequence
  Synthetic oligonucleotide; AGCTGTTT chr2 60545949 60545968 60545952 -
aaatgagaagcaaggagaaa

SEQ ID NO: 191620 - DNA, 20 bp, Artificial Sequence
  Synthetic oligonucleotide; GCATGTTT chr2 60545941 60545960 60545944 -
agcaaggagaaaagctgttt

SEQ ID NO: 191621 - DNA, 20 bp, Artificial Sequence
  Synthetic oligonucleotide; AAGTGCTT chr2 60545887 60545906 60545890 -
ccaagcagtaaggagttgtg

SEQ ID NO: 191622 - DNA, 20 bp, Artificial Sequence
  Synthetic oligonucleotide; TGTTGCTT chr2 60545821 60545840 60545824 -
aatgttaaaataatcatttc

SEQ ID NO: 191623 - DNA, 20 bp, Artificial Sequence
  Synthetic oligonucleotide; TGTCGATT chr2 60545720 60545739 60545723 -
agacaccttctctctggatc

SEQ ID NO: 191624 - DNA, 20 bp, Artificial Sequence
  Synthetic oligonucleotide; TTTGGATT chr2 60545713 60545732 60545716 -
ttctctctggatctgtcgat

SEQ ID NO: 191625 - DNA, 20 bp, Artificial Sequence
  Synthetic oligonucleotide; TTGAGCTT chr2 60545667 60545686 60545670 -
caccttctcattttgaagta

SEQ ID NO: 191626 - DNA, 20 bp, Artificial Sequence
  Synthetic oligonucleotide; TCCAGCTT chr2 60545647 60545666 60545650 -
ttgagctttactacacctag

SEQ ID NO: 191627 - DNA, 20 bp, Artificial Sequence
  Synthetic oligonucleotide; ACTTGTTT chr2 60545565 60545584 60545568 -
catttgcagttcagccaatg

SEQ ID NO: 191628 - DNA, 20 bp, Artificial Sequence
  Synthetic oligonucleotide; CAAGGCTT chr2 60545511 60545530 60545514 -
ttaggggttcagctcgttct

SEQ ID NO: 191629 - DNA, 20 bp, Artificial Sequence
  Synthetic oligonucleotide; CTGAGCTT chr2 60545451 60545470 60545454 -
gaggtggtggaaagagttaa

SEQ ID NO: 191630 - DNA, 20 bp, Artificial Sequence
  Synthetic oligonucleotide; ACATGCTT chr2 60545290 60545309 60545293 -
gcagttgctgaagcgcacag

SEQ ID NO: 191631 - DNA, 20 bp, Artificial Sequence
  Synthetic oligonucleotide; AAAAGTTT chr2 60545277 60545296 60545280 -
cgcacagacatgcttactcg

SEQ ID NO: 191632 - DNA, 20 bp, Artificial Sequence
  Synthetic oligonucleotide; GTTGGTTT chr2 60545244 60545263 60545247 -
catgttggaaatttcaaaag

SEQ ID NO: 191633 - DNA, 20 bp, Artificial Sequence
  Synthetic oligonucleotide; AAATGCTT chr2 60545190 60545209 60545193 -
tgcctcctcagctaaatgat

SEQ ID NO: 191634 - DNA, 20 bp, Artificial Sequence
  Synthetic oligonucleotide; TGTGGTTT chr2 60545158 60545177 60545161 -
gtgctctctcttgtctctga

SEQ ID NO: 191635 - DNA, 20 bp, Artificial Sequence
  Synthetic oligonucleotide; TCTTGATT chr2 60545139 60545158 60545142 -
atgtggttttgacagatgta

SEQ ID NO: 191636 - DNA, 20 bp, Artificial Sequence
  Synthetic oligonucleotide; TTTTGTTT chr2 60545133 60545152 60545136 -
ttttgacagatgtatcttga

SEQ ID NO: 191637 - DNA, 20 bp, Artificial Sequence
  Synthetic oligonucleotide; TGTGGTTT chr2 60545126 60545145 60545129 -
agatgtatcttgattttgtt

SEQ ID NO: 191638 - DNA, 20 bp, Artificial Sequence
  Synthetic oligonucleotide; CACTGTTT chr2 60545076 60545095 60545079 -
caaatgtccagtccagactc

SEQ ID NO: 191639 - DNA, 20 bp, Artificial Sequence
  Synthetic oligonucleotide; GTGGGTTT chr2 60544968 60544987 60544971 -
gcagggaggcagctaggtgt

SEQ ID NO: 191640 - DNA, 20 bp, Artificial Sequence
  Synthetic oligonucleotide; TTTTGCTT chr2 60544858 60544877 60544861 -
atagtgaccctcaaaacatt

SEQ ID NO: 191641 - DNA, 20 bp, Artificial Sequence
  Synthetic oligonucleotide; TGCAGATT chr2 60544828 60544847 60544831 -
gcatgttagacaaaagtcaa

SEQ ID NO: 191642 - DNA, 20 bp, Artificial Sequence
  Synthetic oligonucleotide; GATCGCTT chr2 60544788 60544807 60544791 -
acatgccatgcctgttggtg

SEQ ID NO: 191643 - DNA, 20 bp, Artificial Sequence
  Synthetic oligonucleotide; AGAGGTTT chr2 60544744 60544763 60544747 -
cacccagctcccgaaaggca

SEQ ID NO: 191644 - DNA, 20 bp, Artificial Sequence
  Synthetic oligonucleotide; TTCAGTTT chr2 60544735 60544754 60544738 -
cccgaaaggcaagaggtttg

SEQ ID NO: 191645 - DNA, 20 bp, Artificial Sequence
  Synthetic oligonucleotide; AATTGATT chr2 60544704 60544723 60544707 -
gaaaggtagtgcatatcatg

SEQ ID NO: 191646 - DNA, 20 bp, Artificial Sequence
  Synthetic oligonucleotide; CCTAGTTT chr2 60544675 60544694 60544678 -
actggaacttgtctctccga

SEQ ID NO: 191647 - DNA, 20 bp, Artificial Sequence
  Synthetic oligonucleotide; AGGGGATT chr2 60544630 60544649 60544633 -
ataataggtcagtggtctag

SEQ ID NO: 191648 - DNA, 20 bp, Artificial Sequence
  Synthetic oligonucleotide; TAGTGCTT chr2 60544546 60544565 60544549 -
tggcattttctttctttttt

SEQ ID NO: 191649 - DNA, 20 bp, Artificial Sequence
  Synthetic oligonucleotide; TGAAGATT chr2 60544420 60544439 60544423 -
taccttatgtgacatgtagg

SEQ ID NO: 191650 - DNA, 20 bp, Artificial Sequence
  Synthetic oligonucleotide; GCATGATT chr2 60544324 60544343 60544327 -
aaaatgaacagaagtgtaag

SEQ ID NO: 191651 - DNA, 20 bp, Artificial Sequence
  Synthetic oligonucleotide; AGGGGATT chr2 60544295 60544314 60544298 -
atgaagcaagagcaggcgga

SEQ ID NO: 191652 - DNA, 20 bp, Artificial Sequence
  Synthetic oligonucleotide; GCTCGTTT chr2 60544199 60544218 60544202 -
tcgtatttacatatcgagct

SEQ ID NO: 191653 - DNA, 20 bp, Artificial Sequence
  Synthetic oligonucleotide; CTTAGATT chr2 60544114 60544133 60544117 -
tcccaaataggttattcagt

SEQ ID NO: 191654 - DNA, 20 bp, Artificial Sequence
  Synthetic oligonucleotide; ATTTGCTT chr2 60543982 60544001 60543985 -
tatgtagggaaataagagat

SEQ ID NO: 191655 - DNA, 20 bp, Artificial Sequence
  Synthetic oligonucleotide; TCTTGATT chr2 60543741 60543760 60543744 -
gtgcatgaataattacaaag

SEQ ID NO: 191656 - DNA, 20 bp, Artificial Sequence
  Synthetic oligonucleotide; TTGTGTTT chr2 60543726 60543745 60543729 -
caaagtcttgatttctttca

SEQ ID NO: 191657 - DNA, 20 bp, Artificial Sequence
  Synthetic oligonucleotide; AAGAGTTT chr2 60543607 60543626 60543610 -
ataattcacagtaatgaatt

SEQ ID NO: 191658 - DNA, 20 bp, Artificial Sequence
  Synthetic oligonucleotide; GTCTGCTT chr2 60543459 60543478 60543462 -
gcacgtctgcacaattccaa

SEQ ID NO: 191659 - DNA, 20 bp, Artificial Sequence
  Synthetic oligonucleotide; ATGTGTTT chr2 60543322 60543341 60543325 -
attgatgaatctctagaaga

SEQ ID NO: 191660 - DNA, 20 bp, Artificial Sequence
  Synthetic oligonucleotide; AAAGGCTT chr2 60543272 60543291 60543275 -
atttaagcgtgctgggtagg

SEQ ID NO: 191661 - DNA, 20 bp, Artificial Sequence
  Synthetic oligonucleotide; GTTGGATT chr2 60543248 60543267 60543251 -
gctttattaaagtgatgtaa

SEQ ID NO: 191662 - DNA, 20 bp, Artificial Sequence
  Synthetic oligonucleotide; TAAAGCTT chr2 60543161 60543180 60543164 -
gatcttcttcctaagataaa

SEQ ID NO: 191663 - DNA, 20 bp, Artificial Sequence
  Synthetic oligonucleotide; CTGAGTTT chr2 60543059 60543078 60543062 -
tgtactcaggcctctccaag

SEQ ID NO: 191664 - DNA, 20 bp, Artificial Sequence
  Synthetic oligonucleotide; CAGAGTTT chr2 60543027 60543046 60543030 -
tttttttttttttttttaga

SEQ ID NO: 191665 - DNA, 20 bp, Artificial Sequence
  Synthetic oligonucleotide; GCATGATT chr2 60542989 60543008 60542992 -
gcccaggctggagtgcagtg

SEQ ID NO: 191666 - DNA, 20 bp, Artificial Sequence
  Synthetic oligonucleotide; AAGCGATT chr2 60542949 60542968 60542952 -
aacctctgcctcctaggttc

SEQ ID NO: 191667 - DNA, 20 bp, Artificial Sequence
  Synthetic oligonucleotide; CTGGGATT chr2 60542917 60542936 60542920 -
tgcctcagcctcccaagtag

SEQ ID NO: 191668 - DNA, 20 bp, Artificial Sequence
  Synthetic oligonucleotide; GCTAGTTT chr2 60542886 60542905 60542889 -
ggcgtgtgccactacgccca

SEQ ID NO: 191669 - DNA, 20 bp, Artificial Sequence
  Synthetic oligonucleotide; CAGGGTTT chr2 60542859 60542878 60542862 -
ttttgtattttcagtagagg

SEQ ID NO: 191670 - DNA, 20 bp, Artificial Sequence
  Synthetic oligonucleotide; CCTGGCTT chr2 60542803 60542822 60542806 -
tcctgacctcaggtgatcca

SEQ ID NO: 191671 - DNA, 20 bp, Artificial Sequence
  Synthetic oligonucleotide; CTGGGATT chr2 60542781 60542800 60542784 -
tggcttggcctcccaaagtg

SEQ ID NO: 191672 - DNA, 20 bp, Artificial Sequence
  Synthetic oligonucleotide; ACAGGCTT chr2 60542773 60542792 60542776 -
cctcccaaagtgctgggatt

SEQ ID NO: 191673 - DNA, 20 bp, Artificial Sequence
  Synthetic oligonucleotide; AGAGGATT chr2 60542730 60542749 60542733 -
gcccaaactgagtatttttt

SEQ ID NO: 191674 - DNA, 20 bp, Artificial Sequence
  Synthetic oligonucleotide; GGTTGCTT chr2 60542639 60542658 60542642 -
gtacacatagatgttaatca

SEQ ID NO: 191675 - DNA, 20 bp, Artificial Sequence
  Synthetic oligonucleotide; GTGTGATT chr2 60542601 60542620 60542604 -
atttaaatattcaaaatatt

SEQ ID NO: 191676 - DNA, 20 bp, Artificial Sequence
  Synthetic oligonucleotide; AGCAGCTT chr2 60542547 60542566 60542550 -
tattaatttagctgggaatt

SEQ ID NO: 191677 - DNA, 20 bp, Artificial Sequence
  Synthetic oligonucleotide; CAGAGCTT chr2 60542463 60542482 60542466 -
agcagcctttgacttgcagt

SEQ ID NO: 191678 - DNA, 20 bp, Artificial Sequence
  Synthetic oligonucleotide; AGGGGTTT chr2 60542450 60542469 60542453 -
ttgcagtcagagctttcaat

SEQ ID NO: 191679 - DNA, 20 bp, Artificial Sequence
  Synthetic oligonucleotide; TTTTGTTT chr2 60542445 60542464 60542448 -
gtcagagctttcaatagggg

SEQ ID NO: 191680 - DNA, 20 bp, Artificial Sequence
  Synthetic oligonucleotide; TTTTGTTT chr2 60542440 60542459 60542443 -
agctttcaataggggttttg

SEQ ID NO: 191681 - DNA, 20 bp, Artificial Sequence
  Synthetic oligonucleotide; TTTTGTTT chr2 60542435 60542454 60542438 -
tcaataggggttttgttttg

SEQ ID NO: 191682 - DNA, 20 bp, Artificial Sequence
  Synthetic oligonucleotide; GGAAGATT chr2 60542382 60542401 60542385 -
tgatggggggaaatattcat

SEQ ID NO: 191683 - DNA, 20 bp, Artificial Sequence
  Synthetic oligonucleotide; GTCAGATT chr2 60542318 60542337 60542321 -
cccaaacattatcccatcat

SEQ ID NO: 191684 - DNA, 20 bp, Artificial Sequence
  Synthetic oligonucleotide; TGAGGTTT chr2 60542310 60542329 60542313 -
ttatcccatcatgtcagatt

SEQ ID NO: 191685 - DNA, 20 bp, Artificial Sequence
  Synthetic oligonucleotide; TTTGGCTT chr2 60542304 60542323 60542307 -
catcatgtcagatttgaggt

SEQ ID NO: 191686 - DNA, 20 bp, Artificial Sequence
  Synthetic oligonucleotide; TTAGGTTT chr2 60542274 60542293 60542277 -
tgcacataggaatctttaaa

SEQ ID NO: 191687 - DNA, 20 bp, Artificial Sequence
  Synthetic oligonucleotide; GTTAGCTT chr2 60542253 60542272 60542256 -
taggtttgggctgtcataaa

SEQ ID NO: 191688 - DNA, 20 bp, Artificial Sequence
  Synthetic oligonucleotide; ATATGCTT chr2 60541994 60542013 60541997 -
ttaaaagtaaatcaaataca

SEQ ID NO: 191689 - DNA, 20 bp, Artificial Sequence
  Synthetic oligonucleotide; TTCTGATT chr2 60541943 60541962 60541946 -
accttttctttttgtatcca

SEQ ID NO: 191690 - DNA, 20 bp, Artificial Sequence
  Synthetic oligonucleotide; ATGTGATT chr2 60541817 60541836 60541820 -
tttttcttttctctttattt

SEQ ID NO: 191691 - DNA, 20 bp, Artificial Sequence
  Synthetic oligonucleotide; TATTGTTT chr2 60541680 60541699 60541683 -
aaaatccagagagtagagaa

SEQ ID NO: 191692 - DNA, 20 bp, Artificial Sequence
  Synthetic oligonucleotide; CTAGGATT chr2 60541660 60541679 60541663 -
tattgttttctaataagtac

SEQ ID NO: 191693 - DNA, 20 bp, Artificial Sequence
  Synthetic oligonucleotide; CTATGTTT chr2 60541640 60541659 60541643 -
ctaggattttcatagggagc

SEQ ID NO: 191694 - DNA, 20 bp, Artificial Sequence
  Synthetic oligonucleotide; GGCAGCTT chr2 60541540 60541559 60541543 -
acagagaaaggttgtgaact

SEQ ID NO: 191695 - DNA, 20 bp, Artificial Sequence
  Synthetic oligonucleotide; GGATGTTT chr2 60541532 60541551 60541535 -
aggttgtgaactggcagctt

SEQ ID NO: 191696 - DNA, 20 bp, Artificial Sequence
  Synthetic oligonucleotide; CAGTGATT chr2 60541466 60541485 60541469 -
aattgtaaatagaactgtca

SEQ ID NO: 191697 - DNA, 20 bp, Artificial Sequence
  Synthetic oligonucleotide; GCATGATT chr2 60541458 60541477 60541461 -
atagaactgtcacagtgatt

SEQ ID NO: 191698 - DNA, 20 bp, Artificial Sequence
  Synthetic oligonucleotide; GAAAGCTT chr2 60541405 60541424 60541408 -
ttggcattgtcaggactttt

SEQ ID NO: 191699 - DNA, 20 bp, Artificial Sequence
  Synthetic oligonucleotide; TAATGTTT chr2 60541225 60541244 60541228 -
tcctagtcatcttttataaa

SEQ ID NO: 191700 - DNA, 20 bp, Artificial Sequence
  Synthetic oligonucleotide; TGGAGATT chr2 60541173 60541192 60541176 -
agatcatcctgtgtgtgatg

SEQ ID NO: 191701 - DNA, 20 bp, Artificial Sequence
  Synthetic oligonucleotide; GTTAGTTT chr2 60541163 60541182 60541166 -
gtgtgtgatgtggagattgt

SEQ ID NO: 191702 - DNA, 20 bp, Artificial Sequence
  Synthetic oligonucleotide; CAAAGTTT chr2 60541060 60541079 60541063 -
agaacaggagcagaggggga

SEQ ID NO: 191703 - DNA, 20 bp, Artificial Sequence
  Synthetic oligonucleotide; CTGTGTTT chr2 60541040 60541059 60541043 -
caaagtttccctcccgttct

SEQ ID NO: 191704 - DNA, 20 bp, Artificial Sequence
  Synthetic oligonucleotide; GAAAGCTT chr2 60541025 60541044 60541028 -
gttctctgtgtttattctgt

SEQ ID NO: 191705 - DNA, 20 bp, Artificial Sequence
  Synthetic oligonucleotide; ATATGTTT chr2 60540869 60540888 60540872 -
tttactataaaggatctgaa

SEQ ID NO: 191706 - DNA, 20 bp, Artificial Sequence
  Synthetic oligonucleotide; GGATGCTT chr2 60540730 60540749 60540733 -
gctcagggaggaggcgagtt

SEQ ID NO: 191707 - DNA, 20 bp, Artificial Sequence
  Synthetic oligonucleotide; TGCAGCTT chr2 60540677 60540696 60540680 -
gaaaatcattaatttcacac

SEQ ID NO: 191708 - DNA, 20 bp, Artificial Sequence
  Synthetic oligonucleotide; TGTAGTTT chr2 60540666 60540685 60540669 -
atttcacactgcagcttcca

SEQ ID NO: 191709 - DNA, 20 bp, Artificial Sequence
  Synthetic oligonucleotide; TTTAGATT chr2 60540596 60540615 60540599 -
caaatcctagggaaacattt

SEQ ID NO: 191710 - DNA, 20 bp, Artificial Sequence
  Synthetic oligonucleotide; TTGTGATT chr2 60540587 60540606 60540590 -
gggaaacattttttagattt

SEQ ID NO: 191711 - DNA, 20 bp, Artificial Sequence
  Synthetic oligonucleotide; AAATGTTT chr2 60540570 60540589 60540573 -
tttttgtgatttctcaatga

SEQ ID NO: 191712 - DNA, 20 bp, Artificial Sequence
  Synthetic oligonucleotide; GGTGGCTT chr2 60540541 60540560 60540544 -
ataaaggagaataggtgaat

SEQ ID NO: 191713 - DNA, 20 bp, Artificial Sequence
  Synthetic oligonucleotide; TTTGGCTT chr2 60540502 60540521 60540505 -
cagtaagaaaggaaacaaat

SEQ ID NO: 191714 - DNA, 20 bp, Artificial Sequence
  Synthetic oligonucleotide; CCAAGATT chr2 60540436 60540455 60540439 -
agcacagctagggagatgca

SEQ ID NO: 191715 - DNA, 20 bp, Artificial Sequence
  Synthetic oligonucleotide; GTCTGTTT chr2 60540333 60540352 60540336 -
aaaatttaccccaagcccaa

SEQ ID NO: 191716 - DNA, 20 bp, Artificial Sequence
  Synthetic oligonucleotide; ACCAGCTT chr2 60540311 60540330 60540314 -
ctgtttttacatacagtagt

SEQ ID NO: 191717 - DNA, 20 bp, Artificial Sequence
  Synthetic oligonucleotide; ATGAGATT chr2 60540240 60540259 60540243 -
caccttgccacttttttagc

SEQ ID NO: 191718 - DNA, 20 bp, Artificial Sequence
  Synthetic oligonucleotide; TTCTGCTT chr2 60540207 60540226 60540210 -
accaagcatctttagtacct

SEQ ID NO: 191719 - DNA, 20 bp, Artificial Sequence
  Synthetic oligonucleotide; TTCAGATT chr2 60540198 60540217 60540201 -
ctttagtacctttctgcttg

SEQ ID NO: 191720 - DNA, 20 bp, Artificial Sequence
  Synthetic oligonucleotide; CAAGGATT chr2 60540152 60540171 60540155 -
tgtcagcagtgttgttattt

SEQ ID NO: 191721 - DNA, 20 bp, Artificial Sequence
  Synthetic oligonucleotide; AAAAGATT chr2 60540139 60540158 60540142 -
gttatttcaaggattaaaaa

SEQ ID NO: 191722 - DNA, 20 bp, Artificial Sequence
  Synthetic oligonucleotide; GCAGGTTT chr2 60540093 60540112 60540096 -
ttaacattatttcaaatcaa

SEQ ID NO: 191723 - DNA, 20 bp, Artificial Sequence
  Synthetic oligonucleotide; AACAGCTT chr2 60539913 60539932 60539916 -
taggtaaatgggcatcctta

SEQ ID NO: 191724 - DNA, 20 bp, Artificial Sequence
  Synthetic oligonucleotide; CGTAGTTT chr2 60539839 60539858 60539842 -
tttacctttgtaatttgcca

SEQ ID NO: 191725 - DNA, 20 bp, Artificial Sequence
  Synthetic oligonucleotide; GGCAGATT chr2 60539690 60539709 60539693 -
atgtgctcctagagaccaaa

SEQ ID NO: 191726 - DNA, 20 bp, Artificial Sequence
  Synthetic oligonucleotide; ATCAGTTT chr2 60539584 60539603 60539587 -
aacatcagactgtatttcta

SEQ ID NO: 191727 - DNA, 20 bp, Artificial Sequence
  Synthetic oligonucleotide; CCCTGCTT chr2 60539533 60539552 60539536 -
gggttcattggaatttgtct

SEQ ID NO: 191728 - DNA, 20 bp, Artificial Sequence
  Synthetic oligonucleotide; AAAGGCTT chr2 60539479 60539498 60539482 -
catttttaaaacatttcagc

SEQ ID NO: 191729 - DNA, 20 bp, Artificial Sequence
  Synthetic oligonucleotide; GAAGGATT chr2 60539384 60539403 60539387 -
attgagttaggttggcaagg

SEQ ID NO: 191730 - DNA, 20 bp, Artificial Sequence
  Synthetic oligonucleotide; GTGAGCTT chr2 60539328 60539347 60539331 -
ctgatcccagcagggaatag

SEQ ID NO: 191731 - DNA, 20 bp, Artificial Sequence
  Synthetic oligonucleotide; TAATGCTT chr2 60539214 60539233 60539217 -
cagatgcggagctggaatat

SEQ ID NO: 191732 - DNA, 20 bp, Artificial Sequence
  Synthetic oligonucleotide; GCAAGCTT chr2 60539172 60539191 60539175 -
ccataataaagctgtacaca

SEQ ID NO: 191733 - DNA, 20 bp, Artificial Sequence
  Synthetic oligonucleotide; CACAGTTT chr2 60539084 60539103 60539087 -
tggaaaaatgctcgatatgc

SEQ ID NO: 191734 - DNA, 20 bp, Artificial Sequence
  Synthetic oligonucleotide; ATTTGTTT chr2 60538936 60538955 60538939 -
gtatggagaaatgcaacata

SEQ ID NO: 191735 - DNA, 20 bp, Artificial Sequence
  Synthetic oligonucleotide; AGGCGTTT chr2 60538913 60538932 60538916 -
tgtttcatatggttaattac

SEQ ID NO: 191736 - DNA, 20 bp, Artificial Sequence
  Synthetic oligonucleotide; TCCAGCTT chr2 60538876 60538895 60538879 -
aaattttaaatagccacagt

SEQ ID NO: 191737 - DNA, 20 bp, Artificial Sequence
  Synthetic oligonucleotide; ATGTGATT chr2 60538854 60538873 60538857 -
cagcttttcccgttaaaagt

SEQ ID NO: 191738 - DNA, 20 bp, Artificial Sequence
  Synthetic oligonucleotide; TGGTGATT chr2 60538816 60538835 60538819 -
gagtacagtgtaaatatttg

SEQ ID NO: 191739 - DNA, 20 bp, Artificial Sequence
  Synthetic oligonucleotide; TTCAGTTT chr2 60538718 60538737 60538721 -
gagagagagagagagagaca

SEQ ID NO: 191740 - DNA, 20 bp, Artificial Sequence
  Synthetic oligonucleotide; CATTGCTT chr2 60538599 60538618 60538602 -
ccattatatttttgagtcca

SEQ ID NO: 191741 - DNA, 20 bp, Artificial Sequence
  Synthetic oligonucleotide; TGAGGTTT chr2 60538592 60538611 60538595 -
atttttgagtccacattgct

SEQ ID NO: 191742 - DNA, 20 bp, Artificial Sequence
  Synthetic oligonucleotide; AGAAGATT chr2 60538581 60538600 60538584 -
cacattgcttgaggttttaa

SEQ ID NO: 191743 - DNA, 20 bp, Artificial Sequence
  Synthetic oligonucleotide; ACACGTTT chr2 60538494 60538513 60538497 -
caaaacgtataaagaaaaat

SEQ ID NO: 191744 - DNA, 20 bp, Artificial Sequence
  Synthetic oligonucleotide; AGAAGTTT chr2 60538438 60538457 60538441 -
ctgctaagaactggcgaatt

SEQ ID NO: 191745 - DNA, 20 bp, Artificial Sequence
  Synthetic oligonucleotide; GGAAGATT chr2 60538355 60538374 60538358 -
ggatctgatgcaatgctgct

SEQ ID NO: 191746 - DNA, 20 bp, Artificial Sequence
  Synthetic oligonucleotide; GCACGATT chr2 60538310 60538329 60538313 -
cctctaaggcaacgcgcagt

SEQ ID NO: 191747 - DNA, 20 bp, Artificial Sequence
  Synthetic oligonucleotide; TCAGGTTT chr2 60538170 60538189 60538173 -
tatacctaaaggtgagatga

SEQ ID NO: 191748 - DNA, 20 bp, Artificial Sequence
  Synthetic oligonucleotide; ATGAGTTT chr2 60537996 60538015 60537999 -
gggacctttggtcactcaca

SEQ ID NO: 191749 - DNA, 20 bp, Artificial Sequence
  Synthetic oligonucleotide; TTTTGTTT chr2 60537990 60538009 60537993 -
tttggtcactcacaatgagt

SEQ ID NO: 191750 - DNA, 20 bp, Artificial Sequence
  Synthetic oligonucleotide; ATTTGATT chr2 60537936 60537955 60537939 -
aatgaacaattgcacctaca

SEQ ID NO: 191751 - DNA, 20 bp, Artificial Sequence
  Synthetic oligonucleotide; TTTAGTTT chr2 60537929 60537948 60537932 -
aattgcacctacaatttgat

SEQ ID NO: 191752 - DNA, 20 bp, Artificial Sequence
  Synthetic oligonucleotide; CACTGATT chr2 60537905 60537924 60537908 -
gttttagatagaggcgaatc

SEQ ID NO: 191753 - DNA, 20 bp, Artificial Sequence
  Synthetic oligonucleotide; ATTTGCTT chr2 60537798 60537817 60537801 -
tatacctacctcgcctttct

SEQ ID NO: 191754 - DNA, 20 bp, Artificial Sequence
  Synthetic oligonucleotide; GGAAGCTT chr2 60537767 60537786 60537770 -
gaactttctaaaaaacacaa

SEQ ID NO: 191755 - DNA, 20 bp, Artificial Sequence
  Synthetic oligonucleotide; TGTAGCTT chr2 60537641 60537660 60537644 -
taatttttagggaaataaag

SEQ ID NO: 191756 - DNA, 20 bp, Artificial Sequence
  Synthetic oligonucleotide; CTTGGATT chr2 60537636 60537655 60537639 -
tttagggaaataaagtgtag

SEQ ID NO: 191757 - DNA, 20 bp, Artificial Sequence
  Synthetic oligonucleotide; TAGAGTTT chr2 60537572 60537591 60537575 -
gttcctgtacattttaaata

SEQ ID NO: 191758 - DNA, 20 bp, Artificial Sequence
  Synthetic oligonucleotide; CCATGATT chr2 60537464 60537483 60537467 -
cttcaccaactcaaggtata

SEQ ID NO: 191759 - DNA, 20 bp, Artificial Sequence
  Synthetic oligonucleotide; TTATGATT chr2 60537456 60537475 60537459 -
actcaaggtataccatgatt

SEQ ID NO: 191760 - DNA, 20 bp, Artificial Sequence
  Synthetic oligonucleotide; TTCAGTTT chr2 60537378 60537397 60537381 -
aactcccctgccccgatcct

SEQ ID NO: 191761 - DNA, 20 bp, Artificial Sequence
  Synthetic oligonucleotide; GTGAGTTT chr2 60537327 60537346 60537330 -
aatgttaaatcttaaatctc

SEQ ID NO: 191762 - DNA, 20 bp, Artificial Sequence
  Synthetic oligonucleotide; GAATGATT chr2 60537249 60537268 60537252 -
actgaacattggctactgaa

SEQ ID NO: 191763 - DNA, 20 bp, Artificial Sequence
  Synthetic oligonucleotide; TTATGTTT chr2 60537196 60537215 60537199 -
taaatcgtaaccttctcatg

SEQ ID NO: 191764 - DNA, 20 bp, Artificial Sequence
  Synthetic oligonucleotide; AGCAGCTT chr2 60537084 60537103 60537087 -
ccttttaactaaaacatttg

SEQ ID NO: 191765 - DNA, 20 bp, Artificial Sequence
  Synthetic oligonucleotide; AGTGGATT chr2 60536998 60537017 60537001 -
aaaatcttattctacataca

SEQ ID NO: 191766 - DNA, 20 bp, Artificial Sequence
  Synthetic oligonucleotide; GATTGCTT chr2 60536994 60537013 60536997 -
tcttattctacatacaagtg

SEQ ID NO: 191767 - DNA, 20 bp, Artificial Sequence
  Synthetic oligonucleotide; ACTTGTTT chr2 60536965 60536984 60536968 -
acaagtcagcacagacacgt

SEQ ID NO: 191768 - DNA, 20 bp, Artificial Sequence
  Synthetic oligonucleotide; TTGTGCTT chr2 60536882 60536901 60536885 -
attgttgttggacctgtctt

SEQ ID NO: 191769 - DNA, 20 bp, Artificial Sequence
  Synthetic oligonucleotide; ATCTGCTT chr2 60536845 60536864 60536848 -
ctgggtccccctcccctcct

SEQ ID NO: 191770 - DNA, 20 bp, Artificial Sequence
  Synthetic oligonucleotide; CAAGGCTT chr2 60536750 60536769 60536753 -
gtatttaaagaggaatatct

SEQ ID NO: 191771 - DNA, 20 bp, Artificial Sequence
  Synthetic oligonucleotide; ATGTGATT chr2 60536715 60536734 60536718 -
gcattccactttactttctg

SEQ ID NO: 191772 - DNA, 20 bp, Artificial Sequence
  Synthetic oligonucleotide; ATTGGTTT chr2 60536598 60536617 60536601 -
catttgctctgtagtgtagc

SEQ ID NO: 191773 - DNA, 20 bp, Artificial Sequence
  Synthetic oligonucleotide; TTTTGTTT chr2 60536584 60536603 60536587 -
tgtagcattggtttctaaac

SEQ ID NO: 191774 - DNA, 20 bp, Artificial Sequence
  Synthetic oligonucleotide; TTCTGATT chr2 60536567 60536586 60536570 -
aacttttgtttttaatctaa

SEQ ID NO: 191775 - DNA, 20 bp, Artificial Sequence
  Synthetic oligonucleotide; CTGAGATT chr2 60536334 60536353 60536337 -
aagaaatcagggggtagtac

SEQ ID NO: 191776 - DNA, 20 bp, Artificial Sequence
  Synthetic oligonucleotide; TTCCGATT chr2 60536312 60536331 60536315 -
gagatttttctcccttctct

SEQ ID NO: 191777 - DNA, 20 bp, Artificial Sequence
  Synthetic oligonucleotide; GAGAGCTT chr2 60536167 60536186 60536170 -
caaatgaaatccccacagca

SEQ ID NO: 191778 - DNA, 20 bp, Artificial Sequence
  Synthetic oligonucleotide; TCTTGCTT chr2 60536056 60536075 60536059 -
ataggacttaacatatactt

SEQ ID NO: 191779 - DNA, 20 bp, Artificial Sequence
  Synthetic oligonucleotide; AAAGGATT chr2 60535933 60535952 60535936 -
gtgtgagttagcattcaagc

SEQ ID NO: 191780 - DNA, 20 bp, Artificial Sequence
  Synthetic oligonucleotide; CATGGATT chr2 60535789 60535808 60535792 -
tgtctgcatgacccgttcac

SEQ ID NO: 191781 - DNA, 20 bp, Artificial Sequence
  Synthetic oligonucleotide; ACAGGATT chr2 60535731 60535750 60535734 -
agaaaggcaaatctcaagca

SEQ ID NO: 191782 - DNA, 20 bp, Artificial Sequence
  Synthetic oligonucleotide; CTGTGCTT chr2 60535682 60535701 60535685 -
agaccttgctcctctccctc

SEQ ID NO: 191783 - DNA, 20 bp, Artificial Sequence
  Synthetic oligonucleotide; GCTGGTTT chr2 60535664 60535683 60535667 -
tcctgtgcttctcctttctt

SEQ ID NO: 191784 - DNA, 20 bp, Artificial Sequence
  Synthetic oligonucleotide; AGCTGTTT chr2 60535604 60535623 60535607 -
ccactccaagccaatgaaaa

SEQ ID NO: 191785 - DNA, 20 bp, Artificial Sequence
  Synthetic oligonucleotide; GGATGTTT chr2 60535584 60535603 60535587 -
agctgtttttataccacagt

SEQ ID NO: 191786 - DNA, 20 bp, Artificial Sequence
  Synthetic oligonucleotide; AAAGGCTT chr2 60535550 60535569 60535553 -
gagagacaacttgaggggga

SEQ ID NO: 191787 - DNA, 20 bp, Artificial Sequence
  Synthetic oligonucleotide; GGCTGTTT chr2 60535468 60535487 60535471 -
attgcctatgagcgactctg

SEQ ID NO: 191788 - DNA, 20 bp, Artificial Sequence
  Synthetic oligonucleotide; CCATGTTT chr2 60535449 60535468 60535452 -
gggctgtttttgataaatta

SEQ ID NO: 191789 - DNA, 20 bp, Artificial Sequence
  Synthetic oligonucleotide; ATAGGTTT chr2 60535437 60535456 60535440 -
ataaattaccatgtttagag

SEQ ID NO: 191790 - DNA, 20 bp, Artificial Sequence
  Synthetic oligonucleotide; AAGGGCTT chr2 60535422 60535441 60535425 -
tagagataggtttggctctt

SEQ ID NO: 191791 - DNA, 20 bp, Artificial Sequence
  Synthetic oligonucleotide; CTTAGTTT chr2 60535417 60535436 60535420 -
ataggtttggctcttaaggg

SEQ ID NO: 191792 - DNA, 20 bp, Artificial Sequence
  Synthetic oligonucleotide; CGATGTTT chr2 60535391 60535410 60535394 -
tttatgaacaaagtccgtga

SEQ ID NO: 191793 - DNA, 20 bp, Artificial Sequence
  Synthetic oligonucleotide; CTCTGTTT chr2 60535378 60535397 60535381 -
tccgtgacgatgtttgcagc

SEQ ID NO: 191794 - DNA, 20 bp, Artificial Sequence
  Synthetic oligonucleotide; TTTGGCTT chr2 60535357 60535376 60535360 -
tctgtttgtatcttagcccc

SEQ ID NO: 191795 - DNA, 20 bp, Artificial Sequence
  Synthetic oligonucleotide; CTATGTTT chr2 60535338 60535357 60535341 -
ctttggcttgactagaagct

SEQ ID NO: 191796 - DNA, 20 bp, Artificial Sequence
  Synthetic oligonucleotide; TTTAGTTT chr2 60535333 60535352 60535336 -
gcttgactagaagctctatg

SEQ ID NO: 191797 - DNA, 20 bp, Artificial Sequence
  Synthetic oligonucleotide; CTTTGCTT chr2 60535259 60535278 60535262 -
aaatcataggaagaaaaacc

SEQ ID NO: 191798 - DNA, 20 bp, Artificial Sequence
  Synthetic oligonucleotide; AATTGCTT chr2 60535178 60535197 60535181 -
tctttaatcttcaaaggcta

SEQ ID NO: 191799 - DNA, 20 bp, Artificial Sequence
  Synthetic oligonucleotide; AATTGTTT chr2 60535086 60535105 60535089 -
aggtccttccagtaattgcg

SEQ ID NO: 191800 - DNA, 20 bp, Artificial Sequence
  Synthetic oligonucleotide; TTTTGATT chr2 60535073 60535092 60535076 -
aattgcgaattgttttgcat

SEQ ID NO: 191801 - DNA, 20 bp, Artificial Sequence
  Synthetic oligonucleotide; AATTGTTT chr2 60534992 60535011 60534995 -
aaggagaaaaaaaaggtgaa

SEQ ID NO: 191802 - DNA, 20 bp, Artificial Sequence
  Synthetic oligonucleotide; CCAAGATT chr2 60534978 60534997 60534981 -
ggtgaaaattgtttatagca

SEQ ID NO: 191803 - DNA, 20 bp, Artificial Sequence
  Synthetic oligonucleotide; CTTAGATT chr2 60534970 60534989 60534973 -
ttgtttatagcaccaagatt

SEQ ID NO: 191804 - DNA, 20 bp, Artificial Sequence
  Synthetic oligonucleotide; CAGTGTTT chr2 60534924 60534943 60534927 -
atgatgtaaaaaaattaaag

SEQ ID NO: 191805 - DNA, 20 bp, Artificial Sequence
  Synthetic oligonucleotide; TCAAGATT chr2 60534909 60534928 60534912 -
taaagcagtgttttttcttc

SEQ ID NO: 191806 - DNA, 20 bp, Artificial Sequence
  Synthetic oligonucleotide; AAGAGATT chr2 60534890 60534909 60534893 -
ctcaagattaaaagttcacc

SEQ ID NO: 191807 - DNA, 20 bp, Artificial Sequence
  Synthetic oligonucleotide; TCATGTTT chr2 60534801 60534820 60534804 -
ctgttgttaatcacttttga

SEQ ID NO: 191808 - DNA, 20 bp, Artificial Sequence
  Synthetic oligonucleotide; CCAAGTTT chr2 60534719 60534738 60534722 -
caaaatgatgcatcttcttg

SEQ ID NO: 191809 - DNA, 20 bp, Artificial Sequence
  Synthetic oligonucleotide; ATATGTTT chr2 60534666 60534685 60534669 -
gtctaaccttgagtaattac

SEQ ID NO: 191810 - DNA, 20 bp, Artificial Sequence
  Synthetic oligonucleotide; ATCCGTTT chr2 60534657 60534676 60534660 -
tgagtaattacatatgtttt

SEQ ID NO: 191811 - DNA, 20 bp, Artificial Sequence
  Synthetic oligonucleotide; TACAGTTT chr2 60534634 60534653 60534637 -
cgttttcttttaacgttaag

SEQ ID NO: 191812 - DNA, 20 bp, Artificial Sequence
  Synthetic oligonucleotide; ATATGATT chr2 60534569 60534588 60534572 -
gaagactgtaaaatttaagt

SEQ ID NO: 191813 - DNA, 20 bp, Artificial Sequence
  Synthetic oligonucleotide; GCCTGTTT chr2 60534527 60534546 60534530 -
tacatagagaaatatgtatt

SEQ ID NO: 191814 - DNA, 20 bp, Artificial Sequence
  Synthetic oligonucleotide; GGCAGTTT chr2 60534497 60534516 60534500 -
gttccccacgaacattgcag

SEQ ID NO: 191815 - DNA, 20 bp, Artificial Sequence
  Synthetic oligonucleotide; AGCAGTTT chr2 60534482 60534501 60534485 -
tgcagggcagttttattgtt

SEQ ID NO: 191816 - DNA, 20 bp, Artificial Sequence
  Synthetic oligonucleotide; CAATGCTT chr2 60534383 60534402 60534386 -
agaactacaaacctttctaa

SEQ ID NO: 191817 - DNA, 20 bp, Artificial Sequence
  Synthetic oligonucleotide; TTAGGTTT chr2 60534376 60534395 60534379 -
caaacctttctaacaatgct

SEQ ID NO: 191818 - DNA, 20 bp, Artificial Sequence
  Synthetic oligonucleotide; CTGGGTTT chr2 60534329 60534348 60534332 -
ggcacctaaaggacttgggc

SEQ ID NO: 191819 - DNA, 20 bp, Artificial Sequence
  Synthetic oligonucleotide; GTAAGTTT chr2 60534294 60534313 60534297 -
tcttttatcttttagatcaa

SEQ ID NO: 191820 - DNA, 20 bp, Artificial Sequence
  Synthetic oligonucleotide; AACGGTTT chr2 60534147 60534166 60534150 -
gtgaaaacaaggtgctaact

SEQ ID NO: 191821 - DNA, 20 bp, Artificial Sequence
  Synthetic oligonucleotide; TTCCGATT chr2 60534141 60534160 60534144 -
acaaggtgctaactaacggt

SEQ ID NO: 191822 - DNA, 20 bp, Artificial Sequence
  Synthetic oligonucleotide; CTGTGATT chr2 60534124 60534143 60534127 -
ggtttccgatttttgagagc

SEQ ID NO: 191823 - DNA, 20 bp, Artificial Sequence
  Synthetic oligonucleotide; TGGTGTTT chr2 60534115 60534134 60534118 -
tttttgagagcctgtgattt

SEQ ID NO: 191824 - DNA, 20 bp, Artificial Sequence
  Synthetic oligonucleotide; TTTGGTTT chr2 60534063 60534082 60534066 -
ctgtattattgatgttcatc

SEQ ID NO: 191825 - DNA, 20 bp, Artificial Sequence
  Synthetic oligonucleotide; ATGAGTTT chr2 60534055 60534074 60534058 -
ttgatgttcatctttggttt

SEQ ID NO: 191826 - DNA, 20 bp, Artificial Sequence
  Synthetic oligonucleotide; TTCTGATT chr2 60534006 60534025 60534009 -
tcagaacagtgtaactgata

SEQ ID NO: 191827 - DNA, 20 bp, Artificial Sequence
  Synthetic oligonucleotide; GAATGTTT chr2 60533993 60534012 60533996 -
actgatattctgattaaaac

SEQ ID NO: 191828 - DNA, 20 bp, Artificial Sequence
  Synthetic oligonucleotide; GCATGCTT chr2 60533866 60533885 60533869 -
ccatccataccatgctaaaa

SEQ ID NO: 191829 - DNA, 20 bp, Artificial Sequence
  Synthetic oligonucleotide; TTCAGTTT chr2 60533860 60533879 60533863 -
ataccatgctaaaagcatgc

SEQ ID NO: 191830 - DNA, 20 bp, Artificial Sequence
  Synthetic oligonucleotide; AGGGGCTT chr2 60533742 60533761 60533745 -
ggggtccatctgtgagatcc

SEQ ID NO: 191831 - DNA, 20 bp, Artificial Sequence
  Synthetic oligonucleotide; GAGCGATT chr2 60533718 60533737 60533721 -
gctttttatttgtgtgtgtc

SEQ ID NO: 191832 - DNA, 20 bp, Artificial Sequence
  Synthetic oligonucleotide; AATTGATT chr2 60533661 60533680 60533664 -
ctccggccaactgcatgcat

SEQ ID NO: 191833 - DNA, 20 bp, Artificial Sequence
  Synthetic oligonucleotide; AATTGCTT chr2 60533626 60533645 60533629 -
cactatcattttcttgatgt

SEQ ID NO: 191834 - DNA, 20 bp, Artificial Sequence
  Synthetic oligonucleotide; TGCTGCTT chr2 60533462 60533481 60533465 -
aagcaacactaacttatgca

SEQ ID NO: 191835 - DNA, 20 bp, Artificial Sequence
  Synthetic oligonucleotide; AGGAGTTT chr2 60533250 60533269 60533253 -
ccttattattcagtctatcc

SEQ ID NO: 191836 - DNA, 20 bp, Artificial Sequence
  Synthetic oligonucleotide; GTCGGTTT chr2 60533236 60533255 60533239 -
ctatccaggagttttgccat

SEQ ID NO: 191837 - DNA, 20 bp, Artificial Sequence
  Synthetic oligonucleotide; GAAAGATT chr2 60533180 60533199 60533183 -
cacagccctagaagcagcaa

SEQ ID NO: 191838 - DNA, 20 bp, Artificial Sequence
  Synthetic oligonucleotide; CTGTGCTT chr2 60533137 60533156 60533140 -
aaaacgtgagcatggaggag

SEQ ID NO: 191839 - DNA, 20 bp, Artificial Sequence
  Synthetic oligonucleotide; TTCTGCTT chr2 60533066 60533085 60533069 -
agtcaaaagtgactggaaac

SEQ ID NO: 191840 - DNA, 20 bp, Artificial Sequence
  Synthetic oligonucleotide; AATAGATT chr2 60533035 60533054 60533038 -
tggagtacaaatttcattct

SEQ ID NO: 191841 - DNA, 20 bp, Artificial Sequence
  Synthetic oligonucleotide; GGTAGATT chr2 60533006 60533025 60533009 -
gcataatctagtgtacccag

SEQ ID NO: 191842 - DNA, 20 bp, Artificial Sequence
  Synthetic oligonucleotide; TGTGGCTT chr2 60532863 60532882 60532866 -
cattagctccttcaaaatca

SEQ ID NO: 191843 - DNA, 20 bp, Artificial Sequence
  Synthetic oligonucleotide; CATTGTTT chr2 60532805 60532824 60532808 -
ggaatttacagatggtgaaa

SEQ ID NO: 191844 - DNA, 20 bp, Artificial Sequence
  Synthetic oligonucleotide; TAATGCTT chr2 60532783 60532802 60532786 -
ttgttttaatccaaaccagt

SEQ ID NO: 191845 - DNA, 20 bp, Artificial Sequence
  Synthetic oligonucleotide; TACTGTTT chr2 60532752 60532771 60532755 -
atctacctttaaaaaaattg

SEQ ID NO: 191846 - DNA, 20 bp, Artificial Sequence
  Synthetic oligonucleotide; AACTGTTT chr2 60532680 60532699 60532683 -
gaatccatctcactgtggca

SEQ ID NO: 191847 - DNA, 20 bp, Artificial Sequence
  Synthetic oligonucleotide; AATAGTTT chr2 60532357 60532376 60532360 -
taaaaaactggaaatgacag

SEQ ID NO: 191848 - DNA, 20 bp, Artificial Sequence
  Synthetic oligonucleotide; CTGTGATT chr2 60532177 60532196 60532180 -
tctcaaaatttgaagaactt

SEQ ID NO: 191849 - DNA, 20 bp, Artificial Sequence
  Synthetic oligonucleotide; ATTAGATT chr2 60532123 60532142 60532126 -
caaatttcttcctgatctta

SEQ ID NO: 191850 - DNA, 20 bp, Artificial Sequence
  Synthetic oligonucleotide; ATTCGATT chr2 60532118 60532137 60532121 -
ttcttcctgatcttaattag

SEQ ID NO: 191851 - DNA, 20 bp, Artificial Sequence
  Synthetic oligonucleotide; GTTGGATT chr2 60532097 60532116 60532100 -
ttcgattgtgcggtgggtgt

SEQ ID NO: 191852 - DNA, 20 bp, Artificial Sequence
  Synthetic oligonucleotide; GGCAGCTT chr2 60531991 60532010 60531994 -
ggcggtgtggcaggaacaaa

SEQ ID NO: 191853 - DNA, 20 bp, Artificial Sequence
  Synthetic oligonucleotide; GCAGGATT chr2 60531972 60531991 60531975 -
aggcagcttccaacgctggt

SEQ ID NO: 191854 - DNA, 20 bp, Artificial Sequence
  Synthetic oligonucleotide; GTGGGCTT chr2 60531911 60531930 60531914 -
gtcttgagttcttcatttag

SEQ ID NO: 191855 - DNA, 20 bp, Artificial Sequence
  Synthetic oligonucleotide; GGGGGATT chr2 60531887 60531906 60531890 -
gcttatttcccactgggtct

SEQ ID NO: 191856 - DNA, 20 bp, Artificial Sequence
  Synthetic oligonucleotide; TTGAGTTT chr2 60531662 60531681 60531665 -
ggcactgccaaaacacgctc

SEQ ID NO: 191857 - DNA, 20 bp, Artificial Sequence
  Synthetic oligonucleotide; GCAAGTTT chr2 60531614 60531633 60531617 -
gtcctgccaaagtgtatgga

SEQ ID NO: 191858 - DNA, 20 bp, Artificial Sequence
  Synthetic oligonucleotide; CAAGGCTT chr2 60531561 60531580 60531564 -
gaaataataaaagccctggc

SEQ ID NO: 191859 - DNA, 20 bp, Artificial Sequence
  Synthetic oligonucleotide; TTTTGTTT chr2 60531543 60531562 60531546 -
gccaaggcttatgaatctat

SEQ ID NO: 191860 - DNA, 20 bp, Artificial Sequence
  Synthetic oligonucleotide; GTGTGCTT chr2 60531429 60531448 60531432 -
ttccgtactggttgtaaaaa

SEQ ID NO: 191861 - DNA, 20 bp, Artificial Sequence
  Synthetic oligonucleotide; ATATGATT chr2 60531389 60531408 60531392 -
aagtcagggtaaattaatgg

SEQ ID NO: 191862 - DNA, 20 bp, Artificial Sequence
  Synthetic oligonucleotide; TCTGGTTT chr2 60531310 60531329 60531313 -
tcccagtatttaatttattt

SEQ ID NO: 191863 - DNA, 20 bp, Artificial Sequence
  Synthetic oligonucleotide; AAAAGATT chr2 60531281 60531300 60531284 -
gtgttagtgtgagagggtcg

SEQ ID NO: 191864 - DNA, 20 bp, Artificial Sequence
  Synthetic oligonucleotide; ACGGGATT chr2 60531262 60531281 60531265 -
gaaaagattctgtgggtcca

SEQ ID NO: 191865 - DNA, 20 bp, Artificial Sequence
  Synthetic oligonucleotide; AGGGGCTT chr2 60531139 60531158 60531142 -
taatttctgaggttgccagg

SEQ ID NO: 191866 - DNA, 20 bp, Artificial Sequence
  Synthetic oligonucleotide; ACTGGTTT chr2 60531001 60531020 60531004 -
cctggccatggtgtagccag

SEQ ID NO: 191867 - DNA, 20 bp, Artificial Sequence
  Synthetic oligonucleotide; GATAGATT chr2 60530981 60531000 60530984 -
actggtttagcagacagaat

SEQ ID NO: 191868 - DNA, 20 bp, Artificial Sequence
  Synthetic oligonucleotide; GATTGTTT chr2 60530977 60530996 60530980 -
gtttagcagacagaatgata

SEQ ID NO: 191869 - DNA, 20 bp, Artificial Sequence
  Synthetic oligonucleotide; CTTTGTTT chr2 60530932 60530951 60530935 -
tgcgccctgaacttgaagca

SEQ ID NO: 191870 - DNA, 20 bp, Artificial Sequence
  Synthetic oligonucleotide; TCTAGTTT chr2 60530885 60530904 60530888 -
aagcgcagacataatcgatg

SEQ ID NO: 191871 - DNA, 20 bp, Artificial Sequence
  Synthetic oligonucleotide; CCAGGCTT chr2 60530763 60530782 60530766 -
cagatgaacttggccgaggg

SEQ ID NO: 191872 - DNA, 20 bp, Artificial Sequence
  Synthetic oligonucleotide; CAGTGTTT chr2 60530713 60530732 60530716 -
ccagtgcagccaagcctttt

SEQ ID NO: 191873 - DNA, 20 bp, Artificial Sequence
  Synthetic oligonucleotide; CCTGGCTT chr2 60530517 60530536 60530520 -
atgcgggttctatcatcttt

SEQ ID NO: 191874 - DNA, 20 bp, Artificial Sequence
  Synthetic oligonucleotide; AAGGGTTT chr2 60530457 60530476 60530460 -
taacccgagggccagatggg

SEQ ID NO: 191875 - DNA, 20 bp, Artificial Sequence
  Synthetic oligonucleotide; TGAAGTTT chr2 60530326 60530345 60530329 -
tttttttttttttaaatggc

SEQ ID NO: 191876 - DNA, 20 bp, Artificial Sequence
  Synthetic oligonucleotide; ATGTGTTT chr2 60530157 60530176 60530160 -
ccaggaccgatggcaaaccc

SEQ ID NO: 191877 - DNA, 20 bp, Artificial Sequence
  Synthetic oligonucleotide; TTGGGCTT chr2 60530151 60530170 60530154 -
ccgatggcaaacccatgtgt

SEQ ID NO: 191878 - DNA, 20 bp, Artificial Sequence
  Synthetic oligonucleotide; GCTTGTTT chr2 60530147 60530166 60530150 -
tggcaaacccatgtgtttgg

SEQ ID NO: 191879 - DNA, 20 bp, Artificial Sequence
  Synthetic oligonucleotide; TCTCGATT chr2 60530136 60530155 60530139 -
tgtgtttgggcttgttttgt

SEQ ID NO: 191880 - DNA, 20 bp, Artificial Sequence
  Synthetic oligonucleotide; CTGTGTTT chr2 60530106 60530125 60530109 -
cttatcttcttggcctcttc

SEQ ID NO: 191881 - DNA, 20 bp, Artificial Sequence
  Synthetic oligonucleotide; TTTAGTTT chr2 60530098 60530117 60530101 -
cttggcctcttcctgtgttt

SEQ ID NO: 191882 - DNA, 20 bp, Artificial Sequence
  Synthetic oligonucleotide; CAGGGCTT chr2 60529864 60529883 60529867 -
gaatcccacctaggggacac

SEQ ID NO: 191883 - DNA, 20 bp, Artificial Sequence
  Synthetic oligonucleotide; AGTGGTTT chr2 60529853 60529872 60529856 -
aggggacaccagggctttca

SEQ ID NO: 191884 - DNA, 20 bp, Artificial Sequence
  Synthetic oligonucleotide; GCAGGATT chr2 60529708 60529727 60529711 -
ggctaggcctcataagggag

SEQ ID NO: 191885 - DNA, 20 bp, Artificial Sequence
  Synthetic oligonucleotide; CTGGGTTT chr2 60529650 60529669 60529653 -
ctgggaaaatttgggggcct

SEQ ID NO: 191886 - DNA, 20 bp, Artificial Sequence
  Synthetic oligonucleotide; CTTTGATT chr2 60529468 60529487 60529471 -
cttctttcttttcttcttct

SEQ ID NO: 191887 - DNA, 20 bp, Artificial Sequence
  Synthetic oligonucleotide; AATGGTTT chr2 60529449 60529468 60529452 -
tctttgattacacgaaataa

SEQ ID NO: 191888 - DNA, 20 bp, Artificial Sequence
  Synthetic oligonucleotide; GGCAGATT chr2 60529395 60529414 60529398 -
tttctagttgtgcaaccttg

SEQ ID NO: 191889 - DNA, 20 bp, Artificial Sequence
  Synthetic oligonucleotide; CTCCGCTT chr2 60529374 60529393 60529377 -
gcagatttcattccctaagc

SEQ ID NO: 191890 - DNA, 20 bp, Artificial Sequence
  Synthetic oligonucleotide; CGGGGCTT chr2 60529339 60529358 60529342 -
ctgtaaagtggggagaatca

SEQ ID NO: 191891 - DNA, 20 bp, Artificial Sequence
  Synthetic oligonucleotide; CATGGCTT chr2 60529221 60529240 60529224 -
ttactattacggttatgact

SEQ ID NO: 191892 - DNA, 20 bp, Artificial Sequence
  Synthetic oligonucleotide; TTATGTTT chr2 60529105 60529124 60529108 -
ctaaagagctcagggtctca

SEQ ID NO: 191893 - DNA, 20 bp, Artificial Sequence
  Synthetic oligonucleotide; AGAGGCTT chr2 60529036 60529055 60529039 -
tagacgtgtgttgccttacg

SEQ ID NO: 191894 - DNA, 20 bp, Artificial Sequence
  Synthetic oligonucleotide; TTCAGATT chr2 60528993 60529012 60528996 -
tgtgacacagttactctggg

SEQ ID NO: 191895 - DNA, 20 bp, Artificial Sequence
  Synthetic oligonucleotide; GTACGTTT chr2 60528632 60528651 60528635 -
caccctctgctacctcttca

SEQ ID NO: 191896 - DNA, 20 bp, Artificial Sequence
  Synthetic oligonucleotide; TGCAGCTT chr2 60528625 60528644 60528628 -
tgctacctcttcagtacgtt

SEQ ID NO: 191897 - DNA, 20 bp, Artificial Sequence
  Synthetic oligonucleotide; TCAAGTTT chr2 60528542 60528561 60528545 -
ccctcccatgggttctgtgg

SEQ ID NO: 191898 - DNA, 20 bp, Artificial Sequence
  Synthetic oligonucleotide; TCCTGCTT chr2 60528441 60528460 60528444 -
aaaagttgcaatgtaaggaa

SEQ ID NO: 191899 - DNA, 20 bp, Artificial Sequence
  Synthetic oligonucleotide; GGAGGTTT chr2 60528362 60528381 60528365 -
ggtcctgagaaacagaggga

SEQ ID NO: 191900 - DNA, 20 bp, Artificial Sequence
  Synthetic oligonucleotide; TACTGTTT chr2 60528354 60528373 60528357 -
gaaacagagggaggaggttt

SEQ ID NO: 191901 - DNA, 20 bp, Artificial Sequence
  Synthetic oligonucleotide; TGTGGCTT chr2 60528343 60528362 60528346 -
aggaggttttactgtttgtg

SEQ ID NO: 191902 - DNA, 20 bp, Artificial Sequence
  Synthetic oligonucleotide; TGAGGCTT chr2 60528278 60528297 60528281 -
ctcggacttttaagaagtgg

SEQ ID NO: 191903 - DNA, 20 bp, Artificial Sequence
  Synthetic oligonucleotide; TGGTGTTT chr2 60528145 60528164 60528148 -
tgagtgagtgtgcgtggcag

SEQ ID NO: 191904 - DNA, 20 bp, Artificial Sequence
  Synthetic oligonucleotide; ATCTGCTT chr2 60528108 60528127 60528111 -
atgggttctggggggtcata

SEQ ID NO: 191905 - DNA, 20 bp, Artificial Sequence
  Synthetic oligonucleotide; GGAGGTTT chr2 60528097 60528116 60528100 -
ggggtcataatctgcttcga

SEQ ID NO: 191906 - DNA, 20 bp, Artificial Sequence
  Synthetic oligonucleotide; GGAAGTTT chr2 60528028 60528047 60528031 -
aggcatgctggaaacttgag

SEQ ID NO: 191907 - DNA, 20 bp, Artificial Sequence
  Synthetic oligonucleotide; TGTGGCTT chr2 60527981 60528000 60527984 -
acagctccatatgatccgca

SEQ ID NO: 191908 - DNA, 20 bp, Artificial Sequence
  Synthetic oligonucleotide; GCAAGTTT chr2 60527965 60527984 60527968 -
cgcatgtggcttccccagag

SEQ ID NO: 191909 - DNA, 20 bp, Artificial Sequence
  Synthetic oligonucleotide; GATGGATT chr2 60527869 60527888 60527872 -
aagacctgaggttcgttgca

SEQ ID NO: 191910 - DNA, 20 bp, Artificial Sequence
  Synthetic oligonucleotide; TACTGTTT chr2 60527835 60527854 60527838 -
tgtattccaaaaccaaatgt

SEQ ID NO: 191911 - DNA, 20 bp, Artificial Sequence
  Synthetic oligonucleotide; CTGAGTTT chr2 60527577 60527596 60527580 -
ggtcacatccaggttgtctt

SEQ ID NO: 191912 - DNA, 20 bp, Artificial Sequence
  Synthetic oligonucleotide; CAAAGCTT chr2 60527521 60527540 60527524 -
tccatgtgggtcaagagctc

SEQ ID NO: 191913 - DNA, 20 bp, Artificial Sequence
  Synthetic oligonucleotide; CTTAGTTT chr2 60527355 60527374 60527358 -
gtcaccctggaagagaagct

SEQ ID NO: 191914 - DNA, 20 bp, Artificial Sequence
  Synthetic oligonucleotide; CATGGCTT chr2 60527292 60527311 60527295 -
tgaaatgataaaaggcgtat

SEQ ID NO: 191915 - DNA, 20 bp, Artificial Sequence
  Synthetic oligonucleotide; CCTAGTTT chr2 60527252 60527271 60527255 -
tatttccctcgctcgcaccc

SEQ ID NO: 191916 - DNA, 20 bp, Artificial Sequence
  Synthetic oligonucleotide; TTTTGTTT chr2 60527189 60527208 60527192 -
ccacatctctgatgatggcc

SEQ ID NO: 191917 - DNA, 20 bp, Artificial Sequence
  Synthetic oligonucleotide; TTCTGTTT chr2 60527171 60527190 60527174 -
ccttttgtttctttttcttt

SEQ ID NO: 191918 - DNA, 20 bp, Artificial Sequence
  Synthetic oligonucleotide; ACCTGATT chr2 60526956 60526975 60526959 -
cgggtagtatttctacttca

SEQ ID NO: 191919 - DNA, 20 bp, Artificial Sequence
  Synthetic oligonucleotide; CCCCGCTT chr2 60526880 60526899 60526883 -
gttcctggtgctaagtagtt

SEQ ID NO: 191920 - DNA, 20 bp, Artificial Sequence
  Synthetic oligonucleotide; CAGAGATT chr2 60526854 60526873 60526857 -
ttaagaatgcgttggctggg

SEQ ID NO: 191921 - DNA, 20 bp, Artificial Sequence
  Synthetic oligonucleotide; ATTTGTTT chr2 60526790 60526809 60526793 -
gcattataggtcagcccttt

SEQ ID NO: 191922 - DNA, 20 bp, Artificial Sequence
  Synthetic oligonucleotide; GGCTGCTT chr2 60526747 60526766 60526750 -
acagttgtcatgtaatttat

SEQ ID NO: 191923 - DNA, 20 bp, Artificial Sequence
  Synthetic oligonucleotide; GAAGGCTT chr2 60526671 60526690 60526674 -
gacatagacacactgcactt

SEQ ID NO: 191924 - DNA, 20 bp, Artificial Sequence
  Synthetic oligonucleotide; TATTGTTT chr2 60526661 60526680 60526664 -
cactgcacttgaaggcttgg

SEQ ID NO: 191925 - DNA, 20 bp, Artificial Sequence
  Synthetic oligonucleotide; TGCAGATT chr2 60526589 60526608 60526592 -
ttgggctaatctaaatgcgc

SEQ ID NO: 191926 - DNA, 20 bp, Artificial Sequence
  Synthetic oligonucleotide; TGCTGCTT chr2 60526384 60526403 60526387 -
aatggtaaaggataaacata

SEQ ID NO: 191927 - DNA, 20 bp, Artificial Sequence
  Synthetic oligonucleotide; CTTTGTTT chr2 60526379 60526398 60526382 -
taaaggataaacatatgctg

SEQ ID NO: 191928 - DNA, 20 bp, Artificial Sequence
  Synthetic oligonucleotide; TATTGATT chr2 60526359 60526378 60526362 -
ctttgtttgtcttatttatt

SEQ ID NO: 191929 - DNA, 20 bp, Artificial Sequence
  Synthetic oligonucleotide; AATAGCTT chr2 60526244 60526263 60526247 -
agagcaaaatatagccaacc

SEQ ID NO: 191930 - DNA, 20 bp, Artificial Sequence
  Synthetic oligonucleotide; ATGGGATT chr2 60526210 60526229 60526213 -
agaacacatcatcccaaaat

SEQ ID NO: 191931 - DNA, 20 bp, Artificial Sequence
  Synthetic oligonucleotide; ACCAGTTT chr2 60526185 60526204 60526188 -
attctgaatttgatcaaatc

SEQ ID NO: 191932 - DNA, 20 bp, Artificial Sequence
  Synthetic oligonucleotide; TCTAGATT chr2 60526162 60526181 60526165 -
agtttctgaatttgatcaaa

SEQ ID NO: 191933 - DNA, 20 bp, Artificial Sequence
  Synthetic oligonucleotide; GCCTGTTT chr2 60526125 60526144 60526128 -
ttcagggtgagagaaaccat

SEQ ID NO: 191934 - DNA, 20 bp, Artificial Sequence
  Synthetic oligonucleotide; TTTTGATT chr2 60525957 60525976 60525960 -
agagcattatgataaactat

SEQ ID NO: 191935 - DNA, 20 bp, Artificial Sequence
  Synthetic oligonucleotide; ACTGGTTT chr2 60525851 60525870 60525854 -
gccatggagaaattaccaag

SEQ ID NO: 191936 - DNA, 20 bp, Artificial Sequence
  Synthetic oligonucleotide; TACAGATT chr2 60525812 60525831 60525815 -
atttaaggtcttttgggcat

SEQ ID NO: 191937 - DNA, 20 bp, Artificial Sequence
  Synthetic oligonucleotide; GTGAGATT chr2 60525712 60525731 60525715 -
gacccttattgtatcatgct

SEQ ID NO: 191938 - DNA, 20 bp, Artificial Sequence
  Synthetic oligonucleotide; ATTTGTTT chr2 60525681 60525700 60525684 -
ggctcccttcacctgttagc

SEQ ID NO: 191939 - DNA, 20 bp, Artificial Sequence
  Synthetic oligonucleotide; GATAGTTT chr2 60525647 60525666 60525650 -
cttgtaaagtaggtaaaata

SEQ ID NO: 191940 - DNA, 20 bp, Artificial Sequence
  Synthetic oligonucleotide; ACCAGTTT chr2 60525583 60525602 60525586 -
gcatagtatgaacaccactg

SEQ ID NO: 191941 - DNA, 20 bp, Artificial Sequence
  Synthetic oligonucleotide; TCTTGATT chr2 60525506 60525525 60525509 -
aagacagcagaatattattt

SEQ ID NO: 191942 - DNA, 20 bp, Artificial Sequence
  Synthetic oligonucleotide; TGGAGATT chr2 60525475 60525494 60525478 -
ctcaaagatggaagctatgg

SEQ ID NO: 191943 - DNA, 20 bp, Artificial Sequence
  Synthetic oligonucleotide; TAAGGCTT chr2 60525468 60525487 60525471 -
atggaagctatggtggagat

SEQ ID NO: 191944 - DNA, 20 bp, Artificial Sequence
  Synthetic oligonucleotide; CTTGGATT chr2 60525463 60525482 60525466 -
agctatggtggagattaagg

SEQ ID NO: 191945 - DNA, 20 bp, Artificial Sequence
  Synthetic oligonucleotide; TCGTGATT chr2 60525456 60525475 60525459 -
gtggagattaaggcttggat

SEQ ID NO: 191946 - DNA, 20 bp, Artificial Sequence
  Synthetic oligonucleotide; GAAAGCTT chr2 60525440 60525459 60525443 -
ggattcgtgattccccaaca

SEQ ID NO: 191947 - DNA, 20 bp, Artificial Sequence
  Synthetic oligonucleotide; AGAAGTTT chr2 60525366 60525385 60525369 -
atggaatggtgataattcac

SEQ ID NO: 191948 - DNA, 20 bp, Artificial Sequence
  Synthetic oligonucleotide; ATAAGATT chr2 60525350 60525369 60525353 -
tcacagaagtttccagcctt

SEQ ID NO: 191949 - DNA, 20 bp, Artificial Sequence
  Synthetic oligonucleotide; AGCTGTTT chr2 60525320 60525339 60525323 -
tccatcttttaattgttgca

SEQ ID NO: 191950 - DNA, 20 bp, Artificial Sequence
  Synthetic oligonucleotide; CCAAGTTT chr2 60525274 60525293 60525277 -
gaatgtaatgtgtattttct

SEQ ID NO: 191951 - DNA, 20 bp, Artificial Sequence
  Synthetic oligonucleotide; GTTTGCTT chr2 60525270 60525289 60525273 -
gtaatgtgtattttctccaa

SEQ ID NO: 191952 - DNA, 20 bp, Artificial Sequence
  Synthetic oligonucleotide; GTACGTTT chr2 60525230 60525249 60525233 -
gtaactacatcaaaatagaa

SEQ ID NO: 191953 - DNA, 20 bp, Artificial Sequence
  Synthetic oligonucleotide; GCTGGTTT chr2 60525127 60525146 60525130 -
cctccttcctcctcccaaaa

SEQ ID NO: 191954 - DNA, 20 bp, Artificial Sequence
  Synthetic oligonucleotide; TTTTGCTT chr2 60525071 60525090 60525074 -
gagtccctggagttaggaat

SEQ ID NO: 191955 - DNA, 20 bp, Artificial Sequence
  Synthetic oligonucleotide; ACATGTTT chr2 60525044 60525063 60525047 -
tgttaaaggcatccgatgca

SEQ ID NO: 191956 - DNA, 20 bp, Artificial Sequence
  Synthetic oligonucleotide; TGGTGTTT chr2 60524903 60524922 60524906 -
tgcaatccattttttaaact

SEQ ID NO: 191957 - DNA, 20 bp, Artificial Sequence
  Synthetic oligonucleotide; ATTGGCTT chr2 60524892 60524911 60524895 -
ttttaaacttggtgtttacc

SEQ ID NO: 191958 - DNA, 20 bp, Artificial Sequence
  Synthetic oligonucleotide; GGATGTTT chr2 60524877 60524896 60524880 -
ttaccattggcttttagcac

SEQ ID NO: 191959 - DNA, 20 bp, Artificial Sequence
  Synthetic oligonucleotide; TTCTGTTT chr2 60524871 60524890 60524874 -
ttggcttttagcacggatgt

SEQ ID NO: 191960 - DNA, 20 bp, Artificial Sequence
  Synthetic oligonucleotide; AAATGTTT chr2 60524813 60524832 60524816 -
gtggcattgaatgagatatg

SEQ ID NO: 191961 - DNA, 20 bp, Artificial Sequence
  Synthetic oligonucleotide; TATAGCTT chr2 60524653 60524672 60524656 -
acacaggcactcttgagatc

SEQ ID NO: 191962 - DNA, 20 bp, Artificial Sequence
  Synthetic oligonucleotide; TAATGTTT chr2 60524602 60524621 60524605 -
attactgcctctttaattta

SEQ ID NO: 191963 - DNA, 20 bp, Artificial Sequence
  Synthetic oligonucleotide; TGGGGATT chr2 60524594 60524613 60524597 -
ctctttaatttataatgttt

SEQ ID NO: 191964 - DNA, 20 bp, Artificial Sequence
  Synthetic oligonucleotide; AGCTGTTT chr2 60524551 60524570 60524554 -
ctgtaagggcactggtaatc

SEQ ID NO: 191965 - DNA, 20 bp, Artificial Sequence
  Synthetic oligonucleotide; TTCTGATT chr2 60524545 60524564 60524548 -
gggcactggtaatcagctgt

SEQ ID NO: 191966 - DNA, 20 bp, Artificial Sequence
  Synthetic oligonucleotide; TAAAGTTT chr2 60524451 60524470 60524454 -
aaaaacaaaaacaaggaaca

SEQ ID NO: 191967 - DNA, 20 bp, Artificial Sequence
  Synthetic oligonucleotide; TGAAGTTT chr2 60524298 60524317 60524301 -
caaaattatgtattcagaca

SEQ ID NO: 191968 - DNA, 20 bp, Artificial Sequence
  Synthetic oligonucleotide; TTAGGATT chr2 60524292 60524311 60524295 -
tatgtattcagacatgaagt

SEQ ID NO: 191969 - DNA, 20 bp, Artificial Sequence
  Synthetic oligonucleotide; TATAGATT chr2 60524140 60524159 60524143 -
agctgtgtcacaatgtgata

SEQ ID NO: 191970 - DNA, 20 bp, Artificial Sequence
  Synthetic oligonucleotide; TTTTGTTT chr2 60524115 60524134 60524118 -
attatatttaccatggcata

SEQ ID NO: 191971 - DNA, 20 bp, Artificial Sequence
  Synthetic oligonucleotide; TCCAGTTT chr2 60524073 60524092 60524076 -
gatgataaatgaagataccc

SEQ ID NO: 191972 - DNA, 20 bp, Artificial Sequence
  Synthetic oligonucleotide; CAAAGTTT chr2 60523979 60523998 60523982 -
tatgggaacataattgactt

SEQ ID NO: 191973 - DNA, 20 bp, Artificial Sequence
  Synthetic oligonucleotide; TGAAGTTT chr2 60523959 60523978 60523962 -
caaagttttagatctctggc

SEQ ID NO: 191974 - DNA, 20 bp, Artificial Sequence
  Synthetic oligonucleotide; CTGTGCTT chr2 60523923 60523942 60523926 -
atagtccattacattaatgt

SEQ ID NO: 191975 - DNA, 20 bp, Artificial Sequence
  Synthetic oligonucleotide; TTTGGCTT chr2 60523905 60523924 60523908 -
gtctgtgcttaaagctccta

SEQ ID NO: 191976 - DNA, 20 bp, Artificial Sequence
  Synthetic oligonucleotide; TAGGGTTT chr2 60523885 60523904 60523888 -
tttggcttaaataaattatt

SEQ ID NO: 191977 - DNA, 20 bp, Artificial Sequence
  Synthetic oligonucleotide; TACTGCTT chr2 60523878 60523897 60523881 -
taaataaattatttagggtt

SEQ ID NO: 191978 - DNA, 20 bp, Artificial Sequence
  Synthetic oligonucleotide; GAACGTTT chr2 60523852 60523871 60523855 -
ttaaaccttggtcaattctt

SEQ ID NO: 191979 - DNA, 20 bp, Artificial Sequence
  Synthetic oligonucleotide; TGGTGATT chr2 60523806 60523825 60523809 -
tccagtgactttctgtgcct

SEQ ID NO: 191980 - DNA, 20 bp, Artificial Sequence
  Synthetic oligonucleotide; ACTTGATT chr2 60523793 60523812 60523796 -
tgtgccttggtgattcattt

SEQ ID NO: 191981 - DNA, 20 bp, Artificial Sequence
  Synthetic oligonucleotide; GTATGATT chr2 60523769 60523788 60523772 -
gattgagctcctgtgtgctc

SEQ ID NO: 191982 - DNA, 20 bp, Artificial Sequence
  Synthetic oligonucleotide; TCAAGTTT chr2 60523747 60523766 60523750 -
atgatttctaaatgtatttc

SEQ ID NO: 191983 - DNA, 20 bp, Artificial Sequence
  Synthetic oligonucleotide; GAATGATT chr2 60523728 60523747 60523731 -
ctcaagttttgcctggcaat

SEQ ID NO: 191984 - DNA, 20 bp, Artificial Sequence
  Synthetic oligonucleotide; TTTTGCTT chr2 60523722 60523741 60523725 -
ttttgcctggcaatgaatga

SEQ ID NO: 191985 - DNA, 20 bp, Artificial Sequence
  Synthetic oligonucleotide; AAAGGCTT chr2 60523687 60523706 60523690 -
tcttgtgtggtacacctata

SEQ ID NO: 191986 - DNA, 20 bp, Artificial Sequence
  Synthetic oligonucleotide; CCATGATT chr2 60523466 60523485 60523469 -
aggaaagtctttagaattca

SEQ ID NO: 191987 - DNA, 20 bp, Artificial Sequence
  Synthetic oligonucleotide; AGAAGTTT chr2 60523443 60523462 60523446 -
tgattccatcaaatcaatat

SEQ ID NO: 191988 - DNA, 20 bp, Artificial Sequence
  Synthetic oligonucleotide; GCTGGATT chr2 60523339 60523358 60523342 -
aagtctgttgttcacatagc

SEQ ID NO: 191989 - DNA, 20 bp, Artificial Sequence
  Synthetic oligonucleotide; TGGTGTTT chr2 60523239 60523258 60523242 -
ctcccctgagttgagaagac

SEQ ID NO: 191990 - DNA, 20 bp, Artificial Sequence
  Synthetic oligonucleotide; ACAAGCTT chr2 60523064 60523083 60523067 -
cctgaaagatattaagtcca

SEQ ID NO: 191991 - DNA, 20 bp, Artificial Sequence
  Synthetic oligonucleotide; TTTTGTTT chr2 60523019 60523038 60523022 -
agagaaaacggccaggcaat

SEQ ID NO: 191992 - DNA, 20 bp, Artificial Sequence
  Synthetic oligonucleotide; ATAGGTTT chr2 60522967 60522986 60522970 -
ctagttccagaggctgatca

SEQ ID NO: 191993 - DNA, 20 bp, Artificial Sequence
  Synthetic oligonucleotide; ACCTGCTT chr2 60522729 60522748 60522732 -
gttctgaacactgggagtgc

SEQ ID NO: 191994 - DNA, 20 bp, Artificial Sequence
  Synthetic oligonucleotide; AGGAGCTT chr2 60522584 60522603 60522587 -
ggcaaaggactgcaaggggc

SEQ ID NO: 191995 - DNA, 20 bp, Artificial Sequence
  Synthetic oligonucleotide; GGTGGCTT chr2 60522562 60522581 60522565 -
gagcttgggctgacatgcaa

SEQ ID NO: 191996 - DNA, 20 bp, Artificial Sequence
  Synthetic oligonucleotide; GTGTGATT chr2 60522532 60522551 60522535 -
cacaaggccctttttagaga

SEQ ID NO: 191997 - DNA, 20 bp, Artificial Sequence
  Synthetic oligonucleotide; TGAAGCTT chr2 60522521 60522540 60522524 -
ttttagagagtgtgattctc

SEQ ID NO: 191998 - DNA, 20 bp, Artificial Sequence
  Synthetic oligonucleotide; GGCAGCTT chr2 60522508 60522527 60522511 -
gattctctgaagcttttctt

SEQ ID NO: 191999 - DNA, 20 bp, Artificial Sequence
  Synthetic oligonucleotide; CTGAGTTT chr2 60522439 60522458 60522442 -
ccagatggaaagaagtattt

SEQ ID NO: 192000 - DNA, 20 bp, Artificial Sequence
  Synthetic oligonucleotide; AATGGTTT chr2 60522367 60522386 60522370 -
ttattatttttaggtgtgat

SEQ ID NO: 192001 - DNA, 20 bp, Artificial Sequence
  Synthetic oligonucleotide; CTATGTTT chr2 60522326 60522345 60522329 -
aaaagaaaaaaaacgagttc

SEQ ID NO: 192002 - DNA, 20 bp, Artificial Sequence
  Synthetic oligonucleotide; AGGTGTTT chr2 60522303 60522322 60522306 -
tgtttaaaaaatacatacag

SEQ ID NO: 192003 - DNA, 20 bp, Artificial Sequence
  Synthetic oligonucleotide; GACTGATT chr2 60522168 60522187 60522171 -
ctggaagatgtggacttggg

SEQ ID NO: 192004 - DNA, 20 bp, Artificial Sequence
  Synthetic oligonucleotide; TTGAGATT chr2 60522132 60522151 60522135 -
tctctctacttttgtagtat

SEQ ID NO: 192005 - DNA, 20 bp, Artificial Sequence
  Synthetic oligonucleotide; CCTTGTTT chr2 60522078 60522097 60522081 -
actggtggagagcagtatgg

SEQ ID NO: 192006 - DNA, 20 bp, Artificial Sequence
  Synthetic oligonucleotide; TGTTGTTT chr2 60522064 60522083 60522067 -
gtatggccttgtttagtcgg

SEQ ID NO: 192007 - DNA, 20 bp, Artificial Sequence
  Synthetic oligonucleotide; AAGGGTTT chr2 60522049 60522068 60522052 -
gtcggtgttgtttcttcacc

SEQ ID NO: 192008 - DNA, 20 bp, Artificial Sequence
  Synthetic oligonucleotide; TGGCGTTT chr2 60521858 60521877 60521861 -
gcatgaggcagagtcagatg

SEQ ID NO: 192009 - DNA, 20 bp, Artificial Sequence
  Synthetic oligonucleotide; GTTTGCTT chr2 60521854 60521873 60521857 -
gaggcagagtcagatgtggc

SEQ ID NO: 192010 - DNA, 20 bp, Artificial Sequence
  Synthetic oligonucleotide; TTGAGTTT chr2 60521848 60521867 60521851 -
gagtcagatgtggcgtttgc

SEQ ID NO: 192011 - DNA, 20 bp, Artificial Sequence
  Synthetic oligonucleotide; CAAGGCTT chr2 60521756 60521775 60521759 -
ggctggtagtgttatgaaga

SEQ ID NO: 192012 - DNA, 20 bp, Artificial Sequence
  Synthetic oligonucleotide; AGATGATT chr2 60521706 60521725 60521709 -
gagccctggctattagagaa

SEQ ID NO: 192013 - DNA, 20 bp, Artificial Sequence
  Synthetic oligonucleotide; AGGAGATT chr2 60521690 60521709 60521693 -
agaaagatgatttgcctgag

SEQ ID NO: 192014 - DNA, 20 bp, Artificial Sequence
  Synthetic oligonucleotide; GTGGGCTT chr2 60521487 60521506 60521490 -
acttgaaagctaggtcactg

SEQ ID NO: 192015 - DNA, 20 bp, Artificial Sequence
  Synthetic oligonucleotide; TCTGGTTT chr2 60521352 60521371 60521355 -
caggcccaggcccgggtccc

SEQ ID NO: 192016 - DNA, 20 bp, Artificial Sequence
  Synthetic oligonucleotide; TCTCGCTT chr2 60521326 60521345 60521329 -
tttacaaaatgtccgctctc

SEQ ID NO: 192017 - DNA, 20 bp, Artificial Sequence
  Synthetic oligonucleotide; TGGCGCTT chr2 60521273 60521292 60521276 -
gtcactcagttatctgagag

SEQ ID NO: 192018 - DNA, 20 bp, Artificial Sequence
  Synthetic oligonucleotide; TTGGGTTT chr2 60521239 60521258 60521242 -
gccatctaagtgcctgatac

SEQ ID NO: 192019 - DNA, 20 bp, Artificial Sequence
  Synthetic oligonucleotide; AGCAGATT chr2 60521229 60521248 60521232 -
tgcctgatacttgggtttac

SEQ ID NO: 192020 - DNA, 20 bp, Artificial Sequence
  Synthetic oligonucleotide; GCTGGTTT chr2 60521207 60521226 60521210 -
cagattaaattaaattttag

SEQ ID NO: 192021 - DNA, 20 bp, Artificial Sequence
  Synthetic oligonucleotide; TTTGGCTT chr2 60521202 60521221 60521205 -
taaattaaattttaggctgg

SEQ ID NO: 192022 - DNA, 20 bp, Artificial Sequence
  Synthetic oligonucleotide; CAAGGATT chr2 60521140 60521159 60521143 -
gaaatgtaacctggcaccct

SEQ ID NO: 192023 - DNA, 20 bp, Artificial Sequence
  Synthetic oligonucleotide; AAGTGTTT chr2 60521012 60521031 60521015 -
ccatttcatccctttccaaa

SEQ ID NO: 192024 - DNA, 20 bp, Artificial Sequence
  Synthetic oligonucleotide; AATAGTTT chr2 60520999 60521018 60521002 -
ttccaaaaagtgtttagaca

SEQ ID NO: 192025 - DNA, 20 bp, Artificial Sequence
  Synthetic oligonucleotide; CTTGGTTT chr2 60520985 60521004 60520988 -
tagacaaatagtttcccaga

SEQ ID NO: 192026 - DNA, 20 bp, Artificial Sequence
  Synthetic oligonucleotide; CTAAGCTT chr2 60520878 60520897 60520881 -
ttttttctgcaaagaagggg

SEQ ID NO: 192027 - DNA, 20 bp, Artificial Sequence
  Synthetic oligonucleotide; GGTGGTTT chr2 60520830 60520849 60520833 -
acccactggagaagggcatg

SEQ ID NO: 192028 - DNA, 20 bp, Artificial Sequence
  Synthetic oligonucleotide; TTCAGATT chr2 60520765 60520784 60520768 -
gcagaatgtctggctgcccc

SEQ ID NO: 192029 - DNA, 20 bp, Artificial Sequence
  Synthetic oligonucleotide; TGTAGATT chr2 60520755 60520774 60520758 -
tggctgccccttcagattcc

SEQ ID NO: 192030 - DNA, 20 bp, Artificial Sequence
  Synthetic oligonucleotide; TGGTGCTT chr2 60520675 60520694 60520678 -
gcaaatatcttcactctcct

SEQ ID NO: 192031 - DNA, 20 bp, Artificial Sequence
  Synthetic oligonucleotide; AACAGTTT chr2 60520610 60520629 60520613 -
atagtgttgagtcagagcaa

SEQ ID NO: 192032 - DNA, 20 bp, Artificial Sequence
  Synthetic oligonucleotide; TCTAGATT chr2 60520467 60520486 60520470 -
gatgctctttacttttataa

SEQ ID NO: 192033 - DNA, 20 bp, Artificial Sequence
  Synthetic oligonucleotide; ACTTGATT chr2 60520442 60520461 60520445 -
attttaaaaaatttggtggc

SEQ ID NO: 192034 - DNA, 20 bp, Artificial Sequence
  Synthetic oligonucleotide; CACTGATT chr2 60520405 60520424 60520408 -
cagactccagaatttatact

SEQ ID NO: 192035 - DNA, 20 bp, Artificial Sequence
  Synthetic oligonucleotide; TTCAGTTT chr2 60520376 60520395 60520379 -
gtaatgcattatgcaaataa

SEQ ID NO: 192036 - DNA, 20 bp, Artificial Sequence
  Synthetic oligonucleotide; TACTGTTT chr2 60520357 60520376 60520360 -
attcagtttacatatccaaa

SEQ ID NO: 192037 - DNA, 20 bp, Artificial Sequence
  Synthetic oligonucleotide; AAATGTTT chr2 60520312 60520331 60520315 -
atgtcttgaaaaaaaaagtg

SEQ ID NO: 192038 - DNA, 20 bp, Artificial Sequence
  Synthetic oligonucleotide; AAGAGTTT chr2 60520280 60520299 60520283 -
aaaataaacaaaacctgcag

SEQ ID NO: 192039 - DNA, 20 bp, Artificial Sequence
  Synthetic oligonucleotide; TTTTGATT chr2 60520181 60520200 60520184 -
ataaataattttgcaattat

SEQ ID NO: 192040 - DNA, 20 bp, Artificial Sequence
  Synthetic oligonucleotide; TTTGGCTT chr2 60520127 60520146 60520130 -
gcaaggtatattctattatc

SEQ ID NO: 192041 - DNA, 20 bp, Artificial Sequence
  Synthetic oligonucleotide; AATTGCTT chr2 60520002 60520021 60520005 -
ttatttgaagaggatacaat

SEQ ID NO: 192042 - DNA, 20 bp, Artificial Sequence
  Synthetic oligonucleotide; ACATGATT chr2 60519987 60520006 60519990 -
acaataattgcttgccagtg

SEQ ID NO: 192043 - DNA, 20 bp, Artificial Sequence
  Synthetic oligonucleotide; TATGGATT chr2 60519885 60519904 60519888 -
atagccatgaattcctgagt

SEQ ID NO: 192044 - DNA, 20 bp, Artificial Sequence
  Synthetic oligonucleotide; CTGAGTTT chr2 60519836 60519855 60519839 -
aaacgatctctttgtcttca

SEQ ID NO: 192045 - DNA, 20 bp, Artificial Sequence
  Synthetic oligonucleotide; ACAAGATT chr2 60519686 60519705 60519689 -
agaactggcctcagaaatct

SEQ ID NO: 192046 - DNA, 20 bp, Artificial Sequence
  Synthetic oligonucleotide; GTCAGATT chr2 60519622 60519641 60519625 -
ttactgctgttgcaaagcac

SEQ ID NO: 192047 - DNA, 20 bp, Artificial Sequence
  Synthetic oligonucleotide; GAGCGATT chr2 60519610 60519629 60519613 -
caaagcacgtcagatttcag

SEQ ID NO: 192048 - DNA, 20 bp, Artificial Sequence
  Synthetic oligonucleotide; ACATGTTT chr2 60519417 60519436 60519420 -
tgcataaagtaagcgttcca

SEQ ID NO: 192049 - DNA, 20 bp, Artificial Sequence
  Synthetic oligonucleotide; CTGTGTTT chr2 60519314 60519333 60519317 -
cacctgacaggtgtaatgtt

SEQ ID NO: 192050 - DNA, 20 bp, Artificial Sequence
  Synthetic oligonucleotide; CCCCGCTT chr2 60519200 60519219 60519203 -
tcctcaggttccctttcttg

SEQ ID NO: 192051 - DNA, 20 bp, Artificial Sequence
  Synthetic oligonucleotide; AGAAGCTT chr2 60519127 60519146 60519130 -
cctggtgtacttgggagaaa

SEQ ID NO: 192052 - DNA, 20 bp, Artificial Sequence
  Synthetic oligonucleotide; CTTGGTTT chr2 60519119 60519138 60519122 -
acttgggagaaaagaagctt

SEQ ID NO: 192053 - DNA, 20 bp, Artificial Sequence
  Synthetic oligonucleotide; CCCTGTTT chr2 60519091 60519110 60519094 -
ggtagtacctaccagagact

SEQ ID NO: 192054 - DNA, 20 bp, Artificial Sequence
  Synthetic oligonucleotide; TCAGGATT chr2 60519073 60519092 60519076 -
ctccctgtttcctgctggta

SEQ ID NO: 192055 - DNA, 20 bp, Artificial Sequence
  Synthetic oligonucleotide; TGTGGATT chr2 60518981 60519000 60518984 -
agaaggaactctccttttgc

SEQ ID NO: 192056 - DNA, 20 bp, Artificial Sequence
  Synthetic oligonucleotide; AGCAGATT chr2 60518967 60518986 60518970 -
ttttgctgtggattgtaggg

SEQ ID NO: 192057 - DNA, 20 bp, Artificial Sequence
  Synthetic oligonucleotide; TGGTGCTT chr2 60518959 60518978 60518962 -
tggattgtagggagcagatt

SEQ ID NO: 192058 - DNA, 20 bp, Artificial Sequence
  Synthetic oligonucleotide; TGTGGCTT chr2 60518949 60518968 60518952 -
ggagcagatttggtgcttac

SEQ ID NO: 192059 - DNA, 20 bp, Artificial Sequence
  Synthetic oligonucleotide; TCCAGCTT chr2 60518823 60518842 60518826 -
caccatgtggatggtgtcca

SEQ ID NO: 192060 - DNA, 20 bp, Artificial Sequence
  Synthetic oligonucleotide; TTCTGATT chr2 60518733 60518752 60518736 -
ttggggcaccccatcccacg

SEQ ID NO: 192061 - DNA, 20 bp, Artificial Sequence
  Synthetic oligonucleotide; CTGGGTTT chr2 60518658 60518677 60518661 -
ctctttctcaacgttctctg

SEQ ID NO: 192062 - DNA, 20 bp, Artificial Sequence
  Synthetic oligonucleotide; TGGTGATT chr2 60518619 60518638 60518622 -
cccatgccctctctggtgtg

SEQ ID NO: 192063 - DNA, 20 bp, Artificial Sequence
  Synthetic oligonucleotide; CAATGCTT chr2 60518598 60518617 60518601 -
ggtgattctcagatctagag

SEQ ID NO: 192064 - DNA, 20 bp, Artificial Sequence
  Synthetic oligonucleotide; GTCTGCTT chr2 60518365 60518384 60518368 -
gtagtagccaaattctctga

SEQ ID NO: 192065 - DNA, 20 bp, Artificial Sequence
  Synthetic oligonucleotide; TGATGTTT chr2 60518295 60518314 60518298 -
tcctgtgactcctttatcta

SEQ ID NO: 192066 - DNA, 20 bp, Artificial Sequence
  Synthetic oligonucleotide; AGATGATT chr2 60518241 60518260 60518244 -
ttgacagagggaatgagaca

SEQ ID NO: 192067 - DNA, 20 bp, Artificial Sequence
  Synthetic oligonucleotide; CTAGGTTT chr2 60518227 60518246 60518230 -
gagacaagatgattttaggt

SEQ ID NO: 192068 - DNA, 20 bp, Artificial Sequence
  Synthetic oligonucleotide; TTAAGCTT chr2 60518140 60518159 60518143 -
caattattttattttattta

SEQ ID NO: 192069 - DNA, 20 bp, Artificial Sequence
  Synthetic oligonucleotide; CAGGGTTT chr2 60518122 60518141 60518125 -
tattaagctttttgtagaga

SEQ ID NO: 192070 - DNA, 20 bp, Artificial Sequence
  Synthetic oligonucleotide; CCTAGCTT chr2 60518085 60518104 60518088 -
gcccaggctggtcttgaact

SEQ ID NO: 192071 - DNA, 20 bp, Artificial Sequence
  Synthetic oligonucleotide; CTGAGATT chr2 60518044 60518063 60518047 -
ctctgtggccttccaaattt

SEQ ID NO: 192072 - DNA, 20 bp, Artificial Sequence
  Synthetic oligonucleotide; TTGGGTTT chr2 60517959 60517978 60517962 -
ttttctctcctcccctaaaa

SEQ ID NO: 192073 - DNA, 20 bp, Artificial Sequence
  Synthetic oligonucleotide; AAGAGTTT chr2 60517921 60517940 60517924 -
ttcttgttcctctagtcgac

SEQ ID NO: 192074 - DNA, 20 bp, Artificial Sequence
  Synthetic oligonucleotide; GATAGTTT chr2 60517874 60517893 60517877 -
agcacagctctttgagcata

SEQ ID NO: 192075 - DNA, 20 bp, Artificial Sequence
  Synthetic oligonucleotide; TGGGGCTT chr2 60517697 60517716 60517700 -
ggtagacttggcccagagcc

SEQ ID NO: 192076 - DNA, 20 bp, Artificial Sequence
  Synthetic oligonucleotide; ATGTGCTT chr2 60517613 60517632 60517616 -
aggagccagaggtggcccgc

SEQ ID NO: 192077 - DNA, 20 bp, Artificial Sequence
  Synthetic oligonucleotide; CCACGCTT chr2 60517588 60517607 60517591 -
ctttgcagaggaacttgcac

SEQ ID NO: 192078 - DNA, 20 bp, Artificial Sequence
  Synthetic oligonucleotide; GAATGCTT chr2 60517564 60517583 60517567 -
gcttttatcggtgatggctg

SEQ ID NO: 192079 - DNA, 20 bp, Artificial Sequence
  Synthetic oligonucleotide; TGGAGCTT chr2 60517548 60517567 60517551 -
gctggaatgcttttcttaac

SEQ ID NO: 192080 - DNA, 20 bp, Artificial Sequence
  Synthetic oligonucleotide; TGGTGCTT chr2 60517528 60517547 60517531 -
tggagctttgttgaagagcc

SEQ ID NO: 192081 - DNA, 20 bp, Artificial Sequence
  Synthetic oligonucleotide; CCCTGTTT chr2 60517402 60517421 60517405 -
tcttcttgccttgttccttt

SEQ ID NO: 192082 - DNA, 20 bp, Artificial Sequence
  Synthetic oligonucleotide; TGGGGTTT chr2 60517325 60517344 60517328 -
ctcccaaagtgtggcccttc

SEQ ID NO: 192083 - DNA, 20 bp, Artificial Sequence
  Synthetic oligonucleotide; AATAGCTT chr2 60517300 60517319 60517303 -
tttacatggtgtgcccaggg

SEQ ID NO: 192084 - DNA, 20 bp, Artificial Sequence
  Synthetic oligonucleotide; CTTGGCTT chr2 60517295 60517314 60517298 -
atggtgtgcccagggaatag

SEQ ID NO: 192085 - DNA, 20 bp, Artificial Sequence
  Synthetic oligonucleotide; TTATGCTT chr2 60517102 60517121 60517105 -
ttttgtctaccttcgatccc

SEQ ID NO: 192086 - DNA, 20 bp, Artificial Sequence
  Synthetic oligonucleotide; ACCAGCTT chr2 60517044 60517063 60517047 -
agacgacaaagtatctcatc

SEQ ID NO: 192087 - DNA, 20 bp, Artificial Sequence
  Synthetic oligonucleotide; AAATGCTT chr2 60517029 60517048 60517032 -
tcatcaccagctttgggctg

SEQ ID NO: 192088 - DNA, 20 bp, Artificial Sequence
  Synthetic oligonucleotide; TATTGTTT chr2 60516922 60516941 60516925 -
ctattatcttgtaacccatt

SEQ ID NO: 192089 - DNA, 20 bp, Artificial Sequence
  Synthetic oligonucleotide; GCTGGTTT chr2 60516893 60516912 60516896 -
tatgcctctctttagaatct

SEQ ID NO: 192090 - DNA, 20 bp, Artificial Sequence
  Synthetic oligonucleotide; TAGTGTTT chr2 60516826 60516845 60516829 -
agtccaatggcaagatatct

SEQ ID NO: 192091 - DNA, 20 bp, Artificial Sequence
  Synthetic oligonucleotide; TCCTGCTT chr2 60516783 60516802 60516786 -
cttatgtctgcactcttatg

SEQ ID NO: 192092 - DNA, 20 bp, Artificial Sequence
  Synthetic oligonucleotide; GCTTGCTT chr2 60516779 60516798 60516782 -
tgtctgcactcttatgtcct

SEQ ID NO: 192093 - DNA, 20 bp, Artificial Sequence
  Synthetic oligonucleotide; CAGTGCTT chr2 60516761 60516780 60516764 -
ctgcttgcttttttaaaaac

SEQ ID NO: 192094 - DNA, 20 bp, Artificial Sequence
  Synthetic oligonucleotide; CTCAGCTT chr2 60516738 60516757 60516741 -
tgcttcattgatgactcatg

SEQ ID NO: 192095 - DNA, 20 bp, Artificial Sequence
  Synthetic oligonucleotide; TTGAGCTT chr2 60516608 60516627 60516611 -
cctctctgtccttgtccata

SEQ ID NO: 192096 - DNA, 20 bp, Artificial Sequence
  Synthetic oligonucleotide; AAAGGTTT chr2 60516372 60516391 60516375 -
tgcactgacatctggagaac

SEQ ID NO: 192097 - DNA, 20 bp, Artificial Sequence
  Synthetic oligonucleotide; CCCAGATT chr2 60516351 60516370 60516354 -
aaggttttggaagagcggag

SEQ ID NO: 192098 - DNA, 20 bp, Artificial Sequence
  Synthetic oligonucleotide; TTGAGTTT chr2 60516314 60516333 60516317 -
ccagcagagccaagtctttt

SEQ ID NO: 192099 - DNA, 20 bp, Artificial Sequence
  Synthetic oligonucleotide; CTGTGTTT chr2 60516296 60516315 60516299 -
ttttgagtttccagcaaaac

SEQ ID NO: 192100 - DNA, 20 bp, Artificial Sequence
  Synthetic oligonucleotide; TTGTGTTT chr2 60516269 60516288 60516272 -
ttaataataggagtgggtca

SEQ ID NO: 192101 - DNA, 20 bp, Artificial Sequence
  Synthetic oligonucleotide; ACAGGCTT chr2 60516110 60516129 60516113 -
caaagctggcatgagtcatc

SEQ ID NO: 192102 - DNA, 20 bp, Artificial Sequence
  Synthetic oligonucleotide; GCTAGATT chr2 60516091 60516110 60516094 -
cacaggcttatggccacaag

SEQ ID NO: 192103 - DNA, 20 bp, Artificial Sequence
  Synthetic oligonucleotide; CCCTGCTT chr2 60516077 60516096 60516080 -
cacaaggctagattttcaat

SEQ ID NO: 192104 - DNA, 20 bp, Artificial Sequence
  Synthetic oligonucleotide; CTGTGTTT chr2 60515684 60515703 60515687 -
ccctgcctgaaagcactggg

SEQ ID NO: 192105 - DNA, 20 bp, Artificial Sequence
  Synthetic oligonucleotide; GAGGGCTT chr2 60515643 60515662 60515646 -
gggtcccacagatatttatg

SEQ ID NO: 192106 - DNA, 20 bp, Artificial Sequence
  Synthetic oligonucleotide; GCTTGTTT chr2 60515639 60515658 60515642 -
cccacagatatttatggagg

SEQ ID NO: 192107 - DNA, 20 bp, Artificial Sequence
  Synthetic oligonucleotide; CTTGGCTT chr2 60515554 60515573 60515557 -
aggcctgactctgtcagcaa

SEQ ID NO: 192108 - DNA, 20 bp, Artificial Sequence
  Synthetic oligonucleotide; CTGGGATT chr2 60515526 60515545 60515529 -
tctttggaggaggtgtcact

SEQ ID NO: 192109 - DNA, 20 bp, Artificial Sequence
  Synthetic oligonucleotide; TCATGTTT chr2 60515434 60515453 60515437 -
aaccttttggagggcaggag

SEQ ID NO: 192110 - DNA, 20 bp, Artificial Sequence
  Synthetic oligonucleotide; CGCTGCTT chr2 60515355 60515374 60515358 -
tttaatctgtactttgctca

SEQ ID NO: 192111 - DNA, 20 bp, Artificial Sequence
  Synthetic oligonucleotide; GCTTGATT chr2 60515351 60515370 60515354 -
atctgtactttgctcacgct

SEQ ID NO: 192112 - DNA, 20 bp, Artificial Sequence
  Synthetic oligonucleotide; CCGGGCTT chr2 60515330 60515349 60515333 -
cttgattgaacagagaaaga

SEQ ID NO: 192113 - DNA, 20 bp, Artificial Sequence
  Synthetic oligonucleotide; GCAAGTTT chr2 60515278 60515297 60515281 -
cagggaaggtgtgaggctgg

SEQ ID NO: 192114 - DNA, 20 bp, Artificial Sequence
  Synthetic oligonucleotide; TGTGGCTT chr2 60515198 60515217 60515201 -
gggatagctggtggtgtctt

SEQ ID NO: 192115 - DNA, 20 bp, Artificial Sequence
  Synthetic oligonucleotide; CTCTGCTT chr2 60515167 60515186 60515170 -
ccccatggtcaagcagtgaa

SEQ ID NO: 192116 - DNA, 20 bp, Artificial Sequence
  Synthetic oligonucleotide; TGCAGATT chr2 60515160 60515179 60515163 -
gtcaagcagtgaactctgct

SEQ ID NO: 192117 - DNA, 20 bp, Artificial Sequence
  Synthetic oligonucleotide; GCCTGCTT chr2 60514969 60514988 60514972 -
tgagttcggaagggactggg

SEQ ID NO: 192118 - DNA, 20 bp, Artificial Sequence
  Synthetic oligonucleotide; GGTGGCTT chr2 60514954 60514973 60514957 -
ctggggcctgctttcctttg

SEQ ID NO: 192119 - DNA, 20 bp, Artificial Sequence
  Synthetic oligonucleotide; ATGAGTTT chr2 60514932 60514951 60514935 -
tggctttgactggctcttgg

SEQ ID NO: 192120 - DNA, 20 bp, Artificial Sequence
  Synthetic oligonucleotide; AGGTGATT chr2 60514921 60514940 60514924 -
ggctcttggatgagtttaaa

SEQ ID NO: 192121 - DNA, 20 bp, Artificial Sequence
  Synthetic oligonucleotide; TTCTGTTT chr2 60514869 60514888 60514872 -
tctttttttttttttctttt

SEQ ID NO: 192122 - DNA, 20 bp, Artificial Sequence
  Synthetic oligonucleotide; ACTAGATT chr2 60514742 60514761 60514745 -
ttgtaaagacagtcagacca

SEQ ID NO: 192123 - DNA, 20 bp, Artificial Sequence
  Synthetic oligonucleotide; CTCTGATT chr2 60514723 60514742 60514726 -
aactagatttatttgcacaa

SEQ ID NO: 192124 - DNA, 20 bp, Artificial Sequence
  Synthetic oligonucleotide; AAGTGATT chr2 60514587 60514606 60514590 -
agcctccgcctcccaggttc

SEQ ID NO: 192125 - DNA, 20 bp, Artificial Sequence
  Synthetic oligonucleotide; CTGGGATT chr2 60514555 60514574 60514558 -
tgcctcagcctcccaagtag

SEQ ID NO: 192126 - DNA, 20 bp, Artificial Sequence
  Synthetic oligonucleotide; GGCTGATT chr2 60514525 60514544 60514528 -
aggtgcatgccatcacacct

SEQ ID NO: 192127 - DNA, 20 bp, Artificial Sequence
  Synthetic oligonucleotide; TGGGGTTT chr2 60514487 60514506 60514490 -
tttttttttttaagtagaga

SEQ ID NO: 192128 - DNA, 20 bp, Artificial Sequence
  Synthetic oligonucleotide; CTGAGATT chr2 60514409 60514428 60514412 -
cgcctcggcctcccaaaatg

SEQ ID NO: 192129 - DNA, 20 bp, Artificial Sequence
  Synthetic oligonucleotide; GATGGCTT chr2 60514358 60514377 60514361 -
gctatttaattctattttca

SEQ ID NO: 192130 - DNA, 20 bp, Artificial Sequence
  Synthetic oligonucleotide; CTGGGCTT chr2 60514232 60514251 60514235 -
ctagttcagttgtggccctt

SEQ ID NO: 192131 - DNA, 20 bp, Artificial Sequence
  Synthetic oligonucleotide; ACCAGTTT chr2 60514216 60514235 60514219 -
ccttctgggcttcctttgct

SEQ ID NO: 192132 - DNA, 20 bp, Artificial Sequence
  Synthetic oligonucleotide; GAGTGCTT chr2 60514141 60514160 60514144 -
cagcctggaagcctctcaga

SEQ ID NO: 192133 - DNA, 20 bp, Artificial Sequence
  Synthetic oligonucleotide; TGAGGATT chr2 60514001 60514020 60514004 -
ccctcaagtctgtccttctc

SEQ ID NO: 192134 - DNA, 20 bp, Artificial Sequence
  Synthetic oligonucleotide; GGGAGTTT chr2 60513930 60513949 60513933 -
ccaggtctcgactcaatcca

SEQ ID NO: 192135 - DNA, 20 bp, Artificial Sequence
  Synthetic oligonucleotide; AACAGCTT chr2 60513904 60513923 60513907 -
tttgctcaccacaagccagg

SEQ ID NO: 192136 - DNA, 20 bp, Artificial Sequence
  Synthetic oligonucleotide; TCTGGCTT chr2 60513859 60513878 60513862 -
tgtctggaaggcagagaatc

SEQ ID NO: 192137 - DNA, 20 bp, Artificial Sequence
  Synthetic oligonucleotide; TTGGGTTT chr2 60513667 60513686 60513670 -
tcagggatgagtccgtgctg

SEQ ID NO: 192138 - DNA, 20 bp, Artificial Sequence
  Synthetic oligonucleotide; GATGGATT chr2 60513630 60513649 60513633 -
ctttagcgtgtgagtgggga

SEQ ID NO: 192139 - DNA, 20 bp, Artificial Sequence
  Synthetic oligonucleotide; GGAAGATT chr2 60513598 60513617 60513601 -
agcaggcccttggaagggtg

SEQ ID NO: 192140 - DNA, 20 bp, Artificial Sequence
  Synthetic oligonucleotide; TGAAGATT chr2 60513549 60513568 60513552 -
gggaagatccagacaggaca

SEQ ID NO: 192141 - DNA, 20 bp, Artificial Sequence
  Synthetic oligonucleotide; GCTGGCTT chr2 60513457 60513476 60513460 -
aaaggggttcccatggggtg

SEQ ID NO: 192142 - DNA, 20 bp, Artificial Sequence
  Synthetic oligonucleotide; GCTGGTTT chr2 60513435 60513454 60513438 -
tggcttgaggggatctgggc

SEQ ID NO: 192143 - DNA, 20 bp, Artificial Sequence
  Synthetic oligonucleotide; CATGGATT chr2 60513129 60513148 60513132 -
ccctcacaggctagactatc

SEQ ID NO: 192144 - DNA, 20 bp, Artificial Sequence
  Synthetic oligonucleotide; TTGGGTTT chr2 60512880 60512899 60512883 -
catgtgggtgggcaaagtgg

SEQ ID NO: 192145 - DNA, 20 bp, Artificial Sequence
  Synthetic oligonucleotide; ACCTGCTT chr2 60512840 60512859 60512843 -
taggtgtgtattgtagtaaa

SEQ ID NO: 192146 - DNA, 20 bp, Artificial Sequence
  Synthetic oligonucleotide; GCCAGATT chr2 60512751 60512770 60512754 -
ttcataaggctgtgaacgtc

SEQ ID NO: 192147 - DNA, 20 bp, Artificial Sequence
  Synthetic oligonucleotide; GGGGGCTT chr2 60512657 60512676 60512660 -
atatgcaaaatggagttgct

SEQ ID NO: 192148 - DNA, 20 bp, Artificial Sequence
  Synthetic oligonucleotide; TTCAGTTT chr2 60512651 60512670 60512654 -
aaaatggagttgctgggggc

SEQ ID NO: 192149 - DNA, 20 bp, Artificial Sequence
  Synthetic oligonucleotide; ATTGGATT chr2 60512572 60512591 60512575 -
ctcactttttacaatttagc

SEQ ID NO: 192150 - DNA, 20 bp, Artificial Sequence
  Synthetic oligonucleotide; GAATGATT chr2 60512300 60512319 60512303 -
gctcagccacaagcccaaat

SEQ ID NO: 192151 - DNA, 20 bp, Artificial Sequence
  Synthetic oligonucleotide; GGTGGCTT chr2 60512226 60512245 60512229 -
cagtgacaggtggggctcta

SEQ ID NO: 192152 - DNA, 20 bp, Artificial Sequence
  Synthetic oligonucleotide; GCAGGCTT chr2 60512197 60512216 60512200 -
ctttaaaacatctgaggaaa

SEQ ID NO: 192153 - DNA, 20 bp, Artificial Sequence
  Synthetic oligonucleotide; AGTTGTTT chr2 60512109 60512128 60512112 -
cagtgctccttagccttcca

SEQ ID NO: 192154 - DNA, 20 bp, Artificial Sequence
  Synthetic oligonucleotide; TACTGATT chr2 60511882 60511901 60511885 -
gaggaagcacctcatcattt

SEQ ID NO: 192155 - DNA, 20 bp, Artificial Sequence
  Synthetic oligonucleotide; GAAAGCTT chr2 60511820 60511839 60511823 -
cttcatagaaacagagtgtt

SEQ ID NO: 192156 - DNA, 20 bp, Artificial Sequence
  Synthetic oligonucleotide; AGCTGCTT chr2 60511766 60511785 60511769 -
ccttagtgtcttacatgact

SEQ ID NO: 192157 - DNA, 20 bp, Artificial Sequence
  Synthetic oligonucleotide; TGTGGCTT chr2 60511718 60511737 60511721 -
acttatttcaacttattttc

SEQ ID NO: 192158 - DNA, 20 bp, Artificial Sequence
  Synthetic oligonucleotide; TGATGATT chr2 60511691 60511710 60511694 -
tggaaaatacgttgactgag

SEQ ID NO: 192159 - DNA, 20 bp, Artificial Sequence
  Synthetic oligonucleotide; GATTGTTT chr2 60511687 60511706 60511690 -
aaatacgttgactgagtgat

SEQ ID NO: 192160 - DNA, 20 bp, Artificial Sequence
  Synthetic oligonucleotide; TTCAGTTT chr2 60511604 60511623 60511607 -
agagtgtagctctttgagtc

SEQ ID NO: 192161 - DNA, 20 bp, Artificial Sequence
  Synthetic oligonucleotide; ATCAGATT chr2 60511593 60511612 60511596 -
ctttgagtcttcagttttga

SEQ ID NO: 192162 - DNA, 20 bp, Artificial Sequence
  Synthetic oligonucleotide; AAGTGTTT chr2 60511444 60511463 60511447 -
tctgcatgaatagcatcttt

SEQ ID NO: 192163 - DNA, 20 bp, Artificial Sequence
  Synthetic oligonucleotide; TTTAGCTT chr2 60511289 60511308 60511292 -
gctagggtgggaaagggtat

SEQ ID NO: 192164 - DNA, 20 bp, Artificial Sequence
  Synthetic oligonucleotide; AAGGGATT chr2 60511252 60511271 60511255 -
catcccgggctctcaggtag

SEQ ID NO: 192165 - DNA, 20 bp, Artificial Sequence
  Synthetic oligonucleotide; CTGGGATT chr2 60511137 60511156 60511140 -
gagtaatgccgtggaggcag

SEQ ID NO: 192166 - DNA, 20 bp, Artificial Sequence
  Synthetic oligonucleotide; TTTCGTTT chr2 60510949 60510968 60510952 -
acctaagccttaggaaagac

SEQ ID NO: 192167 - DNA, 20 bp, Artificial Sequence
  Synthetic oligonucleotide; TTTGGTTT chr2 60510944 60510963 60510947 -
agccttaggaaagactttcg

SEQ ID NO: 192168 - DNA, 20 bp, Artificial Sequence
  Synthetic oligonucleotide; GACAGTTT chr2 60510777 60510796 60510780 -
gcccccaggttgggctgcct

SEQ ID NO: 192169 - DNA, 20 bp, Artificial Sequence
  Synthetic oligonucleotide; GGCAGTTT chr2 60510742 60510761 60510745 -
atggcattgagtggcctcct

SEQ ID NO: 192170 - DNA, 20 bp, Artificial Sequence
  Synthetic oligonucleotide; CCAGGCTT chr2 60510487 60510506 60510490 -
gggtaaggggtgcatggtga

SEQ ID NO: 192171 - DNA, 20 bp, Artificial Sequence
  Synthetic oligonucleotide; CAGGGATT chr2 60510247 60510266 60510250 -
gctccttgaaggacgtagag

SEQ ID NO: 192172 - DNA, 20 bp, Artificial Sequence
  Synthetic oligonucleotide; TTGCGCTT chr2 60510184 60510203 60510187 -
gaggagtgatgtcatatgac

SEQ ID NO: 192173 - DNA, 20 bp, Artificial Sequence
  Synthetic oligonucleotide; GCTGGATT chr2 60510052 60510071 60510055 -
tggtggggacgtgagaaggg

SEQ ID NO: 192174 - DNA, 20 bp, Artificial Sequence
  Synthetic oligonucleotide; GCAGGATT chr2 60510018 60510037 60510021 -
atacttcgaagggaaaaccg

SEQ ID NO: 192175 - DNA, 20 bp, Artificial Sequence
  Synthetic oligonucleotide; TGCTGTTT chr2 60509921 60509940 60509924 -
ggtgactgggagaatagaat

SEQ ID NO: 192176 - DNA, 20 bp, Artificial Sequence
  Synthetic oligonucleotide; CCCCGATT chr2 60509778 60509797 60509781 -
tgaggggaaagagagtagcc

SEQ ID NO: 192177 - DNA, 20 bp, Artificial Sequence
  Synthetic oligonucleotide; AGATGATT chr2 60509731 60509750 60509734 -
cagttgactgcctatagctg

SEQ ID NO: 192178 - DNA, 20 bp, Artificial Sequence
  Synthetic oligonucleotide; AGGTGTTT chr2 60509698 60509717 60509701 -
cgagttctttggggagggcc

SEQ ID NO: 192179 - DNA, 20 bp, Artificial Sequence
  Synthetic oligonucleotide; ATGCGCTT chr2 60509604 60509623 60509607 -
tgatcttttgatccagaaag

SEQ ID NO: 192180 - DNA, 20 bp, Artificial Sequence
  Synthetic oligonucleotide; CTTTGTTT chr2 60509599 60509618 60509602 -
ttttgatccagaaagatgcg

SEQ ID NO: 192181 - DNA, 20 bp, Artificial Sequence
  Synthetic oligonucleotide; CTTCGTTT chr2 60509576 60509595 60509579 -
tgtttcttgcatttctttcc

SEQ ID NO: 192182 - DNA, 20 bp, Artificial Sequence
  Synthetic oligonucleotide; GTTTGTTT chr2 60509572 60509591 60509575 -
tcttgcatttctttcccttc

SEQ ID NO: 192183 - DNA, 20 bp, Artificial Sequence
  Synthetic oligonucleotide; TTGTGCTT chr2 60509455 60509474 60509458 -
gactctcactgccacgtgtc

SEQ ID NO: 192184 - DNA, 20 bp, Artificial Sequence
  Synthetic oligonucleotide; AACCGTTT chr2 60509441 60509460 60509444 -
cgtgtcttgtgcttccacag

SEQ ID NO: 192185 - DNA, 20 bp, Artificial Sequence
  Synthetic oligonucleotide; CCTGGCTT chr2 60509386 60509405 60509389 -
gctcaggtccacggttagcc

SEQ ID NO: 192186 - DNA, 20 bp, Artificial Sequence
  Synthetic oligonucleotide; AATTGCTT chr2 60509146 60509165 60509149 -
gcaagggcctgaatcaaaca

SEQ ID NO: 192187 - DNA, 20 bp, Artificial Sequence
  Synthetic oligonucleotide; TCTTGTTT chr2 60509138 60509157 60509141 -
ctgaatcaaacaaattgctt

SEQ ID NO: 192188 - DNA, 20 bp, Artificial Sequence
  Synthetic oligonucleotide; CTCAGCTT chr2 60509130 60509149 60509133 -
aacaaattgctttcttgttt

SEQ ID NO: 192189 - DNA, 20 bp, Artificial Sequence
  Synthetic oligonucleotide; CTGTGATT chr2 60509103 60509122 60509106 -
tgaatctttagaccagaagc

SEQ ID NO: 192190 - DNA, 20 bp, Artificial Sequence
  Synthetic oligonucleotide; CAGTGTTT chr2 60509070 60509089 60509073 -
gtctgatgagaaataagagt

SEQ ID NO: 192191 - DNA, 20 bp, Artificial Sequence
  Synthetic oligonucleotide; CTAGGCTT chr2 60509029 60509048 60509032 -
ttttctttggaggaggtcct

SEQ ID NO: 192192 - DNA, 20 bp, Artificial Sequence
  Synthetic oligonucleotide; TCAGGATT chr2 60508964 60508983 60508967 -
ataggagagctccttggtcc

SEQ ID NO: 192193 - DNA, 20 bp, Artificial Sequence
  Synthetic oligonucleotide; GTAAGTTT chr2 60508924 60508943 60508927 -
taagtagcagtgggtagggc

SEQ ID NO: 192194 - DNA, 20 bp, Artificial Sequence
  Synthetic oligonucleotide; TTAGGTTT chr2 60508896 60508915 60508899 -
aacatccctcaaggtaggcc

SEQ ID NO: 192195 - DNA, 20 bp, Artificial Sequence
  Synthetic oligonucleotide; GCTGGCTT chr2 60508868 60508887 60508871 -
ccctctgtcccctctatggt

SEQ ID NO: 192196 - DNA, 20 bp, Artificial Sequence
  Synthetic oligonucleotide; GCCAGCTT chr2 60508700 60508719 60508703 -
cacggcccctgtagctgagc

SEQ ID NO: 192197 - DNA, 20 bp, Artificial Sequence
  Synthetic oligonucleotide; GGCTGTTT chr2 60508674 60508693 60508677 -
ttcttcctgggccaagctga

SEQ ID NO: 192198 - DNA, 20 bp, Artificial Sequence
  Synthetic oligonucleotide; CAACGCTT chr2 60508644 60508663 60508647 -
tgccgtgtccattctcctag

SEQ ID NO: 192199 - DNA, 20 bp, Artificial Sequence
  Synthetic oligonucleotide; GCCAGTTT chr2 60508629 60508648 60508632 -
cctagcaacgcttctctttg

SEQ ID NO: 192200 - DNA, 20 bp, Artificial Sequence
  Synthetic oligonucleotide; GTAAGTTT chr2 60508606 60508625 60508609 -
agtttgccatagtacctgag

SEQ ID NO: 192201 - DNA, 20 bp, Artificial Sequence
  Synthetic oligonucleotide; AAATGCTT chr2 60508583 60508602 60508586 -
agttttgtcctttgcctgcc

SEQ ID NO: 192202 - DNA, 20 bp, Artificial Sequence
  Synthetic oligonucleotide; CCCTGTTT chr2 60508429 60508448 60508432 -
tctcgcagcaactggcaacc

SEQ ID NO: 192203 - DNA, 20 bp, Artificial Sequence
  Synthetic oligonucleotide; CAGTGCTT chr2 60508391 60508410 60508394 -
cagactcagggacccggctg

SEQ ID NO: 192204 - DNA, 20 bp, Artificial Sequence
  Synthetic oligonucleotide; GGAAGCTT chr2 60508330 60508349 60508333 -
ggtgtaattctgcacaccca

SEQ ID NO: 192205 - DNA, 20 bp, Artificial Sequence
  Synthetic oligonucleotide; ATGAGTTT chr2 60508270 60508289 60508273 -
gtgtcctgaaccaagtgtgg

SEQ ID NO: 192206 - DNA, 20 bp, Artificial Sequence
  Synthetic oligonucleotide; TTGAGCTT chr2 60508264 60508283 60508267 -
tgaaccaagtgtggatgagt

SEQ ID NO: 192207 - DNA, 20 bp, Artificial Sequence
  Synthetic oligonucleotide; CCTAGTTT chr2 60508253 60508272 60508256 -
tggatgagtttgagcttcct

SEQ ID NO: 192208 - DNA, 20 bp, Artificial Sequence
  Synthetic oligonucleotide; TGTTGTTT chr2 60508219 60508238 60508222 -
gtgtaatttgttgttgttgt

SEQ ID NO: 192209 - DNA, 20 bp, Artificial Sequence
  Synthetic oligonucleotide; TTTTGTTT chr2 60508125 60508144 60508128 -
cttagctgttgctcaactac

SEQ ID NO: 192210 - DNA, 20 bp, Artificial Sequence
  Synthetic oligonucleotide; TCAGGTTT chr2 60508077 60508096 60508080 -
caccatgacatgagagaatt

SEQ ID NO: 192211 - DNA, 20 bp, Artificial Sequence
  Synthetic oligonucleotide; TTGTGATT chr2 60508068 60508087 60508071 -
atgagagaatttcaggttta

SEQ ID NO: 192212 - DNA, 20 bp, Artificial Sequence
  Synthetic oligonucleotide; TTGTGTTT chr2 60508054 60508073 60508057 -
ggtttattgtgatttctttt

SEQ ID NO: 192213 - DNA, 20 bp, Artificial Sequence
  Synthetic oligonucleotide; ATATGATT chr2 60507985 60508004 60507988 -
aggaaccaacaccgaagacc

SEQ ID NO: 192214 - DNA, 20 bp, Artificial Sequence
  Synthetic oligonucleotide; TAAAGCTT chr2 60507976 60507995 60507979 -
caccgaagaccatatgattt

SEQ ID NO: 192215 - DNA, 20 bp, Artificial Sequence
  Synthetic oligonucleotide; TTTTGCTT chr2 60507921 60507940 60507924 -
ttgtgaatttttttttgttc

SEQ ID NO: 192216 - DNA, 20 bp, Artificial Sequence
  Synthetic oligonucleotide; ATTGGATT chr2 60507850 60507869 60507853 -
ctgtcctttgttacaggagc

SEQ ID NO: 192217 - DNA, 20 bp, Artificial Sequence
  Synthetic oligonucleotide; TACAGTTT chr2 60507821 60507840 60507824 -
ctgtgaagacgtgtcctgta

SEQ ID NO: 192218 - DNA, 20 bp, Artificial Sequence
  Synthetic oligonucleotide; AACAGCTT chr2 60507812 60507831 60507815 -
cgtgtcctgtatacagtttc

SEQ ID NO: 192219 - DNA, 20 bp, Artificial Sequence
  Synthetic oligonucleotide; GCTTGTTT chr2 60507808 60507827 60507811 -
tcctgtatacagtttcaaca

SEQ ID NO: 192220 - DNA, 20 bp, Artificial Sequence
  Synthetic oligonucleotide; ACCCGCTT chr2 60507759 60507778 60507762 -
cacccgtcgccccccacccc

SEQ ID NO: 192221 - DNA, 20 bp, Artificial Sequence
  Synthetic oligonucleotide; TGCTGTTT chr2 60507742 60507761 60507745 -
cccacccgctttctgtcttg

SEQ ID NO: 192222 - DNA, 20 bp, Artificial Sequence
  Synthetic oligonucleotide; CAAGGTTT chr2 60507506 60507525 60507509 -
gaaaatgtaaaagcacttca

SEQ ID NO: 192223 - DNA, 20 bp, Artificial Sequence
  Synthetic oligonucleotide; TCTGGCTT chr2 60507491 60507510 60507494 -
cttcacaaggttttaacttt

SEQ ID NO: 192224 - DNA, 20 bp, Artificial Sequence
  Synthetic oligonucleotide; AGCAGCTT chr2 60507476 60507495 60507479 -
acttttctggcttgaacgga

SEQ ID NO: 192225 - DNA, 20 bp, Artificial Sequence
  Synthetic oligonucleotide; GTAGGTTT chr2 60507441 60507460 60507444 -
acaagagcacaatagtcttt

SEQ ID NO: 192226 - DNA, 20 bp, Artificial Sequence
  Synthetic oligonucleotide; CACAGTTT chr2 60507429 60507448 60507432 -
tagtctttgtaggttttgga

SEQ ID NO: 192227 - DNA, 20 bp, Artificial Sequence
  Synthetic oligonucleotide; TCTAGCTT chr2 60507421 60507440 60507424 -
gtaggttttggacacagttt

SEQ ID NO: 192228 - DNA, 20 bp, Artificial Sequence
  Synthetic oligonucleotide; TCTTGCTT chr2 60507199 60507218 60507202 -
cttccttcctttcttccttg

SEQ ID NO: 192229 - DNA, 20 bp, Artificial Sequence
  Synthetic oligonucleotide; TTATGTTT chr2 60507135 60507154 60507138 -
gccctctgtctgttgggata

SEQ ID NO: 192230 - DNA, 20 bp, Artificial Sequence
  Synthetic oligonucleotide; TAGTGCTT chr2 60507121 60507140 60507124 -
gggatattatgtttttttaa

SEQ ID NO: 192231 - DNA, 20 bp, Artificial Sequence
  Synthetic oligonucleotide; GCTTGTTT chr2 60507117 60507136 60507120 -
tattatgtttttttaatagt

SEQ ID NO: 192232 - DNA, 20 bp, Artificial Sequence
  Synthetic oligonucleotide; TACTGTTT chr2 60507038 60507057 60507041 -
aattgagtacatatgtacgt

SEQ ID NO: 192233 - DNA, 20 bp, Artificial Sequence
  Synthetic oligonucleotide; TATAGTTT chr2 60507025 60507044 60507028 -
tgtacgttactgtttatttt

SEQ ID NO: 192234 - DNA, 20 bp, Artificial Sequence
  Synthetic oligonucleotide; ACATGTTT chr2 60506984 60507003 60506987 -
taaacagctcagttacgcca

SEQ ID NO: 192235 - DNA, 20 bp, Artificial Sequence
  Synthetic oligonucleotide; ACATGCTT chr2 60506930 60506949 60506933 -
cagtcagggtgttaaaaggc

SEQ ID NO: 192236 - DNA, 20 bp, Artificial Sequence
  Synthetic oligonucleotide; AATAGTTT chr2 60506919 60506938 60506922 -
ttaaaaggcacatgcttttc

SEQ ID NO: 192237 - DNA, 20 bp, Artificial Sequence
  Synthetic oligonucleotide; GAATGTTT chr2 60506856 60506875 60506859 -
gcaatttaattacattaatt

SEQ ID NO: 192238 - DNA, 20 bp, Artificial Sequence
  Synthetic oligonucleotide; GGTAGTTT chr2 60506839 60506858 60506842 -
attgaatgtttaggcggaaa

SEQ ID NO: 192239 - DNA, 20 bp, Artificial Sequence
  Synthetic oligonucleotide; AGGCGTTT chr2 60506731 60506750 60506734 -
cagaaaaatggatatatatc

SEQ ID NO: 192240 - DNA, 20 bp, Artificial Sequence
  Synthetic oligonucleotide; GGTCGTTT chr2 60506652 60506671 60506655 -
tttaggagactgctgggcac

SEQ ID NO: 192241 - DNA, 20 bp, Artificial Sequence
  Synthetic oligonucleotide; CTGTGTTT chr2 60506583 60506602 60506586 -
tgcacaaaggcacgtgggtg

SEQ ID NO: 192242 - DNA, 20 bp, Artificial Sequence
  Synthetic oligonucleotide; CAGGGCTT chr2 60506567 60506586 60506570 -
ggtgctgtgttttgtatagc

SEQ ID NO: 192243 - DNA, 20 bp, Artificial Sequence
  Synthetic oligonucleotide; TGAAGTTT chr2 60506395 60506414 60506398 -
tggatctgaggaacactgtc

SEQ ID NO: 192244 - DNA, 20 bp, Artificial Sequence
  Synthetic oligonucleotide; AGGGGTTT chr2 60506384 60506403 60506387 -
aacactgtctgaagttttcc

SEQ ID NO: 192245 - DNA, 20 bp, Artificial Sequence
  Synthetic oligonucleotide; CTGTGATT chr2 60506149 60506168 60506152 -
aggtgttctttctgacctct

SEQ ID NO: 192246 - DNA, 20 bp, Artificial Sequence
  Synthetic oligonucleotide; AGGGGATT chr2 60506110 60506129 60506113 -
tgtcaaaggatggctgggaa

SEQ ID NO: 192247 - DNA, 20 bp, Artificial Sequence
  Synthetic oligonucleotide; GAGTGATT chr2 60506074 60506093 60506077 -
tgctaacatcccttgcctat

SEQ ID NO: 192248 - DNA, 20 bp, Artificial Sequence
  Synthetic oligonucleotide; TCTGGTTT chr2 60506048 60506067 60506051 -
ttcactatcttctcgcacca

SEQ ID NO: 192249 - DNA, 20 bp, Artificial Sequence
  Synthetic oligonucleotide; TATTGCTT chr2 60505921 60505940 60505924 -
gacgaaccaggtggggctgc

SEQ ID NO: 192250 - DNA, 20 bp, Artificial Sequence
  Synthetic oligonucleotide; TGCAGATT chr2 60505897 60505916 60505900 -
gcttctgggtatttacggga

SEQ ID NO: 192251 - DNA, 20 bp, Artificial Sequence
  Synthetic oligonucleotide; CGTTGTTT chr2 60505878 60505897 60505881 -
atgcagatttttctgcccac

SEQ ID NO: 192252 - DNA, 20 bp, Artificial Sequence
  Synthetic oligonucleotide; GAGGGATT chr2 60505867 60505886 60505870 -
tctgcccaccgttgttttgg

SEQ ID NO: 192253 - DNA, 20 bp, Artificial Sequence
  Synthetic oligonucleotide; GAATGATT chr2 60505788 60505807 60505791 -
cccatttaagagtcagccac

SEQ ID NO: 192254 - DNA, 20 bp, Artificial Sequence
  Synthetic oligonucleotide; CCCTGCTT chr2 60505713 60505732 60505716 -
acagagtggccagctgtgtc

SEQ ID NO: 192255 - DNA, 20 bp, Artificial Sequence
  Synthetic oligonucleotide; AACAGCTT chr2 60505620 60505639 60505623 -
gagctgtctgtgccctgaac

SEQ ID NO: 192256 - DNA, 20 bp, Artificial Sequence
  Synthetic oligonucleotide; GCTGGTTT chr2 60505534 60505553 60505537 -
ggacaagaaggtaaaagagg

SEQ ID NO: 192257 - DNA, 20 bp, Artificial Sequence
  Synthetic oligonucleotide; ACCCGCTT chr2 60505500 60505519 60505503 -
taagggaaggacaggaaagc

SEQ ID NO: 192258 - DNA, 20 bp, Artificial Sequence
  Synthetic oligonucleotide; CAGTGTTT chr2 60505476 60505495 60505479 -
gcttgttccctgtgtggatg

SEQ ID NO: 192259 - DNA, 20 bp, Artificial Sequence
  Synthetic oligonucleotide; GAGTGATT chr2 60505429 60505448 60505432 -
cactcggctgactacctgat

SEQ ID NO: 192260 - DNA, 20 bp, Artificial Sequence
  Synthetic oligonucleotide; AGCCGTTT chr2 60505285 60505304 60505288 -
gtgccaaaggacacccttga

SEQ ID NO: 192261 - DNA, 20 bp, Artificial Sequence
  Synthetic oligonucleotide; TCTAGCTT chr2 60505244 60505263 60505247 -
ccttcttttctctccgatcc

SEQ ID NO: 192262 - DNA, 20 bp, Artificial Sequence
  Synthetic oligonucleotide; TTTGGCTT chr2 60505235 60505254 60505238 -
ctctccgatcctctagcttt

SEQ ID NO: 192263 - DNA, 20 bp, Artificial Sequence
  Synthetic oligonucleotide; TGAAGCTT chr2 60505066 60505085 60505069 -
gaggcaggagaaagggtagt

SEQ ID NO: 192264 - DNA, 20 bp, Artificial Sequence
  Synthetic oligonucleotide; TAGGGATT chr2 60505010 60505029 60505013 -
atgcagccgcaggggtagac

SEQ ID NO: 192265 - DNA, 20 bp, Artificial Sequence
  Synthetic oligonucleotide; CCACGCTT chr2 60504968 60504987 60504971 -
cttatacttctgggtccacc

SEQ ID NO: 192266 - DNA, 20 bp, Artificial Sequence
  Synthetic oligonucleotide; TGTGGCTT chr2 60504932 60504951 60504935 -
tgcacacagggtagggaagt

SEQ ID NO: 192267 - DNA, 20 bp, Artificial Sequence
  Synthetic oligonucleotide; GGCTGTTT chr2 60504918 60504937 60504921 -
ggaagttgtggcttgcagaa

SEQ ID NO: 192268 - DNA, 20 bp, Artificial Sequence
  Synthetic oligonucleotide; CTCTGTTT chr2 60504897 60504916 60504900 -
gctgtttttttggggggacg

SEQ ID NO: 192269 - DNA, 20 bp, Artificial Sequence
  Synthetic oligonucleotide; AATAGTTT chr2 60504888 60504907 60504891 -
ttggggggacgctctgtttt

SEQ ID NO: 192270 - DNA, 20 bp, Artificial Sequence
  Synthetic oligonucleotide; ATCAGTTT chr2 60504826 60504845 60504829 -
aggggaggcatgtgatagga

SEQ ID NO: 192271 - DNA, 20 bp, Artificial Sequence
  Synthetic oligonucleotide; ACTTGATT chr2 60504753 60504772 60504756 -
cctctctatataatttcaag

SEQ ID NO: 192272 - DNA, 20 bp, Artificial Sequence
  Synthetic oligonucleotide; GAAAGCTT chr2 60504722 60504741 60504725 -
attgtccctaagcaccagta

SEQ ID NO: 192273 - DNA, 20 bp, Artificial Sequence
  Synthetic oligonucleotide; AGAAGCTT chr2 60504712 60504731 60504715 -
agcaccagtagaaagcttga

SEQ ID NO: 192274 - DNA, 20 bp, Artificial Sequence
  Synthetic oligonucleotide; GAGGGCTT chr2 60504632 60504651 60504635 -
tgagagaacgttctgactag

SEQ ID NO: 192275 - DNA, 20 bp, Artificial Sequence
  Synthetic oligonucleotide; GGCTGTTT chr2 60504603 60504622 60504606 -
ggggagacagagacagagtt

SEQ ID NO: 192276 - DNA, 20 bp, Artificial Sequence
  Synthetic oligonucleotide; ATTTGCTT chr2 60504577 60504596 60504580 -
ttcagcagactcattctgct

SEQ ID NO: 192277 - DNA, 20 bp, Artificial Sequence
  Synthetic oligonucleotide; TGGAGATT chr2 60504562 60504581 60504565 -
ctgctatttgctttttgcct

SEQ ID NO: 192278 - DNA, 20 bp, Artificial Sequence
  Synthetic oligonucleotide; TTCTGTTT chr2 60504166 60504185 60504169 -
tgcccggctgagcatctctg

SEQ ID NO: 192279 - DNA, 20 bp, Artificial Sequence
  Synthetic oligonucleotide; GTAGGCTT chr2 60504042 60504061 60504045 -
aatgtgccgctcgaagccat

SEQ ID NO: 192280 - DNA, 20 bp, Artificial Sequence
  Synthetic oligonucleotide; GCAGGCTT chr2 60504031 60504050 60504034 -
cgaagccatgtaggcttcca

SEQ ID NO: 192281 - DNA, 20 bp, Artificial Sequence
  Synthetic oligonucleotide; TGGGGTTT chr2 60504015 60504034 60504018 -
tccagcaggcttctagcaga

SEQ ID NO: 192282 - DNA, 20 bp, Artificial Sequence
  Synthetic oligonucleotide; TCTTGCTT chr2 60503938 60503957 60503941 -
cctcgttcctttcctgcatt

SEQ ID NO: 192283 - DNA, 20 bp, Artificial Sequence
  Synthetic oligonucleotide; GGAGGTTT chr2 60503885 60503904 60503888 -
cagccaataaccaattttca

SEQ ID NO: 192284 - DNA, 20 bp, Artificial Sequence
  Synthetic oligonucleotide; TGCTGTTT chr2 60503863 60503882 60503866 -
aggtttagatgaatgtgaat

SEQ ID NO: 192285 - DNA, 20 bp, Artificial Sequence
  Synthetic oligonucleotide; GTGGGCTT chr2 60503792 60503811 60503795 -
ccagaatattgtcccttgca

SEQ ID NO: 192286 - DNA, 20 bp, Artificial Sequence
  Synthetic oligonucleotide; ATAGGTTT chr2 60503706 60503725 60503709 -
gtcacatttccctggcagct

SEQ ID NO: 192287 - DNA, 20 bp, Artificial Sequence
  Synthetic oligonucleotide; GGGTGTTT chr2 60503673 60503692 60503676 -
agggtgaacaagggccatct

SEQ ID NO: 192288 - DNA, 20 bp, Artificial Sequence
  Synthetic oligonucleotide; GAGGGCTT chr2 60503662 60503681 60503665 -
gggccatctgggtgtttgct

SEQ ID NO: 192289 - DNA, 20 bp, Artificial Sequence
  Synthetic oligonucleotide; CAAGGCTT chr2 60503616 60503635 60503619 -
ctgctgggtgtggaaaccac

SEQ ID NO: 192290 - DNA, 20 bp, Artificial Sequence
  Synthetic oligonucleotide; GGGAGCTT chr2 60503581 60503600 60503584 -
ctgaaagagccactggtatt

SEQ ID NO: 192291 - DNA, 20 bp, Artificial Sequence
  Synthetic oligonucleotide; CCCAGATT chr2 60503537 60503556 60503540 -
tgagcgccacacattatttt

SEQ ID NO: 192292 - DNA, 20 bp, Artificial Sequence
  Synthetic oligonucleotide; AAGGGTTT chr2 60503360 60503379 60503363 -
ctgcggtgggtggcatgggt

SEQ ID NO: 192293 - DNA, 20 bp, Artificial Sequence
  Synthetic oligonucleotide; TCTGGCTT chr2 60503266 60503285 60503269 -
gtctcctggttggaccccat

SEQ ID NO: 192294 - DNA, 20 bp, Artificial Sequence
  Synthetic oligonucleotide; TGTGGCTT chr2 60503201 60503220 60503204 -
gctaacatgatcaagggtga

SEQ ID NO: 192295 - DNA, 20 bp, Artificial Sequence
  Synthetic oligonucleotide; CCAGGTTT chr2 60503170 60503189 60503173 -
catcttgggactaggagtga

SEQ ID NO: 192296 - DNA, 20 bp, Artificial Sequence
  Synthetic oligonucleotide; GTTGGTTT chr2 60503040 60503059 60503043 -
tgtattaagatgacagacac

SEQ ID NO: 192297 - DNA, 20 bp, Artificial Sequence
  Synthetic oligonucleotide; AGGTGTTT chr2 60502979 60502998 60502982 -
ccaggccttaaaagacaagg

SEQ ID NO: 192298 - DNA, 20 bp, Artificial Sequence
  Synthetic oligonucleotide; ACTTGATT chr2 60502864 60502883 60502867 -
gctcattttacccactcgag

SEQ ID NO: 192299 - DNA, 20 bp, Artificial Sequence
  Synthetic oligonucleotide; TAGAGATT chr2 60502852 60502871 60502855 -
cactcgagacttgattctct

SEQ ID NO: 192300 - DNA, 20 bp, Artificial Sequence
  Synthetic oligonucleotide; CATAGTTT chr2 60502826 60502845 60502829 -
ttaagtacctcccctggtca

SEQ ID NO: 192301 - DNA, 20 bp, Artificial Sequence
  Synthetic oligonucleotide; ATTTGTTT chr2 60502733 60502752 60502736 -
gctaccatgatcagaggtaa

SEQ ID NO: 192302 - DNA, 20 bp, Artificial Sequence
  Synthetic oligonucleotide; TGATGATT chr2 60502717 60502736 60502720 -
gtaaatttgtttttctctga

SEQ ID NO: 192303 - DNA, 20 bp, Artificial Sequence
  Synthetic oligonucleotide; AACAGTTT chr2 60502706 60502725 60502709 -
tttctctgatgatgattgaa

SEQ ID NO: 192304 - DNA, 20 bp, Artificial Sequence
  Synthetic oligonucleotide; AAGAGTTT chr2 60502669 60502688 60502672 -
atcaagaacattacaacaca

SEQ ID NO: 192305 - DNA, 20 bp, Artificial Sequence
  Synthetic oligonucleotide; TCTGGTTT chr2 60502662 60502681 60502665 -
acattacaacacaaagagtt

SEQ ID NO: 192306 - DNA, 20 bp, Artificial Sequence
  Synthetic oligonucleotide; ATGGGATT chr2 60502600 60502619 60502603 -
atattttaatattagaaagc

SEQ ID NO: 192307 - DNA, 20 bp, Artificial Sequence
  Synthetic oligonucleotide; CACTGCTT chr2 60502583 60502602 60502586 -
agcatgggattgggtgtgaa

SEQ ID NO: 192308 - DNA, 20 bp, Artificial Sequence
  Synthetic oligonucleotide; TGCAGTTT chr2 60502408 60502427 60502411 -
tgaagaagttattctgtctg

SEQ ID NO: 192309 - DNA, 20 bp, Artificial Sequence
  Synthetic oligonucleotide; GATGGTTT chr2 60502379 60502398 60502382 -
attaggctgagactttttcc

SEQ ID NO: 192310 - DNA, 20 bp, Artificial Sequence
  Synthetic oligonucleotide; TTCCGTTT chr2 60502367 60502386 60502370 -
ctttttccgatggtttattt

SEQ ID NO: 192311 - DNA, 20 bp, Artificial Sequence
  Synthetic oligonucleotide; CACTGTTT chr2 60502314 60502333 60502317 -
ggagggagctgacacgttca

SEQ ID NO: 192312 - DNA, 20 bp, Artificial Sequence
  Synthetic oligonucleotide; TTTTGTTT chr2 60502262 60502281 60502265 -
agcaaatctgctatccatca

SEQ ID NO: 192313 - DNA, 20 bp, Artificial Sequence
  Synthetic oligonucleotide; ACCAGCTT chr2 60502253 60502272 60502256 -
gctatccatcattttgtttc

SEQ ID NO: 192314 - DNA, 20 bp, Artificial Sequence
  Synthetic oligonucleotide; CTCTGATT chr2 60502198 60502217 60502201 -
ctcatttggagggacctgat

SEQ ID NO: 192315 - DNA, 20 bp, Artificial Sequence
  Synthetic oligonucleotide; TGTTGCTT chr2 60502191 60502210 60502194 -
ggagggacctgatctctgat

SEQ ID NO: 192316 - DNA, 20 bp, Artificial Sequence
  Synthetic oligonucleotide; CTCAGTTT chr2 60502112 60502131 60502115 -
ttgttacaacatgcaaacct

SEQ ID NO: 192317 - DNA, 20 bp, Artificial Sequence
  Synthetic oligonucleotide; TACAGCTT chr2 60502087 60502106 60502090 -
ttttccaggacttctggtgg

SEQ ID NO: 192318 - DNA, 20 bp, Artificial Sequence
  Synthetic oligonucleotide; CTGAGATT chr2 60502022 60502041 60502025 -
ctccctgaagctctgttagc

SEQ ID NO: 192319 - DNA, 20 bp, Artificial Sequence
  Synthetic oligonucleotide; GGCTGTTT chr2 60501930 60501949 60501933 -
gtaaaataattagaataaaa

SEQ ID NO: 192320 - DNA, 20 bp, Artificial Sequence
  Synthetic oligonucleotide; TCCTGTTT chr2 60501873 60501892 60501876 -
taacttctcagaatgcatct

SEQ ID NO: 192321 - DNA, 20 bp, Artificial Sequence
  Synthetic oligonucleotide; AAGAGTTT chr2 60501734 60501753 60501737 -
tgggtagatcacctgaggtc

SEQ ID NO: 192322 - DNA, 20 bp, Artificial Sequence
  Synthetic oligonucleotide; AATTGCTT chr2 60501614 60501633 60501617 -
tcaggaggctgagggaggag

SEQ ID NO: 192323 - DNA, 20 bp, Artificial Sequence
  Synthetic oligonucleotide; AAGTGATT chr2 60501414 60501433 60501417 -
aaaccaggtaaagtatttgg

SEQ ID NO: 192324 - DNA, 20 bp, Artificial Sequence
  Synthetic oligonucleotide; CATGGCTT chr2 60501366 60501385 60501369 -
cttcatttcccccaaaggac

SEQ ID NO: 192325 - DNA, 20 bp, Artificial Sequence
  Synthetic oligonucleotide; ACAGGTTT chr2 60501246 60501265 60501249 -
ttgttctggcaagtagcact

SEQ ID NO: 192326 - DNA, 20 bp, Artificial Sequence
  Synthetic oligonucleotide; TAGTGTTT chr2 60501189 60501208 60501192 -
gaatcaaagcagaatgaagg

SEQ ID NO: 192327 - DNA, 20 bp, Artificial Sequence
  Synthetic oligonucleotide; GGATGTTT chr2 60501150 60501169 60501153 -
atataaataagtgcaaaatt

SEQ ID NO: 192328 - DNA, 20 bp, Artificial Sequence
  Synthetic oligonucleotide; TCTTGTTT chr2 60501119 60501138 60501122 -
aacaactttccagaaacagg

SEQ ID NO: 192329 - DNA, 20 bp, Artificial Sequence
  Synthetic oligonucleotide; AAATGCTT chr2 60500978 60500997 60500981 -
aggaggatgcagcgacccag

SEQ ID NO: 192330 - DNA, 20 bp, Artificial Sequence
  Synthetic oligonucleotide; CTAGGCTT chr2 60500956 60500975 60500959 -
atgcttgcaagcccacccag

SEQ ID NO: 192331 - DNA, 20 bp, Artificial Sequence
  Synthetic oligonucleotide; GCTTGCTT chr2 60500952 60500971 60500955 -
ttgcaagcccacccagctag

SEQ ID NO: 192332 - DNA, 20 bp, Artificial Sequence
  Synthetic oligonucleotide; TGAGGCTT chr2 60500860 60500879 60500863 -
cattttaccagtgaagaaac

SEQ ID NO: 192333 - DNA, 20 bp, Artificial Sequence
  Synthetic oligonucleotide; CAAGGCTT chr2 60500741 60500760 60500744 -
tgttcatcttacctatccac

SEQ ID NO: 192334 - DNA, 20 bp, Artificial Sequence
  Synthetic oligonucleotide; CCAGGTTT chr2 60500707 60500726 60500710 -
aggtgccccgactgtgagtt

SEQ ID NO: 192335 - DNA, 20 bp, Artificial Sequence
  Synthetic oligonucleotide; TCTGGTTT chr2 60500574 60500593 60500577 -
gagttgggaagtgtggggtg

SEQ ID NO: 192336 - DNA, 20 bp, Artificial Sequence
  Synthetic oligonucleotide; GGATGATT chr2 60500455 60500474 60500458 -
tctgatgtaagttcctgctg

SEQ ID NO: 192337 - DNA, 20 bp, Artificial Sequence
  Synthetic oligonucleotide; CTGGGCTT chr2 60500279 60500298 60500282 -
gccccctgtcccctccccgc

SEQ ID NO: 192338 - DNA, 20 bp, Artificial Sequence
  Synthetic oligonucleotide; CACAGCTT chr2 60500212 60500231 60500215 -
cacaggtcctgtgctgcccc

SEQ ID NO: 192339 - DNA, 20 bp, Artificial Sequence
  Synthetic oligonucleotide; GCTGGTTT chr2 60500196 60500215 60500199 -
cccccacagctttgcaggct

SEQ ID NO: 192340 - DNA, 20 bp, Artificial Sequence
  Synthetic oligonucleotide; TCCTGCTT chr2 60499909 60499928 60499912 -
ctgctctctccgaatcttag

SEQ ID NO: 192341 - DNA, 20 bp, Artificial Sequence
  Synthetic oligonucleotide; AGCAGCTT chr2 60499894 60499913 60499897 -
cttagtcctgcttgaggtct

SEQ ID NO: 192342 - DNA, 20 bp, Artificial Sequence
  Synthetic oligonucleotide; TGGGGCTT chr2 60499873 60499892 60499876 -
gcagcttccggagctgcaca

SEQ ID NO: 192343 - DNA, 20 bp, Artificial Sequence
  Synthetic oligonucleotide; TGGTGCTT chr2 60499859 60499878 60499862 -
tgcacatggggcttgaggtc

SEQ ID NO: 192344 - DNA, 20 bp, Artificial Sequence
  Synthetic oligonucleotide; TATGGATT chr2 60499852 60499871 60499855 -
ggggcttgaggtctggtgct

SEQ ID NO: 192345 - DNA, 20 bp, Artificial Sequence
  Synthetic oligonucleotide; GGCAGCTT chr2 60499812 60499831 60499815 -
agacagatggcagagtacca

SEQ ID NO: 192346 - DNA, 20 bp, Artificial Sequence
  Synthetic oligonucleotide; AGCTGTTT chr2 60499759 60499778 60499762 -
gtggcccaggtgctgcccag

SEQ ID NO: 192347 - DNA, 20 bp, Artificial Sequence
  Synthetic oligonucleotide; AGCGGTTT chr2 60499725 60499744 60499728 -
agcctctccactcaaggttg

SEQ ID NO: 192348 - DNA, 20 bp, Artificial Sequence
  Synthetic oligonucleotide; GGGAGCTT chr2 60499688 60499707 60499691 -
ctgtccacccctttggtccg

SEQ ID NO: 192349 - DNA, 20 bp, Artificial Sequence
  Synthetic oligonucleotide; AGGAGCTT chr2 60499560 60499579 60499563 -
ttgagaaagtgggacgttga

SEQ ID NO: 192350 - DNA, 20 bp, Artificial Sequence
  Synthetic oligonucleotide; ATGGGCTT chr2 60499347 60499366 60499350 -
tcctgaaggaataaggcacg

SEQ ID NO: 192351 - DNA, 20 bp, Artificial Sequence
  Synthetic oligonucleotide; TTTGGCTT chr2 60499172 60499191 60499175 -
cagatactgttctccagctc

SEQ ID NO: 192352 - DNA, 20 bp, Artificial Sequence
  Synthetic oligonucleotide; ACCTGCTT chr2 60498946 60498965 60498949 -
ccccaccacccaccaccacc

SEQ ID NO: 192353 - DNA, 20 bp, Artificial Sequence
  Synthetic oligonucleotide; CGTAGTTT chr2 60498920 60498939 60498923 -
ttcctgttctattagacaaa

SEQ ID NO: 192354 - DNA, 20 bp, Artificial Sequence
  Synthetic oligonucleotide; CTGAGTTT chr2 60498891 60498910 60498894 -
tggatgagttggacagtcat

SEQ ID NO: 192355 - DNA, 20 bp, Artificial Sequence
  Synthetic oligonucleotide; TCAAGATT chr2 60498881 60498900 60498884 -
ggacagtcatctgagtttga

SEQ ID NO: 192356 - DNA, 20 bp, Artificial Sequence
  Synthetic oligonucleotide; AGAGGCTT chr2 60498819 60498838 60498822 -
catattagtacatccatcag

SEQ ID NO: 192357 - DNA, 20 bp, Artificial Sequence
  Synthetic oligonucleotide; ACTGGTTT chr2 60498730 60498749 60498733 -
ttggacctatagatgacctc

SEQ ID NO: 192358 - DNA, 20 bp, Artificial Sequence
  Synthetic oligonucleotide; GCCTGCTT chr2 60498702 60498721 60498705 -
ctccccttgtcacctcatct

SEQ ID NO: 192359 - DNA, 20 bp, Artificial Sequence
  Synthetic oligonucleotide; CAATGCTT chr2 60498487 60498506 60498490 -
ttcctggtaccaggatgatg

SEQ ID NO: 192360 - DNA, 20 bp, Artificial Sequence
  Synthetic oligonucleotide; GTGTGCTT chr2 60498393 60498412 60498396 -
ccagcctgggtgtgcatctt

SEQ ID NO: 192361 - DNA, 20 bp, Artificial Sequence
  Synthetic oligonucleotide; TCCTGCTT chr2 60498167 60498186 60498170 -
cccgtctacatagaggccct

SEQ ID NO: 192362 - DNA, 20 bp, Artificial Sequence
  Synthetic oligonucleotide; CTTGGATT chr2 60498005 60498024 60498008 -
ctccccacctccatgggcct

SEQ ID NO: 192363 - DNA, 20 bp, Artificial Sequence
  Synthetic oligonucleotide; GGAAGCTT chr2 60497885 60497904 60497888 -
gctcacttccatcctgcaga

SEQ ID NO: 192364 - DNA, 20 bp, Artificial Sequence
  Synthetic oligonucleotide; CTTGGTTT chr2 60497880 60497899 60497883 -
cttccatcctgcagaggaag

SEQ ID NO: 192365 - DNA, 20 bp, Artificial Sequence
  Synthetic oligonucleotide; AGCCGATT chr2 60497561 60497580 60497564 -
cgtaggtagtgactggtaag

SEQ ID NO: 192366 - DNA, 20 bp, Artificial Sequence
  Synthetic oligonucleotide; TTGAGTTT chr2 60497555 60497574 60497558 -
tagtgactggtaagagccga

SEQ ID NO: 192367 - DNA, 20 bp, Artificial Sequence
  Synthetic oligonucleotide; AGCTGATT chr2 60497545 60497564 60497548 -
taagagccgattgagtttct

SEQ ID NO: 192368 - DNA, 20 bp, Artificial Sequence
  Synthetic oligonucleotide; GGCAGTTT chr2 60497479 60497498 60497482 -
ttctaattcaattcaggagc

SEQ ID NO: 192369 - DNA, 20 bp, Artificial Sequence
  Synthetic oligonucleotide; GCTAGTTT chr2 60497420 60497439 60497423 -
cttggcctgctaacctgagg

SEQ ID NO: 192370 - DNA, 20 bp, Artificial Sequence
  Synthetic oligonucleotide; TAGGGATT chr2 60497411 60497430 60497414 -
ctaacctgagggctagtttc

SEQ ID NO: 192371 - DNA, 20 bp, Artificial Sequence
  Synthetic oligonucleotide; GATTGATT chr2 60497407 60497426 60497410 -
cctgagggctagtttctagg

SEQ ID NO: 192372 - DNA, 20 bp, Artificial Sequence
  Synthetic oligonucleotide; ATATGCTT chr2 60497381 60497400 60497384 -
ttaacttaaagacagttcat

SEQ ID NO: 192373 - DNA, 20 bp, Artificial Sequence
  Synthetic oligonucleotide; CGATGCTT chr2 60497315 60497334 60497318 -
tcaaacagagcagttaaagg

SEQ ID NO: 192374 - DNA, 20 bp, Artificial Sequence
  Synthetic oligonucleotide; CTTCGTTT chr2 60497310 60497329 60497313 -
cagagcagttaaaggcgatg

SEQ ID NO: 192375 - DNA, 20 bp, Artificial Sequence
  Synthetic oligonucleotide; AAAAGATT chr2 60497299 60497318 60497302 -
aaggcgatgcttcgttttac

SEQ ID NO: 192376 - DNA, 20 bp, Artificial Sequence
  Synthetic oligonucleotide; GAATGTTT chr2 60497245 60497264 60497248 -
cagtggtattcctttcaatg

SEQ ID NO: 192377 - DNA, 20 bp, Artificial Sequence
  Synthetic oligonucleotide; AAGTGTTT chr2 60497225 60497244 60497228 -
gaatgtttctctagctcatt

SEQ ID NO: 192378 - DNA, 20 bp, Artificial Sequence
  Synthetic oligonucleotide; TCTAGCTT chr2 60497141 60497160 60497144 -
gaaatagctctagctctagc

SEQ ID NO: 192379 - DNA, 20 bp, Artificial Sequence
  Synthetic oligonucleotide; TCTTGCTT chr2 60497040 60497059 60497043 -
cactgggggaggagtagaga

SEQ ID NO: 192380 - DNA, 20 bp, Artificial Sequence
  Synthetic oligonucleotide; GAGAGCTT chr2 60497022 60497041 60497025 -
gatcttgcttccttccatgt

SEQ ID NO: 192381 - DNA, 20 bp, Artificial Sequence
  Synthetic oligonucleotide; TCCAGATT chr2 60496999 60497018 60497002 -
agcttatagtccctttggaa

SEQ ID NO: 192382 - DNA, 20 bp, Artificial Sequence
  Synthetic oligonucleotide; TCCTGCTT chr2 60496909 60496928 60496912 -
actgtccatggggaaatggg

SEQ ID NO: 192383 - DNA, 20 bp, Artificial Sequence
  Synthetic oligonucleotide; TTCAGTTT chr2 60496893 60496912 60496896 -
tgggtcctgctttacaaaaa

SEQ ID NO: 192384 - DNA, 20 bp, Artificial Sequence
  Synthetic oligonucleotide; TGCTGCTT chr2 60496882 60496901 60496885 -
ttacaaaaattcagtttgca

SEQ ID NO: 192385 - DNA, 20 bp, Artificial Sequence
  Synthetic oligonucleotide; GGGAGATT chr2 60496845 60496864 60496848 -
atgactgtgacatccagtga

SEQ ID NO: 192386 - DNA, 20 bp, Artificial Sequence
  Synthetic oligonucleotide; CAGGGCTT chr2 60496703 60496722 60496706 -
tgtaagtaagtctgtgtggt

SEQ ID NO: 192387 - DNA, 20 bp, Artificial Sequence
  Synthetic oligonucleotide; TCCTGCTT chr2 60496511 60496530 60496514 -
atcctcctctcttccctctt

SEQ ID NO: 192388 - DNA, 20 bp, Artificial Sequence
  Synthetic oligonucleotide; AATGGTTT chr2 60496393 60496412 60496396 -
tgctctgtctctgcctggga

SEQ ID NO: 192389 - DNA, 20 bp, Artificial Sequence
  Synthetic oligonucleotide; CATTGCTT chr2 60496226 60496245 60496229 -
gtaaacgtgtattggacttc

SEQ ID NO: 192390 - DNA, 20 bp, Artificial Sequence
  Synthetic oligonucleotide; TCATGATT chr2 60496215 60496234 60496218 -
ttggacttccattgcttaag

SEQ ID NO: 192391 - DNA, 20 bp, Artificial Sequence
  Synthetic oligonucleotide; ATTTGTTT chr2 60496210 60496229 60496213 -
cttccattgcttaagtcatg

SEQ ID NO: 192392 - DNA, 20 bp, Artificial Sequence
  Synthetic oligonucleotide; TCTGGTTT chr2 60496177 60496196 60496180 -
acttccagaactttcccggt

SEQ ID NO: 192393 - DNA, 20 bp, Artificial Sequence
  Synthetic oligonucleotide; CTGGGATT chr2 60496168 60496187 60496171 -
actttcccggttctggtttt

SEQ ID NO: 192394 - DNA, 20 bp, Artificial Sequence
  Synthetic oligonucleotide; CCCTGTTT chr2 60496148 60496167 60496151 -
ctgggatttcatgaacaatt

SEQ ID NO: 192395 - DNA, 20 bp, Artificial Sequence
  Synthetic oligonucleotide; CATTGCTT chr2 60496115 60496134 60496118 -
atccatttcctgcacaggtg

SEQ ID NO: 192396 - DNA, 20 bp, Artificial Sequence
  Synthetic oligonucleotide; TTTGGTTT chr2 60496023 60496042 60496026 -
tgacctctggatcccttctc

SEQ ID NO: 192397 - DNA, 20 bp, Artificial Sequence
  Synthetic oligonucleotide; GTTTGTTT chr2 60496019 60496038 60496022 -
ctctggatcccttctctttg

SEQ ID NO: 192398 - DNA, 20 bp, Artificial Sequence
  Synthetic oligonucleotide; GTATGTTT chr2 60495990 60496009 60495993 -
ttctcttttccagagctgca

SEQ ID NO: 192399 - DNA, 20 bp, Artificial Sequence
  Synthetic oligonucleotide; AGGTGTTT chr2 60495979 60495998 60495982 -
agagctgcagtatgtttctt

SEQ ID NO: 192400 - DNA, 20 bp, Artificial Sequence
  Synthetic oligonucleotide; TACAGTTT chr2 60495888 60495907 60495891 -
caccatttagagcctggaat

SEQ ID NO: 192401 - DNA, 20 bp, Artificial Sequence
  Synthetic oligonucleotide; AAGGGTTT chr2 60495839 60495858 60495842 -
ccccaggctcccatggtggc

SEQ ID NO: 192402 - DNA, 20 bp, Artificial Sequence
  Synthetic oligonucleotide; TACAGTTT chr2 60495780 60495799 60495783 -
tctttgagcaggaaaagaat

SEQ ID NO: 192403 - DNA, 20 bp, Artificial Sequence
  Synthetic oligonucleotide; TGCTGATT chr2 60495749 60495768 60495752 -
aggtaccttttgtgtgtatg

SEQ ID NO: 192404 - DNA, 20 bp, Artificial Sequence
  Synthetic oligonucleotide; ACTAGTTT chr2 60495568 60495587 60495571 -
gtgccccatgggcaaaccag

SEQ ID NO: 192405 - DNA, 20 bp, Artificial Sequence
  Synthetic oligonucleotide; AGCTGATT chr2 60495403 60495422 60495406 -
gtgcataagtaagagcagat

SEQ ID NO: 192406 - DNA, 20 bp, Artificial Sequence
  Synthetic oligonucleotide; AGTTGCTT chr2 60495279 60495298 60495282 -
ctagtctagtgcaagctaac

SEQ ID NO: 192407 - DNA, 20 bp, Artificial Sequence
  Synthetic oligonucleotide; AAGGGTTT chr2 60495254 60495273 60495257 -
cttttatcacaggctccagg

SEQ ID NO: 192408 - DNA, 20 bp, Artificial Sequence
  Synthetic oligonucleotide; CTCTGATT chr2 60495243 60495262 60495246 -
ggctccaggaagggtttggc

SEQ ID NO: 192409 - DNA, 20 bp, Artificial Sequence
  Synthetic oligonucleotide; GGCCGTTT chr2 60495183 60495202 60495186 -
tggcagacctctccatcggt

SEQ ID NO: 192410 - DNA, 20 bp, Artificial Sequence
  Synthetic oligonucleotide; ATTGGATT chr2 60495132 60495151 60495135 -
ggctctcttggtgatggaga

SEQ ID NO: 192411 - DNA, 20 bp, Artificial Sequence
  Synthetic oligonucleotide; TGAAGCTT chr2 60495056 60495075 60495059 -
tcccaaaattgtaaaggagg

SEQ ID NO: 192412 - DNA, 20 bp, Artificial Sequence
  Synthetic oligonucleotide; CTTTGTTT chr2 60494827 60494846 60494830 -
ttggggaaagggcctgataa

SEQ ID NO: 192413 - DNA, 20 bp, Artificial Sequence
  Synthetic oligonucleotide; TCTGGCTT chr2 60494557 60494576 60494560 -
ccagtctgtattgccccaag

SEQ ID NO: 192414 - DNA, 20 bp, Artificial Sequence
  Synthetic oligonucleotide; TGGAGATT chr2 60494542 60494561 60494545 -
ccaagtctggctttgccaat

SEQ ID NO: 192415 - DNA, 20 bp, Artificial Sequence
  Synthetic oligonucleotide; GGCCGTTT chr2 60494477 60494496 60494480 -
tctcatctcactgagctctg

SEQ ID NO: 192416 - DNA, 20 bp, Artificial Sequence
  Synthetic oligonucleotide; ATAAGATT chr2 60494428 60494447 60494431 -
cccatcttggcaaaaattgc

SEQ ID NO: 192417 - DNA, 20 bp, Artificial Sequence
  Synthetic oligonucleotide; CCTTGTTT chr2 60494380 60494399 60494383 -
gagataatttattacaacct

SEQ ID NO: 192418 - DNA, 20 bp, Artificial Sequence
  Synthetic oligonucleotide; CCCAGTTT chr2 60494319 60494338 60494322 -
tgaccaggccatggtcactg

SEQ ID NO: 192419 - DNA, 20 bp, Artificial Sequence
  Synthetic oligonucleotide; TCTTGCTT chr2 60494218 60494237 60494221 -
tcagcatcaccctctctcac

SEQ ID NO: 192420 - DNA, 20 bp, Artificial Sequence
  Synthetic oligonucleotide; TCAGGTTT chr2 60494160 60494179 60494163 -
ccctaggcgtaagaatgtgc

SEQ ID NO: 192421 - DNA, 20 bp, Artificial Sequence
  Synthetic oligonucleotide; TGGGGCTT chr2 60494124 60494143 60494127 -
atgtaggtgtgcctcaccca

SEQ ID NO: 192422 - DNA, 20 bp, Artificial Sequence
  Synthetic oligonucleotide; CTCTGTTT chr2 60494108 60494127 60494111 -
cccatggggcttcactttct

SEQ ID NO: 192423 - DNA, 20 bp, Artificial Sequence
  Synthetic oligonucleotide; TTCTGTTT chr2 60494080 60494099 60494083 -
attgccagtagtggtctctg

SEQ ID NO: 192424 - DNA, 20 bp, Artificial Sequence
  Synthetic oligonucleotide; TTCAGTTT chr2 60494070 60494089 60494073 -
gtggtctctgttctgttttc

SEQ ID NO: 192425 - DNA, 20 bp, Artificial Sequence
  Synthetic oligonucleotide; ATCAGCTT chr2 60493985 60494004 60493988 -
actccccgtaccttccttta

SEQ ID NO: 192426 - DNA, 20 bp, Artificial Sequence
  Synthetic oligonucleotide; TTCTGCTT chr2 60493914 60493933 60493917 -
cctgtctcccccaggggtcc

SEQ ID NO: 192427 - DNA, 20 bp, Artificial Sequence
  Synthetic oligonucleotide; TGAAGCTT chr2 60493817 60493836 60493820 -
ggaatcttaatttcctgcac

SEQ ID NO: 192428 - DNA, 20 bp, Artificial Sequence
  Synthetic oligonucleotide; GCCTGATT chr2 60493587 60493606 60493590 -
cccagagtccaatttatttg

SEQ ID NO: 192429 - DNA, 20 bp, Artificial Sequence
  Synthetic oligonucleotide; GAATGTTT chr2 60493559 60493578 60493562 -
caaatgaatgcccattttaa

SEQ ID NO: 192430 - DNA, 20 bp, Artificial Sequence
  Synthetic oligonucleotide; AGAGGTTT chr2 60493516 60493535 60493519 -
tcatttccttagtgtagtgg

SEQ ID NO: 192431 - DNA, 20 bp, Artificial Sequence
  Synthetic oligonucleotide; TAGGGTTT chr2 60493455 60493474 60493458 -
ccaaacagatagctgggata

SEQ ID NO: 192432 - DNA, 20 bp, Artificial Sequence
  Synthetic oligonucleotide; AGATGTTT chr2 60493336 60493355 60493339 -
ctgtgttctcgaaatgcctt

SEQ ID NO: 192433 - DNA, 20 bp, Artificial Sequence
  Synthetic oligonucleotide; AGGGGATT chr2 60492987 60493006 60492990 -
aggggtcagagggttaggga

SEQ ID NO: 192434 - DNA, 20 bp, Artificial Sequence
  Synthetic oligonucleotide; GGGGGCTT chr2 60492961 60492980 60492964 -
ttgacagcaaaggggcatga

SEQ ID NO: 192435 - DNA, 20 bp, Artificial Sequence
  Synthetic oligonucleotide; TCTTGATT chr2 60492928 60492947 60492931 -
actggtggacgtgttctgta

SEQ ID NO: 192436 - DNA, 20 bp, Artificial Sequence
  Synthetic oligonucleotide; AACTGTTT chr2 60492758 60492777 60492761 -
caagtctgtctgtaaccttt

SEQ ID NO: 192437 - DNA, 20 bp, Artificial Sequence
  Synthetic oligonucleotide; CTGAGATT chr2 60492672 60492691 60492675 -
atgagaatgccctttgtatt

SEQ ID NO: 192438 - DNA, 20 bp, Artificial Sequence
  Synthetic oligonucleotide; ATCTGTTT chr2 60492511 60492530 60492514 -
ggagagagcaaggggaggaa

SEQ ID NO: 192439 - DNA, 20 bp, Artificial Sequence
  Synthetic oligonucleotide; GCAGGCTT chr2 60492490 60492509 60492493 -
tctgttttcctagaattcca

SEQ ID NO: 192440 - DNA, 20 bp, Artificial Sequence
  Synthetic oligonucleotide; CTAAGTTT chr2 60492452 60492471 60492455 -
aaaggggagggagtacccaa

SEQ ID NO: 192441 - DNA, 20 bp, Artificial Sequence
  Synthetic oligonucleotide; TTTTGTTT chr2 60492393 60492412 60492396 -
cattagcccaattagttgtc

SEQ ID NO: 192442 - DNA, 20 bp, Artificial Sequence
  Synthetic oligonucleotide; GTTTGTTT chr2 60492389 60492408 60492392 -
agcccaattagttgtctttt

SEQ ID NO: 192443 - DNA, 20 bp, Artificial Sequence
  Synthetic oligonucleotide; GTTTGTTT chr2 60492385 60492404 60492388 -
caattagttgtcttttgttt

SEQ ID NO: 192444 - DNA, 20 bp, Artificial Sequence
  Synthetic oligonucleotide; GTTTGTTT chr2 60492381 60492400 60492384 -
tagttgtcttttgtttgttt

SEQ ID NO: 192445 - DNA, 20 bp, Artificial Sequence
  Synthetic oligonucleotide; GTTTGTTT chr2 60492377 60492396 60492380 -
tgtcttttgtttgtttgttt

SEQ ID NO: 192446 - DNA, 20 bp, Artificial Sequence
  Synthetic oligonucleotide; TGGAGTTT chr2 60492207 60492226 60492210 -
cctggctaattttgtagaga

SEQ ID NO: 192447 - DNA, 20 bp, Artificial Sequence
  Synthetic oligonucleotide; CTGGGATT chr2 60492129 60492148 60492132 -
tgccttgacctcccaaagtg

SEQ ID NO: 192448 - DNA, 20 bp, Artificial Sequence
  Synthetic oligonucleotide; GAGGGTTT chr2 60492008 60492027 60492011 -
gtgctgaattcctgtaaagt

SEQ ID NO: 192449 - DNA, 20 bp, Artificial Sequence
  Synthetic oligonucleotide; TTTTGTTT chr2 60492002 60492021 60492005 -
aattcctgtaaagtgagggt

SEQ ID NO: 192450 - DNA, 20 bp, Artificial Sequence
  Synthetic oligonucleotide; TCCAGATT chr2 60491974 60491993 60491977 -
ttcctacatccatcttcctc

SEQ ID NO: 192451 - DNA, 20 bp, Artificial Sequence
  Synthetic oligonucleotide; GGCAGATT chr2 60491910 60491929 60491913 -
tatctgaacttcatttattt

SEQ ID NO: 192452 - DNA, 20 bp, Artificial Sequence
  Synthetic oligonucleotide; TATGGATT chr2 60491858 60491877 60491861 -
tatttgggtgctaaggactg

SEQ ID NO: 192453 - DNA, 20 bp, Artificial Sequence
  Synthetic oligonucleotide; GGGTGTTT chr2 60491762 60491781 60491765 -
acacggagtgatgatgccta

SEQ ID NO: 192454 - DNA, 20 bp, Artificial Sequence
  Synthetic oligonucleotide; CGGAGATT chr2 60491668 60491687 60491671 -
tttttctttttttggtgaga

SEQ ID NO: 192455 - DNA, 20 bp, Artificial Sequence
  Synthetic oligonucleotide; CTGAGATT chr2 60491559 60491578 60491562 -
tgcctcagcctcccgagtag

SEQ ID NO: 192456 - DNA, 20 bp, Artificial Sequence
  Synthetic oligonucleotide; CGGGGTTT chr2 60491503 60491522 60491506 -
ttttgtatttttagtagaga

SEQ ID NO: 192457 - DNA, 20 bp, Artificial Sequence
  Synthetic oligonucleotide; CTGGGATT chr2 60491425 60491444 60491428 -
tgccccggcctcccaaagtg

SEQ ID NO: 192458 - DNA, 20 bp, Artificial Sequence
  Synthetic oligonucleotide; CCATGTTT chr2 60491322 60491341 60491325 -
ctgaagggggccaaaagtgt

SEQ ID NO: 192459 - DNA, 20 bp, Artificial Sequence
  Synthetic oligonucleotide; ATACGTTT chr2 60491251 60491270 60491254 -
catttaaaacagcattaaga

SEQ ID NO: 192460 - DNA, 20 bp, Artificial Sequence
  Synthetic oligonucleotide; CTTAGCTT chr2 60491237 60491256 60491240 -
ttaagaatacgtttttagaa

SEQ ID NO: 192461 - DNA, 20 bp, Artificial Sequence
  Synthetic oligonucleotide; TTGGGCTT chr2 60491139 60491158 60491142 -
agagttgcacaaccacgtag

SEQ ID NO: 192462 - DNA, 20 bp, Artificial Sequence
  Synthetic oligonucleotide; GGCTGTTT chr2 60491019 60491038 60491022 -
tcttctccagggtgtggggt

SEQ ID NO: 192463 - DNA, 20 bp, Artificial Sequence
  Synthetic oligonucleotide; ACTTGCTT chr2 60490959 60490978 60490962 -
tagcataacatgttactgca

SEQ ID NO: 192464 - DNA, 20 bp, Artificial Sequence
  Synthetic oligonucleotide; AAATGTTT chr2 60490911 60490930 60490914 -
tcaagtagatatcagaaggg

SEQ ID NO: 192465 - DNA, 20 bp, Artificial Sequence
  Synthetic oligonucleotide; ATGAGATT chr2 60490586 60490605 60490589 -
ttctatgaggttggagaagg

SEQ ID NO: 192466 - DNA, 20 bp, Artificial Sequence
  Synthetic oligonucleotide; GATTGATT chr2 60490582 60490601 60490585 -
atgaggttggagaaggatga

SEQ ID NO: 192467 - DNA, 20 bp, Artificial Sequence
  Synthetic oligonucleotide; GCAGGATT chr2 60490524 60490543 60490527 -
attgaggccttgaagtatga

SEQ ID NO: 192468 - DNA, 20 bp, Artificial Sequence
  Synthetic oligonucleotide; AAGGGATT chr2 60490467 60490486 60490470 -
caggaaggaaatgagaacgg

SEQ ID NO: 192469 - DNA, 20 bp, Artificial Sequence
  Synthetic oligonucleotide; GTTGGATT chr2 60490395 60490414 60490398 -
gactggaatagaaaattgga

SEQ ID NO: 192470 - DNA, 20 bp, Artificial Sequence
  Synthetic oligonucleotide; GATGGCTT chr2 60490372 60490391 60490375 -
ggattgtggagctctggaat

SEQ ID NO: 192471 - DNA, 20 bp, Artificial Sequence
  Synthetic oligonucleotide; TAGGGTTT chr2 60490165 60490184 60490168 -
aggatggagttggttgaccg

SEQ ID NO: 192472 - DNA, 20 bp, Artificial Sequence
  Synthetic oligonucleotide; GACTGTTT chr2 60490089 60490108 60490092 -
ggtctgttactaatatagag

SEQ ID NO: 192473 - DNA, 20 bp, Artificial Sequence
  Synthetic oligonucleotide; GAAAGCTT chr2 60490073 60490092 60490076 -
agaggactgtttaaatcttg

SEQ ID NO: 192474 - DNA, 20 bp, Artificial Sequence
  Synthetic oligonucleotide; TGGTGTTT chr2 60489930 60489949 60489933 -
tgggatactcagggcatgga

SEQ ID NO: 192475 - DNA, 20 bp, Artificial Sequence
  Synthetic oligonucleotide; TCCTGCTT chr2 60489833 60489852 60489836 -
atctctctttaatagtgtcc

SEQ ID NO: 192476 - DNA, 20 bp, Artificial Sequence
  Synthetic oligonucleotide; TTCAGCTT chr2 60489609 60489628 60489612 -
ttcaaatgtcagactttctt

SEQ ID NO: 192477 - DNA, 20 bp, Artificial Sequence
  Synthetic oligonucleotide; AGGTGCTT chr2 60489596 60489615 60489599 -
ctttcttttcagcttccttc

SEQ ID NO: 192478 - DNA, 20 bp, Artificial Sequence
  Synthetic oligonucleotide; ACAAGCTT chr2 60489545 60489564 60489548 -
ttgagataggtgctggtcaa

SEQ ID NO: 192479 - DNA, 20 bp, Artificial Sequence
  Synthetic oligonucleotide; TTTTGTTT chr2 60489539 60489558 60489542 -
taggtgctggtcaaacaagc

SEQ ID NO: 192480 - DNA, 20 bp, Artificial Sequence
  Synthetic oligonucleotide; GGCTGTTT chr2 60489505 60489524 60489508 -
ggtcacttggcacacagtgt

SEQ ID NO: 192481 - DNA, 20 bp, Artificial Sequence
  Synthetic oligonucleotide; GTGTGTTT chr2 60489449 60489468 60489452 -
taatggcacgcagggccgcc

SEQ ID NO: 192482 - DNA, 20 bp, Artificial Sequence
  Synthetic oligonucleotide; AAGGGCTT chr2 60489428 60489447 60489431 -
tgtgtttactgccaagaaat

SEQ ID NO: 192483 - DNA, 20 bp, Artificial Sequence
  Synthetic oligonucleotide; GGTGGCTT chr2 60489409 60489428 60489412 -
taagggcttctaggagactt

SEQ ID NO: 192484 - DNA, 20 bp, Artificial Sequence
  Synthetic oligonucleotide; AGGTGTTT chr2 60489201 60489220 60489204 -
ctcacagtgtgaatttagtt

SEQ ID NO: 192485 - DNA, 20 bp, Artificial Sequence
  Synthetic oligonucleotide; AACAGTTT chr2 60489165 60489184 60489168 -
ttttccccaaactctaaagc

SEQ ID NO: 192486 - DNA, 20 bp, Artificial Sequence
  Synthetic oligonucleotide; ATTTGTTT chr2 60489075 60489094 60489078 -
ttttttttctttgaagataa

SEQ ID NO: 192487 - DNA, 20 bp, Artificial Sequence
  Synthetic oligonucleotide; GGTAGCTT chr2 60489050 60489069 60489053 -
ttttgggtatggctgggtgt

SEQ ID NO: 192488 - DNA, 20 bp, Artificial Sequence
  Synthetic oligonucleotide; GGGAGTTT chr2 60488988 60489007 60488991 -
tgggtggatcacctaaggtc

SEQ ID NO: 192489 - DNA, 20 bp, Artificial Sequence
  Synthetic oligonucleotide; AATCGCTT chr2 60488867 60488886 60488870 -
ttgggaggctgaggcaggag

SEQ ID NO: 192490 - DNA, 20 bp, Artificial Sequence
  Synthetic oligonucleotide; CGGAGATT chr2 60488847 60488866 60488850 -
aatcgcttgaacccgggagg

SEQ ID NO: 192491 - DNA, 20 bp, Artificial Sequence
  Synthetic oligonucleotide; CCGAGATT chr2 60488831 60488850 60488834 -
gaggcggagattgcggtgag

SEQ ID NO: 192492 - DNA, 20 bp, Artificial Sequence
  Synthetic oligonucleotide; AATCGTTT chr2 60488738 60488757 60488741 -
acaaacaaacaaacaaacaa

SEQ ID NO: 192493 - DNA, 20 bp, Artificial Sequence
  Synthetic oligonucleotide; AGTGGCTT chr2 60488722 60488741 60488725 -
acaaaatcgttttgggtagc

SEQ ID NO: 192494 - DNA, 20 bp, Artificial Sequence
  Synthetic oligonucleotide; GGCTGTTT chr2 60488712 60488731 60488715 -
tttgggtagcagtggcttta

SEQ ID NO: 192495 - DNA, 20 bp, Artificial Sequence
  Synthetic oligonucleotide; TACTGATT chr2 60488685 60488704 60488688 -
tttggatctttggctattga

SEQ ID NO: 192496 - DNA, 20 bp, Artificial Sequence
  Synthetic oligonucleotide; GAAAGTTT chr2 60488638 60488657 60488641 -
tttcatgttaagcaaaacta

SEQ ID NO: 192497 - DNA, 20 bp, Artificial Sequence
  Synthetic oligonucleotide; CAGGGTTT chr2 60488561 60488580 60488564 -
caaactatttacagccataa

SEQ ID NO: 192498 - DNA, 20 bp, Artificial Sequence
  Synthetic oligonucleotide; ACTGGATT chr2 60488368 60488387 60488371 -
ttaaatgctgtcaaattgta

SEQ ID NO: 192499 - DNA, 20 bp, Artificial Sequence
  Synthetic oligonucleotide; ACAGGCTT chr2 60488223 60488242 60488226 -
tcatgactcaggtatctttt

SEQ ID NO: 192500 - DNA, 20 bp, Artificial Sequence
  Synthetic oligonucleotide; GTCAGATT chr2 60488205 60488224 60488208 -
ttacaggctttgatgaaata

SEQ ID NO: 192501 - DNA, 20 bp, Artificial Sequence
  Synthetic oligonucleotide; AAATGTTT chr2 60488120 60488139 60488123 -
aaactcttccaggataattt

SEQ ID NO: 192502 - DNA, 20 bp, Artificial Sequence
  Synthetic oligonucleotide; CTGTGTTT chr2 60488082 60488101 60488085 -
agaataaattgtaagtgtta

SEQ ID NO: 192503 - DNA, 20 bp, Artificial Sequence
  Synthetic oligonucleotide; TATTGCTT chr2 60488006 60488025 60488009 -
ttaatatctaattgttcata

SEQ ID NO: 192504 - DNA, 20 bp, Artificial Sequence
  Synthetic oligonucleotide; CCAGGTTT chr2 60487996 60488015 60487999 -
attgttcatatattgcttcc

SEQ ID NO: 192505 - DNA, 20 bp, Artificial Sequence
  Synthetic oligonucleotide; TTGTGTTT chr2 60487895 60487914 60487898 -
ggagttggagtacttgcatt

SEQ ID NO: 192506 - DNA, 20 bp, Artificial Sequence
  Synthetic oligonucleotide; TCCAGATT chr2 60487840 60487859 60487843 -
atatttagaccaaattctta

SEQ ID NO: 192507 - DNA, 20 bp, Artificial Sequence
  Synthetic oligonucleotide; TCCAGTTT chr2 60487810 60487829 60487813 -
ccattaaaggttcataaatt

SEQ ID NO: 192508 - DNA, 20 bp, Artificial Sequence
  Synthetic oligonucleotide; TGCAGCTT chr2 60487793 60487812 60487796 -
atttccagttttcacctttc

SEQ ID NO: 192509 - DNA, 20 bp, Artificial Sequence
  Synthetic oligonucleotide; TCTTGCTT chr2 60487737 60487756 60487740 -
taccgcattaaaattaagcc

SEQ ID NO: 192510 - DNA, 20 bp, Artificial Sequence
  Synthetic oligonucleotide; TTTTGTTT chr2 60487596 60487615 60487599 -
gccttctttttcatgccttt

SEQ ID NO: 192511 - DNA, 20 bp, Artificial Sequence
  Synthetic oligonucleotide; TTTTGTTT chr2 60487591 60487610 60487594 -
ctttttcatgcctttttttg

SEQ ID NO: 192512 - DNA, 20 bp, Artificial Sequence
  Synthetic oligonucleotide; TCTGGATT chr2 60487580 60487599 60487583 -
ctttttttgttttgttttgt

SEQ ID NO: 192513 - DNA, 20 bp, Artificial Sequence
  Synthetic oligonucleotide; TTTAGTTT chr2 60487558 60487577 60487561 -
tggattttataaaggcatca

SEQ ID NO: 192514 - DNA, 20 bp, Artificial Sequence
  Synthetic oligonucleotide; TGTTGATT chr2 60487511 60487530 60487514 -
attcatttttaaatatctaa

SEQ ID NO: 192515 - DNA, 20 bp, Artificial Sequence
  Synthetic oligonucleotide; AGACGATT chr2 60487440 60487459 60487443 -
aagataatctacatttgaga

SEQ ID NO: 192516 - DNA, 20 bp, Artificial Sequence
  Synthetic oligonucleotide; AAGAGCTT chr2 60487276 60487295 60487279 -
gctctgctgacattagcatg

SEQ ID NO: 192517 - DNA, 20 bp, Artificial Sequence
  Synthetic oligonucleotide; GGGAGTTT chr2 60487240 60487259 60487243 -
gacttgcaaaatataggtta

SEQ ID NO: 192518 - DNA, 20 bp, Artificial Sequence
  Synthetic oligonucleotide; CATTGATT chr2 60487204 60487223 60487207 -
atcaaattatcttactcttt

SEQ ID NO: 192519 - DNA, 20 bp, Artificial Sequence
  Synthetic oligonucleotide; CTTCGCTT chr2 60487004 60487023 60487007 -
cttaaaggaggggcatttgc

SEQ ID NO: 192520 - DNA, 20 bp, Artificial Sequence
  Synthetic oligonucleotide; TTCTGATT chr2 60486934 60486953 60486937 -
taaaattaaatattaatttg

SEQ ID NO: 192521 - DNA, 20 bp, Artificial Sequence
  Synthetic oligonucleotide; CCAGGTTT chr2 60486868 60486887 60486871 -
gggcgtgggctgagccatgg

SEQ ID NO: 192522 - DNA, 20 bp, Artificial Sequence
  Synthetic oligonucleotide; GAGTGATT chr2 60486852 60486871 60486855 -
atggccaggtttgagagaca

SEQ ID NO: 192523 - DNA, 20 bp, Artificial Sequence
  Synthetic oligonucleotide; AGAAGTTT chr2 60486708 60486727 60486711 -
gctatcaaggccttcctgag

SEQ ID NO: 192524 - DNA, 20 bp, Artificial Sequence
  Synthetic oligonucleotide; CAAGGCTT chr2 60486545 60486564 60486548 -
tctgtggatagggaaaattt

SEQ ID NO: 192525 - DNA, 20 bp, Artificial Sequence
  Synthetic oligonucleotide; CTTAGATT chr2 60486503 60486522 60486506 -
tagccattttctttcagtat

SEQ ID NO: 192526 - DNA, 20 bp, Artificial Sequence
  Synthetic oligonucleotide; TATAGTTT chr2 60486446 60486465 60486449 -
tgtgtgtgtgtgtgcctaag

SEQ ID NO: 192527 - DNA, 20 bp, Artificial Sequence
  Synthetic oligonucleotide; CTGTGATT chr2 60486297 60486316 60486300 -
ggcaaggtgggccagtagag

SEQ ID NO: 192528 - DNA, 20 bp, Artificial Sequence
  Synthetic oligonucleotide; AACAGCTT chr2 60486124 60486143 60486127 -
aaatccatttcagaatggag

SEQ ID NO: 192529 - DNA, 20 bp, Artificial Sequence
  Synthetic oligonucleotide; AGGGGCTT chr2 60486080 60486099 60486083 -
cttgacctgctgatagaaca

SEQ ID NO: 192530 - DNA, 20 bp, Artificial Sequence
  Synthetic oligonucleotide; TGGAGATT chr2 60486073 60486092 60486076 -
tgctgatagaacaaggggct

SEQ ID NO: 192531 - DNA, 20 bp, Artificial Sequence
  Synthetic oligonucleotide; AAAAGATT chr2 60486029 60486048 60486032 -
atagatccctaaacatacta

SEQ ID NO: 192532 - DNA, 20 bp, Artificial Sequence
  Synthetic oligonucleotide; CTGTGTTT chr2 60485734 60485753 60485737 -
gcattgctggtatttataga

SEQ ID NO: 192533 - DNA, 20 bp, Artificial Sequence
  Synthetic oligonucleotide; CGTTGTTT chr2 60485677 60485696 60485680 -
tctcaccccagaatagcaag

SEQ ID NO: 192534 - DNA, 20 bp, Artificial Sequence
  Synthetic oligonucleotide; GACAGCTT chr2 60485650 60485669 60485653 -
tctcatatctaggttgctgg

SEQ ID NO: 192535 - DNA, 20 bp, Artificial Sequence
  Synthetic oligonucleotide; AGCAGCTT chr2 60485624 60485643 60485627 -
ttcccaggaacctaatattc

SEQ ID NO: 192536 - DNA, 20 bp, Artificial Sequence
  Synthetic oligonucleotide; GAGGGTTT chr2 60485602 60485621 60485605 -
cagcttcgtgacgttggatg

SEQ ID NO: 192537 - DNA, 20 bp, Artificial Sequence
  Synthetic oligonucleotide; AGTTGATT chr2 60485581 60485600 60485584 -
agggtttttctttttaaatg

SEQ ID NO: 192538 - DNA, 20 bp, Artificial Sequence
  Synthetic oligonucleotide; ATTGGCTT chr2 60485576 60485595 60485579 -
ttttctttttaaatgagttg

SEQ ID NO: 192539 - DNA, 20 bp, Artificial Sequence
  Synthetic oligonucleotide; CATTGTTT chr2 60485555 60485574 60485558 -
ttggcttttgccactttaca

SEQ ID NO: 192540 - DNA, 20 bp, Artificial Sequence
  Synthetic oligonucleotide; CTAGGTTT chr2 60485540 60485559 60485543 -
ttacacattgttttccaggt

SEQ ID NO: 192541 - DNA, 20 bp, Artificial Sequence
  Synthetic oligonucleotide; TTCTGTTT chr2 60485475 60485494 60485478 -
gtctgccctggctcacaccg

SEQ ID NO: 192542 - DNA, 20 bp, Artificial Sequence
  Synthetic oligonucleotide; GTTAGCTT chr2 60485462 60485481 60485465 -
cacaccgttctgtttttgca

SEQ ID NO: 192543 - DNA, 20 bp, Artificial Sequence
  Synthetic oligonucleotide; GCCTGTTT chr2 60485157 60485176 60485160 -
gtgacttcaaggaagaaggg

SEQ ID NO: 192544 - DNA, 20 bp, Artificial Sequence
  Synthetic oligonucleotide; AATTGTTT chr2 60485040 60485059 60485043 -
ggtggtggtgagggtgtaca

SEQ ID NO: 192545 - DNA, 20 bp, Artificial Sequence
  Synthetic oligonucleotide; TTTTGATT chr2 60485019 60485038 60485022 -
attgttttttgtatttccta

SEQ ID NO: 192546 - DNA, 20 bp, Artificial Sequence
  Synthetic oligonucleotide; TACTGTTT chr2 60485007 60485026 60485010 -
atttcctattttgatttaaa

SEQ ID NO: 192547 - DNA, 20 bp, Artificial Sequence
  Synthetic oligonucleotide; TTTTGTTT chr2 60485000 60485019 60485003 -
attttgatttaaatactgtt

SEQ ID NO: 192548 - DNA, 20 bp, Artificial Sequence
  Synthetic oligonucleotide; GTTGGTTT chr2 60484987 60485006 60484990 -
tactgttttttgtttggttg

SEQ ID NO: 192549 - DNA, 20 bp, Artificial Sequence
  Synthetic oligonucleotide; AGAGGATT chr2 60484944 60484963 60484947 -
aagtcctaaacaagtgccac

SEQ ID NO: 192550 - DNA, 20 bp, Artificial Sequence
  Synthetic oligonucleotide; TTTGGCTT chr2 60484932 60484951 60484935 -
agtgccacagaggatttctt

SEQ ID NO: 192551 - DNA, 20 bp, Artificial Sequence
  Synthetic oligonucleotide; ACAAGTTT chr2 60484901 60484920 60484904 -
cttgataaaatttggagcac

SEQ ID NO: 192552 - DNA, 20 bp, Artificial Sequence
  Synthetic oligonucleotide; TGAGGTTT chr2 60484793 60484812 60484796 -
aagtgagaattcccataatt

SEQ ID NO: 192553 - DNA, 20 bp, Artificial Sequence
  Synthetic oligonucleotide; GAGAGTTT chr2 60484554 60484573 60484557 -
tatttaaaaggcagggaggg

SEQ ID NO: 192554 - DNA, 20 bp, Artificial Sequence
  Synthetic oligonucleotide; TGCTGTTT chr2 60484531 60484550 60484534 -
agtttctgttccacaatcac

SEQ ID NO: 192555 - DNA, 20 bp, Artificial Sequence
  Synthetic oligonucleotide; CCCGGTTT chr2 60484510 60484529 60484513 -
gctgtttcagtgaaaagcaa

SEQ ID NO: 192556 - DNA, 20 bp, Artificial Sequence
  Synthetic oligonucleotide; GGCTGTTT chr2 60484468 60484487 60484471 -
cttccctttctggtgaatgt

SEQ ID NO: 192557 - DNA, 20 bp, Artificial Sequence
  Synthetic oligonucleotide; TGCAGATT chr2 60484286 60484305 60484289 -
tattttcagctgaatgtgag

SEQ ID NO: 192558 - DNA, 20 bp, Artificial Sequence
  Synthetic oligonucleotide; TCAGGCTT chr2 60484275 60484294 60484278 -
gaatgtgagtgcagatttca

SEQ ID NO: 192559 - DNA, 20 bp, Artificial Sequence
  Synthetic oligonucleotide; GAGGGCTT chr2 60484072 60484091 60484075 -
cctgcatttgcagaaaatct

SEQ ID NO: 192560 - DNA, 20 bp, Artificial Sequence
  Synthetic oligonucleotide; ACAAGCTT chr2 60483969 60483988 60483972 -
gcagataatcattacatcta

SEQ ID NO: 192561 - DNA, 20 bp, Artificial Sequence
  Synthetic oligonucleotide; TTCTGATT chr2 60483963 60483982 60483966 -
aatcattacatctaacaagc

SEQ ID NO: 192562 - DNA, 20 bp, Artificial Sequence
  Synthetic oligonucleotide; TTCAGTTT chr2 60483918 60483937 60483921 -
gaccaactcatttataatgg

SEQ ID NO: 192563 - DNA, 20 bp, Artificial Sequence
  Synthetic oligonucleotide; TAGTGCTT chr2 60483785 60483804 60483788 -
ataaaaagaaatcctccttc

SEQ ID NO: 192564 - DNA, 20 bp, Artificial Sequence
  Synthetic oligonucleotide; GAGTGCTT chr2 60483772 60483791 60483775 -
ctccttctagtgctttgggc

SEQ ID NO: 192565 - DNA, 20 bp, Artificial Sequence
  Synthetic oligonucleotide; TTCTGTTT chr2 60483710 60483729 60483713 -
ctgaagcatccagatacatc

SEQ ID NO: 192566 - DNA, 20 bp, Artificial Sequence
  Synthetic oligonucleotide; TTTAGATT chr2 60483704 60483723 60483707 -
catccagatacatcttctgt

SEQ ID NO: 192567 - DNA, 20 bp, Artificial Sequence
  Synthetic oligonucleotide; TGATGTTT chr2 60483651 60483670 60483654 -
aatatgccagctcattcatt

SEQ ID NO: 192568 - DNA, 20 bp, Artificial Sequence
  Synthetic oligonucleotide; AGTTGATT chr2 60483522 60483541 60483525 -
aaacacatgacatagacagc

SEQ ID NO: 192569 - DNA, 20 bp, Artificial Sequence
  Synthetic oligonucleotide; CATCGATT chr2 60483354 60483373 60483357 -
atttgagtcccaatttgagg

SEQ ID NO: 192570 - DNA, 20 bp, Artificial Sequence
  Synthetic oligonucleotide; AGCTGATT chr2 60483319 60483338 60483322 -
cttttcaaaggcctgaatgg

SEQ ID NO: 192571 - DNA, 20 bp, Artificial Sequence
  Synthetic oligonucleotide; CCCTGATT chr2 60483223 60483242 60483226 -
gaggggaaaacggctgtaaa

SEQ ID NO: 192572 - DNA, 20 bp, Artificial Sequence
  Synthetic oligonucleotide; TGTTGATT chr2 60483159 60483178 60483162 -
agcaacacttctctcgcctg

SEQ ID NO: 192573 - DNA, 20 bp, Artificial Sequence
  Synthetic oligonucleotide; GCCTGATT chr2 60483091 60483110 60483094 -
gaaataatataaatcacact

SEQ ID NO: 192574 - DNA, 20 bp, Artificial Sequence
  Synthetic oligonucleotide; GCAGGTTT chr2 60483045 60483064 60483048 -
aagtaatcatgggctgaagt

SEQ ID NO: 192575 - DNA, 20 bp, Artificial Sequence
  Synthetic oligonucleotide; ATCAGATT chr2 60483014 60483033 60483017 -
tgcagtgcctttatcagtaa

SEQ ID NO: 192576 - DNA, 20 bp, Artificial Sequence
  Synthetic oligonucleotide; TAATGTTT chr2 60482960 60482979 60482963 -
cttaaacatcatcatttctg

SEQ ID NO: 192577 - DNA, 20 bp, Artificial Sequence
  Synthetic oligonucleotide; GAAAGATT chr2 60482948 60482967 60482951 -
catttctgtaatgtttgaaa

SEQ ID NO: 192578 - DNA, 20 bp, Artificial Sequence
  Synthetic oligonucleotide; ATTTGTTT chr2 60482943 60482962 60482946 -
ctgtaatgtttgaaagaaag

SEQ ID NO: 192579 - DNA, 20 bp, Artificial Sequence
  Synthetic oligonucleotide; TCCAGCTT chr2 60482907 60482926 60482910 -
actctgccaatcaatgatct

SEQ ID NO: 192580 - DNA, 20 bp, Artificial Sequence
  Synthetic oligonucleotide; AGATGATT chr2 60482834 60482853 60482837 -
tttaaaatgtcatcagaaag

SEQ ID NO: 192581 - DNA, 20 bp, Artificial Sequence
  Synthetic oligonucleotide; CCCTGTTT chr2 60482704 60482723 60482707 -
actgaagcagcagtcttctg

SEQ ID NO: 192582 - DNA, 20 bp, Artificial Sequence
  Synthetic oligonucleotide; GTGTGCTT chr2 60482666 60482685 60482669 -
gatcttaaccttgggatgca

SEQ ID NO: 192583 - DNA, 20 bp, Artificial Sequence
  Synthetic oligonucleotide; TCTTGCTT chr2 60482524 60482543 60482527 -
ataagcagtccctctattct

SEQ ID NO: 192584 - DNA, 20 bp, Artificial Sequence
  Synthetic oligonucleotide; TGTGGATT chr2 60482514 60482533 60482517 -
cctctattcttcttgcttcc

SEQ ID NO: 192585 - DNA, 20 bp, Artificial Sequence
  Synthetic oligonucleotide; TCCTGATT chr2 60482495 60482514 60482498 -
ctgtggatttaaatgccaaa

SEQ ID NO: 192586 - DNA, 20 bp, Artificial Sequence
  Synthetic oligonucleotide; AACTGTTT chr2 60482408 60482427 60482411 -
gcagtggcagtggaaattac

SEQ ID NO: 192587 - DNA, 20 bp, Artificial Sequence
  Synthetic oligonucleotide; GTGGGTTT chr2 60481934 60481953 60481937 -
gagaaggtctctatacctag

SEQ ID NO: 192588 - DNA, 20 bp, Artificial Sequence
  Synthetic oligonucleotide; TGAGGCTT chr2 60481888 60481907 60481891 -
ccatggggctgtctgtgtgt

SEQ ID NO: 192589 - DNA, 20 bp, Artificial Sequence
  Synthetic oligonucleotide; CACTGTTT chr2 60481609 60481628 60481612 -
ccatggaaatggagaagaaa

SEQ ID NO: 192590 - DNA, 20 bp, Artificial Sequence
  Synthetic oligonucleotide; GCCAGCTT chr2 60481529 60481548 60481532 -
atccctgtcctccttcacct

SEQ ID NO: 192591 - DNA, 20 bp, Artificial Sequence
  Synthetic oligonucleotide; GGTGGCTT chr2 60481513 60481532 60481516 -
acctgccagcttgtgggctg

SEQ ID NO: 192592 - DNA, 20 bp, Artificial Sequence
  Synthetic oligonucleotide; ATGTGCTT chr2 60481461 60481480 60481464 -
tgactcctgagagcatgtgt

SEQ ID NO: 192593 - DNA, 20 bp, Artificial Sequence
  Synthetic oligonucleotide; GAATGTTT chr2 60481359 60481378 60481362 -
gagagaaggccctgggttct

SEQ ID NO: 192594 - DNA, 20 bp, Artificial Sequence
  Synthetic oligonucleotide; CCCTGCTT chr2 60481335 60481354 60481338 -
gtttttacttttcctaggat

SEQ ID NO: 192595 - DNA, 20 bp, Artificial Sequence
  Synthetic oligonucleotide; TTTTGTTT chr2 60481324 60481343 60481327 -
tcctaggatccctgcttcat

SEQ ID NO: 192596 - DNA, 20 bp, Artificial Sequence
  Synthetic oligonucleotide; ACTTGTTT chr2 60481306 60481325 60481309 -
atttttgttttcaaggagtt

SEQ ID NO: 192597 - DNA, 20 bp, Artificial Sequence
  Synthetic oligonucleotide; CTAGGTTT chr2 60481255 60481274 60481258 -
tcccaagcagagatgggtgg

SEQ ID NO: 192598 - DNA, 20 bp, Artificial Sequence
  Synthetic oligonucleotide; CCCAGTTT chr2 60481199 60481218 60481202 -
tatcccattccagggccctt

SEQ ID NO: 192599 - DNA, 20 bp, Artificial Sequence
  Synthetic oligonucleotide; CAGGGCTT chr2 60481157 60481176 60481160 -
ctcaatctccttgagcacag

SEQ ID NO: 192600 - DNA, 20 bp, Artificial Sequence
  Synthetic oligonucleotide; GGGGGCTT chr2 60481028 60481047 60481031 -
tctgaggcagggaggcagct

SEQ ID NO: 192601 - DNA, 20 bp, Artificial Sequence
  Synthetic oligonucleotide; TCTAGCTT chr2 60480992 60481011 60480995 -
cctgtaatgcccctcccagg

SEQ ID NO: 192602 - DNA, 20 bp, Artificial Sequence
  Synthetic oligonucleotide; ATAGGATT chr2 60480922 60480941 60480925 -
ttagaactatgagttcaaaa

SEQ ID NO: 192603 - DNA, 20 bp, Artificial Sequence
  Synthetic oligonucleotide; GGAGGATT chr2 60480830 60480849 60480833 -
atgagaatagaggaaaatgt

SEQ ID NO: 192604 - DNA, 20 bp, Artificial Sequence
  Synthetic oligonucleotide; GAATGATT chr2 60480688 60480707 60480691 -
ttacacagcatttggaaagt

SEQ ID NO: 192605 - DNA, 20 bp, Artificial Sequence
  Synthetic oligonucleotide; ACCTGATT chr2 60480679 60480698 60480682 -
atttggaaagtgaatgatta

SEQ ID NO: 192606 - DNA, 20 bp, Artificial Sequence
  Synthetic oligonucleotide; TACAGATT chr2 60480640 60480659 60480643 -
ccattgagtaaatacactat

SEQ ID NO: 192607 - DNA, 20 bp, Artificial Sequence
  Synthetic oligonucleotide; GAAGGTTT chr2 60480520 60480539 60480523 -
ttagtgaatcatttactagg

SEQ ID NO: 192608 - DNA, 20 bp, Artificial Sequence
  Synthetic oligonucleotide; CAGCGCTT chr2 60480426 60480445 60480429 -
aggaagaaaagttcactgca

SEQ ID NO: 192609 - DNA, 20 bp, Artificial Sequence
  Synthetic oligonucleotide; TGCTGATT chr2 60480292 60480311 60480295 -
gagaaccagtggtagataca

SEQ ID NO: 192610 - DNA, 20 bp, Artificial Sequence
  Synthetic oligonucleotide; CACAGCTT chr2 60480074 60480093 60480077 -
ggcctcctcccggggaagtc

SEQ ID NO: 192611 - DNA, 20 bp, Artificial Sequence
  Synthetic oligonucleotide; GTATGATT chr2 60480009 60480028 60480012 -
ccgcaggccataaatgcaaa

SEQ ID NO: 192612 - DNA, 20 bp, Artificial Sequence
  Synthetic oligonucleotide; AGCAGCTT chr2 60479994 60480013 60479997 -
gcaaagtatgatttaacaaa

SEQ ID NO: 192613 - DNA, 20 bp, Artificial Sequence
  Synthetic oligonucleotide; TTCAGATT chr2 60479945 60479964 60479948 -
agttgtcccaacctgtcaac

SEQ ID NO: 192614 - DNA, 20 bp, Artificial Sequence
  Synthetic oligonucleotide; AAGCGTTT chr2 60479886 60479905 60479889 -
ttggtggaagggagggacag

SEQ ID NO: 192615 - DNA, 20 bp, Artificial Sequence
  Synthetic oligonucleotide; TTCAGATT chr2 60479874 60479893 60479877 -
agggacagaagcgtttcatt

SEQ ID NO: 192616 - DNA, 20 bp, Artificial Sequence
  Synthetic oligonucleotide; CCAGGTTT chr2 60479810 60479829 60479813 -
ccacgctgataccttacatg

SEQ ID NO: 192617 - DNA, 20 bp, Artificial Sequence
  Synthetic oligonucleotide; CAGGGTTT chr2 60479606 60479625 60479609 -
ccacactctccaccgcctga

SEQ ID NO: 192618 - DNA, 20 bp, Artificial Sequence
  Synthetic oligonucleotide; GGGGGCTT chr2 60479559 60479578 60479562 -
atctgtgggccggtgacaga

SEQ ID NO: 192619 - DNA, 20 bp, Artificial Sequence
  Synthetic oligonucleotide; AAAGGATT chr2 60479515 60479534 60479518 -
aggttgaggccctggaagca

SEQ ID NO: 192620 - DNA, 20 bp, Artificial Sequence
  Synthetic oligonucleotide; AGGGGCTT chr2 60479499 60479518 60479502 -
agcaaaaggatttcagcctg

SEQ ID NO: 192621 - DNA, 20 bp, Artificial Sequence
  Synthetic oligonucleotide; GAGAGCTT chr2 60479450 60479469 60479453 -
cctgttcctagtagacctga

SEQ ID NO: 192622 - DNA, 20 bp, Artificial Sequence
  Synthetic oligonucleotide; AGGAGCTT chr2 60479210 60479229 60479213 -
gatgttgtgctgttggttgg

SEQ ID NO: 192623 - DNA, 20 bp, Artificial Sequence
  Synthetic oligonucleotide; TCCAGATT chr2 60479044 60479063 60479047 -
aatttgctcagggaactctt

SEQ ID NO: 192624 - DNA, 20 bp, Artificial Sequence
  Synthetic oligonucleotide; GAAGGATT chr2 60479020 60479039 60479023 -
gattggtcagtggtataaat

SEQ ID NO: 192625 - DNA, 20 bp, Artificial Sequence
  Synthetic oligonucleotide; CTGTGTTT chr2 60478940 60478959 60478943 -
aagcacgtcaaagccaaggc

SEQ ID NO: 192626 - DNA, 20 bp, Artificial Sequence
  Synthetic oligonucleotide; GCCTGTTT chr2 60478816 60478835 60478819 -
gcagcatgccccgggcagag

SEQ ID NO: 192627 - DNA, 20 bp, Artificial Sequence
  Synthetic oligonucleotide; CCTAGTTT chr2 60478716 60478735 60478719 -
cacctcaggcgagagggcag

SEQ ID NO: 192628 - DNA, 20 bp, Artificial Sequence
  Synthetic oligonucleotide; TAGAGCTT chr2 60478659 60478678 60478662 -
tgctagaccattttttttgg

SEQ ID NO: 192629 - DNA, 20 bp, Artificial Sequence
  Synthetic oligonucleotide; ATAGGTTT chr2 60478592 60478611 60478595 -
tgtgttaaccataggacata

SEQ ID NO: 192630 - DNA, 20 bp, Artificial Sequence
  Synthetic oligonucleotide; CCACGCTT chr2 60478502 60478521 60478505 -
ttaggcctgtgaagtgcctt

SEQ ID NO: 192631 - DNA, 20 bp, Artificial Sequence
  Synthetic oligonucleotide; AGGAGATT chr2 60478445 60478464 60478448 -
tagtgccagaaaggcaagtg

SEQ ID NO: 192632 - DNA, 20 bp, Artificial Sequence
  Synthetic oligonucleotide; ACAGGTTT chr2 60478403 60478422 60478406 -
gtatgaccagtgtccagacg

SEQ ID NO: 192633 - DNA, 20 bp, Artificial Sequence
  Synthetic oligonucleotide; AGGGGTTT chr2 60478368 60478387 60478371 -
ggccctgaggtggcagtggg

SEQ ID NO: 192634 - DNA, 20 bp, Artificial Sequence
  Synthetic oligonucleotide; GACTGCTT chr2 60478070 60478089 60478073 -
cttgagagctgaggcaggag

SEQ ID NO: 192635 - DNA, 20 bp, Artificial Sequence
  Synthetic oligonucleotide; CCAAGATT chr2 60478034 60478053 60478037 -
gaggcggaggttgcagtgag

SEQ ID NO: 192636 - DNA, 20 bp, Artificial Sequence
  Synthetic oligonucleotide; AAAAGCTT chr2 60477963 60477982 60477966 -
tcaattaaaaaaaaaaaaaa

SEQ ID NO: 192637 - DNA, 20 bp, Artificial Sequence
  Synthetic oligonucleotide; ATGTGCTT chr2 60477936 60477955 60477939 -
ttccataaaggccaggacag

SEQ ID NO: 192638 - DNA, 20 bp, Artificial Sequence
  Synthetic oligonucleotide; CTGGGCTT chr2 60477891 60477910 60477894 -
gttggaggccttgccctcct

SEQ ID NO: 192639 - DNA, 20 bp, Artificial Sequence
  Synthetic oligonucleotide; CCCTGTTT chr2 60477692 60477711 60477695 -
gtctctcacagcaccactgc

SEQ ID NO: 192640 - DNA, 20 bp, Artificial Sequence
  Synthetic oligonucleotide; CCATGTTT chr2 60477641 60477660 60477644 -
tcaggagtctcttggaaaca

SEQ ID NO: 192641 - DNA, 20 bp, Artificial Sequence
  Synthetic oligonucleotide; GTTTGATT chr2 60477637 60477656 60477640 -
gagtctcttggaaacaccat

SEQ ID NO: 192642 - DNA, 20 bp, Artificial Sequence
  Synthetic oligonucleotide; GCAGGTTT chr2 60477564 60477583 60477567 -
gggatacatgtgcagaatgt

SEQ ID NO: 192643 - DNA, 20 bp, Artificial Sequence
  Synthetic oligonucleotide; GGTGGTTT chr2 60477532 60477551 60477535 -
cataagtatacatgtaccat

SEQ ID NO: 192644 - DNA, 20 bp, Artificial Sequence
  Synthetic oligonucleotide; CCATGTTT chr2 60477454 60477473 60477457 -
ccctccccttgcccctccac

SEQ ID NO: 192645 - DNA, 20 bp, Artificial Sequence
  Synthetic oligonucleotide; TTTGGTTT chr2 60477449 60477468 60477452 -
cccttgcccctccacccatg

SEQ ID NO: 192646 - DNA, 20 bp, Artificial Sequence
  Synthetic oligonucleotide; TTTAGCTT chr2 60477439 60477458 60477442 -
tccacccatgtttggttttc

SEQ ID NO: 192647 - DNA, 20 bp, Artificial Sequence
  Synthetic oligonucleotide; AAAGGCTT chr2 60477352 60477371 60477355 -
ttgtgagttgatgcagataa

SEQ ID NO: 192648 - DNA, 20 bp, Artificial Sequence
  Synthetic oligonucleotide; GCTGGCTT chr2 60477306 60477325 60477309 -
atttgggagttgtgtgttct

SEQ ID NO: 192649 - DNA, 20 bp, Artificial Sequence
  Synthetic oligonucleotide; AAACGTTT chr2 60477254 60477273 60477257 -
tggcaggtgttatcagaatc

SEQ ID NO: 192650 - DNA, 20 bp, Artificial Sequence
  Synthetic oligonucleotide; TGTGGTTT chr2 60477125 60477144 60477128 -
taacctgggagaaacgcaag

SEQ ID NO: 192651 - DNA, 20 bp, Artificial Sequence
  Synthetic oligonucleotide; CAAGGCTT chr2 60477116 60477135 60477119 -
agaaacgcaagtgtggtttg

SEQ ID NO: 192652 - DNA, 20 bp, Artificial Sequence
  Synthetic oligonucleotide; TGATGATT chr2 60477094 60477113 60477097 -
aggctttccaggtgtccaaa

SEQ ID NO: 192653 - DNA, 20 bp, Artificial Sequence
  Synthetic oligonucleotide; GGGTGTTT chr2 60477042 60477061 60477045 -
agtggggcagggaggcatcg

SEQ ID NO: 192654 - DNA, 20 bp, Artificial Sequence
  Synthetic oligonucleotide; ATACGTTT chr2 60477031 60477050 60477034 -
gaggcatcggggtgtttgtg

SEQ ID NO: 192655 - DNA, 20 bp, Artificial Sequence
  Synthetic oligonucleotide; CATGGATT chr2 60476947 60476966 60476950 -
gtcccttctaactacaaagg

SEQ ID NO: 192656 - DNA, 20 bp, Artificial Sequence
  Synthetic oligonucleotide; GAGTGATT chr2 60476869 60476888 60476872 -
atggaaactgataaattaga

SEQ ID NO: 192657 - DNA, 20 bp, Artificial Sequence
  Synthetic oligonucleotide; GAAAGATT chr2 60476849 60476868 60476852 -
gagtgatttttcacattaca

SEQ ID NO: 192658 - DNA, 20 bp, Artificial Sequence
  Synthetic oligonucleotide; AAAGGTTT chr2 60476829 60476848 60476832 -
gaaagattgttaacttttca

SEQ ID NO: 192659 - DNA, 20 bp, Artificial Sequence
  Synthetic oligonucleotide; CAGGGTTT chr2 60476816 60476835 60476819 -
cttttcaaaaggtttcacca

SEQ ID NO: 192660 - DNA, 20 bp, Artificial Sequence
  Synthetic oligonucleotide; AAGTGTTT chr2 60476777 60476796 60476780 -
gagctcccccactgaattta

SEQ ID NO: 192661 - DNA, 20 bp, Artificial Sequence
  Synthetic oligonucleotide; GTTTGTTT chr2 60476773 60476792 60476776 -
tcccccactgaatttaaagt

SEQ ID NO: 192662 - DNA, 20 bp, Artificial Sequence
  Synthetic oligonucleotide; ATATGATT chr2 60476620 60476639 60476623 -
gaaattatgttggttagcaa

SEQ ID NO: 192663 - DNA, 20 bp, Artificial Sequence
  Synthetic oligonucleotide; CATGGCTT chr2 60476588 60476607 60476591 -
ttacagaaattcattttaca

SEQ ID NO: 192664 - DNA, 20 bp, Artificial Sequence
  Synthetic oligonucleotide; CTGGGCTT chr2 60476525 60476544 60476528 -
aggtcaaggaccacagggtg

SEQ ID NO: 192665 - DNA, 20 bp, Artificial Sequence
  Synthetic oligonucleotide; CCTGGTTT chr2 60476511 60476530 60476514 -
agggtgctgggctttgctgt

SEQ ID NO: 192666 - DNA, 20 bp, Artificial Sequence
  Synthetic oligonucleotide; CCGAGCTT chr2 60476420 60476439 60476423 -
tgccaggctctggcatgagg

SEQ ID NO: 192667 - DNA, 20 bp, Artificial Sequence
  Synthetic oligonucleotide; CTGGGTTT chr2 60476359 60476378 60476362 -
cttttcccttgacatttagc

SEQ ID NO: 192668 - DNA, 20 bp, Artificial Sequence
  Synthetic oligonucleotide; GGAAGTTT chr2 60476349 60476368 60476352 -
gacatttagcctgggtttgg

SEQ ID NO: 192669 - DNA, 20 bp, Artificial Sequence
  Synthetic oligonucleotide; CTAGGTTT chr2 60476297 60476316 60476300 -
ctcattggctcaggacacac

SEQ ID NO: 192670 - DNA, 20 bp, Artificial Sequence
  Synthetic oligonucleotide; TAAGGATT chr2 60476206 60476225 60476209 -
tcaggctcactctctaagcc

SEQ ID NO: 192671 - DNA, 20 bp, Artificial Sequence
  Synthetic oligonucleotide; GCCAGCTT chr2 60476112 60476131 60476115 -
aggggaacaggtgtatcctg

SEQ ID NO: 192672 - DNA, 20 bp, Artificial Sequence
  Synthetic oligonucleotide; AAAGGATT chr2 60475971 60475990 60475974 -
aaacacttagggccagaaag

SEQ ID NO: 192673 - DNA, 20 bp, Artificial Sequence
  Synthetic oligonucleotide; CCCTGCTT chr2 60475867 60475886 60475870 -
gtctctccagaggaacaagt

SEQ ID NO: 192674 - DNA, 20 bp, Artificial Sequence
  Synthetic oligonucleotide; CATGGCTT chr2 60475660 60475679 60475663 -
aagggcacccctatcctccc

SEQ ID NO: 192675 - DNA, 20 bp, Artificial Sequence
  Synthetic oligonucleotide; TGATGATT chr2 60475611 60475630 60475614 -
atttggagggatggtcaagt

SEQ ID NO: 192676 - DNA, 20 bp, Artificial Sequence
  Synthetic oligonucleotide; CAATGTTT chr2 60475575 60475594 60475578 -
aaagtagtgtaggaaaatct

SEQ ID NO: 192677 - DNA, 20 bp, Artificial Sequence
  Synthetic oligonucleotide; AATAGATT chr2 60475496 60475515 60475499 -
actggcaatgagacatctga

SEQ ID NO: 192678 - DNA, 20 bp, Artificial Sequence
  Synthetic oligonucleotide; ACTTGTTT chr2 60475441 60475460 60475444 -
ggaagaacatggctatcaac

SEQ ID NO: 192679 - DNA, 20 bp, Artificial Sequence
  Synthetic oligonucleotide; TGGAGTTT chr2 60475323 60475342 60475326 -
acagaacagatgaaccttca

SEQ ID NO: 192680 - DNA, 20 bp, Artificial Sequence
  Synthetic oligonucleotide; AGAGGATT chr2 60475221 60475240 60475224 -
aagatgtcacagaaatcttc

SEQ ID NO: 192681 - DNA, 20 bp, Artificial Sequence
  Synthetic oligonucleotide; TTGGGCTT chr2 60475110 60475129 60475113 -
ccatttactctgtgcccacc

SEQ ID NO: 192682 - DNA, 20 bp, Artificial Sequence
  Synthetic oligonucleotide; CTTTGCTT chr2 60475105 60475124 60475108 -
tactctgtgcccaccttggg

SEQ ID NO: 192683 - DNA, 20 bp, Artificial Sequence
  Synthetic oligonucleotide; ACCTGCTT chr2 60475081 60475100 60475084 -
gcttctctctaagcatcttt

SEQ ID NO: 192684 - DNA, 20 bp, Artificial Sequence
  Synthetic oligonucleotide; CCAGGTTT chr2 60475037 60475056 60475040 -
atatcctttctcttggctct

SEQ ID NO: 192685 - DNA, 20 bp, Artificial Sequence
  Synthetic oligonucleotide; ATAAGTTT chr2 60475024 60475043 60475027 -
tggctctccaggtttaactc

SEQ ID NO: 192686 - DNA, 20 bp, Artificial Sequence
  Synthetic oligonucleotide; CCGTGTTT chr2 60474835 60474854 60474838 -
gctgtgggagaaatctgtgt

SEQ ID NO: 192687 - DNA, 20 bp, Artificial Sequence
  Synthetic oligonucleotide; CATTGCTT chr2 60474800 60474819 60474803 -
actgcccacagcggctagcc

SEQ ID NO: 192688 - DNA, 20 bp, Artificial Sequence
  Synthetic oligonucleotide; ATGTGATT chr2 60474673 60474692 60474676 -
cacattttgcatagtgaggt

SEQ ID NO: 192689 - DNA, 20 bp, Artificial Sequence
  Synthetic oligonucleotide; AAAAGCTT chr2 60474575 60474594 60474578 -
aagttccgccattctaaggc

SEQ ID NO: 192690 - DNA, 20 bp, Artificial Sequence
  Synthetic oligonucleotide; GAAGGATT chr2 60474413 60474432 60474416 -
cctattcaaccttttgaaat

SEQ ID NO: 192691 - DNA, 20 bp, Artificial Sequence
  Synthetic oligonucleotide; TTTGGCTT chr2 60474354 60474373 60474357 -
caaagatggaacacaatgtc

SEQ ID NO: 192692 - DNA, 20 bp, Artificial Sequence
  Synthetic oligonucleotide; AGTTGCTT chr2 60474346 60474365 60474349 -
gaacacaatgtctttggctt

SEQ ID NO: 192693 - DNA, 20 bp, Artificial Sequence
  Synthetic oligonucleotide; GCAAGATT chr2 60474329 60474348 60474332 -
cttagttgcttttcagaaaa

SEQ ID NO: 192694 - DNA, 20 bp, Artificial Sequence
  Synthetic oligonucleotide; ATATGCTT chr2 60474305 60474324 60474308 -
gattttttttttttggaatt

SEQ ID NO: 192695 - DNA, 20 bp, Artificial Sequence
  Synthetic oligonucleotide; CTTTGCTT chr2 60474300 60474319 60474303 -
tttttttttggaattatatg

SEQ ID NO: 192696 - DNA, 20 bp, Artificial Sequence
  Synthetic oligonucleotide; CACAGCTT chr2 60474282 60474301 60474285 -
tgctttgcttatgttaaaga

SEQ ID NO: 192697 - DNA, 20 bp, Artificial Sequence
  Synthetic oligonucleotide; TTTTGTTT chr2 60474265 60474284 60474268 -
agacacagcttgcagaaaaa

SEQ ID NO: 192698 - DNA, 20 bp, Artificial Sequence
  Synthetic oligonucleotide; GACAGATT chr2 60474251 60474270 60474254 -
gaaaaattttgtttaggcct

SEQ ID NO: 192699 - DNA, 20 bp, Artificial Sequence
  Synthetic oligonucleotide; TGTTGTTT chr2 60474132 60474151 60474135 -
aaaaggtgaagttagtaacc

SEQ ID NO: 192700 - DNA, 20 bp, Artificial Sequence
  Synthetic oligonucleotide; AAGAGTTT chr2 60474086 60474105 60474089 -
gaggatagcattgatcaaaa

SEQ ID NO: 192701 - DNA, 20 bp, Artificial Sequence
  Synthetic oligonucleotide; GAGTGATT chr2 60474072 60474091 60474075 -
tcaaaaaagagttttaaaat

SEQ ID NO: 192702 - DNA, 20 bp, Artificial Sequence
  Synthetic oligonucleotide; GAGAGTTT chr2 60474015 60474034 60474018 -
aaggaatctaaggaccatga

SEQ ID NO: 192703 - DNA, 20 bp, Artificial Sequence
  Synthetic oligonucleotide; TATTGCTT chr2 60473973 60473992 60473976 -
tatattgtagtgtctataat

SEQ ID NO: 192704 - DNA, 20 bp, Artificial Sequence
  Synthetic oligonucleotide; TTTTGTTT chr2 60473963 60473982 60473966 -
tgtctataattattgctttc

SEQ ID NO: 192705 - DNA, 20 bp, Artificial Sequence
  Synthetic oligonucleotide; TCAGGATT chr2 60473929 60473948 60473932 -
aatacactttttaaagaaca

SEQ ID NO: 192706 - DNA, 20 bp, Artificial Sequence
  Synthetic oligonucleotide; GTGCGATT chr2 60473845 60473864 60473848 -
catttctagaacaaaagaga

SEQ ID NO: 192707 - DNA, 20 bp, Artificial Sequence
  Synthetic oligonucleotide; TACAGATT chr2 60473774 60473793 60473777 -
taaagctggcacattttcat

SEQ ID NO: 192708 - DNA, 20 bp, Artificial Sequence
  Synthetic oligonucleotide; TAATGTTT chr2 60473740 60473759 60473743 -
actcaagtcacaggcatagc

SEQ ID NO: 192709 - DNA, 20 bp, Artificial Sequence
  Synthetic oligonucleotide; TGTGGCTT chr2 60473571 60473590 60473574 -
agctgcactgttgttatttg

SEQ ID NO: 192710 - DNA, 20 bp, Artificial Sequence
  Synthetic oligonucleotide; ATCGGATT chr2 60473553 60473572 60473556 -
tgtgtggcttgaacctagta

SEQ ID NO: 192711 - DNA, 20 bp, Artificial Sequence
  Synthetic oligonucleotide; TGAGGATT chr2 60473449 60473468 60473452 -
catggaagagctgagggact

SEQ ID NO: 192712 - DNA, 20 bp, Artificial Sequence
  Synthetic oligonucleotide; TACTGCTT chr2 60473281 60473300 60473284 -
cattccacgtgggacagctc

SEQ ID NO: 192713 - DNA, 20 bp, Artificial Sequence
  Synthetic oligonucleotide; ATATGTTT chr2 60473221 60473240 60473224 -
cagggaaattatctaaaaac

SEQ ID NO: 192714 - DNA, 20 bp, Artificial Sequence
  Synthetic oligonucleotide; AAATGCTT chr2 60473007 60473026 60473010 -
taacacacatatgtacacat

SEQ ID NO: 192715 - DNA, 20 bp, Artificial Sequence
  Synthetic oligonucleotide; TGTGGTTT chr2 60472935 60472954 60472938 -
tgtactcctgtggagagtcc

SEQ ID NO: 192716 - DNA, 20 bp, Artificial Sequence
  Synthetic oligonucleotide; TGATGCTT chr2 60472877 60472896 60472880 -
agtcattaaacgtgttggaa

SEQ ID NO: 192717 - DNA, 20 bp, Artificial Sequence
  Synthetic oligonucleotide; TTTTGCTT chr2 60472870 60472889 60472873 -
aaacgtgttggaatgatgct

SEQ ID NO: 192718 - DNA, 20 bp, Artificial Sequence
  Synthetic oligonucleotide; AGCTGTTT chr2 60472862 60472881 60472865 -
tggaatgatgctttttgctt

SEQ ID NO: 192719 - DNA, 20 bp, Artificial Sequence
  Synthetic oligonucleotide; TGTTGATT chr2 60472825 60472844 60472828 -
tggaaatctgcagtattacc

SEQ ID NO: 192720 - DNA, 20 bp, Artificial Sequence
  Synthetic oligonucleotide; CAGTGATT chr2 60472786 60472805 60472789 -
atgtggctgtattacacacc

SEQ ID NO: 192721 - DNA, 20 bp, Artificial Sequence
  Synthetic oligonucleotide; ATTAGTTT chr2 60472781 60472800 60472784 -
gctgtattacacacccagtg

SEQ ID NO: 192722 - DNA, 20 bp, Artificial Sequence
  Synthetic oligonucleotide; ACTTGATT chr2 60472711 60472730 60472714 -
gttcttgaggaaaccaaaaa

SEQ ID NO: 192723 - DNA, 20 bp, Artificial Sequence
  Synthetic oligonucleotide; CTGGGCTT chr2 60472675 60472694 60472678 -
taaattccaggaacatccca

SEQ ID NO: 192724 - DNA, 20 bp, Artificial Sequence
  Synthetic oligonucleotide; CCCAGTTT chr2 60472586 60472605 60472589 -
aacattaaatcaaagccatt

SEQ ID NO: 192725 - DNA, 20 bp, Artificial Sequence
  Synthetic oligonucleotide; AAAAGATT chr2 60472387 60472406 60472390 -
aaaagtgtaagacatttgaa

SEQ ID NO: 192726 - DNA, 20 bp, Artificial Sequence
  Synthetic oligonucleotide; GTCGGCTT chr2 60472275 60472294 60472278 -
acagctgcgttcgctgacat

SEQ ID NO: 192727 - DNA, 20 bp, Artificial Sequence
  Synthetic oligonucleotide; GCTGGTTT chr2 60472230 60472249 60472233 -
acacaatctgtctggcacaa

SEQ ID NO: 192728 - DNA, 20 bp, Artificial Sequence
  Synthetic oligonucleotide; TAGGGATT chr2 60472107 60472126 60472110 -
tttcctaatggagggatcct

SEQ ID NO: 192729 - DNA, 20 bp, Artificial Sequence
  Synthetic oligonucleotide; CTAAGCTT chr2 60472097 60472116 60472100 -
gagggatccttagggattcc

SEQ ID NO: 192730 - DNA, 20 bp, Artificial Sequence
  Synthetic oligonucleotide; ATTTGTTT chr2 60472088 60472107 60472091 -
ttagggattccctaagctta

SEQ ID NO: 192731 - DNA, 20 bp, Artificial Sequence
  Synthetic oligonucleotide; CAAAGCTT chr2 60471995 60472014 60471998 -
ggtctctgcccagggaattt

SEQ ID NO: 192732 - DNA, 20 bp, Artificial Sequence
  Synthetic oligonucleotide; TGCTGATT chr2 60471952 60471971 60471955 -
cccttaccctaagacagcag

SEQ ID NO: 192733 - DNA, 20 bp, Artificial Sequence
  Synthetic oligonucleotide; TTCAGCTT chr2 60471946 60471965 60471949 -
ccctaagacagcagtgctga

SEQ ID NO: 192734 - DNA, 20 bp, Artificial Sequence
  Synthetic oligonucleotide; GGCTGCTT chr2 60471895 60471914 60471898 -
agaatttattcaacatagaa

SEQ ID NO: 192735 - DNA, 20 bp, Artificial Sequence
  Synthetic oligonucleotide; TTCTGATT chr2 60471874 60471893 60471877 -
gctgcttccccaccctcaat

SEQ ID NO: 192736 - DNA, 20 bp, Artificial Sequence
  Synthetic oligonucleotide; TCGAGTTT chr2 60471591 60471610 60471594 -
tgggaaggcagagctgctcc

SEQ ID NO: 192737 - DNA, 20 bp, Artificial Sequence
  Synthetic oligonucleotide; TGTCGATT chr2 60471453 60471472 60471456 -
atttccagttcatgtgggaa

SEQ ID NO: 192738 - DNA, 20 bp, Artificial Sequence
  Synthetic oligonucleotide; ATGTGTTT chr2 60471420 60471439 60471423 -
taccaaagagaatattatgg

SEQ ID NO: 192739 - DNA, 20 bp, Artificial Sequence
  Synthetic oligonucleotide; GTTGGCTT chr2 60471377 60471396 60471380 -
agaatcagctggggtcccca

SEQ ID NO: 192740 - DNA, 20 bp, Artificial Sequence
  Synthetic oligonucleotide; CTTTGCTT chr2 60471372 60471391 60471375 -
cagctggggtccccagttgg

SEQ ID NO: 192741 - DNA, 20 bp, Artificial Sequence
  Synthetic oligonucleotide; GTGTGCTT chr2 60471313 60471332 60471316 -
gggtgagtctcacaaagaca

SEQ ID NO: 192742 - DNA, 20 bp, Artificial Sequence
  Synthetic oligonucleotide; AATAGCTT chr2 60471292 60471311 60471295 -
tgtgctttttttctaaagta

SEQ ID NO: 192743 - DNA, 20 bp, Artificial Sequence
  Synthetic oligonucleotide; AAATGTTT chr2 60471271 60471290 60471274 -
atagcttcttaggctgatag

SEQ ID NO: 192744 - DNA, 20 bp, Artificial Sequence
  Synthetic oligonucleotide; CCTTGTTT chr2 60471178 60471197 60471181 -
ggcccaggcagcagagcagg

SEQ ID NO: 192745 - DNA, 20 bp, Artificial Sequence
  Synthetic oligonucleotide; TACTGCTT chr2 60471081 60471100 60471084 -
cctcccccaagacggttaag

SEQ ID NO: 192746 - DNA, 20 bp, Artificial Sequence
  Synthetic oligonucleotide; AGGAGATT chr2 60470967 60470986 60470970 -
agaccactggatcaggagtc

SEQ ID NO: 192747 - DNA, 20 bp, Artificial Sequence
  Synthetic oligonucleotide; CTCAGTTT chr2 60470891 60470910 60470894 -
gtcacttaatttctcatggc

SEQ ID NO: 192748 - DNA, 20 bp, Artificial Sequence
  Synthetic oligonucleotide; TAGGGTTT chr2 60470845 60470864 60470848 -
gggacagacttgatgatagc

SEQ ID NO: 192749 - DNA, 20 bp, Artificial Sequence
  Synthetic oligonucleotide; GTCAGCTT chr2 60470721 60470740 60470724 -
tgtagagatctggtcctgcc

SEQ ID NO: 192750 - DNA, 20 bp, Artificial Sequence
  Synthetic oligonucleotide; GCTTGTTT chr2 60470717 60470736 60470720 -
gagatctggtcctgccgtca

SEQ ID NO: 192751 - DNA, 20 bp, Artificial Sequence
  Synthetic oligonucleotide; ATGGGTTT chr2 60470702 60470721 60470705 -
cgtcagcttgtttagggcta

SEQ ID NO: 192752 - DNA, 20 bp, Artificial Sequence
  Synthetic oligonucleotide; ACAAGTTT chr2 60470690 60470709 60470693 -
tagggctaatgggtttgtag

SEQ ID NO: 192753 - DNA, 20 bp, Artificial Sequence
  Synthetic oligonucleotide; AAGAGATT chr2 60470676 60470695 60470679 -
ttgtagacaagtttgccaac

SEQ ID NO: 192754 - DNA, 20 bp, Artificial Sequence
  Synthetic oligonucleotide; CATGGATT chr2 60470652 60470671 60470655 -
gattcatgcgaggggctagg

SEQ ID NO: 192755 - DNA, 20 bp, Artificial Sequence
  Synthetic oligonucleotide; TTGCGTTT chr2 60470524 60470543 60470527 -
tacaaggatccaagtacctg

SEQ ID NO: 192756 - DNA, 20 bp, Artificial Sequence
  Synthetic oligonucleotide; CTGTGTTT chr2 60470486 60470505 60470489 -
cacagagatacctgggttgc

SEQ ID NO: 192757 - DNA, 20 bp, Artificial Sequence
  Synthetic oligonucleotide; GTCTGTTT chr2 60470464 60470483 60470467 -
gtgtttcctaagaaaaggat

SEQ ID NO: 192758 - DNA, 20 bp, Artificial Sequence
  Synthetic oligonucleotide; GATGGATT chr2 60470412 60470431 60470415 -
gaggcaaaaacaagtgcaaa

SEQ ID NO: 192759 - DNA, 20 bp, Artificial Sequence
  Synthetic oligonucleotide; CTCAGATT chr2 60470404 60470423 60470407 -
aacaagtgcaaagatggatt

SEQ ID NO: 192760 - DNA, 20 bp, Artificial Sequence
  Synthetic oligonucleotide; ACTTGTTT chr2 60470309 60470328 60470312 -
aaacagtcaaatgtagacat

SEQ ID NO: 192761 - DNA, 20 bp, Artificial Sequence
  Synthetic oligonucleotide; TCCTGCTT chr2 60470287 60470306 60470290 -
ttgtttgttaagtccggtct

SEQ ID NO: 192762 - DNA, 20 bp, Artificial Sequence
  Synthetic oligonucleotide; TGGTGTTT chr2 60470263 60470282 60470266 -
gcttgtgttggttcactttg

SEQ ID NO: 192763 - DNA, 20 bp, Artificial Sequence
  Synthetic oligonucleotide; TTTTGTTT chr2 60470254 60470273 60470257 -
ggttcactttgtggtgttta

SEQ ID NO: 192764 - DNA, 20 bp, Artificial Sequence
  Synthetic oligonucleotide; TGGTGCTT chr2 60470200 60470219 60470203 -
gtagatgttctcaggctagg

SEQ ID NO: 192765 - DNA, 20 bp, Artificial Sequence
  Synthetic oligonucleotide; CAGGGCTT chr2 60470188 60470207 60470191 -
aggctaggtggtgcttccac

SEQ ID NO: 192766 - DNA, 20 bp, Artificial Sequence
  Synthetic oligonucleotide; CTGTGCTT chr2 60470062 60470081 60470065 -
tcttgtcccaactgccttgg

SEQ ID NO: 192767 - DNA, 20 bp, Artificial Sequence
  Synthetic oligonucleotide; TACTGTTT chr2 60469941 60469960 60469944 -
tattaagctaatggaaaaca

SEQ ID NO: 192768 - DNA, 20 bp, Artificial Sequence
  Synthetic oligonucleotide; GTCTGTTT chr2 60469920 60469939 60469923 -
actgtttgttcaccatcaaa

SEQ ID NO: 192769 - DNA, 20 bp, Artificial Sequence
  Synthetic oligonucleotide; CCCAGATT chr2 60469742 60469761 60469745 -
accacataaaccgtaaaatc

SEQ ID NO: 192770 - DNA, 20 bp, Artificial Sequence
  Synthetic oligonucleotide; AAATGTTT chr2 60469690 60469709 60469693 -
caaaaaaatctcagtgctac

SEQ ID NO: 192771 - DNA, 20 bp, Artificial Sequence
  Synthetic oligonucleotide; ATTAGATT chr2 60469674 60469693 60469677 -
ctacaaatgtttcattgact

SEQ ID NO: 192772 - DNA, 20 bp, Artificial Sequence
  Synthetic oligonucleotide; CAGGGTTT chr2 60469593 60469612 60469596 -
gtaaaatggtgaagatgggt

SEQ ID NO: 192773 - DNA, 20 bp, Artificial Sequence
  Synthetic oligonucleotide; CATTGCTT chr2 60469495 60469514 60469498 -
gaagtctaatctttatcttc

SEQ ID NO: 192774 - DNA, 20 bp, Artificial Sequence
  Synthetic oligonucleotide; TAAGGTTT chr2 60469462 60469481 60469465 -
tgtgagaagccacatctgtg

SEQ ID NO: 192775 - DNA, 20 bp, Artificial Sequence
  Synthetic oligonucleotide; ACAGGATT chr2 60469447 60469466 60469450 -
ctgtgtaaggtttccagttg

SEQ ID NO: 192776 - DNA, 20 bp, Artificial Sequence
  Synthetic oligonucleotide; CCAGGTTT chr2 60469407 60469426 60469410 -
ccagctcagtccagaaatgc

SEQ ID NO: 192777 - DNA, 20 bp, Artificial Sequence
  Synthetic oligonucleotide; AAACGATT chr2 60469309 60469328 60469312 -
gtgggactctgtcccataaa

SEQ ID NO: 192778 - DNA, 20 bp, Artificial Sequence
  Synthetic oligonucleotide; TTTTGCTT chr2 60469274 60469293 60469277 -
ctactcatttcctatcagca

SEQ ID NO: 192779 - DNA, 20 bp, Artificial Sequence
  Synthetic oligonucleotide; TTTTGCTT chr2 60469267 60469286 60469270 -
tttcctatcagcattttgct

SEQ ID NO: 192780 - DNA, 20 bp, Artificial Sequence
  Synthetic oligonucleotide; TTGGGTTT chr2 60469261 60469280 60469264 -
atcagcattttgctttttgc

SEQ ID NO: 192781 - DNA, 20 bp, Artificial Sequence
  Synthetic oligonucleotide; CCATGTTT chr2 60469197 60469216 60469200 -
gccttgcagataaaatcccc

SEQ ID NO: 192782 - DNA, 20 bp, Artificial Sequence
  Synthetic oligonucleotide; ACCAGTTT chr2 60469170 60469189 60469173 -
tccaggctacccacaatatt

SEQ ID NO: 192783 - DNA, 20 bp, Artificial Sequence
  Synthetic oligonucleotide; TGCTGCTT chr2 60469156 60469175 60469159 -
aatattaccagttttcccct

SEQ ID NO: 192784 - DNA, 20 bp, Artificial Sequence
  Synthetic oligonucleotide; TTTTGTTT chr2 60468984 60469003 60468987 -
gaaataactcaccactcttc

SEQ ID NO: 192785 - DNA, 20 bp, Artificial Sequence
  Synthetic oligonucleotide; TGTGGTTT chr2 60468894 60468913 60468897 -
ggaattgaaatgtgatatcc

SEQ ID NO: 192786 - DNA, 20 bp, Artificial Sequence
  Synthetic oligonucleotide; CGTTGTTT chr2 60468878 60468897 60468881 -
atcctgtggtttatgatgca

SEQ ID NO: 192787 - DNA, 20 bp, Artificial Sequence
  Synthetic oligonucleotide; TAGTGCTT chr2 60468863 60468882 60468866 -
atgcacgttgtttgtagctg

SEQ ID NO: 192788 - DNA, 20 bp, Artificial Sequence
  Synthetic oligonucleotide; GCTTGATT chr2 60468859 60468878 60468862 -
acgttgtttgtagctgtagt

SEQ ID NO: 192789 - DNA, 20 bp, Artificial Sequence
  Synthetic oligonucleotide; TTGGGTTT chr2 60468851 60468870 60468854 -
tgtagctgtagtgcttgatt

SEQ ID NO: 192790 - DNA, 20 bp, Artificial Sequence
  Synthetic oligonucleotide; AATAGATT chr2 60468631 60468650 60468634 -
actgaaggagttacttccaa

SEQ ID NO: 192791 - DNA, 20 bp, Artificial Sequence
  Synthetic oligonucleotide; TAGTGATT chr2 60468460 60468479 60468463 -
gtcttgtcttgctccgtggc

SEQ ID NO: 192792 - DNA, 20 bp, Artificial Sequence
  Synthetic oligonucleotide; GTCAGTTT chr2 60468333 60468352 60468336 -
caaggccagaatcaaaagga

SEQ ID NO: 192793 - DNA, 20 bp, Artificial Sequence
  Synthetic oligonucleotide; CCTGGTTT chr2 60468214 60468233 60468217 -
taattttgactaatttttct

SEQ ID NO: 192794 - DNA, 20 bp, Artificial Sequence
  Synthetic oligonucleotide; GTGAGCTT chr2 60467048 60467067 60467051 -
accaccatttacttgttcaa

SEQ ID NO: 192795 - DNA, 20 bp, Artificial Sequence
  Synthetic oligonucleotide; AAATGTTT chr2 60466994 60467013 60466997 -
ttaaatttgtccatttatac

SEQ ID NO: 192796 - DNA, 20 bp, Artificial Sequence
  Synthetic oligonucleotide; TACTGTTT chr2 60466977 60466996 60466980 -
tacaaatgttttctgaaaga

SEQ ID NO: 192797 - DNA, 20 bp, Artificial Sequence
  Synthetic oligonucleotide; TACAGTTT chr2 60466959 60466978 60466962 -
gatactgttttagaaaataa

SEQ ID NO: 192798 - DNA, 20 bp, Artificial Sequence
  Synthetic oligonucleotide; GTTTGCTT chr2 60466955 60466974 60466958 -
ctgttttagaaaataataca

SEQ ID NO: 192799 - DNA, 20 bp, Artificial Sequence
  Synthetic oligonucleotide; CAGTGATT chr2 60466891 60466910 60466894 -
ctaaaaggttagggggtggg

SEQ ID NO: 192800 - DNA, 20 bp, Artificial Sequence
  Synthetic oligonucleotide; GACTGTTT chr2 60466712 60466731 60466715 -
agagttaaggctctaagggg

SEQ ID NO: 192801 - DNA, 20 bp, Artificial Sequence
  Synthetic oligonucleotide; ACCAGATT chr2 60466634 60466653 60466637 -
agcagggcatgcaccctgag

SEQ ID NO: 192802 - DNA, 20 bp, Artificial Sequence
  Synthetic oligonucleotide; AGTTGTTT chr2 60466619 60466638 60466622 -
ctgagaccagattcaaagcc

SEQ ID NO: 192803 - DNA, 20 bp, Artificial Sequence
  Synthetic oligonucleotide; CACAGATT chr2 60466462 60466481 60466465 -
ggcctaagcctgggttaggt

SEQ ID NO: 192804 - DNA, 20 bp, Artificial Sequence
  Synthetic oligonucleotide; GAAGGTTT chr2 60466451 60466470 60466454 -
gggttaggtcacagattgca

SEQ ID NO: 192805 - DNA, 20 bp, Artificial Sequence
  Synthetic oligonucleotide; CACGGTTT chr2 60466430 60466449 60466433 -
aaggtttaggaggttgggct

SEQ ID NO: 192806 - DNA, 20 bp, Artificial Sequence
  Synthetic oligonucleotide; GGGAGTTT chr2 60466215 60466234 60466218 -
gcctggtcttcctgagggct

SEQ ID NO: 192807 - DNA, 20 bp, Artificial Sequence
  Synthetic oligonucleotide; GTTTGATT chr2 60466211 60466230 60466214 -
ggtcttcctgagggctggga

SEQ ID NO: 192808 - DNA, 20 bp, Artificial Sequence
  Synthetic oligonucleotide; CTGAGCTT chr2 60466187 60466206 60466190 -
gatttgactggtaggaaagt

SEQ ID NO: 192809 - DNA, 20 bp, Artificial Sequence
  Synthetic oligonucleotide; CATAGTTT chr2 60466133 60466152 60466136 -
cttcccacaaagggagggta

SEQ ID NO: 192810 - DNA, 20 bp, Artificial Sequence
  Synthetic oligonucleotide; CCTGGCTT chr2 60465994 60466013 60465997 -
ggcggcattaacctgctgcc

SEQ ID NO: 192811 - DNA, 20 bp, Artificial Sequence
  Synthetic oligonucleotide; GATAGTTT chr2 60465781 60465800 60465784 -
ctcacattcacattcgacct

SEQ ID NO: 192812 - DNA, 20 bp, Artificial Sequence
  Synthetic oligonucleotide; GAGGGCTT chr2 60465770 60465789 60465773 -
attcgacctgatagtttaca

SEQ ID NO: 192813 - DNA, 20 bp, Artificial Sequence
  Synthetic oligonucleotide; TACTGTTT chr2 60465719 60465738 60465722 -
ttcccaacaattcttacagg

SEQ ID NO: 192814 - DNA, 20 bp, Artificial Sequence
  Synthetic oligonucleotide; TGAGGCTT chr2 60465587 60465606 60465590 -
ctccttgttcttctgaatct

SEQ ID NO: 192815 - DNA, 20 bp, Artificial Sequence
  Synthetic oligonucleotide; AGCTGATT chr2 60465478 60465497 60465481 -
aagccagtaggtgggctaat

SEQ ID NO: 192816 - DNA, 20 bp, Artificial Sequence
  Synthetic oligonucleotide; CTATGCTT chr2 60465445 60465464 60465448 -
ccttttgatgtctcaagttc

SEQ ID NO: 192817 - DNA, 20 bp, Artificial Sequence
  Synthetic oligonucleotide; GTCAGTTT chr2 60465426 60465445 60465429 -
cctatgcttaggggccaggt

SEQ ID NO: 192818 - DNA, 20 bp, Artificial Sequence
  Synthetic oligonucleotide; AGTTGATT chr2 60465362 60465381 60465365 -
atgaggctctcaaattgaga

SEQ ID NO: 192819 - DNA, 20 bp, Artificial Sequence
  Synthetic oligonucleotide; TGCAGTTT chr2 60465189 60465208 60465192 -
gtaacacatttattgatgac

SEQ ID NO: 192820 - DNA, 20 bp, Artificial Sequence
  Synthetic oligonucleotide; TACAGATT chr2 60465119 60465138 60465122 -
ccggcatgagctgagtgaaa

SEQ ID NO: 192821 - DNA, 20 bp, Artificial Sequence
  Synthetic oligonucleotide; ACCAGTTT chr2 60465060 60465079 60465063 -
ttagtggactggtaataatt

SEQ ID NO: 192822 - DNA, 20 bp, Artificial Sequence
  Synthetic oligonucleotide; TTATGATT chr2 60464993 60465012 60464996 -
aacagcccttctcattgaca

SEQ ID NO: 192823 - DNA, 20 bp, Artificial Sequence
  Synthetic oligonucleotide; AAAAGTTT chr2 60464796 60464815 60464799 -
tcacataactggctctgaaa

SEQ ID NO: 192824 - DNA, 20 bp, Artificial Sequence
  Synthetic oligonucleotide; CACAGATT chr2 60464696 60464715 60464699 -
cttgatgtagtgctgtatgc

SEQ ID NO: 192825 - DNA, 20 bp, Artificial Sequence
  Synthetic oligonucleotide; CCTGGATT chr2 60464621 60464640 60464624 -
ccactaattatgagtctagt

SEQ ID NO: 192826 - DNA, 20 bp, Artificial Sequence
  Synthetic oligonucleotide; CGATGTTT chr2 60464608 60464627 60464611 -
gtctagtcctggatttcaat

SEQ ID NO: 192827 - DNA, 20 bp, Artificial Sequence
  Synthetic oligonucleotide; CTTGGATT chr2 60464548 60464567 60464551 -
agtgatgaacgtgttaagga

SEQ ID NO: 192828 - DNA, 20 bp, Artificial Sequence
  Synthetic oligonucleotide; GATAGTTT chr2 60464422 60464441 60464425 -
ggatcatgtagttggaacca

SEQ ID NO: 192829 - DNA, 20 bp, Artificial Sequence
  Synthetic oligonucleotide; TGAAGCTT chr2 60464345 60464364 60464348 -
atttataaaaatgttctcaa

SEQ ID NO: 192830 - DNA, 20 bp, Artificial Sequence
  Synthetic oligonucleotide; CAGCGTTT chr2 60464277 60464296 60464280 -
agataatgtgatactaatgt

SEQ ID NO: 192831 - DNA, 20 bp, Artificial Sequence
  Synthetic oligonucleotide; AAATGTTT chr2 60464225 60464244 60464228 -
ttcccccttccacattagac

SEQ ID NO: 192832 - DNA, 20 bp, Artificial Sequence
  Synthetic oligonucleotide; TCTTGTTT chr2 60464187 60464206 60464190 -
tttggtatcttaccatctaa

SEQ ID NO: 192833 - DNA, 20 bp, Artificial Sequence
  Synthetic oligonucleotide; AAGAGATT chr2 60464179 60464198 60464182 -
cttaccatctaatcttgttt

SEQ ID NO: 192834 - DNA, 20 bp, Artificial Sequence
  Synthetic oligonucleotide; GTGGGATT chr2 60464148 60464167 60464151 -
ccaggagtgagatatattga

SEQ ID NO: 192835 - DNA, 20 bp, Artificial Sequence
  Synthetic oligonucleotide; AAGTGCTT chr2 60464085 60464104 60464088 -
caggagtccattatttagac

SEQ ID NO: 192836 - DNA, 20 bp, Artificial Sequence
  Synthetic oligonucleotide; GCTGGCTT chr2 60464070 60464089 60464073 -
tagacaagtgcttgagcgag

SEQ ID NO: 192837 - DNA, 20 bp, Artificial Sequence
  Synthetic oligonucleotide; CAGTGTTT chr2 60464050 60464069 60464053 -
gctggcttattttggaatac

SEQ ID NO: 192838 - DNA, 20 bp, Artificial Sequence
  Synthetic oligonucleotide; GCCGGCTT chr2 60464021 60464040 60464024 -
ggggctcctgagaagaccct

SEQ ID NO: 192839 - DNA, 20 bp, Artificial Sequence
  Synthetic oligonucleotide; AATTGATT chr2 60463980 60463999 60463983 -
gctaaatggaggcatcatat

SEQ ID NO: 192840 - DNA, 20 bp, Artificial Sequence
  Synthetic oligonucleotide; GGTAGATT chr2 60463943 60463962 60463946 -
ttctcactcttaacctccct

SEQ ID NO: 192841 - DNA, 20 bp, Artificial Sequence
  Synthetic oligonucleotide; AAAAGTTT chr2 60463847 60463866 60463850 -
ccttcttttaaaagaaggag

SEQ ID NO: 192842 - DNA, 20 bp, Artificial Sequence
  Synthetic oligonucleotide; TAAGGCTT chr2 60463819 60463838 60463822 -
gttatttctcagttatattt

SEQ ID NO: 192843 - DNA, 20 bp, Artificial Sequence
  Synthetic oligonucleotide; GGAAGTTT chr2 60463793 60463812 60463796 -
tttttttttcagaatctctg

SEQ ID NO: 192844 - DNA, 20 bp, Artificial Sequence
  Synthetic oligonucleotide; TTTTGTTT chr2 60463788 60463807 60463791 -
ttttcagaatctctgggaag

SEQ ID NO: 192845 - DNA, 20 bp, Artificial Sequence
  Synthetic oligonucleotide; GACGGCTT chr2 60463524 60463543 60463527 -
ttaagcagggcccctctcca

SEQ ID NO: 192846 - DNA, 20 bp, Artificial Sequence
  Synthetic oligonucleotide; TTCTGTTT chr2 60463480 60463499 60463483 -
tgactagctgaactgtatct

SEQ ID NO: 192847 - DNA, 20 bp, Artificial Sequence
  Synthetic oligonucleotide; GGCTGTTT chr2 60463340 60463359 60463343 -
ctgctgcctgtcatggcgct

SEQ ID NO: 192848 - DNA, 20 bp, Artificial Sequence
  Synthetic oligonucleotide; GTCTGCTT chr2 60463305 60463324 60463308 -
tccttaaactaggatgctgt

SEQ ID NO: 192849 - DNA, 20 bp, Artificial Sequence
  Synthetic oligonucleotide; TAAAGATT chr2 60463231 60463250 60463234 -
tctgaccgggggacaactcc

SEQ ID NO: 192850 - DNA, 20 bp, Artificial Sequence
  Synthetic oligonucleotide; TGAAGTTT chr2 60463196 60463215 60463199 -
gcctatccgttaaatctgaa

SEQ ID NO: 192851 - DNA, 20 bp, Artificial Sequence
  Synthetic oligonucleotide; TTCAGATT chr2 60463184 60463203 60463187 -
aatctgaatgaagtttttct

SEQ ID NO: 192852 - DNA, 20 bp, Artificial Sequence
  Synthetic oligonucleotide; GTGTGTTT chr2 60463010 60463029 60463013 -
tttaacaatatcaacaatta

SEQ ID NO: 192853 - DNA, 20 bp, Artificial Sequence
  Synthetic oligonucleotide; AAATGTTT chr2 60462921 60462940 60462924 -
ccttttttgatacctctatg

SEQ ID NO: 192854 - DNA, 20 bp, Artificial Sequence
  Synthetic oligonucleotide; CTGGGATT chr2 60462869 60462888 60462872 -
acccaggggggaatagaaag

SEQ ID NO: 192855 - DNA, 20 bp, Artificial Sequence
  Synthetic oligonucleotide; AAAAGTTT chr2 60462851 60462870 60462854 -
agctgggatttaggaagcca

SEQ ID NO: 192856 - DNA, 20 bp, Artificial Sequence
  Synthetic oligonucleotide; CCAAGTTT chr2 60462827 60462846 60462830 -
gtttccttgggtcaccttgt

SEQ ID NO: 192857 - DNA, 20 bp, Artificial Sequence
  Synthetic oligonucleotide; GATGGCTT chr2 60462780 60462799 60462783 -
acagaggcacatggagatga

SEQ ID NO: 192858 - DNA, 20 bp, Artificial Sequence
  Synthetic oligonucleotide; GAAAGTTT chr2 60462746 60462765 60462749 -
aactacagctgatggaactg

SEQ ID NO: 192859 - DNA, 20 bp, Artificial Sequence
  Synthetic oligonucleotide; TCAGGATT chr2 60462679 60462698 60462682 -
catcctcaagccagaactgg

SEQ ID NO: 192860 - DNA, 20 bp, Artificial Sequence
  Synthetic oligonucleotide; TTCTGCTT chr2 60462670 60462689 60462673 -
gccagaactggtcaggattt

SEQ ID NO: 192861 - DNA, 20 bp, Artificial Sequence
  Synthetic oligonucleotide; TGGGGATT chr2 60462662 60462681 60462665 -
tggtcaggatttttctgctt

SEQ ID NO: 192862 - DNA, 20 bp, Artificial Sequence
  Synthetic oligonucleotide; CTGAGTTT chr2 60462635 60462654 60462638 -
tggatataaaatttctagaa

SEQ ID NO: 192863 - DNA, 20 bp, Artificial Sequence
  Synthetic oligonucleotide; GAGGGCTT chr2 60462549 60462568 60462552 -
ggcacagggggtaggtcagt

SEQ ID NO: 192864 - DNA, 20 bp, Artificial Sequence
  Synthetic oligonucleotide; CAGTGATT chr2 60462466 60462485 60462469 -
gcaattgctgatgcccgcct

SEQ ID NO: 192865 - DNA, 20 bp, Artificial Sequence
  Synthetic oligonucleotide; CATGGTTT chr2 60462368 60462387 60462371 -
caaacagccattcaccagtg

SEQ ID NO: 192866 - DNA, 20 bp, Artificial Sequence
  Synthetic oligonucleotide; CATGGATT chr2 60462336 60462355 60462339 -
tgcaacacgcacagaacact

SEQ ID NO: 192867 - DNA, 20 bp, Artificial Sequence
  Synthetic oligonucleotide; ATGGGATT chr2 60462230 60462249 60462233 -
tccttcccagccacctctcc

SEQ ID NO: 192868 - DNA, 20 bp, Artificial Sequence
  Synthetic oligonucleotide; AGAGGCTT chr2 60462166 60462185 60462169 -
ataccaggatcagtatcgag

SEQ ID NO: 192869 - DNA, 20 bp, Artificial Sequence
  Synthetic oligonucleotide; GGGCGCTT chr2 60462144 60462163 60462147 -
aggcttccggcctggcagaa

SEQ ID NO: 192870 - DNA, 20 bp, Artificial Sequence
  Synthetic oligonucleotide; CCCTGTTT chr2 60462122 60462141 60462125 -
gcgctttccacccactcccc

SEQ ID NO: 192871 - DNA, 20 bp, Artificial Sequence
  Synthetic oligonucleotide; CATGGATT chr2 60461977 60461996 60461980 -
atggctatggagcctcccgc

SEQ ID NO: 192872 - DNA, 20 bp, Artificial Sequence
  Synthetic oligonucleotide; TACGGCTT chr2 60461376 60461395 60461379 -
cggagagcgagagggtggac

SEQ ID NO: 192873 - DNA, 20 bp, Artificial Sequence
  Synthetic oligonucleotide; CTTAGCTT chr2 60460893 60460912 60460896 -
ggcagctcaaagatcccttc

SEQ ID NO: 192874 - DNA, 20 bp, Artificial Sequence
  Synthetic oligonucleotide; GGGAGTTT chr2 60460830 60460849 60460833 -
cggagcactcctcggagaac

SEQ ID NO: 192875 - DNA, 20 bp, Artificial Sequence
  Synthetic oligonucleotide; TTGCGCTT chr2 60460824 60460843 60460827 -
actcctcggagaacgggagt

SEQ ID NO: 192876 - DNA, 20 bp, Artificial Sequence
  Synthetic oligonucleotide; GGACGTTT chr2 60460522 60460541 60460525 -
acgcatggccaggtggggaa

SEQ ID NO: 192877 - DNA, 20 bp, Artificial Sequence
  Synthetic oligonucleotide; GTAGGATT chr2 60460317 60460336 60460320 -
gccctccagccccactccct

SEQ ID NO: 192878 - DNA, 20 bp, Artificial Sequence
  Synthetic oligonucleotide; ATGTGATT chr2 60460296 60460315 60460299 -
taggatttttttctagtccc

SEQ ID NO: 192879 - DNA, 20 bp, Artificial Sequence
  Synthetic oligonucleotide; GAGTGCTT chr2 60460242 60460261 60460245 -
taacgaagctaagaatatga

SEQ ID NO: 192880 - DNA, 20 bp, Artificial Sequence
  Synthetic oligonucleotide; ACCTGTTT chr2 60460223 60460242 60460226 -
agagtgcttgtcaccagcac

SEQ ID NO: 192881 - DNA, 20 bp, Artificial Sequence
  Synthetic oligonucleotide; CACCGTTT chr2 60460157 60460176 60460160 -
ttttttttcctttatgttct

SEQ ID NO: 192882 - DNA, 20 bp, Artificial Sequence
  Synthetic oligonucleotide; GTATGTTT chr2 60460066 60460085 60460069 -
tgcaataatttacatgttgt

SEQ ID NO: 192883 - DNA, 20 bp, Artificial Sequence
  Synthetic oligonucleotide; TGCTGTTT chr2 60459980 60459999 60459983 -
tcgttgctgagcaaacatgt

SEQ ID NO: 192884 - DNA, 20 bp, Artificial Sequence
  Synthetic oligonucleotide; TACAGTTT chr2 60459896 60459915 60459899 -
attctgtaatacatatcatg

SEQ ID NO: 192885 - DNA, 20 bp, Artificial Sequence
  Synthetic oligonucleotide; TTTGGATT chr2 60459858 60459877 60459861 -
cgtgaggaggaaaaacagtc

SEQ ID NO: 192886 - DNA, 20 bp, Artificial Sequence
  Synthetic oligonucleotide; ACAAGTTT chr2 60459716 60459735 60459719 -
caaattaacagaaaaacaga

SEQ ID NO: 192887 - DNA, 20 bp, Artificial Sequence
  Synthetic oligonucleotide; TTTGGTTT chr2 60459699 60459718 60459702 -
agaacaagtttattctatca

SEQ ID NO: 192888 - DNA, 20 bp, Artificial Sequence
  Synthetic oligonucleotide; TGTAGCTT chr2 60459627 60459646 60459630 -
ctttctacttgttataaact

SEQ ID NO: 192889 - DNA, 20 bp, Artificial Sequence
  Synthetic oligonucleotide; TTTAGTTT chr2 60459497 60459516 60459500 -
tagttaatcatcatttttcc

SEQ ID NO: 192890 - DNA, 20 bp, Artificial Sequence
  Synthetic oligonucleotide; AACTGATT chr2 60459475 60459494 60459478 -
tagtttaattttataaacaa

SEQ ID NO: 192891 - DNA, 20 bp, Artificial Sequence
  Synthetic oligonucleotide; GAGAGCTT chr2 60459436 60459455 60459439 -
aaagctactttgctcctggt

SEQ ID NO: 192892 - DNA, 20 bp, Artificial Sequence
  Synthetic oligonucleotide; GGCTGTTT chr2 60459418 60459437 60459421 -
gtgagagcttaaaagaaatg

SEQ ID NO: 192893 - DNA, 20 bp, Artificial Sequence
  Synthetic oligonucleotide; CAAAGTTT chr2 60459406 60459425 60459409 -
aagaaatgggctgttttgcc

SEQ ID NO: 192894 - DNA, 20 bp, Artificial Sequence
  Synthetic oligonucleotide; CAATGATT chr2 60459385 60459404 60459388 -
aaagttttattttttttaaa

SEQ ID NO: 192895 - DNA, 20 bp, Artificial Sequence
  Synthetic oligonucleotide; ATTTGCTT chr2 60459303 60459322 60459306 -
ggagttcattttatgaagat

SEQ ID NO: 192896 - DNA, 20 bp, Artificial Sequence
  Synthetic oligonucleotide; TAAGGTTT chr2 60459168 60459187 60459171 -
tgaaaggaagaggctgacaa

SEQ ID NO: 192897 - DNA, 20 bp, Artificial Sequence
  Synthetic oligonucleotide; ATATGATT chr2 60459136 60459155 60459139 -
gaggggaacagaagaaaata

SEQ ID NO: 192898 - DNA, 20 bp, Artificial Sequence
  Synthetic oligonucleotide; TGATGATT chr2 60459060 60459079 60459063 -
ataagctaatattgatacaa

SEQ ID NO: 192899 - DNA, 20 bp, Artificial Sequence
  Synthetic oligonucleotide; AGAGGATT chr2 60458900 60458919 60458903 -
gctatttgtgttaacatgga

SEQ ID NO: 192900 - DNA, 20 bp, Artificial Sequence
  Synthetic oligonucleotide; CATTGTTT chr2 60458892 60458911 60458895 -
tgttaacatggaagaggatt

SEQ ID NO: 192901 - DNA, 20 bp, Artificial Sequence
  Synthetic oligonucleotide; CCCAGTTT chr2 60458707 60458726 60458710 -
taagtgcactgtacaatttt

SEQ ID NO: 192902 - DNA, 20 bp, Artificial Sequence
  Synthetic oligonucleotide; TTGAGCTT chr2 60458578 60458597 60458581 -
gccagccatttacttgacta

SEQ ID NO: 192903 - DNA, 20 bp, Artificial Sequence
  Synthetic oligonucleotide; GAATGATT chr2 60458507 60458526 60458510 -
aatacacttaacatagaaat

SEQ ID NO: 192904 - DNA, 20 bp, Artificial Sequence
  Synthetic oligonucleotide; GATTGCTT chr2 60458503 60458522 60458506 -
cacttaacatagaaatgaat

SEQ ID NO: 192905 - DNA, 20 bp, Artificial Sequence
  Synthetic oligonucleotide; TTTCGCTT chr2 60458497 60458516 60458500 -
acatagaaatgaatgattgc

SEQ ID NO: 192906 - DNA, 20 bp, Artificial Sequence
  Synthetic oligonucleotide; CAAGGATT chr2 60458481 60458500 60458484 -
ttgctttcgcttctacagtg

SEQ ID NO: 192907 - DNA, 20 bp, Artificial Sequence
  Synthetic oligonucleotide; TTATGTTT chr2 60458411 60458430 60458414 -
tttttttaaaaaacacttca

SEQ ID NO: 192908 - DNA, 20 bp, Artificial Sequence
  Synthetic oligonucleotide; AAAGGTTT chr2 60458263 60458282 60458266 -
aaaaaaaacatacattgggg

SEQ ID NO: 192909 - DNA, 20 bp, Artificial Sequence
  Synthetic oligonucleotide; TTAAGATT chr2 60458257 60458276 60458260 -
aacatacattggggaaaggt

SEQ ID NO: 192910 - DNA, 20 bp, Artificial Sequence
  Synthetic oligonucleotide; TGTTGATT chr2 60458215 60458234 60458218 -
tataggaaaatgcacactca

SEQ ID NO: 192911 - DNA, 20 bp, Artificial Sequence
  Synthetic oligonucleotide; TGAAGCTT chr2 60458111 60458130 60458114 -
aggcactatagtatttatat

SEQ ID NO: 192912 - DNA, 20 bp, Artificial Sequence
  Synthetic oligonucleotide; TGTTGCTT chr2 60458092 60458111 60458095 -
ttgaagcttgtatttttaac

SEQ ID NO: 192913 - DNA, 20 bp, Artificial Sequence
  Synthetic oligonucleotide; GTATGCTT chr2 60457976 60457995 60457979 -
taatatagtgcaaattattt

SEQ ID NO: 192914 - DNA, 20 bp, Artificial Sequence
  Synthetic oligonucleotide; GGCGGTTT chr2 60457907 60457926 60457910 -
cagatgagaagccatataat

SEQ ID NO: 192915 - DNA, 20 bp, Artificial Sequence
  Synthetic oligonucleotide; GTTGGTTT chr2 60457789 60457808 60457792 -
cagtactgcaagctaataac

SEQ ID NO: 192916 - DNA, 20 bp, Artificial Sequence
  Synthetic oligonucleotide; GTGTGCTT chr2 60457773 60457792 60457776 -
taacgttggtttgttatgta

SEQ ID NO: 192917 - DNA, 20 bp, Artificial Sequence
  Synthetic oligonucleotide; CAATGTTT chr2 60457670 60457689 60457673 -
aaggaaaaaaaaaaaaaaac

SEQ ID NO: 192918 - DNA, 20 bp, Artificial Sequence
  Synthetic oligonucleotide; TGCAGTTT chr2 60457662 60457681 60457665 -
aaaaaaaaaaaccaatgttt

SEQ ID NO: 192919 - DNA, 20 bp, Artificial Sequence
  Synthetic oligonucleotide; TGGTGCTT chr2 60457633 60457652 60457636 -
tttcattgccaaaaactaaa

SEQ ID NO: 192920 - DNA, 20 bp, Artificial Sequence
  Synthetic oligonucleotide; TTTAGATT chr2 60457621 60457640 60457624 -
aaactaaatggtgctttata

SEQ ID NO: 192921 - DNA, 20 bp, Artificial Sequence
  Synthetic oligonucleotide; GCCCGCTT chr2 60457576 60457595 60457579 -
caaagcatattaaagagaaa

SEQ ID NO: 192922 - DNA, 20 bp, Artificial Sequence
  Synthetic oligonucleotide; AGCTGTTT chr2 60457498 60457517 60457501 -
ttttctattcctgtaatgaa

SEQ ID NO: 192923 - DNA, 20 bp, Artificial Sequence
  Synthetic oligonucleotide; TATTGCTT chr2 60457444 60457463 60457447 -
ctatgggagtcactatttat

SEQ ID NO: 192924 - DNA, 20 bp, Artificial Sequence
  Synthetic oligonucleotide; CTTTGTTT chr2 60457389 60457408 60457392 -
taatttgatcttttattttt

SEQ ID NO: 192925 - DNA, 20 bp, Artificial Sequence
  Synthetic oligonucleotide; CCTGGCTT chr2 60457341 60457360 60457344 -
atgaccaaaggtcattacaa

SEQ ID NO: 192926 - DNA, 20 bp, Artificial Sequence
  Synthetic oligonucleotide; ATTTGTTT chr2 60457325 60457344 60457328 -
acaacctggctttttattgt

SEQ ID NO: 192927 - DNA, 20 bp, Artificial Sequence
  Synthetic oligonucleotide; CTGTGTTT chr2 60457281 60457300 60457284 -
tctattggaaaaaccactgt

SEQ ID NO: 192928 - DNA, 20 bp, Artificial Sequence
  Synthetic oligonucleotide; GTAAGCTT chr2 60457190 60457209 60457193 -
aaaaaattaaagtacacatt

SEQ ID NO: 192929 - DNA, 20 bp, Artificial Sequence
  Synthetic oligonucleotide; ACAGGTTT chr2 60457135 60457154 60457138 -
aaattacttgcaagaaaata

SEQ ID NO: 192930 - DNA, 20 bp, Artificial Sequence
  Synthetic oligonucleotide; TCAGGATT chr2 60457103 60457122 60457106 -
agaaggccagtcagtctttt

SEQ ID NO: 192931 - DNA, 20 bp, Artificial Sequence
  Synthetic oligonucleotide; CATAGTTT chr2 60457006 60457025 60457009 -
gacatatctcaaaccctgga

SEQ ID NO: 192932 - DNA, 20 bp, Artificial Sequence
  Synthetic oligonucleotide; TAAGGCTT chr2 60456998 60457017 60457001 -
tcaaaccctggacatagttt

SEQ ID NO: 192933 - DNA, 20 bp, Artificial Sequence
  Synthetic oligonucleotide; TCCAGTTT chr2 60456990 60457009 60456993 -
tggacatagttttaaggctt

SEQ ID NO: 192934 - DNA, 20 bp, Artificial Sequence
  Synthetic oligonucleotide; AATAGTTT chr2 60456980 60456999 60456983 -
tttaaggctttccagtttag

SEQ ID NO: 192935 - DNA, 20 bp, Artificial Sequence
  Synthetic oligonucleotide; AGGTGTTT chr2 60456960 60456979 60456963 -
aatagttttcaagaaatgga

SEQ ID NO: 192936 - DNA, 20 bp, Artificial Sequence
  Synthetic oligonucleotide; CCTTGCTT chr2 60456801 60456820 60456804 -
gttcttttctattctcccat

SEQ ID NO: 192937 - DNA, 20 bp, Artificial Sequence
  Synthetic oligonucleotide; AAAAGATT chr2 60456773 60456792 60456776 -
tatcttagaacataatgtaa

SEQ ID NO: 192938 - DNA, 20 bp, Artificial Sequence
  Synthetic oligonucleotide; TTTGGTTT chr2 60456745 60456764 60456748 -
tttttaaaaaaaatcagctc

SEQ ID NO: 192939 - DNA, 20 bp, Artificial Sequence
  Synthetic oligonucleotide; TCAGGTTT chr2 60456667 60456686 60456670 -
aaaatctggaaacaaaggca

SEQ ID NO: 192940 - DNA, 20 bp, Artificial Sequence
  Synthetic oligonucleotide; TTTTGTTT chr2 60456662 60456681 60456665 -
ctggaaacaaaggcatcagg

SEQ ID NO: 192941 - DNA, 20 bp, Artificial Sequence
  Synthetic oligonucleotide; TTTTGTTT chr2 60456657 60456676 60456660 -
aacaaaggcatcaggttttg

SEQ ID NO: 192942 - DNA, 20 bp, Artificial Sequence
  Synthetic oligonucleotide; TTTTGTTT chr2 60456652 60456671 60456655 -
aggcatcaggttttgttttg

SEQ ID NO: 192943 - DNA, 20 bp, Artificial Sequence
  Synthetic oligonucleotide; TTTTGTTT chr2 60456647 60456666 60456650 -
tcaggttttgttttgttttg

SEQ ID NO: 192944 - DNA, 20 bp, Artificial Sequence
  Synthetic oligonucleotide; TTTTGTTT chr2 60456642 60456661 60456645 -
ttttgttttgttttgttttg

SEQ ID NO: 192945 - DNA, 20 bp, Artificial Sequence
  Synthetic oligonucleotide; CACTGATT chr2 60456544 60456563 60456547 -
gtgaaatctttggaatcagc

SEQ ID NO: 192946 - DNA, 20 bp, Artificial Sequence
  Synthetic oligonucleotide; AGTGGTTT chr2 60456523 60456542 60456526 -
actgatttcctgagatgcat

SEQ ID NO: 192947 - DNA, 20 bp, Artificial Sequence
  Synthetic oligonucleotide; TACAGATT chr2 60456479 60456498 60456482 -
atcccaggaaccctagatgc

SEQ ID NO: 192948 - DNA, 20 bp, Artificial Sequence
  Synthetic oligonucleotide; AGGTGTTT chr2 60456466 60456485 60456469 -
tagatgctacagattacttt

SEQ ID NO: 192949 - DNA, 20 bp, Artificial Sequence
  Synthetic oligonucleotide; ATTTGCTT chr2 60456319 60456338 60456322 -
tactgcatgttgcagcatct

SEQ ID NO: 192950 - DNA, 20 bp, Artificial Sequence
  Synthetic oligonucleotide; AATAGTTT chr2 60456111 60456130 60456114 -
tgccttttatctgaggcaag

SEQ ID NO: 192951 - DNA, 20 bp, Artificial Sequence
  Synthetic oligonucleotide; CAATGTTT chr2 60456078 60456097 60456081 -
ttctaaagtataaagaaagt

SEQ ID NO: 192952 - DNA, 20 bp, Artificial Sequence
  Synthetic oligonucleotide; GCCAGTTT chr2 60456062 60456081 60456065 -
aagtcaatgttttctgaaaa

SEQ ID NO: 192953 - DNA, 20 bp, Artificial Sequence
  Synthetic oligonucleotide; TGATGTTT chr2 60455950 60455969 60455953 -
cgtgcggtaccttgagaact

SEQ ID NO: 192954 - DNA, 20 bp, Artificial Sequence
  Synthetic oligonucleotide; ATGTGTTT chr2 60455914 60455933 60455917 -
acttagaaaagatatactgt

SEQ ID NO: 192955 - DNA, 20 bp, Artificial Sequence
  Synthetic oligonucleotide; TTTGGATT chr2 60455908 60455927 60455911 -
aaaagatatactgtatgtgt

SEQ ID NO: 192956 - DNA, 20 bp, Artificial Sequence
  Synthetic oligonucleotide; TTAGGTTT chr2 60455902 60455921 60455905 -
tatactgtatgtgttttgga

SEQ ID NO: 192957 - DNA, 20 bp, Artificial Sequence
  Synthetic oligonucleotide; GCCAGCTT chr2 60455835 60455854 60455838 -
aaataattccccagtgccat

SEQ ID NO: 192958 - DNA, 20 bp, Artificial Sequence
  Synthetic oligonucleotide; GTAGGTTT chr2 60455733 60455752 60455736 -
ggagctatgagtgcaactgt

SEQ ID NO: 192959 - DNA, 20 bp, Artificial Sequence
  Synthetic oligonucleotide; TTAGGTTT chr2 60455675 60455694 60455678 -
atatgctgctcttagcgtaa

SEQ ID NO: 192960 - DNA, 20 bp, Artificial Sequence
  Synthetic oligonucleotide; CACAGATT chr2 60455562 60455581 60455565 -
gcaaacatctggtgataaat

SEQ ID NO: 192961 - DNA, 20 bp, Artificial Sequence
  Synthetic oligonucleotide; TTATGTTT chr2 60455556 60455575 60455559 -
atctggtgataaatcacaga

SEQ ID NO: 192962 - DNA, 20 bp, Artificial Sequence
  Synthetic oligonucleotide; GTTTGATT chr2 60455552 60455571 60455555 -
ggtgataaatcacagattat

SEQ ID NO: 192963 - DNA, 20 bp, Artificial Sequence
  Synthetic oligonucleotide; GTAAGTTT chr2 60455249 60455268 60455252 -
atgtctcttaaaatcctcaa

SEQ ID NO: 192964 - DNA, 20 bp, Artificial Sequence
  Synthetic oligonucleotide; ACAGGCTT chr2 60455236 60455255 60455239 -
tcctcaagtaagtttttgta

SEQ ID NO: 192965 - DNA, 20 bp, Artificial Sequence
  Synthetic oligonucleotide; TGATGCTT chr2 60455193 60455212 60455196 -
tgttctctacatacctgaac

SEQ ID NO: 192966 - DNA, 20 bp, Artificial Sequence
  Synthetic oligonucleotide; CACAGATT chr2 60455118 60455137 60455121 -
ataccgcaaattctatttct

SEQ ID NO: 192967 - DNA, 20 bp, Artificial Sequence
  Synthetic oligonucleotide; CTTTGTTT chr2 60455048 60455067 60455051 -
gaacccatttgctatcctct

SEQ ID NO: 192968 - DNA, 20 bp, Artificial Sequence
  Synthetic oligonucleotide; TTGAGTTT chr2 60454936 60454955 60454939 -
tggcagaaagtgtgaagtag

SEQ ID NO: 192969 - DNA, 20 bp, Artificial Sequence
  Synthetic oligonucleotide; AACTGTTT chr2 60454903 60454922 60454906 -
agggcattctgtagatatag

SEQ ID NO: 192970 - DNA, 20 bp, Artificial Sequence
  Synthetic oligonucleotide; GATGGCTT chr2 60454807 60454826 60454810 -
cttgaaaggaagtggcggga

SEQ ID NO: 192971 - DNA, 20 bp, Artificial Sequence
  Synthetic oligonucleotide; GGTGGTTT chr2 60454765 60454784 60454768 -
ttggagaaataaggaaatga

SEQ ID NO: 192972 - DNA, 20 bp, Artificial Sequence
  Synthetic oligonucleotide; CACAGTTT chr2 60454748 60454767 60454751 -
tgaggtggtttattcacaga

SEQ ID NO: 192973 - DNA, 20 bp, Artificial Sequence
  Synthetic oligonucleotide; CTGGGATT chr2 60454729 60454748 60454732 -
acacagtttgctgaaaggta

SEQ ID NO: 192974 - DNA, 20 bp, Artificial Sequence
  Synthetic oligonucleotide; TCCTGCTT chr2 60454672 60454691 60454675 -
aagcctcaggccccatcctc

SEQ ID NO: 192975 - DNA, 20 bp, Artificial Sequence
  Synthetic oligonucleotide; CAGTGTTT chr2 60454628 60454647 60454631 -
agagactgagggaggaaata

SEQ ID NO: 192976 - DNA, 20 bp, Artificial Sequence
  Synthetic oligonucleotide; TCTTGTTT chr2 60454620 60454639 60454623 -
agggaggaaatacagtgttt

SEQ ID NO: 192977 - DNA, 20 bp, Artificial Sequence
  Synthetic oligonucleotide; TTACGATT chr2 60454539 60454558 60454542 -
ttgtaactgtgtgttcctca

SEQ ID NO: 192978 - DNA, 20 bp, Artificial Sequence
  Synthetic oligonucleotide; ATGGGATT chr2 60454417 60454436 60454420 -
ggaactttgccgatatgagg

SEQ ID NO: 192979 - DNA, 20 bp, Artificial Sequence
  Synthetic oligonucleotide; ACCTGCTT chr2 60454394 60454413 60454397 -
ggattggcagagttctctca

SEQ ID NO: 192980 - DNA, 20 bp, Artificial Sequence
  Synthetic oligonucleotide; AAATGTTT chr2 60454382 60454401 60454385 -
ttctctcaacctgcttggaa

SEQ ID NO: 192981 - DNA, 20 bp, Artificial Sequence
  Synthetic oligonucleotide; AGCAGATT chr2 60454335 60454354 60454338 -
ttaaaaggcatgagccatct

SEQ ID NO: 192982 - DNA, 20 bp, Artificial Sequence
  Synthetic oligonucleotide; TTCTGCTT chr2 60454163 60454182 60454166 -
atgggttgtccggtctgcac

SEQ ID NO: 192983 - DNA, 20 bp, Artificial Sequence
  Synthetic oligonucleotide; CGCTGTTT chr2 60454129 60454148 60454132 -
atctcgttatcccattagcc

SEQ ID NO: 192984 - DNA, 20 bp, Artificial Sequence
  Synthetic oligonucleotide; GGCTGTTT chr2 60454071 60454090 60454074 -
ctcagcctttaggggaatgg

SEQ ID NO: 192985 - DNA, 20 bp, Artificial Sequence
  Synthetic oligonucleotide; ATACGTTT chr2 60453896 60453915 60453899 -
cagctcgatggttgatccaa

SEQ ID NO: 192986 - DNA, 20 bp, Artificial Sequence
  Synthetic oligonucleotide; CTGTGCTT chr2 60453752 60453771 60453755 -
cccctaaacccatagggggg

SEQ ID NO: 192987 - DNA, 20 bp, Artificial Sequence
  Synthetic oligonucleotide; AAGGGTTT chr2 60453665 60453684 60453668 -
attggtagcaggttggacga

SEQ ID NO: 192988 - DNA, 20 bp, Artificial Sequence
  Synthetic oligonucleotide; GTTTGATT chr2 60453661 60453680 60453664 -
gtagcaggttggacgaaagg

SEQ ID NO: 192989 - DNA, 20 bp, Artificial Sequence
  Synthetic oligonucleotide; ATGGGATT chr2 60453601 60453620 60453604 -
gacttagcgctggactggga

SEQ ID NO: 192990 - DNA, 20 bp, Artificial Sequence
  Synthetic oligonucleotide; CCCTGCTT chr2 60453453 60453472 60453456 -
ggggagaggaggccccaggc

SEQ ID NO: 192991 - DNA, 20 bp, Artificial Sequence
  Synthetic oligonucleotide; TGCTGCTT chr2 60453370 60453389 60453373 -
cacatccggactcccagttc

SEQ ID NO: 192992 - DNA, 20 bp, Artificial Sequence
  Synthetic oligonucleotide; GCATGTTT chr2 60453261 60453280 60453264 -
ccaaaaaagaaaagaaaact

SEQ ID NO: 192993 - DNA, 20 bp, Artificial Sequence
  Synthetic oligonucleotide; GGCAGTTT chr2 60453240 60453259 60453243 -
catgtttgaaagaaactaca

SEQ ID NO: 192994 - DNA, 20 bp, Artificial Sequence
  Synthetic oligonucleotide; TCTGGTTT chr2 60453201 60453220 60453204 -
tgagagcaactcttttgggt

SEQ ID NO: 192995 - DNA, 20 bp, Artificial Sequence
  Synthetic oligonucleotide; CAGAGATT chr2 60453187 60453206 60453190 -
ttgggttctggttttctctt

SEQ ID NO: 192996 - DNA, 20 bp, Artificial Sequence
  Synthetic oligonucleotide; GGCTGCTT chr2 60453157 60453176 60453160 -
ttcgcctcttgtaaatcatt

SEQ ID NO: 192997 - DNA, 20 bp, Artificial Sequence
  Synthetic oligonucleotide; TCATGTTT chr2 60453127 60453146 60453130 -
acgttgaacttgatgacatt

SEQ ID NO: 192998 - DNA, 20 bp, Artificial Sequence
  Synthetic oligonucleotide; TGCTGCTT chr2 60453113 60453132 60453116 -
gacatttcatgttttcgttg

SEQ ID NO: 192999 - DNA, 20 bp, Artificial Sequence
  Synthetic oligonucleotide; ATCAGTTT chr2 60453101 60453120 60453104 -
tttcgttgtgctgcttttac

SEQ ID NO: 193000 - DNA, 20 bp, Artificial Sequence
  Synthetic oligonucleotide; TTTTGATT chr2 60453096 60453115 60453099 -
ttgtgctgcttttacatcag

SEQ ID NO: 193001 - DNA, 20 bp, Artificial Sequence
  Synthetic oligonucleotide; TTTTGTTT chr2 60453088 60453107 60453091 -
cttttacatcagttttgatt

SEQ ID NO: 193002 - DNA, 20 bp, Artificial Sequence
  Synthetic oligonucleotide; GACTGTTT chr2 60453007 60453026 60453010 -
cccgctctcctcaaccaaag

SEQ ID NO: 193003 - DNA, 20 bp, Artificial Sequence
  Synthetic oligonucleotide; CTAAGTTT chr2 60452995 60453014 60452998 -
aaccaaaggactgtttctta

SEQ ID NO: 193004 - DNA, 20 bp, Artificial Sequence
  Synthetic oligonucleotide; AAGTGTTT chr2 60452971 60452990 60452974 -
gttttctcagtcataagggc

SEQ ID NO: 193005 - DNA, 20 bp, Artificial Sequence
  Synthetic oligonucleotide; CCGAGTTT chr2 60452948 60452967 60452951 -
tgtttccttccaggtgtgtc

SEQ ID NO: 193006 - DNA, 20 bp, Artificial Sequence
  Synthetic oligonucleotide; CTGAGTTT chr2 60452822 60452841 60452825 -
agatacttggggaggggagg

SEQ ID NO: 193007 - DNA, 20 bp, Artificial Sequence
  Synthetic oligonucleotide; TCATGCTT chr2 60452810 60452829 60452813 -
aggggaggctgagtttgaaa

SEQ ID NO: 193008 - DNA, 20 bp, Artificial Sequence
  Synthetic oligonucleotide; GTTGGTTT chr2 60452778 60452797 60452781 -
tgccagtggctcgacctgtg

SEQ ID NO: 193009 - DNA, 20 bp, Artificial Sequence
  Synthetic oligonucleotide; GGCAGTTT chr2 60452616 60452635 60452619 -
ccagagagctcaagatgtgt

SEQ ID NO: 193010 - DNA, 20 bp, Artificial Sequence
  Synthetic oligonucleotide; GCTAGTTT chr2 60452504 60452523 60452507 -
tcagcgtggtctgtcatcct

SEQ ID NO: 193011 - DNA, 20 bp, Artificial Sequence
  Synthetic oligonucleotide; TGATGTTT chr2 60452495 60452514 60452498 -
tctgtcatcctgctagtttg

SEQ ID NO: 193012 - DNA, 20 bp, Artificial Sequence
  Synthetic oligonucleotide; CCTTGTTT chr2 60452232 60452251 60452235 -
atgcgcatgagtccccaacc

SEQ ID NO: 193013 - DNA, 20 bp, Artificial Sequence
  Synthetic oligonucleotide; GTGTGCTT chr2 60452196 60452215 60452199 -
tctatgttgtcttttaaaaa

SEQ ID NO: 193014 - DNA, 20 bp, Artificial Sequence
  Synthetic oligonucleotide; TGGAGCTT chr2 60452168 60452187 60452171 -
aacattgacacaataaatgt

SEQ ID NO: 193015 - DNA, 20 bp, Artificial Sequence
  Synthetic oligonucleotide; TGGTGTTT chr2 60452156 60452175 60452159 -
ataaatgttggagctttagg

SEQ ID NO: 193016 - DNA, 20 bp, Artificial Sequence
  Synthetic oligonucleotide; GTTTGCTT chr2 60452152 60452171 60452155 -
atgttggagctttaggtggt

SEQ ID NO: 193017 - DNA, 20 bp, Artificial Sequence
  Synthetic oligonucleotide; TAATGCTT chr2 60452131 60452150 60452134 -
tttgcttgttctttaatttt

SEQ ID NO: 193018 - DNA, 20 bp, Artificial Sequence
  Synthetic oligonucleotide; GGCTGCTT chr2 60452111 60452130 60452114 -
taatgcttataagacaatga

SEQ ID NO: 193019 - DNA, 20 bp, Artificial Sequence
  Synthetic oligonucleotide; TTATGATT chr2 60452105 60452124 60452108 -
ttataagacaatgaggctgc

SEQ ID NO: 193020 - DNA, 20 bp, Artificial Sequence
  Synthetic oligonucleotide; ACCTGTTT chr2 60452085 60452104 60452088 -
ttatgattttgtacttctgt

SEQ ID NO: 193021 - DNA, 20 bp, Artificial Sequence
  Synthetic oligonucleotide; AACAGATT chr2 60452047 60452066 60452050 -
cccatcgggtgggtaggagg

SEQ ID NO: 193022 - DNA, 20 bp, Artificial Sequence
  Synthetic oligonucleotide; TACCGCTT chr2 60452002 60452021 60452005 -
atgtaggaggggaactaggt

SEQ ID NO: 193023 - DNA, 20 bp, Artificial Sequence
  Synthetic oligonucleotide; TGCTGTTT chr2 60451906 60451925 60451909 -
aattaatgtagtagtaatat

SEQ ID NO: 193024 - DNA, 20 bp, Artificial Sequence
  Synthetic oligonucleotide; TGTGGTTT chr2 60451885 60451904 60451888 -
gctgtttattaatgctgaag

SEQ ID NO: 193025 - DNA, 20 bp, Artificial Sequence
  Synthetic oligonucleotide; TCCTGTTT chr2 60451816 60451835 60451819 -
gcataatatggcacgccgaa

SEQ ID NO: 193026 - DNA, 20 bp, Artificial Sequence
  Synthetic oligonucleotide; ATATGCTT chr2 60451801 60451820 60451804 -
ccgaatcctgtttttcaaat

SEQ ID NO: 193027 - DNA, 20 bp, Artificial Sequence
  Synthetic oligonucleotide; GCAGGATT chr2 60451779 60451798 60451782 -
atgcttttggtggctaccat

SEQ ID NO: 193028 - DNA, 20 bp, Artificial Sequence
  Synthetic oligonucleotide; TTTAGCTT chr2 60451755 60451774 60451758 -
gatttgaatttgtcttttaa

SEQ ID NO: 193029 - DNA, 20 bp, Artificial Sequence
  Synthetic oligonucleotide; AGTAGTTT chr2 60451694 60451713 60451697 -
taaagaaggtgataaatgtc

SEQ ID NO: 193030 - DNA, 20 bp, Artificial Sequence
  Synthetic oligonucleotide; GGCAGATT chr2 60451582 60451601 60451585 -
acttacatcaggaaatttgg

SEQ ID NO: 193031 - DNA, 20 bp, Artificial Sequence
  Synthetic oligonucleotide; CTCAGTTT chr2 60451419 60451438 60451422 -
ttaatttgcacagaactttt

SEQ ID NO: 193032 - DNA, 20 bp, Artificial Sequence
  Synthetic oligonucleotide; TACTGCTT chr2 60451402 60451421 60451405 -
tttctcagtttggtattttt

SEQ ID NO: 193033 - DNA, 20 bp, Artificial Sequence
  Synthetic oligonucleotide; ATAGGTTT chr2 60451353 60451372 60451356 -
aaacaacatagcaaattaaa

SEQ ID NO: 193034 - DNA, 20 bp, Artificial Sequence
  Synthetic oligonucleotide; TGTAGATT chr2 60451315 60451334 60451318 -
gagctcagacacctgtgtgc

SEQ ID NO: 193035 - DNA, 20 bp, Artificial Sequence
  Synthetic oligonucleotide; GCTAGATT chr2 60451255 60451274 60451258 -
tcctacctatccaccttctg

SEQ ID NO: 193036 - DNA, 20 bp, Artificial Sequence
  Synthetic oligonucleotide; CCTAGCTT chr2 60451246 60451265 60451249 -
tccaccttctggctagatta

SEQ ID NO: 193037 - DNA, 20 bp, Artificial Sequence
  Synthetic oligonucleotide; TCCTGCTT chr2 60451200 60451219 60451203 -
taattggcatgtgaattatt

SEQ ID NO: 193038 - DNA, 20 bp, Artificial Sequence
  Synthetic oligonucleotide; TGGAGATT chr2 60451072 60451091 60451075 -
cgacttctactttatggagg

SEQ ID NO: 193039 - DNA, 20 bp, Artificial Sequence
  Synthetic oligonucleotide; TGAGGCTT chr2 60451065 60451084 60451068 -
tactttatggaggtggagat

SEQ ID NO: 193040 - DNA, 20 bp, Artificial Sequence
  Synthetic oligonucleotide; AAGGGCTT chr2 60451048 60451067 60451051 -
gattgaggcttaccaaggtt

SEQ ID NO: 193041 - DNA, 20 bp, Artificial Sequence
  Synthetic oligonucleotide; CCAGGTTT chr2 60451003 60451022 60451006 -
taagagagaaagcagagaag

SEQ ID NO: 193042 - DNA, 20 bp, Artificial Sequence
  Synthetic oligonucleotide; TCTGGTTT chr2 60450995 60451014 60450998 -
aaagcagagaagccaggttt

SEQ ID NO: 193043 - DNA, 20 bp, Artificial Sequence
  Synthetic oligonucleotide; CTCTGTTT chr2 60450962 60450981 60450965 -
ccagagctaatttcaccaaa

SEQ ID NO: 193044 - DNA, 20 bp, Artificial Sequence
  Synthetic oligonucleotide; TGTGGCTT chr2 60450887 60450906 60450890 -
aatgttcacagacacacaca

SEQ ID NO: 193045 - DNA, 20 bp, Artificial Sequence
  Synthetic oligonucleotide; TGTGGCTT chr2 60450764 60450783 60450767 -
ccttgccatcacctttcccc

SEQ ID NO: 193046 - DNA, 20 bp, Artificial Sequence
  Synthetic oligonucleotide; CCCTGATT chr2 60450741 60450760 60450744 -
ggcttttccatgacaaataa

SEQ ID NO: 193047 - DNA, 20 bp, Artificial Sequence
  Synthetic oligonucleotide; GCCTGTTT chr2 60450724 60450743 60450727 -
taaccctgattgcacgagtg

SEQ ID NO: 193048 - DNA, 20 bp, Artificial Sequence
  Synthetic oligonucleotide; TAGGGTTT chr2 60450609 60450628 60450612 -
ttgctgaaacataagaccat

SEQ ID NO: 193049 - DNA, 20 bp, Artificial Sequence
  Synthetic oligonucleotide; GATGGCTT chr2 60450597 60450616 60450600 -
aagaccattagggtttctgt

SEQ ID NO: 193050 - DNA, 20 bp, Artificial Sequence
  Synthetic oligonucleotide; CTGTGTTT chr2 60450438 60450457 60450441 -
actacactttcatttctggt

SEQ ID NO: 193051 - DNA, 20 bp, Artificial Sequence
  Synthetic oligonucleotide; GTCAGTTT chr2 60450398 60450417 60450401 -
tttatatatttcttctcaga

SEQ ID NO: 193052 - DNA, 20 bp, Artificial Sequence
  Synthetic oligonucleotide; GTGGGATT chr2 60450366 60450385 60450369 -
ataagtggatatctctaaaa

SEQ ID NO: 193053 - DNA, 20 bp, Artificial Sequence
  Synthetic oligonucleotide; TATTGTTT chr2 60450321 60450340 60450324 -
taacagaagtggataaagga

SEQ ID NO: 193054 - DNA, 20 bp, Artificial Sequence
  Synthetic oligonucleotide; CATGGCTT chr2 60450250 60450269 60450253 -
acaaaaagactgtcttttcc

SEQ ID NO: 193055 - DNA, 20 bp, Artificial Sequence
  Synthetic oligonucleotide; CTCAGCTT chr2 60450050 60450069 60450053 -
ggttcaagggatcctcctgc

SEQ ID NO: 193056 - DNA, 20 bp, Artificial Sequence
  Synthetic oligonucleotide; CGGCGTTT chr2 60449973 60449992 60449976 -
ttttgtatttttagtagata

SEQ ID NO: 193057 - DNA, 20 bp, Artificial Sequence
  Synthetic oligonucleotide; CTGGGATT chr2 60449897 60449916 60449900 -
ctcctaggcctcccatagtg

SEQ ID NO: 193058 - DNA, 20 bp, Artificial Sequence
  Synthetic oligonucleotide; ACAAGATT chr2 60449837 60449856 60449840 -
ctagacttttgaaaccccat

SEQ ID NO: 193059 - DNA, 20 bp, Artificial Sequence
  Synthetic oligonucleotide; TTCAGATT chr2 60449702 60449721 60449705 -
tcctctctgcagagtggaac

SEQ ID NO: 193060 - DNA, 20 bp, Artificial Sequence
  Synthetic oligonucleotide; CATTGTTT chr2 60449608 60449627 60449611 -
ggaggagaccaaatacaggg

SEQ ID NO: 193061 - DNA, 20 bp, Artificial Sequence
  Synthetic oligonucleotide; TTCAGATT chr2 60449573 60449592 60449576 -
cccaagccttttgtgggctg

SEQ ID NO: 193062 - DNA, 20 bp, Artificial Sequence
  Synthetic oligonucleotide; CTGGGATT chr2 60449404 60449423 60449407 -
tgcctcagcctcctgagtgg

SEQ ID NO: 193063 - DNA, 20 bp, Artificial Sequence
  Synthetic oligonucleotide; CGGGGTTT chr2 60449352 60449371 60449355 -
ttttgtatttttagtagaga

SEQ ID NO: 193064 - DNA, 20 bp, Artificial Sequence
  Synthetic oligonucleotide; CTGGGATT chr2 60449276 60449295 60449279 -
tgcctcggcctcccaaagtg

SEQ ID NO: 193065 - DNA, 20 bp, Artificial Sequence
  Synthetic oligonucleotide; GACAGATT chr2 60449245 60449264 60449248 -
ggtgtaagccaccgcgcccg

SEQ ID NO: 193066 - DNA, 20 bp, Artificial Sequence
  Synthetic oligonucleotide; GCCTGTTT chr2 60449135 60449154 60449138 -
atccagcatgttgaatatca

SEQ ID NO: 193067 - DNA, 20 bp, Artificial Sequence
  Synthetic oligonucleotide; AATTGTTT chr2 60449120 60449139 60449123 -
tatcagcctgtttgagaaat

SEQ ID NO: 193068 - DNA, 20 bp, Artificial Sequence
  Synthetic oligonucleotide; TTTTGCTT chr2 60449003 60449022 60449006 -
gcagcatattttctgggcac

SEQ ID NO: 193069 - DNA, 20 bp, Artificial Sequence
  Synthetic oligonucleotide; TGGAGTTT chr2 60448996 60449015 60448999 -
attttctgggcacttttgct

SEQ ID NO: 193070 - DNA, 20 bp, Artificial Sequence
  Synthetic oligonucleotide; TTCAGATT chr2 60448979 60448998 60448982 -
gcttggagtttccaagagca

SEQ ID NO: 193071 - DNA, 20 bp, Artificial Sequence
  Synthetic oligonucleotide; TCAGGTTT chr2 60448937 60448956 60448940 -
caagtggtcaggaatatctt

SEQ ID NO: 193072 - DNA, 20 bp, Artificial Sequence
  Synthetic oligonucleotide; ACATGATT chr2 60448918 60448937 60448921 -
ttcaggttttgtatgcgttg

SEQ ID NO: 193073 - DNA, 20 bp, Artificial Sequence
  Synthetic oligonucleotide; GTAGGATT chr2 60448793 60448812 60448796 -
cagtgtccccggaagtaata

SEQ ID NO: 193074 - DNA, 20 bp, Artificial Sequence
  Synthetic oligonucleotide; CATAGCTT chr2 60448736 60448755 60448739 -
tctgttcttacagtatgcca

SEQ ID NO: 193075 - DNA, 20 bp, Artificial Sequence
  Synthetic oligonucleotide; AGCAGATT chr2 60448699 60448718 60448702 -
ttggagtatagtgtgaagga

SEQ ID NO: 193076 - DNA, 20 bp, Artificial Sequence
  Synthetic oligonucleotide; TTCAGTTT chr2 60448545 60448564 60448548 -
gcctaggagagacagtactc

SEQ ID NO: 193077 - DNA, 20 bp, Artificial Sequence
  Synthetic oligonucleotide; GTCTGTTT chr2 60448470 60448489 60448473 -
aaaatccagaagcagtcatt

SEQ ID NO: 193078 - DNA, 20 bp, Artificial Sequence
  Synthetic oligonucleotide; CTTAGTTT chr2 60448456 60448475 60448459 -
gtcattgtctgtttttctat

SEQ ID NO: 193079 - DNA, 20 bp, Artificial Sequence
  Synthetic oligonucleotide; TTTTGCTT chr2 60448410 60448429 60448413 -
acgaaccacatggcctttct

SEQ ID NO: 193080 - DNA, 20 bp, Artificial Sequence
  Synthetic oligonucleotide; TTAAGCTT chr2 60448372 60448391 60448375 -
aaaatgctcccaggaagtac

SEQ ID NO: 193081 - DNA, 20 bp, Artificial Sequence
  Synthetic oligonucleotide; TTGTGATT chr2 60448325 60448344 60448328 -
catgatagaatcaattttcc

SEQ ID NO: 193082 - DNA, 20 bp, Artificial Sequence
  Synthetic oligonucleotide; CAAAGATT chr2 60448232 60448251 60448235 -
agatcagaataataagggcc

SEQ ID NO: 193083 - DNA, 20 bp, Artificial Sequence
  Synthetic oligonucleotide; CCAAGCTT chr2 60448182 60448201 60448185 -
gtgtgaaaaaaacatcatag

SEQ ID NO: 193084 - DNA, 22 bp, Artificial Sequence
  Synthetic oligonucleotide; TTT chr2 60448173 60448194 60448190 60448195 +
caagcttggctatgatgttttt

SEQ ID NO: 193085 - DNA, 22 bp, Artificial Sequence
  Synthetic oligonucleotide; TTC chr2 60448174 60448195 60448191 60448196 +
aagcttggctatgatgtttttt

SEQ ID NO: 193086 - DNA, 22 bp, Artificial Sequence
  Synthetic oligonucleotide; CTT chr2 60448180 60448201 60448197 60448202 +
ggctatgatgtttttttcacac

SEQ ID NO: 193087 - DNA, 22 bp, Artificial Sequence
  Synthetic oligonucleotide; TTG chr2 60448181 60448202 60448198 60448203 +
gctatgatgtttttttcacact

SEQ ID NO: 193088 - DNA, 22 bp, Artificial Sequence
  Synthetic oligonucleotide; CTA chr2 60448185 60448206 60448202 60448207 +
tgatgtttttttcacactgtga

SEQ ID NO: 193089 - DNA, 22 bp, Artificial Sequence
  Synthetic oligonucleotide; TTT chr2 60448193 60448214 60448210 60448215 +
ttttcacactgtgatcttaggt

SEQ ID NO: 193090 - DNA, 22 bp, Artificial Sequence
  Synthetic oligonucleotide; TTT chr2 60448194 60448215 60448211 60448216 +
tttcacactgtgatcttaggta

SEQ ID NO: 193091 - DNA, 22 bp, Artificial Sequence
  Synthetic oligonucleotide; TTT chr2 60448195 60448216 60448212 60448217 +
ttcacactgtgatcttaggtac

SEQ ID NO: 193092 - DNA, 22 bp, Artificial Sequence
  Synthetic oligonucleotide; TTT chr2 60448196 60448217 60448213 60448218 +
tcacactgtgatcttaggtact

SEQ ID NO: 193093 - DNA, 22 bp, Artificial Sequence
  Synthetic oligonucleotide; TTT chr2 60448197 60448218 60448214 60448219 +
cacactgtgatcttaggtactt

SEQ ID NO: 193094 - DNA, 22 bp, Artificial Sequence
  Synthetic oligonucleotide; TTC chr2 60448198 60448219 60448215 60448220 +
acactgtgatcttaggtacttc

SEQ ID NO: 193095 - DNA, 22 bp, Artificial Sequence
  Synthetic oligonucleotide; CTG chr2 60448204 60448225 60448221 60448226 +
tgatcttaggtacttcacttaa

SEQ ID NO: 193096 - DNA, 22 bp, Artificial Sequence
  Synthetic oligonucleotide; CTT chr2 60448211 60448232 60448228 60448233 +
aggtacttcacttaatctttgg

SEQ ID NO: 193097 - DNA, 22 bp, Artificial Sequence
  Synthetic oligonucleotide; TTA chr2 60448212 60448233 60448229 60448234 +
ggtacttcacttaatctttggg

SEQ ID NO: 193098 - DNA, 22 bp, Artificial Sequence
  Synthetic oligonucleotide; CTT chr2 60448219 60448240 60448236 60448241 +
cacttaatctttgggcccttat

SEQ ID NO: 193099 - DNA, 22 bp, Artificial Sequence
  Synthetic oligonucleotide; TTC chr2 60448220 60448241 60448237 60448242 +
acttaatctttgggcccttatt

SEQ ID NO: 193100 - DNA, 22 bp, Artificial Sequence
  Synthetic oligonucleotide; CTT chr2 60448224 60448245 60448241 60448246 +
aatctttgggcccttattattc

SEQ ID NO: 193101 - DNA, 22 bp, Artificial Sequence
  Synthetic oligonucleotide; TTA chr2 60448225 60448246 60448242 60448247 +
atctttgggcccttattattct

SEQ ID NO: 193102 - DNA, 22 bp, Artificial Sequence
  Synthetic oligonucleotide; CTT chr2 60448230 60448251 60448247 60448252 +
tgggcccttattattctgatct

SEQ ID NO: 193103 - DNA, 22 bp, Artificial Sequence
  Synthetic oligonucleotide; TTT chr2 60448231 60448252 60448248 60448253 +
gggcccttattattctgatctc

SEQ ID NO: 193104 - DNA, 22 bp, Artificial Sequence
  Synthetic oligonucleotide; TTG chr2 60448232 60448253 60448249 60448254 +
ggcccttattattctgatctct

SEQ ID NO: 193105 - DNA, 22 bp, Artificial Sequence
  Synthetic oligonucleotide; CTT chr2 60448239 60448260 60448256 60448261 +
attattctgatctctaaaatga

SEQ ID NO: 193106 - DNA, 22 bp, Artificial Sequence
  Synthetic oligonucleotide; TTA chr2 60448240 60448261 60448257 60448262 +
ttattctgatctctaaaatgag

SEQ ID NO: 193107 - DNA, 22 bp, Artificial Sequence
  Synthetic oligonucleotide; TTA chr2 60448243 60448264 60448260 60448265 +
ttctgatctctaaaatgagtga

SEQ ID NO: 193108 - DNA, 22 bp, Artificial Sequence
  Synthetic oligonucleotide; TTC chr2 60448246 60448267 60448263 60448268 +
tgatctctaaaatgagtgatta

SEQ ID NO: 193109 - DNA, 22 bp, Artificial Sequence
  Synthetic oligonucleotide; CTG chr2 60448248 60448269 60448265 60448270 +
atctctaaaatgagtgattact

SEQ ID NO: 193110 - DNA, 22 bp, Artificial Sequence
  Synthetic oligonucleotide; CTC chr2 60448253 60448274 60448270 60448275 +
taaaatgagtgattactaggat

SEQ ID NO: 193111 - DNA, 22 bp, Artificial Sequence
  Synthetic oligonucleotide; CTA chr2 60448255 60448276 60448272 60448277 +
aaatgagtgattactaggattc

SEQ ID NO: 193112 - DNA, 22 bp, Artificial Sequence
  Synthetic oligonucleotide; TTA chr2 60448268 60448289 60448285 60448290 +
ctaggattcctttcaacttcag

SEQ ID NO: 193113 - DNA, 22 bp, Artificial Sequence
  Synthetic oligonucleotide; CTA chr2 60448271 60448292 60448288 60448293 +
ggattcctttcaacttcagtct

SEQ ID NO: 193114 - DNA, 22 bp, Artificial Sequence
  Synthetic oligonucleotide; TTC chr2 60448277 60448298 60448294 60448299 +
ctttcaacttcagtctattctt

SEQ ID NO: 193115 - DNA, 22 bp, Artificial Sequence
  Synthetic oligonucleotide; CTT chr2 60448280 60448301 60448297 60448302 +
tcaacttcagtctattcttttc

SEQ ID NO: 193116 - DNA, 22 bp, Artificial Sequence
  Synthetic oligonucleotide; TTT chr2 60448281 60448302 60448298 60448303 +
caacttcagtctattcttttct

SEQ ID NO: 193117 - DNA, 22 bp, Artificial Sequence
  Synthetic oligonucleotide; TTC chr2 60448282 60448303 60448299 60448304 +
aacttcagtctattcttttctt

SEQ ID NO: 193118 - DNA, 22 bp, Artificial Sequence
  Synthetic oligonucleotide; CTT chr2 60448287 60448308 60448304 60448309 +
cagtctattcttttcttatcta

SEQ ID NO: 193119 - DNA, 22 bp, Artificial Sequence
  Synthetic oligonucleotide; TTC chr2 60448288 60448309 60448305 60448310 +
agtctattcttttcttatctaa

SEQ ID NO: 193120 - DNA, 22 bp, Artificial Sequence
  Synthetic oligonucleotide; CTA chr2 60448294 60448315 60448311 60448316 +
ttcttttcttatctaatttata

SEQ ID NO: 193121 - DNA, 22 bp, Artificial Sequence
  Synthetic oligonucleotide; TTC chr2 60448297 60448318 60448314 60448319 +
ttttcttatctaatttatagaa

SEQ ID NO: 193122 - DNA, 22 bp, Artificial Sequence
  Synthetic oligonucleotide; CTT chr2 60448299 60448320 60448316 60448321 +
ttcttatctaatttatagaatc

SEQ ID NO: 193123 - DNA, 22 bp, Artificial Sequence
  Synthetic oligonucleotide; TTT chr2 60448300 60448321 60448317 60448322 +
tcttatctaatttatagaatca

SEQ ID NO: 193124 - DNA, 22 bp, Artificial Sequence
  Synthetic oligonucleotide; TTT chr2 60448301 60448322 60448318 60448323 +
cttatctaatttatagaatcac

SEQ ID NO: 193125 - DNA, 22 bp, Artificial Sequence
  Synthetic oligonucleotide; TTC chr2 60448302 60448323 60448319 60448324 +
ttatctaatttatagaatcaca

SEQ ID NO: 193126 - DNA, 22 bp, Artificial Sequence
  Synthetic oligonucleotide; CTT chr2 60448304 60448325 60448321 60448326 +
atctaatttatagaatcacaag

SEQ ID NO: 193127 - DNA, 22 bp, Artificial Sequence
  Synthetic oligonucleotide; TTA chr2 60448305 60448326 60448322 60448327 +
tctaatttatagaatcacaagg

SEQ ID NO: 193128 - DNA, 22 bp, Artificial Sequence
  Synthetic oligonucleotide; CTA chr2 60448309 60448330 60448326 60448331 +
atttatagaatcacaaggaaaa

SEQ ID NO: 193129 - DNA, 22 bp, Artificial Sequence
  Synthetic oligonucleotide; TTT chr2 60448313 60448334 60448330 60448335 +
atagaatcacaaggaaaattga

SEQ ID NO: 193130 - DNA, 22 bp, Artificial Sequence
  Synthetic oligonucleotide; TTA chr2 60448314 60448335 60448331 60448336 +
tagaatcacaaggaaaattgat

SEQ ID NO: 193131 - DNA, 22 bp, Artificial Sequence
  Synthetic oligonucleotide; TTG chr2 60448334 60448355 60448351 60448356 +
attctatcatgtatataaaagt

SEQ ID NO: 193132 - DNA, 22 bp, Artificial Sequence
  Synthetic oligonucleotide; TTC chr2 60448338 60448359 60448355 60448360 +
tatcatgtatataaaagtattc

SEQ ID NO: 193133 - DNA, 22 bp, Artificial Sequence
  Synthetic oligonucleotide; CTA chr2 60448340 60448361 60448357 60448362 +
tcatgtatataaaagtattcta

SEQ ID NO: 193134 - DNA, 22 bp, Artificial Sequence
  Synthetic oligonucleotide; TTC chr2 60448360 60448381 60448377 60448382 +
tataaagcttaagtacttcctg

SEQ ID NO: 193135 - DNA, 22 bp, Artificial Sequence
  Synthetic oligonucleotide; CTA chr2 60448362 60448383 60448379 60448384 +
taaagcttaagtacttcctggg

SEQ ID NO: 193136 - DNA, 22 bp, Artificial Sequence
  Synthetic oligonucleotide; CTT chr2 60448370 60448391 60448387 60448392 +
aagtacttcctgggagcatttt

SEQ ID NO: 193137 - DNA, 22 bp, Artificial Sequence
  Synthetic oligonucleotide; TTA chr2 60448371 60448392 60448388 60448393 +
agtacttcctgggagcattttt

SEQ ID NO: 193138 - DNA, 22 bp, Artificial Sequence
  Synthetic oligonucleotide; CTT chr2 60448378 60448399 60448395 60448400 +
cctgggagcattttttaaaata

SEQ ID NO: 193139 - DNA, 22 bp, Artificial Sequence
  Synthetic oligonucleotide; TTC chr2 60448379 60448400 60448396 60448401 +
ctgggagcattttttaaaatac

SEQ ID NO: 193140 - DNA, 22 bp, Artificial Sequence
  Synthetic oligonucleotide; CTG chr2 60448382 60448403 60448399 60448404 +
ggagcattttttaaaatacaaa

SEQ ID NO: 193141 - DNA, 22 bp, Artificial Sequence
  Synthetic oligonucleotide; TTT chr2 60448391 60448412 60448408 60448413 +
tttaaaatacaaagcaaaaaga

SEQ ID NO: 193142 - DNA, 22 bp, Artificial Sequence
  Synthetic oligonucleotide; TTT chr2 60448392 60448413 60448409 60448414 +
ttaaaatacaaagcaaaaagaa

SEQ ID NO: 193143 - DNA, 22 bp, Artificial Sequence
  Synthetic oligonucleotide; TTT chr2 60448393 60448414 60448410 60448415 +
taaaatacaaagcaaaaagaaa

SEQ ID NO: 193144 - DNA, 22 bp, Artificial Sequence
  Synthetic oligonucleotide; TTT chr2 60448394 60448415 60448411 60448416 +
aaaatacaaagcaaaaagaaag

SEQ ID NO: 193145 - DNA, 22 bp, Artificial Sequence
  Synthetic oligonucleotide; TTA chr2 60448395 60448416 60448412 60448417 +
aaatacaaagcaaaaagaaagg

SEQ ID NO: 193146 - DNA, 22 bp, Artificial Sequence
  Synthetic oligonucleotide; TTC chr2 60448428 60448449 60448445 60448450 +
gtaataagatatcctaatttaa

SEQ ID NO: 193147 - DNA, 22 bp, Artificial Sequence
  Synthetic oligonucleotide; CTA chr2 60448444 60448465 60448461 60448466 +
atttaaactaagatagaaaaac

SEQ ID NO: 193148 - DNA, 22 bp, Artificial Sequence
  Synthetic oligonucleotide; TTT chr2 60448448 60448469 60448465 60448470 +
aaactaagatagaaaaacagac

SEQ ID NO: 193149 - DNA, 22 bp, Artificial Sequence
  Synthetic oligonucleotide; TTA chr2 60448449 60448470 60448466 60448471 +
aactaagatagaaaaacagaca

SEQ ID NO: 193150 - DNA, 22 bp, Artificial Sequence
  Synthetic oligonucleotide; CTA chr2 60448454 60448475 60448471 60448476 +
agatagaaaaacagacaatgac

SEQ ID NO: 193151 - DNA, 22 bp, Artificial Sequence
  Synthetic oligonucleotide; CTG chr2 60448478 60448499 60448495 60448500 +
cttctggattttactggaagtg

SEQ ID NO: 193152 - DNA, 22 bp, Artificial Sequence
  Synthetic oligonucleotide; CTT chr2 60448481 60448502 60448498 60448503 +
ctggattttactggaagtgaga

SEQ ID NO: 193153 - DNA, 22 bp, Artificial Sequence
  Synthetic oligonucleotide; TTC chr2 60448482 60448503 60448499 60448504 +
tggattttactggaagtgagaa

SEQ ID NO: 193154 - DNA, 22 bp, Artificial Sequence
  Synthetic oligonucleotide; CTG chr2 60448484 60448505 60448501 60448506 +
gattttactggaagtgagaagt

SEQ ID NO: 193155 - DNA, 22 bp, Artificial Sequence
  Synthetic oligonucleotide; TTT chr2 60448489 60448510 60448506 60448511 +
tactggaagtgagaagttccat

SEQ ID NO: 193156 - DNA, 22 bp, Artificial Sequence
  Synthetic oligonucleotide; TTT chr2 60448490 60448511 60448507 60448512 +
actggaagtgagaagttccatg

SEQ ID NO: 193157 - DNA, 22 bp, Artificial Sequence
  Synthetic oligonucleotide; TTA chr2 60448491 60448512 60448508 60448513 +
ctggaagtgagaagttccatga

SEQ ID NO: 193158 - DNA, 22 bp, Artificial Sequence
  Synthetic oligonucleotide; CTG chr2 60448494 60448515 60448511 60448516 +
gaagtgagaagttccatgactt

SEQ ID NO: 193159 - DNA, 22 bp, Artificial Sequence
  Synthetic oligonucleotide; TTC chr2 60448508 60448529 60448525 60448530 +
catgacttaatgtaactccagg

SEQ ID NO: 193160 - DNA, 22 bp, Artificial Sequence
  Synthetic oligonucleotide; CTT chr2 60448516 60448537 60448533 60448538 +
aatgtaactccaggggaatgca

SEQ ID NO: 193161 - DNA, 22 bp, Artificial Sequence
  Synthetic oligonucleotide; TTA chr2 60448517 60448538 60448534 60448539 +
atgtaactccaggggaatgcaa

SEQ ID NO: 193162 - DNA, 22 bp, Artificial Sequence
  Synthetic oligonucleotide; CTC chr2 60448526 60448547 60448543 60448548 +
caggggaatgcaaactgaagag

SEQ ID NO: 193163 - DNA, 22 bp, Artificial Sequence
  Synthetic oligonucleotide; CTG chr2 60448543 60448564 60448560 60448565 +
aagagtactgtctctcctaggc

SEQ ID NO: 193164 - DNA, 22 bp, Artificial Sequence
  Synthetic oligonucleotide; CTG chr2 60448553 60448574 60448570 60448575 +
tctctcctaggcagtcagagga

SEQ ID NO: 193165 - DNA, 22 bp, Artificial Sequence
  Synthetic oligonucleotide; CTC chr2 60448557 60448578 60448574 60448579 +
tcctaggcagtcagaggaaaga

SEQ ID NO: 193166 - DNA, 22 bp, Artificial Sequence
  Synthetic oligonucleotide; CTC chr2 60448559 60448580 60448576 60448581 +
ctaggcagtcagaggaaagaaa

SEQ ID NO: 193167 - DNA, 22 bp, Artificial Sequence
  Synthetic oligonucleotide; CTA chr2 60448562 60448583 60448579 60448584 +
ggcagtcagaggaaagaaatat

SEQ ID NO: 193168 - DNA, 22 bp, Artificial Sequence
  Synthetic oligonucleotide; TTG chr2 60448591 60448612 60448608 60448613 +
tttctctgctggttaggaactc

SEQ ID NO: 193169 - DNA, 22 bp, Artificial Sequence
  Synthetic oligonucleotide; TTT chr2 60448594 60448615 60448611 60448616 +
ctctgctggttaggaactcaag

SEQ ID NO: 193170 - DNA, 22 bp, Artificial Sequence
  Synthetic oligonucleotide; TTC chr2 60448595 60448616 60448612 60448617 +
tctgctggttaggaactcaaga

SEQ ID NO: 193171 - DNA, 22 bp, Artificial Sequence
  Synthetic oligonucleotide; CTC chr2 60448597 60448618 60448614 60448619 +
tgctggttaggaactcaagatg

SEQ ID NO: 193172 - DNA, 22 bp, Artificial Sequence
  Synthetic oligonucleotide; CTG chr2 60448599 60448620 60448616 60448621 +
ctggttaggaactcaagatgaa

SEQ ID NO: 193173 - DNA, 22 bp, Artificial Sequence
  Synthetic oligonucleotide; CTG chr2 60448602 60448623 60448619 60448624 +
gttaggaactcaagatgaactc

SEQ ID NO: 193174 - DNA, 22 bp, Artificial Sequence
  Synthetic oligonucleotide; TTA chr2 60448606 60448627 60448623 60448628 +
ggaactcaagatgaactcttga

SEQ ID NO: 193175 - DNA, 22 bp, Artificial Sequence
  Synthetic oligonucleotide; CTC chr2 60448613 60448634 60448630 60448635 +
aagatgaactcttgaagaagga

SEQ ID NO: 193176 - DNA, 22 bp, Artificial Sequence
  Synthetic oligonucleotide; CTC chr2 60448624 60448645 60448641 60448646 +
ttgaagaaggaaggtgtgcttg

SEQ ID NO: 193177 - DNA, 22 bp, Artificial Sequence
  Synthetic oligonucleotide; CTT chr2 60448626 60448647 60448643 60448648 +
gaagaaggaaggtgtgcttgca

SEQ ID NO: 193178 - DNA, 22 bp, Artificial Sequence
  Synthetic oligonucleotide; TTG chr2 60448627 60448648 60448644 60448649 +
aagaaggaaggtgtgcttgcat

SEQ ID NO: 193179 - DNA, 22 bp, Artificial Sequence
  Synthetic oligonucleotide; CTT chr2 60448645 60448666 60448662 60448667 +
gcatcaccagttattttggaac

SEQ ID NO: 193180 - DNA, 22 bp, Artificial Sequence
  Synthetic oligonucleotide; TTG chr2 60448646 60448667 60448663 60448668 +
catcaccagttattttggaact

SEQ ID NO: 193181 - DNA, 22 bp, Artificial Sequence
  Synthetic oligonucleotide; TTA chr2 60448658 60448679 60448675 60448680 +
ttttggaacttccaccagactc

SEQ ID NO: 193182 - DNA, 22 bp, Artificial Sequence
  Synthetic oligonucleotide; TTT chr2 60448661 60448682 60448678 60448683 +
tggaacttccaccagactcaaa

SEQ ID NO: 193183 - DNA, 22 bp, Artificial Sequence
  Synthetic oligonucleotide; TTT chr2 60448662 60448683 60448679 60448684 +
ggaacttccaccagactcaaaa

SEQ ID NO: 193184 - DNA, 22 bp, Artificial Sequence
  Synthetic oligonucleotide; TTG chr2 60448663 60448684 60448680 60448685 +
gaacttccaccagactcaaaat

SEQ ID NO: 193185 - DNA, 22 bp, Artificial Sequence
  Synthetic oligonucleotide; CTT chr2 60448669 60448690 60448686 60448691 +
ccaccagactcaaaattcctca

SEQ ID NO: 193186 - DNA, 22 bp, Artificial Sequence
  Synthetic oligonucleotide; TTC chr2 60448670 60448691 60448687 60448692 +
caccagactcaaaattcctcaa

SEQ ID NO: 193187 - DNA, 22 bp, Artificial Sequence
  Synthetic oligonucleotide; CTC chr2 60448680 60448701 60448697 60448702 +
aaaattcctcaaatctgcttcc

SEQ ID NO: 193188 - DNA, 22 bp, Artificial Sequence
  Synthetic oligonucleotide; TTC chr2 60448687 60448708 60448704 60448709 +
ctcaaatctgcttccttcacac

SEQ ID NO: 193189 - DNA, 22 bp, Artificial Sequence
  Synthetic oligonucleotide; CTC chr2 60448690 60448711 60448707 60448712 +
aaatctgcttccttcacactat

SEQ ID NO: 193190 - DNA, 22 bp, Artificial Sequence
  Synthetic oligonucleotide; CTG chr2 60448697 60448718 60448714 60448719 +
cttccttcacactatactccaa

SEQ ID NO: 193191 - DNA, 22 bp, Artificial Sequence
  Synthetic oligonucleotide; CTT chr2 60448700 60448721 60448717 60448722 +
ccttcacactatactccaaaag

SEQ ID NO: 193192 - DNA, 22 bp, Artificial Sequence
  Synthetic oligonucleotide; TTC chr2 60448701 60448722 60448718 60448723 +
cttcacactatactccaaaagg

SEQ ID NO: 193193 - DNA, 22 bp, Artificial Sequence
  Synthetic oligonucleotide; CTT chr2 60448704 60448725 60448721 60448726 +
cacactatactccaaaaggagt

SEQ ID NO: 193194 - DNA, 22 bp, Artificial Sequence
  Synthetic oligonucleotide; TTC chr2 60448705 60448726 60448722 60448727 +
acactatactccaaaaggagtc

SEQ ID NO: 193195 - DNA, 22 bp, Artificial Sequence
  Synthetic oligonucleotide; CTA chr2 60448711 60448732 60448728 60448733 +
tactccaaaaggagtcaaagct

SEQ ID NO: 193196 - DNA, 22 bp, Artificial Sequence
  Synthetic oligonucleotide; CTC chr2 60448716 60448737 60448733 60448738 +
caaaaggagtcaaagctatgtg

SEQ ID NO: 193197 - DNA, 22 bp, Artificial Sequence
  Synthetic oligonucleotide; CTA chr2 60448734 60448755 60448751 60448756 +
tgtggcatactgtaagaacaga

SEQ ID NO: 193198 - DNA, 22 bp, Artificial Sequence
  Synthetic oligonucleotide; CTG chr2 60448746 60448767 60448763 60448768 +
taagaacagaaccaacagccta

SEQ ID NO: 193199 - DNA, 22 bp, Artificial Sequence
  Synthetic oligonucleotide; CTA chr2 60448768 60448789 60448785 60448790 +
caaaatacttccattctaatcc

SEQ ID NO: 193200 - DNA, 22 bp, Artificial Sequence
  Synthetic oligonucleotide; CTT chr2 60448778 60448799 60448795 60448800 +
ccattctaatcctactattact

SEQ ID NO: 193201 - DNA, 22 bp, Artificial Sequence
  Synthetic oligonucleotide; TTC chr2 60448779 60448800 60448796 60448801 +
cattctaatcctactattactt

SEQ ID NO: 193202 - DNA, 22 bp, Artificial Sequence
  Synthetic oligonucleotide; TTC chr2 60448784 60448805 60448801 60448806 +
taatcctactattacttccggg

SEQ ID NO: 193203 - DNA, 22 bp, Artificial Sequence
  Synthetic oligonucleotide; CTA chr2 60448786 60448807 60448803 60448808 +
atcctactattacttccgggga

SEQ ID NO: 193204 - DNA, 22 bp, Artificial Sequence
  Synthetic oligonucleotide; CTA chr2 60448792 60448813 60448809 60448814 +
ctattacttccggggacactga

SEQ ID NO: 193205 - DNA, 22 bp, Artificial Sequence
  Synthetic oligonucleotide; CTA chr2 60448795 60448816 60448812 60448817 +
ttacttccggggacactgattt

SEQ ID NO: 193206 - DNA, 22 bp, Artificial Sequence
  Synthetic oligonucleotide; TTA chr2 60448798 60448819 60448815 60448820 +
cttccggggacactgatttata

SEQ ID NO: 193207 - DNA, 22 bp, Artificial Sequence
  Synthetic oligonucleotide; CTT chr2 60448801 60448822 60448818 60448823 +
ccggggacactgatttataaaa

SEQ ID NO: 193208 - DNA, 22 bp, Artificial Sequence
  Synthetic oligonucleotide; TTC chr2 60448802 60448823 60448819 60448824 +
cggggacactgatttataaaat

SEQ ID NO: 193209 - DNA, 22 bp, Artificial Sequence
  Synthetic oligonucleotide; CTG chr2 60448813 60448834 60448830 60448835 +
atttataaaataagaattataa

SEQ ID NO: 193210 - DNA, 22 bp, Artificial Sequence
  Synthetic oligonucleotide; TTT chr2 60448817 60448838 60448834 60448839 +
ataaaataagaattataaaata

SEQ ID NO: 193211 - DNA, 22 bp, Artificial Sequence
  Synthetic oligonucleotide; TTA chr2 60448818 60448839 60448835 60448840 +
taaaataagaattataaaataa

SEQ ID NO: 193212 - DNA, 22 bp, Artificial Sequence
  Synthetic oligonucleotide; TTA chr2 60448832 60448853 60448849 60448854 +
taaaataagaatttttaaaaat

SEQ ID NO: 193213 - DNA, 22 bp, Artificial Sequence
  Synthetic oligonucleotide; TTT chr2 60448846 60448867 60448863 60448868 +
ttaaaaataggaataaatatag

SEQ ID NO: 193214 - DNA, 22 bp, Artificial Sequence
  Synthetic oligonucleotide; TTT chr2 60448847 60448868 60448864 60448869 +
taaaaataggaataaatatagc

SEQ ID NO: 193215 - DNA, 22 bp, Artificial Sequence
  Synthetic oligonucleotide; TTT chr2 60448848 60448869 60448865 60448870 +
aaaaataggaataaatatagcc

SEQ ID NO: 193216 - DNA, 22 bp, Artificial Sequence
  Synthetic oligonucleotide; TTA chr2 60448849 60448870 60448866 60448871 +
aaaataggaataaatatagcca

SEQ ID NO: 193217 - DNA, 22 bp, Artificial Sequence
  Synthetic oligonucleotide; CTT chr2 60448875 60448896 60448892 60448897 +
cgtcaatgttaacctcactatc

SEQ ID NO: 193218 - DNA, 22 bp, Artificial Sequence
  Synthetic oligonucleotide; TTC chr2 60448876 60448897 60448893 60448898 +
gtcaatgttaacctcactatca

SEQ ID NO: 193219 - DNA, 22 bp, Artificial Sequence
  Synthetic oligonucleotide; TTA chr2 60448886 60448907 60448903 60448908 +
acctcactatcaaaaaaaaaaa

SEQ ID NO: 193220 - DNA, 22 bp, Artificial Sequence
  Synthetic oligonucleotide; CTC chr2 60448891 60448912 60448908 60448913 +
actatcaaaaaaaaaaaaaaat

SEQ ID NO: 193221 - DNA, 22 bp, Artificial Sequence
  Synthetic oligonucleotide; CTA chr2 60448895 60448916 60448912 60448917 +
tcaaaaaaaaaaaaaaatcatg

SEQ ID NO: 193222 - DNA, 22 bp, Artificial Sequence
  Synthetic oligonucleotide; CTG chr2 60448936 60448957 60448953 60448958 +
aaagatattcctgaccacttga

SEQ ID NO: 193223 - DNA, 22 bp, Artificial Sequence
  Synthetic oligonucleotide; TTC chr2 60448946 60448967 60448963 60448968 +
ctgaccacttgaagggcttggt

SEQ ID NO: 193224 - DNA, 22 bp, Artificial Sequence
  Synthetic oligonucleotide; CTG chr2 60448949 60448970 60448966 60448971 +
accacttgaagggcttggtttt

SEQ ID NO: 193225 - DNA, 22 bp, Artificial Sequence
  Synthetic oligonucleotide; CTT chr2 60448956 60448977 60448973 60448978 +
gaagggcttggttttaatctga

SEQ ID NO: 193226 - DNA, 22 bp, Artificial Sequence
  Synthetic oligonucleotide; TTG chr2 60448957 60448978 60448974 60448979 +
aagggcttggttttaatctgaa

SEQ ID NO: 193227 - DNA, 22 bp, Artificial Sequence
  Synthetic oligonucleotide; CTT chr2 60448965 60448986 60448982 60448987 +
ggttttaatctgaatgctcttg

SEQ ID NO: 193228 - DNA, 22 bp, Artificial Sequence
  Synthetic oligonucleotide; TTG chr2 60448966 60448987 60448983 60448988 +
gttttaatctgaatgctcttgg

SEQ ID NO: 193229 - DNA, 22 bp, Artificial Sequence
  Synthetic oligonucleotide; TTT chr2 60448970 60448991 60448987 60448992 +
taatctgaatgctcttggaaac

SEQ ID NO: 193230 - DNA, 22 bp, Artificial Sequence
  Synthetic oligonucleotide; TTT chr2 60448971 60448992 60448988 60448993 +
aatctgaatgctcttggaaact

SEQ ID NO: 193231 - DNA, 22 bp, Artificial Sequence
  Synthetic oligonucleotide; TTA chr2 60448972 60448993 60448989 60448994 +
atctgaatgctcttggaaactc

SEQ ID NO: 193232 - DNA, 22 bp, Artificial Sequence
  Synthetic oligonucleotide; CTG chr2 60448977 60448998 60448994 60448999 +
aatgctcttggaaactccaagc

SEQ ID NO: 193233 - DNA, 22 bp, Artificial Sequence
  Synthetic oligonucleotide; CTC chr2 60448984 60449005 60449001 60449006 +
ttggaaactccaagcaaaagtg

SEQ ID NO: 193234 - DNA, 22 bp, Artificial Sequence
  Synthetic oligonucleotide; CTT chr2 60448986 60449007 60449003 60449008 +
ggaaactccaagcaaaagtgcc

SEQ ID NO: 193235 - DNA, 22 bp, Artificial Sequence
  Synthetic oligonucleotide; TTG chr2 60448987 60449008 60449004 60449009 +
gaaactccaagcaaaagtgccc

SEQ ID NO: 193236 - DNA, 22 bp, Artificial Sequence
  Synthetic oligonucleotide; CTC chr2 60448994 60449015 60449011 60449016 +
caagcaaaagtgcccagaaaat

SEQ ID NO: 193237 - DNA, 22 bp, Artificial Sequence
  Synthetic oligonucleotide; CTG chr2 60449022 60449043 60449039 60449044 +
ccaaggtttggggcactcagtt

SEQ ID NO: 193238 - DNA, 22 bp, Artificial Sequence
  Synthetic oligonucleotide; TTT chr2 60449031 60449052 60449048 60449053 +
ggggcactcagttagacctcag

SEQ ID NO: 193239 - DNA, 22 bp, Artificial Sequence
  Synthetic oligonucleotide; TTG chr2 60449032 60449053 60449049 60449054 +
gggcactcagttagacctcagc

SEQ ID NO: 193240 - DNA, 22 bp, Artificial Sequence
  Synthetic oligonucleotide; CTC chr2 60449040 60449061 60449057 60449062 +
agttagacctcagcagattcca

SEQ ID NO: 193241 - DNA, 22 bp, Artificial Sequence
  Synthetic oligonucleotide; TTA chr2 60449045 60449066 60449062 60449067 +
gacctcagcagattccaagatt

SEQ ID NO: 193242 - DNA, 22 bp, Artificial Sequence
  Synthetic oligonucleotide; CTC chr2 60449051 60449072 60449068 60449073 +
agcagattccaagattgcactc

SEQ ID NO: 193243 - DNA, 22 bp, Artificial Sequence
  Synthetic oligonucleotide; TTC chr2 60449060 60449081 60449077 60449082 +
caagattgcactccttgcctaa

SEQ ID NO: 193244 - DNA, 22 bp, Artificial Sequence
  Synthetic oligonucleotide; TTG chr2 60449068 60449089 60449085 60449090 +
cactccttgcctaagagttttc

SEQ ID NO: 193245 - DNA, 22 bp, Artificial Sequence
  Synthetic oligonucleotide; CTC chr2 60449073 60449094 60449090 60449095 +
cttgcctaagagttttctttaa

SEQ ID NO: 193246 - DNA, 22 bp, Artificial Sequence
  Synthetic oligonucleotide; CTT chr2 60449076 60449097 60449093 60449098 +
gcctaagagttttctttaaatg

SEQ ID NO: 193247 - DNA, 22 bp, Artificial Sequence
  Synthetic oligonucleotide; TTG chr2 60449077 60449098 60449094 60449099 +
cctaagagttttctttaaatga

SEQ ID NO: 193248 - DNA, 22 bp, Artificial Sequence
  Synthetic oligonucleotide; CTA chr2 60449081 60449102 60449098 60449103 +
agagttttctttaaatgatcac

SEQ ID NO: 193249 - DNA, 22 bp, Artificial Sequence
  Synthetic oligonucleotide; TTT chr2 60449088 60449109 60449105 60449110 +
tctttaaatgatcactggtttt

SEQ ID NO: 193250 - DNA, 22 bp, Artificial Sequence
  Synthetic oligonucleotide; TTT chr2 60449089 60449110 60449106 60449111 +
ctttaaatgatcactggttttt

SEQ ID NO: 193251 - DNA, 22 bp, Artificial Sequence
  Synthetic oligonucleotide; TTC chr2 60449090 60449111 60449107 60449112 +
tttaaatgatcactggtttttg

SEQ ID NO: 193252 - DNA, 22 bp, Artificial Sequence
  Synthetic oligonucleotide; CTT chr2 60449092 60449113 60449109 60449114 +
taaatgatcactggtttttgaa

SEQ ID NO: 193253 - DNA, 22 bp, Artificial Sequence
  Synthetic oligonucleotide; TTT chr2 60449093 60449114 60449110 60449115 +
aaatgatcactggtttttgaaa

SEQ ID NO: 193254 - DNA, 22 bp, Artificial Sequence
  Synthetic oligonucleotide; TTA chr2 60449094 60449115 60449111 60449116 +
aatgatcactggtttttgaaac

SEQ ID NO: 193255 - DNA, 22 bp, Artificial Sequence
  Synthetic oligonucleotide; CTG chr2 60449105 60449126 60449122 60449127 +
gtttttgaaacaattatttctc

SEQ ID NO: 193256 - DNA, 22 bp, Artificial Sequence
  Synthetic oligonucleotide; TTT chr2 60449109 60449130 60449126 60449131 +
ttgaaacaattatttctcaaac

SEQ ID NO: 193257 - DNA, 22 bp, Artificial Sequence
  Synthetic oligonucleotide; TTT chr2 60449110 60449131 60449127 60449132 +
tgaaacaattatttctcaaaca

SEQ ID NO: 193258 - DNA, 22 bp, Artificial Sequence
  Synthetic oligonucleotide; TTT chr2 60449111 60449132 60449128 60449133 +
gaaacaattatttctcaaacag

SEQ ID NO: 193259 - DNA, 22 bp, Artificial Sequence
  Synthetic oligonucleotide; TTG chr2 60449112 60449133 60449129 60449134 +
aaacaattatttctcaaacagg

SEQ ID NO: 193260 - DNA, 22 bp, Artificial Sequence
  Synthetic oligonucleotide; TTA chr2 60449121 60449142 60449138 60449143 +
tttctcaaacaggctgatattc

SEQ ID NO: 193261 - DNA, 22 bp, Artificial Sequence
  Synthetic oligonucleotide; TTT chr2 60449124 60449145 60449141 60449146 +
ctcaaacaggctgatattcaac

SEQ ID NO: 193262 - DNA, 22 bp, Artificial Sequence
  Synthetic oligonucleotide; TTC chr2 60449125 60449146 60449142 60449147 +
tcaaacaggctgatattcaaca

SEQ ID NO: 193263 - DNA, 22 bp, Artificial Sequence
  Synthetic oligonucleotide; CTC chr2 60449127 60449148 60449144 60449149 +
aaacaggctgatattcaacatg

SEQ ID NO: 193264 - DNA, 22 bp, Artificial Sequence
  Synthetic oligonucleotide; CTG chr2 60449137 60449158 60449154 60449159 +
atattcaacatgctggatgctg

SEQ ID NO: 193265 - DNA, 22 bp, Artificial Sequence
  Synthetic oligonucleotide; TTC chr2 60449143 60449164 60449160 60449165 +
aacatgctggatgctgggtgct

SEQ ID NO: 193266 - DNA, 22 bp, Artificial Sequence
  Synthetic oligonucleotide; CTG chr2 60449152 60449173 60449169 60449174 +
gatgctgggtgctgcaggggct

SEQ ID NO: 193267 - DNA, 22 bp, Artificial Sequence
  Synthetic oligonucleotide; CTG chr2 60449159 60449180 60449176 60449181 +
ggtgctgcaggggctttgagtg

SEQ ID NO: 193268 - DNA, 22 bp, Artificial Sequence
  Synthetic oligonucleotide; CTG chr2 60449166 60449187 60449183 60449188 +
caggggctttgagtgtctttct

SEQ ID NO: 193269 - DNA, 22 bp, Artificial Sequence
  Synthetic oligonucleotide; CTT chr2 60449175 60449196 60449192 60449197 +
tgagtgtctttctctcccatca

SEQ ID NO: 193270 - DNA, 22 bp, Artificial Sequence
  Synthetic oligonucleotide; TTT chr2 60449176 60449197 60449193 60449198 +
gagtgtctttctctcccatcat

SEQ ID NO: 193271 - DNA, 22 bp, Artificial Sequence
  Synthetic oligonucleotide; TTG chr2 60449177 60449198 60449194 60449199 +
agtgtctttctctcccatcatg

SEQ ID NO: 193272 - DNA, 22 bp, Artificial Sequence
  Synthetic oligonucleotide; CTT chr2 60449185 60449206 60449202 60449207 +
tctctcccatcatggaccccaa

SEQ ID NO: 193273 - DNA, 22 bp, Artificial Sequence
  Synthetic oligonucleotide; TTT chr2 60449186 60449207 60449203 60449208 +
ctctcccatcatggaccccaat

SEQ ID NO: 193274 - DNA, 22 bp, Artificial Sequence
  Synthetic oligonucleotide; TTC chr2 60449187 60449208 60449204 60449209 +
tctcccatcatggaccccaatt

SEQ ID NO: 193275 - DNA, 22 bp, Artificial Sequence
  Synthetic oligonucleotide; CTC chr2 60449189 60449210 60449206 60449211 +
tcccatcatggaccccaattct

SEQ ID NO: 193276 - DNA, 22 bp, Artificial Sequence
  Synthetic oligonucleotide; CTC chr2 60449191 60449212 60449208 60449213 +
ccatcatggaccccaattctaa

SEQ ID NO: 193277 - DNA, 22 bp, Artificial Sequence
  Synthetic oligonucleotide; TTC chr2 60449210 60449231 60449227 60449232 +
taacagaccttttttatacagt

SEQ ID NO: 193278 - DNA, 22 bp, Artificial Sequence
  Synthetic oligonucleotide; CTA chr2 60449212 60449233 60449229 60449234 +
acagaccttttttatacagtgt

SEQ ID NO: 193279 - DNA, 22 bp, Artificial Sequence
  Synthetic oligonucleotide; CTT chr2 60449221 60449242 60449238 60449243 +
ttttatacagtgtaataatctg

SEQ ID NO: 193280 - DNA, 22 bp, Artificial Sequence
  Synthetic oligonucleotide; TTT chr2 60449222 60449243 60449239 60449244 +
tttatacagtgtaataatctgt

SEQ ID NO: 193281 - DNA, 22 bp, Artificial Sequence
  Synthetic oligonucleotide; TTT chr2 60449223 60449244 60449240 60449245 +
ttatacagtgtaataatctgtc

SEQ ID NO: 193282 - DNA, 22 bp, Artificial Sequence
  Synthetic oligonucleotide; TTT chr2 60449224 60449245 60449241 60449246 +
tatacagtgtaataatctgtcc

SEQ ID NO: 193283 - DNA, 22 bp, Artificial Sequence
  Synthetic oligonucleotide; TTT chr2 60449225 60449246 60449242 60449247 +
atacagtgtaataatctgtccg

SEQ ID NO: 193284 - DNA, 22 bp, Artificial Sequence
  Synthetic oligonucleotide; TTA chr2 60449226 60449247 60449243 60449248 +
tacagtgtaataatctgtccgg

SEQ ID NO: 193285 - DNA, 22 bp, Artificial Sequence
  Synthetic oligonucleotide; CTG chr2 60449243 60449264 60449260 60449265 +
tccgggcgcggtggcttacacc

SEQ ID NO: 193286 - DNA, 22 bp, Artificial Sequence
  Synthetic oligonucleotide; CTT chr2 60449260 60449281 60449277 60449282 +
acacctgtaatcccagcacttt

SEQ ID NO: 193287 - DNA, 22 bp, Artificial Sequence
  Synthetic oligonucleotide; TTA chr2 60449261 60449282 60449278 60449283 +
cacctgtaatcccagcactttg

SEQ ID NO: 193288 - DNA, 22 bp, Artificial Sequence
  Synthetic oligonucleotide; CTG chr2 60449267 60449288 60449284 60449289 +
taatcccagcactttgggaggc

SEQ ID NO: 193289 - DNA, 22 bp, Artificial Sequence
  Synthetic oligonucleotide; CTT chr2 60449281 60449302 60449298 60449303 +
tgggaggccgaggcaggtggct

SEQ ID NO: 193290 - DNA, 22 bp, Artificial Sequence
  Synthetic oligonucleotide; TTT chr2 60449282 60449303 60449299 60449304 +
gggaggccgaggcaggtggctc

SEQ ID NO: 193291 - DNA, 22 bp, Artificial Sequence
  Synthetic oligonucleotide; TTG chr2 60449283 60449304 60449300 60449305 +
ggaggccgaggcaggtggctca

SEQ ID NO: 193292 - DNA, 22 bp, Artificial Sequence
  Synthetic oligonucleotide; CTC chr2 60449304 60449325 60449321 60449326 +
atgaggtcaggagttcgagacc

SEQ ID NO: 193293 - DNA, 22 bp, Artificial Sequence
  Synthetic oligonucleotide; TTC chr2 60449320 60449341 60449337 60449342 +
gagaccagcctgaccaacatgg

SEQ ID NO: 193294 - DNA, 22 bp, Artificial Sequence
  Synthetic oligonucleotide; CTG chr2 60449332 60449353 60449349 60449354 +
accaacatggtgaaaccccgtc

SEQ ID NO: 193295 - DNA, 22 bp, Artificial Sequence
  Synthetic oligonucleotide; CTC chr2 60449356 60449377 60449373 60449378 +
tactaaaaatacaaaaattagc

SEQ ID NO: 193296 - DNA, 22 bp, Artificial Sequence
  Synthetic oligonucleotide; CTA chr2 60449358 60449379 60449375 60449380 +
ctaaaaatacaaaaattagcca

SEQ ID NO: 193297 - DNA, 22 bp, Artificial Sequence
  Synthetic oligonucleotide; CTA chr2 60449361 60449382 60449378 60449383 +
aaaatacaaaaattagccaggt

SEQ ID NO: 193298 - DNA, 22 bp, Artificial Sequence
  Synthetic oligonucleotide; TTA chr2 60449376 60449397 60449393 60449398 +
gccaggtggtacgcacctgtaa

SEQ ID NO: 193299 - DNA, 22 bp, Artificial Sequence
  Synthetic oligonucleotide; CTG chr2 60449395 60449416 60449412 60449417 +
taatcccagccactcaggaggc

SEQ ID NO: 193300 - DNA, 22 bp, Artificial Sequence
  Synthetic oligonucleotide; CTC chr2 60449410 60449431 60449427 60449432 +
aggaggctgaggcaggagaacc

SEQ ID NO: 193301 - DNA, 22 bp, Artificial Sequence
  Synthetic oligonucleotide; CTG chr2 60449419 60449440 60449436 60449441 +
aggcaggagaaccacttgaacc

SEQ ID NO: 193302 - DNA, 22 bp, Artificial Sequence
  Synthetic oligonucleotide; CTT chr2 60449436 60449457 60449453 60449458 +
gaacccgggaggtagaggttgc

SEQ ID NO: 193303 - DNA, 22 bp, Artificial Sequence
  Synthetic oligonucleotide; TTG chr2 60449437 60449458 60449454 60449459 +
aacccgggaggtagaggttgca

SEQ ID NO: 193304 - DNA, 22 bp, Artificial Sequence
  Synthetic oligonucleotide; TTG chr2 60449457 60449478 60449474 60449479 +
cagtgagccaagatcgtgccat

SEQ ID NO: 193305 - DNA, 22 bp, Artificial Sequence
  Synthetic oligonucleotide; TTG chr2 60449481 60449502 60449498 60449503 +
cactccagcctgggcaatagag

SEQ ID NO: 193306 - DNA, 22 bp, Artificial Sequence
  Synthetic oligonucleotide; CTC chr2 60449486 60449507 60449503 60449508 +
cagcctgggcaatagagtgaga

SEQ ID NO: 193307 - DNA, 22 bp, Artificial Sequence
  Synthetic oligonucleotide; CTG chr2 60449493 60449514 60449510 60449515 +
ggcaatagagtgagactccatc

SEQ ID NO: 193308 - DNA, 22 bp, Artificial Sequence
  Synthetic oligonucleotide; CTC chr2 60449511 60449532 60449528 60449533 +
catctcaacaataataataata

SEQ ID NO: 193309 - DNA, 22 bp, Artificial Sequence
  Synthetic oligonucleotide; CTC chr2 60449517 60449538 60449534 60449539 +
aacaataataataataataata

SEQ ID NO: 193310 - DNA, 22 bp, Artificial Sequence
  Synthetic oligonucleotide; CTG chr2 60449571 60449592 60449588 60449593 +
aacagcccacaaaaggcttggg

SEQ ID NO: 193311 - DNA, 22 bp, Artificial Sequence
  Synthetic oligonucleotide; CTT chr2 60449590 60449611 60449607 60449612 +
gggaaagtaaaaacaatgccct

SEQ ID NO: 193312 - DNA, 22 bp, Artificial Sequence
  Synthetic oligonucleotide; TTG chr2 60449591 60449612 60449608 60449613 +
ggaaagtaaaaacaatgccctg

SEQ ID NO: 193313 - DNA, 22 bp, Artificial Sequence
  Synthetic oligonucleotide; CTG chr2 60449613 60449634 60449630 60449635 +
tatttggtctcctccatccaag

SEQ ID NO: 193314 - DNA, 22 bp, Artificial Sequence
  Synthetic oligonucleotide; TTT chr2 60449618 60449639 60449635 60449640 +
ggtctcctccatccaagtggct

SEQ ID NO: 193315 - DNA, 22 bp, Artificial Sequence
  Synthetic oligonucleotide; TTG chr2 60449619 60449640 60449636 60449641 +
gtctcctccatccaagtggctg

SEQ ID NO: 193316 - DNA, 22 bp, Artificial Sequence
  Synthetic oligonucleotide; CTC chr2 60449624 60449645 60449641 60449646 +
ctccatccaagtggctgggact

SEQ ID NO: 193317 - DNA, 22 bp, Artificial Sequence
  Synthetic oligonucleotide; CTC chr2 60449627 60449648 60449644 60449649 +
catccaagtggctgggactctg

SEQ ID NO: 193318 - DNA, 22 bp, Artificial Sequence
  Synthetic oligonucleotide; CTG chr2 60449641 60449662 60449658 60449663 +
ggactctgtcctctagtctgtg

SEQ ID NO: 193319 - DNA, 22 bp, Artificial Sequence
  Synthetic oligonucleotide; CTC chr2 60449647 60449668 60449664 60449669 +
tgtcctctagtctgtgctcatg

SEQ ID NO: 193320 - DNA, 22 bp, Artificial Sequence
  Synthetic oligonucleotide; CTG chr2 60449649 60449670 60449666 60449671 +
tcctctagtctgtgctcatgtc

SEQ ID NO: 193321 - DNA, 22 bp, Artificial Sequence
  Synthetic oligonucleotide; CTC chr2 60449654 60449675 60449671 60449676 +
tagtctgtgctcatgtcaggca

SEQ ID NO: 193322 - DNA, 22 bp, Artificial Sequence
  Synthetic oligonucleotide; CTA chr2 60449656 60449677 60449673 60449678 +
gtctgtgctcatgtcaggcaac

SEQ ID NO: 193323 - DNA, 22 bp, Artificial Sequence
  Synthetic oligonucleotide; CTG chr2 60449661 60449682 60449678 60449683 +
tgctcatgtcaggcaaccaatt

SEQ ID NO: 193324 - DNA, 22 bp, Artificial Sequence
  Synthetic oligonucleotide; CTC chr2 60449666 60449687 60449683 60449688 +
atgtcaggcaaccaatttatct

SEQ ID NO: 193325 - DNA, 22 bp, Artificial Sequence
  Synthetic oligonucleotide; TTT chr2 60449684 60449705 60449701 60449706 +
atctctctgcaatctgaagttc

SEQ ID NO: 193326 - DNA, 22 bp, Artificial Sequence
  Synthetic oligonucleotide; TTA chr2 60449685 60449706 60449702 60449707 +
tctctctgcaatctgaagttcc

SEQ ID NO: 193327 - DNA, 22 bp, Artificial Sequence
  Synthetic oligonucleotide; CTC chr2 60449689 60449710 60449706 60449711 +
tctgcaatctgaagttccactc

SEQ ID NO: 193328 - DNA, 22 bp, Artificial Sequence
  Synthetic oligonucleotide; CTC chr2 60449691 60449712 60449708 60449713 +
tgcaatctgaagttccactctg

SEQ ID NO: 193329 - DNA, 22 bp, Artificial Sequence
  Synthetic oligonucleotide; CTG chr2 60449693 60449714 60449710 60449715 +
caatctgaagttccactctgca

SEQ ID NO: 193330 - DNA, 22 bp, Artificial Sequence
  Synthetic oligonucleotide; CTG chr2 60449700 60449721 60449717 60449722 +
aagttccactctgcagagagga

SEQ ID NO: 193331 - DNA, 22 bp, Artificial Sequence
  Synthetic oligonucleotide; TTC chr2 60449706 60449727 60449723 60449728 +
cactctgcagagaggacacagt

SEQ ID NO: 193332 - DNA, 22 bp, Artificial Sequence
  Synthetic oligonucleotide; CTC chr2 60449711 60449732 60449728 60449733 +
tgcagagaggacacagtgagaa

SEQ ID NO: 193333 - DNA, 22 bp, Artificial Sequence
  Synthetic oligonucleotide; CTG chr2 60449713 60449734 60449730 60449735 +
cagagaggacacagtgagaacc

SEQ ID NO: 193334 - DNA, 22 bp, Artificial Sequence
  Synthetic oligonucleotide; CTG chr2 60449739 60449760 60449756 60449761 +
gcagatttgtgagcctcttccc

SEQ ID NO: 193335 - DNA, 22 bp, Artificial Sequence
  Synthetic oligonucleotide; TTT chr2 60449747 60449768 60449764 60449769 +
gtgagcctcttccctgcttctg

SEQ ID NO: 193336 - DNA, 22 bp, Artificial Sequence
  Synthetic oligonucleotide; TTG chr2 60449748 60449769 60449765 60449770 +
tgagcctcttccctgcttctgc

SEQ ID NO: 193337 - DNA, 22 bp, Artificial Sequence
  Synthetic oligonucleotide; CTC chr2 60449756 60449777 60449773 60449778 +
ttccctgcttctgccattcatg

SEQ ID NO: 193338 - DNA, 22 bp, Artificial Sequence
  Synthetic oligonucleotide; CTT chr2 60449758 60449779 60449775 60449780 +
ccctgcttctgccattcatgga

SEQ ID NO: 193339 - DNA, 22 bp, Artificial Sequence
  Synthetic oligonucleotide; TTC chr2 60449759 60449780 60449776 60449781 +
cctgcttctgccattcatggat

SEQ ID NO: 193340 - DNA, 22 bp, Artificial Sequence
  Synthetic oligonucleotide; CTG chr2 60449763 60449784 60449780 60449785 +
cttctgccattcatggataacc

SEQ ID NO: 193341 - DNA, 22 bp, Artificial Sequence
  Synthetic oligonucleotide; CTT chr2 60449766 60449787 60449783 60449788 +
ctgccattcatggataaccatg

SEQ ID NO: 193342 - DNA, 22 bp, Artificial Sequence
  Synthetic oligonucleotide; TTC chr2 60449767 60449788 60449784 60449789 +
tgccattcatggataaccatga

SEQ ID NO: 193343 - DNA, 22 bp, Artificial Sequence
  Synthetic oligonucleotide; CTG chr2 60449769 60449790 60449786 60449791 +
ccattcatggataaccatgatc

SEQ ID NO: 193344 - DNA, 22 bp, Artificial Sequence
  Synthetic oligonucleotide; TTC chr2 60449775 60449796 60449792 60449797 +
atggataaccatgatcttgact

SEQ ID NO: 193345 - DNA, 22 bp, Artificial Sequence
  Synthetic oligonucleotide; CTT chr2 60449793 60449814 60449810 60449815 +
gactcatcacacagagagatgt

SEQ ID NO: 193346 - DNA, 22 bp, Artificial Sequence
  Synthetic oligonucleotide; TTG chr2 60449794 60449815 60449811 60449816 +
actcatcacacagagagatgtc

SEQ ID NO: 193347 - DNA, 22 bp, Artificial Sequence
  Synthetic oligonucleotide; CTC chr2 60449798 60449819 60449815 60449820 +
atcacacagagagatgtcttcc

SEQ ID NO: 193348 - DNA, 22 bp, Artificial Sequence
  Synthetic oligonucleotide; CTT chr2 60449818 60449839 60449835 60449840 +
cccaaattgtcaatcttgtatg

SEQ ID NO: 193349 - DNA, 22 bp, Artificial Sequence
  Synthetic oligonucleotide; TTC chr2 60449819 60449840 60449836 60449841 +
ccaaattgtcaatcttgtatgg

SEQ ID NO: 193350 - DNA, 22 bp, Artificial Sequence
  Synthetic oligonucleotide; TTG chr2 60449827 60449848 60449844 60449849 +
tcaatcttgtatggggtttcaa

SEQ ID NO: 193351 - DNA, 22 bp, Artificial Sequence
  Synthetic oligonucleotide; CTT chr2 60449835 60449856 60449852 60449857 +
gtatggggtttcaaaagtctag

SEQ ID NO: 193352 - DNA, 22 bp, Artificial Sequence
  Synthetic oligonucleotide; TTG chr2 60449836 60449857 60449853 60449858 +
tatggggtttcaaaagtctagc

SEQ ID NO: 193353 - DNA, 22 bp, Artificial Sequence
  Synthetic oligonucleotide; TTT chr2 60449846 60449867 60449863 60449868 +
caaaagtctagccctaggccag

SEQ ID NO: 193354 - DNA, 22 bp, Artificial Sequence
  Synthetic oligonucleotide; TTC chr2 60449847 60449868 60449864 60449869 +
aaaagtctagccctaggccagg

SEQ ID NO: 193355 - DNA, 22 bp, Artificial Sequence
  Synthetic oligonucleotide; CTA chr2 60449856 60449877 60449873 60449878 +
gccctaggccaggtgaggtagt

SEQ ID NO: 193356 - DNA, 22 bp, Artificial Sequence
  Synthetic oligonucleotide; CTA chr2 60449862 60449883 60449879 60449884 +
ggccaggtgaggtagtgcaatg

SEQ ID NO: 193357 - DNA, 22 bp, Artificial Sequence
  Synthetic oligonucleotide; CTC chr2 60449888 60449909 60449905 60449910 +
taatcccagcactatgggaggc

SEQ ID NO: 193358 - DNA, 22 bp, Artificial Sequence
  Synthetic oligonucleotide; CTA chr2 60449890 60449911 60449907 60449912 +
atcccagcactatgggaggcct

SEQ ID NO: 193359 - DNA, 22 bp, Artificial Sequence
  Synthetic oligonucleotide; CTA chr2 60449902 60449923 60449919 60449924 +
tgggaggcctaggagggtggat

SEQ ID NO: 193360 - DNA, 22 bp, Artificial Sequence
  Synthetic oligonucleotide; CTA chr2 60449913 60449934 60449930 60449935 +
ggagggtggatcacgagatcag

SEQ ID NO: 193361 - DNA, 22 bp, Artificial Sequence
  Synthetic oligonucleotide; CTG chr2 60449953 60449974 60449970 60449975 +
gctaacacggtgaaacgccgta

SEQ ID NO: 193362 - DNA, 22 bp, Artificial Sequence
  Synthetic oligonucleotide; CTA chr2 60449957 60449978 60449974 60449979 +
acacggtgaaacgccgtatcta

SEQ ID NO: 193363 - DNA, 22 bp, Artificial Sequence
  Synthetic oligonucleotide; CTA chr2 60449979 60450000 60449996 60450001 +
ctaaaaatacaaaaaatattag

SEQ ID NO: 193364 - DNA, 22 bp, Artificial Sequence
  Synthetic oligonucleotide; CTA chr2 60449982 60450003 60449999 60450004 +
aaaatacaaaaaatattagctg

SEQ ID NO: 193365 - DNA, 22 bp, Artificial Sequence
  Synthetic oligonucleotide; TTA chr2 60450000 60450021 60450017 60450022 +
gctgggcgtggtggcgcgtgcc

SEQ ID NO: 193366 - DNA, 22 bp, Artificial Sequence
  Synthetic oligonucleotide; CTG chr2 60450004 60450025 60450021 60450026 +
ggcgtggtggcgcgtgcctgta

SEQ ID NO: 193367 - DNA, 22 bp, Artificial Sequence
  Synthetic oligonucleotide; CTG chr2 60450024 60450045 60450041 60450046 +
tagtcccagctacttgggaagc

SEQ ID NO: 193368 - DNA, 22 bp, Artificial Sequence
  Synthetic oligonucleotide; CTA chr2 60450036 60450057 60450053 60450058 +
cttgggaagctgaggcaggagg

SEQ ID NO: 193369 - DNA, 22 bp, Artificial Sequence
  Synthetic oligonucleotide; CTT chr2 60450039 60450060 60450056 60450061 +
gggaagctgaggcaggaggatc

SEQ ID NO: 193370 - DNA, 22 bp, Artificial Sequence
  Synthetic oligonucleotide; TTG chr2 60450040 60450061 60450057 60450062 +
ggaagctgaggcaggaggatcc

SEQ ID NO: 193371 - DNA, 22 bp, Artificial Sequence
  Synthetic oligonucleotide; CTG chr2 60450048 60450069 60450065 60450070 +
aggcaggaggatcccttgaacc

SEQ ID NO: 193372 - DNA, 22 bp, Artificial Sequence
  Synthetic oligonucleotide; CTT chr2 60450065 60450086 60450082 60450087 +
gaacccagtaggcggaggttgt

SEQ ID NO: 193373 - DNA, 22 bp, Artificial Sequence
  Synthetic oligonucleotide; TTG chr2 60450066 60450087 60450083 60450088 +
aacccagtaggcggaggttgtg

SEQ ID NO: 193374 - DNA, 22 bp, Artificial Sequence
  Synthetic oligonucleotide; TTG chr2 60450086 60450107 60450103 60450108 +
tggtgagctgagtccttgccac

SEQ ID NO: 193375 - DNA, 22 bp, Artificial Sequence
  Synthetic oligonucleotide; CTG chr2 60450096 60450117 60450113 60450118 +
agtccttgccactgcactccag

SEQ ID NO: 193376 - DNA, 22 bp, Artificial Sequence
  Synthetic oligonucleotide; CTT chr2 60450103 60450124 60450120 60450125 +
gccactgcactccagcctgggt

SEQ ID NO: 193377 - DNA, 22 bp, Artificial Sequence
  Synthetic oligonucleotide; TTG chr2 60450104 60450125 60450121 60450126 +
ccactgcactccagcctgggtg

SEQ ID NO: 193378 - DNA, 22 bp, Artificial Sequence
  Synthetic oligonucleotide; CTG chr2 60450110 60450131 60450127 60450132 +
cactccagcctgggtgacagag

SEQ ID NO: 193379 - DNA, 22 bp, Artificial Sequence
  Synthetic oligonucleotide; CTC chr2 60450115 60450136 60450132 60450137 +
cagcctgggtgacagagcgaga

SEQ ID NO: 193380 - DNA, 22 bp, Artificial Sequence
  Synthetic oligonucleotide; CTG chr2 60450122 60450143 60450139 60450144 +
ggtgacagagcgagattctgtc

SEQ ID NO: 193381 - DNA, 22 bp, Artificial Sequence
  Synthetic oligonucleotide; TTC chr2 60450140 60450161 60450157 60450162 +
tgtcttaaaaaaaaaaaaaaaa

SEQ ID NO: 193382 - DNA, 22 bp, Artificial Sequence
  Synthetic oligonucleotide; CTG chr2 60450142 60450163 60450159 60450164 +
tcttaaaaaaaaaaaaaaaaaa

SEQ ID NO: 193383 - DNA, 22 bp, Artificial Sequence
  Synthetic oligonucleotide; CTT chr2 60450146 60450167 60450163 60450168 +
aaaaaaaaaaaaaaaaaaaaaa

SEQ ID NO: 193384 - DNA, 22 bp, Artificial Sequence
  Synthetic oligonucleotide; TTA chr2 60450147 60450168 60450164 60450169 +
aaaaaaaaaaaaaaaaaaaaaa

SEQ ID NO: 193385 - DNA, 22 bp, Artificial Sequence
  Synthetic oligonucleotide; CTA chr2 60450177 60450198 60450194 60450199 +
gccctaacacaataccgtttcc

SEQ ID NO: 193386 - DNA, 22 bp, Artificial Sequence
  Synthetic oligonucleotide; CTA chr2 60450183 60450204 60450200 60450205 +
acacaataccgtttcctaataa

SEQ ID NO: 193387 - DNA, 22 bp, Artificial Sequence
  Synthetic oligonucleotide; TTT chr2 60450197 60450218 60450214 60450219 +
cctaataaattctgtaaataaa

SEQ ID NO: 193388 - DNA, 22 bp, Artificial Sequence
  Synthetic oligonucleotide; TTC chr2 60450198 60450219 60450215 60450220 +
ctaataaattctgtaaataaat

SEQ ID NO: 193389 - DNA, 22 bp, Artificial Sequence
  Synthetic oligonucleotide; CTA chr2 60450201 60450222 60450218 60450223 +
ataaattctgtaaataaatttt

SEQ ID NO: 193390 - DNA, 22 bp, Artificial Sequence
  Synthetic oligonucleotide; TTC chr2 60450209 60450230 60450226 60450231 +
tgtaaataaatttttgttgtct

SEQ ID NO: 193391 - DNA, 22 bp, Artificial Sequence
  Synthetic oligonucleotide; CTG chr2 60450211 60450232 60450228 60450233 +
taaataaatttttgttgtcttt

SEQ ID NO: 193392 - DNA, 22 bp, Artificial Sequence
  Synthetic oligonucleotide; TTT chr2 60450222 60450243 60450239 60450244 +
ttgttgtctttcaactttaaaa

SEQ ID NO: 193393 - DNA, 22 bp, Artificial Sequence
  Synthetic oligonucleotide; TTT chr2 60450223 60450244 60450240 60450245 +
tgttgtctttcaactttaaaag

SEQ ID NO: 193394 - DNA, 22 bp, Artificial Sequence
  Synthetic oligonucleotide; TTT chr2 60450224 60450245 60450241 60450246 +
gttgtctttcaactttaaaagc

SEQ ID NO: 193395 - DNA, 22 bp, Artificial Sequence
  Synthetic oligonucleotide; TTG chr2 60450225 60450246 60450242 60450247 +
ttgtctttcaactttaaaagcc

SEQ ID NO: 193396 - DNA, 22 bp, Artificial Sequence
  Synthetic oligonucleotide; TTG chr2 60450228 60450249 60450245 60450250 +
tctttcaactttaaaagccatg

SEQ ID NO: 193397 - DNA, 22 bp, Artificial Sequence
  Synthetic oligonucleotide; CTT chr2 60450232 60450253 60450249 60450254 +
tcaactttaaaagccatgggaa

SEQ ID NO: 193398 - DNA, 22 bp, Artificial Sequence
  Synthetic oligonucleotide; TTT chr2 60450233 60450254 60450250 60450255 +
caactttaaaagccatgggaaa

SEQ ID NO: 193399 - DNA, 22 bp, Artificial Sequence
  Synthetic oligonucleotide; TTC chr2 60450234 60450255 60450251 60450256 +
aactttaaaagccatgggaaaa

SEQ ID NO: 193400 - DNA, 22 bp, Artificial Sequence
  Synthetic oligonucleotide; CTT chr2 60450239 60450260 60450256 60450261 +
taaaagccatgggaaaagacag

SEQ ID NO: 193401 - DNA, 22 bp, Artificial Sequence
  Synthetic oligonucleotide; TTT chr2 60450240 60450261 60450257 60450262 +
aaaagccatgggaaaagacagt

SEQ ID NO: 193402 - DNA, 22 bp, Artificial Sequence
  Synthetic oligonucleotide; TTA chr2 60450241 60450262 60450258 60450263 +
aaagccatgggaaaagacagtc

SEQ ID NO: 193403 - DNA, 22 bp, Artificial Sequence
  Synthetic oligonucleotide; CTT chr2 60450265 60450286 60450282 60450287 +
tttgttctgtttgttttgaggg

SEQ ID NO: 193404 - DNA, 22 bp, Artificial Sequence
  Synthetic oligonucleotide; TTT chr2 60450266 60450287 60450283 60450288 +
ttgttctgtttgttttgagggg

SEQ ID NO: 193405 - DNA, 22 bp, Artificial Sequence
  Synthetic oligonucleotide; TTT chr2 60450267 60450288 60450284 60450289 +
tgttctgtttgttttgaggggg

SEQ ID NO: 193406 - DNA, 22 bp, Artificial Sequence
  Synthetic oligonucleotide; TTT chr2 60450268 60450289 60450285 60450290 +
gttctgtttgttttgagggggt

SEQ ID NO: 193407 - DNA, 22 bp, Artificial Sequence
  Synthetic oligonucleotide; TTG chr2 60450269 60450290 60450286 60450291 +
ttctgtttgttttgagggggtt

SEQ ID NO: 193408 - DNA, 22 bp, Artificial Sequence
  Synthetic oligonucleotide; TTC chr2 60450272 60450293 60450289 60450294 +
tgtttgttttgagggggttctt

SEQ ID NO: 193409 - DNA, 22 bp, Artificial Sequence
  Synthetic oligonucleotide; CTG chr2 60450274 60450295 60450291 60450296 +
tttgttttgagggggttcttct

SEQ ID NO: 193410 - DNA, 22 bp, Artificial Sequence
  Synthetic oligonucleotide; TTT chr2 60450277 60450298 60450294 60450299 +
gttttgagggggttcttctcca

SEQ ID NO: 193411 - DNA, 22 bp, Artificial Sequence
  Synthetic oligonucleotide; TTG chr2 60450278 60450299 60450295 60450300 +
ttttgagggggttcttctccac

SEQ ID NO: 193412 - DNA, 22 bp, Artificial Sequence
  Synthetic oligonucleotide; TTT chr2 60450281 60450302 60450298 60450303 +
tgagggggttcttctccacagt

SEQ ID NO: 193413 - DNA, 22 bp, Artificial Sequence
  Synthetic oligonucleotide; TTT chr2 60450282 60450303 60450299 60450304 +
gagggggttcttctccacagtg

SEQ ID NO: 193414 - DNA, 22 bp, Artificial Sequence
  Synthetic oligonucleotide; TTG chr2 60450283 60450304 60450300 60450305 +
agggggttcttctccacagtga

SEQ ID NO: 193415 - DNA, 22 bp, Artificial Sequence
  Synthetic oligonucleotide; TTC chr2 60450292 60450313 60450309 60450314 +
ttctccacagtgaagaggataa

SEQ ID NO: 193416 - DNA, 22 bp, Artificial Sequence
  Synthetic oligonucleotide; CTT chr2 60450294 60450315 60450311 60450316 +
ctccacagtgaagaggataaaa

SEQ ID NO: 193417 - DNA, 22 bp, Artificial Sequence
  Synthetic oligonucleotide; TTC chr2 60450295 60450316 60450312 60450317 +
tccacagtgaagaggataaaac

SEQ ID NO: 193418 - DNA, 22 bp, Artificial Sequence
  Synthetic oligonucleotide; CTC chr2 60450297 60450318 60450314 60450319 +
cacagtgaagaggataaaacaa

SEQ ID NO: 193419 - DNA, 22 bp, Artificial Sequence
  Synthetic oligonucleotide; CTT chr2 60450326 60450347 60450343 60450348 +
tatccacttctgttatcctctt

SEQ ID NO: 193420 - DNA, 22 bp, Artificial Sequence
  Synthetic oligonucleotide; TTT chr2 60450327 60450348 60450344 60450349 +
atccacttctgttatcctcttg

SEQ ID NO: 193421 - DNA, 22 bp, Artificial Sequence
  Synthetic oligonucleotide; TTA chr2 60450328 60450349 60450345 60450350 +
tccacttctgttatcctcttgc

SEQ ID NO: 193422 - DNA, 22 bp, Artificial Sequence
  Synthetic oligonucleotide; CTT chr2 60450335 60450356 60450352 60450357 +
ctgttatcctcttgccccttaa

SEQ ID NO: 193423 - DNA, 22 bp, Artificial Sequence
  Synthetic oligonucleotide; TTC chr2 60450336 60450357 60450353 60450358 +
tgttatcctcttgccccttaaa

SEQ ID NO: 193424 - DNA, 22 bp, Artificial Sequence
  Synthetic oligonucleotide; CTG chr2 60450338 60450359 60450355 60450360 +
ttatcctcttgccccttaaaaa

SEQ ID NO: 193425 - DNA, 22 bp, Artificial Sequence
  Synthetic oligonucleotide; TTA chr2 60450341 60450362 60450358 60450363 +
tcctcttgccccttaaaaatcc

SEQ ID NO: 193426 - DNA, 22 bp, Artificial Sequence
  Synthetic oligonucleotide; CTC chr2 60450346 60450367 60450363 60450368 +
ttgccccttaaaaatcccactt

SEQ ID NO: 193427 - DNA, 22 bp, Artificial Sequence
  Synthetic oligonucleotide; CTT chr2 60450348 60450369 60450365 60450370 +
gccccttaaaaatcccactttt

SEQ ID NO: 193428 - DNA, 22 bp, Artificial Sequence
  Synthetic oligonucleotide; TTG chr2 60450349 60450370 60450366 60450371 +
ccccttaaaaatcccactttta

SEQ ID NO: 193429 - DNA, 22 bp, Artificial Sequence
  Synthetic oligonucleotide; CTT chr2 60450355 60450376 60450372 60450377 +
aaaaatcccacttttagagata

SEQ ID NO: 193430 - DNA, 22 bp, Artificial Sequence
  Synthetic oligonucleotide; TTA chr2 60450356 60450377 60450373 60450378 +
aaaatcccacttttagagatat

SEQ ID NO: 193431 - DNA, 22 bp, Artificial Sequence
  Synthetic oligonucleotide; CTT chr2 60450368 60450389 60450385 60450390 +
ttagagatatccacttatttac

SEQ ID NO: 193432 - DNA, 22 bp, Artificial Sequence
  Synthetic oligonucleotide; TTT chr2 60450369 60450390 60450386 60450391 +
tagagatatccacttatttaca

SEQ ID NO: 193433 - DNA, 22 bp, Artificial Sequence
  Synthetic oligonucleotide; TTT chr2 60450370 60450391 60450387 60450392 +
agagatatccacttatttacaa

SEQ ID NO: 193434 - DNA, 22 bp, Artificial Sequence
  Synthetic oligonucleotide; TTA chr2 60450371 60450392 60450388 60450393 +
gagatatccacttatttacaaa

SEQ ID NO: 193435 - DNA, 22 bp, Artificial Sequence
  Synthetic oligonucleotide; CTT chr2 60450384 60450405 60450401 60450406 +
atttacaaactgactctgagaa

SEQ ID NO: 193436 - DNA, 22 bp, Artificial Sequence
  Synthetic oligonucleotide; TTA chr2 60450385 60450406 60450402 60450407 +
tttacaaactgactctgagaag

SEQ ID NO: 193437 - DNA, 22 bp, Artificial Sequence
  Synthetic oligonucleotide; TTT chr2 60450388 60450409 60450405 60450410 +
acaaactgactctgagaagaaa

SEQ ID NO: 193438 - DNA, 22 bp, Artificial Sequence
  Synthetic oligonucleotide; TTA chr2 60450389 60450410 60450406 60450411 +
caaactgactctgagaagaaat

SEQ ID NO: 193439 - DNA, 22 bp, Artificial Sequence
  Synthetic oligonucleotide; CTG chr2 60450396 60450417 60450413 60450418 +
actctgagaagaaatatataaa

SEQ ID NO: 193440 - DNA, 22 bp, Artificial Sequence
  Synthetic oligonucleotide; CTC chr2 60450400 60450421 60450417 60450422 +
tgagaagaaatatataaaaagt

SEQ ID NO: 193441 - DNA, 22 bp, Artificial Sequence
  Synthetic oligonucleotide; CTG chr2 60450402 60450423 60450419 60450424 +
agaagaaatatataaaaagtgg

SEQ ID NO: 193442 - DNA, 22 bp, Artificial Sequence
  Synthetic oligonucleotide; TTA chr2 60450476 60450497 60450493 60450498 +
caaaggctgaacttgtctcaag

SEQ ID NO: 193443 - DNA, 22 bp, Artificial Sequence
  Synthetic oligonucleotide; CTG chr2 60450485 60450506 60450502 60450507 +
aacttgtctcaagacccaggat

SEQ ID NO: 193444 - DNA, 22 bp, Artificial Sequence
  Synthetic oligonucleotide; CTT chr2 60450490 60450511 60450507 60450512 +
gtctcaagacccaggattgttg

SEQ ID NO: 193445 - DNA, 22 bp, Artificial Sequence
  Synthetic oligonucleotide; TTG chr2 60450491 60450512 60450508 60450513 +
tctcaagacccaggattgttgt

SEQ ID NO: 193446 - DNA, 22 bp, Artificial Sequence
  Synthetic oligonucleotide; CTC chr2 60450495 60450516 60450512 60450517 +
aagacccaggattgttgtttca

SEQ ID NO: 193447 - DNA, 22 bp, Artificial Sequence
  Synthetic oligonucleotide; TTG chr2 60450509 60450530 60450526 60450531 +
ttgtttcagttctggcctccct

SEQ ID NO: 193448 - DNA, 22 bp, Artificial Sequence
  Synthetic oligonucleotide; TTG chr2 60450512 60450533 60450529 60450534 +
tttcagttctggcctccctttg

SEQ ID NO: 193449 - DNA, 22 bp, Artificial Sequence
  Synthetic oligonucleotide; TTT chr2 60450515 60450536 60450532 60450537 +
cagttctggcctccctttggaa

SEQ ID NO: 193450 - DNA, 22 bp, Artificial Sequence
  Synthetic oligonucleotide; TTC chr2 60450516 60450537 60450533 60450538 +
agttctggcctccctttggaag

SEQ ID NO: 193451 - DNA, 22 bp, Artificial Sequence
  Synthetic oligonucleotide; TTC chr2 60450521 60450542 60450538 60450543 +
tggcctccctttggaagtggtg

SEQ ID NO: 193452 - DNA, 22 bp, Artificial Sequence
  Synthetic oligonucleotide; CTG chr2 60450523 60450544 60450540 60450545 +
gcctccctttggaagtggtgtc

SEQ ID NO: 193453 - DNA, 22 bp, Artificial Sequence
  Synthetic oligonucleotide; CTC chr2 60450528 60450549 60450545 60450550 +
cctttggaagtggtgtcactct

SEQ ID NO: 193454 - DNA, 22 bp, Artificial Sequence
  Synthetic oligonucleotide; CTT chr2 60450532 60450553 60450549 60450554 +
tggaagtggtgtcactctttct

SEQ ID NO: 193455 - DNA, 22 bp, Artificial Sequence
  Synthetic oligonucleotide; TTT chr2 60450533 60450554 60450550 60450555 +
ggaagtggtgtcactctttcta

SEQ ID NO: 193456 - DNA, 22 bp, Artificial Sequence
  Synthetic oligonucleotide; TTG chr2 60450534 60450555 60450551 60450556 +
gaagtggtgtcactctttctag

SEQ ID NO: 193457 - DNA, 22 bp, Artificial Sequence
  Synthetic oligonucleotide; CTC chr2 60450549 60450570 60450566 60450571 +
tttctaggcatcagcaaggagt

SEQ ID NO: 193458 - DNA, 22 bp, Artificial Sequence
  Synthetic oligonucleotide; CTT chr2 60450551 60450572 60450568 60450573 +
tctaggcatcagcaaggagttc

SEQ ID NO: 193459 - DNA, 22 bp, Artificial Sequence
  Synthetic oligonucleotide; TTT chr2 60450552 60450573 60450569 60450574 +
ctaggcatcagcaaggagttca

SEQ ID NO: 193460 - DNA, 22 bp, Artificial Sequence
  Synthetic oligonucleotide; TTC chr2 60450553 60450574 60450570 60450575 +
taggcatcagcaaggagttcag

SEQ ID NO: 193461 - DNA, 22 bp, Artificial Sequence
  Synthetic oligonucleotide; CTA chr2 60450555 60450576 60450572 60450577 +
ggcatcagcaaggagttcagca

SEQ ID NO: 193462 - DNA, 22 bp, Artificial Sequence
  Synthetic oligonucleotide; TTC chr2 60450573 60450594 60450590 60450595 +
agcacatttagggaggaagcca

SEQ ID NO: 193463 - DNA, 22 bp, Artificial Sequence
  Synthetic oligonucleotide; TTT chr2 60450582 60450603 60450599 60450604 +
agggaggaagccatcacagaaa

SEQ ID NO: 193464 - DNA, 22 bp, Artificial Sequence
  Synthetic oligonucleotide; TTA chr2 60450583 60450604 60450600 60450605 +
gggaggaagccatcacagaaac

SEQ ID NO: 193465 - DNA, 22 bp, Artificial Sequence
  Synthetic oligonucleotide; CTA chr2 60450609 60450630 60450626 60450631 +
atggtcttatgtttcagcaaca

SEQ ID NO: 193466 - DNA, 22 bp, Artificial Sequence
  Synthetic oligonucleotide; CTT chr2 60450617 60450638 60450634 60450639 +
atgtttcagcaacacataggca

SEQ ID NO: 193467 - DNA, 22 bp, Artificial Sequence
  Synthetic oligonucleotide; TTA chr2 60450618 60450639 60450635 60450640 +
tgtttcagcaacacataggcag

SEQ ID NO: 193468 - DNA, 22 bp, Artificial Sequence
  Synthetic oligonucleotide; TTT chr2 60450623 60450644 60450640 60450645 +
cagcaacacataggcagagcat

SEQ ID NO: 193469 - DNA, 22 bp, Artificial Sequence
  Synthetic oligonucleotide; TTC chr2 60450624 60450645 60450641 60450646 +
agcaacacataggcagagcatg

SEQ ID NO: 193470 - DNA, 22 bp, Artificial Sequence
  Synthetic oligonucleotide; TTT chr2 60450663 60450684 60450680 60450685 +
ctttatgaaataacttcttgtc

SEQ ID NO: 193471 - DNA, 22 bp, Artificial Sequence
  Synthetic oligonucleotide; TTC chr2 60450664 60450685 60450681 60450686 +
tttatgaaataacttcttgtct

SEQ ID NO: 193472 - DNA, 22 bp, Artificial Sequence
  Synthetic oligonucleotide; CTT chr2 60450666 60450687 60450683 60450688 +
tatgaaataacttcttgtctgg

SEQ ID NO: 193473 - DNA, 22 bp, Artificial Sequence
  Synthetic oligonucleotide; TTT chr2 60450667 60450688 60450684 60450689 +
atgaaataacttcttgtctgga

SEQ ID NO: 193474 - DNA, 22 bp, Artificial Sequence
  Synthetic oligonucleotide; TTA chr2 60450668 60450689 60450685 60450690 +
tgaaataacttcttgtctggaa

SEQ ID NO: 193475 - DNA, 22 bp, Artificial Sequence
  Synthetic oligonucleotide; CTT chr2 60450679 60450700 60450696 60450701 +
cttgtctggaagtcccaactaa

SEQ ID NO: 193476 - DNA, 22 bp, Artificial Sequence
  Synthetic oligonucleotide; TTC chr2 60450680 60450701 60450697 60450702 +
ttgtctggaagtcccaactaat

SEQ ID NO: 193477 - DNA, 22 bp, Artificial Sequence
  Synthetic oligonucleotide; CTT chr2 60450682 60450703 60450699 60450704 +
gtctggaagtcccaactaattg

SEQ ID NO: 193478 - DNA, 22 bp, Artificial Sequence
  Synthetic oligonucleotide; TTG chr2 60450683 60450704 60450700 60450705 +
tctggaagtcccaactaattga

SEQ ID NO: 193479 - DNA, 22 bp, Artificial Sequence
  Synthetic oligonucleotide; CTG chr2 60450687 60450708 60450704 60450709 +
gaagtcccaactaattgatagg

SEQ ID NO: 193480 - DNA, 22 bp, Artificial Sequence
  Synthetic oligonucleotide; CTA chr2 60450700 60450721 60450717 60450722 +
attgataggaagtcacaaacag

SEQ ID NO: 193481 - DNA, 22 bp, Artificial Sequence
  Synthetic oligonucleotide; TTG chr2 60450704 60450725 60450721 60450726 +
ataggaagtcacaaacaggcca

SEQ ID NO: 193482 - DNA, 22 bp, Artificial Sequence
  Synthetic oligonucleotide; CTC chr2 60450729 60450750 60450746 60450751 +
gtgcaatcagggttatttgtca

SEQ ID NO: 193483 - DNA, 22 bp, Artificial Sequence
  Synthetic oligonucleotide; TTA chr2 60450744 60450765 60450761 60450766 +
tttgtcatggaaaagccacagg

SEQ ID NO: 193484 - DNA, 22 bp, Artificial Sequence
  Synthetic oligonucleotide; TTT chr2 60450747 60450768 60450764 60450769 +
gtcatggaaaagccacagggga

SEQ ID NO: 193485 - DNA, 22 bp, Artificial Sequence
  Synthetic oligonucleotide; TTG chr2 60450748 60450769 60450765 60450770 +
tcatggaaaagccacaggggaa

SEQ ID NO: 193486 - DNA, 22 bp, Artificial Sequence
  Synthetic oligonucleotide; CTG chr2 60450790 60450811 60450807 60450812 +
caacctccctttctcagtgcac

SEQ ID NO: 193487 - DNA, 22 bp, Artificial Sequence
  Synthetic oligonucleotide; CTC chr2 60450797 60450818 60450814 60450819 +
cctttctcagtgcacacatctg

SEQ ID NO: 193488 - DNA, 22 bp, Artificial Sequence
  Synthetic oligonucleotide; CTT chr2 60450801 60450822 60450818 60450823 +
tctcagtgcacacatctgttgg

SEQ ID NO: 193489 - DNA, 22 bp, Artificial Sequence
  Synthetic oligonucleotide; TTT chr2 60450802 60450823 60450819 60450824 +
ctcagtgcacacatctgttggt

SEQ ID NO: 193490 - DNA, 22 bp, Artificial Sequence
  Synthetic oligonucleotide; TTC chr2 60450803 60450824 60450820 60450825 +
tcagtgcacacatctgttggta

SEQ ID NO: 193491 - DNA, 22 bp, Artificial Sequence
  Synthetic oligonucleotide; CTC chr2 60450805 60450826 60450822 60450827 +
agtgcacacatctgttggtagg

SEQ ID NO: 193492 - DNA, 22 bp, Artificial Sequence
  Synthetic oligonucleotide; CTG chr2 60450819 60450840 60450836 60450841 +
ttggtaggaagaggcaactctg

SEQ ID NO: 193493 - DNA, 22 bp, Artificial Sequence
  Synthetic oligonucleotide; TTG chr2 60450822 60450843 60450839 60450844 +
gtaggaagaggcaactctgcat

SEQ ID NO: 193494 - DNA, 22 bp, Artificial Sequence
  Synthetic oligonucleotide; CTC chr2 60450839 60450860 60450856 60450861 +
tgcatgcctttaccaaaggcca

SEQ ID NO: 193495 - DNA, 22 bp, Artificial Sequence
  Synthetic oligonucleotide; CTG chr2 60450841 60450862 60450858 60450863 +
catgcctttaccaaaggccatc

SEQ ID NO: 193496 - DNA, 22 bp, Artificial Sequence
  Synthetic oligonucleotide; CTT chr2 60450849 60450870 60450866 60450871 +
taccaaaggccatcctgggtct

SEQ ID NO: 193497 - DNA, 22 bp, Artificial Sequence
  Synthetic oligonucleotide; TTT chr2 60450850 60450871 60450867 60450872 +
accaaaggccatcctgggtctg

SEQ ID NO: 193498 - DNA, 22 bp, Artificial Sequence
  Synthetic oligonucleotide; TTA chr2 60450851 60450872 60450868 60450873 +
ccaaaggccatcctgggtctgt

SEQ ID NO: 193499 - DNA, 22 bp, Artificial Sequence
  Synthetic oligonucleotide; CTG chr2 60450866 60450887 60450883 60450888 +
ggtctgtatgtgtaagccacat

SEQ ID NO: 193500 - DNA, 22 bp, Artificial Sequence
  Synthetic oligonucleotide; CTG chr2 60450872 60450893 60450889 60450894 +
tatgtgtaagccacatgtgtgt

SEQ ID NO: 193501 - DNA, 22 bp, Artificial Sequence
  Synthetic oligonucleotide; CTG chr2 60450899 60450920 60450916 60450921 +
tgaacatttatgacttatgtgc

SEQ ID NO: 193502 - DNA, 22 bp, Artificial Sequence
  Synthetic oligonucleotide; TTT chr2 60450908 60450929 60450925 60450930 +
atgacttatgtgctaacacagg

SEQ ID NO: 193503 - DNA, 22 bp, Artificial Sequence
  Synthetic oligonucleotide; TTA chr2 60450909 60450930 60450926 60450931 +
tgacttatgtgctaacacagga

SEQ ID NO: 193504 - DNA, 22 bp, Artificial Sequence
  Synthetic oligonucleotide; CTT chr2 60450915 60450936 60450932 60450937 +
atgtgctaacacaggaaaagat

SEQ ID NO: 193505 - DNA, 22 bp, Artificial Sequence
  Synthetic oligonucleotide; TTA chr2 60450916 60450937 60450933 60450938 +
tgtgctaacacaggaaaagata

SEQ ID NO: 193506 - DNA, 22 bp, Artificial Sequence
  Synthetic oligonucleotide; CTA chr2 60450923 60450944 60450940 60450945 +
acacaggaaaagatactccctt

SEQ ID NO: 193507 - DNA, 22 bp, Artificial Sequence
  Synthetic oligonucleotide; CTC chr2 60450941 60450962 60450958 60450963 +
cctttgatcagttaaacagagt

SEQ ID NO: 193508 - DNA, 22 bp, Artificial Sequence
  Synthetic oligonucleotide; CTT chr2 60450945 60450966 60450962 60450967 +
tgatcagttaaacagagtttgg

SEQ ID NO: 193509 - DNA, 22 bp, Artificial Sequence
  Synthetic oligonucleotide; TTT chr2 60450946 60450967 60450963 60450968 +
gatcagttaaacagagtttggt

SEQ ID NO: 193510 - DNA, 22 bp, Artificial Sequence
  Synthetic oligonucleotide; TTG chr2 60450947 60450968 60450964 60450969 +
atcagttaaacagagtttggtg

SEQ ID NO: 193511 - DNA, 22 bp, Artificial Sequence
  Synthetic oligonucleotide; TTA chr2 60450955 60450976 60450972 60450977 +
aacagagtttggtgaaattagc

SEQ ID NO: 193512 - DNA, 22 bp, Artificial Sequence
  Synthetic oligonucleotide; TTT chr2 60450965 60450986 60450982 60450987 +
ggtgaaattagctctggacaag

SEQ ID NO: 193513 - DNA, 22 bp, Artificial Sequence
  Synthetic oligonucleotide; TTG chr2 60450966 60450987 60450983 60450988 +
gtgaaattagctctggacaaga

SEQ ID NO: 193514 - DNA, 22 bp, Artificial Sequence
  Synthetic oligonucleotide; TTA chr2 60450975 60450996 60450992 60450997 +
gctctggacaagaaaccagaaa

SEQ ID NO: 193515 - DNA, 22 bp, Artificial Sequence
  Synthetic oligonucleotide; CTC chr2 60450979 60451000 60450996 60451001 +
tggacaagaaaccagaaaacct

SEQ ID NO: 193516 - DNA, 22 bp, Artificial Sequence
  Synthetic oligonucleotide; CTG chr2 60450981 60451002 60450998 60451003 +
gacaagaaaccagaaaacctgg

SEQ ID NO: 193517 - DNA, 22 bp, Artificial Sequence
  Synthetic oligonucleotide; CTG chr2 60451002 60451023 60451019 60451024 +
gcttctctgctttctctcttac

SEQ ID NO: 193518 - DNA, 22 bp, Artificial Sequence
  Synthetic oligonucleotide; CTT chr2 60451006 60451027 60451023 60451028 +
ctctgctttctctcttactgat

SEQ ID NO: 193519 - DNA, 22 bp, Artificial Sequence
  Synthetic oligonucleotide; TTC chr2 60451007 60451028 60451024 60451029 +
tctgctttctctcttactgatg

SEQ ID NO: 193520 - DNA, 22 bp, Artificial Sequence
  Synthetic oligonucleotide; CTC chr2 60451009 60451030 60451026 60451031 +
tgctttctctcttactgatgtg

SEQ ID NO: 193521 - DNA, 22 bp, Artificial Sequence
  Synthetic oligonucleotide; CTG chr2 60451011 60451032 60451028 60451033 +
ctttctctcttactgatgtggc

SEQ ID NO: 193522 - DNA, 22 bp, Artificial Sequence
  Synthetic oligonucleotide; CTT chr2 60451014 60451035 60451031 60451036 +
tctctcttactgatgtggcctc

SEQ ID NO: 193523 - DNA, 22 bp, Artificial Sequence
  Synthetic oligonucleotide; TTT chr2 60451015 60451036 60451032 60451037 +
ctctcttactgatgtggcctct

SEQ ID NO: 193524 - DNA, 22 bp, Artificial Sequence
  Synthetic oligonucleotide; TTC chr2 60451016 60451037 60451033 60451038 +
tctcttactgatgtggcctctg

SEQ ID NO: 193525 - DNA, 22 bp, Artificial Sequence
  Synthetic oligonucleotide; CTC chr2 60451018 60451039 60451035 60451040 +
tcttactgatgtggcctctggc

SEQ ID NO: 193526 - DNA, 22 bp, Artificial Sequence
  Synthetic oligonucleotide; CTC chr2 60451020 60451041 60451037 60451042 +
ttactgatgtggcctctggcaa

SEQ ID NO: 193527 - DNA, 22 bp, Artificial Sequence
  Synthetic oligonucleotide; CTT chr2 60451022 60451043 60451039 60451044 +
actgatgtggcctctggcaagc

SEQ ID NO: 193528 - DNA, 22 bp, Artificial Sequence
  Synthetic oligonucleotide; TTA chr2 60451023 60451044 60451040 60451045 +
ctgatgtggcctctggcaagcc

SEQ ID NO: 193529 - DNA, 22 bp, Artificial Sequence
  Synthetic oligonucleotide; CTG chr2 60451026 60451047 60451043 60451048 +
atgtggcctctggcaagccctt

SEQ ID NO: 193530 - DNA, 22 bp, Artificial Sequence
  Synthetic oligonucleotide; CTC chr2 60451036 60451057 60451053 60451058 +
tggcaagcccttaaccttggta

SEQ ID NO: 193531 - DNA, 22 bp, Artificial Sequence
  Synthetic oligonucleotide; CTG chr2 60451038 60451059 60451055 60451060 +
gcaagcccttaaccttggtaag

SEQ ID NO: 193532 - DNA, 22 bp, Artificial Sequence
  Synthetic oligonucleotide; CTT chr2 60451048 60451069 60451065 60451070 +
aaccttggtaagcctcaatctc

SEQ ID NO: 193533 - DNA, 22 bp, Artificial Sequence
  Synthetic oligonucleotide; TTA chr2 60451049 60451070 60451066 60451071 +
accttggtaagcctcaatctcc

SEQ ID NO: 193534 - DNA, 22 bp, Artificial Sequence
  Synthetic oligonucleotide; CTT chr2 60451054 60451075 60451071 60451076 +
ggtaagcctcaatctccacctc

SEQ ID NO: 193535 - DNA, 22 bp, Artificial Sequence
  Synthetic oligonucleotide; TTG chr2 60451055 60451076 60451072 60451077 +
gtaagcctcaatctccacctcc

SEQ ID NO: 193536 - DNA, 22 bp, Artificial Sequence
  Synthetic oligonucleotide; CTC chr2 60451064 60451085 60451081 60451086 +
aatctccacctccataaagtag

SEQ ID NO: 193537 - DNA, 22 bp, Artificial Sequence
  Synthetic oligonucleotide; CTC chr2 60451070 60451091 60451087 60451092 +
cacctccataaagtagaagtcg

SEQ ID NO: 193538 - DNA, 22 bp, Artificial Sequence
  Synthetic oligonucleotide; CTC chr2 60451076 60451097 60451093 60451098 +
cataaagtagaagtcgtgagat

SEQ ID NO: 193539 - DNA, 22 bp, Artificial Sequence
  Synthetic oligonucleotide; CTG chr2 60451101 60451122 60451118 60451123 +
tcccagagagcaggtgaaataa

SEQ ID NO: 193540 - DNA, 22 bp, Artificial Sequence
  Synthetic oligonucleotide; CTG chr2 60451140 60451161 60451157 60451162 +
tatacagtataaggtagttcac

SEQ ID NO: 193541 - DNA, 22 bp, Artificial Sequence
  Synthetic oligonucleotide; TTC chr2 60451160 60451181 60451177 60451182 +
actactgtagacagtcattatt

SEQ ID NO: 193542 - DNA, 22 bp, Artificial Sequence
  Synthetic oligonucleotide; CTA chr2 60451164 60451185 60451181 60451186 +
ctgtagacagtcattatttatt

SEQ ID NO: 193543 - DNA, 22 bp, Artificial Sequence
  Synthetic oligonucleotide; CTG chr2 60451167 60451188 60451184 60451189 +
tagacagtcattatttattatg

SEQ ID NO: 193544 - DNA, 22 bp, Artificial Sequence
  Synthetic oligonucleotide; TTA chr2 60451180 60451201 60451197 60451202 +
tttattatgaataagcaggaaa

SEQ ID NO: 193545 - DNA, 22 bp, Artificial Sequence
  Synthetic oligonucleotide; TTT chr2 60451183 60451204 60451200 60451205 +
attatgaataagcaggaaataa

SEQ ID NO: 193546 - DNA, 22 bp, Artificial Sequence
  Synthetic oligonucleotide; TTA chr2 60451184 60451205 60451201 60451206 +
ttatgaataagcaggaaataat

SEQ ID NO: 193547 - DNA, 22 bp, Artificial Sequence
  Synthetic oligonucleotide; TTA chr2 60451187 60451208 60451204 60451209 +
tgaataagcaggaaataattca

SEQ ID NO: 193548 - DNA, 22 bp, Artificial Sequence
  Synthetic oligonucleotide; TTC chr2 60451208 60451229 60451225 60451230 +
acatgccaattatttggctatc

SEQ ID NO: 193549 - DNA, 22 bp, Artificial Sequence
  Synthetic oligonucleotide; TTA chr2 60451220 60451241 60451237 60451242 +
tttggctatcttttcactaagc

SEQ ID NO: 193550 - DNA, 22 bp, Artificial Sequence
  Synthetic oligonucleotide; TTT chr2 60451223 60451244 60451240 60451245 +
ggctatcttttcactaagctag

SEQ ID NO: 193551 - DNA, 22 bp, Artificial Sequence
  Synthetic oligonucleotide; TTG chr2 60451224 60451245 60451241 60451246 +
gctatcttttcactaagctagg

SEQ ID NO: 193552 - DNA, 22 bp, Artificial Sequence
  Synthetic oligonucleotide; CTA chr2 60451228 60451249 60451245 60451250 +
tcttttcactaagctaggtaat

SEQ ID NO: 193553 - DNA, 22 bp, Artificial Sequence
  Synthetic oligonucleotide; CTT chr2 60451232 60451253 60451249 60451254 +
ttcactaagctaggtaatctag

SEQ ID NO: 193554 - DNA, 22 bp, Artificial Sequence
  Synthetic oligonucleotide; TTT chr2 60451233 60451254 60451250 60451255 +
tcactaagctaggtaatctagc

SEQ ID NO: 193555 - DNA, 22 bp, Artificial Sequence
  Synthetic oligonucleotide; TTT chr2 60451234 60451255 60451251 60451256 +
cactaagctaggtaatctagcc

SEQ ID NO: 193556 - DNA, 22 bp, Artificial Sequence
  Synthetic oligonucleotide; TTC chr2 60451235 60451256 60451252 60451257 +
actaagctaggtaatctagcca

SEQ ID NO: 193557 - DNA, 22 bp, Artificial Sequence
  Synthetic oligonucleotide; CTA chr2 60451239 60451260 60451256 60451261 +
agctaggtaatctagccagaag

SEQ ID NO: 193558 - DNA, 22 bp, Artificial Sequence
  Synthetic oligonucleotide; CTA chr2 60451244 60451265 60451261 60451266 +
ggtaatctagccagaaggtgga

SEQ ID NO: 193559 - DNA, 22 bp, Artificial Sequence
  Synthetic oligonucleotide; CTA chr2 60451253 60451274 60451270 60451275 +
gccagaaggtggataggtagga

SEQ ID NO: 193560 - DNA, 22 bp, Artificial Sequence
  Synthetic oligonucleotide; TTT chr2 60451278 60451299 60451295 60451300 +
tccccacttaggttcacggcct

SEQ ID NO: 193561 - DNA, 22 bp, Artificial Sequence
  Synthetic oligonucleotide; TTT chr2 60451279 60451300 60451296 60451301 +
ccccacttaggttcacggcctg

SEQ ID NO: 193562 - DNA, 22 bp, Artificial Sequence
  Synthetic oligonucleotide; TTC chr2 60451280 60451301 60451297 60451302 +
cccacttaggttcacggcctgt

SEQ ID NO: 193563 - DNA, 22 bp, Artificial Sequence
  Synthetic oligonucleotide; CTT chr2 60451287 60451308 60451304 60451309 +
aggttcacggcctgtatgtgaa

SEQ ID NO: 193564 - DNA, 22 bp, Artificial Sequence
  Synthetic oligonucleotide; TTA chr2 60451288 60451309 60451305 60451310 +
ggttcacggcctgtatgtgaat

SEQ ID NO: 193565 - DNA, 22 bp, Artificial Sequence
  Synthetic oligonucleotide; TTC chr2 60451293 60451314 60451310 60451315 +
acggcctgtatgtgaatctaca

SEQ ID NO: 193566 - DNA, 22 bp, Artificial Sequence
  Synthetic oligonucleotide; CTG chr2 60451301 60451322 60451318 60451323 +
tatgtgaatctacagcacacag

SEQ ID NO: 193567 - DNA, 22 bp, Artificial Sequence
  Synthetic oligonucleotide; CTA chr2 60451313 60451334 60451330 60451335 +
cagcacacaggtgtctgagctc

SEQ ID NO: 193568 - DNA, 22 bp, Artificial Sequence
  Synthetic oligonucleotide; CTG chr2 60451330 60451351 60451347 60451352 +
agctctattattgacaaaccta

SEQ ID NO: 193569 - DNA, 22 bp, Artificial Sequence
  Synthetic oligonucleotide; CTC chr2 60451335 60451356 60451352 60451357 +
tattattgacaaacctatttta

SEQ ID NO: 193570 - DNA, 22 bp, Artificial Sequence
  Synthetic oligonucleotide; CTA chr2 60451337 60451358 60451354 60451359 +
ttattgacaaacctattttaat

SEQ ID NO: 193571 - DNA, 22 bp, Artificial Sequence
  Synthetic oligonucleotide; TTA chr2 60451340 60451361 60451357 60451362 +
ttgacaaacctattttaatttg

SEQ ID NO: 193572 - DNA, 22 bp, Artificial Sequence
  Synthetic oligonucleotide; TTG chr2 60451343 60451364 60451360 60451365 +
acaaacctattttaatttgcta

SEQ ID NO: 193573 - DNA, 22 bp, Artificial Sequence
  Synthetic oligonucleotide; CTA chr2 60451352 60451373 60451369 60451374 +
ttttaatttgctatgttgtttc

SEQ ID NO: 193574 - DNA, 22 bp, Artificial Sequence
  Synthetic oligonucleotide; TTT chr2 60451355 60451376 60451372 60451377 +
taatttgctatgttgtttctaa

SEQ ID NO: 193575 - DNA, 22 bp, Artificial Sequence
  Synthetic oligonucleotide; TTT chr2 60451356 60451377 60451373 60451378 +
aatttgctatgttgtttctaat

SEQ ID NO: 193576 - DNA, 22 bp, Artificial Sequence
  Synthetic oligonucleotide; TTA chr2 60451357 60451378 60451374 60451379 +
atttgctatgttgtttctaatt

SEQ ID NO: 193577 - DNA, 22 bp, Artificial Sequence
  Synthetic oligonucleotide; TTT chr2 60451361 60451382 60451378 60451383 +
gctatgttgtttctaattctct

SEQ ID NO: 193578 - DNA, 22 bp, Artificial Sequence
  Synthetic oligonucleotide; TTG chr2 60451362 60451383 60451379 60451384 +
ctatgttgtttctaattctctt

SEQ ID NO: 193579 - DNA, 22 bp, Artificial Sequence
  Synthetic oligonucleotide; CTA chr2 60451365 60451386 60451382 60451387 +
tgttgtttctaattctcttctg

SEQ ID NO: 193580 - DNA, 22 bp, Artificial Sequence
  Synthetic oligonucleotide; TTG chr2 60451370 60451391 60451387 60451392 +
tttctaattctcttctggatct

SEQ ID NO: 193581 - DNA, 22 bp, Artificial Sequence
  Synthetic oligonucleotide; TTT chr2 60451373 60451394 60451390 60451395 +
ctaattctcttctggatctcca

SEQ ID NO: 193582 - DNA, 22 bp, Artificial Sequence
  Synthetic oligonucleotide; TTC chr2 60451374 60451395 60451391 60451396 +
taattctcttctggatctccaa

SEQ ID NO: 193583 - DNA, 22 bp, Artificial Sequence
  Synthetic oligonucleotide; CTA chr2 60451376 60451397 60451393 60451398 +
attctcttctggatctccaagc

SEQ ID NO: 193584 - DNA, 22 bp, Artificial Sequence
  Synthetic oligonucleotide; TTC chr2 60451380 60451401 60451397 60451402 +
tcttctggatctccaagcagta

SEQ ID NO: 193585 - DNA, 22 bp, Artificial Sequence
  Synthetic oligonucleotide; CTC chr2 60451382 60451403 60451399 60451404 +
ttctggatctccaagcagtaaa

SEQ ID NO: 193586 - DNA, 22 bp, Artificial Sequence
  Synthetic oligonucleotide; CTT chr2 60451384 60451405 60451401 60451406 +
ctggatctccaagcagtaaaaa

SEQ ID NO: 193587 - DNA, 22 bp, Artificial Sequence
  Synthetic oligonucleotide; TTC chr2 60451385 60451406 60451402 60451407 +
tggatctccaagcagtaaaaaa

SEQ ID NO: 193588 - DNA, 22 bp, Artificial Sequence
  Synthetic oligonucleotide; CTG chr2 60451387 60451408 60451404 60451409 +
gatctccaagcagtaaaaaata

SEQ ID NO: 193589 - DNA, 22 bp, Artificial Sequence
  Synthetic oligonucleotide; CTC chr2 60451393 60451414 60451410 60451415 +
caagcagtaaaaaataccaaac

SEQ ID NO: 193590 - DNA, 22 bp, Artificial Sequence
  Synthetic oligonucleotide; CTG chr2 60451417 60451438 60451434 60451439 +
agaaaagttctgtgcaaattaa

SEQ ID NO: 193591 - DNA, 22 bp, Artificial Sequence
  Synthetic oligonucleotide; TTC chr2 60451427 60451448 60451444 60451449 +
tgtgcaaattaactgggccaga

SEQ ID NO: 193592 - DNA, 22 bp, Artificial Sequence
  Synthetic oligonucleotide; CTG chr2 60451429 60451450 60451446 60451451 +
tgcaaattaactgggccagaaa

SEQ ID NO: 193593 - DNA, 22 bp, Artificial Sequence
  Synthetic oligonucleotide; TTA chr2 60451438 60451459 60451455 60451460 +
actgggccagaaagaattttta

SEQ ID NO: 193594 - DNA, 22 bp, Artificial Sequence
  Synthetic oligonucleotide; CTG chr2 60451442 60451463 60451459 60451464 +
ggccagaaagaatttttaccac

SEQ ID NO: 193595 - DNA, 22 bp, Artificial Sequence
  Synthetic oligonucleotide; TTT chr2 60451457 60451478 60451474 60451479 +
ttaccacctgtttgtagatgta

SEQ ID NO: 193596 - DNA, 22 bp, Artificial Sequence
  Synthetic oligonucleotide; TTT chr2 60451458 60451479 60451475 60451480 +
taccacctgtttgtagatgtaa

SEQ ID NO: 193597 - DNA, 22 bp, Artificial Sequence
  Synthetic oligonucleotide; TTT chr2 60451459 60451480 60451476 60451481 +
accacctgtttgtagatgtaac

SEQ ID NO: 193598 - DNA, 22 bp, Artificial Sequence
  Synthetic oligonucleotide; TTA chr2 60451460 60451481 60451477 60451482 +
ccacctgtttgtagatgtaact

SEQ ID NO: 193599 - DNA, 22 bp, Artificial Sequence
  Synthetic oligonucleotide; CTG chr2 60451467 60451488 60451484 60451489 +
tttgtagatgtaacttatttgt

SEQ ID NO: 193600 - DNA, 22 bp, Artificial Sequence
  Synthetic oligonucleotide; TTT chr2 60451470 60451491 60451487 60451492 +
gtagatgtaacttatttgtggc

SEQ ID NO: 193601 - DNA, 22 bp, Artificial Sequence
  Synthetic oligonucleotide; TTG chr2 60451471 60451492 60451488 60451493 +
tagatgtaacttatttgtggca

SEQ ID NO: 193602 - DNA, 22 bp, Artificial Sequence
  Synthetic oligonucleotide; CTT chr2 60451483 60451504 60451500 60451505 +
atttgtggcactaatttctaag

SEQ ID NO: 193603 - DNA, 22 bp, Artificial Sequence
  Synthetic oligonucleotide; TTA chr2 60451484 60451505 60451501 60451506 +
tttgtggcactaatttctaagg

SEQ ID NO: 193604 - DNA, 22 bp, Artificial Sequence
  Synthetic oligonucleotide; TTT chr2 60451487 60451508 60451504 60451509 +
gtggcactaatttctaaggaat

SEQ ID NO: 193605 - DNA, 22 bp, Artificial Sequence
  Synthetic oligonucleotide; TTG chr2 60451488 60451509 60451505 60451510 +
tggcactaatttctaaggaata

SEQ ID NO: 193606 - DNA, 22 bp, Artificial Sequence
  Synthetic oligonucleotide; CTA chr2 60451496 60451517 60451513 60451518 +
atttctaaggaatagagcattg

SEQ ID NO: 193607 - DNA, 22 bp, Artificial Sequence
  Synthetic oligonucleotide; TTT chr2 60451500 60451521 60451517 60451522 +
ctaaggaatagagcattgctgt

SEQ ID NO: 193608 - DNA, 22 bp, Artificial Sequence
  Synthetic oligonucleotide; TTC chr2 60451501 60451522 60451518 60451523 +
taaggaatagagcattgctgtg

SEQ ID NO: 193609 - DNA, 22 bp, Artificial Sequence
  Synthetic oligonucleotide; CTA chr2 60451503 60451524 60451520 60451525 +
aggaatagagcattgctgtgat

SEQ ID NO: 193610 - DNA, 22 bp, Artificial Sequence
  Synthetic oligonucleotide; TTG chr2 60451518 60451539 60451535 60451540 +
ctgtgattgtctgttctgatgt

SEQ ID NO: 193611 - DNA, 22 bp, Artificial Sequence
  Synthetic oligonucleotide; CTG chr2 60451521 60451542 60451538 60451543 +
tgattgtctgttctgatgtgaa

SEQ ID NO: 193612 - DNA, 22 bp, Artificial Sequence
  Synthetic oligonucleotide; TTG chr2 60451527 60451548 60451544 60451549 +
tctgttctgatgtgaacttctt

SEQ ID NO: 193613 - DNA, 22 bp, Artificial Sequence
  Synthetic oligonucleotide; CTG chr2 60451531 60451552 60451548 60451553 +
ttctgatgtgaacttctttcct

SEQ ID NO: 193614 - DNA, 22 bp, Artificial Sequence
  Synthetic oligonucleotide; TTC chr2 60451534 60451555 60451551 60451556 +
tgatgtgaacttctttcctcct

SEQ ID NO: 193615 - DNA, 22 bp, Artificial Sequence
  Synthetic oligonucleotide; CTG chr2 60451536 60451557 60451553 60451558 +
atgtgaacttctttcctcctat

SEQ ID NO: 193616 - DNA, 22 bp, Artificial Sequence
  Synthetic oligonucleotide; CTT chr2 60451546 60451567 60451563 60451568 +
ctttcctcctataatttccccc

SEQ ID NO: 193617 - DNA, 22 bp, Artificial Sequence
  Synthetic oligonucleotide; TTC chr2 60451547 60451568 60451564 60451569 +
tttcctcctataatttcccccc

SEQ ID NO: 193618 - DNA, 22 bp, Artificial Sequence
  Synthetic oligonucleotide; CTT chr2 60451549 60451570 60451566 60451571 +
tcctcctataatttcccccctc

SEQ ID NO: 193619 - DNA, 22 bp, Artificial Sequence
  Synthetic oligonucleotide; TTT chr2 60451550 60451571 60451567 60451572 +
cctcctataatttcccccctct

SEQ ID NO: 193620 - DNA, 22 bp, Artificial Sequence
  Synthetic oligonucleotide; TTC chr2 60451551 60451572 60451568 60451573 +
ctcctataatttcccccctcta

SEQ ID NO: 193621 - DNA, 22 bp, Artificial Sequence
  Synthetic oligonucleotide; CTC chr2 60451554 60451575 60451571 60451576 +
ctataatttcccccctctaaaa

SEQ ID NO: 193622 - DNA, 22 bp, Artificial Sequence
  Synthetic oligonucleotide; CTA chr2 60451557 60451578 60451574 60451579 +
taatttcccccctctaaaatct

SEQ ID NO: 193623 - DNA, 22 bp, Artificial Sequence
  Synthetic oligonucleotide; TTT chr2 60451563 60451584 60451580 60451585 +
cccccctctaaaatctgcccca

SEQ ID NO: 193624 - DNA, 22 bp, Artificial Sequence
  Synthetic oligonucleotide; TTC chr2 60451564 60451585 60451581 60451586 +
ccccctctaaaatctgccccaa

SEQ ID NO: 193625 - DNA, 22 bp, Artificial Sequence
  Synthetic oligonucleotide; CTC chr2 60451571 60451592 60451588 60451593 +
taaaatctgccccaaatttcct

SEQ ID NO: 193626 - DNA, 22 bp, Artificial Sequence
  Synthetic oligonucleotide; CTA chr2 60451573 60451594 60451590 60451595 +
aaatctgccccaaatttcctga

SEQ ID NO: 193627 - DNA, 22 bp, Artificial Sequence
  Synthetic oligonucleotide; CTG chr2 60451580 60451601 60451597 60451602 +
ccccaaatttcctgatgtaagt

SEQ ID NO: 193628 - DNA, 22 bp, Artificial Sequence
  Synthetic oligonucleotide; TTT chr2 60451590 60451611 60451607 60451612 +
cctgatgtaagtactaaagaag

SEQ ID NO: 193629 - DNA, 22 bp, Artificial Sequence
  Synthetic oligonucleotide; TTC chr2 60451591 60451612 60451608 60451613 +
ctgatgtaagtactaaagaagt

SEQ ID NO: 193630 - DNA, 22 bp, Artificial Sequence
  Synthetic oligonucleotide; CTG chr2 60451594 60451615 60451611 60451616 +
atgtaagtactaaagaagtttt

SEQ ID NO: 193631 - DNA, 22 bp, Artificial Sequence
  Synthetic oligonucleotide; CTA chr2 60451606 60451627 60451623 60451628 +
aagaagttttatgtttgtttgt

SEQ ID NO: 193632 - DNA, 22 bp, Artificial Sequence
  Synthetic oligonucleotide; TTT chr2 60451615 60451636 60451632 60451637 +
tatgtttgtttgtctgcattaa

SEQ ID NO: 193633 - DNA, 22 bp, Artificial Sequence
  Synthetic oligonucleotide; TTT chr2 60451616 60451637 60451633 60451638 +
atgtttgtttgtctgcattaag

SEQ ID NO: 193634 - DNA, 22 bp, Artificial Sequence
  Synthetic oligonucleotide; TTA chr2 60451617 60451638 60451634 60451639 +
tgtttgtttgtctgcattaaga

SEQ ID NO: 193635 - DNA, 22 bp, Artificial Sequence
  Synthetic oligonucleotide; TTT chr2 60451622 60451643 60451639 60451644 +
gtttgtctgcattaagatatat

SEQ ID NO: 193636 - DNA, 22 bp, Artificial Sequence
  Synthetic oligonucleotide; TTG chr2 60451623 60451644 60451640 60451645 +
tttgtctgcattaagatatatt

SEQ ID NO: 193637 - DNA, 22 bp, Artificial Sequence
  Synthetic oligonucleotide; TTT chr2 60451626 60451647 60451643 60451648 +
gtctgcattaagatatatttcc

SEQ ID NO: 193638 - DNA, 22 bp, Artificial Sequence
  Synthetic oligonucleotide; TTG chr2 60451627 60451648 60451644 60451649 +
tctgcattaagatatatttcct

SEQ ID NO: 193639 - DNA, 22 bp, Artificial Sequence
  Synthetic oligonucleotide; CTG chr2 60451631 60451652 60451648 60451653 +
cattaagatatatttcctgaag

SEQ ID NO: 193640 - DNA, 22 bp, Artificial Sequence
  Synthetic oligonucleotide; TTA chr2 60451636 60451657 60451653 60451658 +
agatatatttcctgaaggtttg

SEQ ID NO: 193641 - DNA, 22 bp, Artificial Sequence
  Synthetic oligonucleotide; TTT chr2 60451646 60451667 60451663 60451668 +
cctgaaggtttgggaacctaaa

SEQ ID NO: 193642 - DNA, 22 bp, Artificial Sequence
  Synthetic oligonucleotide; TTC chr2 60451647 60451668 60451664 60451669 +
ctgaaggtttgggaacctaaaa

SEQ ID NO: 193643 - DNA, 22 bp, Artificial Sequence
  Synthetic oligonucleotide; CTG chr2 60451650 60451671 60451667 60451672 +
aaggtttgggaacctaaaatta

SEQ ID NO: 193644 - DNA, 22 bp, Artificial Sequence
  Synthetic oligonucleotide; TTT chr2 60451657 60451678 60451674 60451679 +
gggaacctaaaattagaatatt

SEQ ID NO: 193645 - DNA, 22 bp, Artificial Sequence
  Synthetic oligonucleotide; TTG chr2 60451658 60451679 60451675 60451680 +
ggaacctaaaattagaatattt

SEQ ID NO: 193646 - DNA, 22 bp, Artificial Sequence
  Synthetic oligonucleotide; CTA chr2 60451666 60451687 60451683 60451688 +
aaattagaatatttaataagaa

SEQ ID NO: 193647 - DNA, 22 bp, Artificial Sequence
  Synthetic oligonucleotide; TTA chr2 60451672 60451693 60451689 60451694 +
gaatatttaataagaaactact

SEQ ID NO: 193648 - DNA, 22 bp, Artificial Sequence
  Synthetic oligonucleotide; TTT chr2 60451680 60451701 60451697 60451702 +
aataagaaactactgacattta

SEQ ID NO: 193649 - DNA, 22 bp, Artificial Sequence
  Synthetic oligonucleotide; TTA chr2 60451681 60451702 60451698 60451703 +
ataagaaactactgacatttat

SEQ ID NO: 193650 - DNA, 22 bp, Artificial Sequence
  Synthetic oligonucleotide; CTA chr2 60451692 60451713 60451709 60451714 +
ctgacatttatcaccttcttta

SEQ ID NO: 193651 - DNA, 22 bp, Artificial Sequence
  Synthetic oligonucleotide; CTG chr2 60451695 60451716 60451712 60451717 +
acatttatcaccttctttagga

SEQ ID NO: 193652 - DNA, 22 bp, Artificial Sequence
  Synthetic oligonucleotide; TTT chr2 60451701 60451722 60451718 60451723 +
atcaccttctttaggatttacc

SEQ ID NO: 193653 - DNA, 22 bp, Artificial Sequence
  Synthetic oligonucleotide; TTA chr2 60451702 60451723 60451719 60451724 +
tcaccttctttaggatttaccg

SEQ ID NO: 193654 - DNA, 22 bp, Artificial Sequence
  Synthetic oligonucleotide; CTT chr2 60451709 60451730 60451726 60451731 +
ctttaggatttaccgctcgccc

SEQ ID NO: 193655 - DNA, 22 bp, Artificial Sequence
  Synthetic oligonucleotide; TTC chr2 60451710 60451731 60451727 60451732 +
tttaggatttaccgctcgccca

SEQ ID NO: 193656 - DNA, 22 bp, Artificial Sequence
  Synthetic oligonucleotide; CTT chr2 60451712 60451733 60451729 60451734 +
taggatttaccgctcgcccagt

SEQ ID NO: 193657 - DNA, 22 bp, Artificial Sequence
  Synthetic oligonucleotide; TTT chr2 60451713 60451734 60451730 60451735 +
aggatttaccgctcgcccagtg

SEQ ID NO: 193658 - DNA, 22 bp, Artificial Sequence
  Synthetic oligonucleotide; TTA chr2 60451714 60451735 60451731 60451736 +
ggatttaccgctcgcccagtga

SEQ ID NO: 193659 - DNA, 22 bp, Artificial Sequence
  Synthetic oligonucleotide; TTT chr2 60451720 60451741 60451737 60451742 +
accgctcgcccagtgatgttct

SEQ ID NO: 193660 - DNA, 22 bp, Artificial Sequence
  Synthetic oligonucleotide; TTA chr2 60451721 60451742 60451738 60451743 +
ccgctcgcccagtgatgttctt

SEQ ID NO: 193661 - DNA, 22 bp, Artificial Sequence
  Synthetic oligonucleotide; CTC chr2 60451727 60451748 60451744 60451749 +
gcccagtgatgttctttcctaa

SEQ ID NO: 193662 - DNA, 22 bp, Artificial Sequence
  Synthetic oligonucleotide; TTC chr2 60451741 60451762 60451758 60451763 +
tttcctaagctaaattaaaaga

SEQ ID NO: 193663 - DNA, 22 bp, Artificial Sequence
  Synthetic oligonucleotide; CTT chr2 60451743 60451764 60451760 60451765 +
tcctaagctaaattaaaagaca

SEQ ID NO: 193664 - DNA, 22 bp, Artificial Sequence
  Synthetic oligonucleotide; TTT chr2 60451744 60451765 60451761 60451766 +
cctaagctaaattaaaagacaa

SEQ ID NO: 193665 - DNA, 22 bp, Artificial Sequence
  Synthetic oligonucleotide; TTC chr2 60451745 60451766 60451762 60451767 +
ctaagctaaattaaaagacaaa

SEQ ID NO: 193666 - DNA, 22 bp, Artificial Sequence
  Synthetic oligonucleotide; CTA chr2 60451748 60451769 60451765 60451770 +
agctaaattaaaagacaaattc

SEQ ID NO: 193667 - DNA, 22 bp, Artificial Sequence
  Synthetic oligonucleotide; CTA chr2 60451753 60451774 60451770 60451775 +
aattaaaagacaaattcaaatc

SEQ ID NO: 193668 - DNA, 22 bp, Artificial Sequence
  Synthetic oligonucleotide; TTA chr2 60451758 60451779 60451775 60451780 +
aaagacaaattcaaatcctgca

SEQ ID NO: 193669 - DNA, 22 bp, Artificial Sequence
  Synthetic oligonucleotide; TTC chr2 60451770 60451791 60451787 60451792 +
aaatcctgcatggtagccacca

SEQ ID NO: 193670 - DNA, 22 bp, Artificial Sequence
  Synthetic oligonucleotide; CTG chr2 60451778 60451799 60451795 60451800 +
catggtagccaccaaaagcata

SEQ ID NO: 193671 - DNA, 22 bp, Artificial Sequence
  Synthetic oligonucleotide; TTT chr2 60451805 60451826 60451822 60451827 +
gaaaaacaggattcggcgtgcc

SEQ ID NO: 193672 - DNA, 22 bp, Artificial Sequence
  Synthetic oligonucleotide; TTG chr2 60451806 60451827 60451823 60451828 +
aaaaacaggattcggcgtgcca

SEQ ID NO: 193673 - DNA, 22 bp, Artificial Sequence
  Synthetic oligonucleotide; TTC chr2 60451819 60451840 60451836 60451841 +
ggcgtgccatattatgcattat

SEQ ID NO: 193674 - DNA, 22 bp, Artificial Sequence
  Synthetic oligonucleotide; TTA chr2 60451833 60451854 60451850 60451855 +
tgcattatttaatggtatgcaa

SEQ ID NO: 193675 - DNA, 22 bp, Artificial Sequence
  Synthetic oligonucleotide; TTA chr2 60451840 60451861 60451857 60451862 +
tttaatggtatgcaaattataa

SEQ ID NO: 193676 - DNA, 22 bp, Artificial Sequence
  Synthetic oligonucleotide; TTT chr2 60451843 60451864 60451860 60451865 +
aatggtatgcaaattataagtc

SEQ ID NO: 193677 - DNA, 22 bp, Artificial Sequence
  Synthetic oligonucleotide; TTA chr2 60451844 60451865 60451861 60451866 +
atggtatgcaaattataagtca

SEQ ID NO: 193678 - DNA, 22 bp, Artificial Sequence
  Synthetic oligonucleotide; TTA chr2 60451859 60451880 60451876 60451881 +
taagtcagacagttaggaaaac

SEQ ID NO: 193679 - DNA, 22 bp, Artificial Sequence
  Synthetic oligonucleotide; TTA chr2 60451874 60451895 60451891 60451896 +
ggaaaaccacacttcagcatta

SEQ ID NO: 193680 - DNA, 22 bp, Artificial Sequence
  Synthetic oligonucleotide; CTT chr2 60451888 60451909 60451905 60451910 +
cagcattaataaacagcaatat

SEQ ID NO: 193681 - DNA, 22 bp, Artificial Sequence
  Synthetic oligonucleotide; TTC chr2 60451889 60451910 60451906 60451911 +
agcattaataaacagcaatatt

SEQ ID NO: 193682 - DNA, 22 bp, Artificial Sequence
  Synthetic oligonucleotide; TTA chr2 60451896 60451917 60451913 60451918 +
ataaacagcaatattactacta

SEQ ID NO: 193683 - DNA, 22 bp, Artificial Sequence
  Synthetic oligonucleotide; TTA chr2 60451912 60451933 60451929 60451934 +
ctactacattaattatgatatt

SEQ ID NO: 193684 - DNA, 22 bp, Artificial Sequence
  Synthetic oligonucleotide; CTA chr2 60451915 60451936 60451932 60451937 +
ctacattaattatgatattgct

SEQ ID NO: 193685 - DNA, 22 bp, Artificial Sequence
  Synthetic oligonucleotide; CTA chr2 60451918 60451939 60451935 60451940 +
cattaattatgatattgctatg

SEQ ID NO: 193686 - DNA, 22 bp, Artificial Sequence
  Synthetic oligonucleotide; TTA chr2 60451923 60451944 60451940 60451945 +
attatgatattgctatgattta

SEQ ID NO: 193687 - DNA, 22 bp, Artificial Sequence
  Synthetic oligonucleotide; TTA chr2 60451927 60451948 60451944 60451949 +
tgatattgctatgatttattcc

SEQ ID NO: 193688 - DNA, 22 bp, Artificial Sequence
  Synthetic oligonucleotide; TTG chr2 60451935 60451956 60451952 60451957 +
ctatgatttattcccaagtttt

SEQ ID NO: 193689 - DNA, 22 bp, Artificial Sequence
  Synthetic oligonucleotide; CTA chr2 60451938 60451959 60451955 60451960 +
tgatttattcccaagttttgca

SEQ ID NO: 193690 - DNA, 22 bp, Artificial Sequence
  Synthetic oligonucleotide; TTT chr2 60451944 60451965 60451961 60451966 +
attcccaagttttgcattttga

SEQ ID NO: 193691 - DNA, 22 bp, Artificial Sequence
  Synthetic oligonucleotide; TTA chr2 60451945 60451966 60451962 60451967 +
ttcccaagttttgcattttgat

SEQ ID NO: 193692 - DNA, 22 bp, Artificial Sequence
  Synthetic oligonucleotide; TTC chr2 60451948 60451969 60451965 60451970 +
ccaagttttgcattttgattct

SEQ ID NO: 193693 - DNA, 22 bp, Artificial Sequence
  Synthetic oligonucleotide; TTT chr2 60451956 60451977 60451973 60451978 +
tgcattttgattctccttgaaa

SEQ ID NO: 193694 - DNA, 22 bp, Artificial Sequence
  Synthetic oligonucleotide; TTT chr2 60451957 60451978 60451974 60451979 +
gcattttgattctccttgaaaa

SEQ ID NO: 193695 - DNA, 22 bp, Artificial Sequence
  Synthetic oligonucleotide; TTG chr2 60451958 60451979 60451975 60451980 +
cattttgattctccttgaaaat

SEQ ID NO: 193696 - DNA, 22 bp, Artificial Sequence
  Synthetic oligonucleotide; TTT chr2 60451963 60451984 60451980 60451985 +
tgattctccttgaaaatttatg

SEQ ID NO: 193697 - DNA, 22 bp, Artificial Sequence
  Synthetic oligonucleotide; TTT chr2 60451964 60451985 60451981 60451986 +
gattctccttgaaaatttatgc

SEQ ID NO: 193698 - DNA, 22 bp, Artificial Sequence
  Synthetic oligonucleotide; TTG chr2 60451965 60451986 60451982 60451987 +
attctccttgaaaatttatgcc

SEQ ID NO: 193699 - DNA, 22 bp, Artificial Sequence
  Synthetic oligonucleotide; TTC chr2 60451969 60451990 60451986 60451991 +
tccttgaaaatttatgccatct

SEQ ID NO: 193700 - DNA, 22 bp, Artificial Sequence
  Synthetic oligonucleotide; CTC chr2 60451971 60451992 60451988 60451993 +
cttgaaaatttatgccatctga

SEQ ID NO: 193701 - DNA, 22 bp, Artificial Sequence
  Synthetic oligonucleotide; CTT chr2 60451974 60451995 60451991 60451996 +
gaaaatttatgccatctgataa

SEQ ID NO: 193702 - DNA, 22 bp, Artificial Sequence
  Synthetic oligonucleotide; TTG chr2 60451975 60451996 60451992 60451997 +
aaaatttatgccatctgataag

SEQ ID NO: 193703 - DNA, 22 bp, Artificial Sequence
  Synthetic oligonucleotide; TTT chr2 60451982 60452003 60451999 60452004 +
atgccatctgataagcggtaac

SEQ ID NO: 193704 - DNA, 22 bp, Artificial Sequence
  Synthetic oligonucleotide; TTA chr2 60451983 60452004 60452000 60452005 +
tgccatctgataagcggtaacc

SEQ ID NO: 193705 - DNA, 22 bp, Artificial Sequence
  Synthetic oligonucleotide; CTG chr2 60451992 60452013 60452009 60452014 +
ataagcggtaacctagttcccc

SEQ ID NO: 193706 - DNA, 22 bp, Artificial Sequence
  Synthetic oligonucleotide; CTA chr2 60452007 60452028 60452024 60452029 +
gttcccctcctacatctcctgc

SEQ ID NO: 193707 - DNA, 22 bp, Artificial Sequence
  Synthetic oligonucleotide; TTC chr2 60452011 60452032 60452028 60452033 +
ccctcctacatctcctgcccat

SEQ ID NO: 193708 - DNA, 22 bp, Artificial Sequence
  Synthetic oligonucleotide; CTC chr2 60452016 60452037 60452033 60452038 +
ctacatctcctgcccatttctc

SEQ ID NO: 193709 - DNA, 22 bp, Artificial Sequence
  Synthetic oligonucleotide; CTA chr2 60452019 60452040 60452036 60452041 +
catctcctgcccatttctcaaa

SEQ ID NO: 193710 - DNA, 22 bp, Artificial Sequence
  Synthetic oligonucleotide; CTC chr2 60452025 60452046 60452042 60452047 +
ctgcccatttctcaaatctgtt

SEQ ID NO: 193711 - DNA, 22 bp, Artificial Sequence
  Synthetic oligonucleotide; CTG chr2 60452028 60452049 60452045 60452050 +
cccatttctcaaatctgttcct

SEQ ID NO: 193712 - DNA, 22 bp, Artificial Sequence
  Synthetic oligonucleotide; TTT chr2 60452035 60452056 60452052 60452057 +
ctcaaatctgttcctcctaccc

SEQ ID NO: 193713 - DNA, 22 bp, Artificial Sequence
  Synthetic oligonucleotide; TTC chr2 60452036 60452057 60452053 60452058 +
tcaaatctgttcctcctaccca

SEQ ID NO: 193714 - DNA, 22 bp, Artificial Sequence
  Synthetic oligonucleotide; CTC chr2 60452038 60452059 60452055 60452060 +
aaatctgttcctcctacccacc

SEQ ID NO: 193715 - DNA, 22 bp, Artificial Sequence
  Synthetic oligonucleotide; CTG chr2 60452045 60452066 60452062 60452067 +
ttcctcctacccacccgatggg

SEQ ID NO: 193716 - DNA, 22 bp, Artificial Sequence
  Synthetic oligonucleotide; TTC chr2 60452048 60452069 60452065 60452070 +
ctcctacccacccgatgggtgt

SEQ ID NO: 193717 - DNA, 22 bp, Artificial Sequence
  Synthetic oligonucleotide; CTC chr2 60452051 60452072 60452068 60452073 +
ctacccacccgatgggtgtctg

SEQ ID NO: 193718 - DNA, 22 bp, Artificial Sequence
  Synthetic oligonucleotide; CTA chr2 60452054 60452075 60452071 60452076 +
cccacccgatgggtgtctgtag

SEQ ID NO: 193719 - DNA, 22 bp, Artificial Sequence
  Synthetic oligonucleotide; CTG chr2 60452073 60452094 60452090 60452095 +
taggaaacaggtacagaagtac

SEQ ID NO: 193720 - DNA, 22 bp, Artificial Sequence
  Synthetic oligonucleotide; CTC chr2 60452113 60452134 60452130 60452135 +
attgtcttataagcattaaaaa

SEQ ID NO: 193721 - DNA, 22 bp, Artificial Sequence
  Synthetic oligonucleotide; TTG chr2 60452117 60452138 60452134 60452139 +
tcttataagcattaaaaattaa

SEQ ID NO: 193722 - DNA, 22 bp, Artificial Sequence
  Synthetic oligonucleotide; CTT chr2 60452121 60452142 60452138 60452143 +
ataagcattaaaaattaaagaa

SEQ ID NO: 193723 - DNA, 22 bp, Artificial Sequence
  Synthetic oligonucleotide; TTA chr2 60452122 60452143 60452139 60452144 +
taagcattaaaaattaaagaac

SEQ ID NO: 193724 - DNA, 22 bp, Artificial Sequence
  Synthetic oligonucleotide; TTA chr2 60452131 60452152 60452148 60452153 +
aaaattaaagaacaagcaaaca

SEQ ID NO: 193725 - DNA, 22 bp, Artificial Sequence
  Synthetic oligonucleotide; TTA chr2 60452138 60452159 60452155 60452160 +
aagaacaagcaaacaccaccta

SEQ ID NO: 193726 - DNA, 22 bp, Artificial Sequence
  Synthetic oligonucleotide; CTA chr2 60452160 60452181 60452177 60452182 +
aagctccaacatttattgtgtc

SEQ ID NO: 193727 - DNA, 22 bp, Artificial Sequence
  Synthetic oligonucleotide; CTC chr2 60452166 60452187 60452183 60452188 +
caacatttattgtgtcaatgtt

SEQ ID NO: 193728 - DNA, 22 bp, Artificial Sequence
  Synthetic oligonucleotide; TTT chr2 60452174 60452195 60452191 60452196 +
attgtgtcaatgttaagcacac

SEQ ID NO: 193729 - DNA, 22 bp, Artificial Sequence
  Synthetic oligonucleotide; TTA chr2 60452175 60452196 60452192 60452197 +
ttgtgtcaatgttaagcacact

SEQ ID NO: 193730 - DNA, 22 bp, Artificial Sequence
  Synthetic oligonucleotide; TTG chr2 60452178 60452199 60452195 60452200 +
tgtcaatgttaagcacactttt

SEQ ID NO: 193731 - DNA, 22 bp, Artificial Sequence
  Synthetic oligonucleotide; TTA chr2 60452189 60452210 60452206 60452211 +
agcacactttttaaaagacaac

SEQ ID NO: 193732 - DNA, 22 bp, Artificial Sequence
  Synthetic oligonucleotide; CTT chr2 60452198 60452219 60452215 60452220 +
tttaaaagacaacatagaatgt

SEQ ID NO: 193733 - DNA, 22 bp, Artificial Sequence
  Synthetic oligonucleotide; TTT chr2 60452199 60452220 60452216 60452221 +
ttaaaagacaacatagaatgta

SEQ ID NO: 193734 - DNA, 22 bp, Artificial Sequence
  Synthetic oligonucleotide; TTT chr2 60452200 60452221 60452217 60452222 +
taaaagacaacatagaatgtat

SEQ ID NO: 193735 - DNA, 22 bp, Artificial Sequence
  Synthetic oligonucleotide; TTT chr2 60452201 60452222 60452218 60452223 +
aaaagacaacatagaatgtata

SEQ ID NO: 193736 - DNA, 22 bp, Artificial Sequence
  Synthetic oligonucleotide; TTA chr2 60452202 60452223 60452219 60452224 +
aaagacaacatagaatgtatag

SEQ ID NO: 193737 - DNA, 22 bp, Artificial Sequence
  Synthetic oligonucleotide; TTG chr2 60452237 60452258 60452254 60452259 +
gggactcatgcgcatttccaca

SEQ ID NO: 193738 - DNA, 22 bp, Artificial Sequence
  Synthetic oligonucleotide; CTC chr2 60452244 60452265 60452261 60452266 +
atgcgcatttccacaatacagg

SEQ ID NO: 193739 - DNA, 22 bp, Artificial Sequence
  Synthetic oligonucleotide; TTT chr2 60452254 60452275 60452271 60452276 +
ccacaatacaggtaattaggtt

SEQ ID NO: 193740 - DNA, 22 bp, Artificial Sequence
  Synthetic oligonucleotide; TTC chr2 60452255 60452276 60452272 60452277 +
cacaatacaggtaattaggttg

SEQ ID NO: 193741 - DNA, 22 bp, Artificial Sequence
  Synthetic oligonucleotide; TTA chr2 60452272 60452293 60452289 60452294 +
ggttggctggtttcagaagggc

SEQ ID NO: 193742 - DNA, 22 bp, Artificial Sequence
  Synthetic oligonucleotide; TTG chr2 60452277 60452298 60452294 60452299 +
gctggtttcagaagggccaggg

SEQ ID NO: 193743 - DNA, 22 bp, Artificial Sequence
  Synthetic oligonucleotide; CTG chr2 60452281 60452302 60452298 60452303 +
gtttcagaagggccagggcatc

SEQ ID NO: 193744 - DNA, 22 bp, Artificial Sequence
  Synthetic oligonucleotide; TTT chr2 60452285 60452306 60452302 60452307 +
cagaagggccagggcatcactc

SEQ ID NO: 193745 - DNA, 22 bp, Artificial Sequence
  Synthetic oligonucleotide; TTC chr2 60452286 60452307 60452303 60452308 +
agaagggccagggcatcactca

SEQ ID NO: 193746 - DNA, 22 bp, Artificial Sequence
  Synthetic oligonucleotide; CTC chr2 60452307 60452328 60452324 60452329 +
atgacagcgatggtccacgggc

SEQ ID NO: 193747 - DNA, 22 bp, Artificial Sequence
  Synthetic oligonucleotide; CTC chr2 60452333 60452354 60452350 60452355 +
tctatgggactgattcactgtt

SEQ ID NO: 193748 - DNA, 22 bp, Artificial Sequence
  Synthetic oligonucleotide; CTC chr2 60452335 60452356 60452352 60452357 +
tatgggactgattcactgttcc

SEQ ID NO: 193749 - DNA, 22 bp, Artificial Sequence
  Synthetic oligonucleotide; CTA chr2 60452337 60452358 60452354 60452359 +
tgggactgattcactgttccaa

SEQ ID NO: 193750 - DNA, 22 bp, Artificial Sequence
  Synthetic oligonucleotide; CTG chr2 60452345 60452366 60452362 60452367 +
attcactgttccaatgtgggtc

SEQ ID NO: 193751 - DNA, 22 bp, Artificial Sequence
  Synthetic oligonucleotide; TTC chr2 60452349 60452370 60452366 60452371 +
actgttccaatgtgggtctgtt

SEQ ID NO: 193752 - DNA, 22 bp, Artificial Sequence
  Synthetic oligonucleotide; CTG chr2 60452353 60452374 60452370 60452375 +
ttccaatgtgggtctgtttttt

SEQ ID NO: 193753 - DNA, 22 bp, Artificial Sequence
  Synthetic oligonucleotide; TTC chr2 60452356 60452377 60452373 60452378 +
caatgtgggtctgtttttttgt

SEQ ID NO: 193754 - DNA, 22 bp, Artificial Sequence
  Synthetic oligonucleotide; CTG chr2 60452369 60452390 60452386 60452391 +
tttttttgtttttactttttat

SEQ ID NO: 193755 - DNA, 22 bp, Artificial Sequence
  Synthetic oligonucleotide; TTT chr2 60452372 60452393 60452389 60452394 +
ttttgtttttactttttattaa

SEQ ID NO: 193756 - DNA, 22 bp, Artificial Sequence
  Synthetic oligonucleotide; TTT chr2 60452373 60452394 60452390 60452395 +
tttgtttttactttttattaaa

SEQ ID NO: 193757 - DNA, 22 bp, Artificial Sequence
  Synthetic oligonucleotide; TTT chr2 60452374 60452395 60452391 60452396 +
ttgtttttactttttattaaaa

SEQ ID NO: 193758 - DNA, 22 bp, Artificial Sequence
  Synthetic oligonucleotide; TTT chr2 60452375 60452396 60452392 60452397 +
tgtttttactttttattaaaaa

SEQ ID NO: 193759 - DNA, 22 bp, Artificial Sequence
  Synthetic oligonucleotide; TTT chr2 60452376 60452397 60452393 60452398 +
gtttttactttttattaaaaaa

SEQ ID NO: 193760 - DNA, 22 bp, Artificial Sequence
  Synthetic oligonucleotide; TTG chr2 60452377 60452398 60452394 60452399 +
tttttactttttattaaaaaat

SEQ ID NO: 193761 - DNA, 22 bp, Artificial Sequence
  Synthetic oligonucleotide; TTT chr2 60452380 60452401 60452397 60452402 +
ttactttttattaaaaaatata

SEQ ID NO: 193762 - DNA, 22 bp, Artificial Sequence
  Synthetic oligonucleotide; TTT chr2 60452381 60452402 60452398 60452403 +
tactttttattaaaaaatataa

SEQ ID NO: 193763 - DNA, 22 bp, Artificial Sequence
  Synthetic oligonucleotide; TTT chr2 60452382 60452403 60452399 60452404 +
actttttattaaaaaatataaa

SEQ ID NO: 193764 - DNA, 22 bp, Artificial Sequence
  Synthetic oligonucleotide; TTA chr2 60452383 60452404 60452400 60452405 +
ctttttattaaaaaatataaat

SEQ ID NO: 193765 - DNA, 22 bp, Artificial Sequence
  Synthetic oligonucleotide; CTT chr2 60452386 60452407 60452403 60452408 +
tttattaaaaaatataaataaa

SEQ ID NO: 193766 - DNA, 22 bp, Artificial Sequence
  Synthetic oligonucleotide; TTT chr2 60452387 60452408 60452404 60452409 +
ttattaaaaaatataaataaaa

SEQ ID NO: 193767 - DNA, 22 bp, Artificial Sequence
  Synthetic oligonucleotide; TTT chr2 60452388 60452409 60452405 60452410 +
tattaaaaaatataaataaaat

SEQ ID NO: 193768 - DNA, 22 bp, Artificial Sequence
  Synthetic oligonucleotide; TTT chr2 60452389 60452410 60452406 60452411 +
attaaaaaatataaataaaatg

SEQ ID NO: 193769 - DNA, 22 bp, Artificial Sequence
  Synthetic oligonucleotide; TTA chr2 60452390 60452411 60452407 60452412 +
ttaaaaaatataaataaaatgg

SEQ ID NO: 193770 - DNA, 22 bp, Artificial Sequence
  Synthetic oligonucleotide; TTA chr2 60452393 60452414 60452410 60452415 +
aaaaatataaataaaatggcgc

SEQ ID NO: 193771 - DNA, 22 bp, Artificial Sequence
  Synthetic oligonucleotide; CTG chr2 60452417 60452438 60452434 60452439 +
caggcctaggctggaaggactc

SEQ ID NO: 193772 - DNA, 22 bp, Artificial Sequence
  Synthetic oligonucleotide; CTA chr2 60452425 60452446 60452442 60452447 +
ggctggaaggactctgcaggac

SEQ ID NO: 193773 - DNA, 22 bp, Artificial Sequence
  Synthetic oligonucleotide; CTG chr2 60452430 60452451 60452447 60452452 +
gaaggactctgcaggactctgt

SEQ ID NO: 193774 - DNA, 22 bp, Artificial Sequence
  Synthetic oligonucleotide; CTC chr2 60452439 60452460 60452456 60452461 +
tgcaggactctgtcttcgcaca

SEQ ID NO: 193775 - DNA, 22 bp, Artificial Sequence
  Synthetic oligonucleotide; CTG chr2 60452441 60452462 60452458 60452463 +
caggactctgtcttcgcacaac

SEQ ID NO: 193776 - DNA, 22 bp, Artificial Sequence
  Synthetic oligonucleotide; CTC chr2 60452449 60452470 60452466 60452471 +
tgtcttcgcacaacggcttctt

SEQ ID NO: 193777 - DNA, 22 bp, Artificial Sequence
  Synthetic oligonucleotide; CTG chr2 60452451 60452472 60452468 60452473 +
tcttcgcacaacggcttcttgg

SEQ ID NO: 193778 - DNA, 22 bp, Artificial Sequence
  Synthetic oligonucleotide; CTT chr2 60452455 60452476 60452472 60452477 +
cgcacaacggcttcttggaggc

SEQ ID NO: 193779 - DNA, 22 bp, Artificial Sequence
  Synthetic oligonucleotide; TTC chr2 60452456 60452477 60452473 60452478 +
gcacaacggcttcttggaggct

SEQ ID NO: 193780 - DNA, 22 bp, Artificial Sequence
  Synthetic oligonucleotide; CTT chr2 60452468 60452489 60452485 60452490 +
cttggaggctactgtcagaaaa

SEQ ID NO: 193781 - DNA, 22 bp, Artificial Sequence
  Synthetic oligonucleotide; TTC chr2 60452469 60452490 60452486 60452491 +
ttggaggctactgtcagaaaac

SEQ ID NO: 193782 - DNA, 22 bp, Artificial Sequence
  Synthetic oligonucleotide; CTT chr2 60452471 60452492 60452488 60452493 +
ggaggctactgtcagaaaacat

SEQ ID NO: 193783 - DNA, 22 bp, Artificial Sequence
  Synthetic oligonucleotide; TTG chr2 60452472 60452493 60452489 60452494 +
gaggctactgtcagaaaacatc

SEQ ID NO: 193784 - DNA, 22 bp, Artificial Sequence
  Synthetic oligonucleotide; CTA chr2 60452479 60452500 60452496 60452501 +
ctgtcagaaaacatcacaaact

SEQ ID NO: 193785 - DNA, 22 bp, Artificial Sequence
  Synthetic oligonucleotide; CTG chr2 60452482 60452503 60452499 60452504 +
tcagaaaacatcacaaactagc

SEQ ID NO: 193786 - DNA, 22 bp, Artificial Sequence
  Synthetic oligonucleotide; CTA chr2 60452502 60452523 60452519 60452524 +
gcaggatgacagaccacgctga

SEQ ID NO: 193787 - DNA, 22 bp, Artificial Sequence
  Synthetic oligonucleotide; CTG chr2 60452523 60452544 60452540 60452545 +
acgtcgactgggcggcacgcgt

SEQ ID NO: 193788 - DNA, 22 bp, Artificial Sequence
  Synthetic oligonucleotide; CTG chr2 60452533 60452554 60452550 60452555 +
ggcggcacgcgtccaccccacc

SEQ ID NO: 193789 - DNA, 22 bp, Artificial Sequence
  Synthetic oligonucleotide; CTG chr2 60452559 60452580 60452576 60452581 +
ggggcttcaaattttctcagaa

SEQ ID NO: 193790 - DNA, 22 bp, Artificial Sequence
  Synthetic oligonucleotide; CTT chr2 60452566 60452587 60452583 60452588 +
caaattttctcagaacttaagg

SEQ ID NO: 193791 - DNA, 22 bp, Artificial Sequence
  Synthetic oligonucleotide; TTC chr2 60452567 60452588 60452584 60452589 +
aaattttctcagaacttaaggg

SEQ ID NO: 193792 - DNA, 22 bp, Artificial Sequence
  Synthetic oligonucleotide; TTT chr2 60452573 60452594 60452590 60452595 +
tctcagaacttaagggctctcg

SEQ ID NO: 193793 - DNA, 22 bp, Artificial Sequence
  Synthetic oligonucleotide; TTT chr2 60452574 60452595 60452591 60452596 +
ctcagaacttaagggctctcga

SEQ ID NO: 193794 - DNA, 22 bp, Artificial Sequence
  Synthetic oligonucleotide; TTC chr2 60452575 60452596 60452592 60452597 +
tcagaacttaagggctctcgag

SEQ ID NO: 193795 - DNA, 22 bp, Artificial Sequence
  Synthetic oligonucleotide; CTC chr2 60452577 60452598 60452594 60452599 +
agaacttaagggctctcgagct

SEQ ID NO: 193796 - DNA, 22 bp, Artificial Sequence
  Synthetic oligonucleotide; CTT chr2 60452584 60452605 60452601 60452606 +
aagggctctcgagcttccatcc

SEQ ID NO: 193797 - DNA, 22 bp, Artificial Sequence
  Synthetic oligonucleotide; TTA chr2 60452585 60452606 60452602 60452607 +
agggctctcgagcttccatccg

SEQ ID NO: 193798 - DNA, 22 bp, Artificial Sequence
  Synthetic oligonucleotide; CTC chr2 60452592 60452613 60452609 60452614 +
tcgagcttccatccgaaaactg

SEQ ID NO: 193799 - DNA, 22 bp, Artificial Sequence
  Synthetic oligonucleotide; CTC chr2 60452594 60452615 60452611 60452616 +
gagcttccatccgaaaactgcc

SEQ ID NO: 193800 - DNA, 22 bp, Artificial Sequence
  Synthetic oligonucleotide; CTT chr2 60452600 60452621 60452617 60452622 +
ccatccgaaaactgccacacat

SEQ ID NO: 193801 - DNA, 22 bp, Artificial Sequence
  Synthetic oligonucleotide; TTC chr2 60452601 60452622 60452618 60452623 +
catccgaaaactgccacacatc

SEQ ID NO: 193802 - DNA, 22 bp, Artificial Sequence
  Synthetic oligonucleotide; CTG chr2 60452614 60452635 60452631 60452636 +
ccacacatcttgagctctctgg

SEQ ID NO: 193803 - DNA, 22 bp, Artificial Sequence
  Synthetic oligonucleotide; CTT chr2 60452625 60452646 60452642 60452647 +
gagctctctgggtactacgccg

SEQ ID NO: 193804 - DNA, 22 bp, Artificial Sequence
  Synthetic oligonucleotide; TTG chr2 60452626 60452647 60452643 60452648 +
agctctctgggtactacgccga

SEQ ID NO: 193805 - DNA, 22 bp, Artificial Sequence
  Synthetic oligonucleotide; CTC chr2 60452631 60452652 60452648 60452653 +
tctgggtactacgccgaatggg

SEQ ID NO: 193806 - DNA, 22 bp, Artificial Sequence
  Synthetic oligonucleotide; CTC chr2 60452633 60452654 60452650 60452655 +
tgggtactacgccgaatggggg

SEQ ID NO: 193807 - DNA, 22 bp, Artificial Sequence
  Synthetic oligonucleotide; CTG chr2 60452635 60452656 60452652 60452657 +
ggtactacgccgaatgggggtg

SEQ ID NO: 193808 - DNA, 22 bp, Artificial Sequence
  Synthetic oligonucleotide; CTA chr2 60452642 60452663 60452659 60452664 +
cgccgaatgggggtgtgtgaag

SEQ ID NO: 193809 - DNA, 22 bp, Artificial Sequence
  Synthetic oligonucleotide; CTA chr2 60452670 60452691 60452687 60452692 +
gaaagaggttggagacagagga

SEQ ID NO: 193810 - DNA, 22 bp, Artificial Sequence
  Synthetic oligonucleotide; TTG chr2 60452681 60452702 60452698 60452703 +
gagacagaggagggggaaaaaa

SEQ ID NO: 193811 - DNA, 22 bp, Artificial Sequence
  Synthetic oligonucleotide; CTT chr2 60452721 60452742 60452738 60452743 +
ggcccaatgattttctgttctc

SEQ ID NO: 193812 - DNA, 22 bp, Artificial Sequence
  Synthetic oligonucleotide; TTG chr2 60452722 60452743 60452739 60452744 +
gcccaatgattttctgttctct

SEQ ID NO: 193813 - DNA, 22 bp, Artificial Sequence
  Synthetic oligonucleotide; TTT chr2 60452734 60452755 60452751 60452756 +
tctgttctctaactagcttttt

SEQ ID NO: 193814 - DNA, 22 bp, Artificial Sequence
  Synthetic oligonucleotide; TTT chr2 60452735 60452756 60452752 60452757 +
ctgttctctaactagcttttta

SEQ ID NO: 193815 - DNA, 22 bp, Artificial Sequence
  Synthetic oligonucleotide; TTC chr2 60452736 60452757 60452753 60452758 +
tgttctctaactagctttttaa

SEQ ID NO: 193816 - DNA, 22 bp, Artificial Sequence
  Synthetic oligonucleotide; CTG chr2 60452738 60452759 60452755 60452760 +
ttctctaactagctttttaaaa

SEQ ID NO: 193817 - DNA, 22 bp, Artificial Sequence
  Synthetic oligonucleotide; TTC chr2 60452741 60452762 60452758 60452763 +
tctaactagctttttaaaaatt

SEQ ID NO: 193818 - DNA, 22 bp, Artificial Sequence
  Synthetic oligonucleotide; CTC chr2 60452743 60452764 60452760 60452765 +
taactagctttttaaaaattag

SEQ ID NO: 193819 - DNA, 22 bp, Artificial Sequence
  Synthetic oligonucleotide; CTA chr2 60452745 60452766 60452762 60452767 +
actagctttttaaaaattagaa

SEQ ID NO: 193820 - DNA, 22 bp, Artificial Sequence
  Synthetic oligonucleotide; CTA chr2 60452749 60452770 60452766 60452771 +
gctttttaaaaattagaactta

SEQ ID NO: 193821 - DNA, 22 bp, Artificial Sequence
  Synthetic oligonucleotide; CTT chr2 60452753 60452774 60452770 60452775 +
tttaaaaattagaacttaaacc

SEQ ID NO: 193822 - DNA, 22 bp, Artificial Sequence
  Synthetic oligonucleotide; TTT chr2 60452754 60452775 60452771 60452776 +
ttaaaaattagaacttaaacca

SEQ ID NO: 193823 - DNA, 22 bp, Artificial Sequence
  Synthetic oligonucleotide; TTT chr2 60452755 60452776 60452772 60452777 +
taaaaattagaacttaaaccaa

SEQ ID NO: 193824 - DNA, 22 bp, Artificial Sequence
  Synthetic oligonucleotide; TTT chr2 60452756 60452777 60452773 60452778 +
aaaaattagaacttaaaccaac

SEQ ID NO: 193825 - DNA, 22 bp, Artificial Sequence
  Synthetic oligonucleotide; TTA chr2 60452757 60452778 60452774 60452779 +
aaaattagaacttaaaccaacc

SEQ ID NO: 193826 - DNA, 22 bp, Artificial Sequence
  Synthetic oligonucleotide; TTA chr2 60452764 60452785 60452781 60452786 +
gaacttaaaccaaccacaggtc

SEQ ID NO: 193827 - DNA, 22 bp, Artificial Sequence
  Synthetic oligonucleotide; CTT chr2 60452770 60452791 60452787 60452792 +
aaaccaaccacaggtcgagcca

SEQ ID NO: 193828 - DNA, 22 bp, Artificial Sequence
  Synthetic oligonucleotide; TTA chr2 60452771 60452792 60452788 60452793 +
aaccaaccacaggtcgagccac

SEQ ID NO: 193829 - DNA, 22 bp, Artificial Sequence
  Synthetic oligonucleotide; CTG chr2 60452795 60452816 60452812 60452817 +
gcatcttaagcatgatttcaaa

SEQ ID NO: 193830 - DNA, 22 bp, Artificial Sequence
  Synthetic oligonucleotide; CTT chr2 60452802 60452823 60452819 60452824 +
aagcatgatttcaaactcagcc

SEQ ID NO: 193831 - DNA, 22 bp, Artificial Sequence
  Synthetic oligonucleotide; TTA chr2 60452803 60452824 60452820 60452825 +
agcatgatttcaaactcagcct

SEQ ID NO: 193832 - DNA, 22 bp, Artificial Sequence
  Synthetic oligonucleotide; TTT chr2 60452813 60452834 60452830 60452835 +
caaactcagcctcccctcccca

SEQ ID NO: 193833 - DNA, 22 bp, Artificial Sequence
  Synthetic oligonucleotide; TTC chr2 60452814 60452835 60452831 60452836 +
aaactcagcctcccctccccaa

SEQ ID NO: 193834 - DNA, 22 bp, Artificial Sequence
  Synthetic oligonucleotide; CTC chr2 60452820 60452841 60452837 60452842 +
agcctcccctccccaagtatct

SEQ ID NO: 193835 - DNA, 22 bp, Artificial Sequence
  Synthetic oligonucleotide; CTC chr2 60452826 60452847 60452843 60452848 +
ccctccccaagtatctctgacc

SEQ ID NO: 193836 - DNA, 22 bp, Artificial Sequence
  Synthetic oligonucleotide; CTC chr2 60452831 60452852 60452848 60452853 +
cccaagtatctctgacctctga

SEQ ID NO: 193837 - DNA, 22 bp, Artificial Sequence
  Synthetic oligonucleotide; CTC chr2 60452843 60452864 60452860 60452865 +
tgacctctgagtcgtcttccca

SEQ ID NO: 193838 - DNA, 22 bp, Artificial Sequence
  Synthetic oligonucleotide; CTG chr2 60452845 60452866 60452862 60452867 +
acctctgagtcgtcttcccatg

SEQ ID NO: 193839 - DNA, 22 bp, Artificial Sequence
  Synthetic oligonucleotide; CTC chr2 60452850 60452871 60452867 60452872 +
tgagtcgtcttcccatgcctcc

SEQ ID NO: 193840 - DNA, 22 bp, Artificial Sequence
  Synthetic oligonucleotide; CTG chr2 60452852 60452873 60452869 60452874 +
agtcgtcttcccatgcctccct

SEQ ID NO: 193841 - DNA, 22 bp, Artificial Sequence
  Synthetic oligonucleotide; CTT chr2 60452861 60452882 60452878 60452883 +
cccatgcctccctcccttccgt

SEQ ID NO: 193842 - DNA, 22 bp, Artificial Sequence
  Synthetic oligonucleotide; TTC chr2 60452862 60452883 60452879 60452884 +
ccatgcctccctcccttccgtc

SEQ ID NO: 193843 - DNA, 22 bp, Artificial Sequence
  Synthetic oligonucleotide; CTC chr2 60452871 60452892 60452888 60452893 +
cctcccttccgtccccccaagg

SEQ ID NO: 193844 - DNA, 22 bp, Artificial Sequence
  Synthetic oligonucleotide; CTC chr2 60452875 60452896 60452892 60452897 +
ccttccgtccccccaaggagga

SEQ ID NO: 193845 - DNA, 22 bp, Artificial Sequence
  Synthetic oligonucleotide; CTT chr2 60452879 60452900 60452896 60452901 +
ccgtccccccaaggaggaccca

SEQ ID NO: 193846 - DNA, 22 bp, Artificial Sequence
  Synthetic oligonucleotide; TTC chr2 60452880 60452901 60452897 60452902 +
cgtccccccaaggaggacccag

SEQ ID NO: 193847 - DNA, 22 bp, Artificial Sequence
  Synthetic oligonucleotide; CTG chr2 60452917 60452938 60452934 60452939 +
cccaattgtatgatagtcctaa

SEQ ID NO: 193848 - DNA, 22 bp, Artificial Sequence
  Synthetic oligonucleotide; TTG chr2 60452925 60452946 60452942 60452947 +
tatgatagtcctaataaactcg

SEQ ID NO: 193849 - DNA, 22 bp, Artificial Sequence
  Synthetic oligonucleotide; CTA chr2 60452938 60452959 60452955 60452960 +
ataaactcgggacacacctgga

SEQ ID NO: 193850 - DNA, 22 bp, Artificial Sequence
  Synthetic oligonucleotide; CTC chr2 60452946 60452967 60452963 60452968 +
gggacacacctggaaggaaaca

SEQ ID NO: 193851 - DNA, 22 bp, Artificial Sequence
  Synthetic oligonucleotide; CTG chr2 60452958 60452979 60452975 60452980 +
gaaggaaacacttgcccttatg

SEQ ID NO: 193852 - DNA, 22 bp, Artificial Sequence
  Synthetic oligonucleotide; CTT chr2 60452971 60452992 60452988 60452993 +
gcccttatgactgagaaaactt

SEQ ID NO: 193853 - DNA, 22 bp, Artificial Sequence
  Synthetic oligonucleotide; TTG chr2 60452972 60452993 60452989 60452994 +
cccttatgactgagaaaactta

SEQ ID NO: 193854 - DNA, 22 bp, Artificial Sequence
  Synthetic oligonucleotide; CTT chr2 60452977 60452998 60452994 60452999 +
atgactgagaaaacttagtaag

SEQ ID NO: 193855 - DNA, 22 bp, Artificial Sequence
  Synthetic oligonucleotide; TTA chr2 60452978 60452999 60452995 60453000 +
tgactgagaaaacttagtaaga

SEQ ID NO: 193856 - DNA, 22 bp, Artificial Sequence
  Synthetic oligonucleotide; CTG chr2 60452984 60453005 60453001 60453006 +
agaaaacttagtaagaaacagt

SEQ ID NO: 193857 - DNA, 22 bp, Artificial Sequence
  Synthetic oligonucleotide; CTT chr2 60452993 60453014 60453010 60453015 +
agtaagaaacagtcctttggtt

SEQ ID NO: 193858 - DNA, 22 bp, Artificial Sequence
  Synthetic oligonucleotide; TTA chr2 60452994 60453015 60453011 60453016 +
gtaagaaacagtcctttggttg

SEQ ID NO: 193859 - DNA, 22 bp, Artificial Sequence
  Synthetic oligonucleotide; CTT chr2 60453010 60453031 60453027 60453032 +
tggttgaggagagcgggagagg

SEQ ID NO: 193860 - DNA, 22 bp, Artificial Sequence
  Synthetic oligonucleotide; TTT chr2 60453011 60453032 60453028 60453033 +
ggttgaggagagcgggagaggg

SEQ ID NO: 193861 - DNA, 22 bp, Artificial Sequence
  Synthetic oligonucleotide; TTG chr2 60453012 60453033 60453029 60453034 +
gttgaggagagcgggagaggga

SEQ ID NO: 193862 - DNA, 22 bp, Artificial Sequence
  Synthetic oligonucleotide; TTG chr2 60453016 60453037 60453033 60453038 +
aggagagcgggagagggaggag

SEQ ID NO: 193863 - DNA, 22 bp, Artificial Sequence
  Synthetic oligonucleotide; CTT chr2 60453054 60453075 60453071 60453076 +
ctcaaaataataataaaattat

SEQ ID NO: 193864 - DNA, 22 bp, Artificial Sequence
  Synthetic oligonucleotide; TTC chr2 60453055 60453076 60453072 60453077 +
tcaaaataataataaaattata

SEQ ID NO: 193865 - DNA, 22 bp, Artificial Sequence
  Synthetic oligonucleotide; CTC chr2 60453057 60453078 60453074 60453079 +
aaaataataataaaattataaa

SEQ ID NO: 193866 - DNA, 22 bp, Artificial Sequence
  Synthetic oligonucleotide; TTA chr2 60453075 60453096 60453092 60453097 +
taaagaaacaaaaaatcaaaac

SEQ ID NO: 193867 - DNA, 22 bp, Artificial Sequence
  Synthetic oligonucleotide; CTG chr2 60453099 60453120 60453116 60453121 +
atgtaaaagcagcacaacgaaa

SEQ ID NO: 193868 - DNA, 22 bp, Artificial Sequence
  Synthetic oligonucleotide; TTC chr2 60453142 60453163 60453159 60453164 +
aacgtcaaagcagccaatgatt

SEQ ID NO: 193869 - DNA, 22 bp, Artificial Sequence
  Synthetic oligonucleotide; TTT chr2 60453165 60453186 60453182 60453187 +
acaagaggcgaacaaatctctg

SEQ ID NO: 193870 - DNA, 22 bp, Artificial Sequence
  Synthetic oligonucleotide; TTA chr2 60453166 60453187 60453183 60453188 +
caagaggcgaacaaatctctga

SEQ ID NO: 193871 - DNA, 22 bp, Artificial Sequence
  Synthetic oligonucleotide; CTC chr2 60453185 60453206 60453202 60453207 +
tgaagagaaaaccagaacccaa

SEQ ID NO: 193872 - DNA, 22 bp, Artificial Sequence
  Synthetic oligonucleotide; CTG chr2 60453187 60453208 60453204 60453209 +
aagagaaaaccagaacccaaaa

SEQ ID NO: 193873 - DNA, 22 bp, Artificial Sequence
  Synthetic oligonucleotide; TTG chr2 60453215 60453236 60453232 60453237 +
ctctcaaattgcaccaaaaact

SEQ ID NO: 193874 - DNA, 22 bp, Artificial Sequence
  Synthetic oligonucleotide; CTC chr2 60453218 60453239 60453235 60453240 +
tcaaattgcaccaaaaactgcc

SEQ ID NO: 193875 - DNA, 22 bp, Artificial Sequence
  Synthetic oligonucleotide; CTC chr2 60453220 60453241 60453237 60453242 +
aaattgcaccaaaaactgcctg

SEQ ID NO: 193876 - DNA, 22 bp, Artificial Sequence
  Synthetic oligonucleotide; TTG chr2 60453226 60453247 60453243 60453248 +
caccaaaaactgcctgtagttt

SEQ ID NO: 193877 - DNA, 22 bp, Artificial Sequence
  Synthetic oligonucleotide; CTG chr2 60453238 60453259 60453255 60453260 +
cctgtagtttctttcaaacatg

SEQ ID NO: 193878 - DNA, 22 bp, Artificial Sequence
  Synthetic oligonucleotide; CTG chr2 60453242 60453263 60453259 60453264 +
tagtttctttcaaacatgcagt

SEQ ID NO: 193879 - DNA, 22 bp, Artificial Sequence
  Synthetic oligonucleotide; TTT chr2 60453248 60453269 60453265 60453270 +
ctttcaaacatgcagttttctt

SEQ ID NO: 193880 - DNA, 22 bp, Artificial Sequence
  Synthetic oligonucleotide; TTC chr2 60453249 60453270 60453266 60453271 +
tttcaaacatgcagttttcttt

SEQ ID NO: 193881 - DNA, 22 bp, Artificial Sequence
  Synthetic oligonucleotide; CTT chr2 60453251 60453272 60453268 60453273 +
tcaaacatgcagttttcttttc

SEQ ID NO: 193882 - DNA, 22 bp, Artificial Sequence
  Synthetic oligonucleotide; TTT chr2 60453252 60453273 60453269 60453274 +
caaacatgcagttttcttttct

SEQ ID NO: 193883 - DNA, 22 bp, Artificial Sequence
  Synthetic oligonucleotide; TTC chr2 60453253 60453274 60453270 60453275 +
aaacatgcagttttcttttctt

SEQ ID NO: 193884 - DNA, 22 bp, Artificial Sequence
  Synthetic oligonucleotide; TTT chr2 60453266 60453287 60453283 60453288 +
tcttttcttttttggaaggggg

SEQ ID NO: 193885 - DNA, 22 bp, Artificial Sequence
  Synthetic oligonucleotide; TTT chr2 60453267 60453288 60453284 60453289 +
cttttcttttttggaaggggga

SEQ ID NO: 193886 - DNA, 22 bp, Artificial Sequence
  Synthetic oligonucleotide; TTC chr2 60453268 60453289 60453285 60453290 +
ttttcttttttggaagggggaa

SEQ ID NO: 193887 - DNA, 22 bp, Artificial Sequence
  Synthetic oligonucleotide; CTT chr2 60453270 60453291 60453287 60453292 +
ttcttttttggaagggggaagg

SEQ ID NO: 193888 - DNA, 22 bp, Artificial Sequence
  Synthetic oligonucleotide; TTT chr2 60453271 60453292 60453288 60453293 +
tcttttttggaagggggaaggc

SEQ ID NO: 193889 - DNA, 22 bp, Artificial Sequence
  Synthetic oligonucleotide; TTT chr2 60453272 60453293 60453289 60453294 +
cttttttggaagggggaaggca

SEQ ID NO: 193890 - DNA, 22 bp, Artificial Sequence
  Synthetic oligonucleotide; TTC chr2 60453273 60453294 60453290 60453295 +
ttttttggaagggggaaggcaa

SEQ ID NO: 193891 - DNA, 22 bp, Artificial Sequence
  Synthetic oligonucleotide; CTT chr2 60453275 60453296 60453292 60453297 +
ttttggaagggggaaggcaatg

SEQ ID NO: 193892 - DNA, 22 bp, Artificial Sequence
  Synthetic oligonucleotide; TTT chr2 60453276 60453297 60453293 60453298 +
tttggaagggggaaggcaatgg

SEQ ID NO: 193893 - DNA, 22 bp, Artificial Sequence
  Synthetic oligonucleotide; TTT chr2 60453277 60453298 60453294 60453299 +
ttggaagggggaaggcaatggt

SEQ ID NO: 193894 - DNA, 22 bp, Artificial Sequence
  Synthetic oligonucleotide; TTT chr2 60453278 60453299 60453295 60453300 +
tggaagggggaaggcaatggtg

SEQ ID NO: 193895 - DNA, 22 bp, Artificial Sequence
  Synthetic oligonucleotide; TTT chr2 60453279 60453300 60453296 60453301 +
ggaagggggaaggcaatggtga

SEQ ID NO: 193896 - DNA, 22 bp, Artificial Sequence
  Synthetic oligonucleotide; TTG chr2 60453280 60453301 60453297 60453302 +
gaagggggaaggcaatggtgaa

SEQ ID NO: 193897 - DNA, 22 bp, Artificial Sequence
  Synthetic oligonucleotide; TTA chr2 60453321 60453342 60453338 60453343 +
ttttcctccggggttcctccct

SEQ ID NO: 193898 - DNA, 22 bp, Artificial Sequence
  Synthetic oligonucleotide; TTT chr2 60453324 60453345 60453341 60453346 +
tcctccggggttcctcccttgc

SEQ ID NO: 193899 - DNA, 22 bp, Artificial Sequence
  Synthetic oligonucleotide; TTT chr2 60453325 60453346 60453342 60453347 +
cctccggggttcctcccttgct

SEQ ID NO: 193900 - DNA, 22 bp, Artificial Sequence
  Synthetic oligonucleotide; TTC chr2 60453326 60453347 60453343 60453348 +
ctccggggttcctcccttgctg

SEQ ID NO: 193901 - DNA, 22 bp, Artificial Sequence
  Synthetic oligonucleotide; CTC chr2 60453329 60453350 60453346 60453351 +
cggggttcctcccttgctgtgg

SEQ ID NO: 193902 - DNA, 22 bp, Artificial Sequence
  Synthetic oligonucleotide; TTC chr2 60453337 60453358 60453354 60453359 +
ctcccttgctgtggacattgac

SEQ ID NO: 193903 - DNA, 22 bp, Artificial Sequence
  Synthetic oligonucleotide; CTC chr2 60453340 60453361 60453357 60453362 +
ccttgctgtggacattgacttg

SEQ ID NO: 193904 - DNA, 22 bp, Artificial Sequence
  Synthetic oligonucleotide; CTT chr2 60453344 60453365 60453361 60453366 +
gctgtggacattgacttgaagc

SEQ ID NO: 193905 - DNA, 22 bp, Artificial Sequence
  Synthetic oligonucleotide; TTG chr2 60453345 60453366 60453362 60453367 +
ctgtggacattgacttgaagca

SEQ ID NO: 193906 - DNA, 22 bp, Artificial Sequence
  Synthetic oligonucleotide; CTG chr2 60453348 60453369 60453365 60453370 +
tggacattgacttgaagcagca

SEQ ID NO: 193907 - DNA, 22 bp, Artificial Sequence
  Synthetic oligonucleotide; TTG chr2 60453357 60453378 60453374 60453379 +
acttgaagcagcagaactggga

SEQ ID NO: 193908 - DNA, 22 bp, Artificial Sequence
  Synthetic oligonucleotide; CTT chr2 60453361 60453382 60453378 60453383 +
gaagcagcagaactgggagtcc

SEQ ID NO: 193909 - DNA, 22 bp, Artificial Sequence
  Synthetic oligonucleotide; TTG chr2 60453362 60453383 60453379 60453384 +
aagcagcagaactgggagtccg

SEQ ID NO: 193910 - DNA, 22 bp, Artificial Sequence
  Synthetic oligonucleotide; CTG chr2 60453376 60453397 60453393 60453398 +
ggagtccggatgtgccgaggaa

SEQ ID NO: 193911 - DNA, 22 bp, Artificial Sequence
  Synthetic oligonucleotide; CTA chr2 60453406 60453427 60453423 60453428 +
ccactgtggcattccaggcctc

SEQ ID NO: 193912 - DNA, 22 bp, Artificial Sequence
  Synthetic oligonucleotide; CTG chr2 60453412 60453433 60453429 60453434 +
tggcattccaggcctcgttgcc

SEQ ID NO: 193913 - DNA, 22 bp, Artificial Sequence
  Synthetic oligonucleotide; TTC chr2 60453420 60453441 60453437 60453442 +
caggcctcgttgccatggcgac

SEQ ID NO: 193914 - DNA, 22 bp, Artificial Sequence
  Synthetic oligonucleotide; CTC chr2 60453428 60453449 60453445 60453450 +
gttgccatggcgacccgaagca

SEQ ID NO: 193915 - DNA, 22 bp, Artificial Sequence
  Synthetic oligonucleotide; TTG chr2 60453432 60453453 60453449 60453454 +
ccatggcgacccgaagcagggg

SEQ ID NO: 193916 - DNA, 22 bp, Artificial Sequence
  Synthetic oligonucleotide; CTG chr2 60453458 60453479 60453475 60453480 +
gggcctcctctcccctgacttg

SEQ ID NO: 193917 - DNA, 22 bp, Artificial Sequence
  Synthetic oligonucleotide; CTC chr2 60453465 60453486 60453482 60453487 +
ctctcccctgacttggcgccgc

SEQ ID NO: 193918 - DNA, 22 bp, Artificial Sequence
  Synthetic oligonucleotide; CTC chr2 60453468 60453489 60453485 60453490 +
tcccctgacttggcgccgcagg

SEQ ID NO: 193919 - DNA, 22 bp, Artificial Sequence
  Synthetic oligonucleotide; CTC chr2 60453470 60453491 60453487 60453492 +
ccctgacttggcgccgcaggag

SEQ ID NO: 193920 - DNA, 22 bp, Artificial Sequence
  Synthetic oligonucleotide; CTG chr2 60453475 60453496 60453492 60453497 +
acttggcgccgcaggaggcccg

SEQ ID NO: 193921 - DNA, 22 bp, Artificial Sequence
  Synthetic oligonucleotide; CTT chr2 60453479 60453500 60453496 60453501 +
ggcgccgcaggaggcccggggt

SEQ ID NO: 193922 - DNA, 22 bp, Artificial Sequence
  Synthetic oligonucleotide; TTG chr2 60453480 60453501 60453497 60453502 +
gcgccgcaggaggcccggggtc

SEQ ID NO: 193923 - DNA, 22 bp, Artificial Sequence
  Synthetic oligonucleotide; CTG chr2 60453504 60453525 60453521 60453526 +
gatctcagctgctctcacgcat

SEQ ID NO: 193924 - DNA, 22 bp, Artificial Sequence
  Synthetic oligonucleotide; CTC chr2 60453510 60453531 60453527 60453532 +
agctgctctcacgcatcccacc

SEQ ID NO: 193925 - DNA, 22 bp, Artificial Sequence
  Synthetic oligonucleotide; CTG chr2 60453515 60453536 60453532 60453537 +
ctctcacgcatcccacccctga

SEQ ID NO: 193926 - DNA, 22 bp, Artificial Sequence
  Synthetic oligonucleotide; CTC chr2 60453518 60453539 60453535 60453540 +
tcacgcatcccacccctgagca

SEQ ID NO: 193927 - DNA, 22 bp, Artificial Sequence
  Synthetic oligonucleotide; CTC chr2 60453520 60453541 60453537 60453542 +
acgcatcccacccctgagcaga

SEQ ID NO: 193928 - DNA, 22 bp, Artificial Sequence
  Synthetic oligonucleotide; CTG chr2 60453536 60453557 60453553 60453558 +
agcagagcagcggagacctggg

SEQ ID NO: 193929 - DNA, 22 bp, Artificial Sequence
  Synthetic oligonucleotide; CTG chr2 60453556 60453577 60453573 60453578 +
ggctgaggggcatgctgcgtcc

SEQ ID NO: 193930 - DNA, 22 bp, Artificial Sequence
  Synthetic oligonucleotide; CTG chr2 60453561 60453582 60453578 60453583 +
aggggcatgctgcgtccaggtg

SEQ ID NO: 193931 - DNA, 22 bp, Artificial Sequence
  Synthetic oligonucleotide; CTG chr2 60453573 60453594 60453590 60453595 +
cgtccaggtgggttctggggaa

SEQ ID NO: 193932 - DNA, 22 bp, Artificial Sequence
  Synthetic oligonucleotide; TTC chr2 60453588 60453609 60453605 60453610 +
tggggaatcccattcccagtcc

SEQ ID NO: 193933 - DNA, 22 bp, Artificial Sequence
  Synthetic oligonucleotide; CTG chr2 60453590 60453611 60453607 60453612 +
gggaatcccattcccagtccag

SEQ ID NO: 193934 - DNA, 22 bp, Artificial Sequence
  Synthetic oligonucleotide; TTC chr2 60453603 60453624 60453620 60453625 +
ccagtccagcgctaagtcactg

SEQ ID NO: 193935 - DNA, 22 bp, Artificial Sequence
  Synthetic oligonucleotide; CTA chr2 60453617 60453638 60453634 60453639 +
agtcactgtcgtcgaggcccct

SEQ ID NO: 193936 - DNA, 22 bp, Artificial Sequence
  Synthetic oligonucleotide; CTG chr2 60453625 60453646 60453642 60453647 +
tcgtcgaggcccctttagctga

SEQ ID NO: 193937 - DNA, 22 bp, Artificial Sequence
  Synthetic oligonucleotide; CTT chr2 60453640 60453661 60453657 60453662 +
tagctgataccccaatcaaacc

SEQ ID NO: 193938 - DNA, 22 bp, Artificial Sequence
  Synthetic oligonucleotide; TTT chr2 60453641 60453662 60453658 60453663 +
agctgataccccaatcaaaccc

SEQ ID NO: 193939 - DNA, 22 bp, Artificial Sequence
  Synthetic oligonucleotide; TTA chr2 60453642 60453663 60453659 60453664 +
gctgataccccaatcaaaccct

SEQ ID NO: 193940 - DNA, 22 bp, Artificial Sequence
  Synthetic oligonucleotide; CTG chr2 60453646 60453667 60453663 60453668 +
ataccccaatcaaaccctttcg

SEQ ID NO: 193941 - DNA, 22 bp, Artificial Sequence
  Synthetic oligonucleotide; CTT chr2 60453665 60453686 60453682 60453687 +
tcgtccaacctgctaccaatat

SEQ ID NO: 193942 - DNA, 22 bp, Artificial Sequence
  Synthetic oligonucleotide; TTT chr2 60453666 60453687 60453683 60453688 +
cgtccaacctgctaccaatatt

SEQ ID NO: 193943 - DNA, 22 bp, Artificial Sequence
  Synthetic oligonucleotide; TTC chr2 60453667 60453688 60453684 60453689 +
gtccaacctgctaccaatattc

SEQ ID NO: 193944 - DNA, 22 bp, Artificial Sequence
  Synthetic oligonucleotide; CTG chr2 60453677 60453698 60453694 60453699 +
ctaccaatattcaaattctaat

SEQ ID NO: 193945 - DNA, 22 bp, Artificial Sequence
  Synthetic oligonucleotide; CTA chr2 60453680 60453701 60453697 60453702 +
ccaatattcaaattctaataga

SEQ ID NO: 193946 - DNA, 22 bp, Artificial Sequence
  Synthetic oligonucleotide; TTC chr2 60453689 60453710 60453706 60453711 +
aaattctaatagacaaagtata

SEQ ID NO: 193947 - DNA, 22 bp, Artificial Sequence
  Synthetic oligonucleotide; TTC chr2 60453695 60453716 60453712 60453717 +
taatagacaaagtatatcatgg

SEQ ID NO: 193948 - DNA, 22 bp, Artificial Sequence
  Synthetic oligonucleotide; CTA chr2 60453697 60453718 60453714 60453719 +
atagacaaagtatatcatgggc

SEQ ID NO: 193949 - DNA, 22 bp, Artificial Sequence
  Synthetic oligonucleotide; TTC chr2 60453732 60453753 60453749 60453754 +
acagctatttaaaagcacagcc

SEQ ID NO: 193950 - DNA, 22 bp, Artificial Sequence
  Synthetic oligonucleotide; CTA chr2 60453739 60453760 60453756 60453761 +
tttaaaagcacagcccccctat

SEQ ID NO: 193951 - DNA, 22 bp, Artificial Sequence
  Synthetic oligonucleotide; TTT chr2 60453742 60453763 60453759 60453764 +
aaaagcacagcccccctatggg

SEQ ID NO: 193952 - DNA, 22 bp, Artificial Sequence
  Synthetic oligonucleotide; TTA chr2 60453743 60453764 60453760 60453765 +
aaagcacagcccccctatgggt

SEQ ID NO: 193953 - DNA, 22 bp, Artificial Sequence
  Synthetic oligonucleotide; CTA chr2 60453760 60453781 60453777 60453782 +
tgggtttaggggctcccgcttt

SEQ ID NO: 193954 - DNA, 22 bp, Artificial Sequence
  Synthetic oligonucleotide; TTT chr2 60453767 60453788 60453784 60453789 +
aggggctcccgctttagaggat

SEQ ID NO: 193955 - DNA, 22 bp, Artificial Sequence
  Synthetic oligonucleotide; TTA chr2 60453768 60453789 60453785 60453790 +
ggggctcccgctttagaggata

SEQ ID NO: 193956 - DNA, 22 bp, Artificial Sequence
  Synthetic oligonucleotide; CTC chr2 60453775 60453796 60453792 60453797 +
ccgctttagaggatacttgggg

SEQ ID NO: 193957 - DNA, 22 bp, Artificial Sequence
  Synthetic oligonucleotide; CTT chr2 60453781 60453802 60453798 60453803 +
tagaggatacttggggaaatgg

SEQ ID NO: 193958 - DNA, 22 bp, Artificial Sequence
  Synthetic oligonucleotide; TTT chr2 60453782 60453803 60453799 60453804 +
agaggatacttggggaaatggc

SEQ ID NO: 193959 - DNA, 22 bp, Artificial Sequence
  Synthetic oligonucleotide; TTA chr2 60453783 60453804 60453800 60453805 +
gaggatacttggggaaatggct

SEQ ID NO: 193960 - DNA, 22 bp, Artificial Sequence
  Synthetic oligonucleotide; CTT chr2 60453793 60453814 60453810 60453815 +
ggggaaatggcttaatttgcct

SEQ ID NO: 193961 - DNA, 22 bp, Artificial Sequence
  Synthetic oligonucleotide; TTG chr2 60453794 60453815 60453811 60453816 +
gggaaatggcttaatttgcctt

SEQ ID NO: 193962 - DNA, 22 bp, Artificial Sequence
  Synthetic oligonucleotide; CTT chr2 60453806 60453827 60453823 60453828 +
aatttgccttttctaccatccc

SEQ ID NO: 193963 - DNA, 22 bp, Artificial Sequence
  Synthetic oligonucleotide; TTA chr2 60453807 60453828 60453824 60453829 +
atttgccttttctaccatccct

SEQ ID NO: 193964 - DNA, 22 bp, Artificial Sequence
  Synthetic oligonucleotide; TTT chr2 60453811 60453832 60453828 60453833 +
gccttttctaccatccctatga

SEQ ID NO: 193965 - DNA, 22 bp, Artificial Sequence
  Synthetic oligonucleotide; TTG chr2 60453812 60453833 60453829 60453834 +
ccttttctaccatccctatgaa

SEQ ID NO: 193966 - DNA, 22 bp, Artificial Sequence
  Synthetic oligonucleotide; CTT chr2 60453816 60453837 60453833 60453838 +
ttctaccatccctatgaaagat

SEQ ID NO: 193967 - DNA, 22 bp, Artificial Sequence
  Synthetic oligonucleotide; TTT chr2 60453817 60453838 60453834 60453839 +
tctaccatccctatgaaagatc

SEQ ID NO: 193968 - DNA, 22 bp, Artificial Sequence
  Synthetic oligonucleotide; TTT chr2 60453818 60453839 60453835 60453840 +
ctaccatccctatgaaagatct

SEQ ID NO: 193969 - DNA, 22 bp, Artificial Sequence
  Synthetic oligonucleotide; TTC chr2 60453819 60453840 60453836 60453841 +
taccatccctatgaaagatctg

SEQ ID NO: 193970 - DNA, 22 bp, Artificial Sequence
  Synthetic oligonucleotide; CTA chr2 60453821 60453842 60453838 60453843 +
ccatccctatgaaagatctgat

SEQ ID NO: 193971 - DNA, 22 bp, Artificial Sequence
  Synthetic oligonucleotide; CTA chr2 60453830 60453851 60453847 60453852 +
tgaaagatctgatacacgtgct

SEQ ID NO: 193972 - DNA, 22 bp, Artificial Sequence
  Synthetic oligonucleotide; CTG chr2 60453841 60453862 60453858 60453863 +
atacacgtgctcccttgaaata

SEQ ID NO: 193973 - DNA, 22 bp, Artificial Sequence
  Synthetic oligonucleotide; CTC chr2 60453853 60453874 60453870 60453875 +
ccttgaaatagtttttgccact

SEQ ID NO: 193974 - DNA, 22 bp, Artificial Sequence
  Synthetic oligonucleotide; CTT chr2 60453857 60453878 60453874 60453879 +
gaaatagtttttgccactttac

SEQ ID NO: 193975 - DNA, 22 bp, Artificial Sequence
  Synthetic oligonucleotide; TTG chr2 60453858 60453879 60453875 60453880 +
aaatagtttttgccactttaca

SEQ ID NO: 193976 - DNA, 22 bp, Artificial Sequence
  Synthetic oligonucleotide; TTT chr2 60453867 60453888 60453884 60453889 +
ttgccactttacagaaaggaaa

SEQ ID NO: 193977 - DNA, 22 bp, Artificial Sequence
  Synthetic oligonucleotide; TTT chr2 60453868 60453889 60453885 60453890 +
tgccactttacagaaaggaaaa

SEQ ID NO: 193978 - DNA, 22 bp, Artificial Sequence
  Synthetic oligonucleotide; TTT chr2 60453869 60453890 60453886 60453891 +
gccactttacagaaaggaaaaa

SEQ ID NO: 193979 - DNA, 22 bp, Artificial Sequence
  Synthetic oligonucleotide; TTG chr2 60453870 60453891 60453887 60453892 +
ccactttacagaaaggaaaaac

SEQ ID NO: 193980 - DNA, 22 bp, Artificial Sequence
  Synthetic oligonucleotide; CTT chr2 60453876 60453897 60453893 60453898 +
tacagaaaggaaaaacgtattt

SEQ ID NO: 193981 - DNA, 22 bp, Artificial Sequence
  Synthetic oligonucleotide; TTT chr2 60453877 60453898 60453894 60453899 +
acagaaaggaaaaacgtatttg

SEQ ID NO: 193982 - DNA, 22 bp, Artificial Sequence
  Synthetic oligonucleotide; TTA chr2 60453878 60453899 60453895 60453900 +
cagaaaggaaaaacgtatttgg

SEQ ID NO: 193983 - DNA, 22 bp, Artificial Sequence
  Synthetic oligonucleotide; TTT chr2 60453898 60453919 60453915 60453920 +
ggatcaaccatcgagctgtgtt

SEQ ID NO: 193984 - DNA, 22 bp, Artificial Sequence
  Synthetic oligonucleotide; TTG chr2 60453899 60453920 60453916 60453921 +
gatcaaccatcgagctgtgttc

SEQ ID NO: 193985 - DNA, 22 bp, Artificial Sequence
  Synthetic oligonucleotide; CTG chr2 60453916 60453937 60453933 60453938 +
tgttcagccaagtttaggttct

SEQ ID NO: 193986 - DNA, 22 bp, Artificial Sequence
  Synthetic oligonucleotide; TTC chr2 60453921 60453942 60453938 60453943 +
agccaagtttaggttctcaagt

SEQ ID NO: 193987 - DNA, 22 bp, Artificial Sequence
  Synthetic oligonucleotide; TTT chr2 60453931 60453952 60453948 60453953 +
aggttctcaagtacaatgaccc

SEQ ID NO: 193988 - DNA, 22 bp, Artificial Sequence
  Synthetic oligonucleotide; TTA chr2 60453932 60453953 60453949 60453954 +
ggttctcaagtacaatgacccg

SEQ ID NO: 193989 - DNA, 22 bp, Artificial Sequence
  Synthetic oligonucleotide; TTC chr2 60453937 60453958 60453954 60453959 +
tcaagtacaatgacccgtgtga

SEQ ID NO: 193990 - DNA, 22 bp, Artificial Sequence
  Synthetic oligonucleotide; CTC chr2 60453939 60453960 60453956 60453961 +
aagtacaatgacccgtgtgaac

SEQ ID NO: 193991 - DNA, 22 bp, Artificial Sequence
  Synthetic oligonucleotide; CTG chr2 60453963 60453984 60453980 60453985 +
gattggtctctttcccatttgg

SEQ ID NO: 193992 - DNA, 22 bp, Artificial Sequence
  Synthetic oligonucleotide; TTG chr2 60453968 60453989 60453985 60453990 +
gtctctttcccatttggaaggg

SEQ ID NO: 193993 - DNA, 22 bp, Artificial Sequence
  Synthetic oligonucleotide; CTC chr2 60453973 60453994 60453990 60453995 +
tttcccatttggaagggaggaa

SEQ ID NO: 193994 - DNA, 22 bp, Artificial Sequence
  Synthetic oligonucleotide; CTT chr2 60453975 60453996 60453992 60453997 +
tcccatttggaagggaggaatt

SEQ ID NO: 193995 - DNA, 22 bp, Artificial Sequence
  Synthetic oligonucleotide; TTT chr2 60453976 60453997 60453993 60453998 +
cccatttggaagggaggaatta

SEQ ID NO: 193996 - DNA, 22 bp, Artificial Sequence
  Synthetic oligonucleotide; TTC chr2 60453977 60453998 60453994 60453999 +
ccatttggaagggaggaattaa

SEQ ID NO: 193997 - DNA, 22 bp, Artificial Sequence
  Synthetic oligonucleotide; TTT chr2 60453983 60454004 60454000 60454005 +
ggaagggaggaattaatggtat

SEQ ID NO: 193998 - DNA, 22 bp, Artificial Sequence
  Synthetic oligonucleotide; TTG chr2 60453984 60454005 60454001 60454006 +
gaagggaggaattaatggtatc

SEQ ID NO: 193999 - DNA, 22 bp, Artificial Sequence
  Synthetic oligonucleotide; TTA chr2 60453998 60454019 60454015 60454020 +
atggtatcccatgaccgtagat

SEQ ID NO: 194000 - DNA, 22 bp, Artificial Sequence
  Synthetic oligonucleotide; CTG chr2 60454027 60454048 60454044 60454049 +
ggaaatagagagagagaaagag

SEQ ID NO: 194001 - DNA, 22 bp, Artificial Sequence
  Synthetic oligonucleotide; TTC chr2 60454077 60454098 60454094 60454099 +
ccctaaaggctgagtcactggc

SEQ ID NO: 194002 - DNA, 22 bp, Artificial Sequence
  Synthetic oligonucleotide; CTA chr2 60454082 60454103 60454099 60454104 +
aaggctgagtcactggcctcgt

SEQ ID NO: 194003 - DNA, 22 bp, Artificial Sequence
  Synthetic oligonucleotide; CTG chr2 60454089 60454110 60454106 60454111 +
agtcactggcctcgtgctgtat

SEQ ID NO: 194004 - DNA, 22 bp, Artificial Sequence
  Synthetic oligonucleotide; CTG chr2 60454097 60454118 60454114 60454119 +
gcctcgtgctgtatgtagtaaa

SEQ ID NO: 194005 - DNA, 22 bp, Artificial Sequence
  Synthetic oligonucleotide; CTC chr2 60454102 60454123 60454119 60454124 +
gtgctgtatgtagtaaattaaa

SEQ ID NO: 194006 - DNA, 22 bp, Artificial Sequence
  Synthetic oligonucleotide; CTG chr2 60454108 60454129 60454125 60454130 +
tatgtagtaaattaaacagcgg

SEQ ID NO: 194007 - DNA, 22 bp, Artificial Sequence
  Synthetic oligonucleotide; TTA chr2 60454122 60454143 60454139 60454144 +
aacagcgggctaatgggataac

SEQ ID NO: 194008 - DNA, 22 bp, Artificial Sequence
  Synthetic oligonucleotide; CTA chr2 60454134 60454155 60454151 60454156 +
atgggataacgagatgccagca

SEQ ID NO: 194009 - DNA, 22 bp, Artificial Sequence
  Synthetic oligonucleotide; TTC chr2 60454194 60454215 60454211 60454216 +
atagctatagcagccctagagt

SEQ ID NO: 194010 - DNA, 22 bp, Artificial Sequence
  Synthetic oligonucleotide; CTA chr2 60454201 60454222 60454218 60454223 +
tagcagccctagagtaaataca

SEQ ID NO: 194011 - DNA, 22 bp, Artificial Sequence
  Synthetic oligonucleotide; CTA chr2 60454212 60454233 60454229 60454234 +
gagtaaatacacatcataccaa

SEQ ID NO: 194012 - DNA, 22 bp, Artificial Sequence
  Synthetic oligonucleotide; TTC chr2 60454237 60454258 60454254 60454259 +
cctctatgtgttctgatgtcca

SEQ ID NO: 194013 - DNA, 22 bp, Artificial Sequence
  Synthetic oligonucleotide; CTC chr2 60454241 60454262 60454258 60454263 +
tatgtgttctgatgtccatttc

SEQ ID NO: 194014 - DNA, 22 bp, Artificial Sequence
  Synthetic oligonucleotide; CTA chr2 60454243 60454264 60454260 60454265 +
tgtgttctgatgtccatttctc

SEQ ID NO: 194015 - DNA, 22 bp, Artificial Sequence
  Synthetic oligonucleotide; TTC chr2 60454250 60454271 60454267 60454272 +
tgatgtccatttctctaacaat

SEQ ID NO: 194016 - DNA, 22 bp, Artificial Sequence
  Synthetic oligonucleotide; CTG chr2 60454252 60454273 60454269 60454274 +
atgtccatttctctaacaatgg

SEQ ID NO: 194017 - DNA, 22 bp, Artificial Sequence
  Synthetic oligonucleotide; TTT chr2 60454262 60454283 60454279 60454284 +
ctctaacaatgggttcgtttat

SEQ ID NO: 194018 - DNA, 22 bp, Artificial Sequence
  Synthetic oligonucleotide; TTC chr2 60454263 60454284 60454280 60454285 +
tctaacaatgggttcgtttatt

SEQ ID NO: 194019 - DNA, 22 bp, Artificial Sequence
  Synthetic oligonucleotide; CTC chr2 60454265 60454286 60454282 60454287 +
taacaatgggttcgtttatttt

SEQ ID NO: 194020 - DNA, 22 bp, Artificial Sequence
  Synthetic oligonucleotide; CTA chr2 60454267 60454288 60454284 60454289 +
acaatgggttcgtttattttct

SEQ ID NO: 194021 - DNA, 22 bp, Artificial Sequence
  Synthetic oligonucleotide; TTC chr2 60454278 60454299 60454295 60454300 +
gtttattttctattgggaaata

SEQ ID NO: 194022 - DNA, 22 bp, Artificial Sequence
  Synthetic oligonucleotide; TTT chr2 60454282 60454303 60454299 60454304 +
attttctattgggaaatatgca

SEQ ID NO: 194023 - DNA, 22 bp, Artificial Sequence
  Synthetic oligonucleotide; TTA chr2 60454283 60454304 60454300 60454305 +
ttttctattgggaaatatgcag

SEQ ID NO: 194024 - DNA, 22 bp, Artificial Sequence
  Synthetic oligonucleotide; TTT chr2 60454286 60454307 60454303 60454308 +
tctattgggaaatatgcagggc

SEQ ID NO: 194025 - DNA, 22 bp, Artificial Sequence
  Synthetic oligonucleotide; TTT chr2 60454287 60454308 60454304 60454309 +
ctattgggaaatatgcagggct

SEQ ID NO: 194026 - DNA, 22 bp, Artificial Sequence
  Synthetic oligonucleotide; TTC chr2 60454288 60454309 60454305 60454310 +
tattgggaaatatgcagggctt

SEQ ID NO: 194027 - DNA, 22 bp, Artificial Sequence
  Synthetic oligonucleotide; CTA chr2 60454290 60454311 60454307 60454312 +
ttgggaaatatgcagggcttta

SEQ ID NO: 194028 - DNA, 22 bp, Artificial Sequence
  Synthetic oligonucleotide; TTG chr2 60454293 60454314 60454310 60454315 +
ggaaatatgcagggctttagga

SEQ ID NO: 194029 - DNA, 22 bp, Artificial Sequence
  Synthetic oligonucleotide; CTT chr2 60454310 60454331 60454327 60454332 +
taggagacaactaggaaaatct

SEQ ID NO: 194030 - DNA, 22 bp, Artificial Sequence
  Synthetic oligonucleotide; TTT chr2 60454311 60454332 60454328 60454333 +
aggagacaactaggaaaatctg

SEQ ID NO: 194031 - DNA, 22 bp, Artificial Sequence
  Synthetic oligonucleotide; TTA chr2 60454312 60454333 60454329 60454334 +
ggagacaactaggaaaatctgc

SEQ ID NO: 194032 - DNA, 22 bp, Artificial Sequence
  Synthetic oligonucleotide; CTA chr2 60454323 60454344 60454340 60454345 +
ggaaaatctgctagatggctca

SEQ ID NO: 194033 - DNA, 22 bp, Artificial Sequence
  Synthetic oligonucleotide; CTG chr2 60454333 60454354 60454350 60454355 +
ctagatggctcatgccttttaa

SEQ ID NO: 194034 - DNA, 22 bp, Artificial Sequence
  Synthetic oligonucleotide; CTA chr2 60454336 60454357 60454353 60454358 +
gatggctcatgccttttaaaag

SEQ ID NO: 194035 - DNA, 22 bp, Artificial Sequence
  Synthetic oligonucleotide; CTC chr2 60454344 60454365 60454361 60454366 +
atgccttttaaaagttagcagt

SEQ ID NO: 194036 - DNA, 22 bp, Artificial Sequence
  Synthetic oligonucleotide; CTT chr2 60454351 60454372 60454368 60454373 +
ttaaaagttagcagtcttttaa

SEQ ID NO: 194037 - DNA, 22 bp, Artificial Sequence
  Synthetic oligonucleotide; TTT chr2 60454352 60454373 60454369 60454374 +
taaaagttagcagtcttttaag

SEQ ID NO: 194038 - DNA, 22 bp, Artificial Sequence
  Synthetic oligonucleotide; TTT chr2 60454353 60454374 60454370 60454375 +
aaaagttagcagtcttttaaga

SEQ ID NO: 194039 - DNA, 22 bp, Artificial Sequence
  Synthetic oligonucleotide; TTA chr2 60454354 60454375 60454371 60454376 +
aaagttagcagtcttttaagaa

SEQ ID NO: 194040 - DNA, 22 bp, Artificial Sequence
  Synthetic oligonucleotide; TTA chr2 60454361 60454382 60454378 60454383 +
gcagtcttttaagaaacatttt

SEQ ID NO: 194041 - DNA, 22 bp, Artificial Sequence
  Synthetic oligonucleotide; CTT chr2 60454369 60454390 60454386 60454391 +
ttaagaaacatttttccaagca

SEQ ID NO: 194042 - DNA, 22 bp, Artificial Sequence
  Synthetic oligonucleotide; TTT chr2 60454370 60454391 60454387 60454392 +
taagaaacatttttccaagcag

SEQ ID NO: 194043 - DNA, 22 bp, Artificial Sequence
  Synthetic oligonucleotide; TTT chr2 60454371 60454392 60454388 60454393 +
aagaaacatttttccaagcagg

SEQ ID NO: 194044 - DNA, 22 bp, Artificial Sequence
  Synthetic oligonucleotide; TTA chr2 60454372 60454393 60454389 60454394 +
agaaacatttttccaagcaggt

SEQ ID NO: 194045 - DNA, 22 bp, Artificial Sequence
  Synthetic oligonucleotide; TTT chr2 60454382 60454403 60454399 60454404 +
ttccaagcaggttgagagaact

SEQ ID NO: 194046 - DNA, 22 bp, Artificial Sequence
  Synthetic oligonucleotide; TTT chr2 60454383 60454404 60454400 60454405 +
tccaagcaggttgagagaactc

SEQ ID NO: 194047 - DNA, 22 bp, Artificial Sequence
  Synthetic oligonucleotide; TTT chr2 60454384 60454405 60454401 60454406 +
ccaagcaggttgagagaactct

SEQ ID NO: 194048 - DNA, 22 bp, Artificial Sequence
  Synthetic oligonucleotide; TTC chr2 60454385 60454406 60454402 60454407 +
caagcaggttgagagaactctg

SEQ ID NO: 194049 - DNA, 22 bp, Artificial Sequence
  Synthetic oligonucleotide; TTG chr2 60454396 60454417 60454413 60454418 +
agagaactctgccaatcccatc

SEQ ID NO: 194050 - DNA, 22 bp, Artificial Sequence
  Synthetic oligonucleotide; CTC chr2 60454405 60454426 60454422 60454427 +
tgccaatcccatcctcatatcg

SEQ ID NO: 194051 - DNA, 22 bp, Artificial Sequence
  Synthetic oligonucleotide; CTG chr2 60454407 60454428 60454424 60454429 +
ccaatcccatcctcatatcggc

SEQ ID NO: 194052 - DNA, 22 bp, Artificial Sequence
  Synthetic oligonucleotide; CTC chr2 60454421 60454442 60454438 60454443 +
atatcggcaaagttcccacaat

SEQ ID NO: 194053 - DNA, 22 bp, Artificial Sequence
  Synthetic oligonucleotide; TTC chr2 60454436 60454457 60454453 60454458 +
ccacaattttttttttatggga

SEQ ID NO: 194054 - DNA, 22 bp, Artificial Sequence
  Synthetic oligonucleotide; TTT chr2 60454445 60454466 60454462 60454467 +
tttttttatgggaagttgtctg

SEQ ID NO: 194055 - DNA, 22 bp, Artificial Sequence
  Synthetic oligonucleotide; TTT chr2 60454446 60454467 60454463 60454468 +
ttttttatgggaagttgtctga

SEQ ID NO: 194056 - DNA, 22 bp, Artificial Sequence
  Synthetic oligonucleotide; TTT chr2 60454447 60454468 60454464 60454469 +
tttttatgggaagttgtctgaa

SEQ ID NO: 194057 - DNA, 22 bp, Artificial Sequence
  Synthetic oligonucleotide; TTT chr2 60454448 60454469 60454465 60454470 +
ttttatgggaagttgtctgaaa

SEQ ID NO: 194058 - DNA, 22 bp, Artificial Sequence
  Synthetic oligonucleotide; TTT chr2 60454449 60454470 60454466 60454471 +
tttatgggaagttgtctgaaaa

SEQ ID NO: 194059 - DNA, 22 bp, Artificial Sequence
  Synthetic oligonucleotide; TTT chr2 60454450 60454471 60454467 60454472 +
ttatgggaagttgtctgaaaaa

SEQ ID NO: 194060 - DNA, 22 bp, Artificial Sequence
  Synthetic oligonucleotide; TTT chr2 60454451 60454472 60454468 60454473 +
tatgggaagttgtctgaaaaaa

SEQ ID NO: 194061 - DNA, 22 bp, Artificial Sequence
  Synthetic oligonucleotide; TTT chr2 60454452 60454473 60454469 60454474 +
atgggaagttgtctgaaaaaaa

SEQ ID NO: 194062 - DNA, 22 bp, Artificial Sequence
  Synthetic oligonucleotide; TTA chr2 60454453 60454474 60454470 60454475 +
tgggaagttgtctgaaaaaaag

SEQ ID NO: 194063 - DNA, 22 bp, Artificial Sequence
  Synthetic oligonucleotide; TTG chr2 60454463 60454484 60454480 60454485 +
tctgaaaaaaagagaatgggat

SEQ ID NO: 194064 - DNA, 22 bp, Artificial Sequence
  Synthetic oligonucleotide; CTG chr2 60454467 60454488 60454484 60454489 +
aaaaaaagagaatgggatgggt

SEQ ID NO: 194065 - DNA, 22 bp, Artificial Sequence
  Synthetic oligonucleotide; TTC chr2 60454495 60454516 60454512 60454517 +
ctgaacacaccaggcccaggga

SEQ ID NO: 194066 - DNA, 22 bp, Artificial Sequence
  Synthetic oligonucleotide; CTG chr2 60454498 60454519 60454515 60454520 +
aacacaccaggcccagggacaa

SEQ ID NO: 194067 - DNA, 22 bp, Artificial Sequence
  Synthetic oligonucleotide; TTA chr2 60454556 60454577 60454573 60454578 +
caacacagtcataagaagtcat

SEQ ID NO: 194068 - DNA, 22 bp, Artificial Sequence
  Synthetic oligonucleotide; TTC chr2 60454582 60454603 60454599 60454604 +
atgtgtgtacggagggggaaaa

SEQ ID NO: 194069 - DNA, 22 bp, Artificial Sequence
  Synthetic oligonucleotide; CTT chr2 60454611 60454632 60454628 60454633 +
aaaacaagaaaacactgtattt

SEQ ID NO: 194070 - DNA, 22 bp, Artificial Sequence
  Synthetic oligonucleotide; TTA chr2 60454612 60454633 60454629 60454634 +
aaacaagaaaacactgtatttc

SEQ ID NO: 194071 - DNA, 22 bp, Artificial Sequence
  Synthetic oligonucleotide; CTG chr2 60454628 60454649 60454645 60454650 +
tatttcctccctcagtctctgt

SEQ ID NO: 194072 - DNA, 22 bp, Artificial Sequence
  Synthetic oligonucleotide; TTT chr2 60454633 60454654 60454650 60454655 +
cctccctcagtctctgtgagca

SEQ ID NO: 194073 - DNA, 22 bp, Artificial Sequence
  Synthetic oligonucleotide; TTC chr2 60454634 60454655 60454651 60454656 +
ctccctcagtctctgtgagcaa

SEQ ID NO: 194074 - DNA, 22 bp, Artificial Sequence
  Synthetic oligonucleotide; CTC chr2 60454637 60454658 60454654 60454659 +
cctcagtctctgtgagcaaagt

SEQ ID NO: 194075 - DNA, 22 bp, Artificial Sequence
  Synthetic oligonucleotide; CTC chr2 60454641 60454662 60454658 60454663 +
agtctctgtgagcaaagtacta

SEQ ID NO: 194076 - DNA, 22 bp, Artificial Sequence
  Synthetic oligonucleotide; CTC chr2 60454647 60454668 60454664 60454669 +
tgtgagcaaagtactacaagca

SEQ ID NO: 194077 - DNA, 22 bp, Artificial Sequence
  Synthetic oligonucleotide; CTG chr2 60454649 60454670 60454666 60454671 +
tgagcaaagtactacaagcagg

SEQ ID NO: 194078 - DNA, 22 bp, Artificial Sequence
  Synthetic oligonucleotide; CTA chr2 60454663 60454684 60454680 60454685 +
caagcaggagaggatggggcct

SEQ ID NO: 194079 - DNA, 22 bp, Artificial Sequence
  Synthetic oligonucleotide; CTG chr2 60454686 60454707 60454703 60454708 +
aggcttctcaactccttttcag

SEQ ID NO: 194080 - DNA, 22 bp, Artificial Sequence
  Synthetic oligonucleotide; CTT chr2 60454692 60454713 60454709 60454714 +
ctcaactccttttcaggaaggc

SEQ ID NO: 194081 - DNA, 22 bp, Artificial Sequence
  Synthetic oligonucleotide; TTC chr2 60454693 60454714 60454710 60454715 +
tcaactccttttcaggaaggcc

SEQ ID NO: 194082 - DNA, 22 bp, Artificial Sequence
  Synthetic oligonucleotide; CTC chr2 60454695 60454716 60454712 60454717 +
aactccttttcaggaaggcccg

SEQ ID NO: 194083 - DNA, 22 bp, Artificial Sequence
  Synthetic oligonucleotide; CTC chr2 60454700 60454721 60454717 60454722 +
cttttcaggaaggcccgaaata

SEQ ID NO: 194084 - DNA, 22 bp, Artificial Sequence
  Synthetic oligonucleotide; CTT chr2 60454703 60454724 60454720 60454725 +
ttcaggaaggcccgaaataatc

SEQ ID NO: 194085 - DNA, 22 bp, Artificial Sequence
  Synthetic oligonucleotide; TTT chr2 60454704 60454725 60454721 60454726 +
tcaggaaggcccgaaataatcc

SEQ ID NO: 194086 - DNA, 22 bp, Artificial Sequence
  Synthetic oligonucleotide; TTT chr2 60454705 60454726 60454722 60454727 +
caggaaggcccgaaataatccc

SEQ ID NO: 194087 - DNA, 22 bp, Artificial Sequence
  Synthetic oligonucleotide; TTC chr2 60454706 60454727 60454723 60454728 +
aggaaggcccgaaataatccca

SEQ ID NO: 194088 - DNA, 22 bp, Artificial Sequence
  Synthetic oligonucleotide; CTT chr2 60454735 60454756 60454752 60454757 +
tcagcaaactgtgtctgtgaat

SEQ ID NO: 194089 - DNA, 22 bp, Artificial Sequence
  Synthetic oligonucleotide; TTT chr2 60454736 60454757 60454753 60454758 +
cagcaaactgtgtctgtgaata

SEQ ID NO: 194090 - DNA, 22 bp, Artificial Sequence
  Synthetic oligonucleotide; TTC chr2 60454737 60454758 60454754 60454759 +
agcaaactgtgtctgtgaataa

SEQ ID NO: 194091 - DNA, 22 bp, Artificial Sequence
  Synthetic oligonucleotide; CTG chr2 60454746 60454767 60454763 60454768 +
tgtctgtgaataaaccacctca

SEQ ID NO: 194092 - DNA, 22 bp, Artificial Sequence
  Synthetic oligonucleotide; CTG chr2 60454752 60454773 60454769 60454774 +
tgaataaaccacctcatttcct

SEQ ID NO: 194093 - DNA, 22 bp, Artificial Sequence
  Synthetic oligonucleotide; CTC chr2 60454767 60454788 60454784 60454789 +
atttccttatttctccaattgg

SEQ ID NO: 194094 - DNA, 22 bp, Artificial Sequence
  Synthetic oligonucleotide; TTT chr2 60454771 60454792 60454788 60454793 +
ccttatttctccaattggaatt

SEQ ID NO: 194095 - DNA, 22 bp, Artificial Sequence
  Synthetic oligonucleotide; TTC chr2 60454772 60454793 60454789 60454794 +
cttatttctccaattggaatta

SEQ ID NO: 194096 - DNA, 22 bp, Artificial Sequence
  Synthetic oligonucleotide; CTT chr2 60454775 60454796 60454792 60454797 +
atttctccaattggaattatac

SEQ ID NO: 194097 - DNA, 22 bp, Artificial Sequence
  Synthetic oligonucleotide; TTA chr2 60454776 60454797 60454793 60454798 +
tttctccaattggaattatacc

SEQ ID NO: 194098 - DNA, 22 bp, Artificial Sequence
  Synthetic oligonucleotide; TTT chr2 60454779 60454800 60454796 60454801 +
ctccaattggaattatacctaa

SEQ ID NO: 194099 - DNA, 22 bp, Artificial Sequence
  Synthetic oligonucleotide; TTC chr2 60454780 60454801 60454797 60454802 +
tccaattggaattatacctaag

SEQ ID NO: 194100 - DNA, 22 bp, Artificial Sequence
  Synthetic oligonucleotide; CTC chr2 60454782 60454803 60454799 60454804 +
caattggaattatacctaagcc

SEQ ID NO: 194101 - DNA, 22 bp, Artificial Sequence
  Synthetic oligonucleotide; TTG chr2 60454788 60454809 60454805 60454810 +
gaattatacctaagccatctcc

SEQ ID NO: 194102 - DNA, 22 bp, Artificial Sequence
  Synthetic oligonucleotide; TTA chr2 60454794 60454815 60454811 60454816 +
tacctaagccatctcccgccac

SEQ ID NO: 194103 - DNA, 22 bp, Artificial Sequence
  Synthetic oligonucleotide; CTA chr2 60454800 60454821 60454817 60454822 +
agccatctcccgccacttcctt

SEQ ID NO: 194104 - DNA, 22 bp, Artificial Sequence
  Synthetic oligonucleotide; CTC chr2 60454809 60454830 60454826 60454831 +
ccgccacttcctttcaagttct

SEQ ID NO: 194105 - DNA, 22 bp, Artificial Sequence
  Synthetic oligonucleotide; CTT chr2 60454818 60454839 60454835 60454840 +
cctttcaagttctcacttctag

SEQ ID NO: 194106 - DNA, 22 bp, Artificial Sequence
  Synthetic oligonucleotide; TTC chr2 60454819 60454840 60454836 60454841 +
ctttcaagttctcacttctagc

SEQ ID NO: 194107 - DNA, 22 bp, Artificial Sequence
  Synthetic oligonucleotide; CTT chr2 60454822 60454843 60454839 60454844 +
tcaagttctcacttctagcatt

SEQ ID NO: 194108 - DNA, 22 bp, Artificial Sequence
  Synthetic oligonucleotide; TTT chr2 60454823 60454844 60454840 60454845 +
caagttctcacttctagcatta

SEQ ID NO: 194109 - DNA, 22 bp, Artificial Sequence
  Synthetic oligonucleotide; TTC chr2 60454824 60454845 60454841 60454846 +
aagttctcacttctagcattat

SEQ ID NO: 194110 - DNA, 22 bp, Artificial Sequence
  Synthetic oligonucleotide; TTC chr2 60454830 60454851 60454847 60454852 +
tcacttctagcattatgattat

SEQ ID NO: 194111 - DNA, 22 bp, Artificial Sequence
  Synthetic oligonucleotide; CTC chr2 60454832 60454853 60454849 60454854 +
acttctagcattatgattatat

SEQ ID NO: 194112 - DNA, 22 bp, Artificial Sequence
  Synthetic oligonucleotide; CTT chr2 60454836 60454857 60454853 60454858 +
ctagcattatgattatatacaa

SEQ ID NO: 194113 - DNA, 22 bp, Artificial Sequence
  Synthetic oligonucleotide; TTC chr2 60454837 60454858 60454854 60454859 +
tagcattatgattatatacaat

SEQ ID NO: 194114 - DNA, 22 bp, Artificial Sequence
  Synthetic oligonucleotide; CTA chr2 60454839 60454860 60454856 60454861 +
gcattatgattatatacaatat

SEQ ID NO: 194115 - DNA, 22 bp, Artificial Sequence
  Synthetic oligonucleotide; TTA chr2 60454845 60454866 60454862 60454867 +
tgattatatacaatatgtactt

SEQ ID NO: 194116 - DNA, 22 bp, Artificial Sequence
  Synthetic oligonucleotide; TTA chr2 60454851 60454872 60454868 60454873 +
tatacaatatgtacttattgca

SEQ ID NO: 194117 - DNA, 22 bp, Artificial Sequence
  Synthetic oligonucleotide; CTT chr2 60454867 60454888 60454884 60454889 +
attgcatatacaaaaatggtat

SEQ ID NO: 194118 - DNA, 22 bp, Artificial Sequence
  Synthetic oligonucleotide; TTA chr2 60454868 60454889 60454885 60454890 +
ttgcatatacaaaaatggtatt

SEQ ID NO: 194119 - DNA, 22 bp, Artificial Sequence
  Synthetic oligonucleotide; TTG chr2 60454871 60454892 60454888 60454893 +
catatacaaaaatggtatttaa

SEQ ID NO: 194120 - DNA, 22 bp, Artificial Sequence
  Synthetic oligonucleotide; TTT chr2 60454891 60454912 60454908 60454913 +
aaataaacagttctatatctac

SEQ ID NO: 194121 - DNA, 22 bp, Artificial Sequence
  Synthetic oligonucleotide; TTA chr2 60454892 60454913 60454909 60454914 +
aataaacagttctatatctaca

SEQ ID NO: 194122 - DNA, 22 bp, Artificial Sequence
  Synthetic oligonucleotide; TTC chr2 60454904 60454925 60454921 60454926 +
tatatctacagaatgccctggg

SEQ ID NO: 194123 - DNA, 22 bp, Artificial Sequence
  Synthetic oligonucleotide; CTA chr2 60454906 60454927 60454923 60454928 +
tatctacagaatgccctgggaa

SEQ ID NO: 194124 - DNA, 22 bp, Artificial Sequence
  Synthetic oligonucleotide; CTA chr2 60454912 60454933 60454929 60454934 +
cagaatgccctgggaaaaactc

SEQ ID NO: 194125 - DNA, 22 bp, Artificial Sequence
  Synthetic oligonucleotide; CTG chr2 60454924 60454945 60454941 60454946 +
ggaaaaactcaactacttcaca

SEQ ID NO: 194126 - DNA, 22 bp, Artificial Sequence
  Synthetic oligonucleotide; CTC chr2 60454934 60454955 60454951 60454956 +
aactacttcacactttctgcca

SEQ ID NO: 194127 - DNA, 22 bp, Artificial Sequence
  Synthetic oligonucleotide; CTA chr2 60454939 60454960 60454956 60454961 +
cttcacactttctgccatggcc

SEQ ID NO: 194128 - DNA, 22 bp, Artificial Sequence
  Synthetic oligonucleotide; CTT chr2 60454942 60454963 60454959 60454964 +
cacactttctgccatggccagt

SEQ ID NO: 194129 - DNA, 22 bp, Artificial Sequence
  Synthetic oligonucleotide; TTC chr2 60454943 60454964 60454960 60454965 +
acactttctgccatggccagtg

SEQ ID NO: 194130 - DNA, 22 bp, Artificial Sequence
  Synthetic oligonucleotide; CTT chr2 60454949 60454970 60454966 60454971 +
tctgccatggccagtgcaaatg

SEQ ID NO: 194131 - DNA, 22 bp, Artificial Sequence
  Synthetic oligonucleotide; TTT chr2 60454950 60454971 60454967 60454972 +
ctgccatggccagtgcaaatga

SEQ ID NO: 194132 - DNA, 22 bp, Artificial Sequence
  Synthetic oligonucleotide; TTC chr2 60454951 60454972 60454968 60454973 +
tgccatggccagtgcaaatgaa

SEQ ID NO: 194133 - DNA, 22 bp, Artificial Sequence
  Synthetic oligonucleotide; CTG chr2 60454953 60454974 60454970 60454975 +
ccatggccagtgcaaatgaaga

SEQ ID NO: 194134 - DNA, 22 bp, Artificial Sequence
  Synthetic oligonucleotide; CTG chr2 60454979 60455000 60454996 60455001 +
tgttcacctcacttcttagcaa

SEQ ID NO: 194135 - DNA, 22 bp, Artificial Sequence
  Synthetic oligonucleotide; TTC chr2 60454984 60455005 60455001 60455006 +
acctcacttcttagcaaccttt

SEQ ID NO: 194136 - DNA, 22 bp, Artificial Sequence
  Synthetic oligonucleotide; CTC chr2 60454989 60455010 60455006 60455011 +
acttcttagcaacctttgtaat

SEQ ID NO: 194137 - DNA, 22 bp, Artificial Sequence
  Synthetic oligonucleotide; CTT chr2 60454993 60455014 60455010 60455015 +
cttagcaacctttgtaatgtgt

SEQ ID NO: 194138 - DNA, 22 bp, Artificial Sequence
  Synthetic oligonucleotide; TTC chr2 60454994 60455015 60455011 60455016 +
ttagcaacctttgtaatgtgtt

SEQ ID NO: 194139 - DNA, 22 bp, Artificial Sequence
  Synthetic oligonucleotide; CTT chr2 60454996 60455017 60455013 60455018 +
agcaacctttgtaatgtgttgg

SEQ ID NO: 194140 - DNA, 22 bp, Artificial Sequence
  Synthetic oligonucleotide; TTA chr2 60454997 60455018 60455014 60455019 +
gcaacctttgtaatgtgttggt

SEQ ID NO: 194141 - DNA, 22 bp, Artificial Sequence
  Synthetic oligonucleotide; CTT chr2 60455005 60455026 60455022 60455027 +
tgtaatgtgttggttccagcct

SEQ ID NO: 194142 - DNA, 22 bp, Artificial Sequence
  Synthetic oligonucleotide; TTT chr2 60455006 60455027 60455023 60455028 +
gtaatgtgttggttccagcctt

SEQ ID NO: 194143 - DNA, 22 bp, Artificial Sequence
  Synthetic oligonucleotide; TTG chr2 60455007 60455028 60455024 60455029 +
taatgtgttggttccagccttt

SEQ ID NO: 194144 - DNA, 22 bp, Artificial Sequence
  Synthetic oligonucleotide; TTG chr2 60455017 60455038 60455034 60455039 +
gttccagcctttttgtaggtcc

SEQ ID NO: 194145 - DNA, 22 bp, Artificial Sequence
  Synthetic oligonucleotide; TTC chr2 60455021 60455042 60455038 60455043 +
cagcctttttgtaggtcctaaa

SEQ ID NO: 194146 - DNA, 22 bp, Artificial Sequence
  Synthetic oligonucleotide; CTT chr2 60455028 60455049 60455045 60455050 +
tttgtaggtcctaaacaaagag

SEQ ID NO: 194147 - DNA, 22 bp, Artificial Sequence
  Synthetic oligonucleotide; TTT chr2 60455029 60455050 60455046 60455051 +
ttgtaggtcctaaacaaagaga

SEQ ID NO: 194148 - DNA, 22 bp, Artificial Sequence
  Synthetic oligonucleotide; TTT chr2 60455030 60455051 60455047 60455052 +
tgtaggtcctaaacaaagagag

SEQ ID NO: 194149 - DNA, 22 bp, Artificial Sequence
  Synthetic oligonucleotide; TTT chr2 60455031 60455052 60455048 60455053 +
gtaggtcctaaacaaagagagg

SEQ ID NO: 194150 - DNA, 22 bp, Artificial Sequence
  Synthetic oligonucleotide; TTG chr2 60455032 60455053 60455049 60455054 +
taggtcctaaacaaagagagga

SEQ ID NO: 194151 - DNA, 22 bp, Artificial Sequence
  Synthetic oligonucleotide; CTA chr2 60455041 60455062 60455058 60455063 +
aacaaagagaggatagcaaatg

SEQ ID NO: 194152 - DNA, 22 bp, Artificial Sequence
  Synthetic oligonucleotide; TTC chr2 60455068 60455089 60455085 60455090 +
aggaaggaggtaatataggcac

SEQ ID NO: 194153 - DNA, 22 bp, Artificial Sequence
  Synthetic oligonucleotide; CTG chr2 60455092 60455113 60455109 60455114 +
gaagagtttctggtttaaaatc

SEQ ID NO: 194154 - DNA, 22 bp, Artificial Sequence
  Synthetic oligonucleotide; TTT chr2 60455101 60455122 60455118 60455123 +
ctggtttaaaatctgtgagaaa

SEQ ID NO: 194155 - DNA, 22 bp, Artificial Sequence
  Synthetic oligonucleotide; TTC chr2 60455102 60455123 60455119 60455124 +
tggtttaaaatctgtgagaaat

SEQ ID NO: 194156 - DNA, 22 bp, Artificial Sequence
  Synthetic oligonucleotide; CTG chr2 60455104 60455125 60455121 60455126 +
gtttaaaatctgtgagaaatag

SEQ ID NO: 194157 - DNA, 22 bp, Artificial Sequence
  Synthetic oligonucleotide; TTT chr2 60455108 60455129 60455125 60455130 +
aaaatctgtgagaaatagaatt

SEQ ID NO: 194158 - DNA, 22 bp, Artificial Sequence
  Synthetic oligonucleotide; TTA chr2 60455109 60455130 60455126 60455131 +
aaatctgtgagaaatagaattt

SEQ ID NO: 194159 - DNA, 22 bp, Artificial Sequence
  Synthetic oligonucleotide; CTG chr2 60455116 60455137 60455133 60455138 +
tgagaaatagaatttgcggtat

SEQ ID NO: 194160 - DNA, 22 bp, Artificial Sequence
  Synthetic oligonucleotide; TTT chr2 60455131 60455152 60455148 60455153 +
gcggtattcctgtttattaagt

SEQ ID NO: 194161 - DNA, 22 bp, Artificial Sequence
  Synthetic oligonucleotide; TTG chr2 60455132 60455153 60455149 60455154 +
cggtattcctgtttattaagtt

SEQ ID NO: 194162 - DNA, 22 bp, Artificial Sequence
  Synthetic oligonucleotide; TTC chr2 60455140 60455161 60455157 60455162 +
ctgtttattaagttgttctcaa

SEQ ID NO: 194163 - DNA, 22 bp, Artificial Sequence
  Synthetic oligonucleotide; CTG chr2 60455143 60455164 60455160 60455165 +
tttattaagttgttctcaaatg

SEQ ID NO: 194164 - DNA, 22 bp, Artificial Sequence
  Synthetic oligonucleotide; TTT chr2 60455146 60455167 60455163 60455168 +
attaagttgttctcaaatgaag

SEQ ID NO: 194165 - DNA, 22 bp, Artificial Sequence
  Synthetic oligonucleotide; TTA chr2 60455147 60455168 60455164 60455169 +
ttaagttgttctcaaatgaaga

SEQ ID NO: 194166 - DNA, 22 bp, Artificial Sequence
  Synthetic oligonucleotide; TTA chr2 60455150 60455171 60455167 60455172 +
agttgttctcaaatgaagatta

SEQ ID NO: 194167 - DNA, 22 bp, Artificial Sequence
  Synthetic oligonucleotide; TTG chr2 60455155 60455176 60455172 60455177 +
ttctcaaatgaagattaaaaag

SEQ ID NO: 194168 - DNA, 22 bp, Artificial Sequence
  Synthetic oligonucleotide; TTC chr2 60455158 60455179 60455175 60455180 +
tcaaatgaagattaaaaagaac

SEQ ID NO: 194169 - DNA, 22 bp, Artificial Sequence
  Synthetic oligonucleotide; CTC chr2 60455160 60455181 60455177 60455182 +
aaatgaagattaaaaagaacat

SEQ ID NO: 194170 - DNA, 22 bp, Artificial Sequence
  Synthetic oligonucleotide; TTA chr2 60455172 60455193 60455189 60455194 +
aaaagaacattttaagcatcag

SEQ ID NO: 194171 - DNA, 22 bp, Artificial Sequence
  Synthetic oligonucleotide; TTT chr2 60455184 60455205 60455201 60455206 +
taagcatcagttcaggtatgta

SEQ ID NO: 194172 - DNA, 22 bp, Artificial Sequence
  Synthetic oligonucleotide; TTT chr2 60455185 60455206 60455202 60455207 +
aagcatcagttcaggtatgtag

SEQ ID NO: 194173 - DNA, 22 bp, Artificial Sequence
  Synthetic oligonucleotide; TTA chr2 60455186 60455207 60455203 60455208 +
agcatcagttcaggtatgtaga

SEQ ID NO: 194174 - DNA, 22 bp, Artificial Sequence
  Synthetic oligonucleotide; TTC chr2 60455197 60455218 60455214 60455219 +
aggtatgtagagaacattccat

SEQ ID NO: 194175 - DNA, 22 bp, Artificial Sequence
  Synthetic oligonucleotide; TTC chr2 60455216 60455237 60455233 60455238 +
catcagcacgtcaagcctgtta

SEQ ID NO: 194176 - DNA, 22 bp, Artificial Sequence
  Synthetic oligonucleotide; CTG chr2 60455235 60455256 60455252 60455257 +
ttacaaaaacttacttgaggat

SEQ ID NO: 194177 - DNA, 22 bp, Artificial Sequence
  Synthetic oligonucleotide; TTA chr2 60455238 60455259 60455255 60455260 +
caaaaacttacttgaggatttt

SEQ ID NO: 194178 - DNA, 22 bp, Artificial Sequence
  Synthetic oligonucleotide; CTT chr2 60455247 60455268 60455264 60455269 +
acttgaggattttaagagacat

SEQ ID NO: 194179 - DNA, 22 bp, Artificial Sequence
  Synthetic oligonucleotide; TTA chr2 60455248 60455269 60455265 60455270 +
cttgaggattttaagagacatt

SEQ ID NO: 194180 - DNA, 22 bp, Artificial Sequence
  Synthetic oligonucleotide; CTT chr2 60455251 60455272 60455268 60455273 +
gaggattttaagagacattaat

SEQ ID NO: 194181 - DNA, 22 bp, Artificial Sequence
  Synthetic oligonucleotide; TTG chr2 60455252 60455273 60455269 60455274 +
aggattttaagagacattaatg

SEQ ID NO: 194182 - DNA, 22 bp, Artificial Sequence
  Synthetic oligonucleotide; TTT chr2 60455259 60455280 60455276 60455281 +
taagagacattaatgttcttag

SEQ ID NO: 194183 - DNA, 22 bp, Artificial Sequence
  Synthetic oligonucleotide; TTT chr2 60455260 60455281 60455277 60455282 +
aagagacattaatgttcttagt

SEQ ID NO: 194184 - DNA, 22 bp, Artificial Sequence
  Synthetic oligonucleotide; TTA chr2 60455261 60455282 60455278 60455283 +
agagacattaatgttcttagta

SEQ ID NO: 194185 - DNA, 22 bp, Artificial Sequence
  Synthetic oligonucleotide; TTA chr2 60455271 60455292 60455288 60455293 +
atgttcttagtagttcctcatt

SEQ ID NO: 194186 - DNA, 22 bp, Artificial Sequence
  Synthetic oligonucleotide; TTC chr2 60455277 60455298 60455294 60455299 +
ttagtagttcctcatttaaaaa

SEQ ID NO: 194187 - DNA, 22 bp, Artificial Sequence
  Synthetic oligonucleotide; CTT chr2 60455279 60455300 60455296 60455301 +
agtagttcctcatttaaaaaaa

SEQ ID NO: 194188 - DNA, 22 bp, Artificial Sequence
  Synthetic oligonucleotide; TTA chr2 60455280 60455301 60455297 60455302 +
gtagttcctcatttaaaaaaaa

SEQ ID NO: 194189 - DNA, 22 bp, Artificial Sequence
  Synthetic oligonucleotide; TTC chr2 60455287 60455308 60455304 60455309 +
ctcatttaaaaaaaaaagatca

SEQ ID NO: 194190 - DNA, 22 bp, Artificial Sequence
  Synthetic oligonucleotide; CTC chr2 60455290 60455311 60455307 60455312 +
atttaaaaaaaaaagatcatga

SEQ ID NO: 194191 - DNA, 22 bp, Artificial Sequence
  Synthetic oligonucleotide; TTT chr2 60455294 60455315 60455311 60455316 +
aaaaaaaaaagatcatgaattc

SEQ ID NO: 194192 - DNA, 22 bp, Artificial Sequence
  Synthetic oligonucleotide; TTA chr2 60455295 60455316 60455312 60455317 +
aaaaaaaaagatcatgaattca

SEQ ID NO: 194193 - DNA, 22 bp, Artificial Sequence
  Synthetic oligonucleotide; TTC chr2 60455316 60455337 60455333 60455338 +
atcttactattggaaatgtgca

SEQ ID NO: 194194 - DNA, 22 bp, Artificial Sequence
  Synthetic oligonucleotide; CTT chr2 60455321 60455342 60455338 60455343 +
actattggaaatgtgcatgtta

SEQ ID NO: 194195 - DNA, 22 bp, Artificial Sequence
  Synthetic oligonucleotide; TTA chr2 60455322 60455343 60455339 60455344 +
ctattggaaatgtgcatgttat

SEQ ID NO: 194196 - DNA, 22 bp, Artificial Sequence
  Synthetic oligonucleotide; CTA chr2 60455325 60455346 60455342 60455347 +
ttggaaatgtgcatgttatttt

SEQ ID NO: 194197 - DNA, 22 bp, Artificial Sequence
  Synthetic oligonucleotide; TTG chr2 60455328 60455349 60455345 60455350 +
gaaatgtgcatgttattttata

SEQ ID NO: 194198 - DNA, 22 bp, Artificial Sequence
  Synthetic oligonucleotide; TTA chr2 60455343 60455364 60455360 60455365 +
ttttatattaagattttaaatt

SEQ ID NO: 194199 - DNA, 22 bp, Artificial Sequence
  Synthetic oligonucleotide; TTT chr2 60455346 60455367 60455363 60455368 +
tatattaagattttaaatttta

SEQ ID NO: 194200 - DNA, 22 bp, Artificial Sequence
  Synthetic oligonucleotide; TTT chr2 60455347 60455368 60455364 60455369 +
atattaagattttaaattttag

SEQ ID NO: 194201 - DNA, 22 bp, Artificial Sequence
  Synthetic oligonucleotide; TTA chr2 60455348 60455369 60455365 60455370 +
tattaagattttaaattttaga

SEQ ID NO: 194202 - DNA, 22 bp, Artificial Sequence
  Synthetic oligonucleotide; TTA chr2 60455353 60455374 60455370 60455375 +
agattttaaattttagagttct

SEQ ID NO: 194203 - DNA, 22 bp, Artificial Sequence
  Synthetic oligonucleotide; TTT chr2 60455359 60455380 60455376 60455381 +
taaattttagagttctggatac

SEQ ID NO: 194204 - DNA, 22 bp, Artificial Sequence
  Synthetic oligonucleotide; TTT chr2 60455360 60455381 60455377 60455382 +
aaattttagagttctggataca

SEQ ID NO: 194205 - DNA, 22 bp, Artificial Sequence
  Synthetic oligonucleotide; TTA chr2 60455361 60455382 60455378 60455383 +
aattttagagttctggatacaa

SEQ ID NO: 194206 - DNA, 22 bp, Artificial Sequence
  Synthetic oligonucleotide; TTT chr2 60455366 60455387 60455383 60455388 +
tagagttctggatacaaaatat

SEQ ID NO: 194207 - DNA, 22 bp, Artificial Sequence
  Synthetic oligonucleotide; TTT chr2 60455367 60455388 60455384 60455389 +
agagttctggatacaaaatatc

SEQ ID NO: 194208 - DNA, 22 bp, Artificial Sequence
  Synthetic oligonucleotide; TTA chr2 60455368 60455389 60455385 60455390 +
gagttctggatacaaaatatca

SEQ ID NO: 194209 - DNA, 22 bp, Artificial Sequence
  Synthetic oligonucleotide; TTC chr2 60455374 60455395 60455391 60455396 +
tggatacaaaatatcatttata

SEQ ID NO: 194210 - DNA, 22 bp, Artificial Sequence
  Synthetic oligonucleotide; CTG chr2 60455376 60455397 60455393 60455398 +
gatacaaaatatcatttataag

SEQ ID NO: 194211 - DNA, 22 bp, Artificial Sequence
  Synthetic oligonucleotide; TTT chr2 60455393 60455414 60455410 60455415 +
ataagtgatatcatgttggcta

SEQ ID NO: 194212 - DNA, 22 bp, Artificial Sequence
  Synthetic oligonucleotide; TTA chr2 60455394 60455415 60455411 60455416 +
taagtgatatcatgttggctag

SEQ ID NO: 194213 - DNA, 22 bp, Artificial Sequence
  Synthetic oligonucleotide; TTG chr2 60455411 60455432 60455428 60455433 +
gctaggttctcatgtttctatt

SEQ ID NO: 194214 - DNA, 22 bp, Artificial Sequence
  Synthetic oligonucleotide; CTA chr2 60455415 60455436 60455432 60455437 +
ggttctcatgtttctattgttc

SEQ ID NO: 194215 - DNA, 22 bp, Artificial Sequence
  Synthetic oligonucleotide; TTC chr2 60455420 60455441 60455437 60455442 +
tcatgtttctattgttcatcag

SEQ ID NO: 194216 - DNA, 22 bp, Artificial Sequence
  Synthetic oligonucleotide; CTC chr2 60455422 60455443 60455439 60455444 +
atgtttctattgttcatcagct

SEQ ID NO: 194217 - DNA, 22 bp, Artificial Sequence
  Synthetic oligonucleotide; TTT chr2 60455428 60455449 60455445 60455450 +
ctattgttcatcagcttcagaa

SEQ ID NO: 194218 - DNA, 22 bp, Artificial Sequence
  Synthetic oligonucleotide; TTC chr2 60455429 60455450 60455446 60455451 +
tattgttcatcagcttcagaaa

SEQ ID NO: 194219 - DNA, 22 bp, Artificial Sequence
  Synthetic oligonucleotide; CTA chr2 60455431 60455452 60455448 60455453 +
ttgttcatcagcttcagaaata

SEQ ID NO: 194220 - DNA, 22 bp, Artificial Sequence
  Synthetic oligonucleotide; TTG chr2 60455434 60455455 60455451 60455456 +
ttcatcagcttcagaaataata

SEQ ID NO: 194221 - DNA, 22 bp, Artificial Sequence
  Synthetic oligonucleotide; TTC chr2 60455437 60455458 60455454 60455459 +
atcagcttcagaaataatattt

SEQ ID NO: 194222 - DNA, 22 bp, Artificial Sequence
  Synthetic oligonucleotide; CTT chr2 60455445 60455466 60455462 60455467 +
cagaaataatattttatcagaa

SEQ ID NO: 194223 - DNA, 22 bp, Artificial Sequence
  Synthetic oligonucleotide; TTC chr2 60455446 60455467 60455463 60455468 +
agaaataatattttatcagaag

SEQ ID NO: 194224 - DNA, 22 bp, Artificial Sequence
  Synthetic oligonucleotide; TTT chr2 60455459 60455480 60455476 60455481 +
tatcagaaggcgtcaataagtc

SEQ ID NO: 194225 - DNA, 22 bp, Artificial Sequence
  Synthetic oligonucleotide; TTT chr2 60455460 60455481 60455477 60455482 +
atcagaaggcgtcaataagtca

SEQ ID NO: 194226 - DNA, 22 bp, Artificial Sequence
  Synthetic oligonucleotide; TTA chr2 60455461 60455482 60455478 60455483 +
tcagaaggcgtcaataagtcag

SEQ ID NO: 194227 - DNA, 22 bp, Artificial Sequence
  Synthetic oligonucleotide; CTA chr2 60455490 60455511 60455507 60455512 +
agtaacctgaagaacccatctc

SEQ ID NO: 194228 - DNA, 22 bp, Artificial Sequence
  Synthetic oligonucleotide; CTG chr2 60455499 60455520 60455516 60455521 +
aagaacccatctcccagtaaat

SEQ ID NO: 194229 - DNA, 22 bp, Artificial Sequence
  Synthetic oligonucleotide; CTC chr2 60455512 60455533 60455529 60455534 +
ccagtaaatttatttaactttg

SEQ ID NO: 194230 - DNA, 22 bp, Artificial Sequence
  Synthetic oligonucleotide; TTT chr2 60455523 60455544 60455540 60455545 +
atttaactttgggaccatgtaa

SEQ ID NO: 194231 - DNA, 22 bp, Artificial Sequence
  Synthetic oligonucleotide; TTA chr2 60455524 60455545 60455541 60455546 +
tttaactttgggaccatgtaaa

SEQ ID NO: 194232 - DNA, 22 bp, Artificial Sequence
  Synthetic oligonucleotide; TTT chr2 60455527 60455548 60455544 60455549 +
aactttgggaccatgtaaatca

SEQ ID NO: 194233 - DNA, 22 bp, Artificial Sequence
  Synthetic oligonucleotide; TTA chr2 60455528 60455549 60455545 60455550 +
actttgggaccatgtaaatcaa

SEQ ID NO: 194234 - DNA, 22 bp, Artificial Sequence
  Synthetic oligonucleotide; CTT chr2 60455532 60455553 60455549 60455554 +
tgggaccatgtaaatcaaacat

SEQ ID NO: 194235 - DNA, 22 bp, Artificial Sequence
  Synthetic oligonucleotide; TTT chr2 60455533 60455554 60455550 60455555 +
gggaccatgtaaatcaaacata

SEQ ID NO: 194236 - DNA, 22 bp, Artificial Sequence
  Synthetic oligonucleotide; TTG chr2 60455534 60455555 60455551 60455556 +
ggaccatgtaaatcaaacataa

SEQ ID NO: 194237 - DNA, 22 bp, Artificial Sequence
  Synthetic oligonucleotide; CTG chr2 60455560 60455581 60455577 60455582 +
tgatttatcaccagatgtttgc

SEQ ID NO: 194238 - DNA, 22 bp, Artificial Sequence
  Synthetic oligonucleotide; TTT chr2 60455566 60455587 60455583 60455588 +
atcaccagatgtttgcactcct

SEQ ID NO: 194239 - DNA, 22 bp, Artificial Sequence
  Synthetic oligonucleotide; TTA chr2 60455567 60455588 60455584 60455589 +
tcaccagatgtttgcactcctc

SEQ ID NO: 194240 - DNA, 22 bp, Artificial Sequence
  Synthetic oligonucleotide; TTT chr2 60455580 60455601 60455597 60455602 +
gcactcctccccattccccatt

SEQ ID NO: 194241 - DNA, 22 bp, Artificial Sequence
  Synthetic oligonucleotide; TTG chr2 60455581 60455602 60455598 60455603 +
cactcctccccattccccattt

SEQ ID NO: 194242 - DNA, 22 bp, Artificial Sequence
  Synthetic oligonucleotide; CTC chr2 60455586 60455607 60455603 60455608 +
ctccccattccccatttgattt

SEQ ID NO: 194243 - DNA, 22 bp, Artificial Sequence
  Synthetic oligonucleotide; CTC chr2 60455589 60455610 60455606 60455611 +
cccattccccatttgatttaag

SEQ ID NO: 194244 - DNA, 22 bp, Artificial Sequence
  Synthetic oligonucleotide; TTC chr2 60455596 60455617 60455613 60455618 +
cccatttgatttaagaaatttg

SEQ ID NO: 194245 - DNA, 22 bp, Artificial Sequence
  Synthetic oligonucleotide; TTT chr2 60455603 60455624 60455620 60455625 +
gatttaagaaatttgaacagac

SEQ ID NO: 194246 - DNA, 22 bp, Artificial Sequence
  Synthetic oligonucleotide; TTG chr2 60455604 60455625 60455621 60455626 +
atttaagaaatttgaacagaca

SEQ ID NO: 194247 - DNA, 22 bp, Artificial Sequence
  Synthetic oligonucleotide; TTT chr2 60455608 60455629 60455625 60455630 +
aagaaatttgaacagacaagtg

SEQ ID NO: 194248 - DNA, 22 bp, Artificial Sequence
  Synthetic oligonucleotide; TTA chr2 60455609 60455630 60455626 60455631 +
agaaatttgaacagacaagtgt

SEQ ID NO: 194249 - DNA, 22 bp, Artificial Sequence
  Synthetic oligonucleotide; TTT chr2 60455617 60455638 60455634 60455639 +
gaacagacaagtgtacagtatc

SEQ ID NO: 194250 - DNA, 22 bp, Artificial Sequence
  Synthetic oligonucleotide; TTG chr2 60455618 60455639 60455635 60455640 +
aacagacaagtgtacagtatcc

SEQ ID NO: 194251 - DNA, 22 bp, Artificial Sequence
  Synthetic oligonucleotide; TTA chr2 60455647 60455668 60455664 60455669 +
attctgtctgtcaggatgcaaa

SEQ ID NO: 194252 - DNA, 22 bp, Artificial Sequence
  Synthetic oligonucleotide; TTC chr2 60455651 60455672 60455668 60455673 +
tgtctgtcaggatgcaaaacct

SEQ ID NO: 194253 - DNA, 22 bp, Artificial Sequence
  Synthetic oligonucleotide; CTG chr2 60455653 60455674 60455670 60455675 +
tctgtcaggatgcaaaacctaa

SEQ ID NO: 194254 - DNA, 22 bp, Artificial Sequence
  Synthetic oligonucleotide; CTG chr2 60455657 60455678 60455674 60455679 +
tcaggatgcaaaacctaattac

SEQ ID NO: 194255 - DNA, 22 bp, Artificial Sequence
  Synthetic oligonucleotide; CTA chr2 60455674 60455695 60455691 60455696 +
attacgctaagagcagcatata

SEQ ID NO: 194256 - DNA, 22 bp, Artificial Sequence
  Synthetic oligonucleotide; TTA chr2 60455678 60455699 60455695 60455700 +
cgctaagagcagcatatactga

SEQ ID NO: 194257 - DNA, 22 bp, Artificial Sequence
  Synthetic oligonucleotide; CTA chr2 60455683 60455704 60455700 60455705 +
agagcagcatatactgagaaat

SEQ ID NO: 194258 - DNA, 22 bp, Artificial Sequence
  Synthetic oligonucleotide; CTG chr2 60455699 60455720 60455716 60455721 +
agaaattaaaatgaatactgta

SEQ ID NO: 194259 - DNA, 22 bp, Artificial Sequence
  Synthetic oligonucleotide; TTA chr2 60455707 60455728 60455724 60455729 +
aaatgaatactgtatataaaac

SEQ ID NO: 194260 - DNA, 22 bp, Artificial Sequence
  Synthetic oligonucleotide; CTG chr2 60455719 60455740 60455736 60455741 +
tatataaaacctacacagttgc

SEQ ID NO: 194261 - DNA, 22 bp, Artificial Sequence
  Synthetic oligonucleotide; CTA chr2 60455732 60455753 60455749 60455754 +
cacagttgcactcatagctcct

SEQ ID NO: 194262 - DNA, 22 bp, Artificial Sequence
  Synthetic oligonucleotide; TTG chr2 60455740 60455761 60455757 60455762 +
cactcatagctcctaataaaag

SEQ ID NO: 194263 - DNA, 22 bp, Artificial Sequence
  Synthetic oligonucleotide; CTC chr2 60455745 60455766 60455762 60455767 +
atagctcctaataaaagagtaa

SEQ ID NO: 194264 - DNA, 22 bp, Artificial Sequence
  Synthetic oligonucleotide; CTC chr2 60455752 60455773 60455769 60455774 +
ctaataaaagagtaatagggac

SEQ ID NO: 194265 - DNA, 22 bp, Artificial Sequence
  Synthetic oligonucleotide; CTA chr2 60455755 60455776 60455772 60455777 +
ataaaagagtaatagggacaca

SEQ ID NO: 194266 - DNA, 22 bp, Artificial Sequence
  Synthetic oligonucleotide; TTT chr2 60455786 60455807 60455803 60455808 +
tatggacatttaatagggtgga

SEQ ID NO: 194267 - DNA, 22 bp, Artificial Sequence
  Synthetic oligonucleotide; TTT chr2 60455787 60455808 60455804 60455809 +
atggacatttaatagggtggag

SEQ ID NO: 194268 - DNA, 22 bp, Artificial Sequence
  Synthetic oligonucleotide; TTA chr2 60455788 60455809 60455805 60455810 +
tggacatttaatagggtggagt

SEQ ID NO: 194269 - DNA, 22 bp, Artificial Sequence
  Synthetic oligonucleotide; TTT chr2 60455797 60455818 60455814 60455819 +
aatagggtggagtcgaagtcac

SEQ ID NO: 194270 - DNA, 22 bp, Artificial Sequence
  Synthetic oligonucleotide; TTA chr2 60455798 60455819 60455815 60455820 +
atagggtggagtcgaagtcacc

SEQ ID NO: 194271 - DNA, 22 bp, Artificial Sequence
  Synthetic oligonucleotide; CTA chr2 60455827 60455848 60455844 60455849 +
aagctggcatggcactggggaa

SEQ ID NO: 194272 - DNA, 22 bp, Artificial Sequence
  Synthetic oligonucleotide; CTG chr2 60455833 60455854 60455850 60455855 +
gcatggcactggggaattattt

SEQ ID NO: 194273 - DNA, 22 bp, Artificial Sequence
  Synthetic oligonucleotide; CTG chr2 60455844 60455865 60455861 60455866 +
gggaattatttctatctgtctt

SEQ ID NO: 194274 - DNA, 22 bp, Artificial Sequence
  Synthetic oligonucleotide; TTA chr2 60455852 60455873 60455869 60455874 +
tttctatctgtcttgagcagca

SEQ ID NO: 194275 - DNA, 22 bp, Artificial Sequence
  Synthetic oligonucleotide; TTT chr2 60455855 60455876 60455872 60455877 +
ctatctgtcttgagcagcattt

SEQ ID NO: 194276 - DNA, 22 bp, Artificial Sequence
  Synthetic oligonucleotide; TTC chr2 60455856 60455877 60455873 60455878 +
tatctgtcttgagcagcatttt

SEQ ID NO: 194277 - DNA, 22 bp, Artificial Sequence
  Synthetic oligonucleotide; CTA chr2 60455858 60455879 60455875 60455880 +
tctgtcttgagcagcattttgg

SEQ ID NO: 194278 - DNA, 22 bp, Artificial Sequence
  Synthetic oligonucleotide; CTG chr2 60455862 60455883 60455879 60455884 +
tcttgagcagcattttggattc

SEQ ID NO: 194279 - DNA, 22 bp, Artificial Sequence
  Synthetic oligonucleotide; CTT chr2 60455866 60455887 60455883 60455888 +
gagcagcattttggattcagtt

SEQ ID NO: 194280 - DNA, 22 bp, Artificial Sequence
  Synthetic oligonucleotide; TTG chr2 60455867 60455888 60455884 60455889 +
agcagcattttggattcagttt

SEQ ID NO: 194281 - DNA, 22 bp, Artificial Sequence
  Synthetic oligonucleotide; TTT chr2 60455877 60455898 60455894 60455899 +
tggattcagttttggagaaacc

SEQ ID NO: 194282 - DNA, 22 bp, Artificial Sequence
  Synthetic oligonucleotide; TTT chr2 60455878 60455899 60455895 60455900 +
ggattcagttttggagaaacct

SEQ ID NO: 194283 - DNA, 22 bp, Artificial Sequence
  Synthetic oligonucleotide; TTG chr2 60455879 60455900 60455896 60455901 +
gattcagttttggagaaaccta

SEQ ID NO: 194284 - DNA, 22 bp, Artificial Sequence
  Synthetic oligonucleotide; TTC chr2 60455884 60455905 60455901 60455906 +
agttttggagaaacctaatcca

SEQ ID NO: 194285 - DNA, 22 bp, Artificial Sequence
  Synthetic oligonucleotide; TTT chr2 60455889 60455910 60455906 60455911 +
tggagaaacctaatccaaaaca

SEQ ID NO: 194286 - DNA, 22 bp, Artificial Sequence
  Synthetic oligonucleotide; TTT chr2 60455890 60455911 60455907 60455912 +
ggagaaacctaatccaaaacac

SEQ ID NO: 194287 - DNA, 22 bp, Artificial Sequence
  Synthetic oligonucleotide; TTG chr2 60455891 60455912 60455908 60455913 +
gagaaacctaatccaaaacaca

SEQ ID NO: 194288 - DNA, 22 bp, Artificial Sequence
  Synthetic oligonucleotide; CTA chr2 60455901 60455922 60455918 60455923 +
atccaaaacacatacagtatat

SEQ ID NO: 194289 - DNA, 22 bp, Artificial Sequence
  Synthetic oligonucleotide; CTT chr2 60455926 60455947 60455943 60455948 +
ttctaagttcagtgacaaacat

SEQ ID NO: 194290 - DNA, 22 bp, Artificial Sequence
  Synthetic oligonucleotide; TTT chr2 60455927 60455948 60455944 60455949 +
tctaagttcagtgacaaacatc

SEQ ID NO: 194291 - DNA, 22 bp, Artificial Sequence
  Synthetic oligonucleotide; TTT chr2 60455928 60455949 60455945 60455950 +
ctaagttcagtgacaaacatca

SEQ ID NO: 194292 - DNA, 22 bp, Artificial Sequence
  Synthetic oligonucleotide; TTC chr2 60455929 60455950 60455946 60455951 +
taagttcagtgacaaacatcaa

SEQ ID NO: 194293 - DNA, 22 bp, Artificial Sequence
  Synthetic oligonucleotide; CTA chr2 60455931 60455952 60455948 60455953 +
agttcagtgacaaacatcaagt

SEQ ID NO: 194294 - DNA, 22 bp, Artificial Sequence
  Synthetic oligonucleotide; TTC chr2 60455936 60455957 60455953 60455958 +
agtgacaaacatcaagttctca

SEQ ID NO: 194295 - DNA, 22 bp, Artificial Sequence
  Synthetic oligonucleotide; TTC chr2 60455955 60455976 60455972 60455977 +
tcaaggtaccgcacgcccaccc

SEQ ID NO: 194296 - DNA, 22 bp, Artificial Sequence
  Synthetic oligonucleotide; CTC chr2 60455957 60455978 60455974 60455979 +
aaggtaccgcacgcccacccca

SEQ ID NO: 194297 - DNA, 22 bp, Artificial Sequence
  Synthetic oligonucleotide; CTC chr2 60455988 60456009 60456005 60456010 +
ctatgtaatattctccaacatc

SEQ ID NO: 194298 - DNA, 22 bp, Artificial Sequence
  Synthetic oligonucleotide; CTA chr2 60455991 60456012 60456008 60456013 +
tgtaatattctccaacatcctt

SEQ ID NO: 194299 - DNA, 22 bp, Artificial Sequence
  Synthetic oligonucleotide; TTC chr2 60456001 60456022 60456018 60456023 +
tccaacatcctttctcagtgga

SEQ ID NO: 194300 - DNA, 22 bp, Artificial Sequence
  Synthetic oligonucleotide; CTC chr2 60456003 60456024 60456020 60456025 +
caacatcctttctcagtggatt

SEQ ID NO: 194301 - DNA, 22 bp, Artificial Sequence
  Synthetic oligonucleotide; CTT chr2 60456013 60456034 60456030 60456035 +
tctcagtggattcctctagccc

SEQ ID NO: 194302 - DNA, 22 bp, Artificial Sequence
  Synthetic oligonucleotide; TTT chr2 60456014 60456035 60456031 60456036 +
ctcagtggattcctctagcccc

SEQ ID NO: 194303 - DNA, 22 bp, Artificial Sequence
  Synthetic oligonucleotide; TTC chr2 60456015 60456036 60456032 60456037 +
tcagtggattcctctagcccca

SEQ ID NO: 194304 - DNA, 22 bp, Artificial Sequence
  Synthetic oligonucleotide; CTC chr2 60456017 60456038 60456034 60456039 +
agtggattcctctagccccact

SEQ ID NO: 194305 - DNA, 22 bp, Artificial Sequence
  Synthetic oligonucleotide; TTC chr2 60456026 60456047 60456043 60456048 +
ctctagccccactctctccttc

SEQ ID NO: 194306 - DNA, 22 bp, Artificial Sequence
  Synthetic oligonucleotide; CTC chr2 60456029 60456050 60456046 60456051 +
tagccccactctctccttccca

SEQ ID NO: 194307 - DNA, 22 bp, Artificial Sequence
  Synthetic oligonucleotide; CTA chr2 60456031 60456052 60456048 60456053 +
gccccactctctccttcccacc

SEQ ID NO: 194308 - DNA, 22 bp, Artificial Sequence
  Synthetic oligonucleotide; CTC chr2 60456040 60456061 60456057 60456062 +
tctccttcccacccaaactggc

SEQ ID NO: 194309 - DNA, 22 bp, Artificial Sequence
  Synthetic oligonucleotide; CTC chr2 60456042 60456063 60456059 60456064 +
tccttcccacccaaactggctt

SEQ ID NO: 194310 - DNA, 22 bp, Artificial Sequence
  Synthetic oligonucleotide; CTC chr2 60456044 60456065 60456061 60456066 +
cttcccacccaaactggctttt

SEQ ID NO: 194311 - DNA, 22 bp, Artificial Sequence
  Synthetic oligonucleotide; CTT chr2 60456047 60456068 60456064 60456069 +
cccacccaaactggcttttcag

SEQ ID NO: 194312 - DNA, 22 bp, Artificial Sequence
  Synthetic oligonucleotide; TTC chr2 60456048 60456069 60456065 60456070 +
ccacccaaactggcttttcaga

SEQ ID NO: 194313 - DNA, 22 bp, Artificial Sequence
  Synthetic oligonucleotide; CTG chr2 60456060 60456081 60456077 60456082 +
gcttttcagaaaacattgactt

SEQ ID NO: 194314 - DNA, 22 bp, Artificial Sequence
  Synthetic oligonucleotide; CTT chr2 60456064 60456085 60456081 60456086 +
ttcagaaaacattgactttctt

SEQ ID NO: 194315 - DNA, 22 bp, Artificial Sequence
  Synthetic oligonucleotide; TTT chr2 60456065 60456086 60456082 60456087 +
tcagaaaacattgactttcttt

SEQ ID NO: 194316 - DNA, 22 bp, Artificial Sequence
  Synthetic oligonucleotide; TTT chr2 60456066 60456087 60456083 60456088 +
cagaaaacattgactttcttta

SEQ ID NO: 194317 - DNA, 22 bp, Artificial Sequence
  Synthetic oligonucleotide; TTC chr2 60456067 60456088 60456084 60456089 +
agaaaacattgactttctttat

SEQ ID NO: 194318 - DNA, 22 bp, Artificial Sequence
  Synthetic oligonucleotide; TTG chr2 60456078 60456099 60456095 60456100 +
actttctttatactttagaaag

SEQ ID NO: 194319 - DNA, 22 bp, Artificial Sequence
  Synthetic oligonucleotide; CTT chr2 60456082 60456103 60456099 60456104 +
tctttatactttagaaagataa

SEQ ID NO: 194320 - DNA, 22 bp, Artificial Sequence
  Synthetic oligonucleotide; TTT chr2 60456083 60456104 60456100 60456105 +
ctttatactttagaaagataaa

SEQ ID NO: 194321 - DNA, 22 bp, Artificial Sequence
  Synthetic oligonucleotide; TTC chr2 60456084 60456105 60456101 60456106 +
tttatactttagaaagataaaa

SEQ ID NO: 194322 - DNA, 22 bp, Artificial Sequence
  Synthetic oligonucleotide; CTT chr2 60456086 60456107 60456103 60456108 +
tatactttagaaagataaaact

SEQ ID NO: 194323 - DNA, 22 bp, Artificial Sequence
  Synthetic oligonucleotide; TTT chr2 60456087 60456108 60456104 60456109 +
atactttagaaagataaaacta

SEQ ID NO: 194324 - DNA, 22 bp, Artificial Sequence
  Synthetic oligonucleotide; TTA chr2 60456088 60456109 60456105 60456110 +
tactttagaaagataaaactat

SEQ ID NO: 194325 - DNA, 22 bp, Artificial Sequence
  Synthetic oligonucleotide; CTT chr2 60456093 60456114 60456110 60456115 +
tagaaagataaaactattcttg

SEQ ID NO: 194326 - DNA, 22 bp, Artificial Sequence
  Synthetic oligonucleotide; TTT chr2 60456094 60456115 60456111 60456116 +
agaaagataaaactattcttgc

SEQ ID NO: 194327 - DNA, 22 bp, Artificial Sequence
  Synthetic oligonucleotide; TTA chr2 60456095 60456116 60456112 60456117 +
gaaagataaaactattcttgcc

SEQ ID NO: 194328 - DNA, 22 bp, Artificial Sequence
  Synthetic oligonucleotide; CTA chr2 60456109 60456130 60456126 60456131 +
ttcttgcctcagataaaaggca

SEQ ID NO: 194329 - DNA, 22 bp, Artificial Sequence
  Synthetic oligonucleotide; TTC chr2 60456112 60456133 60456129 60456134 +
ttgcctcagataaaaggcatga

SEQ ID NO: 194330 - DNA, 22 bp, Artificial Sequence
  Synthetic oligonucleotide; CTT chr2 60456114 60456135 60456131 60456136 +
gcctcagataaaaggcatgaca

SEQ ID NO: 194331 - DNA, 22 bp, Artificial Sequence
  Synthetic oligonucleotide; TTG chr2 60456115 60456136 60456132 60456137 +
cctcagataaaaggcatgacat

SEQ ID NO: 194332 - DNA, 22 bp, Artificial Sequence
  Synthetic oligonucleotide; CTC chr2 60456119 60456140 60456136 60456141 +
agataaaaggcatgacatgaaa

SEQ ID NO: 194333 - DNA, 22 bp, Artificial Sequence
  Synthetic oligonucleotide; CTC chr2 60456151 60456172 60456168 60456173 +
acaggcactagggcataagaac

SEQ ID NO: 194334 - DNA, 22 bp, Artificial Sequence
  Synthetic oligonucleotide; CTA chr2 60456161 60456182 60456178 60456183 +
gggcataagaactgagcgacaa

SEQ ID NO: 194335 - DNA, 22 bp, Artificial Sequence
  Synthetic oligonucleotide; CTG chr2 60456175 60456196 60456192 60456197 +
agcgacaaaaaatgctaccaca

SEQ ID NO: 194336 - DNA, 22 bp, Artificial Sequence
  Synthetic oligonucleotide; CTA chr2 60456192 60456213 60456209 60456214 +
ccacaagaagacaacagaacgg

SEQ ID NO: 194337 - DNA, 22 bp, Artificial Sequence
  Synthetic oligonucleotide; CTT chr2 60456217 60456238 60456234 60456239 +
ttgttttggttttttacaaaaa

SEQ ID NO: 194338 - DNA, 22 bp, Artificial Sequence
  Synthetic oligonucleotide; TTT chr2 60456218 60456239 60456235 60456240 +
tgttttggttttttacaaaaat

SEQ ID NO: 194339 - DNA, 22 bp, Artificial Sequence
  Synthetic oligonucleotide; TTT chr2 60456219 60456240 60456236 60456241 +
gttttggttttttacaaaaata

SEQ ID NO: 194340 - DNA, 22 bp, Artificial Sequence
  Synthetic oligonucleotide; TTG chr2 60456220 60456241 60456237 60456242 +
ttttggttttttacaaaaataa

SEQ ID NO: 194341 - DNA, 22 bp, Artificial Sequence
  Synthetic oligonucleotide; TTT chr2 60456223 60456244 60456240 60456245 +
tggttttttacaaaaataagaa

SEQ ID NO: 194342 - DNA, 22 bp, Artificial Sequence
  Synthetic oligonucleotide; TTT chr2 60456224 60456245 60456241 60456246 +
ggttttttacaaaaataagaac

SEQ ID NO: 194343 - DNA, 22 bp, Artificial Sequence
  Synthetic oligonucleotide; TTG chr2 60456225 60456246 60456242 60456247 +
gttttttacaaaaataagaaca

SEQ ID NO: 194344 - DNA, 22 bp, Artificial Sequence
  Synthetic oligonucleotide; TTT chr2 60456229 60456250 60456246 60456251 +
tttacaaaaataagaacaatgt

SEQ ID NO: 194345 - DNA, 22 bp, Artificial Sequence
  Synthetic oligonucleotide; TTT chr2 60456230 60456251 60456247 60456252 +
ttacaaaaataagaacaatgtc

SEQ ID NO: 194346 - DNA, 22 bp, Artificial Sequence
  Synthetic oligonucleotide; TTT chr2 60456231 60456252 60456248 60456253 +
tacaaaaataagaacaatgtcg

SEQ ID NO: 194347 - DNA, 22 bp, Artificial Sequence
  Synthetic oligonucleotide; TTT chr2 60456232 60456253 60456249 60456254 +
acaaaaataagaacaatgtcgt

SEQ ID NO: 194348 - DNA, 22 bp, Artificial Sequence
  Synthetic oligonucleotide; TTA chr2 60456233 60456254 60456250 60456255 +
caaaaataagaacaatgtcgta

SEQ ID NO: 194349 - DNA, 22 bp, Artificial Sequence
  Synthetic oligonucleotide; TTC chr2 60456258 60456279 60456275 60456280 +
attcatctacactgggaacagg

SEQ ID NO: 194350 - DNA, 22 bp, Artificial Sequence
  Synthetic oligonucleotide; TTC chr2 60456262 60456283 60456279 60456284 +
atctacactgggaacagggaca

SEQ ID NO: 194351 - DNA, 22 bp, Artificial Sequence
  Synthetic oligonucleotide; CTA chr2 60456267 60456288 60456284 60456289 +
cactgggaacagggacacgata

SEQ ID NO: 194352 - DNA, 22 bp, Artificial Sequence
  Synthetic oligonucleotide; CTG chr2 60456272 60456293 60456289 60456294 +
ggaacagggacacgatatcaca

SEQ ID NO: 194353 - DNA, 22 bp, Artificial Sequence
  Synthetic oligonucleotide; TTT chr2 60456307 60456328 60456324 60456329 +
agtaaagcaaatagatgctgca

SEQ ID NO: 194354 - DNA, 22 bp, Artificial Sequence
  Synthetic oligonucleotide; TTA chr2 60456308 60456329 60456325 60456330 +
gtaaagcaaatagatgctgcaa

SEQ ID NO: 194355 - DNA, 22 bp, Artificial Sequence
  Synthetic oligonucleotide; CTG chr2 60456327 60456348 60456344 60456349 +
caacatgcagtatttgtaaaag

SEQ ID NO: 194356 - DNA, 22 bp, Artificial Sequence
  Synthetic oligonucleotide; TTT chr2 60456342 60456363 60456359 60456364 +
gtaaaagtgacaacacagattt

SEQ ID NO: 194357 - DNA, 22 bp, Artificial Sequence
  Synthetic oligonucleotide; TTG chr2 60456343 60456364 60456360 60456365 +
taaaagtgacaacacagatttc

SEQ ID NO: 194358 - DNA, 22 bp, Artificial Sequence
  Synthetic oligonucleotide; TTT chr2 60456364 60456385 60456381 60456386 +
ctaaggatttttaaaatagacc

SEQ ID NO: 194359 - DNA, 22 bp, Artificial Sequence
  Synthetic oligonucleotide; TTC chr2 60456365 60456386 60456382 60456387 +
taaggatttttaaaatagacct

SEQ ID NO: 194360 - DNA, 22 bp, Artificial Sequence
  Synthetic oligonucleotide; CTA chr2 60456367 60456388 60456384 60456389 +
aggatttttaaaatagacctaa

SEQ ID NO: 194361 - DNA, 22 bp, Artificial Sequence
  Synthetic oligonucleotide; TTT chr2 60456374 60456395 60456391 60456396 +
ttaaaatagacctaactggctg

SEQ ID NO: 194362 - DNA, 22 bp, Artificial Sequence
  Synthetic oligonucleotide; TTT chr2 60456375 60456396 60456392 60456397 +
taaaatagacctaactggctgg

SEQ ID NO: 194363 - DNA, 22 bp, Artificial Sequence
  Synthetic oligonucleotide; TTT chr2 60456376 60456397 60456393 60456398 +
aaaatagacctaactggctggt

SEQ ID NO: 194364 - DNA, 22 bp, Artificial Sequence
  Synthetic oligonucleotide; TTA chr2 60456377 60456398 60456394 60456399 +
aaatagacctaactggctggtc

SEQ ID NO: 194365 - DNA, 22 bp, Artificial Sequence
  Synthetic oligonucleotide; CTA chr2 60456388 60456409 60456405 60456410 +
actggctggtcagaagataatt

SEQ ID NO: 194366 - DNA, 22 bp, Artificial Sequence
  Synthetic oligonucleotide; CTG chr2 60456392 60456413 60456409 60456414 +
gctggtcagaagataattgaag

SEQ ID NO: 194367 - DNA, 22 bp, Artificial Sequence
  Synthetic oligonucleotide; CTG chr2 60456396 60456417 60456413 60456418 +
gtcagaagataattgaagggta

SEQ ID NO: 194368 - DNA, 22 bp, Artificial Sequence
  Synthetic oligonucleotide; TTG chr2 60456411 60456432 60456428 60456433 +
aagggtattcccgcccttattt

SEQ ID NO: 194369 - DNA, 22 bp, Artificial Sequence
  Synthetic oligonucleotide; TTC chr2 60456421 60456442 60456438 60456443 +
ccgcccttatttgctgtcatcc

SEQ ID NO: 194370 - DNA, 22 bp, Artificial Sequence
  Synthetic oligonucleotide; CTT chr2 60456429 60456450 60456446 60456451 +
atttgctgtcatccaggaagac

SEQ ID NO: 194371 - DNA, 22 bp, Artificial Sequence
  Synthetic oligonucleotide; TTA chr2 60456430 60456451 60456447 60456452 +
tttgctgtcatccaggaagacc

SEQ ID NO: 194372 - DNA, 22 bp, Artificial Sequence
  Synthetic oligonucleotide; TTT chr2 60456433 60456454 60456450 60456455 +
gctgtcatccaggaagacccta

SEQ ID NO: 194373 - DNA, 22 bp, Artificial Sequence
  Synthetic oligonucleotide; TTG chr2 60456434 60456455 60456451 60456456 +
ctgtcatccaggaagaccctat

SEQ ID NO: 194374 - DNA, 22 bp, Artificial Sequence
  Synthetic oligonucleotide; CTG chr2 60456437 60456458 60456454 60456459 +
tcatccaggaagaccctatcaa

SEQ ID NO: 194375 - DNA, 22 bp, Artificial Sequence
  Synthetic oligonucleotide; CTA chr2 60456455 60456476 60456472 60456477 +
tcaaaacacctaaagtaatctg

SEQ ID NO: 194376 - DNA, 22 bp, Artificial Sequence
  Synthetic oligonucleotide; CTA chr2 60456467 60456488 60456484 60456489 +
aagtaatctgtagcatctaggg

SEQ ID NO: 194377 - DNA, 22 bp, Artificial Sequence
  Synthetic oligonucleotide; CTG chr2 60456477 60456498 60456494 60456499 +
tagcatctagggttcctgggat

SEQ ID NO: 194378 - DNA, 22 bp, Artificial Sequence
  Synthetic oligonucleotide; CTA chr2 60456486 60456507 60456503 60456508 +
gggttcctgggatctcagaacc

SEQ ID NO: 194379 - DNA, 22 bp, Artificial Sequence
  Synthetic oligonucleotide; TTC chr2 60456492 60456513 60456509 60456514 +
ctgggatctcagaaccacaagg

SEQ ID NO: 194380 - DNA, 22 bp, Artificial Sequence
  Synthetic oligonucleotide; CTG chr2 60456495 60456516 60456512 60456517 +
ggatctcagaaccacaaggcaa

SEQ ID NO: 194381 - DNA, 22 bp, Artificial Sequence
  Synthetic oligonucleotide; CTC chr2 60456502 60456523 60456519 60456524 +
agaaccacaaggcaaaccacta

SEQ ID NO: 194382 - DNA, 22 bp, Artificial Sequence
  Synthetic oligonucleotide; CTA chr2 60456524 60456545 60456541 60456546 +
tgcatctcaggaaatcagtggc

SEQ ID NO: 194383 - DNA, 22 bp, Artificial Sequence
  Synthetic oligonucleotide; CTC chr2 60456532 60456553 60456549 60456554 +
aggaaatcagtggctgattcca

SEQ ID NO: 194384 - DNA, 22 bp, Artificial Sequence
  Synthetic oligonucleotide; CTG chr2 60456548 60456569 60456565 60456570 +
attccaaagatttcactatgtc

SEQ ID NO: 194385 - DNA, 22 bp, Artificial Sequence
  Synthetic oligonucleotide; TTC chr2 60456552 60456573 60456569 60456574 +
caaagatttcactatgtctggc

SEQ ID NO: 194386 - DNA, 22 bp, Artificial Sequence
  Synthetic oligonucleotide; TTT chr2 60456561 60456582 60456578 60456583 +
cactatgtctggctacacccct

SEQ ID NO: 194387 - DNA, 22 bp, Artificial Sequence
  Synthetic oligonucleotide; TTC chr2 60456562 60456583 60456579 60456584 +
actatgtctggctacaccccta

SEQ ID NO: 194388 - DNA, 22 bp, Artificial Sequence
  Synthetic oligonucleotide; CTA chr2 60456566 60456587 60456583 60456588 +
tgtctggctacacccctagtgg

SEQ ID NO: 194389 - DNA, 22 bp, Artificial Sequence
  Synthetic oligonucleotide; CTG chr2 60456572 60456593 60456589 60456594 +
gctacacccctagtggctgctt

SEQ ID NO: 194390 - DNA, 22 bp, Artificial Sequence
  Synthetic oligonucleotide; CTA chr2 60456576 60456597 60456593 60456598 +
cacccctagtggctgctttctt

SEQ ID NO: 194391 - DNA, 22 bp, Artificial Sequence
  Synthetic oligonucleotide; CTA chr2 60456584 60456605 60456601 60456606 +
gtggctgctttcttttctttcg

SEQ ID NO: 194392 - DNA, 22 bp, Artificial Sequence
  Synthetic oligonucleotide; CTG chr2 60456591 60456612 60456608 60456613 +
ctttcttttctttcgtctctct

SEQ ID NO: 194393 - DNA, 22 bp, Artificial Sequence
  Synthetic oligonucleotide; CTT chr2 60456594 60456615 60456611 60456616 +
tcttttctttcgtctctctctt

SEQ ID NO: 194394 - DNA, 22 bp, Artificial Sequence
  Synthetic oligonucleotide; TTT chr2 60456595 60456616 60456612 60456617 +
cttttctttcgtctctctcttt

SEQ ID NO: 194395 - DNA, 22 bp, Artificial Sequence
  Synthetic oligonucleotide; TTC chr2 60456596 60456617 60456613 60456618 +
ttttctttcgtctctctctttt

SEQ ID NO: 194396 - DNA, 22 bp, Artificial Sequence
  Synthetic oligonucleotide; CTT chr2 60456598 60456619 60456615 60456620 +
ttctttcgtctctctctttttt

SEQ ID NO: 194397 - DNA, 22 bp, Artificial Sequence
  Synthetic oligonucleotide; TTT chr2 60456599 60456620 60456616 60456621 +
tctttcgtctctctcttttttt

SEQ ID NO: 194398 - DNA, 22 bp, Artificial Sequence
  Synthetic oligonucleotide; TTT chr2 60456600 60456621 60456617 60456622 +
ctttcgtctctctctttttttc

SEQ ID NO: 194399 - DNA, 22 bp, Artificial Sequence
  Synthetic oligonucleotide; TTC chr2 60456601 60456622 60456618 60456623 +
tttcgtctctctctttttttct

SEQ ID NO: 194400 - DNA, 22 bp, Artificial Sequence
  Synthetic oligonucleotide; CTT chr2 60456603 60456624 60456620 60456625 +
tcgtctctctctttttttctcc

SEQ ID NO: 194401 - DNA, 22 bp, Artificial Sequence
  Synthetic oligonucleotide; TTT chr2 60456604 60456625 60456621 60456626 +
cgtctctctctttttttctccc

SEQ ID NO: 194402 - DNA, 22 bp, Artificial Sequence
  Synthetic oligonucleotide; TTC chr2 60456605 60456626 60456622 60456627 +
gtctctctctttttttctccct

SEQ ID NO: 194403 - DNA, 22 bp, Artificial Sequence
  Synthetic oligonucleotide; CTC chr2 60456610 60456631 60456627 60456632 +
tctctttttttctccctctttt

SEQ ID NO: 194404 - DNA, 22 bp, Artificial Sequence
  Synthetic oligonucleotide; CTC chr2 60456612 60456633 60456629 60456634 +
tctttttttctccctctttttt

SEQ ID NO: 194405 - DNA, 22 bp, Artificial Sequence
  Synthetic oligonucleotide; CTC chr2 60456614 60456635 60456631 60456636 +
tttttttctccctcttttttaa

SEQ ID NO: 194406 - DNA, 22 bp, Artificial Sequence
  Synthetic oligonucleotide; CTT chr2 60456616 60456637 60456633 60456638 +
tttttctccctcttttttaaac

SEQ ID NO: 194407 - DNA, 22 bp, Artificial Sequence
  Synthetic oligonucleotide; TTT chr2 60456617 60456638 60456634 60456639 +
ttttctccctcttttttaaaca

SEQ ID NO: 194408 - DNA, 22 bp, Artificial Sequence
  Synthetic oligonucleotide; TTT chr2 60456618 60456639 60456635 60456640 +
tttctccctcttttttaaacaa

SEQ ID NO: 194409 - DNA, 22 bp, Artificial Sequence
  Synthetic oligonucleotide; TTT chr2 60456619 60456640 60456636 60456641 +
ttctccctcttttttaaacaaa

SEQ ID NO: 194410 - DNA, 22 bp, Artificial Sequence
  Synthetic oligonucleotide; TTT chr2 60456620 60456641 60456637 60456642 +
tctccctcttttttaaacaaaa

SEQ ID NO: 194411 - DNA, 22 bp, Artificial Sequence
  Synthetic oligonucleotide; TTT chr2 60456621 60456642 60456638 60456643 +
ctccctcttttttaaacaaaac

SEQ ID NO: 194412 - DNA, 22 bp, Artificial Sequence
  Synthetic oligonucleotide; TTC chr2 60456622 60456643 60456639 60456644 +
tccctcttttttaaacaaaaca

SEQ ID NO: 194413 - DNA, 22 bp, Artificial Sequence
  Synthetic oligonucleotide; CTC chr2 60456624 60456645 60456641 60456646 +
cctcttttttaaacaaaacaaa

SEQ ID NO: 194414 - DNA, 22 bp, Artificial Sequence
  Synthetic oligonucleotide; CTC chr2 60456628 60456649 60456645 60456650 +
ttttttaaacaaaacaaaacaa

SEQ ID NO: 194415 - DNA, 22 bp, Artificial Sequence
  Synthetic oligonucleotide; CTT chr2 60456630 60456651 60456647 60456652 +
ttttaaacaaaacaaaacaaaa

SEQ ID NO: 194416 - DNA, 22 bp, Artificial Sequence
  Synthetic oligonucleotide; TTT chr2 60456631 60456652 60456648 60456653 +
tttaaacaaaacaaaacaaaac

SEQ ID NO: 194417 - DNA, 22 bp, Artificial Sequence
  Synthetic oligonucleotide; TTT chr2 60456632 60456653 60456649 60456654 +
ttaaacaaaacaaaacaaaaca

SEQ ID NO: 194418 - DNA, 22 bp, Artificial Sequence
  Synthetic oligonucleotide; TTT chr2 60456633 60456654 60456650 60456655 +
taaacaaaacaaaacaaaacaa

SEQ ID NO: 194419 - DNA, 22 bp, Artificial Sequence
  Synthetic oligonucleotide; TTT chr2 60456634 60456655 60456651 60456656 +
aaacaaaacaaaacaaaacaaa

SEQ ID NO: 194420 - DNA, 22 bp, Artificial Sequence
  Synthetic oligonucleotide; TTA chr2 60456635 60456656 60456652 60456657 +
aacaaaacaaaacaaaacaaaa

SEQ ID NO: 194421 - DNA, 22 bp, Artificial Sequence
  Synthetic oligonucleotide; CTG chr2 60456666 60456687 60456683 60456688 +
atgcctttgtttccagattttt

SEQ ID NO: 194422 - DNA, 22 bp, Artificial Sequence
  Synthetic oligonucleotide; CTT chr2 60456673 60456694 60456690 60456695 +
tgtttccagatttttagatttc

SEQ ID NO: 194423 - DNA, 22 bp, Artificial Sequence
  Synthetic oligonucleotide; TTT chr2 60456674 60456695 60456691 60456696 +
gtttccagatttttagatttca

SEQ ID NO: 194424 - DNA, 22 bp, Artificial Sequence
  Synthetic oligonucleotide; TTG chr2 60456675 60456696 60456692 60456697 +
tttccagatttttagatttcaa

SEQ ID NO: 194425 - DNA, 22 bp, Artificial Sequence
  Synthetic oligonucleotide; TTT chr2 60456678 60456699 60456695 60456700 +
ccagatttttagatttcaaaag

SEQ ID NO: 194426 - DNA, 22 bp, Artificial Sequence
  Synthetic oligonucleotide; TTC chr2 60456679 60456700 60456696 60456701 +
cagatttttagatttcaaaagt

SEQ ID NO: 194427 - DNA, 22 bp, Artificial Sequence
  Synthetic oligonucleotide; TTT chr2 60456686 60456707 60456703 60456708 +
ttagatttcaaaagtggggtta

SEQ ID NO: 194428 - DNA, 22 bp, Artificial Sequence
  Synthetic oligonucleotide; TTT chr2 60456687 60456708 60456704 60456709 +
tagatttcaaaagtggggttat

SEQ ID NO: 194429 - DNA, 22 bp, Artificial Sequence
  Synthetic oligonucleotide; TTT chr2 60456688 60456709 60456705 60456710 +
agatttcaaaagtggggttatt

SEQ ID NO: 194430 - DNA, 22 bp, Artificial Sequence
  Synthetic oligonucleotide; TTA chr2 60456689 60456710 60456706 60456711 +
gatttcaaaagtggggttattt

SEQ ID NO: 194431 - DNA, 22 bp, Artificial Sequence
  Synthetic oligonucleotide; TTT chr2 60456694 60456715 60456711 60456716 +
caaaagtggggttattttgtta

SEQ ID NO: 194432 - DNA, 22 bp, Artificial Sequence
  Synthetic oligonucleotide; TTC chr2 60456695 60456716 60456712 60456717 +
aaaagtggggttattttgttat

SEQ ID NO: 194433 - DNA, 22 bp, Artificial Sequence
  Synthetic oligonucleotide; TTA chr2 60456708 60456729 60456725 60456730 +
ttttgttatgagaaaagactct

SEQ ID NO: 194434 - DNA, 22 bp, Artificial Sequence
  Synthetic oligonucleotide; TTT chr2 60456711 60456732 60456728 60456733 +
tgttatgagaaaagactcttac

SEQ ID NO: 194435 - DNA, 22 bp, Artificial Sequence
  Synthetic oligonucleotide; TTT chr2 60456712 60456733 60456729 60456734 +
gttatgagaaaagactcttaca

SEQ ID NO: 194436 - DNA, 22 bp, Artificial Sequence
  Synthetic oligonucleotide; TTG chr2 60456713 60456734 60456730 60456735 +
ttatgagaaaagactcttacat

SEQ ID NO: 194437 - DNA, 22 bp, Artificial Sequence
  Synthetic oligonucleotide; TTA chr2 60456716 60456737 60456733 60456738 +
tgagaaaagactcttacatgga

SEQ ID NO: 194438 - DNA, 22 bp, Artificial Sequence
  Synthetic oligonucleotide; CTC chr2 60456729 60456750 60456746 60456751 +
ttacatggaaaccaaagagctg

SEQ ID NO: 194439 - DNA, 22 bp, Artificial Sequence
  Synthetic oligonucleotide; CTT chr2 60456731 60456752 60456748 60456753 +
acatggaaaccaaagagctgat

SEQ ID NO: 194440 - DNA, 22 bp, Artificial Sequence
  Synthetic oligonucleotide; TTA chr2 60456732 60456753 60456749 60456754 +
catggaaaccaaagagctgatt

SEQ ID NO: 194441 - DNA, 22 bp, Artificial Sequence
  Synthetic oligonucleotide; CTG chr2 60456751 60456772 60456768 60456773 +
attttttttaaaaaaatctttt

SEQ ID NO: 194442 - DNA, 22 bp, Artificial Sequence
  Synthetic oligonucleotide; TTT chr2 60456755 60456776 60456772 60456777 +
tttttaaaaaaatcttttttac

SEQ ID NO: 194443 - DNA, 22 bp, Artificial Sequence
  Synthetic oligonucleotide; TTT chr2 60456756 60456777 60456773 60456778 +
ttttaaaaaaatcttttttaca

SEQ ID NO: 194444 - DNA, 22 bp, Artificial Sequence
  Synthetic oligonucleotide; TTT chr2 60456757 60456778 60456774 60456779 +
tttaaaaaaatcttttttacat

SEQ ID NO: 194445 - DNA, 22 bp, Artificial Sequence
  Synthetic oligonucleotide; TTT chr2 60456758 60456779 60456775 60456780 +
ttaaaaaaatcttttttacatt

SEQ ID NO: 194446 - DNA, 22 bp, Artificial Sequence
  Synthetic oligonucleotide; TTT chr2 60456759 60456780 60456776 60456781 +
taaaaaaatcttttttacatta

SEQ ID NO: 194447 - DNA, 22 bp, Artificial Sequence
  Synthetic oligonucleotide; TTT chr2 60456760 60456781 60456777 60456782 +
aaaaaaatcttttttacattat

SEQ ID NO: 194448 - DNA, 22 bp, Artificial Sequence
  Synthetic oligonucleotide; TTA chr2 60456761 60456782 60456778 60456783 +
aaaaaatcttttttacattatg

SEQ ID NO: 194449 - DNA, 22 bp, Artificial Sequence
  Synthetic oligonucleotide; CTT chr2 60456771 60456792 60456788 60456793 +
ttttacattatgttctaagata

SEQ ID NO: 194450 - DNA, 22 bp, Artificial Sequence
  Synthetic oligonucleotide; TTT chr2 60456772 60456793 60456789 60456794 +
tttacattatgttctaagataa

SEQ ID NO: 194451 - DNA, 22 bp, Artificial Sequence
  Synthetic oligonucleotide; TTT chr2 60456773 60456794 60456790 60456795 +
ttacattatgttctaagataaa

SEQ ID NO: 194452 - DNA, 22 bp, Artificial Sequence
  Synthetic oligonucleotide; TTT chr2 60456774 60456795 60456791 60456796 +
tacattatgttctaagataaag

SEQ ID NO: 194453 - DNA, 22 bp, Artificial Sequence
  Synthetic oligonucleotide; TTT chr2 60456775 60456796 60456792 60456797 +
acattatgttctaagataaagc

SEQ ID NO: 194454 - DNA, 22 bp, Artificial Sequence
  Synthetic oligonucleotide; TTA chr2 60456776 60456797 60456793 60456798 +
cattatgttctaagataaagca

SEQ ID NO: 194455 - DNA, 22 bp, Artificial Sequence
  Synthetic oligonucleotide; TTA chr2 60456781 60456802 60456798 60456803 +
tgttctaagataaagcaaggat

SEQ ID NO: 194456 - DNA, 22 bp, Artificial Sequence
  Synthetic oligonucleotide; TTC chr2 60456786 60456807 60456803 60456808 +
taagataaagcaaggatgggag

SEQ ID NO: 194457 - DNA, 22 bp, Artificial Sequence
  Synthetic oligonucleotide; CTA chr2 60456788 60456809 60456805 60456810 +
agataaagcaaggatgggagaa

SEQ ID NO: 194458 - DNA, 22 bp, Artificial Sequence
  Synthetic oligonucleotide; CTT chr2 60456823 60456844 60456840 60456845 +
ttagacaacaagaacagcaaaa

SEQ ID NO: 194459 - DNA, 22 bp, Artificial Sequence
  Synthetic oligonucleotide; TTT chr2 60456824 60456845 60456841 60456846 +
tagacaacaagaacagcaaaaa

SEQ ID NO: 194460 - DNA, 22 bp, Artificial Sequence
  Synthetic oligonucleotide; TTT chr2 60456825 60456846 60456842 60456847 +
agacaacaagaacagcaaaaaa

SEQ ID NO: 194461 - DNA, 22 bp, Artificial Sequence
  Synthetic oligonucleotide; TTA chr2 60456826 60456847 60456843 60456848 +
gacaacaagaacagcaaaaaat

SEQ ID NO: 194462 - DNA, 22 bp, Artificial Sequence
  Synthetic oligonucleotide; TTT chr2 60456850 60456871 60456867 60456872 +
aaaggaaataaaagtttaagat

SEQ ID NO: 194463 - DNA, 22 bp, Artificial Sequence
  Synthetic oligonucleotide; TTA chr2 60456851 60456872 60456868 60456873 +
aaggaaataaaagtttaagatg

SEQ ID NO: 194464 - DNA, 22 bp, Artificial Sequence
  Synthetic oligonucleotide; TTT chr2 60456867 60456888 60456884 60456889 +
aagatgctattaccagcaagtt

SEQ ID NO: 194465 - DNA, 22 bp, Artificial Sequence
  Synthetic oligonucleotide; TTA chr2 60456868 60456889 60456885 60456890 +
agatgctattaccagcaagttt

SEQ ID NO: 194466 - DNA, 22 bp, Artificial Sequence
  Synthetic oligonucleotide; CTA chr2 60456876 60456897 60456893 60456898 +
ttaccagcaagttttttcactt

SEQ ID NO: 194467 - DNA, 22 bp, Artificial Sequence
  Synthetic oligonucleotide; TTA chr2 60456879 60456900 60456896 60456901 +
ccagcaagttttttcacttatg

SEQ ID NO: 194468 - DNA, 22 bp, Artificial Sequence
  Synthetic oligonucleotide; TTT chr2 60456890 60456911 60456907 60456912 +
tttcacttatgtttgaatggat

SEQ ID NO: 194469 - DNA, 22 bp, Artificial Sequence
  Synthetic oligonucleotide; TTT chr2 60456891 60456912 60456908 60456913 +
ttcacttatgtttgaatggatt

SEQ ID NO: 194470 - DNA, 22 bp, Artificial Sequence
  Synthetic oligonucleotide; TTT chr2 60456892 60456913 60456909 60456914 +
tcacttatgtttgaatggattt

SEQ ID NO: 194471 - DNA, 22 bp, Artificial Sequence
  Synthetic oligonucleotide; TTT chr2 60456893 60456914 60456910 60456915 +
cacttatgtttgaatggatttc

SEQ ID NO: 194472 - DNA, 22 bp, Artificial Sequence
  Synthetic oligonucleotide; TTC chr2 60456894 60456915 60456911 60456916 +
acttatgtttgaatggatttct

SEQ ID NO: 194473 - DNA, 22 bp, Artificial Sequence
  Synthetic oligonucleotide; CTT chr2 60456898 60456919 60456915 60456920 +
atgtttgaatggatttctgcta

SEQ ID NO: 194474 - DNA, 22 bp, Artificial Sequence
  Synthetic oligonucleotide; TTA chr2 60456899 60456920 60456916 60456921 +
tgtttgaatggatttctgctaa

SEQ ID NO: 194475 - DNA, 22 bp, Artificial Sequence
  Synthetic oligonucleotide; TTT chr2 60456904 60456925 60456921 60456926 +
gaatggatttctgctaagagat

SEQ ID NO: 194476 - DNA, 22 bp, Artificial Sequence
  Synthetic oligonucleotide; TTG chr2 60456905 60456926 60456922 60456927 +
aatggatttctgctaagagatg

SEQ ID NO: 194477 - DNA, 22 bp, Artificial Sequence
  Synthetic oligonucleotide; TTT chr2 60456914 60456935 60456931 60456936 +
ctgctaagagatggagtaagtt

SEQ ID NO: 194478 - DNA, 22 bp, Artificial Sequence
  Synthetic oligonucleotide; TTC chr2 60456915 60456936 60456932 60456937 +
tgctaagagatggagtaagttt

SEQ ID NO: 194479 - DNA, 22 bp, Artificial Sequence
  Synthetic oligonucleotide; CTG chr2 60456917 60456938 60456934 60456939 +
ctaagagatggagtaagttttt

SEQ ID NO: 194480 - DNA, 22 bp, Artificial Sequence
  Synthetic oligonucleotide; CTA chr2 60456920 60456941 60456937 60456942 +
agagatggagtaagtttttaac

SEQ ID NO: 194481 - DNA, 22 bp, Artificial Sequence
  Synthetic oligonucleotide; TTT chr2 60456937 60456958 60456954 60456959 +
ttaacatcagactgaaaacacc

SEQ ID NO: 194482 - DNA, 22 bp, Artificial Sequence
  Synthetic oligonucleotide; TTT chr2 60456938 60456959 60456955 60456960 +
taacatcagactgaaaacacct

SEQ ID NO: 194483 - DNA, 22 bp, Artificial Sequence
  Synthetic oligonucleotide; TTT chr2 60456939 60456960 60456956 60456961 +
aacatcagactgaaaacacctt

SEQ ID NO: 194484 - DNA, 22 bp, Artificial Sequence
  Synthetic oligonucleotide; TTA chr2 60456940 60456961 60456957 60456962 +
acatcagactgaaaacaccttc

SEQ ID NO: 194485 - DNA, 22 bp, Artificial Sequence
  Synthetic oligonucleotide; CTG chr2 60456951 60456972 60456968 60456973 +
aaaacaccttccatttcttgaa

SEQ ID NO: 194486 - DNA, 22 bp, Artificial Sequence
  Synthetic oligonucleotide; CTT chr2 60456961 60456982 60456978 60456983 +
ccatttcttgaaaactattcta

SEQ ID NO: 194487 - DNA, 22 bp, Artificial Sequence
  Synthetic oligonucleotide; TTC chr2 60456962 60456983 60456979 60456984 +
catttcttgaaaactattctaa

SEQ ID NO: 194488 - DNA, 22 bp, Artificial Sequence
  Synthetic oligonucleotide; TTT chr2 60456967 60456988 60456984 60456989 +
cttgaaaactattctaaactgg

SEQ ID NO: 194489 - DNA, 22 bp, Artificial Sequence
  Synthetic oligonucleotide; TTC chr2 60456968 60456989 60456985 60456990 +
ttgaaaactattctaaactgga

SEQ ID NO: 194490 - DNA, 22 bp, Artificial Sequence
  Synthetic oligonucleotide; CTT chr2 60456970 60456991 60456987 60456992 +
gaaaactattctaaactggaaa

SEQ ID NO: 194491 - DNA, 22 bp, Artificial Sequence
  Synthetic oligonucleotide; TTG chr2 60456971 60456992 60456988 60456993 +
aaaactattctaaactggaaag

SEQ ID NO: 194492 - DNA, 22 bp, Artificial Sequence
  Synthetic oligonucleotide; CTA chr2 60456978 60456999 60456995 60457000 +
ttctaaactggaaagccttaaa

SEQ ID NO: 194493 - DNA, 22 bp, Artificial Sequence
  Synthetic oligonucleotide; TTC chr2 60456981 60457002 60456998 60457003 +
taaactggaaagccttaaaact

SEQ ID NO: 194494 - DNA, 22 bp, Artificial Sequence
  Synthetic oligonucleotide; CTA chr2 60456983 60457004 60457000 60457005 +
aactggaaagccttaaaactat

SEQ ID NO: 194495 - DNA, 22 bp, Artificial Sequence
  Synthetic oligonucleotide; CTG chr2 60456988 60457009 60457005 60457010 +
gaaagccttaaaactatgtcca

SEQ ID NO: 194496 - DNA, 22 bp, Artificial Sequence
  Synthetic oligonucleotide; CTT chr2 60456997 60457018 60457014 60457019 +
aaaactatgtccagggtttgag

SEQ ID NO: 194497 - DNA, 22 bp, Artificial Sequence
  Synthetic oligonucleotide; TTA chr2 60456998 60457019 60457015 60457020 +
aaactatgtccagggtttgaga

SEQ ID NO: 194498 - DNA, 22 bp, Artificial Sequence
  Synthetic oligonucleotide; CTA chr2 60457004 60457025 60457021 60457026 +
tgtccagggtttgagatatgtc

SEQ ID NO: 194499 - DNA, 22 bp, Artificial Sequence
  Synthetic oligonucleotide; TTT chr2 60457016 60457037 60457033 60457038 +
gagatatgtctattttaatata

SEQ ID NO: 194500 - DNA, 22 bp, Artificial Sequence
  Synthetic oligonucleotide; TTG chr2 60457017 60457038 60457034 60457039 +
agatatgtctattttaatatag

SEQ ID NO: 194501 - DNA, 22 bp, Artificial Sequence
  Synthetic oligonucleotide; CTA chr2 60457028 60457049 60457045 60457050 +
ttttaatatagtaagtacttta

SEQ ID NO: 194502 - DNA, 22 bp, Artificial Sequence
  Synthetic oligonucleotide; TTT chr2 60457031 60457052 60457048 60457053 +
taatatagtaagtactttatgt

SEQ ID NO: 194503 - DNA, 22 bp, Artificial Sequence
  Synthetic oligonucleotide; TTT chr2 60457032 60457053 60457049 60457054 +
aatatagtaagtactttatgtt

SEQ ID NO: 194504 - DNA, 22 bp, Artificial Sequence
  Synthetic oligonucleotide; TTA chr2 60457033 60457054 60457050 60457055 +
atatagtaagtactttatgttc

SEQ ID NO: 194505 - DNA, 22 bp, Artificial Sequence
  Synthetic oligonucleotide; CTT chr2 60457048 60457069 60457065 60457070 +
tatgttcctttagggtataata

SEQ ID NO: 194506 - DNA, 22 bp, Artificial Sequence
  Synthetic oligonucleotide; TTT chr2 60457049 60457070 60457066 60457071 +
atgttcctttagggtataatac

SEQ ID NO: 194507 - DNA, 22 bp, Artificial Sequence
  Synthetic oligonucleotide; TTA chr2 60457050 60457071 60457067 60457072 +
tgttcctttagggtataataca

SEQ ID NO: 194508 - DNA, 22 bp, Artificial Sequence
  Synthetic oligonucleotide; TTC chr2 60457055 60457076 60457072 60457077 +
ctttagggtataatacacgcat

SEQ ID NO: 194509 - DNA, 22 bp, Artificial Sequence
  Synthetic oligonucleotide; CTT chr2 60457058 60457079 60457075 60457080 +
tagggtataatacacgcatcag

SEQ ID NO: 194510 - DNA, 22 bp, Artificial Sequence
  Synthetic oligonucleotide; TTT chr2 60457059 60457080 60457076 60457081 +
agggtataatacacgcatcaga

SEQ ID NO: 194511 - DNA, 22 bp, Artificial Sequence
  Synthetic oligonucleotide; TTA chr2 60457060 60457081 60457077 60457082 +
gggtataatacacgcatcagaa

SEQ ID NO: 194512 - DNA, 22 bp, Artificial Sequence
  Synthetic oligonucleotide; CTG chr2 60457102 60457123 60457119 60457124 +
aaaaagactgactggccttctc

SEQ ID NO: 194513 - DNA, 22 bp, Artificial Sequence
  Synthetic oligonucleotide; CTG chr2 60457112 60457133 60457129 60457134 +
actggccttctcttaaaacctg

SEQ ID NO: 194514 - DNA, 22 bp, Artificial Sequence
  Synthetic oligonucleotide; CTG chr2 60457116 60457137 60457133 60457138 +
gccttctcttaaaacctgttat

SEQ ID NO: 194515 - DNA, 22 bp, Artificial Sequence
  Synthetic oligonucleotide; CTT chr2 60457121 60457142 60457138 60457143 +
ctcttaaaacctgttattttct

SEQ ID NO: 194516 - DNA, 22 bp, Artificial Sequence
  Synthetic oligonucleotide; TTC chr2 60457122 60457143 60457139 60457144 +
tcttaaaacctgttattttctt

SEQ ID NO: 194517 - DNA, 22 bp, Artificial Sequence
  Synthetic oligonucleotide; CTC chr2 60457124 60457145 60457141 60457146 +
ttaaaacctgttattttcttgc

SEQ ID NO: 194518 - DNA, 22 bp, Artificial Sequence
  Synthetic oligonucleotide; CTT chr2 60457126 60457147 60457143 60457148 +
aaaacctgttattttcttgcaa

SEQ ID NO: 194519 - DNA, 22 bp, Artificial Sequence
  Synthetic oligonucleotide; TTA chr2 60457127 60457148 60457144 60457149 +
aaacctgttattttcttgcaag

SEQ ID NO: 194520 - DNA, 22 bp, Artificial Sequence
  Synthetic oligonucleotide; CTG chr2 60457134 60457155 60457151 60457156 +
ttattttcttgcaagtaattta

SEQ ID NO: 194521 - DNA, 22 bp, Artificial Sequence
  Synthetic oligonucleotide; TTA chr2 60457137 60457158 60457154 60457159 +
ttttcttgcaagtaatttacag

SEQ ID NO: 194522 - DNA, 22 bp, Artificial Sequence
  Synthetic oligonucleotide; TTT chr2 60457140 60457161 60457157 60457162 +
tcttgcaagtaatttacagagt

SEQ ID NO: 194523 - DNA, 22 bp, Artificial Sequence
  Synthetic oligonucleotide; TTT chr2 60457141 60457162 60457158 60457163 +
cttgcaagtaatttacagagtg

SEQ ID NO: 194524 - DNA, 22 bp, Artificial Sequence
  Synthetic oligonucleotide; TTC chr2 60457142 60457163 60457159 60457164 +
ttgcaagtaatttacagagtgt

SEQ ID NO: 194525 - DNA, 22 bp, Artificial Sequence
  Synthetic oligonucleotide; CTT chr2 60457144 60457165 60457161 60457166 +
gcaagtaatttacagagtgtgt

SEQ ID NO: 194526 - DNA, 22 bp, Artificial Sequence
  Synthetic oligonucleotide; TTG chr2 60457145 60457166 60457162 60457167 +
caagtaatttacagagtgtgtc

SEQ ID NO: 194527 - DNA, 22 bp, Artificial Sequence
  Synthetic oligonucleotide; TTT chr2 60457155 60457176 60457172 60457177 +
acagagtgtgtcaaatgaggac

SEQ ID NO: 194528 - DNA, 22 bp, Artificial Sequence
  Synthetic oligonucleotide; TTA chr2 60457156 60457177 60457173 60457178 +
cagagtgtgtcaaatgaggaca

SEQ ID NO: 194529 - DNA, 22 bp, Artificial Sequence
  Synthetic oligonucleotide; CTT chr2 60457188 60457209 60457205 60457210 +
acaatgtgtactttaatttttt

SEQ ID NO: 194530 - DNA, 22 bp, Artificial Sequence
  Synthetic oligonucleotide; TTA chr2 60457189 60457210 60457206 60457211 +
caatgtgtactttaattttttt

SEQ ID NO: 194531 - DNA, 22 bp, Artificial Sequence
  Synthetic oligonucleotide; CTT chr2 60457201 60457222 60457218 60457223 +
taattttttttattttttcaat

SEQ ID NO: 194532 - DNA, 22 bp, Artificial Sequence
  Synthetic oligonucleotide; TTT chr2 60457202 60457223 60457219 60457224 +
aattttttttattttttcaata

SEQ ID NO: 194533 - DNA, 22 bp, Artificial Sequence
  Synthetic oligonucleotide; TTA chr2 60457203 60457224 60457220 60457225 +
attttttttattttttcaataa

SEQ ID NO: 194534 - DNA, 22 bp, Artificial Sequence
  Synthetic oligonucleotide; TTT chr2 60457207 60457228 60457224 60457229 +
tttttattttttcaataaaggg

SEQ ID NO: 194535 - DNA, 22 bp, Artificial Sequence
  Synthetic oligonucleotide; TTT chr2 60457208 60457229 60457225 60457230 +
ttttattttttcaataaaggga

SEQ ID NO: 194536 - DNA, 22 bp, Artificial Sequence
  Synthetic oligonucleotide; TTT chr2 60457209 60457230 60457226 60457231 +
tttattttttcaataaagggac

SEQ ID NO: 194537 - DNA, 22 bp, Artificial Sequence
  Synthetic oligonucleotide; TTT chr2 60457210 60457231 60457227 60457232 +
ttattttttcaataaagggaca

SEQ ID NO: 194538 - DNA, 22 bp, Artificial Sequence
  Synthetic oligonucleotide; TTT chr2 60457211 60457232 60457228 60457233 +
tattttttcaataaagggacaa

SEQ ID NO: 194539 - DNA, 22 bp, Artificial Sequence
  Synthetic oligonucleotide; TTT chr2 60457212 60457233 60457229 60457234 +
attttttcaataaagggacaaa

SEQ ID NO: 194540 - DNA, 22 bp, Artificial Sequence
  Synthetic oligonucleotide; TTA chr2 60457213 60457234 60457230 60457235 +
ttttttcaataaagggacaaaa

SEQ ID NO: 194541 - DNA, 22 bp, Artificial Sequence
  Synthetic oligonucleotide; TTT chr2 60457216 60457237 60457233 60457238 +
tttcaataaagggacaaaatgg

SEQ ID NO: 194542 - DNA, 22 bp, Artificial Sequence
  Synthetic oligonucleotide; TTT chr2 60457217 60457238 60457234 60457239 +
ttcaataaagggacaaaatggg

SEQ ID NO: 194543 - DNA, 22 bp, Artificial Sequence
  Synthetic oligonucleotide; TTT chr2 60457218 60457239 60457235 60457240 +
tcaataaagggacaaaatgggt

SEQ ID NO: 194544 - DNA, 22 bp, Artificial Sequence
  Synthetic oligonucleotide; TTT chr2 60457219 60457240 60457236 60457241 +
caataaagggacaaaatgggtg

SEQ ID NO: 194545 - DNA, 22 bp, Artificial Sequence
  Synthetic oligonucleotide; TTC chr2 60457220 60457241 60457237 60457242 +
aataaagggacaaaatgggtgt

SEQ ID NO: 194546 - DNA, 22 bp, Artificial Sequence
  Synthetic oligonucleotide; TTA chr2 60457254 60457275 60457271 60457276 +
atgcagacaactgccaaaaaaa

SEQ ID NO: 194547 - DNA, 22 bp, Artificial Sequence
  Synthetic oligonucleotide; CTG chr2 60457267 60457288 60457284 60457289 +
ccaaaaaaacacagacagtggt

SEQ ID NO: 194548 - DNA, 22 bp, Artificial Sequence
  Synthetic oligonucleotide; TTT chr2 60457291 60457312 60457308 60457313 +
ttccaatagaacttaacaaaga

SEQ ID NO: 194549 - DNA, 22 bp, Artificial Sequence
  Synthetic oligonucleotide; TTT chr2 60457292 60457313 60457309 60457314 +
tccaatagaacttaacaaagac

SEQ ID NO: 194550 - DNA, 22 bp, Artificial Sequence
  Synthetic oligonucleotide; TTT chr2 60457293 60457314 60457310 60457315 +
ccaatagaacttaacaaagacc

SEQ ID NO: 194551 - DNA, 22 bp, Artificial Sequence
  Synthetic oligonucleotide; TTC chr2 60457294 60457315 60457311 60457316 +
caatagaacttaacaaagacca

SEQ ID NO: 194552 - DNA, 22 bp, Artificial Sequence
  Synthetic oligonucleotide; CTT chr2 60457305 60457326 60457322 60457327 +
aacaaagaccagaaacaaatac

SEQ ID NO: 194553 - DNA, 22 bp, Artificial Sequence
  Synthetic oligonucleotide; TTA chr2 60457306 60457327 60457323 60457328 +
acaaagaccagaaacaaataca

SEQ ID NO: 194554 - DNA, 22 bp, Artificial Sequence
  Synthetic oligonucleotide; TTG chr2 60457344 60457365 60457361 60457366 +
taatgacctttggtcatctaaa

SEQ ID NO: 194555 - DNA, 22 bp, Artificial Sequence
  Synthetic oligonucleotide; CTT chr2 60457354 60457375 60457371 60457376 +
tggtcatctaaataaaaaaaaa

SEQ ID NO: 194556 - DNA, 22 bp, Artificial Sequence
  Synthetic oligonucleotide; TTT chr2 60457355 60457376 60457372 60457377 +
ggtcatctaaataaaaaaaaaa

SEQ ID NO: 194557 - DNA, 22 bp, Artificial Sequence
  Synthetic oligonucleotide; TTG chr2 60457356 60457377 60457373 60457378 +
gtcatctaaataaaaaaaaaaa

SEQ ID NO: 194558 - DNA, 22 bp, Artificial Sequence
  Synthetic oligonucleotide; CTA chr2 60457364 60457385 60457381 60457386 +
aataaaaaaaaaaataaaaaca

SEQ ID NO: 194559 - DNA, 22 bp, Artificial Sequence
  Synthetic oligonucleotide; TTA chr2 60457409 60457430 60457426 60457431 +
agtgcctctgttttgaacaggg

SEQ ID NO: 194560 - DNA, 22 bp, Artificial Sequence
  Synthetic oligonucleotide; CTC chr2 60457417 60457438 60457434 60457439 +
tgttttgaacagggcacataag

SEQ ID NO: 194561 - DNA, 22 bp, Artificial Sequence
  Synthetic oligonucleotide; CTG chr2 60457419 60457440 60457436 60457441 +
ttttgaacagggcacataagca

SEQ ID NO: 194562 - DNA, 22 bp, Artificial Sequence
  Synthetic oligonucleotide; TTT chr2 60457422 60457443 60457439 60457444 +
tgaacagggcacataagcaata

SEQ ID NO: 194563 - DNA, 22 bp, Artificial Sequence
  Synthetic oligonucleotide; TTT chr2 60457423 60457444 60457440 60457445 +
gaacagggcacataagcaataa

SEQ ID NO: 194564 - DNA, 22 bp, Artificial Sequence
  Synthetic oligonucleotide; TTG chr2 60457424 60457445 60457441 60457446 +
aacagggcacataagcaataat

SEQ ID NO: 194565 - DNA, 22 bp, Artificial Sequence
  Synthetic oligonucleotide; CTC chr2 60457458 60457479 60457475 60457480 +
ccatagtaaaagataaaatttc

SEQ ID NO: 194566 - DNA, 22 bp, Artificial Sequence
  Synthetic oligonucleotide; TTT chr2 60457479 60457500 60457496 60457501 +
caagttacgacaaacagctttc

SEQ ID NO: 194567 - DNA, 22 bp, Artificial Sequence
  Synthetic oligonucleotide; TTC chr2 60457480 60457501 60457497 60457502 +
aagttacgacaaacagctttca

SEQ ID NO: 194568 - DNA, 22 bp, Artificial Sequence
  Synthetic oligonucleotide; TTA chr2 60457486 60457507 60457503 60457508 +
cgacaaacagctttcattacag

SEQ ID NO: 194569 - DNA, 22 bp, Artificial Sequence
  Synthetic oligonucleotide; CTT chr2 60457499 60457520 60457516 60457521 +
tcattacaggaatagaaaaggc

SEQ ID NO: 194570 - DNA, 22 bp, Artificial Sequence
  Synthetic oligonucleotide; TTT chr2 60457500 60457521 60457517 60457522 +
cattacaggaatagaaaaggcc

SEQ ID NO: 194571 - DNA, 22 bp, Artificial Sequence
  Synthetic oligonucleotide; TTC chr2 60457501 60457522 60457518 60457523 +
attacaggaatagaaaaggcca

SEQ ID NO: 194572 - DNA, 22 bp, Artificial Sequence
  Synthetic oligonucleotide; TTA chr2 60457505 60457526 60457522 60457527 +
caggaatagaaaaggccaataa

SEQ ID NO: 194573 - DNA, 22 bp, Artificial Sequence
  Synthetic oligonucleotide; TTC chr2 60457537 60457558 60457554 60457559 +
tgcattgccatttacaaaaaag

SEQ ID NO: 194574 - DNA, 22 bp, Artificial Sequence
  Synthetic oligonucleotide; CTG chr2 60457539 60457560 60457556 60457561 +
cattgccatttacaaaaaagta

SEQ ID NO: 194575 - DNA, 22 bp, Artificial Sequence
  Synthetic oligonucleotide; TTG chr2 60457544 60457565 60457561 60457566 +
ccatttacaaaaaagtattgac

SEQ ID NO: 194576 - DNA, 22 bp, Artificial Sequence
  Synthetic oligonucleotide; TTT chr2 60457550 60457571 60457567 60457572 +
acaaaaaagtattgactaaagc

SEQ ID NO: 194577 - DNA, 22 bp, Artificial Sequence
  Synthetic oligonucleotide; TTA chr2 60457551 60457572 60457568 60457573 +
caaaaaagtattgactaaagcg

SEQ ID NO: 194578 - DNA, 22 bp, Artificial Sequence
  Synthetic oligonucleotide; TTG chr2 60457564 60457585 60457581 60457586 +
actaaagcgggctttctcttta

SEQ ID NO: 194579 - DNA, 22 bp, Artificial Sequence
  Synthetic oligonucleotide; CTA chr2 60457568 60457589 60457585 60457590 +
aagcgggctttctctttaatat

SEQ ID NO: 194580 - DNA, 22 bp, Artificial Sequence
  Synthetic oligonucleotide; CTT chr2 60457578 60457599 60457595 60457600 +
tctctttaatatgctttgcata

SEQ ID NO: 194581 - DNA, 22 bp, Artificial Sequence
  Synthetic oligonucleotide; TTT chr2 60457579 60457600 60457596 60457601 +
ctctttaatatgctttgcatat

SEQ ID NO: 194582 - DNA, 22 bp, Artificial Sequence
  Synthetic oligonucleotide; TTC chr2 60457580 60457601 60457597 60457602 +
tctttaatatgctttgcatatg

SEQ ID NO: 194583 - DNA, 22 bp, Artificial Sequence
  Synthetic oligonucleotide; CTC chr2 60457582 60457603 60457599 60457604 +
tttaatatgctttgcatatgaa

SEQ ID NO: 194584 - DNA, 22 bp, Artificial Sequence
  Synthetic oligonucleotide; CTT chr2 60457584 60457605 60457601 60457606 +
taatatgctttgcatatgaaat

SEQ ID NO: 194585 - DNA, 22 bp, Artificial Sequence
  Synthetic oligonucleotide; TTT chr2 60457585 60457606 60457602 60457607 +
aatatgctttgcatatgaaatt

SEQ ID NO: 194586 - DNA, 22 bp, Artificial Sequence
  Synthetic oligonucleotide; TTA chr2 60457586 60457607 60457603 60457608 +
atatgctttgcatatgaaattc

SEQ ID NO: 194587 - DNA, 22 bp, Artificial Sequence
  Synthetic oligonucleotide; CTT chr2 60457594 60457615 60457611 60457616 +
tgcatatgaaattctttccaat

SEQ ID NO: 194588 - DNA, 22 bp, Artificial Sequence
  Synthetic oligonucleotide; TTT chr2 60457595 60457616 60457612 60457617 +
gcatatgaaattctttccaatc

SEQ ID NO: 194589 - DNA, 22 bp, Artificial Sequence
  Synthetic oligonucleotide; TTG chr2 60457596 60457617 60457613 60457618 +
catatgaaattctttccaatct

SEQ ID NO: 194590 - DNA, 22 bp, Artificial Sequence
  Synthetic oligonucleotide; TTC chr2 60457608 60457629 60457625 60457630 +
tttccaatctaaatataaagca

SEQ ID NO: 194591 - DNA, 22 bp, Artificial Sequence
  Synthetic oligonucleotide; CTT chr2 60457610 60457631 60457627 60457632 +
tccaatctaaatataaagcacc

SEQ ID NO: 194592 - DNA, 22 bp, Artificial Sequence
  Synthetic oligonucleotide; TTT chr2 60457611 60457632 60457628 60457633 +
ccaatctaaatataaagcacca

SEQ ID NO: 194593 - DNA, 22 bp, Artificial Sequence
  Synthetic oligonucleotide; TTC chr2 60457612 60457633 60457629 60457634 +
caatctaaatataaagcaccat

SEQ ID NO: 194594 - DNA, 22 bp, Artificial Sequence
  Synthetic oligonucleotide; CTA chr2 60457619 60457640 60457636 60457641 +
aatataaagcaccatttagttt

SEQ ID NO: 194595 - DNA, 22 bp, Artificial Sequence
  Synthetic oligonucleotide; TTT chr2 60457636 60457657 60457653 60457658 +
agtttttggcaatgaaaaaaac

SEQ ID NO: 194596 - DNA, 22 bp, Artificial Sequence
  Synthetic oligonucleotide; TTA chr2 60457637 60457658 60457654 60457659 +
gtttttggcaatgaaaaaaact

SEQ ID NO: 194597 - DNA, 22 bp, Artificial Sequence
  Synthetic oligonucleotide; TTT chr2 60457641 60457662 60457658 60457663 +
ttggcaatgaaaaaaactgcaa

SEQ ID NO: 194598 - DNA, 22 bp, Artificial Sequence
  Synthetic oligonucleotide; TTT chr2 60457642 60457663 60457659 60457664 +
tggcaatgaaaaaaactgcaaa

SEQ ID NO: 194599 - DNA, 22 bp, Artificial Sequence
  Synthetic oligonucleotide; TTT chr2 60457643 60457664 60457660 60457665 +
ggcaatgaaaaaaactgcaaaa

SEQ ID NO: 194600 - DNA, 22 bp, Artificial Sequence
  Synthetic oligonucleotide; TTG chr2 60457644 60457665 60457661 60457666 +
gcaatgaaaaaaactgcaaaac

SEQ ID NO: 194601 - DNA, 22 bp, Artificial Sequence
  Synthetic oligonucleotide; CTG chr2 60457660 60457681 60457677 60457682 +
caaaacattggttttttttttt

SEQ ID NO: 194602 - DNA, 22 bp, Artificial Sequence
  Synthetic oligonucleotide; TTG chr2 60457670 60457691 60457687 60457692 +
gtttttttttttttttcctttt

SEQ ID NO: 194603 - DNA, 22 bp, Artificial Sequence
  Synthetic oligonucleotide; TTT chr2 60457674 60457695 60457691 60457696 +
ttttttttttttcctttttttt

SEQ ID NO: 194604 - DNA, 22 bp, Artificial Sequence
  Synthetic oligonucleotide; TTT chr2 60457675 60457696 60457692 60457697 +
tttttttttttccttttttttt

SEQ ID NO: 194605 - DNA, 22 bp, Artificial Sequence
  Synthetic oligonucleotide; TTT chr2 60457676 60457697 60457693 60457698 +
ttttttttttcctttttttttc

SEQ ID NO: 194606 - DNA, 22 bp, Artificial Sequence
  Synthetic oligonucleotide; TTT chr2 60457677 60457698 60457694 60457699 +
tttttttttcctttttttttct

SEQ ID NO: 194607 - DNA, 22 bp, Artificial Sequence
  Synthetic oligonucleotide; TTT chr2 60457678 60457699 60457695 60457700 +
ttttttttcctttttttttctt

SEQ ID NO: 194608 - DNA, 22 bp, Artificial Sequence
  Synthetic oligonucleotide; TTT chr2 60457679 60457700 60457696 60457701 +
tttttttcctttttttttcttt

SEQ ID NO: 194609 - DNA, 22 bp, Artificial Sequence
  Synthetic oligonucleotide; TTT chr2 60457680 60457701 60457697 60457702 +
ttttttcctttttttttctttc

SEQ ID NO: 194610 - DNA, 22 bp, Artificial Sequence
  Synthetic oligonucleotide; TTT chr2 60457681 60457702 60457698 60457703 +
tttttcctttttttttctttct

SEQ ID NO: 194611 - DNA, 22 bp, Artificial Sequence
  Synthetic oligonucleotide; TTT chr2 60457682 60457703 60457699 60457704 +
ttttcctttttttttctttctt

SEQ ID NO: 194612 - DNA, 22 bp, Artificial Sequence
  Synthetic oligonucleotide; TTT chr2 60457683 60457704 60457700 60457705 +
tttcctttttttttctttcttt

SEQ ID NO: 194613 - DNA, 22 bp, Artificial Sequence
  Synthetic oligonucleotide; TTT chr2 60457684 60457705 60457701 60457706 +
ttcctttttttttctttctttc

SEQ ID NO: 194614 - DNA, 22 bp, Artificial Sequence
  Synthetic oligonucleotide; TTT chr2 60457685 60457706 60457702 60457707 +
tcctttttttttctttctttct

SEQ ID NO: 194615 - DNA, 22 bp, Artificial Sequence
  Synthetic oligonucleotide; TTT chr2 60457686 60457707 60457703 60457708 +
cctttttttttctttctttctt

SEQ ID NO: 194616 - DNA, 22 bp, Artificial Sequence
  Synthetic oligonucleotide; TTC chr2 60457687 60457708 60457704 60457709 +
ctttttttttctttctttcttt

SEQ ID NO: 194617 - DNA, 22 bp, Artificial Sequence
  Synthetic oligonucleotide; CTT chr2 60457690 60457711 60457707 60457712 +
tttttttctttctttcttttac

SEQ ID NO: 194618 - DNA, 22 bp, Artificial Sequence
  Synthetic oligonucleotide; TTT chr2 60457691 60457712 60457708 60457713 +
ttttttctttctttcttttact

SEQ ID NO: 194619 - DNA, 22 bp, Artificial Sequence
  Synthetic oligonucleotide; TTT chr2 60457692 60457713 60457709 60457714 +
tttttctttctttcttttactg

SEQ ID NO: 194620 - DNA, 22 bp, Artificial Sequence
  Synthetic oligonucleotide; TTT chr2 60457693 60457714 60457710 60457715 +
ttttctttctttcttttactgc

SEQ ID NO: 194621 - DNA, 22 bp, Artificial Sequence
  Synthetic oligonucleotide; TTT chr2 60457694 60457715 60457711 60457716 +
tttctttctttcttttactgca

SEQ ID NO: 194622 - DNA, 22 bp, Artificial Sequence
  Synthetic oligonucleotide; TTT chr2 60457695 60457716 60457712 60457717 +
ttctttctttcttttactgcat

SEQ ID NO: 194623 - DNA, 22 bp, Artificial Sequence
  Synthetic oligonucleotide; TTT chr2 60457696 60457717 60457713 60457718 +
tctttctttcttttactgcata

SEQ ID NO: 194624 - DNA, 22 bp, Artificial Sequence
  Synthetic oligonucleotide; TTT chr2 60457697 60457718 60457714 60457719 +
ctttctttcttttactgcatat

SEQ ID NO: 194625 - DNA, 22 bp, Artificial Sequence
  Synthetic oligonucleotide; TTC chr2 60457698 60457719 60457715 60457720 +
tttctttcttttactgcatatg

SEQ ID NO: 194626 - DNA, 22 bp, Artificial Sequence
  Synthetic oligonucleotide; CTT chr2 60457700 60457721 60457717 60457722 +
tctttcttttactgcatatgaa

SEQ ID NO: 194627 - DNA, 22 bp, Artificial Sequence
  Synthetic oligonucleotide; TTT chr2 60457701 60457722 60457718 60457723 +
ctttcttttactgcatatgaag

SEQ ID NO: 194628 - DNA, 22 bp, Artificial Sequence
  Synthetic oligonucleotide; TTC chr2 60457702 60457723 60457719 60457724 +
tttcttttactgcatatgaagg

SEQ ID NO: 194629 - DNA, 22 bp, Artificial Sequence
  Synthetic oligonucleotide; CTT chr2 60457704 60457725 60457721 60457726 +
tcttttactgcatatgaaggta

SEQ ID NO: 194630 - DNA, 22 bp, Artificial Sequence
  Synthetic oligonucleotide; TTT chr2 60457705 60457726 60457722 60457727 +
cttttactgcatatgaaggtaa

SEQ ID NO: 194631 - DNA, 22 bp, Artificial Sequence
  Synthetic oligonucleotide; TTC chr2 60457706 60457727 60457723 60457728 +
ttttactgcatatgaaggtaag

SEQ ID NO: 194632 - DNA, 22 bp, Artificial Sequence
  Synthetic oligonucleotide; CTT chr2 60457708 60457729 60457725 60457730 +
ttactgcatatgaaggtaagat

SEQ ID NO: 194633 - DNA, 22 bp, Artificial Sequence
  Synthetic oligonucleotide; TTT chr2 60457709 60457730 60457726 60457731 +
tactgcatatgaaggtaagatg

SEQ ID NO: 194634 - DNA, 22 bp, Artificial Sequence
  Synthetic oligonucleotide; TTT chr2 60457710 60457731 60457727 60457732 +
actgcatatgaaggtaagatgc

SEQ ID NO: 194635 - DNA, 22 bp, Artificial Sequence
  Synthetic oligonucleotide; TTA chr2 60457711 60457732 60457728 60457733 +
ctgcatatgaaggtaagatgct

SEQ ID NO: 194636 - DNA, 22 bp, Artificial Sequence
  Synthetic oligonucleotide; CTG chr2 60457714 60457735 60457731 60457736 +
catatgaaggtaagatgctgga

SEQ ID NO: 194637 - DNA, 22 bp, Artificial Sequence
  Synthetic oligonucleotide; CTG chr2 60457734 60457755 60457751 60457756 +
gaatgtagggtgatagaaggaa

SEQ ID NO: 194638 - DNA, 22 bp, Artificial Sequence
  Synthetic oligonucleotide; CTA chr2 60457775 60457796 60457792 60457797 +
cataacaaaccaacgttattag

SEQ ID NO: 194639 - DNA, 22 bp, Artificial Sequence
  Synthetic oligonucleotide; TTA chr2 60457793 60457814 60457810 60457815 +
ttagcttgcagtactgcataca

SEQ ID NO: 194640 - DNA, 22 bp, Artificial Sequence
  Synthetic oligonucleotide; TTA chr2 60457796 60457817 60457813 60457818 +
gcttgcagtactgcatacagta

SEQ ID NO: 194641 - DNA, 22 bp, Artificial Sequence
  Synthetic oligonucleotide; CTT chr2 60457800 60457821 60457817 60457822 +
gcagtactgcatacagtatggc

SEQ ID NO: 194642 - DNA, 22 bp, Artificial Sequence
  Synthetic oligonucleotide; TTG chr2 60457801 60457822 60457818 60457823 +
cagtactgcatacagtatggca

SEQ ID NO: 194643 - DNA, 22 bp, Artificial Sequence
  Synthetic oligonucleotide; CTG chr2 60457809 60457830 60457826 60457831 +
catacagtatggcagcaggaaa

SEQ ID NO: 194644 - DNA, 22 bp, Artificial Sequence
  Synthetic oligonucleotide; CTA chr2 60457862 60457883 60457879 60457884 +
tgacagccatccatgtgacatt

SEQ ID NO: 194645 - DNA, 22 bp, Artificial Sequence
  Synthetic oligonucleotide; TTC chr2 60457885 60457906 60457902 60457907 +
tagcaggctcccccaaaccgcc

SEQ ID NO: 194646 - DNA, 22 bp, Artificial Sequence
  Synthetic oligonucleotide; CTA chr2 60457887 60457908 60457904 60457909 +
gcaggctcccccaaaccgccat

SEQ ID NO: 194647 - DNA, 22 bp, Artificial Sequence
  Synthetic oligonucleotide; CTC chr2 60457895 60457916 60457912 60457917 +
ccccaaaccgccattatatggc

SEQ ID NO: 194648 - DNA, 22 bp, Artificial Sequence
  Synthetic oligonucleotide; TTA chr2 60457911 60457932 60457928 60457933 +
tatggcttctcatctgtaatgt

SEQ ID NO: 194649 - DNA, 22 bp, Artificial Sequence
  Synthetic oligonucleotide; CTT chr2 60457919 60457940 60457936 60457941 +
ctcatctgtaatgtcacacttt

SEQ ID NO: 194650 - DNA, 22 bp, Artificial Sequence
  Synthetic oligonucleotide; TTC chr2 60457920 60457941 60457937 60457942 +
tcatctgtaatgtcacactttt

SEQ ID NO: 194651 - DNA, 22 bp, Artificial Sequence
  Synthetic oligonucleotide; CTC chr2 60457922 60457943 60457939 60457944 +
atctgtaatgtcacactttttt

SEQ ID NO: 194652 - DNA, 22 bp, Artificial Sequence
  Synthetic oligonucleotide; CTG chr2 60457927 60457948 60457944 60457949 +
taatgtcacacttttttgtttc

SEQ ID NO: 194653 - DNA, 22 bp, Artificial Sequence
  Synthetic oligonucleotide; CTT chr2 60457940 60457961 60457957 60457962 +
ttttgtttctctcttttttttt

SEQ ID NO: 194654 - DNA, 22 bp, Artificial Sequence
  Synthetic oligonucleotide; TTT chr2 60457941 60457962 60457958 60457963 +
tttgtttctctctttttttttt

SEQ ID NO: 194655 - DNA, 22 bp, Artificial Sequence
  Synthetic oligonucleotide; TTT chr2 60457942 60457963 60457959 60457964 +
ttgtttctctcttttttttttt

SEQ ID NO: 194656 - DNA, 22 bp, Artificial Sequence
  Synthetic oligonucleotide; TTT chr2 60457943 60457964 60457960 60457965 +
tgtttctctctttttttttttt

SEQ ID NO: 194657 - DNA, 22 bp, Artificial Sequence
  Synthetic oligonucleotide; TTT chr2 60457944 60457965 60457961 60457966 +
gtttctctcttttttttttttt

SEQ ID NO: 194658 - DNA, 22 bp, Artificial Sequence
  Synthetic oligonucleotide; TTG chr2 60457945 60457966 60457962 60457967 +
tttctctctttttttttttttt

SEQ ID NO: 194659 - DNA, 22 bp, Artificial Sequence
  Synthetic oligonucleotide; TTT chr2 60457948 60457969 60457965 60457970 +
ctctcttttttttttttttgaa

SEQ ID NO: 194660 - DNA, 22 bp, Artificial Sequence
  Synthetic oligonucleotide; TTC chr2 60457949 60457970 60457966 60457971 +
tctcttttttttttttttgaag

SEQ ID NO: 194661 - DNA, 22 bp, Artificial Sequence
  Synthetic oligonucleotide; CTC chr2 60457951 60457972 60457968 60457973 +
tcttttttttttttttgaagca

SEQ ID NO: 194662 - DNA, 22 bp, Artificial Sequence
  Synthetic oligonucleotide; CTC chr2 60457953 60457974 60457970 60457975 +
ttttttttttttttgaagcata

SEQ ID NO: 194663 - DNA, 22 bp, Artificial Sequence
  Synthetic oligonucleotide; CTT chr2 60457955 60457976 60457972 60457977 +
ttttttttttttgaagcataca

SEQ ID NO: 194664 - DNA, 22 bp, Artificial Sequence
  Synthetic oligonucleotide; TTT chr2 60457956 60457977 60457973 60457978 +
tttttttttttgaagcatacaa

SEQ ID NO: 194665 - DNA, 22 bp, Artificial Sequence
  Synthetic oligonucleotide; TTT chr2 60457957 60457978 60457974 60457979 +
ttttttttttgaagcatacaaa

SEQ ID NO: 194666 - DNA, 22 bp, Artificial Sequence
  Synthetic oligonucleotide; TTT chr2 60457958 60457979 60457975 60457980 +
tttttttttgaagcatacaaat

SEQ ID NO: 194667 - DNA, 22 bp, Artificial Sequence
  Synthetic oligonucleotide; TTT chr2 60457959 60457980 60457976 60457981 +
ttttttttgaagcatacaaata

SEQ ID NO: 194668 - DNA, 22 bp, Artificial Sequence
  Synthetic oligonucleotide; TTT chr2 60457960 60457981 60457977 60457982 +
tttttttgaagcatacaaataa

SEQ ID NO: 194669 - DNA, 22 bp, Artificial Sequence
  Synthetic oligonucleotide; TTT chr2 60457961 60457982 60457978 60457983 +
ttttttgaagcatacaaataat

SEQ ID NO: 194670 - DNA, 22 bp, Artificial Sequence
  Synthetic oligonucleotide; TTT chr2 60457962 60457983 60457979 60457984 +
tttttgaagcatacaaataatt

SEQ ID NO: 194671 - DNA, 22 bp, Artificial Sequence
  Synthetic oligonucleotide; TTT chr2 60457963 60457984 60457980 60457985 +
ttttgaagcatacaaataattt

SEQ ID NO: 194672 - DNA, 22 bp, Artificial Sequence
  Synthetic oligonucleotide; TTT chr2 60457964 60457985 60457981 60457986 +
tttgaagcatacaaataatttg

SEQ ID NO: 194673 - DNA, 22 bp, Artificial Sequence
  Synthetic oligonucleotide; TTT chr2 60457965 60457986 60457982 60457987 +
ttgaagcatacaaataatttgc

SEQ ID NO: 194674 - DNA, 22 bp, Artificial Sequence
  Synthetic oligonucleotide; TTT chr2 60457966 60457987 60457983 60457988 +
tgaagcatacaaataatttgca

SEQ ID NO: 194675 - DNA, 22 bp, Artificial Sequence
  Synthetic oligonucleotide; TTT chr2 60457967 60457988 60457984 60457989 +
gaagcatacaaataatttgcac

SEQ ID NO: 194676 - DNA, 22 bp, Artificial Sequence
  Synthetic oligonucleotide; TTG chr2 60457968 60457989 60457985 60457990 +
aagcatacaaataatttgcact

SEQ ID NO: 194677 - DNA, 22 bp, Artificial Sequence
  Synthetic oligonucleotide; TTT chr2 60457985 60458006 60458002 60458007 +
gcactatattatcctgccaaat

SEQ ID NO: 194678 - DNA, 22 bp, Artificial Sequence
  Synthetic oligonucleotide; TTG chr2 60457986 60458007 60458003 60458008 +
cactatattatcctgccaaatt

SEQ ID NO: 194679 - DNA, 22 bp, Artificial Sequence
  Synthetic oligonucleotide; CTA chr2 60457991 60458012 60458008 60458013 +
tattatcctgccaaattaaaaa

SEQ ID NO: 194680 - DNA, 22 bp, Artificial Sequence
  Synthetic oligonucleotide; TTA chr2 60457996 60458017 60458013 60458018 +
tcctgccaaattaaaaaaatat

SEQ ID NO: 194681 - DNA, 22 bp, Artificial Sequence
  Synthetic oligonucleotide; CTG chr2 60458001 60458022 60458018 60458023 +
ccaaattaaaaaaatatactgt

SEQ ID NO: 194682 - DNA, 22 bp, Artificial Sequence
  Synthetic oligonucleotide; TTA chr2 60458009 60458030 60458026 60458031 +
aaaaaatatactgtggcagcct

SEQ ID NO: 194683 - DNA, 22 bp, Artificial Sequence
  Synthetic oligonucleotide; CTG chr2 60458022 60458043 60458039 60458044 +
tggcagcctgtctttttttttt

SEQ ID NO: 194684 - DNA, 22 bp, Artificial Sequence
  Synthetic oligonucleotide; CTG chr2 60458032 60458053 60458049 60458054 +
tcttttttttttccactaccaa

SEQ ID NO: 194685 - DNA, 22 bp, Artificial Sequence
  Synthetic oligonucleotide; CTT chr2 60458036 60458057 60458053 60458058 +
ttttttttccactaccaaaaaa

SEQ ID NO: 194686 - DNA, 22 bp, Artificial Sequence
  Synthetic oligonucleotide; TTT chr2 60458037 60458058 60458054 60458059 +
tttttttccactaccaaaaaag

SEQ ID NO: 194687 - DNA, 22 bp, Artificial Sequence
  Synthetic oligonucleotide; TTT chr2 60458038 60458059 60458055 60458060 +
ttttttccactaccaaaaaagg

SEQ ID NO: 194688 - DNA, 22 bp, Artificial Sequence
  Synthetic oligonucleotide; TTT chr2 60458039 60458060 60458056 60458061 +
tttttccactaccaaaaaaggt

SEQ ID NO: 194689 - DNA, 22 bp, Artificial Sequence
  Synthetic oligonucleotide; TTT chr2 60458040 60458061 60458057 60458062 +
ttttccactaccaaaaaaggta

SEQ ID NO: 194690 - DNA, 22 bp, Artificial Sequence
  Synthetic oligonucleotide; TTT chr2 60458041 60458062 60458058 60458063 +
tttccactaccaaaaaaggtac

SEQ ID NO: 194691 - DNA, 22 bp, Artificial Sequence
  Synthetic oligonucleotide; TTT chr2 60458042 60458063 60458059 60458064 +
ttccactaccaaaaaaggtaca

SEQ ID NO: 194692 - DNA, 22 bp, Artificial Sequence
  Synthetic oligonucleotide; TTT chr2 60458043 60458064 60458060 60458065 +
tccactaccaaaaaaggtacat

SEQ ID NO: 194693 - DNA, 22 bp, Artificial Sequence
  Synthetic oligonucleotide; TTT chr2 60458044 60458065 60458061 60458066 +
ccactaccaaaaaaggtacatt

SEQ ID NO: 194694 - DNA, 22 bp, Artificial Sequence
  Synthetic oligonucleotide; TTC chr2 60458045 60458066 60458062 60458067 +
cactaccaaaaaaggtacattg

SEQ ID NO: 194695 - DNA, 22 bp, Artificial Sequence
  Synthetic oligonucleotide; CTA chr2 60458050 60458071 60458067 60458072 +
ccaaaaaaggtacattgatacc

SEQ ID NO: 194696 - DNA, 22 bp, Artificial Sequence
  Synthetic oligonucleotide; TTG chr2 60458067 60458088 60458084 60458089 +
ataccttttaagagaacaagca

SEQ ID NO: 194697 - DNA, 22 bp, Artificial Sequence
  Synthetic oligonucleotide; CTT chr2 60458074 60458095 60458091 60458096 +
ttaagagaacaagcaacagtta

SEQ ID NO: 194698 - DNA, 22 bp, Artificial Sequence
  Synthetic oligonucleotide; TTT chr2 60458075 60458096 60458092 60458097 +
taagagaacaagcaacagttaa

SEQ ID NO: 194699 - DNA, 22 bp, Artificial Sequence
  Synthetic oligonucleotide; TTT chr2 60458076 60458097 60458093 60458098 +
aagagaacaagcaacagttaaa

SEQ ID NO: 194700 - DNA, 22 bp, Artificial Sequence
  Synthetic oligonucleotide; TTA chr2 60458077 60458098 60458094 60458099 +
agagaacaagcaacagttaaaa

SEQ ID NO: 194701 - DNA, 22 bp, Artificial Sequence
  Synthetic oligonucleotide; TTA chr2 60458096 60458117 60458113 60458118 +
aaaatacaagcttcaatataaa

SEQ ID NO: 194702 - DNA, 22 bp, Artificial Sequence
  Synthetic oligonucleotide; CTT chr2 60458109 60458130 60458126 60458131 +
caatataaatactatagtgcct

SEQ ID NO: 194703 - DNA, 22 bp, Artificial Sequence
  Synthetic oligonucleotide; TTC chr2 60458110 60458131 60458127 60458132 +
aatataaatactatagtgccta

SEQ ID NO: 194704 - DNA, 22 bp, Artificial Sequence
  Synthetic oligonucleotide; CTA chr2 60458123 60458144 60458140 60458145 +
tagtgcctaacactagatgaac

SEQ ID NO: 194705 - DNA, 22 bp, Artificial Sequence
  Synthetic oligonucleotide; CTA chr2 60458132 60458153 60458149 60458154 +
acactagatgaacatttaattc

SEQ ID NO: 194706 - DNA, 22 bp, Artificial Sequence
  Synthetic oligonucleotide; CTA chr2 60458138 60458159 60458155 60458160 +
gatgaacatttaattcaaatac

SEQ ID NO: 194707 - DNA, 22 bp, Artificial Sequence
  Synthetic oligonucleotide; TTT chr2 60458149 60458170 60458166 60458171 +
aattcaaataccattctagaaa

SEQ ID NO: 194708 - DNA, 22 bp, Artificial Sequence
  Synthetic oligonucleotide; TTA chr2 60458150 60458171 60458167 60458172 +
attcaaataccattctagaaat

SEQ ID NO: 194709 - DNA, 22 bp, Artificial Sequence
  Synthetic oligonucleotide; TTC chr2 60458154 60458175 60458171 60458176 +
aaataccattctagaaatacag

SEQ ID NO: 194710 - DNA, 22 bp, Artificial Sequence
  Synthetic oligonucleotide; TTC chr2 60458165 60458186 60458182 60458187 +
tagaaatacagaaaaaagacca

SEQ ID NO: 194711 - DNA, 22 bp, Artificial Sequence
  Synthetic oligonucleotide; CTA chr2 60458167 60458188 60458184 60458189 +
gaaatacagaaaaaagaccata

SEQ ID NO: 194712 - DNA, 22 bp, Artificial Sequence
  Synthetic oligonucleotide; TTT chr2 60458198 60458219 60458215 60458220 +
tagcataggaatcaacatgagt

SEQ ID NO: 194713 - DNA, 22 bp, Artificial Sequence
  Synthetic oligonucleotide; TTT chr2 60458199 60458220 60458216 60458221 +
agcataggaatcaacatgagtg

SEQ ID NO: 194714 - DNA, 22 bp, Artificial Sequence
  Synthetic oligonucleotide; TTA chr2 60458200 60458221 60458217 60458222 +
gcataggaatcaacatgagtgt

SEQ ID NO: 194715 - DNA, 22 bp, Artificial Sequence
  Synthetic oligonucleotide; TTT chr2 60458228 60458249 60458245 60458250 +
tcctatatttaagtactatata

SEQ ID NO: 194716 - DNA, 22 bp, Artificial Sequence
  Synthetic oligonucleotide; TTT chr2 60458229 60458250 60458246 60458251 +
cctatatttaagtactatataa

SEQ ID NO: 194717 - DNA, 22 bp, Artificial Sequence
  Synthetic oligonucleotide; TTC chr2 60458230 60458251 60458247 60458252 +
ctatatttaagtactatataat

SEQ ID NO: 194718 - DNA, 22 bp, Artificial Sequence
  Synthetic oligonucleotide; CTA chr2 60458233 60458254 60458250 60458255 +
tatttaagtactatataatctt

SEQ ID NO: 194719 - DNA, 22 bp, Artificial Sequence
  Synthetic oligonucleotide; TTT chr2 60458238 60458259 60458255 60458260 +
aagtactatataatcttaaacc

SEQ ID NO: 194720 - DNA, 22 bp, Artificial Sequence
  Synthetic oligonucleotide; TTA chr2 60458239 60458260 60458256 60458261 +
agtactatataatcttaaacct

SEQ ID NO: 194721 - DNA, 22 bp, Artificial Sequence
  Synthetic oligonucleotide; CTA chr2 60458246 60458267 60458263 60458268 +
tataatcttaaacctttcccca

SEQ ID NO: 194722 - DNA, 22 bp, Artificial Sequence
  Synthetic oligonucleotide; CTT chr2 60458255 60458276 60458272 60458277 +
aaacctttccccaatgtatgtt

SEQ ID NO: 194723 - DNA, 22 bp, Artificial Sequence
  Synthetic oligonucleotide; TTA chr2 60458256 60458277 60458273 60458278 +
aacctttccccaatgtatgttt

SEQ ID NO: 194724 - DNA, 22 bp, Artificial Sequence
  Synthetic oligonucleotide; CTT chr2 60458262 60458283 60458279 60458284 +
tccccaatgtatgttttttttt

SEQ ID NO: 194725 - DNA, 22 bp, Artificial Sequence
  Synthetic oligonucleotide; TTT chr2 60458263 60458284 60458280 60458285 +
ccccaatgtatgtttttttttt

SEQ ID NO: 194726 - DNA, 22 bp, Artificial Sequence
  Synthetic oligonucleotide; TTC chr2 60458264 60458285 60458281 60458286 +
cccaatgtatgttttttttttt

SEQ ID NO: 194727 - DNA, 22 bp, Artificial Sequence
  Synthetic oligonucleotide; TTT chr2 60458278 60458299 60458295 60458300 +
tttttttttacaacctgaagag

SEQ ID NO: 194728 - DNA, 22 bp, Artificial Sequence
  Synthetic oligonucleotide; TTT chr2 60458279 60458300 60458296 60458301 +
ttttttttacaacctgaagagc

SEQ ID NO: 194729 - DNA, 22 bp, Artificial Sequence
  Synthetic oligonucleotide; TTT chr2 60458280 60458301 60458297 60458302 +
tttttttacaacctgaagagcg

SEQ ID NO: 194730 - DNA, 22 bp, Artificial Sequence
  Synthetic oligonucleotide; TTT chr2 60458281 60458302 60458298 60458303 +
ttttttacaacctgaagagcgg

SEQ ID NO: 194731 - DNA, 22 bp, Artificial Sequence
  Synthetic oligonucleotide; TTT chr2 60458282 60458303 60458299 60458304 +
tttttacaacctgaagagcggt

SEQ ID NO: 194732 - DNA, 22 bp, Artificial Sequence
  Synthetic oligonucleotide; TTT chr2 60458283 60458304 60458300 60458305 +
ttttacaacctgaagagcggtg

SEQ ID NO: 194733 - DNA, 22 bp, Artificial Sequence
  Synthetic oligonucleotide; TTT chr2 60458284 60458305 60458301 60458306 +
tttacaacctgaagagcggtgt

SEQ ID NO: 194734 - DNA, 22 bp, Artificial Sequence
  Synthetic oligonucleotide; TTT chr2 60458285 60458306 60458302 60458307 +
ttacaacctgaagagcggtgtg

SEQ ID NO: 194735 - DNA, 22 bp, Artificial Sequence
  Synthetic oligonucleotide; TTT chr2 60458286 60458307 60458303 60458308 +
tacaacctgaagagcggtgtgt

SEQ ID NO: 194736 - DNA, 22 bp, Artificial Sequence
  Synthetic oligonucleotide; TTT chr2 60458287 60458308 60458304 60458309 +
acaacctgaagagcggtgtgta

SEQ ID NO: 194737 - DNA, 22 bp, Artificial Sequence
  Synthetic oligonucleotide; TTA chr2 60458288 60458309 60458305 60458310 +
caacctgaagagcggtgtgtat

SEQ ID NO: 194738 - DNA, 22 bp, Artificial Sequence
  Synthetic oligonucleotide; CTG chr2 60458295 60458316 60458312 60458317 +
aagagcggtgtgtatccaaggc

SEQ ID NO: 194739 - DNA, 22 bp, Artificial Sequence
  Synthetic oligonucleotide; TTT chr2 60458326 60458347 60458343 60458348 +
ccactaccatttttaaatggat

SEQ ID NO: 194740 - DNA, 22 bp, Artificial Sequence
  Synthetic oligonucleotide; TTC chr2 60458327 60458348 60458344 60458349 +
cactaccatttttaaatggata

SEQ ID NO: 194741 - DNA, 22 bp, Artificial Sequence
  Synthetic oligonucleotide; CTA chr2 60458332 60458353 60458349 60458354 +
ccatttttaaatggataacaag

SEQ ID NO: 194742 - DNA, 22 bp, Artificial Sequence
  Synthetic oligonucleotide; TTT chr2 60458338 60458359 60458355 60458360 +
ttaaatggataacaagtcttgt

SEQ ID NO: 194743 - DNA, 22 bp, Artificial Sequence
  Synthetic oligonucleotide; TTT chr2 60458339 60458360 60458356 60458361 +
taaatggataacaagtcttgta

SEQ ID NO: 194744 - DNA, 22 bp, Artificial Sequence
  Synthetic oligonucleotide; TTT chr2 60458340 60458361 60458357 60458362 +
aaatggataacaagtcttgtaa

SEQ ID NO: 194745 - DNA, 22 bp, Artificial Sequence
  Synthetic oligonucleotide; TTA chr2 60458341 60458362 60458358 60458363 +
aatggataacaagtcttgtaac

SEQ ID NO: 194746 - DNA, 22 bp, Artificial Sequence
  Synthetic oligonucleotide; CTT chr2 60458358 60458379 60458375 60458380 +
gtaacaccaccaagacaatgga

SEQ ID NO: 194747 - DNA, 22 bp, Artificial Sequence
  Synthetic oligonucleotide; TTG chr2 60458359 60458380 60458376 60458381 +
taacaccaccaagacaatggaa

SEQ ID NO: 194748 - DNA, 22 bp, Artificial Sequence
  Synthetic oligonucleotide; CTA chr2 60458386 60458407 60458403 60458408 +
aaatgcagttcccccctaaaca

SEQ ID NO: 194749 - DNA, 22 bp, Artificial Sequence
  Synthetic oligonucleotide; TTC chr2 60458397 60458418 60458414 60458419 +
ccccctaaacataatgaagtgt

SEQ ID NO: 194750 - DNA, 22 bp, Artificial Sequence
  Synthetic oligonucleotide; CTA chr2 60458404 60458425 60458421 60458426 +
aacataatgaagtgttttttaa

SEQ ID NO: 194751 - DNA, 22 bp, Artificial Sequence
  Synthetic oligonucleotide; TTT chr2 60458421 60458442 60458438 60458443 +
tttaaaaaaaatttttcttaac

SEQ ID NO: 194752 - DNA, 22 bp, Artificial Sequence
  Synthetic oligonucleotide; TTT chr2 60458422 60458443 60458439 60458444 +
ttaaaaaaaatttttcttaaca

SEQ ID NO: 194753 - DNA, 22 bp, Artificial Sequence
  Synthetic oligonucleotide; TTT chr2 60458423 60458444 60458440 60458445 +
taaaaaaaatttttcttaacat

SEQ ID NO: 194754 - DNA, 22 bp, Artificial Sequence
  Synthetic oligonucleotide; TTT chr2 60458424 60458445 60458441 60458446 +
aaaaaaaatttttcttaacatt

SEQ ID NO: 194755 - DNA, 22 bp, Artificial Sequence
  Synthetic oligonucleotide; TTA chr2 60458425 60458446 60458442 60458447 +
aaaaaaatttttcttaacattt

SEQ ID NO: 194756 - DNA, 22 bp, Artificial Sequence
  Synthetic oligonucleotide; TTT chr2 60458435 60458456 60458452 60458457 +
ttcttaacatttatatttaaaa

SEQ ID NO: 194757 - DNA, 22 bp, Artificial Sequence
  Synthetic oligonucleotide; TTT chr2 60458436 60458457 60458453 60458458 +
tcttaacatttatatttaaaaa

SEQ ID NO: 194758 - DNA, 22 bp, Artificial Sequence
  Synthetic oligonucleotide; TTT chr2 60458437 60458458 60458454 60458459 +
cttaacatttatatttaaaaaa

SEQ ID NO: 194759 - DNA, 22 bp, Artificial Sequence
  Synthetic oligonucleotide; TTC chr2 60458438 60458459 60458455 60458460 +
ttaacatttatatttaaaaaag

SEQ ID NO: 194760 - DNA, 22 bp, Artificial Sequence
  Synthetic oligonucleotide; CTT chr2 60458440 60458461 60458457 60458462 +
aacatttatatttaaaaaagtt

SEQ ID NO: 194761 - DNA, 22 bp, Artificial Sequence
  Synthetic oligonucleotide; TTA chr2 60458441 60458462 60458458 60458463 +
acatttatatttaaaaaagttt

SEQ ID NO: 194762 - DNA, 22 bp, Artificial Sequence
  Synthetic oligonucleotide; TTT chr2 60458447 60458468 60458464 60458469 +
atatttaaaaaagttttgtaca

SEQ ID NO: 194763 - DNA, 22 bp, Artificial Sequence
  Synthetic oligonucleotide; TTA chr2 60458448 60458469 60458465 60458470 +
tatttaaaaaagttttgtacaa

SEQ ID NO: 194764 - DNA, 22 bp, Artificial Sequence
  Synthetic oligonucleotide; TTT chr2 60458453 60458474 60458470 60458475 +
aaaaaagttttgtacaaaaaaa

SEQ ID NO: 194765 - DNA, 22 bp, Artificial Sequence
  Synthetic oligonucleotide; TTA chr2 60458454 60458475 60458471 60458476 +
aaaaagttttgtacaaaaaaat

SEQ ID NO: 194766 - DNA, 22 bp, Artificial Sequence
  Synthetic oligonucleotide; TTT chr2 60458463 60458484 60458480 60458485 +
tgtacaaaaaaatccttgcact

SEQ ID NO: 194767 - DNA, 22 bp, Artificial Sequence
  Synthetic oligonucleotide; TTT chr2 60458464 60458485 60458481 60458486 +
gtacaaaaaaatccttgcactg

SEQ ID NO: 194768 - DNA, 22 bp, Artificial Sequence
  Synthetic oligonucleotide; TTG chr2 60458465 60458486 60458482 60458487 +
tacaaaaaaatccttgcactgt

SEQ ID NO: 194769 - DNA, 22 bp, Artificial Sequence
  Synthetic oligonucleotide; CTT chr2 60458480 60458501 60458497 60458502 +
gcactgtagaagcgaaagcaat

SEQ ID NO: 194770 - DNA, 22 bp, Artificial Sequence
  Synthetic oligonucleotide; TTG chr2 60458481 60458502 60458498 60458503 +
cactgtagaagcgaaagcaatc

SEQ ID NO: 194771 - DNA, 22 bp, Artificial Sequence
  Synthetic oligonucleotide; CTG chr2 60458486 60458507 60458503 60458508 +
tagaagcgaaagcaatcattca

SEQ ID NO: 194772 - DNA, 22 bp, Artificial Sequence
  Synthetic oligonucleotide; TTC chr2 60458507 60458528 60458524 60458529 +
atttctatgttaagtgtattct

SEQ ID NO: 194773 - DNA, 22 bp, Artificial Sequence
  Synthetic oligonucleotide; TTT chr2 60458511 60458532 60458528 60458533 +
ctatgttaagtgtattctgttt

SEQ ID NO: 194774 - DNA, 22 bp, Artificial Sequence
  Synthetic oligonucleotide; TTC chr2 60458512 60458533 60458529 60458534 +
tatgttaagtgtattctgtttc

SEQ ID NO: 194775 - DNA, 22 bp, Artificial Sequence
  Synthetic oligonucleotide; CTA chr2 60458514 60458535 60458531 60458536 +
tgttaagtgtattctgtttcca

SEQ ID NO: 194776 - DNA, 22 bp, Artificial Sequence
  Synthetic oligonucleotide; TTA chr2 60458519 60458540 60458536 60458541 +
agtgtattctgtttccattcac

SEQ ID NO: 194777 - DNA, 22 bp, Artificial Sequence
  Synthetic oligonucleotide; TTC chr2 60458528 60458549 60458545 60458550 +
tgtttccattcacagcgcttgc

SEQ ID NO: 194778 - DNA, 22 bp, Artificial Sequence
  Synthetic oligonucleotide; CTG chr2 60458530 60458551 60458547 60458552 +
tttccattcacagcgcttgcaa

SEQ ID NO: 194779 - DNA, 22 bp, Artificial Sequence
  Synthetic oligonucleotide; TTT chr2 60458533 60458554 60458550 60458555 +
ccattcacagcgcttgcaatgt

SEQ ID NO: 194780 - DNA, 22 bp, Artificial Sequence
  Synthetic oligonucleotide; TTC chr2 60458534 60458555 60458551 60458556 +
cattcacagcgcttgcaatgtt

SEQ ID NO: 194781 - DNA, 22 bp, Artificial Sequence
  Synthetic oligonucleotide; TTC chr2 60458539 60458560 60458556 60458561 +
acagcgcttgcaatgttgcgtc

SEQ ID NO: 194782 - DNA, 22 bp, Artificial Sequence
  Synthetic oligonucleotide; CTT chr2 60458548 60458569 60458565 60458570 +
gcaatgttgcgtccaagtaagt

SEQ ID NO: 194783 - DNA, 22 bp, Artificial Sequence
  Synthetic oligonucleotide; TTG chr2 60458549 60458570 60458566 60458571 +
caatgttgcgtccaagtaagta

SEQ ID NO: 194784 - DNA, 22 bp, Artificial Sequence
  Synthetic oligonucleotide; TTG chr2 60458557 60458578 60458574 60458579 +
cgtccaagtaagtaagctcaat

SEQ ID NO: 194785 - DNA, 22 bp, Artificial Sequence
  Synthetic oligonucleotide; CTC chr2 60458576 60458597 60458593 60458598 +
aatagtcaagtaaatggctggc

SEQ ID NO: 194786 - DNA, 22 bp, Artificial Sequence
  Synthetic oligonucleotide; CTG chr2 60458596 60458617 60458613 60458618 +
gcaaagtttttttttttttagt

SEQ ID NO: 194787 - DNA, 22 bp, Artificial Sequence
  Synthetic oligonucleotide; TTT chr2 60458605 60458626 60458622 60458627 +
ttttttttttagtttttaaaaa

SEQ ID NO: 194788 - DNA, 22 bp, Artificial Sequence
  Synthetic oligonucleotide; TTT chr2 60458606 60458627 60458623 60458628 +
tttttttttagtttttaaaaaa

SEQ ID NO: 194789 - DNA, 22 bp, Artificial Sequence
  Synthetic oligonucleotide; TTT chr2 60458607 60458628 60458624 60458629 +
ttttttttagtttttaaaaaat

SEQ ID NO: 194790 - DNA, 22 bp, Artificial Sequence
  Synthetic oligonucleotide; TTT chr2 60458608 60458629 60458625 60458630 +
tttttttagtttttaaaaaatg

SEQ ID NO: 194791 - DNA, 22 bp, Artificial Sequence
  Synthetic oligonucleotide; TTT chr2 60458609 60458630 60458626 60458631 +
ttttttagtttttaaaaaatgc

SEQ ID NO: 194792 - DNA, 22 bp, Artificial Sequence
  Synthetic oligonucleotide; TTT chr2 60458610 60458631 60458627 60458632 +
tttttagtttttaaaaaatgct

SEQ ID NO: 194793 - DNA, 22 bp, Artificial Sequence
  Synthetic oligonucleotide; TTT chr2 60458611 60458632 60458628 60458633 +
ttttagtttttaaaaaatgctc

SEQ ID NO: 194794 - DNA, 22 bp, Artificial Sequence
  Synthetic oligonucleotide; TTT chr2 60458612 60458633 60458629 60458634 +
tttagtttttaaaaaatgctcc

SEQ ID NO: 194795 - DNA, 22 bp, Artificial Sequence
  Synthetic oligonucleotide; TTT chr2 60458613 60458634 60458630 60458635 +
ttagtttttaaaaaatgctcct

SEQ ID NO: 194796 - DNA, 22 bp, Artificial Sequence
  Synthetic oligonucleotide; TTT chr2 60458614 60458635 60458631 60458636 +
tagtttttaaaaaatgctcctc

SEQ ID NO: 194797 - DNA, 22 bp, Artificial Sequence
  Synthetic oligonucleotide; TTT chr2 60458615 60458636 60458632 60458637 +
agtttttaaaaaatgctcctca

SEQ ID NO: 194798 - DNA, 22 bp, Artificial Sequence
  Synthetic oligonucleotide; TTA chr2 60458616 60458637 60458633 60458638 +
gtttttaaaaaatgctcctcaa

SEQ ID NO: 194799 - DNA, 22 bp, Artificial Sequence
  Synthetic oligonucleotide; TTT chr2 60458620 60458641 60458637 60458642 +
ttaaaaaatgctcctcaatgag

SEQ ID NO: 194800 - DNA, 22 bp, Artificial Sequence
  Synthetic oligonucleotide; TTT chr2 60458621 60458642 60458638 60458643 +
taaaaaatgctcctcaatgaga

SEQ ID NO: 194801 - DNA, 22 bp, Artificial Sequence
  Synthetic oligonucleotide; TTT chr2 60458622 60458643 60458639 60458644 +
aaaaaatgctcctcaatgagat

SEQ ID NO: 194802 - DNA, 22 bp, Artificial Sequence
  Synthetic oligonucleotide; TTA chr2 60458623 60458644 60458640 60458645 +
aaaaatgctcctcaatgagatt

SEQ ID NO: 194803 - DNA, 22 bp, Artificial Sequence
  Synthetic oligonucleotide; CTC chr2 60458633 60458654 60458650 60458655 +
ctcaatgagattgtgttcaatt

SEQ ID NO: 194804 - DNA, 22 bp, Artificial Sequence
  Synthetic oligonucleotide; CTC chr2 60458636 60458657 60458653 60458658 +
aatgagattgtgttcaattttt

SEQ ID NO: 194805 - DNA, 22 bp, Artificial Sequence
  Synthetic oligonucleotide; TTG chr2 60458646 60458667 60458663 60458668 +
tgttcaattttttttcagcatt

SEQ ID NO: 194806 - DNA, 22 bp, Artificial Sequence
  Synthetic oligonucleotide; TTC chr2 60458651 60458672 60458668 60458673 +
aattttttttcagcattcttgc

SEQ ID NO: 194807 - DNA, 22 bp, Artificial Sequence
  Synthetic oligonucleotide; TTT chr2 60458656 60458677 60458673 60458678 +
tttttcagcattcttgcaactt

SEQ ID NO: 194808 - DNA, 22 bp, Artificial Sequence
  Synthetic oligonucleotide; TTT chr2 60458657 60458678 60458674 60458679 +
ttttcagcattcttgcaacttt

SEQ ID NO: 194809 - DNA, 22 bp, Artificial Sequence
  Synthetic oligonucleotide; TTT chr2 60458658 60458679 60458675 60458680 +
tttcagcattcttgcaactttt

SEQ ID NO: 194810 - DNA, 22 bp, Artificial Sequence
  Synthetic oligonucleotide; TTT chr2 60458659 60458680 60458676 60458681 +
ttcagcattcttgcaacttttc

SEQ ID NO: 194811 - DNA, 22 bp, Artificial Sequence
  Synthetic oligonucleotide; TTT chr2 60458660 60458681 60458677 60458682 +
tcagcattcttgcaacttttcc

SEQ ID NO: 194812 - DNA, 22 bp, Artificial Sequence
  Synthetic oligonucleotide; TTT chr2 60458661 60458682 60458678 60458683 +
cagcattcttgcaacttttccc

SEQ ID NO: 194813 - DNA, 22 bp, Artificial Sequence
  Synthetic oligonucleotide; TTC chr2 60458662 60458683 60458679 60458684 +
agcattcttgcaacttttccct

SEQ ID NO: 194814 - DNA, 22 bp, Artificial Sequence
  Synthetic oligonucleotide; TTC chr2 60458669 60458690 60458686 60458691 +
ttgcaacttttcccttaagtat

SEQ ID NO: 194815 - DNA, 22 bp, Artificial Sequence
  Synthetic oligonucleotide; CTT chr2 60458671 60458692 60458688 60458693 +
gcaacttttcccttaagtatag

SEQ ID NO: 194816 - DNA, 22 bp, Artificial Sequence
  Synthetic oligonucleotide; TTG chr2 60458672 60458693 60458689 60458694 +
caacttttcccttaagtataga

SEQ ID NO: 194817 - DNA, 22 bp, Artificial Sequence
  Synthetic oligonucleotide; CTT chr2 60458678 60458699 60458695 60458700 +
ttcccttaagtatagacctgta

SEQ ID NO: 194818 - DNA, 22 bp, Artificial Sequence
  Synthetic oligonucleotide; TTT chr2 60458679 60458700 60458696 60458701 +
tcccttaagtatagacctgtaa

SEQ ID NO: 194819 - DNA, 22 bp, Artificial Sequence
  Synthetic oligonucleotide; TTT chr2 60458680 60458701 60458697 60458702 +
cccttaagtatagacctgtaaa

SEQ ID NO: 194820 - DNA, 22 bp, Artificial Sequence
  Synthetic oligonucleotide; TTC chr2 60458681 60458702 60458698 60458703 +
ccttaagtatagacctgtaaac

SEQ ID NO: 194821 - DNA, 22 bp, Artificial Sequence
  Synthetic oligonucleotide; CTT chr2 60458685 60458706 60458702 60458707 +
aagtatagacctgtaaactggg

SEQ ID NO: 194822 - DNA, 22 bp, Artificial Sequence
  Synthetic oligonucleotide; TTA chr2 60458686 60458707 60458703 60458708 +
agtatagacctgtaaactggga

SEQ ID NO: 194823 - DNA, 22 bp, Artificial Sequence
  Synthetic oligonucleotide; CTG chr2 60458698 60458719 60458715 60458720 +
taaactgggaaaattgtacagt

SEQ ID NO: 194824 - DNA, 22 bp, Artificial Sequence
  Synthetic oligonucleotide; CTG chr2 60458705 60458726 60458722 60458727 +
ggaaaattgtacagtgcactta

SEQ ID NO: 194825 - DNA, 22 bp, Artificial Sequence
  Synthetic oligonucleotide; TTG chr2 60458714 60458735 60458731 60458736 +
tacagtgcacttaattgtccta

SEQ ID NO: 194826 - DNA, 22 bp, Artificial Sequence
  Synthetic oligonucleotide; CTT chr2 60458726 60458747 60458743 60458748 +
aattgtcctatctgagcaggtt

SEQ ID NO: 194827 - DNA, 22 bp, Artificial Sequence
  Synthetic oligonucleotide; TTA chr2 60458727 60458748 60458744 60458749 +
attgtcctatctgagcaggttt

SEQ ID NO: 194828 - DNA, 22 bp, Artificial Sequence
  Synthetic oligonucleotide; TTG chr2 60458731 60458752 60458748 60458753 +
tcctatctgagcaggtttattt

SEQ ID NO: 194829 - DNA, 22 bp, Artificial Sequence
  Synthetic oligonucleotide; CTA chr2 60458736 60458757 60458753 60458758 +
tctgagcaggtttattttatac

SEQ ID NO: 194830 - DNA, 22 bp, Artificial Sequence
  Synthetic oligonucleotide; CTG chr2 60458740 60458761 60458757 60458762 +
agcaggtttattttatactcaa

SEQ ID NO: 194831 - DNA, 22 bp, Artificial Sequence
  Synthetic oligonucleotide; TTT chr2 60458749 60458770 60458766 60458771 +
attttatactcaacctctgtat

SEQ ID NO: 194832 - DNA, 22 bp, Artificial Sequence
  Synthetic oligonucleotide; TTA chr2 60458750 60458771 60458767 60458772 +
ttttatactcaacctctgtatc

SEQ ID NO: 194833 - DNA, 22 bp, Artificial Sequence
  Synthetic oligonucleotide; TTT chr2 60458753 60458774 60458770 60458775 +
tatactcaacctctgtatctct

SEQ ID NO: 194834 - DNA, 22 bp, Artificial Sequence
  Synthetic oligonucleotide; TTT chr2 60458754 60458775 60458771 60458776 +
atactcaacctctgtatctctg

SEQ ID NO: 194835 - DNA, 22 bp, Artificial Sequence
  Synthetic oligonucleotide; TTA chr2 60458755 60458776 60458772 60458777 +
tactcaacctctgtatctctga

SEQ ID NO: 194836 - DNA, 22 bp, Artificial Sequence
  Synthetic oligonucleotide; CTC chr2 60458760 60458781 60458777 60458782 +
aacctctgtatctctgattaga

SEQ ID NO: 194837 - DNA, 22 bp, Artificial Sequence
  Synthetic oligonucleotide; CTC chr2 60458766 60458787 60458783 60458788 +
tgtatctctgattagagaaaag

SEQ ID NO: 194838 - DNA, 22 bp, Artificial Sequence
  Synthetic oligonucleotide; CTG chr2 60458768 60458789 60458785 60458790 +
tatctctgattagagaaaagat

SEQ ID NO: 194839 - DNA, 22 bp, Artificial Sequence
  Synthetic oligonucleotide; CTC chr2 60458774 60458795 60458791 60458796 +
tgattagagaaaagatacagat

SEQ ID NO: 194840 - DNA, 22 bp, Artificial Sequence
  Synthetic oligonucleotide; CTG chr2 60458776 60458797 60458793 60458798 +
attagagaaaagatacagatat

SEQ ID NO: 194841 - DNA, 22 bp, Artificial Sequence
  Synthetic oligonucleotide; TTA chr2 60458780 60458801 60458797 60458802 +
gagaaaagatacagatatcaca

SEQ ID NO: 194842 - DNA, 22 bp, Artificial Sequence
  Synthetic oligonucleotide; CTA chr2 60458819 60458840 60458836 60458841 +
tttgaacaccaactggggcaga

SEQ ID NO: 194843 - DNA, 22 bp, Artificial Sequence
  Synthetic oligonucleotide; TTT chr2 60458822 60458843 60458839 60458844 +
gaacaccaactggggcagatgc

SEQ ID NO: 194844 - DNA, 22 bp, Artificial Sequence
  Synthetic oligonucleotide; TTG chr2 60458823 60458844 60458840 60458845 +
aacaccaactggggcagatgct

SEQ ID NO: 194845 - DNA, 22 bp, Artificial Sequence
  Synthetic oligonucleotide; CTG chr2 60458834 60458855 60458851 60458856 +
gggcagatgctagcttaataaa

SEQ ID NO: 194846 - DNA, 22 bp, Artificial Sequence
  Synthetic oligonucleotide; CTA chr2 60458846 60458867 60458863 60458868 +
gcttaataaaaaagaaaaaatt

SEQ ID NO: 194847 - DNA, 22 bp, Artificial Sequence
  Synthetic oligonucleotide; CTT chr2 60458850 60458871 60458867 60458872 +
aataaaaaagaaaaaattaaaa

SEQ ID NO: 194848 - DNA, 22 bp, Artificial Sequence
  Synthetic oligonucleotide; TTA chr2 60458851 60458872 60458868 60458873 +
ataaaaaagaaaaaattaaaaa

SEQ ID NO: 194849 - DNA, 22 bp, Artificial Sequence
  Synthetic oligonucleotide; TTA chr2 60458869 60458890 60458886 60458891 +
aaaaaataaaaataaaaacaat

SEQ ID NO: 194850 - DNA, 22 bp, Artificial Sequence
  Synthetic oligonucleotide; CTC chr2 60458899 60458920 60458916 60458921 +
ttccatgttaacacaaatagca

SEQ ID NO: 194851 - DNA, 22 bp, Artificial Sequence
  Synthetic oligonucleotide; CTT chr2 60458901 60458922 60458918 60458923 +
ccatgttaacacaaatagcaca

SEQ ID NO: 194852 - DNA, 22 bp, Artificial Sequence
  Synthetic oligonucleotide; TTC chr2 60458902 60458923 60458919 60458924 +
catgttaacacaaatagcacac

SEQ ID NO: 194853 - DNA, 22 bp, Artificial Sequence
  Synthetic oligonucleotide; TTA chr2 60458909 60458930 60458926 60458931 +
acacaaatagcacacagtgtat

SEQ ID NO: 194854 - DNA, 22 bp, Artificial Sequence
  Synthetic oligonucleotide; CTT chr2 60458954 60458975 60458971 60458976 +
ttagggagcacagacatatata

SEQ ID NO: 194855 - DNA, 22 bp, Artificial Sequence
  Synthetic oligonucleotide; TTT chr2 60458955 60458976 60458972 60458977 +
tagggagcacagacatatatac

SEQ ID NO: 194856 - DNA, 22 bp, Artificial Sequence
  Synthetic oligonucleotide; TTT chr2 60458956 60458977 60458973 60458978 +
agggagcacagacatatatact

SEQ ID NO: 194857 - DNA, 22 bp, Artificial Sequence
  Synthetic oligonucleotide; TTA chr2 60458957 60458978 60458974 60458979 +
gggagcacagacatatatactg

SEQ ID NO: 194858 - DNA, 22 bp, Artificial Sequence
  Synthetic oligonucleotide; CTG chr2 60458979 60459000 60458996 60459001 +
ctactcttaaaattctttctct

SEQ ID NO: 194859 - DNA, 22 bp, Artificial Sequence
  Synthetic oligonucleotide; CTA chr2 60458982 60459003 60458999 60459004 +
ctcttaaaattctttctcttct

SEQ ID NO: 194860 - DNA, 22 bp, Artificial Sequence
  Synthetic oligonucleotide; CTC chr2 60458985 60459006 60459002 60459007 +
ttaaaattctttctcttctttt

SEQ ID NO: 194861 - DNA, 22 bp, Artificial Sequence
  Synthetic oligonucleotide; CTT chr2 60458987 60459008 60459004 60459009 +
aaaattctttctcttctttttt

SEQ ID NO: 194862 - DNA, 22 bp, Artificial Sequence
  Synthetic oligonucleotide; TTA chr2 60458988 60459009 60459005 60459010 +
aaattctttctcttcttttttt

SEQ ID NO: 194863 - DNA, 22 bp, Artificial Sequence
  Synthetic oligonucleotide; TTC chr2 60458994 60459015 60459011 60459016 +
tttctcttctttttttaagaat

SEQ ID NO: 194864 - DNA, 22 bp, Artificial Sequence
  Synthetic oligonucleotide; CTT chr2 60458996 60459017 60459013 60459018 +
tctcttctttttttaagaatgt

SEQ ID NO: 194865 - DNA, 22 bp, Artificial Sequence
  Synthetic oligonucleotide; TTT chr2 60458997 60459018 60459014 60459019 +
ctcttctttttttaagaatgtc

SEQ ID NO: 194866 - DNA, 22 bp, Artificial Sequence
  Synthetic oligonucleotide; TTC chr2 60458998 60459019 60459015 60459020 +
tcttctttttttaagaatgtca

SEQ ID NO: 194867 - DNA, 22 bp, Artificial Sequence
  Synthetic oligonucleotide; CTC chr2 60459000 60459021 60459017 60459022 +
ttctttttttaagaatgtcaca

SEQ ID NO: 194868 - DNA, 22 bp, Artificial Sequence
  Synthetic oligonucleotide; CTT chr2 60459002 60459023 60459019 60459024 +
ctttttttaagaatgtcacatt

SEQ ID NO: 194869 - DNA, 22 bp, Artificial Sequence
  Synthetic oligonucleotide; TTC chr2 60459003 60459024 60459020 60459025 +
tttttttaagaatgtcacattt

SEQ ID NO: 194870 - DNA, 22 bp, Artificial Sequence
  Synthetic oligonucleotide; CTT chr2 60459005 60459026 60459022 60459027 +
tttttaagaatgtcacatttaa

SEQ ID NO: 194871 - DNA, 22 bp, Artificial Sequence
  Synthetic oligonucleotide; TTT chr2 60459006 60459027 60459023 60459028 +
ttttaagaatgtcacatttaaa

SEQ ID NO: 194872 - DNA, 22 bp, Artificial Sequence
  Synthetic oligonucleotide; TTT chr2 60459007 60459028 60459024 60459029 +
tttaagaatgtcacatttaaat

SEQ ID NO: 194873 - DNA, 22 bp, Artificial Sequence
  Synthetic oligonucleotide; TTT chr2 60459008 60459029 60459025 60459030 +
ttaagaatgtcacatttaaatg

SEQ ID NO: 194874 - DNA, 22 bp, Artificial Sequence
  Synthetic oligonucleotide; TTT chr2 60459009 60459030 60459026 60459031 +
taagaatgtcacatttaaatgc

SEQ ID NO: 194875 - DNA, 22 bp, Artificial Sequence
  Synthetic oligonucleotide; TTT chr2 60459010 60459031 60459027 60459032 +
aagaatgtcacatttaaatgca

SEQ ID NO: 194876 - DNA, 22 bp, Artificial Sequence
  Synthetic oligonucleotide; TTA chr2 60459011 60459032 60459028 60459033 +
agaatgtcacatttaaatgcaa

SEQ ID NO: 194877 - DNA, 22 bp, Artificial Sequence
  Synthetic oligonucleotide; TTT chr2 60459025 60459046 60459042 60459047 +
aaatgcaagtcttaagaattca

SEQ ID NO: 194878 - DNA, 22 bp, Artificial Sequence
  Synthetic oligonucleotide; TTA chr2 60459026 60459047 60459043 60459048 +
aatgcaagtcttaagaattcat

SEQ ID NO: 194879 - DNA, 22 bp, Artificial Sequence
  Synthetic oligonucleotide; CTT chr2 60459038 60459059 60459055 60459060 +
aagaattcatagttaatcatca

SEQ ID NO: 194880 - DNA, 22 bp, Artificial Sequence
  Synthetic oligonucleotide; TTA chr2 60459039 60459060 60459056 60459061 +
agaattcatagttaatcatcat

SEQ ID NO: 194881 - DNA, 22 bp, Artificial Sequence
  Synthetic oligonucleotide; TTC chr2 60459046 60459067 60459063 60459068 +
atagttaatcatcattgtatca

SEQ ID NO: 194882 - DNA, 22 bp, Artificial Sequence
  Synthetic oligonucleotide; TTA chr2 60459053 60459074 60459070 60459075 +
atcatcattgtatcaatattag

SEQ ID NO: 194883 - DNA, 22 bp, Artificial Sequence
  Synthetic oligonucleotide; TTG chr2 60459063 60459084 60459080 60459085 +
tatcaatattagcttatatacc

SEQ ID NO: 194884 - DNA, 22 bp, Artificial Sequence
  Synthetic oligonucleotide; TTA chr2 60459074 60459095 60459091 60459096 +
gcttatatacctgttctagttt

SEQ ID NO: 194885 - DNA, 22 bp, Artificial Sequence
  Synthetic oligonucleotide; CTT chr2 60459078 60459099 60459095 60459100 +
atatacctgttctagttttaaa

SEQ ID NO: 194886 - DNA, 22 bp, Artificial Sequence
  Synthetic oligonucleotide; TTA chr2 60459079 60459100 60459096 60459101 +
tatacctgttctagttttaaat

SEQ ID NO: 194887 - DNA, 22 bp, Artificial Sequence
  Synthetic oligonucleotide; CTG chr2 60459087 60459108 60459104 60459109 +
ttctagttttaaatggcaaata

SEQ ID NO: 194888 - DNA, 22 bp, Artificial Sequence
  Synthetic oligonucleotide; TTC chr2 60459090 60459111 60459107 60459112 +
tagttttaaatggcaaatagta

SEQ ID NO: 194889 - DNA, 22 bp, Artificial Sequence
  Synthetic oligonucleotide; CTA chr2 60459092 60459113 60459109 60459114 +
gttttaaatggcaaatagtacc

SEQ ID NO: 194890 - DNA, 22 bp, Artificial Sequence
  Synthetic oligonucleotide; TTT chr2 60459096 60459117 60459113 60459118 +
taaatggcaaatagtaccacgt

SEQ ID NO: 194891 - DNA, 22 bp, Artificial Sequence
  Synthetic oligonucleotide; TTT chr2 60459097 60459118 60459114 60459119 +
aaatggcaaatagtaccacgtt

SEQ ID NO: 194892 - DNA, 22 bp, Artificial Sequence
  Synthetic oligonucleotide; TTA chr2 60459098 60459119 60459115 60459120 +
aatggcaaatagtaccacgttg

SEQ ID NO: 194893 - DNA, 22 bp, Artificial Sequence
  Synthetic oligonucleotide; TTG chr2 60459120 60459141 60459137 60459142 +
tgctaataaatcatattatttt

SEQ ID NO: 194894 - DNA, 22 bp, Artificial Sequence
  Synthetic oligonucleotide; CTA chr2 60459125 60459146 60459142 60459147 +
ataaatcatattattttcttct

SEQ ID NO: 194895 - DNA, 22 bp, Artificial Sequence
  Synthetic oligonucleotide; TTA chr2 60459138 60459159 60459155 60459160 +
ttttcttctgttcccctctgtc

SEQ ID NO: 194896 - DNA, 22 bp, Artificial Sequence
  Synthetic oligonucleotide; TTT chr2 60459141 60459162 60459158 60459163 +
tcttctgttcccctctgtcaaa

SEQ ID NO: 194897 - DNA, 22 bp, Artificial Sequence
  Synthetic oligonucleotide; TTT chr2 60459142 60459163 60459159 60459164 +
cttctgttcccctctgtcaaac

SEQ ID NO: 194898 - DNA, 22 bp, Artificial Sequence
  Synthetic oligonucleotide; TTC chr2 60459143 60459164 60459160 60459165 +
ttctgttcccctctgtcaaacc

SEQ ID NO: 194899 - DNA, 22 bp, Artificial Sequence
  Synthetic oligonucleotide; CTT chr2 60459145 60459166 60459162 60459167 +
ctgttcccctctgtcaaacctt

SEQ ID NO: 194900 - DNA, 22 bp, Artificial Sequence
  Synthetic oligonucleotide; TTC chr2 60459146 60459167 60459163 60459168 +
tgttcccctctgtcaaacctta

SEQ ID NO: 194901 - DNA, 22 bp, Artificial Sequence
  Synthetic oligonucleotide; CTG chr2 60459148 60459169 60459165 60459170 +
ttcccctctgtcaaaccttatt

SEQ ID NO: 194902 - DNA, 22 bp, Artificial Sequence
  Synthetic oligonucleotide; TTC chr2 60459151 60459172 60459168 60459173 +
ccctctgtcaaaccttattgtc

SEQ ID NO: 194903 - DNA, 22 bp, Artificial Sequence
  Synthetic oligonucleotide; CTC chr2 60459156 60459177 60459173 60459178 +
tgtcaaaccttattgtcagcct

SEQ ID NO: 194904 - DNA, 22 bp, Artificial Sequence
  Synthetic oligonucleotide; CTG chr2 60459158 60459179 60459175 60459180 +
tcaaaccttattgtcagcctct

SEQ ID NO: 194905 - DNA, 22 bp, Artificial Sequence
  Synthetic oligonucleotide; CTT chr2 60459167 60459188 60459184 60459189 +
attgtcagcctcttcctttcaa

SEQ ID NO: 194906 - DNA, 22 bp, Artificial Sequence
  Synthetic oligonucleotide; TTA chr2 60459168 60459189 60459185 60459190 +
ttgtcagcctcttcctttcaat

SEQ ID NO: 194907 - DNA, 22 bp, Artificial Sequence
  Synthetic oligonucleotide; TTG chr2 60459171 60459192 60459188 60459193 +
tcagcctcttcctttcaatatg

SEQ ID NO: 194908 - DNA, 22 bp, Artificial Sequence
  Synthetic oligonucleotide; CTC chr2 60459179 60459200 60459196 60459201 +
ttcctttcaatatggtatacaa

SEQ ID NO: 194909 - DNA, 22 bp, Artificial Sequence
  Synthetic oligonucleotide; CTT chr2 60459181 60459202 60459198 60459203 +
cctttcaatatggtatacaagg

SEQ ID NO: 194910 - DNA, 22 bp, Artificial Sequence
  Synthetic oligonucleotide; TTC chr2 60459182 60459203 60459199 60459204 +
ctttcaatatggtatacaaggt

SEQ ID NO: 194911 - DNA, 22 bp, Artificial Sequence
  Synthetic oligonucleotide; CTT chr2 60459185 60459206 60459202 60459207 +
tcaatatggtatacaaggtctt

SEQ ID NO: 194912 - DNA, 22 bp, Artificial Sequence
  Synthetic oligonucleotide; TTT chr2 60459186 60459207 60459203 60459208 +
caatatggtatacaaggtctta

SEQ ID NO: 194913 - DNA, 22 bp, Artificial Sequence
  Synthetic oligonucleotide; TTC chr2 60459187 60459208 60459204 60459209 +
aatatggtatacaaggtcttaa

SEQ ID NO: 194914 - DNA, 22 bp, Artificial Sequence
  Synthetic oligonucleotide; CTT chr2 60459207 60459228 60459224 60459229 +
aaagtttatcatttgattgtcc

SEQ ID NO: 194915 - DNA, 22 bp, Artificial Sequence
  Synthetic oligonucleotide; TTA chr2 60459208 60459229 60459225 60459230 +
aagtttatcatttgattgtcca

SEQ ID NO: 194916 - DNA, 22 bp, Artificial Sequence
  Synthetic oligonucleotide; TTT chr2 60459214 60459235 60459231 60459236 +
atcatttgattgtccacttgac

SEQ ID NO: 194917 - DNA, 22 bp, Artificial Sequence
  Synthetic oligonucleotide; TTA chr2 60459215 60459236 60459232 60459237 +
tcatttgattgtccacttgaca

SEQ ID NO: 194918 - DNA, 22 bp, Artificial Sequence
  Synthetic oligonucleotide; TTT chr2 60459221 60459242 60459238 60459243 +
gattgtccacttgacaaccaag

SEQ ID NO: 194919 - DNA, 22 bp, Artificial Sequence
  Synthetic oligonucleotide; TTG chr2 60459222 60459243 60459239 60459244 +
attgtccacttgacaaccaagt

SEQ ID NO: 194920 - DNA, 22 bp, Artificial Sequence
  Synthetic oligonucleotide; TTG chr2 60459226 60459247 60459243 60459248 +
tccacttgacaaccaagtagat

SEQ ID NO: 194921 - DNA, 22 bp, Artificial Sequence
  Synthetic oligonucleotide; CTT chr2 60459233 60459254 60459250 60459255 +
gacaaccaagtagatctggatc

SEQ ID NO: 194922 - DNA, 22 bp, Artificial Sequence
  Synthetic oligonucleotide; TTG chr2 60459234 60459255 60459251 60459256 +
acaaccaagtagatctggatct

SEQ ID NO: 194923 - DNA, 22 bp, Artificial Sequence
  Synthetic oligonucleotide; CTG chr2 60459251 60459272 60459268 60459273 +
gatctatttcttttggtgccag

SEQ ID NO: 194924 - DNA, 22 bp, Artificial Sequence
  Synthetic oligonucleotide; CTA chr2 60459257 60459278 60459274 60459279 +
tttcttttggtgccagtatttt

SEQ ID NO: 194925 - DNA, 22 bp, Artificial Sequence
  Synthetic oligonucleotide; TTT chr2 60459260 60459281 60459277 60459282 +
cttttggtgccagtatttttaa

SEQ ID NO: 194926 - DNA, 22 bp, Artificial Sequence
  Synthetic oligonucleotide; TTC chr2 60459261 60459282 60459278 60459283 +
ttttggtgccagtatttttaaa

SEQ ID NO: 194927 - DNA, 22 bp, Artificial Sequence
  Synthetic oligonucleotide; CTT chr2 60459263 60459284 60459280 60459285 +
ttggtgccagtatttttaaaaa

SEQ ID NO: 194928 - DNA, 22 bp, Artificial Sequence
  Synthetic oligonucleotide; TTT chr2 60459264 60459285 60459281 60459286 +
tggtgccagtatttttaaaaag

SEQ ID NO: 194929 - DNA, 22 bp, Artificial Sequence
  Synthetic oligonucleotide; TTT chr2 60459265 60459286 60459282 60459287 +
ggtgccagtatttttaaaaaga

SEQ ID NO: 194930 - DNA, 22 bp, Artificial Sequence
  Synthetic oligonucleotide; TTG chr2 60459266 60459287 60459283 60459288 +
gtgccagtatttttaaaaagac

SEQ ID NO: 194931 - DNA, 22 bp, Artificial Sequence
  Synthetic oligonucleotide; TTT chr2 60459278 60459299 60459295 60459300 +
ttaaaaagacattattaaagca

SEQ ID NO: 194932 - DNA, 22 bp, Artificial Sequence
  Synthetic oligonucleotide; TTT chr2 60459279 60459300 60459296 60459301 +
taaaaagacattattaaagcaa

SEQ ID NO: 194933 - DNA, 22 bp, Artificial Sequence
  Synthetic oligonucleotide; TTT chr2 60459280 60459301 60459297 60459302 +
aaaaagacattattaaagcaaa

SEQ ID NO: 194934 - DNA, 22 bp, Artificial Sequence
  Synthetic oligonucleotide; TTA chr2 60459281 60459302 60459298 60459303 +
aaaagacattattaaagcaaat

SEQ ID NO: 194935 - DNA, 22 bp, Artificial Sequence
  Synthetic oligonucleotide; TTA chr2 60459292 60459313 60459309 60459314 +
ttaaagcaaatatcttcataaa

SEQ ID NO: 194936 - DNA, 22 bp, Artificial Sequence
  Synthetic oligonucleotide; TTA chr2 60459295 60459316 60459312 60459317 +
aagcaaatatcttcataaaatg

SEQ ID NO: 194937 - DNA, 22 bp, Artificial Sequence
  Synthetic oligonucleotide; CTT chr2 60459308 60459329 60459325 60459330 +
cataaaatgaactccttactag

SEQ ID NO: 194938 - DNA, 22 bp, Artificial Sequence
  Synthetic oligonucleotide; TTC chr2 60459309 60459330 60459326 60459331 +
ataaaatgaactccttactagt

SEQ ID NO: 194939 - DNA, 22 bp, Artificial Sequence
  Synthetic oligonucleotide; CTC chr2 60459322 60459343 60459339 60459344 +
cttactagtgtatttaattgcg

SEQ ID NO: 194940 - DNA, 22 bp, Artificial Sequence
  Synthetic oligonucleotide; CTT chr2 60459325 60459346 60459342 60459347 +
actagtgtatttaattgcgttc

SEQ ID NO: 194941 - DNA, 22 bp, Artificial Sequence
  Synthetic oligonucleotide; TTA chr2 60459326 60459347 60459343 60459348 +
ctagtgtatttaattgcgttcc

SEQ ID NO: 194942 - DNA, 22 bp, Artificial Sequence
  Synthetic oligonucleotide; CTA chr2 60459329 60459350 60459346 60459351 +
gtgtatttaattgcgttccagg

SEQ ID NO: 194943 - DNA, 22 bp, Artificial Sequence
  Synthetic oligonucleotide; TTT chr2 60459337 60459358 60459354 60459359 +
aattgcgttccagggcttttgc

SEQ ID NO: 194944 - DNA, 22 bp, Artificial Sequence
  Synthetic oligonucleotide; TTA chr2 60459338 60459359 60459355 60459360 +
attgcgttccagggcttttgca

SEQ ID NO: 194945 - DNA, 22 bp, Artificial Sequence
  Synthetic oligonucleotide; TTG chr2 60459342 60459363 60459359 60459364 +
cgttccagggcttttgcacatt

SEQ ID NO: 194946 - DNA, 22 bp, Artificial Sequence
  Synthetic oligonucleotide; TTC chr2 60459347 60459368 60459364 60459369 +
cagggcttttgcacattacaca

SEQ ID NO: 194947 - DNA, 22 bp, Artificial Sequence
  Synthetic oligonucleotide; CTT chr2 60459355 60459376 60459372 60459377 +
ttgcacattacacattcaattt

SEQ ID NO: 194948 - DNA, 22 bp, Artificial Sequence
  Synthetic oligonucleotide; TTT chr2 60459356 60459377 60459373 60459378 +
tgcacattacacattcaattta

SEQ ID NO: 194949 - DNA, 22 bp, Artificial Sequence
  Synthetic oligonucleotide; TTT chr2 60459357 60459378 60459374 60459379 +
gcacattacacattcaatttaa

SEQ ID NO: 194950 - DNA, 22 bp, Artificial Sequence
  Synthetic oligonucleotide; TTG chr2 60459358 60459379 60459375 60459380 +
cacattacacattcaatttaat

SEQ ID NO: 194951 - DNA, 22 bp, Artificial Sequence
  Synthetic oligonucleotide; TTA chr2 60459365 60459386 60459382 60459387 +
cacattcaatttaatcattgtt

SEQ ID NO: 194952 - DNA, 22 bp, Artificial Sequence
  Synthetic oligonucleotide; TTC chr2 60459372 60459393 60459389 60459394 +
aatttaatcattgtttaaaaaa

SEQ ID NO: 194953 - DNA, 22 bp, Artificial Sequence
  Synthetic oligonucleotide; TTT chr2 60459377 60459398 60459394 60459399 +
aatcattgtttaaaaaaaataa

SEQ ID NO: 194954 - DNA, 22 bp, Artificial Sequence
  Synthetic oligonucleotide; TTA chr2 60459378 60459399 60459395 60459400 +
atcattgtttaaaaaaaataaa

SEQ ID NO: 194955 - DNA, 22 bp, Artificial Sequence
  Synthetic oligonucleotide; TTG chr2 60459385 60459406 60459402 60459407 +
tttaaaaaaaataaaactttgg

SEQ ID NO: 194956 - DNA, 22 bp, Artificial Sequence
  Synthetic oligonucleotide; TTT chr2 60459388 60459409 60459405 60459410 +
aaaaaaaataaaactttgggca

SEQ ID NO: 194957 - DNA, 22 bp, Artificial Sequence
  Synthetic oligonucleotide; TTA chr2 60459389 60459410 60459406 60459411 +
aaaaaaataaaactttgggcaa

SEQ ID NO: 194958 - DNA, 22 bp, Artificial Sequence
  Synthetic oligonucleotide; CTT chr2 60459404 60459425 60459421 60459426 +
tgggcaaaacagcccatttctt

SEQ ID NO: 194959 - DNA, 22 bp, Artificial Sequence
  Synthetic oligonucleotide; TTT chr2 60459405 60459426 60459422 60459427 +
gggcaaaacagcccatttcttt

SEQ ID NO: 194960 - DNA, 22 bp, Artificial Sequence
  Synthetic oligonucleotide; TTG chr2 60459406 60459427 60459423 60459428 +
ggcaaaacagcccatttctttt

SEQ ID NO: 194961 - DNA, 22 bp, Artificial Sequence
  Synthetic oligonucleotide; TTT chr2 60459423 60459444 60459440 60459445 +
cttttaagctctcaccaggagc

SEQ ID NO: 194962 - DNA, 22 bp, Artificial Sequence
  Synthetic oligonucleotide; TTC chr2 60459424 60459445 60459441 60459446 +
ttttaagctctcaccaggagca

SEQ ID NO: 194963 - DNA, 22 bp, Artificial Sequence
  Synthetic oligonucleotide; CTT chr2 60459426 60459447 60459443 60459448 +
ttaagctctcaccaggagcaaa

SEQ ID NO: 194964 - DNA, 22 bp, Artificial Sequence
  Synthetic oligonucleotide; TTT chr2 60459427 60459448 60459444 60459449 +
taagctctcaccaggagcaaag

SEQ ID NO: 194965 - DNA, 22 bp, Artificial Sequence
  Synthetic oligonucleotide; TTT chr2 60459428 60459449 60459445 60459450 +
aagctctcaccaggagcaaagt

SEQ ID NO: 194966 - DNA, 22 bp, Artificial Sequence
  Synthetic oligonucleotide; TTA chr2 60459429 60459450 60459446 60459451 +
agctctcaccaggagcaaagta

SEQ ID NO: 194967 - DNA, 22 bp, Artificial Sequence
  Synthetic oligonucleotide; CTC chr2 60459434 60459455 60459451 60459456 +
tcaccaggagcaaagtagcttt

SEQ ID NO: 194968 - DNA, 22 bp, Artificial Sequence
  Synthetic oligonucleotide; CTC chr2 60459436 60459457 60459453 60459458 +
accaggagcaaagtagctttta

SEQ ID NO: 194969 - DNA, 22 bp, Artificial Sequence
  Synthetic oligonucleotide; CTT chr2 60459455 60459476 60459472 60459477 +
ttatactggtataatcagtttt

SEQ ID NO: 194970 - DNA, 22 bp, Artificial Sequence
  Synthetic oligonucleotide; TTT chr2 60459456 60459477 60459473 60459478 +
tatactggtataatcagttttg

SEQ ID NO: 194971 - DNA, 22 bp, Artificial Sequence
  Synthetic oligonucleotide; TTT chr2 60459457 60459478 60459474 60459479 +
atactggtataatcagttttgt

SEQ ID NO: 194972 - DNA, 22 bp, Artificial Sequence
  Synthetic oligonucleotide; TTA chr2 60459458 60459479 60459475 60459480 +
tactggtataatcagttttgtt

SEQ ID NO: 194973 - DNA, 22 bp, Artificial Sequence
  Synthetic oligonucleotide; CTG chr2 60459463 60459484 60459480 60459485 +
gtataatcagttttgtttataa

SEQ ID NO: 194974 - DNA, 22 bp, Artificial Sequence
  Synthetic oligonucleotide; TTT chr2 60459476 60459497 60459493 60459498 +
tgtttataaaattaaactaaag

SEQ ID NO: 194975 - DNA, 22 bp, Artificial Sequence
  Synthetic oligonucleotide; TTT chr2 60459477 60459498 60459494 60459499 +
gtttataaaattaaactaaagg

SEQ ID NO: 194976 - DNA, 22 bp, Artificial Sequence
  Synthetic oligonucleotide; TTG chr2 60459478 60459499 60459495 60459500 +
tttataaaattaaactaaagga

SEQ ID NO: 194977 - DNA, 22 bp, Artificial Sequence
  Synthetic oligonucleotide; TTT chr2 60459481 60459502 60459498 60459503 +
ataaaattaaactaaaggaaaa

SEQ ID NO: 194978 - DNA, 22 bp, Artificial Sequence
  Synthetic oligonucleotide; TTA chr2 60459482 60459503 60459499 60459504 +
taaaattaaactaaaggaaaaa

SEQ ID NO: 194979 - DNA, 22 bp, Artificial Sequence
  Synthetic oligonucleotide; TTA chr2 60459490 60459511 60459507 60459512 +
aactaaaggaaaaatgatgatt

SEQ ID NO: 194980 - DNA, 22 bp, Artificial Sequence
  Synthetic oligonucleotide; CTA chr2 60459495 60459516 60459512 60459517 +
aaggaaaaatgatgattaacta

SEQ ID NO: 194981 - DNA, 22 bp, Artificial Sequence
  Synthetic oligonucleotide; TTA chr2 60459513 60459534 60459530 60459535 +
actaggacataatgggtcatct

SEQ ID NO: 194982 - DNA, 22 bp, Artificial Sequence
  Synthetic oligonucleotide; CTA chr2 60459517 60459538 60459534 60459539 +
ggacataatgggtcatcttttt

SEQ ID NO: 194983 - DNA, 22 bp, Artificial Sequence
  Synthetic oligonucleotide; CTT chr2 60459536 60459557 60459553 60459558 +
tttaggtagccattgttgtgag

SEQ ID NO: 194984 - DNA, 22 bp, Artificial Sequence
  Synthetic oligonucleotide; TTT chr2 60459537 60459558 60459554 60459559 +
ttaggtagccattgttgtgaga

SEQ ID NO: 194985 - DNA, 22 bp, Artificial Sequence
  Synthetic oligonucleotide; TTT chr2 60459538 60459559 60459555 60459560 +
taggtagccattgttgtgagaa

SEQ ID NO: 194986 - DNA, 22 bp, Artificial Sequence
  Synthetic oligonucleotide; TTT chr2 60459539 60459560 60459556 60459561 +
aggtagccattgttgtgagaaa

SEQ ID NO: 194987 - DNA, 22 bp, Artificial Sequence
  Synthetic oligonucleotide; TTA chr2 60459540 60459561 60459557 60459562 +
ggtagccattgttgtgagaaat

SEQ ID NO: 194988 - DNA, 22 bp, Artificial Sequence
  Synthetic oligonucleotide; TTG chr2 60459551 60459572 60459568 60459573 +
ttgtgagaaatacaatatagaa

SEQ ID NO: 194989 - DNA, 22 bp, Artificial Sequence
  Synthetic oligonucleotide; TTG chr2 60459554 60459575 60459571 60459576 +
tgagaaatacaatatagaatta

SEQ ID NO: 194990 - DNA, 22 bp, Artificial Sequence
  Synthetic oligonucleotide; TTA chr2 60459576 60459597 60459593 60459598 +
tatgctagttcctaaggtttat

SEQ ID NO: 194991 - DNA, 22 bp, Artificial Sequence
  Synthetic oligonucleotide; CTA chr2 60459583 60459604 60459600 60459605 +
gttcctaaggtttattacctca

SEQ ID NO: 194992 - DNA, 22 bp, Artificial Sequence
  Synthetic oligonucleotide; TTC chr2 60459587 60459608 60459604 60459609 +
ctaaggtttattacctcaccca

SEQ ID NO: 194993 - DNA, 22 bp, Artificial Sequence
  Synthetic oligonucleotide; CTA chr2 60459590 60459611 60459607 60459612 +
aggtttattacctcacccaatg

SEQ ID NO: 194994 - DNA, 22 bp, Artificial Sequence
  Synthetic oligonucleotide; TTT chr2 60459596 60459617 60459613 60459618 +
attacctcacccaatgctgaat

SEQ ID NO: 194995 - DNA, 22 bp, Artificial Sequence
  Synthetic oligonucleotide; TTA chr2 60459597 60459618 60459614 60459619 +
ttacctcacccaatgctgaatt

SEQ ID NO: 194996 - DNA, 22 bp, Artificial Sequence
  Synthetic oligonucleotide; TTA chr2 60459600 60459621 60459617 60459622 +
cctcacccaatgctgaattaag

SEQ ID NO: 194997 - DNA, 22 bp, Artificial Sequence
  Synthetic oligonucleotide; CTC chr2 60459604 60459625 60459621 60459626 +
acccaatgctgaattaagctac

SEQ ID NO: 194998 - DNA, 22 bp, Artificial Sequence
  Synthetic oligonucleotide; CTG chr2 60459615 60459636 60459632 60459637 +
aattaagctacaagtttataac

SEQ ID NO: 194999 - DNA, 22 bp, Artificial Sequence
  Synthetic oligonucleotide; TTA chr2 60459620 60459641 60459637 60459642 +
agctacaagtttataacaagta

SEQ ID NO: 195000 - DNA, 22 bp, Artificial Sequence
  Synthetic oligonucleotide; CTA chr2 60459625 60459646 60459642 60459647 +
caagtttataacaagtagaaag

SEQ ID NO: 195001 - DNA, 22 bp, Artificial Sequence
  Synthetic oligonucleotide; TTT chr2 60459632 60459653 60459649 60459654 +
ataacaagtagaaagaaccatc

SEQ ID NO: 195002 - DNA, 22 bp, Artificial Sequence
  Synthetic oligonucleotide; TTA chr2 60459633 60459654 60459650 60459655 +
taacaagtagaaagaaccatcg

SEQ ID NO: 195003 - DNA, 22 bp, Artificial Sequence
  Synthetic oligonucleotide; TTT chr2 60459664 60459685 60459681 60459686 +
taatagatccaaggcactcata

SEQ ID NO: 195004 - DNA, 22 bp, Artificial Sequence
  Synthetic oligonucleotide; TTT chr2 60459665 60459686 60459682 60459687 +
aatagatccaaggcactcatat

SEQ ID NO: 195005 - DNA, 22 bp, Artificial Sequence
  Synthetic oligonucleotide; TTA chr2 60459666 60459687 60459683 60459688 +
atagatccaaggcactcatatt

SEQ ID NO: 195006 - DNA, 22 bp, Artificial Sequence
  Synthetic oligonucleotide; CTC chr2 60459683 60459704 60459700 60459705 +
atattttaaaaccaaatgatag

SEQ ID NO: 195007 - DNA, 22 bp, Artificial Sequence
  Synthetic oligonucleotide; TTT chr2 60459689 60459710 60459706 60459711 +
taaaaccaaatgatagaataaa

SEQ ID NO: 195008 - DNA, 22 bp, Artificial Sequence
  Synthetic oligonucleotide; TTT chr2 60459690 60459711 60459707 60459712 +
aaaaccaaatgatagaataaac

SEQ ID NO: 195009 - DNA, 22 bp, Artificial Sequence
  Synthetic oligonucleotide; TTA chr2 60459691 60459712 60459708 60459713 +
aaaccaaatgatagaataaact

SEQ ID NO: 195010 - DNA, 22 bp, Artificial Sequence
  Synthetic oligonucleotide; CTT chr2 60459714 60459735 60459731 60459736 +
gttctgtttttctgttaatttg

SEQ ID NO: 195011 - DNA, 22 bp, Artificial Sequence
  Synthetic oligonucleotide; TTG chr2 60459715 60459736 60459732 60459737 +
ttctgtttttctgttaatttgt

SEQ ID NO: 195012 - DNA, 22 bp, Artificial Sequence
  Synthetic oligonucleotide; TTC chr2 60459718 60459739 60459735 60459740 +
tgtttttctgttaatttgtcaa

SEQ ID NO: 195013 - DNA, 22 bp, Artificial Sequence
  Synthetic oligonucleotide; CTG chr2 60459720 60459741 60459737 60459742 +
tttttctgttaatttgtcaatt

SEQ ID NO: 195014 - DNA, 22 bp, Artificial Sequence
  Synthetic oligonucleotide; TTT chr2 60459723 60459744 60459740 60459745 +
ttctgttaatttgtcaattcaa

SEQ ID NO: 195015 - DNA, 22 bp, Artificial Sequence
  Synthetic oligonucleotide; TTT chr2 60459724 60459745 60459741 60459746 +
tctgttaatttgtcaattcaag

SEQ ID NO: 195016 - DNA, 22 bp, Artificial Sequence
  Synthetic oligonucleotide; TTT chr2 60459725 60459746 60459742 60459747 +
ctgttaatttgtcaattcaagg

SEQ ID NO: 195017 - DNA, 22 bp, Artificial Sequence
  Synthetic oligonucleotide; TTC chr2 60459726 60459747 60459743 60459748 +
tgttaatttgtcaattcaaggc

SEQ ID NO: 195018 - DNA, 22 bp, Artificial Sequence
  Synthetic oligonucleotide; CTG chr2 60459728 60459749 60459745 60459750 +
ttaatttgtcaattcaaggcct

SEQ ID NO: 195019 - DNA, 22 bp, Artificial Sequence
  Synthetic oligonucleotide; TTA chr2 60459731 60459752 60459748 60459753 +
atttgtcaattcaaggcctttt

SEQ ID NO: 195020 - DNA, 22 bp, Artificial Sequence
  Synthetic oligonucleotide; TTT chr2 60459735 60459756 60459752 60459757 +
gtcaattcaaggccttttttct

SEQ ID NO: 195021 - DNA, 22 bp, Artificial Sequence
  Synthetic oligonucleotide; TTG chr2 60459736 60459757 60459753 60459758 +
tcaattcaaggccttttttctt

SEQ ID NO: 195022 - DNA, 22 bp, Artificial Sequence
  Synthetic oligonucleotide; TTC chr2 60459743 60459764 60459760 60459765 +
aaggccttttttcttcctttcc

SEQ ID NO: 195023 - DNA, 22 bp, Artificial Sequence
  Synthetic oligonucleotide; CTT chr2 60459751 60459772 60459768 60459773 +
ttttcttcctttccaattgata

SEQ ID NO: 195024 - DNA, 22 bp, Artificial Sequence
  Synthetic oligonucleotide; TTT chr2 60459752 60459773 60459769 60459774 +
tttcttcctttccaattgatac

SEQ ID NO: 195025 - DNA, 22 bp, Artificial Sequence
  Synthetic oligonucleotide; TTT chr2 60459753 60459774 60459770 60459775 +
ttcttcctttccaattgataca

SEQ ID NO: 195026 - DNA, 22 bp, Artificial Sequence
  Synthetic oligonucleotide; TTT chr2 60459754 60459775 60459771 60459776 +
tcttcctttccaattgatacat

SEQ ID NO: 195027 - DNA, 22 bp, Artificial Sequence
  Synthetic oligonucleotide; TTT chr2 60459755 60459776 60459772 60459777 +
cttcctttccaattgatacatt

SEQ ID NO: 195028 - DNA, 22 bp, Artificial Sequence
  Synthetic oligonucleotide; TTC chr2 60459756 60459777 60459773 60459778 +
ttcctttccaattgatacattt

SEQ ID NO: 195029 - DNA, 22 bp, Artificial Sequence
  Synthetic oligonucleotide; CTT chr2 60459758 60459779 60459775 60459780 +
cctttccaattgatacatttaa

SEQ ID NO: 195030 - DNA, 22 bp, Artificial Sequence
  Synthetic oligonucleotide; TTC chr2 60459759 60459780 60459776 60459781 +
ctttccaattgatacatttaac

SEQ ID NO: 195031 - DNA, 22 bp, Artificial Sequence
  Synthetic oligonucleotide; CTT chr2 60459762 60459783 60459779 60459784 +
tccaattgatacatttaaccct

SEQ ID NO: 195032 - DNA, 22 bp, Artificial Sequence
  Synthetic oligonucleotide; TTT chr2 60459763 60459784 60459780 60459785 +
ccaattgatacatttaaccctt

SEQ ID NO: 195033 - DNA, 22 bp, Artificial Sequence
  Synthetic oligonucleotide; TTC chr2 60459764 60459785 60459781 60459786 +
caattgatacatttaacccttt

SEQ ID NO: 195034 - DNA, 22 bp, Artificial Sequence
  Synthetic oligonucleotide; TTG chr2 60459770 60459791 60459787 60459792 +
atacatttaaccctttagagac

SEQ ID NO: 195035 - DNA, 22 bp, Artificial Sequence
  Synthetic oligonucleotide; TTT chr2 60459778 60459799 60459795 60459800 +
aaccctttagagacagacattt

SEQ ID NO: 195036 - DNA, 22 bp, Artificial Sequence
  Synthetic oligonucleotide; TTA chr2 60459779 60459800 60459796 60459801 +
accctttagagacagacattta

SEQ ID NO: 195037 - DNA, 22 bp, Artificial Sequence
  Synthetic oligonucleotide; CTT chr2 60459785 60459806 60459802 60459807 +
tagagacagacatttagctcat

SEQ ID NO: 195038 - DNA, 22 bp, Artificial Sequence
  Synthetic oligonucleotide; TTT chr2 60459786 60459807 60459803 60459808 +
agagacagacatttagctcata

SEQ ID NO: 195039 - DNA, 22 bp, Artificial Sequence
  Synthetic oligonucleotide; TTA chr2 60459787 60459808 60459804 60459809 +
gagacagacatttagctcatag

SEQ ID NO: 195040 - DNA, 22 bp, Artificial Sequence
  Synthetic oligonucleotide; TTT chr2 60459800 60459821 60459817 60459822 +
agctcatagagattttttttca

SEQ ID NO: 195041 - DNA, 22 bp, Artificial Sequence
  Synthetic oligonucleotide; TTA chr2 60459801 60459822 60459818 60459823 +
gctcatagagattttttttcag

SEQ ID NO: 195042 - DNA, 22 bp, Artificial Sequence
  Synthetic oligonucleotide; CTC chr2 60459805 60459826 60459822 60459827 +
atagagattttttttcagtgct

SEQ ID NO: 195043 - DNA, 22 bp, Artificial Sequence
  Synthetic oligonucleotide; TTT chr2 60459815 60459836 60459832 60459837 +
tttttcagtgctatctattctg

SEQ ID NO: 195044 - DNA, 22 bp, Artificial Sequence
  Synthetic oligonucleotide; TTT chr2 60459816 60459837 60459833 60459838 +
ttttcagtgctatctattctgt

SEQ ID NO: 195045 - DNA, 22 bp, Artificial Sequence
  Synthetic oligonucleotide; TTT chr2 60459817 60459838 60459834 60459839 +
tttcagtgctatctattctgtc

SEQ ID NO: 195046 - DNA, 22 bp, Artificial Sequence
  Synthetic oligonucleotide; TTT chr2 60459818 60459839 60459835 60459840 +
ttcagtgctatctattctgtct

SEQ ID NO: 195047 - DNA, 22 bp, Artificial Sequence
  Synthetic oligonucleotide; TTT chr2 60459819 60459840 60459836 60459841 +
tcagtgctatctattctgtcta

SEQ ID NO: 195048 - DNA, 22 bp, Artificial Sequence
  Synthetic oligonucleotide; TTT chr2 60459820 60459841 60459837 60459842 +
cagtgctatctattctgtctat

SEQ ID NO: 195049 - DNA, 22 bp, Artificial Sequence
  Synthetic oligonucleotide; TTC chr2 60459821 60459842 60459838 60459843 +
agtgctatctattctgtctata

SEQ ID NO: 195050 - DNA, 22 bp, Artificial Sequence
  Synthetic oligonucleotide; CTA chr2 60459828 60459849 60459845 60459850 +
tctattctgtctatagagggtt

SEQ ID NO: 195051 - DNA, 22 bp, Artificial Sequence
  Synthetic oligonucleotide; CTA chr2 60459832 60459853 60459849 60459854 +
ttctgtctatagagggttaatc

SEQ ID NO: 195052 - DNA, 22 bp, Artificial Sequence
  Synthetic oligonucleotide; TTC chr2 60459835 60459856 60459852 60459857 +
tgtctatagagggttaatccaa

SEQ ID NO: 195053 - DNA, 22 bp, Artificial Sequence
  Synthetic oligonucleotide; CTG chr2 60459837 60459858 60459854 60459859 +
tctatagagggttaatccaaag

SEQ ID NO: 195054 - DNA, 22 bp, Artificial Sequence
  Synthetic oligonucleotide; CTA chr2 60459841 60459862 60459858 60459863 +
tagagggttaatccaaagactg

SEQ ID NO: 195055 - DNA, 22 bp, Artificial Sequence
  Synthetic oligonucleotide; TTA chr2 60459851 60459872 60459868 60459873 +
atccaaagactgtttttcctcc

SEQ ID NO: 195056 - DNA, 22 bp, Artificial Sequence
  Synthetic oligonucleotide; CTG chr2 60459863 60459884 60459880 60459885 +
tttttcctcctcacgttataaa

SEQ ID NO: 195057 - DNA, 22 bp, Artificial Sequence
  Synthetic oligonucleotide; TTT chr2 60459866 60459887 60459883 60459888 +
ttcctcctcacgttataaaata

SEQ ID NO: 195058 - DNA, 22 bp, Artificial Sequence
  Synthetic oligonucleotide; TTT chr2 60459867 60459888 60459884 60459889 +
tcctcctcacgttataaaataa

SEQ ID NO: 195059 - DNA, 22 bp, Artificial Sequence
  Synthetic oligonucleotide; TTT chr2 60459868 60459889 60459885 60459890 +
cctcctcacgttataaaataaa

SEQ ID NO: 195060 - DNA, 22 bp, Artificial Sequence
  Synthetic oligonucleotide; TTC chr2 60459869 60459890 60459886 60459891 +
ctcctcacgttataaaataaaa

SEQ ID NO: 195061 - DNA, 22 bp, Artificial Sequence
  Synthetic oligonucleotide; CTC chr2 60459872 60459893 60459889 60459894 +
ctcacgttataaaataaaactg

SEQ ID NO: 195062 - DNA, 22 bp, Artificial Sequence
  Synthetic oligonucleotide; CTC chr2 60459875 60459896 60459892 60459897 +
acgttataaaataaaactgtac

SEQ ID NO: 195063 - DNA, 22 bp, Artificial Sequence
  Synthetic oligonucleotide; TTA chr2 60459881 60459902 60459898 60459903 +
taaaataaaactgtacatgata

SEQ ID NO: 195064 - DNA, 22 bp, Artificial Sequence
  Synthetic oligonucleotide; CTG chr2 60459894 60459915 60459911 60459916 +
tacatgatatgtattacagaat

SEQ ID NO: 195065 - DNA, 22 bp, Artificial Sequence
  Synthetic oligonucleotide; TTA chr2 60459910 60459931 60459927 60459932 +
cagaatgtatgcagcatggtct

SEQ ID NO: 195066 - DNA, 22 bp, Artificial Sequence
  Synthetic oligonucleotide; CTT chr2 60459933 60459954 60459950 60459955 +
tttctctctctctctctttttc

SEQ ID NO: 195067 - DNA, 22 bp, Artificial Sequence
  Synthetic oligonucleotide; TTT chr2 60459934 60459955 60459951 60459956 +
ttctctctctctctctttttct

SEQ ID NO: 195068 - DNA, 22 bp, Artificial Sequence
  Synthetic oligonucleotide; TTT chr2 60459935 60459956 60459952 60459957 +
tctctctctctctctttttctc

SEQ ID NO: 195069 - DNA, 22 bp, Artificial Sequence
  Synthetic oligonucleotide; TTT chr2 60459936 60459957 60459953 60459958 +
ctctctctctctctttttctct

SEQ ID NO: 195070 - DNA, 22 bp, Artificial Sequence
  Synthetic oligonucleotide; TTC chr2 60459937 60459958 60459954 60459959 +
tctctctctctctttttctctc

SEQ ID NO: 195071 - DNA, 22 bp, Artificial Sequence
  Synthetic oligonucleotide; CTC chr2 60459939 60459960 60459956 60459961 +
tctctctctctttttctctcag

SEQ ID NO: 195072 - DNA, 22 bp, Artificial Sequence
  Synthetic oligonucleotide; CTC chr2 60459941 60459962 60459958 60459963 +
tctctctctttttctctcagaa

SEQ ID NO: 195073 - DNA, 22 bp, Artificial Sequence
  Synthetic oligonucleotide; CTC chr2 60459943 60459964 60459960 60459965 +
tctctctttttctctcagaacg

SEQ ID NO: 195074 - DNA, 22 bp, Artificial Sequence
  Synthetic oligonucleotide; CTC chr2 60459945 60459966 60459962 60459967 +
tctctttttctctcagaacgga

SEQ ID NO: 195075 - DNA, 22 bp, Artificial Sequence
  Synthetic oligonucleotide; CTC chr2 60459947 60459968 60459964 60459969 +
tctttttctctcagaacggaac

SEQ ID NO: 195076 - DNA, 22 bp, Artificial Sequence
  Synthetic oligonucleotide; CTC chr2 60459949 60459970 60459966 60459971 +
tttttctctcagaacggaactg

SEQ ID NO: 195077 - DNA, 22 bp, Artificial Sequence
  Synthetic oligonucleotide; CTT chr2 60459951 60459972 60459968 60459973 +
tttctctcagaacggaactgga

SEQ ID NO: 195078 - DNA, 22 bp, Artificial Sequence
  Synthetic oligonucleotide; TTT chr2 60459952 60459973 60459969 60459974 +
ttctctcagaacggaactggaa

SEQ ID NO: 195079 - DNA, 22 bp, Artificial Sequence
  Synthetic oligonucleotide; TTT chr2 60459953 60459974 60459970 60459975 +
tctctcagaacggaactggaaa

SEQ ID NO: 195080 - DNA, 22 bp, Artificial Sequence
  Synthetic oligonucleotide; TTT chr2 60459954 60459975 60459971 60459976 +
ctctcagaacggaactggaaac

SEQ ID NO: 195081 - DNA, 22 bp, Artificial Sequence
  Synthetic oligonucleotide; TTC chr2 60459955 60459976 60459972 60459977 +
tctcagaacggaactggaaaca

SEQ ID NO: 195082 - DNA, 22 bp, Artificial Sequence
  Synthetic oligonucleotide; CTC chr2 60459957 60459978 60459974 60459979 +
tcagaacggaactggaaacagc

SEQ ID NO: 195083 - DNA, 22 bp, Artificial Sequence
  Synthetic oligonucleotide; CTC chr2 60459959 60459980 60459976 60459981 +
agaacggaactggaaacagcaa

SEQ ID NO: 195084 - DNA, 22 bp, Artificial Sequence
  Synthetic oligonucleotide; CTG chr2 60459971 60459992 60459988 60459993 +
gaaacagcaacatgtttgctca

SEQ ID NO: 195085 - DNA, 22 bp, Artificial Sequence
  Synthetic oligonucleotide; TTT chr2 60459988 60460009 60460005 60460010 +
gctcagcaacgaattagggaca

SEQ ID NO: 195086 - DNA, 22 bp, Artificial Sequence
  Synthetic oligonucleotide; TTG chr2 60459989 60460010 60460006 60460011 +
ctcagcaacgaattagggacaa

SEQ ID NO: 195087 - DNA, 22 bp, Artificial Sequence
  Synthetic oligonucleotide; CTC chr2 60459992 60460013 60460009 60460014 +
agcaacgaattagggacaattt

SEQ ID NO: 195088 - DNA, 22 bp, Artificial Sequence
  Synthetic oligonucleotide; TTA chr2 60460004 60460025 60460021 60460026 +
gggacaatttaaaatagccata

SEQ ID NO: 195089 - DNA, 22 bp, Artificial Sequence
  Synthetic oligonucleotide; TTT chr2 60460014 60460035 60460031 60460036 +
aaaatagccataacataccata

SEQ ID NO: 195090 - DNA, 22 bp, Artificial Sequence
  Synthetic oligonucleotide; TTA chr2 60460015 60460036 60460032 60460037 +
aaatagccataacataccatac

SEQ ID NO: 195091 - DNA, 22 bp, Artificial Sequence
  Synthetic oligonucleotide; CTG chr2 60460043 60460064 60460060 60460065 +
tctaagtttaaaaaaaaacata

SEQ ID NO: 195092 - DNA, 22 bp, Artificial Sequence
  Synthetic oligonucleotide; CTA chr2 60460047 60460068 60460064 60460069 +
agtttaaaaaaaaacatacaca

SEQ ID NO: 195093 - DNA, 22 bp, Artificial Sequence
  Synthetic oligonucleotide; TTT chr2 60460052 60460073 60460069 60460074 +
aaaaaaaaacatacacaacatg

SEQ ID NO: 195094 - DNA, 22 bp, Artificial Sequence
  Synthetic oligonucleotide; TTA chr2 60460053 60460074 60460070 60460075 +
aaaaaaaacatacacaacatgt

SEQ ID NO: 195095 - DNA, 22 bp, Artificial Sequence
  Synthetic oligonucleotide; TTA chr2 60460081 60460102 60460098 60460103 +
ttgcacaagagaaaggctcaaa

SEQ ID NO: 195096 - DNA, 22 bp, Artificial Sequence
  Synthetic oligonucleotide; TTG chr2 60460084 60460105 60460101 60460106 +
cacaagagaaaggctcaaagtt

SEQ ID NO: 195097 - DNA, 22 bp, Artificial Sequence
  Synthetic oligonucleotide; CTC chr2 60460100 60460121 60460117 60460122 +
aaagtttgcgtaaaatgcaata

SEQ ID NO: 195098 - DNA, 22 bp, Artificial Sequence
  Synthetic oligonucleotide; TTT chr2 60460107 60460128 60460124 60460129 +
gcgtaaaatgcaatagtattgc

SEQ ID NO: 195099 - DNA, 22 bp, Artificial Sequence
  Synthetic oligonucleotide; TTG chr2 60460108 60460129 60460125 60460130 +
cgtaaaatgcaatagtattgcc

SEQ ID NO: 195100 - DNA, 22 bp, Artificial Sequence
  Synthetic oligonucleotide; TTG chr2 60460128 60460149 60460145 60460150 +
ccccatacagatcatgcattca

SEQ ID NO: 195101 - DNA, 22 bp, Artificial Sequence
  Synthetic oligonucleotide; TTC chr2 60460149 60460170 60460166 60460171 +
aaacggtgagaacataaaggaa

SEQ ID NO: 195102 - DNA, 22 bp, Artificial Sequence
  Synthetic oligonucleotide; CTG chr2 60460229 60460250 60460246 60460251 +
gtgacaagcactctcatattct

SEQ ID NO: 195103 - DNA, 22 bp, Artificial Sequence
  Synthetic oligonucleotide; CTC chr2 60460242 60460263 60460259 60460264 +
tcatattcttagcttcgttact

SEQ ID NO: 195104 - DNA, 22 bp, Artificial Sequence
  Synthetic oligonucleotide; CTC chr2 60460244 60460265 60460261 60460266 +
atattcttagcttcgttacttc

SEQ ID NO: 195105 - DNA, 22 bp, Artificial Sequence
  Synthetic oligonucleotide; TTC chr2 60460250 60460271 60460267 60460272 +
ttagcttcgttacttctgtttg

SEQ ID NO: 195106 - DNA, 22 bp, Artificial Sequence
  Synthetic oligonucleotide; CTT chr2 60460252 60460273 60460269 60460274 +
agcttcgttacttctgtttgtt

SEQ ID NO: 195107 - DNA, 22 bp, Artificial Sequence
  Synthetic oligonucleotide; TTA chr2 60460253 60460274 60460270 60460275 +
gcttcgttacttctgtttgttt

SEQ ID NO: 195108 - DNA, 22 bp, Artificial Sequence
  Synthetic oligonucleotide; CTT chr2 60460257 60460278 60460274 60460279 +
cgttacttctgtttgtttgttt

SEQ ID NO: 195109 - DNA, 22 bp, Artificial Sequence
  Synthetic oligonucleotide; TTC chr2 60460258 60460279 60460275 60460280 +
gttacttctgtttgtttgtttg

SEQ ID NO: 195110 - DNA, 22 bp, Artificial Sequence
  Synthetic oligonucleotide; TTA chr2 60460262 60460283 60460279 60460284 +
cttctgtttgtttgtttgtttg

SEQ ID NO: 195111 - DNA, 22 bp, Artificial Sequence
  Synthetic oligonucleotide; CTT chr2 60460265 60460286 60460282 60460287 +
ctgtttgtttgtttgtttgttt

SEQ ID NO: 195112 - DNA, 22 bp, Artificial Sequence
  Synthetic oligonucleotide; TTC chr2 60460266 60460287 60460283 60460288 +
tgtttgtttgtttgtttgttta

SEQ ID NO: 195113 - DNA, 22 bp, Artificial Sequence
  Synthetic oligonucleotide; CTG chr2 60460268 60460289 60460285 60460290 +
tttgtttgtttgtttgtttaaa

SEQ ID NO: 195114 - DNA, 22 bp, Artificial Sequence
  Synthetic oligonucleotide; TTT chr2 60460271 60460292 60460288 60460293 +
gtttgtttgtttgtttaaatca

SEQ ID NO: 195115 - DNA, 22 bp, Artificial Sequence
  Synthetic oligonucleotide; TTG chr2 60460272 60460293 60460289 60460294 +
tttgtttgtttgtttaaatcac

SEQ ID NO: 195116 - DNA, 22 bp, Artificial Sequence
  Synthetic oligonucleotide; TTT chr2 60460275 60460296 60460292 60460297 +
gtttgtttgtttaaatcacatg

SEQ ID NO: 195117 - DNA, 22 bp, Artificial Sequence
  Synthetic oligonucleotide; TTG chr2 60460276 60460297 60460293 60460298 +
tttgtttgtttaaatcacatgg

SEQ ID NO: 195118 - DNA, 22 bp, Artificial Sequence
  Synthetic oligonucleotide; TTT chr2 60460279 60460300 60460296 60460301 +
gtttgtttaaatcacatgggac

SEQ ID NO: 195119 - DNA, 22 bp, Artificial Sequence
  Synthetic oligonucleotide; TTG chr2 60460280 60460301 60460297 60460302 +
tttgtttaaatcacatgggact

SEQ ID NO: 195120 - DNA, 22 bp, Artificial Sequence
  Synthetic oligonucleotide; TTT chr2 60460283 60460304 60460300 60460305 +
gtttaaatcacatgggactaga

SEQ ID NO: 195121 - DNA, 22 bp, Artificial Sequence
  Synthetic oligonucleotide; TTG chr2 60460284 60460305 60460301 60460306 +
tttaaatcacatgggactagaa

SEQ ID NO: 195122 - DNA, 22 bp, Artificial Sequence
  Synthetic oligonucleotide; TTT chr2 60460287 60460308 60460304 60460309 +
aaatcacatgggactagaaaaa

SEQ ID NO: 195123 - DNA, 22 bp, Artificial Sequence
  Synthetic oligonucleotide; TTA chr2 60460288 60460309 60460305 60460310 +
aatcacatgggactagaaaaaa

SEQ ID NO: 195124 - DNA, 22 bp, Artificial Sequence
  Synthetic oligonucleotide; CTA chr2 60460303 60460324 60460320 60460325 +
gaaaaaaatcctacagggagtg

SEQ ID NO: 195125 - DNA, 22 bp, Artificial Sequence
  Synthetic oligonucleotide; CTA chr2 60460316 60460337 60460333 60460338 +
cagggagtggggctggagggcg

SEQ ID NO: 195126 - DNA, 22 bp, Artificial Sequence
  Synthetic oligonucleotide; CTG chr2 60460331 60460352 60460348 60460353 +
gagggcgatggggaaggggagt

SEQ ID NO: 195127 - DNA, 22 bp, Artificial Sequence
  Synthetic oligonucleotide; TTA chr2 60460396 60460417 60460413 60460418 +
atatacctctattcagttttta

SEQ ID NO: 195128 - DNA, 22 bp, Artificial Sequence
  Synthetic oligonucleotide; CTC chr2 60460405 60460426 60460422 60460427 +
tattcagtttttatatcattat

SEQ ID NO: 195129 - DNA, 22 bp, Artificial Sequence
  Synthetic oligonucleotide; CTA chr2 60460407 60460428 60460424 60460429 +
ttcagtttttatatcattattc

SEQ ID NO: 195130 - DNA, 22 bp, Artificial Sequence
  Synthetic oligonucleotide; TTC chr2 60460410 60460431 60460427 60460432 +
agtttttatatcattattcaac

SEQ ID NO: 195131 - DNA, 22 bp, Artificial Sequence
  Synthetic oligonucleotide; TTT chr2 60460415 60460436 60460432 60460437 +
ttatatcattattcaacactcg

SEQ ID NO: 195132 - DNA, 22 bp, Artificial Sequence
  Synthetic oligonucleotide; TTT chr2 60460416 60460437 60460433 60460438 +
tatatcattattcaacactcga

SEQ ID NO: 195133 - DNA, 22 bp, Artificial Sequence
  Synthetic oligonucleotide; TTT chr2 60460417 60460438 60460434 60460439 +
atatcattattcaacactcgat

SEQ ID NO: 195134 - DNA, 22 bp, Artificial Sequence
  Synthetic oligonucleotide; TTA chr2 60460418 60460439 60460435 60460440 +
tatcattattcaacactcgatc

SEQ ID NO: 195135 - DNA, 22 bp, Artificial Sequence
  Synthetic oligonucleotide; TTA chr2 60460426 60460447 60460443 60460448 +
ttcaacactcgatcactgtgcc

SEQ ID NO: 195136 - DNA, 22 bp, Artificial Sequence
  Synthetic oligonucleotide; TTC chr2 60460429 60460450 60460446 60460451 +
aacactcgatcactgtgccatt

SEQ ID NO: 195137 - DNA, 22 bp, Artificial Sequence
  Synthetic oligonucleotide; CTC chr2 60460436 60460457 60460453 60460458 +
gatcactgtgccattttttcat

SEQ ID NO: 195138 - DNA, 22 bp, Artificial Sequence
  Synthetic oligonucleotide; CTG chr2 60460444 60460465 60460461 60460466 +
tgccattttttcatgtgtttct

SEQ ID NO: 195139 - DNA, 22 bp, Artificial Sequence
  Synthetic oligonucleotide; TTT chr2 60460452 60460473 60460469 60460474 +
tttcatgtgtttctccagggta

SEQ ID NO: 195140 - DNA, 22 bp, Artificial Sequence
  Synthetic oligonucleotide; TTT chr2 60460453 60460474 60460470 60460475 +
ttcatgtgtttctccagggtac

SEQ ID NO: 195141 - DNA, 22 bp, Artificial Sequence
  Synthetic oligonucleotide; TTT chr2 60460454 60460475 60460471 60460476 +
tcatgtgtttctccagggtact

SEQ ID NO: 195142 - DNA, 22 bp, Artificial Sequence
  Synthetic oligonucleotide; TTT chr2 60460455 60460476 60460472 60460477 +
catgtgtttctccagggtactg

SEQ ID NO: 195143 - DNA, 22 bp, Artificial Sequence
  Synthetic oligonucleotide; TTC chr2 60460456 60460477 60460473 60460478 +
atgtgtttctccagggtactgt

SEQ ID NO: 195144 - DNA, 22 bp, Artificial Sequence
  Synthetic oligonucleotide; TTT chr2 60460464 60460485 60460481 60460486 +
ctccagggtactgtacacgcta

SEQ ID NO: 195145 - DNA, 22 bp, Artificial Sequence
  Synthetic oligonucleotide; TTC chr2 60460465 60460486 60460482 60460487 +
tccagggtactgtacacgctaa

SEQ ID NO: 195146 - DNA, 22 bp, Artificial Sequence
  Synthetic oligonucleotide; CTC chr2 60460467 60460488 60460484 60460489 +
cagggtactgtacacgctaaaa

SEQ ID NO: 195147 - DNA, 22 bp, Artificial Sequence
  Synthetic oligonucleotide; CTG chr2 60460477 60460498 60460494 60460499 +
tacacgctaaaaggcatcttac

SEQ ID NO: 195148 - DNA, 22 bp, Artificial Sequence
  Synthetic oligonucleotide; CTA chr2 60460486 60460507 60460503 60460508 +
aaaggcatcttacaaatttcac

SEQ ID NO: 195149 - DNA, 22 bp, Artificial Sequence
  Synthetic oligonucleotide; CTT chr2 60460497 60460518 60460514 60460519 +
acaaatttcacatttgtaaacg

SEQ ID NO: 195150 - DNA, 22 bp, Artificial Sequence
  Synthetic oligonucleotide; TTA chr2 60460498 60460519 60460515 60460520 +
caaatttcacatttgtaaacgt

SEQ ID NO: 195151 - DNA, 22 bp, Artificial Sequence
  Synthetic oligonucleotide; TTT chr2 60460505 60460526 60460522 60460527 +
cacatttgtaaacgtccttccc

SEQ ID NO: 195152 - DNA, 22 bp, Artificial Sequence
  Synthetic oligonucleotide; TTC chr2 60460506 60460527 60460523 60460528 +
acatttgtaaacgtccttcccc

SEQ ID NO: 195153 - DNA, 22 bp, Artificial Sequence
  Synthetic oligonucleotide; TTT chr2 60460512 60460533 60460529 60460534 +
gtaaacgtccttccccacctgg

SEQ ID NO: 195154 - DNA, 22 bp, Artificial Sequence
  Synthetic oligonucleotide; TTG chr2 60460513 60460534 60460530 60460535 +
taaacgtccttccccacctggc

SEQ ID NO: 195155 - DNA, 22 bp, Artificial Sequence
  Synthetic oligonucleotide; CTT chr2 60460524 60460545 60460541 60460546 +
ccccacctggccatgcgttttc

SEQ ID NO: 195156 - DNA, 22 bp, Artificial Sequence
  Synthetic oligonucleotide; TTC chr2 60460525 60460546 60460542 60460547 +
cccacctggccatgcgttttca

SEQ ID NO: 195157 - DNA, 22 bp, Artificial Sequence
  Synthetic oligonucleotide; CTG chr2 60460533 60460554 60460550 60460555 +
gccatgcgttttcatgtgcctg

SEQ ID NO: 195158 - DNA, 22 bp, Artificial Sequence
  Synthetic oligonucleotide; TTT chr2 60460544 60460565 60460561 60460566 +
tcatgtgcctggtgagcttgct

SEQ ID NO: 195159 - DNA, 22 bp, Artificial Sequence
  Synthetic oligonucleotide; TTT chr2 60460545 60460566 60460562 60460567 +
catgtgcctggtgagcttgcta

SEQ ID NO: 195160 - DNA, 22 bp, Artificial Sequence
  Synthetic oligonucleotide; TTC chr2 60460546 60460567 60460563 60460568 +
atgtgcctggtgagcttgctac

SEQ ID NO: 195161 - DNA, 22 bp, Artificial Sequence
  Synthetic oligonucleotide; CTG chr2 60460555 60460576 60460572 60460577 +
gtgagcttgctactctgggcac

SEQ ID NO: 195162 - DNA, 22 bp, Artificial Sequence
  Synthetic oligonucleotide; CTT chr2 60460563 60460584 60460580 60460585 +
gctactctgggcacaggcatag

SEQ ID NO: 195163 - DNA, 22 bp, Artificial Sequence
  Synthetic oligonucleotide; TTG chr2 60460564 60460585 60460581 60460586 +
ctactctgggcacaggcatagt

SEQ ID NO: 195164 - DNA, 22 bp, Artificial Sequence
  Synthetic oligonucleotide; CTA chr2 60460567 60460588 60460584 60460589 +
ctctgggcacaggcatagttgc

SEQ ID NO: 195165 - DNA, 22 bp, Artificial Sequence
  Synthetic oligonucleotide; CTC chr2 60460570 60460591 60460587 60460592 +
tgggcacaggcatagttgcaca

SEQ ID NO: 195166 - DNA, 22 bp, Artificial Sequence
  Synthetic oligonucleotide; CTG chr2 60460572 60460593 60460589 60460594 +
ggcacaggcatagttgcacagc

SEQ ID NO: 195167 - DNA, 22 bp, Artificial Sequence
  Synthetic oligonucleotide; TTG chr2 60460588 60460609 60460605 60460610 +
cacagctcgcatttataaggcc

SEQ ID NO: 195168 - DNA, 22 bp, Artificial Sequence
  Synthetic oligonucleotide; CTC chr2 60460596 60460617 60460613 60460618 +
gcatttataaggcctttcgccc

SEQ ID NO: 195169 - DNA, 22 bp, Artificial Sequence
  Synthetic oligonucleotide; TTT chr2 60460602 60460623 60460619 60460624 +
ataaggcctttcgcccgtgtgg

SEQ ID NO: 195170 - DNA, 22 bp, Artificial Sequence
  Synthetic oligonucleotide; TTA chr2 60460603 60460624 60460620 60460625 +
taaggcctttcgcccgtgtggc

SEQ ID NO: 195171 - DNA, 22 bp, Artificial Sequence
  Synthetic oligonucleotide; CTT chr2 60460612 60460633 60460629 60460634 +
tcgcccgtgtggcttctcctgt

SEQ ID NO: 195172 - DNA, 22 bp, Artificial Sequence
  Synthetic oligonucleotide; TTT chr2 60460613 60460634 60460630 60460635 +
cgcccgtgtggcttctcctgtg

SEQ ID NO: 195173 - DNA, 22 bp, Artificial Sequence
  Synthetic oligonucleotide; TTC chr2 60460614 60460635 60460631 60460636 +
gcccgtgtggcttctcctgtgg

SEQ ID NO: 195174 - DNA, 22 bp, Artificial Sequence
  Synthetic oligonucleotide; CTT chr2 60460627 60460648 60460644 60460649 +
ctcctgtggacagtgagattgc

SEQ ID NO: 195175 - DNA, 22 bp, Artificial Sequence
  Synthetic oligonucleotide; TTC chr2 60460628 60460649 60460645 60460650 +
tcctgtggacagtgagattgct

SEQ ID NO: 195176 - DNA, 22 bp, Artificial Sequence
  Synthetic oligonucleotide; CTC chr2 60460630 60460651 60460647 60460652 +
ctgtggacagtgagattgctac

SEQ ID NO: 195177 - DNA, 22 bp, Artificial Sequence
  Synthetic oligonucleotide; CTG chr2 60460633 60460654 60460650 60460655 +
tggacagtgagattgctacagt

SEQ ID NO: 195178 - DNA, 22 bp, Artificial Sequence
  Synthetic oligonucleotide; TTG chr2 60460648 60460669 60460665 60460670 +
ctacagttcttgaagactttcc

SEQ ID NO: 195179 - DNA, 22 bp, Artificial Sequence
  Synthetic oligonucleotide; CTA chr2 60460651 60460672 60460668 60460673 +
cagttcttgaagactttcccac

SEQ ID NO: 195180 - DNA, 22 bp, Artificial Sequence
  Synthetic oligonucleotide; TTC chr2 60460657 60460678 60460674 60460679 +
ttgaagactttcccacagtact

SEQ ID NO: 195181 - DNA, 22 bp, Artificial Sequence
  Synthetic oligonucleotide; CTT chr2 60460659 60460680 60460676 60460681 +
gaagactttcccacagtactca

SEQ ID NO: 195182 - DNA, 22 bp, Artificial Sequence
  Synthetic oligonucleotide; TTG chr2 60460660 60460681 60460677 60460682 +
aagactttcccacagtactcac

SEQ ID NO: 195183 - DNA, 22 bp, Artificial Sequence
  Synthetic oligonucleotide; CTT chr2 60460667 60460688 60460684 60460689 +
tcccacagtactcacaagtgtc

SEQ ID NO: 195184 - DNA, 22 bp, Artificial Sequence
  Synthetic oligonucleotide; TTT chr2 60460668 60460689 60460685 60460690 +
cccacagtactcacaagtgtcg

SEQ ID NO: 195185 - DNA, 22 bp, Artificial Sequence
  Synthetic oligonucleotide; TTC chr2 60460669 60460690 60460686 60460691 +
ccacagtactcacaagtgtcgc

SEQ ID NO: 195186 - DNA, 22 bp, Artificial Sequence
  Synthetic oligonucleotide; CTC chr2 60460680 60460701 60460697 60460702 +
acaagtgtcgctgcgtctgccc

SEQ ID NO: 195187 - DNA, 22 bp, Artificial Sequence
  Synthetic oligonucleotide; CTG chr2 60460693 60460714 60460710 60460715 +
cgtctgccctcttttgagctgg

SEQ ID NO: 195188 - DNA, 22 bp, Artificial Sequence
  Synthetic oligonucleotide; CTG chr2 60460699 60460720 60460716 60460721 +
ccctcttttgagctgggcctgc

SEQ ID NO: 195189 - DNA, 22 bp, Artificial Sequence
  Synthetic oligonucleotide; CTC chr2 60460704 60460725 60460721 60460726 +
ttttgagctgggcctgcccggg

SEQ ID NO: 195190 - DNA, 22 bp, Artificial Sequence
  Synthetic oligonucleotide; CTT chr2 60460706 60460727 60460723 60460728 +
ttgagctgggcctgcccgggcc

SEQ ID NO: 195191 - DNA, 22 bp, Artificial Sequence
  Synthetic oligonucleotide; TTT chr2 60460707 60460728 60460724 60460729 +
tgagctgggcctgcccgggccc

SEQ ID NO: 195192 - DNA, 22 bp, Artificial Sequence
  Synthetic oligonucleotide; TTT chr2 60460708 60460729 60460725 60460730 +
gagctgggcctgcccgggcccg

SEQ ID NO: 195193 - DNA, 22 bp, Artificial Sequence
  Synthetic oligonucleotide; TTG chr2 60460709 60460730 60460726 60460731 +
agctgggcctgcccgggcccgg

SEQ ID NO: 195194 - DNA, 22 bp, Artificial Sequence
  Synthetic oligonucleotide; CTG chr2 60460714 60460735 60460731 60460736 +
ggcctgcccgggcccggaccac

SEQ ID NO: 195195 - DNA, 22 bp, Artificial Sequence
  Synthetic oligonucleotide; CTG chr2 60460720 60460741 60460737 60460742 +
cccgggcccggaccactaatat

SEQ ID NO: 195196 - DNA, 22 bp, Artificial Sequence
  Synthetic oligonucleotide; CTA chr2 60460738 60460759 60460755 60460760 +
atatggggcgtgctccctccac

SEQ ID NO: 195197 - DNA, 22 bp, Artificial Sequence
  Synthetic oligonucleotide; CTC chr2 60460753 60460774 60460770 60460775 +
cctccacttcccgtgccgctgc

SEQ ID NO: 195198 - DNA, 22 bp, Artificial Sequence
  Synthetic oligonucleotide; CTC chr2 60460757 60460778 60460774 60460779 +
cacttcccgtgccgctgcgccc

SEQ ID NO: 195199 - DNA, 22 bp, Artificial Sequence
  Synthetic oligonucleotide; CTT chr2 60460762 60460783 60460779 60460784 +
cccgtgccgctgcgccccgaga

SEQ ID NO: 195200 - DNA, 22 bp, Artificial Sequence
  Synthetic oligonucleotide; TTC chr2 60460763 60460784 60460780 60460785 +
ccgtgccgctgcgccccgagat

SEQ ID NO: 195201 - DNA, 22 bp, Artificial Sequence
  Synthetic oligonucleotide; CTG chr2 60460774 60460795 60460791 60460796 +
cgccccgagatccctccgtcca

SEQ ID NO: 195202 - DNA, 22 bp, Artificial Sequence
  Synthetic oligonucleotide; CTC chr2 60460790 60460811 60460807 60460812 +
cgtccagctccccgggcggtgt

SEQ ID NO: 195203 - DNA, 22 bp, Artificial Sequence
  Synthetic oligonucleotide; CTC chr2 60460800 60460821 60460817 60460822 +
cccgggcggtgtggagaagcgc

SEQ ID NO: 195204 - DNA, 22 bp, Artificial Sequence
  Synthetic oligonucleotide; CTC chr2 60460828 60460849 60460845 60460850 +
ccgttctccgaggagtgctccg

SEQ ID NO: 195205 - DNA, 22 bp, Artificial Sequence
  Synthetic oligonucleotide; TTC chr2 60460834 60460855 60460851 60460856 +
tccgaggagtgctccgacgagg

SEQ ID NO: 195206 - DNA, 22 bp, Artificial Sequence
  Synthetic oligonucleotide; CTC chr2 60460836 60460857 60460853 60460858 +
cgaggagtgctccgacgaggag

SEQ ID NO: 195207 - DNA, 22 bp, Artificial Sequence
  Synthetic oligonucleotide; CTC chr2 60460848 60460869 60460865 60460870 +
cgacgaggaggcaaaaggcgat

SEQ ID NO: 195208 - DNA, 22 bp, Artificial Sequence
  Synthetic oligonucleotide; TTG chr2 60460872 60460893 60460889 60460894 +
tctggagtctccgaagctaagg

SEQ ID NO: 195209 - DNA, 22 bp, Artificial Sequence
  Synthetic oligonucleotide; CTG chr2 60460876 60460897 60460893 60460898 +
gagtctccgaagctaaggaagg

SEQ ID NO: 195210 - DNA, 22 bp, Artificial Sequence
  Synthetic oligonucleotide; CTC chr2 60460883 60460904 60460900 60460905 +
cgaagctaaggaagggatcttt

SEQ ID NO: 195211 - DNA, 22 bp, Artificial Sequence
  Synthetic oligonucleotide; CTA chr2 60460891 60460912 60460908 60460913 +
aggaagggatctttgagctgcc

SEQ ID NO: 195212 - DNA, 22 bp, Artificial Sequence
  Synthetic oligonucleotide; CTT chr2 60460904 60460925 60460921 60460926 +
tgagctgcctggaggccgcgta

SEQ ID NO: 195213 - DNA, 22 bp, Artificial Sequence
  Synthetic oligonucleotide; TTT chr2 60460905 60460926 60460922 60460927 +
gagctgcctggaggccgcgtag

SEQ ID NO: 195214 - DNA, 22 bp, Artificial Sequence
  Synthetic oligonucleotide; TTG chr2 60460906 60460927 60460923 60460928 +
agctgcctggaggccgcgtagc

SEQ ID NO: 195215 - DNA, 22 bp, Artificial Sequence
  Synthetic oligonucleotide; CTG chr2 60460911 60460932 60460928 60460933 +
cctggaggccgcgtagccggcg

SEQ ID NO: 195216 - DNA, 22 bp, Artificial Sequence
  Synthetic oligonucleotide; CTG chr2 60460915 60460936 60460932 60460937 +
gaggccgcgtagccggcgagcc

SEQ ID NO: 195217 - DNA, 22 bp, Artificial Sequence
  Synthetic oligonucleotide; CTG chr2 60460941 60460962 60460958 60460963 +
cgagtacacgttctccgtgttg

SEQ ID NO: 195218 - DNA, 22 bp, Artificial Sequence
  Synthetic oligonucleotide; TTC chr2 60460954 60460975 60460971 60460976 +
tccgtgttgggcatcgcggccg

SEQ ID NO: 195219 - DNA, 22 bp, Artificial Sequence
  Synthetic oligonucleotide; CTC chr2 60460956 60460977 60460973 60460978 +
cgtgttgggcatcgcggccggg

SEQ ID NO: 195220 - DNA, 22 bp, Artificial Sequence
  Synthetic oligonucleotide; TTG chr2 60460963 60460984 60460980 60460985 +
ggcatcgcggccgggggcaggt

SEQ ID NO: 195221 - DNA, 22 bp, Artificial Sequence
  Synthetic oligonucleotide; CTC chr2 60460992 60461013 60461009 60461014 +
cttctcgagcttgatgcgctta

SEQ ID NO: 195222 - DNA, 22 bp, Artificial Sequence
  Synthetic oligonucleotide; CTT chr2 60460995 60461016 60461012 60461017 +
ctcgagcttgatgcgcttagag

SEQ ID NO: 195223 - DNA, 22 bp, Artificial Sequence
  Synthetic oligonucleotide; TTC chr2 60460996 60461017 60461013 60461018 +
tcgagcttgatgcgcttagaga

SEQ ID NO: 195224 - DNA, 22 bp, Artificial Sequence
  Synthetic oligonucleotide; CTC chr2 60460998 60461019 60461015 60461020 +
gagcttgatgcgcttagagaag

SEQ ID NO: 195225 - DNA, 22 bp, Artificial Sequence
  Synthetic oligonucleotide; CTT chr2 60461004 60461025 60461021 60461026 +
gatgcgcttagagaaggggctc

SEQ ID NO: 195226 - DNA, 22 bp, Artificial Sequence
  Synthetic oligonucleotide; TTG chr2 60461005 60461026 60461022 60461027 +
atgcgcttagagaaggggctca

SEQ ID NO: 195227 - DNA, 22 bp, Artificial Sequence
  Synthetic oligonucleotide; CTT chr2 60461013 60461034 60461030 60461035 +
agagaaggggctcagcgagctg

SEQ ID NO: 195228 - DNA, 22 bp, Artificial Sequence
  Synthetic oligonucleotide; TTA chr2 60461014 60461035 60461031 60461036 +
gagaaggggctcagcgagctgg

SEQ ID NO: 195229 - DNA, 22 bp, Artificial Sequence
  Synthetic oligonucleotide; CTC chr2 60461026 60461047 60461043 60461048 +
agcgagctggggctgcccagca

SEQ ID NO: 195230 - DNA, 22 bp, Artificial Sequence
  Synthetic oligonucleotide; CTG chr2 60461035 60461056 60461052 60461057 +
gggctgcccagcagcagctttt

SEQ ID NO: 195231 - DNA, 22 bp, Artificial Sequence
  Synthetic oligonucleotide; CTG chr2 60461041 60461062 60461058 60461063 +
cccagcagcagctttttggaca

SEQ ID NO: 195232 - DNA, 22 bp, Artificial Sequence
  Synthetic oligonucleotide; CTT chr2 60461055 60461076 60461072 60461077 +
tttggacaggccccccgaggcc

SEQ ID NO: 195233 - DNA, 22 bp, Artificial Sequence
  Synthetic oligonucleotide; TTT chr2 60461056 60461077 60461073 60461078 +
ttggacaggccccccgaggccg

SEQ ID NO: 195234 - DNA, 22 bp, Artificial Sequence
  Synthetic oligonucleotide; TTT chr2 60461057 60461078 60461074 60461079 +
tggacaggccccccgaggccga

SEQ ID NO: 195235 - DNA, 22 bp, Artificial Sequence
  Synthetic oligonucleotide; TTT chr2 60461058 60461079 60461075 60461080 +
ggacaggccccccgaggccgac

SEQ ID NO: 195236 - DNA, 22 bp, Artificial Sequence
  Synthetic oligonucleotide; TTG chr2 60461059 60461080 60461076 60461081 +
gacaggccccccgaggccgact

SEQ ID NO: 195237 - DNA, 22 bp, Artificial Sequence
  Synthetic oligonucleotide; CTC chr2 60461082 60461103 60461099 60461104 +
gcccggggagcagccgcggcca

SEQ ID NO: 195238 - DNA, 22 bp, Artificial Sequence
  Synthetic oligonucleotide; TTA chr2 60461107 60461128 60461124 60461129 +
acagtgccatcgtctatgcggt

SEQ ID NO: 195239 - DNA, 22 bp, Artificial Sequence
  Synthetic oligonucleotide; CTA chr2 60461123 60461144 60461140 60461145 +
tgcggtccgactcgccggccac

SEQ ID NO: 195240 - DNA, 22 bp, Artificial Sequence
  Synthetic oligonucleotide; CTC chr2 60461136 60461157 60461153 60461158 +
gccggccaccgagtcttcgtcg

SEQ ID NO: 195241 - DNA, 22 bp, Artificial Sequence
  Synthetic oligonucleotide; CTT chr2 60461153 60461174 60461170 60461175 +
cgtcgcaagtgtccctgtggcc

SEQ ID NO: 195242 - DNA, 22 bp, Artificial Sequence
  Synthetic oligonucleotide; TTC chr2 60461154 60461175 60461171 60461176 +
gtcgcaagtgtccctgtggccc

SEQ ID NO: 195243 - DNA, 22 bp, Artificial Sequence
  Synthetic oligonucleotide; CTG chr2 60461170 60461191 60461187 60461192 +
tggccctcggcctcggccaggt

SEQ ID NO: 195244 - DNA, 22 bp, Artificial Sequence
  Synthetic oligonucleotide; CTC chr2 60461178 60461199 60461195 60461200 +
ggcctcggccaggtggccgcgc

SEQ ID NO: 195245 - DNA, 22 bp, Artificial Sequence
  Synthetic oligonucleotide; CTC chr2 60461184 60461205 60461201 60461206 +
ggccaggtggccgcgcttatgc

SEQ ID NO: 195246 - DNA, 22 bp, Artificial Sequence
  Synthetic oligonucleotide; CTT chr2 60461202 60461223 60461219 60461224 +
atgcttctcgcccaggacctgg

SEQ ID NO: 195247 - DNA, 22 bp, Artificial Sequence
  Synthetic oligonucleotide; TTA chr2 60461203 60461224 60461220 60461225 +
tgcttctcgcccaggacctggt

SEQ ID NO: 195248 - DNA, 22 bp, Artificial Sequence
  Synthetic oligonucleotide; CTT chr2 60461208 60461229 60461225 60461230 +
ctcgcccaggacctggtggaag

SEQ ID NO: 195249 - DNA, 22 bp, Artificial Sequence
  Synthetic oligonucleotide; TTC chr2 60461209 60461230 60461226 60461231 +
tcgcccaggacctggtggaagg

SEQ ID NO: 195250 - DNA, 22 bp, Artificial Sequence
  Synthetic oligonucleotide; CTC chr2 60461211 60461232 60461228 60461233 +
gcccaggacctggtggaaggcc

SEQ ID NO: 195251 - DNA, 22 bp, Artificial Sequence
  Synthetic oligonucleotide; CTG chr2 60461223 60461244 60461240 60461245 +
gtggaaggcctcgctgaagtgc

SEQ ID NO: 195252 - DNA, 22 bp, Artificial Sequence
  Synthetic oligonucleotide; CTC chr2 60461235 60461256 60461252 60461257 +
gctgaagtgctgcatggagctg

SEQ ID NO: 195253 - DNA, 22 bp, Artificial Sequence
  Synthetic oligonucleotide; CTG chr2 60461239 60461260 60461256 60461261 +
aagtgctgcatggagctgagca

SEQ ID NO: 195254 - DNA, 22 bp, Artificial Sequence
  Synthetic oligonucleotide; CTG chr2 60461247 60461268 60461264 60461269 +
catggagctgagcaccatgccc

SEQ ID NO: 195255 - DNA, 22 bp, Artificial Sequence
  Synthetic oligonucleotide; CTG chr2 60461257 60461278 60461274 60461279 +
agcaccatgccctgcatgacgt

SEQ ID NO: 195256 - DNA, 22 bp, Artificial Sequence
  Synthetic oligonucleotide; CTG chr2 60461271 60461292 60461288 60461293 +
catgacgtcgggcagggcgcgg

SEQ ID NO: 195257 - DNA, 22 bp, Artificial Sequence
  Synthetic oligonucleotide; CTC chr2 60461296 60461317 60461313 60461318 +
tcgtcgcccacgcccacgaccg

SEQ ID NO: 195258 - DNA, 22 bp, Artificial Sequence
  Synthetic oligonucleotide; CTC chr2 60461298 60461319 60461315 60461320 +
gtcgcccacgcccacgaccgcg

SEQ ID NO: 195259 - DNA, 22 bp, Artificial Sequence
  Synthetic oligonucleotide; CTG chr2 60461332 60461353 60461349 60461354 +
ttctcgtggtggcgcgccgcct

SEQ ID NO: 195260 - DNA, 22 bp, Artificial Sequence
  Synthetic oligonucleotide; TTC chr2 60461335 60461356 60461352 60461357 +
tcgtggtggcgcgccgcctcca

SEQ ID NO: 195261 - DNA, 22 bp, Artificial Sequence
  Synthetic oligonucleotide; CTC chr2 60461337 60461358 60461354 60461359 +
gtggtggcgcgccgcctccagg

SEQ ID NO: 195262 - DNA, 22 bp, Artificial Sequence
  Synthetic oligonucleotide; CTC chr2 60461355 60461376 60461372 60461377 +
caggctcagcccgaagccgtag

SEQ ID NO: 195263 - DNA, 22 bp, Artificial Sequence
  Synthetic oligonucleotide; CTC chr2 60461362 60461383 60461379 60461384 +
agcccgaagccgtagtccaccc

SEQ ID NO: 195264 - DNA, 22 bp, Artificial Sequence
  Synthetic oligonucleotide; CTC chr2 60461386 60461407 60461403 60461408 +
tcgctctccgtcagctcctcct

SEQ ID NO: 195265 - DNA, 22 bp, Artificial Sequence
  Synthetic oligonucleotide; CTC chr2 60461388 60461409 60461405 60461410 +
gctctccgtcagctcctcctcc

SEQ ID NO: 195266 - DNA, 22 bp, Artificial Sequence
  Synthetic oligonucleotide; CTC chr2 60461392 60461413 60461409 60461414 +
tccgtcagctcctcctcctcct

SEQ ID NO: 195267 - DNA, 22 bp, Artificial Sequence
  Synthetic oligonucleotide; CTC chr2 60461394 60461415 60461411 60461416 +
cgtcagctcctcctcctcctct

SEQ ID NO: 195268 - DNA, 22 bp, Artificial Sequence
  Synthetic oligonucleotide; CTC chr2 60461403 60461424 60461420 60461425 +
ctcctcctcctcttcctcctct

SEQ ID NO: 195269 - DNA, 22 bp, Artificial Sequence
  Synthetic oligonucleotide; CTC chr2 60461406 60461427 60461423 60461428 +
ctcctcctcttcctcctcttct

SEQ ID NO: 195270 - DNA, 22 bp, Artificial Sequence
  Synthetic oligonucleotide; CTC chr2 60461409 60461430 60461426 60461431 +
ctcctcttcctcctcttcttcc

SEQ ID NO: 195271 - DNA, 22 bp, Artificial Sequence
  Synthetic oligonucleotide; CTC chr2 60461412 60461433 60461429 60461434 +
ctcttcctcctcttcttcctct

SEQ ID NO: 195272 - DNA, 22 bp, Artificial Sequence
  Synthetic oligonucleotide; CTC chr2 60461415 60461436 60461432 60461437 +
ttcctcctcttcttcctcttcc

SEQ ID NO: 195273 - DNA, 22 bp, Artificial Sequence
  Synthetic oligonucleotide; CTT chr2 60461417 60461438 60461434 60461439 +
cctcctcttcttcctcttcctc

SEQ ID NO: 195274 - DNA, 22 bp, Artificial Sequence
  Synthetic oligonucleotide; TTC chr2 60461418 60461439 60461435 60461440 +
ctcctcttcttcctcttcctcg

SEQ ID NO: 195275 - DNA, 22 bp, Artificial Sequence
  Synthetic oligonucleotide; CTC chr2 60461421 60461442 60461438 60461443 +
ctcttcttcctcttcctcgtcg

SEQ ID NO: 195276 - DNA, 22 bp, Artificial Sequence
  Synthetic oligonucleotide; CTC chr2 60461424 60461445 60461441 60461446 +
ttcttcctcttcctcgtcgtcc

SEQ ID NO: 195277 - DNA, 22 bp, Artificial Sequence
  Synthetic oligonucleotide; CTT chr2 60461426 60461447 60461443 60461448 +
cttcctcttcctcgtcgtcctc

SEQ ID NO: 195278 - DNA, 22 bp, Artificial Sequence
  Synthetic oligonucleotide; TTC chr2 60461427 60461448 60461444 60461449 +
ttcctcttcctcgtcgtcctcc

SEQ ID NO: 195279 - DNA, 22 bp, Artificial Sequence
  Synthetic oligonucleotide; CTT chr2 60461429 60461450 60461446 60461451 +
cctcttcctcgtcgtcctcctc

SEQ ID NO: 195280 - DNA, 22 bp, Artificial Sequence
  Synthetic oligonucleotide; TTC chr2 60461430 60461451 60461447 60461452 +
ctcttcctcgtcgtcctcctct

SEQ ID NO: 195281 - DNA, 22 bp, Artificial Sequence
  Synthetic oligonucleotide; CTC chr2 60461433 60461454 60461450 60461455 +
ttcctcgtcgtcctcctcttcc

SEQ ID NO: 195282 - DNA, 22 bp, Artificial Sequence
  Synthetic oligonucleotide; CTT chr2 60461435 60461456 60461452 60461457 +
cctcgtcgtcctcctcttcctc

SEQ ID NO: 195283 - DNA, 22 bp, Artificial Sequence
  Synthetic oligonucleotide; TTC chr2 60461436 60461457 60461453 60461458 +
ctcgtcgtcctcctcttcctcc

SEQ ID NO: 195284 - DNA, 22 bp, Artificial Sequence
  Synthetic oligonucleotide; CTC chr2 60461439 60461460 60461456 60461461 +
gtcgtcctcctcttcctcctcg

SEQ ID NO: 195285 - DNA, 22 bp, Artificial Sequence
  Synthetic oligonucleotide; CTC chr2 60461448 60461469 60461465 60461470 +
ctcttcctcctcgtccccgttc

SEQ ID NO: 195286 - DNA, 22 bp, Artificial Sequence
  Synthetic oligonucleotide; CTC chr2 60461451 60461472 60461468 60461473 +
ttcctcctcgtccccgttctcc

SEQ ID NO: 195287 - DNA, 22 bp, Artificial Sequence
  Synthetic oligonucleotide; CTT chr2 60461453 60461474 60461470 60461475 +
cctcctcgtccccgttctccgg

SEQ ID NO: 195288 - DNA, 22 bp, Artificial Sequence
  Synthetic oligonucleotide; TTC chr2 60461454 60461475 60461471 60461476 +
ctcctcgtccccgttctccggg

SEQ ID NO: 195289 - DNA, 22 bp, Artificial Sequence
  Synthetic oligonucleotide; CTC chr2 60461457 60461478 60461474 60461479 +
ctcgtccccgttctccgggatc

SEQ ID NO: 195290 - DNA, 22 bp, Artificial Sequence
  Synthetic oligonucleotide; CTC chr2 60461460 60461481 60461477 60461482 +
gtccccgttctccgggatcagg

SEQ ID NO: 195291 - DNA, 22 bp, Artificial Sequence
  Synthetic oligonucleotide; TTC chr2 60461470 60461491 60461487 60461492 +
tccgggatcaggttggggtcgt

SEQ ID NO: 195292 - DNA, 22 bp, Artificial Sequence
  Synthetic oligonucleotide; CTC chr2 60461472 60461493 60461489 60461494 +
cgggatcaggttggggtcgttc

SEQ ID NO: 195293 - DNA, 22 bp, Artificial Sequence
  Synthetic oligonucleotide; TTG chr2 60461485 60461506 60461502 60461507 +
gggtcgttctcgctcttgaact

SEQ ID NO: 195294 - DNA, 22 bp, Artificial Sequence
  Synthetic oligonucleotide; TTC chr2 60461494 60461515 60461511 60461516 +
tcgctcttgaacttggccacca

SEQ ID NO: 195295 - DNA, 22 bp, Artificial Sequence
  Synthetic oligonucleotide; CTC chr2 60461496 60461517 60461513 60461518 +
gctcttgaacttggccaccacg

SEQ ID NO: 195296 - DNA, 22 bp, Artificial Sequence
  Synthetic oligonucleotide; CTC chr2 60461500 60461521 60461517 60461522 +
ttgaacttggccaccacggact

SEQ ID NO: 195297 - DNA, 22 bp, Artificial Sequence
  Synthetic oligonucleotide; CTT chr2 60461502 60461523 60461519 60461524 +
gaacttggccaccacggacttg

SEQ ID NO: 195298 - DNA, 22 bp, Artificial Sequence
  Synthetic oligonucleotide; TTG chr2 60461503 60461524 60461520 60461525 +
aacttggccaccacggacttga

SEQ ID NO: 195299 - DNA, 22 bp, Artificial Sequence
  Synthetic oligonucleotide; CTT chr2 60461508 60461529 60461525 60461530 +
ggccaccacggacttgagcgcg

SEQ ID NO: 195300 - DNA, 22 bp, Artificial Sequence
  Synthetic oligonucleotide; TTG chr2 60461509 60461530 60461526 60461531 +
gccaccacggacttgagcgcgc

SEQ ID NO: 195301 - DNA, 22 bp, Artificial Sequence
  Synthetic oligonucleotide; CTT chr2 60461523 60461544 60461540 60461545 +
gagcgcgctgctggcgctgccc

SEQ ID NO: 195302 - DNA, 22 bp, Artificial Sequence
  Synthetic oligonucleotide; TTG chr2 60461524 60461545 60461541 60461546 +
agcgcgctgctggcgctgccca

SEQ ID NO: 195303 - DNA, 22 bp, Artificial Sequence
  Synthetic oligonucleotide; CTG chr2 60461533 60461554 60461550 60461555 +
ctggcgctgcccaccaagtcgc

SEQ ID NO: 195304 - DNA, 22 bp, Artificial Sequence
  Synthetic oligonucleotide; CTG chr2 60461536 60461557 60461553 60461558 +
gcgctgcccaccaagtcgctgg

SEQ ID NO: 195305 - DNA, 22 bp, Artificial Sequence
  Synthetic oligonucleotide; CTG chr2 60461542 60461563 60461559 60461564 +
cccaccaagtcgctggtgccgg

SEQ ID NO: 195306 - DNA, 22 bp, Artificial Sequence
  Synthetic oligonucleotide; CTG chr2 60461557 60461578 60461574 60461579 +
gtgccgggttccggggagctgg

SEQ ID NO: 195307 - DNA, 22 bp, Artificial Sequence
  Synthetic oligonucleotide; TTC chr2 60461568 60461589 60461585 60461590 +
cggggagctggcggtggagaga

SEQ ID NO: 195308 - DNA, 22 bp, Artificial Sequence
  Synthetic oligonucleotide; CTG chr2 60461578 60461599 60461595 60461600 +
gcggtggagagaccgtcgtcgg

SEQ ID NO: 195309 - DNA, 22 bp, Artificial Sequence
  Synthetic oligonucleotide; CTT chr2 60461604 60461625 60461621 60461626 +
gaccgtcatgggggacgatttg

SEQ ID NO: 195310 - DNA, 22 bp, Artificial Sequence
  Synthetic oligonucleotide; TTG chr2 60461605 60461626 60461622 60461627 +
accgtcatgggggacgatttgt

SEQ ID NO: 195311 - DNA, 22 bp, Artificial Sequence
  Synthetic oligonucleotide; TTT chr2 60461625 60461646 60461642 60461647 +
gtgcatgtgcgtcttcatgtgg

SEQ ID NO: 195312 - DNA, 22 bp, Artificial Sequence
  Synthetic oligonucleotide; TTG chr2 60461626 60461647 60461643 60461648 +
tgcatgtgcgtcttcatgtggc

SEQ ID NO: 195313 - DNA, 22 bp, Artificial Sequence
  Synthetic oligonucleotide; CTT chr2 60461640 60461661 60461657 60461662 +
catgtggcgcttcagcttgctg

SEQ ID NO: 195314 - DNA, 22 bp, Artificial Sequence
  Synthetic oligonucleotide; TTC chr2 60461641 60461662 60461658 60461663 +
atgtggcgcttcagcttgctgg

SEQ ID NO: 195315 - DNA, 22 bp, Artificial Sequence
  Synthetic oligonucleotide; CTT chr2 60461652 60461673 60461669 60461674 +
cagcttgctggcctgggtgcac

SEQ ID NO: 195316 - DNA, 22 bp, Artificial Sequence
  Synthetic oligonucleotide; TTC chr2 60461653 60461674 60461670 60461675 +
agcttgctggcctgggtgcacg

SEQ ID NO: 195317 - DNA, 22 bp, Artificial Sequence
  Synthetic oligonucleotide; CTT chr2 60461658 60461679 60461675 60461680 +
gctggcctgggtgcacgcgtgg

SEQ ID NO: 195318 - DNA, 22 bp, Artificial Sequence
  Synthetic oligonucleotide; TTG chr2 60461659 60461680 60461676 60461681 +
ctggcctgggtgcacgcgtggt

SEQ ID NO: 195319 - DNA, 22 bp, Artificial Sequence
  Synthetic oligonucleotide; CTG chr2 60461662 60461683 60461679 60461684 +
gcctgggtgcacgcgtggtcgc

SEQ ID NO: 195320 - DNA, 22 bp, Artificial Sequence
  Synthetic oligonucleotide; CTG chr2 60461667 60461688 60461684 60461689 +
ggtgcacgcgtggtcgcacagg

SEQ ID NO: 195321 - DNA, 22 bp, Artificial Sequence
  Synthetic oligonucleotide; TTG chr2 60461692 60461713 60461709 60461714 +
cacttgtagggcttctcgcccg

SEQ ID NO: 195322 - DNA, 22 bp, Artificial Sequence
  Synthetic oligonucleotide; CTT chr2 60461697 60461718 60461714 60461719 +
gtagggcttctcgcccgtgtgg

SEQ ID NO: 195323 - DNA, 22 bp, Artificial Sequence
  Synthetic oligonucleotide; TTG chr2 60461698 60461719 60461715 60461720 +
tagggcttctcgcccgtgtggc

SEQ ID NO: 195324 - DNA, 22 bp, Artificial Sequence
  Synthetic oligonucleotide; CTT chr2 60461706 60461727 60461723 60461728 +
ctcgcccgtgtggctgcgccgg

SEQ ID NO: 195325 - DNA, 22 bp, Artificial Sequence
  Synthetic oligonucleotide; TTC chr2 60461707 60461728 60461724 60461729 +
tcgcccgtgtggctgcgccggt

SEQ ID NO: 195326 - DNA, 22 bp, Artificial Sequence
  Synthetic oligonucleotide; CTC chr2 60461709 60461730 60461726 60461731 +
gcccgtgtggctgcgccggtgc

SEQ ID NO: 195327 - DNA, 22 bp, Artificial Sequence
  Synthetic oligonucleotide; CTG chr2 60461722 60461743 60461739 60461744 +
cgccggtgcaccaccaggttgc

SEQ ID NO: 195328 - DNA, 22 bp, Artificial Sequence
  Synthetic oligonucleotide; TTG chr2 60461743 60461764 60461760 60461765 +
ctctgaaatttgaacgtcttgc

SEQ ID NO: 195329 - DNA, 22 bp, Artificial Sequence
  Synthetic oligonucleotide; CTC chr2 60461746 60461767 60461763 60461768 +
tgaaatttgaacgtcttgccgc

SEQ ID NO: 195330 - DNA, 22 bp, Artificial Sequence
  Synthetic oligonucleotide; CTG chr2 60461748 60461769 60461765 60461770 +
aaatttgaacgtcttgccgcag

SEQ ID NO: 195331 - DNA, 22 bp, Artificial Sequence
  Synthetic oligonucleotide; TTT chr2 60461754 60461775 60461771 60461776 +
gaacgtcttgccgcagaactcg

SEQ ID NO: 195332 - DNA, 22 bp, Artificial Sequence
  Synthetic oligonucleotide; TTG chr2 60461755 60461776 60461772 60461777 +
aacgtcttgccgcagaactcgc

SEQ ID NO: 195333 - DNA, 22 bp, Artificial Sequence
  Synthetic oligonucleotide; CTT chr2 60461763 60461784 60461780 60461785 +
gccgcagaactcgcatgacttg

SEQ ID NO: 195334 - DNA, 22 bp, Artificial Sequence
  Synthetic oligonucleotide; TTG chr2 60461764 60461785 60461781 60461786 +
ccgcagaactcgcatgacttgg

SEQ ID NO: 195335 - DNA, 22 bp, Artificial Sequence
  Synthetic oligonucleotide; CTC chr2 60461775 60461796 60461792 60461797 +
gcatgacttggacttgaccggg

SEQ ID NO: 195336 - DNA, 22 bp, Artificial Sequence
  Synthetic oligonucleotide; CTT chr2 60461784 60461805 60461801 60461806 +
ggacttgaccgggggctgggag

SEQ ID NO: 195337 - DNA, 22 bp, Artificial Sequence
  Synthetic oligonucleotide; TTG chr2 60461785 60461806 60461802 60461807 +
gacttgaccgggggctgggagg

SEQ ID NO: 195338 - DNA, 22 bp, Artificial Sequence
  Synthetic oligonucleotide; CTT chr2 60461790 60461811 60461807 60461812 +
gaccgggggctgggagggagga

SEQ ID NO: 195339 - DNA, 22 bp, Artificial Sequence
  Synthetic oligonucleotide; TTG chr2 60461791 60461812 60461808 60461813 +
accgggggctgggagggaggag

SEQ ID NO: 195340 - DNA, 22 bp, Artificial Sequence
  Synthetic oligonucleotide; CTG chr2 60461802 60461823 60461819 60461824 +
ggagggaggaggggcggattgc

SEQ ID NO: 195341 - DNA, 22 bp, Artificial Sequence
  Synthetic oligonucleotide; TTG chr2 60461823 60461844 60461840 60461845 +
cagaggagggagggggggcgtc

SEQ ID NO: 195342 - DNA, 22 bp, Artificial Sequence
  Synthetic oligonucleotide; CTT chr2 60461862 60461883 60461879 60461884 +
gctacctggctggaatggttgc

SEQ ID NO: 195343 - DNA, 22 bp, Artificial Sequence
  Synthetic oligonucleotide; TTG chr2 60461863 60461884 60461880 60461885 +
ctacctggctggaatggttgca

SEQ ID NO: 195344 - DNA, 22 bp, Artificial Sequence
  Synthetic oligonucleotide; CTA chr2 60461866 60461887 60461883 60461888 +
cctggctggaatggttgcagta

SEQ ID NO: 195345 - DNA, 22 bp, Artificial Sequence
  Synthetic oligonucleotide; CTG chr2 60461870 60461891 60461887 60461892 +
gctggaatggttgcagtaacct

SEQ ID NO: 195346 - DNA, 22 bp, Artificial Sequence
  Synthetic oligonucleotide; CTG chr2 60461874 60461895 60461891 60461896 +
gaatggttgcagtaacctttgc

SEQ ID NO: 195347 - DNA, 22 bp, Artificial Sequence
  Synthetic oligonucleotide; TTG chr2 60461883 60461904 60461900 60461905 +
cagtaacctttgcatagggctg

SEQ ID NO: 195348 - DNA, 22 bp, Artificial Sequence
  Synthetic oligonucleotide; CTT chr2 60461893 60461914 60461910 60461915 +
tgcatagggctgggccggcctg

SEQ ID NO: 195349 - DNA, 22 bp, Artificial Sequence
  Synthetic oligonucleotide; TTT chr2 60461894 60461915 60461911 60461916 +
gcatagggctgggccggcctgg

SEQ ID NO: 195350 - DNA, 22 bp, Artificial Sequence
  Synthetic oligonucleotide; TTG chr2 60461895 60461916 60461912 60461917 +
catagggctgggccggcctggg

SEQ ID NO: 195351 - DNA, 22 bp, Artificial Sequence
  Synthetic oligonucleotide; CTG chr2 60461905 60461926 60461922 60461927 +
ggccggcctggggacagcggtg

SEQ ID NO: 195352 - DNA, 22 bp, Artificial Sequence
  Synthetic oligonucleotide; CTG chr2 60461915 60461936 60461932 60461937 +
gggacagcggtgggctagacgt

SEQ ID NO: 195353 - DNA, 22 bp, Artificial Sequence
  Synthetic oligonucleotide; CTA chr2 60461932 60461953 60461949 60461954 +
gacgtgttccctgccagctctc

SEQ ID NO: 195354 - DNA, 22 bp, Artificial Sequence
  Synthetic oligonucleotide; TTC chr2 60461941 60461962 60461958 60461963 +
cctgccagctctctaagtctcc

SEQ ID NO: 195355 - DNA, 22 bp, Artificial Sequence
  Synthetic oligonucleotide; CTG chr2 60461945 60461966 60461962 60461967 +
ccagctctctaagtctcctaga

SEQ ID NO: 195356 - DNA, 22 bp, Artificial Sequence
  Synthetic oligonucleotide; CTC chr2 60461952 60461973 60461969 60461974 +
tctaagtctcctagagaaatcc

SEQ ID NO: 195357 - DNA, 22 bp, Artificial Sequence
  Synthetic oligonucleotide; CTC chr2 60461954 60461975 60461971 60461976 +
taagtctcctagagaaatccat

SEQ ID NO: 195358 - DNA, 22 bp, Artificial Sequence
  Synthetic oligonucleotide; CTA chr2 60461956 60461977 60461973 60461978 +
agtctcctagagaaatccatgg

SEQ ID NO: 195359 - DNA, 22 bp, Artificial Sequence
  Synthetic oligonucleotide; CTC chr2 60461962 60461983 60461979 60461984 +
ctagagaaatccatggcgggag

SEQ ID NO: 195360 - DNA, 22 bp, Artificial Sequence
  Synthetic oligonucleotide; CTA chr2 60461965 60461986 60461982 60461987 +
gagaaatccatggcgggaggct

SEQ ID NO: 195361 - DNA, 22 bp, Artificial Sequence
  Synthetic oligonucleotide; CTC chr2 60461988 60462009 60462005 60462010 +
catagccattggattcaaccgc

SEQ ID NO: 195362 - DNA, 22 bp, Artificial Sequence
  Synthetic oligonucleotide; TTG chr2 60461999 60462020 60462016 60462021 +
gattcaaccgcagcaccctgtc

SEQ ID NO: 195363 - DNA, 22 bp, Artificial Sequence
  Synthetic oligonucleotide; TTC chr2 60462004 60462025 60462021 60462026 +
aaccgcagcaccctgtcaaagg

SEQ ID NO: 195364 - DNA, 22 bp, Artificial Sequence
  Synthetic oligonucleotide; CTG chr2 60462019 60462040 60462036 60462041 +
tcaaaggcactcgggtgatggg

SEQ ID NO: 195365 - DNA, 22 bp, Artificial Sequence
  Synthetic oligonucleotide; CTC chr2 60462031 60462052 60462048 60462053 +
gggtgatgggtggccagggcca

SEQ ID NO: 195366 - DNA, 22 bp, Artificial Sequence
  Synthetic oligonucleotide; CTC chr2 60462057 60462078 60462074 60462079 +
ttccgcccccaggcgctctatg

SEQ ID NO: 195367 - DNA, 22 bp, Artificial Sequence
  Synthetic oligonucleotide; CTT chr2 60462059 60462080 60462076 60462081 +
ccgcccccaggcgctctatgcg

SEQ ID NO: 195368 - DNA, 22 bp, Artificial Sequence
  Synthetic oligonucleotide; TTC chr2 60462060 60462081 60462077 60462082 +
cgcccccaggcgctctatgcgg

SEQ ID NO: 195369 - DNA, 22 bp, Artificial Sequence
  Synthetic oligonucleotide; CTC chr2 60462075 60462096 60462092 60462097 +
tatgcggtgggggtccaagtga

SEQ ID NO: 195370 - DNA, 22 bp, Artificial Sequence
  Synthetic oligonucleotide; CTA chr2 60462077 60462098 60462094 60462099 +
tgcggtgggggtccaagtgatg

SEQ ID NO: 195371 - DNA, 22 bp, Artificial Sequence
  Synthetic oligonucleotide; CTC chr2 60462103 60462124 60462120 60462125 +
ggtggtggactaaacagggggg

SEQ ID NO: 195372 - DNA, 22 bp, Artificial Sequence
  Synthetic oligonucleotide; CTA chr2 60462115 60462136 60462132 60462137 +
aacagggggggagtgggtggaa

SEQ ID NO: 195373 - DNA, 22 bp, Artificial Sequence
  Synthetic oligonucleotide; CTT chr2 60462146 60462167 60462163 60462168 +
ctgccaggccggaagcctctct

SEQ ID NO: 195374 - DNA, 22 bp, Artificial Sequence
  Synthetic oligonucleotide; TTC chr2 60462147 60462168 60462164 60462169 +
tgccaggccggaagcctctctc

SEQ ID NO: 195375 - DNA, 22 bp, Artificial Sequence
  Synthetic oligonucleotide; CTG chr2 60462149 60462170 60462166 60462171 +
ccaggccggaagcctctctcga

SEQ ID NO: 195376 - DNA, 22 bp, Artificial Sequence
  Synthetic oligonucleotide; CTC chr2 60462165 60462186 60462182 60462187 +
tctcgatactgatcctggtatt

SEQ ID NO: 195377 - DNA, 22 bp, Artificial Sequence
  Synthetic oligonucleotide; CTC chr2 60462167 60462188 60462184 60462189 +
tcgatactgatcctggtattct

SEQ ID NO: 195378 - DNA, 22 bp, Artificial Sequence
  Synthetic oligonucleotide; CTC chr2 60462169 60462190 60462186 60462191 +
gatactgatcctggtattctta

SEQ ID NO: 195379 - DNA, 22 bp, Artificial Sequence
  Synthetic oligonucleotide; CTG chr2 60462176 60462197 60462193 60462198 +
atcctggtattcttagcaggtt

SEQ ID NO: 195380 - DNA, 22 bp, Artificial Sequence
  Synthetic oligonucleotide; CTG chr2 60462182 60462203 60462199 60462204 +
gtattcttagcaggttaaaggg

SEQ ID NO: 195381 - DNA, 22 bp, Artificial Sequence
  Synthetic oligonucleotide; TTC chr2 60462188 60462209 60462205 60462210 +
ttagcaggttaaaggggttatt

SEQ ID NO: 195382 - DNA, 22 bp, Artificial Sequence
  Synthetic oligonucleotide; CTT chr2 60462190 60462211 60462207 60462212 +
agcaggttaaaggggttattgt

SEQ ID NO: 195383 - DNA, 22 bp, Artificial Sequence
  Synthetic oligonucleotide; TTA chr2 60462191 60462212 60462208 60462213 +
gcaggttaaaggggttattgtc

SEQ ID NO: 195384 - DNA, 22 bp, Artificial Sequence
  Synthetic oligonucleotide; TTA chr2 60462199 60462220 60462216 60462221 +
aaggggttattgtctgcaatat

SEQ ID NO: 195385 - DNA, 22 bp, Artificial Sequence
  Synthetic oligonucleotide; TTA chr2 60462208 60462229 60462225 60462230 +
ttgtctgcaatatgaatcccat

SEQ ID NO: 195386 - DNA, 22 bp, Artificial Sequence
  Synthetic oligonucleotide; TTG chr2 60462211 60462232 60462228 60462233 +
tctgcaatatgaatcccatgga

SEQ ID NO: 195387 - DNA, 22 bp, Artificial Sequence
  Synthetic oligonucleotide; CTG chr2 60462215 60462236 60462232 60462237 +
caatatgaatcccatggagagg

SEQ ID NO: 195388 - DNA, 22 bp, Artificial Sequence
  Synthetic oligonucleotide; CTG chr2 60462243 60462264 60462260 60462265 +
ggaaggacattctgcacctagt

SEQ ID NO: 195389 - DNA, 22 bp, Artificial Sequence
  Synthetic oligonucleotide; TTC chr2 60462255 60462276 60462272 60462277 +
tgcacctagtcctgaagggata

SEQ ID NO: 195390 - DNA, 22 bp, Artificial Sequence
  Synthetic oligonucleotide; CTG chr2 60462257 60462278 60462274 60462279 +
cacctagtcctgaagggatacc

SEQ ID NO: 195391 - DNA, 22 bp, Artificial Sequence
  Synthetic oligonucleotide; CTA chr2 60462263 60462284 60462280 60462285 +
gtcctgaagggataccaacccg

SEQ ID NO: 195392 - DNA, 22 bp, Artificial Sequence
  Synthetic oligonucleotide; CTG chr2 60462269 60462290 60462286 60462291 +
aagggataccaacccgcggggt

SEQ ID NO: 195393 - DNA, 22 bp, Artificial Sequence
  Synthetic oligonucleotide; CTT chr2 60462301 60462322 60462318 60462323 +
ccgtgttcgctttctaagtaga

SEQ ID NO: 195394 - DNA, 22 bp, Artificial Sequence
  Synthetic oligonucleotide; TTC chr2 60462302 60462323 60462319 60462324 +
cgtgttcgctttctaagtagat

SEQ ID NO: 195395 - DNA, 22 bp, Artificial Sequence
  Synthetic oligonucleotide; TTC chr2 60462309 60462330 60462326 60462331 +
gctttctaagtagattcttaat

SEQ ID NO: 195396 - DNA, 22 bp, Artificial Sequence
  Synthetic oligonucleotide; CTT chr2 60462313 60462334 60462330 60462335 +
tctaagtagattcttaatccat

SEQ ID NO: 195397 - DNA, 22 bp, Artificial Sequence
  Synthetic oligonucleotide; TTT chr2 60462314 60462335 60462331 60462336 +
ctaagtagattcttaatccatg

SEQ ID NO: 195398 - DNA, 22 bp, Artificial Sequence
  Synthetic oligonucleotide; TTC chr2 60462315 60462336 60462332 60462337 +
taagtagattcttaatccatga

SEQ ID NO: 195399 - DNA, 22 bp, Artificial Sequence
  Synthetic oligonucleotide; CTA chr2 60462317 60462338 60462334 60462339 +
agtagattcttaatccatgagt

SEQ ID NO: 195400 - DNA, 22 bp, Artificial Sequence
  Synthetic oligonucleotide; TTC chr2 60462326 60462347 60462343 60462348 +
ttaatccatgagtgttctgtgc

SEQ ID NO: 195401 - DNA, 22 bp, Artificial Sequence
  Synthetic oligonucleotide; CTT chr2 60462328 60462349 60462345 60462350 +
aatccatgagtgttctgtgcgt

SEQ ID NO: 195402 - DNA, 22 bp, Artificial Sequence
  Synthetic oligonucleotide; TTA chr2 60462329 60462350 60462346 60462351 +
atccatgagtgttctgtgcgtg

SEQ ID NO: 195403 - DNA, 22 bp, Artificial Sequence
  Synthetic oligonucleotide; TTC chr2 60462343 60462364 60462360 60462365 +
tgtgcgtgttgcaagagaaacc

SEQ ID NO: 195404 - DNA, 22 bp, Artificial Sequence
  Synthetic oligonucleotide; CTG chr2 60462345 60462366 60462362 60462367 +
tgcgtgttgcaagagaaaccat

SEQ ID NO: 195405 - DNA, 22 bp, Artificial Sequence
  Synthetic oligonucleotide; TTG chr2 60462354 60462375 60462371 60462376 +
caagagaaaccatgcactggtg

SEQ ID NO: 195406 - DNA, 22 bp, Artificial Sequence
  Synthetic oligonucleotide; CTG chr2 60462373 60462394 60462390 60462395 +
gtgaatggctgtttgcaagttg

SEQ ID NO: 195407 - DNA, 22 bp, Artificial Sequence
  Synthetic oligonucleotide; CTG chr2 60462384 60462405 60462401 60462406 +
tttgcaagttgtacatgtgtag

SEQ ID NO: 195408 - DNA, 22 bp, Artificial Sequence
  Synthetic oligonucleotide; TTT chr2 60462387 60462408 60462404 60462409 +
gcaagttgtacatgtgtagctg

SEQ ID NO: 195409 - DNA, 22 bp, Artificial Sequence
  Synthetic oligonucleotide; TTG chr2 60462388 60462409 60462405 60462410 +
caagttgtacatgtgtagctgc

SEQ ID NO: 195410 - DNA, 22 bp, Artificial Sequence
  Synthetic oligonucleotide; TTG chr2 60462395 60462416 60462412 60462417 +
tacatgtgtagctgctgggctc

SEQ ID NO: 195411 - DNA, 22 bp, Artificial Sequence
  Synthetic oligonucleotide; CTG chr2 60462409 60462430 60462426 60462431 +
ctgggctcatctttacctgcaa

SEQ ID NO: 195412 - DNA, 22 bp, Artificial Sequence
  Synthetic oligonucleotide; CTG chr2 60462412 60462433 60462429 60462434 +
ggctcatctttacctgcaaaat

SEQ ID NO: 195413 - DNA, 22 bp, Artificial Sequence
  Synthetic oligonucleotide; CTC chr2 60462417 60462438 60462434 60462439 +
atctttacctgcaaaataatac

SEQ ID NO: 195414 - DNA, 22 bp, Artificial Sequence
  Synthetic oligonucleotide; CTT chr2 60462422 60462443 60462439 60462444 +
tacctgcaaaataatacaacac

SEQ ID NO: 195415 - DNA, 22 bp, Artificial Sequence
  Synthetic oligonucleotide; TTT chr2 60462423 60462444 60462440 60462445 +
acctgcaaaataatacaacacc

SEQ ID NO: 195416 - DNA, 22 bp, Artificial Sequence
  Synthetic oligonucleotide; TTA chr2 60462424 60462445 60462441 60462446 +
cctgcaaaataatacaacacca

SEQ ID NO: 195417 - DNA, 22 bp, Artificial Sequence
  Synthetic oligonucleotide; CTG chr2 60462428 60462449 60462445 60462450 +
caaaataatacaacaccaacat

SEQ ID NO: 195418 - DNA, 22 bp, Artificial Sequence
  Synthetic oligonucleotide; TTT chr2 60462458 60462479 60462475 60462480 +
aatcactgaggcgggcatcagc

SEQ ID NO: 195419 - DNA, 22 bp, Artificial Sequence
  Synthetic oligonucleotide; TTA chr2 60462459 60462480 60462476 60462481 +
atcactgaggcgggcatcagca

SEQ ID NO: 195420 - DNA, 22 bp, Artificial Sequence
  Synthetic oligonucleotide; CTG chr2 60462466 60462487 60462483 60462488 +
aggcgggcatcagcaattgctt

SEQ ID NO: 195421 - DNA, 22 bp, Artificial Sequence
  Synthetic oligonucleotide; TTG chr2 60462485 60462506 60462502 60462507 +
cttatttatgttccacctccag

SEQ ID NO: 195422 - DNA, 22 bp, Artificial Sequence
  Synthetic oligonucleotide; CTT chr2 60462488 60462509 60462505 60462510 +
atttatgttccacctccagcct

SEQ ID NO: 195423 - DNA, 22 bp, Artificial Sequence
  Synthetic oligonucleotide; TTA chr2 60462489 60462510 60462506 60462511 +
tttatgttccacctccagcctt

SEQ ID NO: 195424 - DNA, 22 bp, Artificial Sequence
  Synthetic oligonucleotide; TTT chr2 60462492 60462513 60462509 60462514 +
atgttccacctccagccttccc

SEQ ID NO: 195425 - DNA, 22 bp, Artificial Sequence
  Synthetic oligonucleotide; TTA chr2 60462493 60462514 60462510 60462515 +
tgttccacctccagccttccct

SEQ ID NO: 195426 - DNA, 22 bp, Artificial Sequence
  Synthetic oligonucleotide; TTC chr2 60462498 60462519 60462515 60462520 +
cacctccagccttccctgcccc

SEQ ID NO: 195427 - DNA, 22 bp, Artificial Sequence
  Synthetic oligonucleotide; CTC chr2 60462504 60462525 60462521 60462526 +
cagccttccctgcccccacccc

SEQ ID NO: 195428 - DNA, 22 bp, Artificial Sequence
  Synthetic oligonucleotide; CTT chr2 60462511 60462532 60462528 60462533 +
ccctgcccccacccctcaaccc

SEQ ID NO: 195429 - DNA, 22 bp, Artificial Sequence
  Synthetic oligonucleotide; TTC chr2 60462512 60462533 60462529 60462534 +
cctgcccccacccctcaacccc

SEQ ID NO: 195430 - DNA, 22 bp, Artificial Sequence
  Synthetic oligonucleotide; CTG chr2 60462516 60462537 60462533 60462538 +
cccccacccctcaaccccaagg

SEQ ID NO: 195431 - DNA, 22 bp, Artificial Sequence
  Synthetic oligonucleotide; CTC chr2 60462528 60462549 60462545 60462550 +
aaccccaaggcctaagccctca

SEQ ID NO: 195432 - DNA, 22 bp, Artificial Sequence
  Synthetic oligonucleotide; CTA chr2 60462542 60462563 60462559 60462564 +
agccctcactgacctaccccct

SEQ ID NO: 195433 - DNA, 22 bp, Artificial Sequence
  Synthetic oligonucleotide; CTC chr2 60462549 60462570 60462566 60462571 +
actgacctaccccctgtgcctg

SEQ ID NO: 195434 - DNA, 22 bp, Artificial Sequence
  Synthetic oligonucleotide; CTG chr2 60462553 60462574 60462570 60462575 +
acctaccccctgtgcctggcac

SEQ ID NO: 195435 - DNA, 22 bp, Artificial Sequence
  Synthetic oligonucleotide; CTA chr2 60462558 60462579 60462575 60462580 +
ccccctgtgcctggcacgtctg

SEQ ID NO: 195436 - DNA, 22 bp, Artificial Sequence
  Synthetic oligonucleotide; CTG chr2 60462565 60462586 60462582 60462587 +
tgcctggcacgtctgagcatgg

SEQ ID NO: 195437 - DNA, 22 bp, Artificial Sequence
  Synthetic oligonucleotide; CTG chr2 60462571 60462592 60462588 60462593 +
gcacgtctgagcatgggtaccc

SEQ ID NO: 195438 - DNA, 22 bp, Artificial Sequence
  Synthetic oligonucleotide; CTG chr2 60462580 60462601 60462597 60462602 +
agcatgggtacccagtaaatat

SEQ ID NO: 195439 - DNA, 22 bp, Artificial Sequence
  Synthetic oligonucleotide; TTG chr2 60462604 60462625 60462621 60462626 +
gtccaattgatcttcctgccat

SEQ ID NO: 195440 - DNA, 22 bp, Artificial Sequence
  Synthetic oligonucleotide; TTG chr2 60462613 60462634 60462630 60462635 +
atcttcctgccattaaactcag

SEQ ID NO: 195441 - DNA, 22 bp, Artificial Sequence
  Synthetic oligonucleotide; CTT chr2 60462618 60462639 60462635 60462640 +
cctgccattaaactcagttcta

SEQ ID NO: 195442 - DNA, 22 bp, Artificial Sequence
  Synthetic oligonucleotide; TTC chr2 60462619 60462640 60462636 60462641 +
ctgccattaaactcagttctag

SEQ ID NO: 195443 - DNA, 22 bp, Artificial Sequence
  Synthetic oligonucleotide; CTG chr2 60462622 60462643 60462639 60462644 +
ccattaaactcagttctagaaa

SEQ ID NO: 195444 - DNA, 22 bp, Artificial Sequence
  Synthetic oligonucleotide; TTA chr2 60462628 60462649 60462645 60462650 +
aactcagttctagaaattttat

SEQ ID NO: 195445 - DNA, 22 bp, Artificial Sequence
  Synthetic oligonucleotide; CTC chr2 60462633 60462654 60462650 60462655 +
agttctagaaattttatatcca

SEQ ID NO: 195446 - DNA, 22 bp, Artificial Sequence
  Synthetic oligonucleotide; TTC chr2 60462638 60462659 60462655 60462660 +
tagaaattttatatccaatccc

SEQ ID NO: 195447 - DNA, 22 bp, Artificial Sequence
  Synthetic oligonucleotide; CTA chr2 60462640 60462661 60462657 60462662 +
gaaattttatatccaatcccca

SEQ ID NO: 195448 - DNA, 22 bp, Artificial Sequence
  Synthetic oligonucleotide; TTT chr2 60462647 60462668 60462664 60462669 +
tatatccaatccccaaagcaga

SEQ ID NO: 195449 - DNA, 22 bp, Artificial Sequence
  Synthetic oligonucleotide; TTT chr2 60462648 60462669 60462665 60462670 +
atatccaatccccaaagcagaa

SEQ ID NO: 195450 - DNA, 22 bp, Artificial Sequence
  Synthetic oligonucleotide; TTA chr2 60462649 60462670 60462666 60462671 +
tatccaatccccaaagcagaaa

SEQ ID NO: 195451 - DNA, 22 bp, Artificial Sequence
  Synthetic oligonucleotide; CTG chr2 60462678 60462699 60462695 60462700 +
accagttctggcttgaggatga

SEQ ID NO: 195452 - DNA, 22 bp, Artificial Sequence
  Synthetic oligonucleotide; TTC chr2 60462686 60462707 60462703 60462708 +
tggcttgaggatgaaggtccct

SEQ ID NO: 195453 - DNA, 22 bp, Artificial Sequence
  Synthetic oligonucleotide; CTG chr2 60462688 60462709 60462705 60462710 +
gcttgaggatgaaggtccctac

SEQ ID NO: 195454 - DNA, 22 bp, Artificial Sequence
  Synthetic oligonucleotide; CTT chr2 60462692 60462713 60462709 60462714 +
gaggatgaaggtccctacattc

SEQ ID NO: 195455 - DNA, 22 bp, Artificial Sequence
  Synthetic oligonucleotide; TTG chr2 60462693 60462714 60462710 60462715 +
aggatgaaggtccctacattct

SEQ ID NO: 195456 - DNA, 22 bp, Artificial Sequence
  Synthetic oligonucleotide; CTA chr2 60462709 60462730 60462726 60462731 +
cattctaggcacctcaacaaat

SEQ ID NO: 195457 - DNA, 22 bp, Artificial Sequence
  Synthetic oligonucleotide; TTC chr2 60462714 60462735 60462731 60462736 +
taggcacctcaacaaatgtctt

SEQ ID NO: 195458 - DNA, 22 bp, Artificial Sequence
  Synthetic oligonucleotide; CTA chr2 60462716 60462737 60462733 60462738 +
ggcacctcaacaaatgtcttct

SEQ ID NO: 195459 - DNA, 22 bp, Artificial Sequence
  Synthetic oligonucleotide; CTC chr2 60462724 60462745 60462741 60462746 +
aacaaatgtcttctaaactttc

SEQ ID NO: 195460 - DNA, 22 bp, Artificial Sequence
  Synthetic oligonucleotide; CTT chr2 60462736 60462757 60462753 60462758 +
ctaaactttccagttccatcag

SEQ ID NO: 195461 - DNA, 22 bp, Artificial Sequence
  Synthetic oligonucleotide; TTC chr2 60462737 60462758 60462754 60462759 +
taaactttccagttccatcagc

SEQ ID NO: 195462 - DNA, 22 bp, Artificial Sequence
  Synthetic oligonucleotide; CTA chr2 60462739 60462760 60462756 60462761 +
aactttccagttccatcagctg

SEQ ID NO: 195463 - DNA, 22 bp, Artificial Sequence
  Synthetic oligonucleotide; CTT chr2 60462744 60462765 60462761 60462766 +
tccagttccatcagctgtagtt

SEQ ID NO: 195464 - DNA, 22 bp, Artificial Sequence
  Synthetic oligonucleotide; TTT chr2 60462745 60462766 60462762 60462767 +
ccagttccatcagctgtagttt

SEQ ID NO: 195465 - DNA, 22 bp, Artificial Sequence
  Synthetic oligonucleotide; TTC chr2 60462746 60462767 60462763 60462768 +
cagttccatcagctgtagtttg

SEQ ID NO: 195466 - DNA, 22 bp, Artificial Sequence
  Synthetic oligonucleotide; TTC chr2 60462752 60462773 60462769 60462774 +
catcagctgtagtttggggcaa

SEQ ID NO: 195467 - DNA, 22 bp, Artificial Sequence
  Synthetic oligonucleotide; CTG chr2 60462761 60462782 60462778 60462783 +
tagtttggggcaagccatctca

SEQ ID NO: 195468 - DNA, 22 bp, Artificial Sequence
  Synthetic oligonucleotide; TTT chr2 60462767 60462788 60462784 60462789 +
ggggcaagccatctcatctcca

SEQ ID NO: 195469 - DNA, 22 bp, Artificial Sequence
  Synthetic oligonucleotide; TTG chr2 60462768 60462789 60462785 60462790 +
gggcaagccatctcatctccat

SEQ ID NO: 195470 - DNA, 22 bp, Artificial Sequence
  Synthetic oligonucleotide; CTC chr2 60462782 60462803 60462799 60462804 +
atctccatgtgcctctgtttcc

SEQ ID NO: 195471 - DNA, 22 bp, Artificial Sequence
  Synthetic oligonucleotide; CTC chr2 60462787 60462808 60462804 60462809 +
catgtgcctctgtttcctcctt

SEQ ID NO: 195472 - DNA, 22 bp, Artificial Sequence
  Synthetic oligonucleotide; CTC chr2 60462797 60462818 60462814 60462819 +
tgtttcctccttgttaagtgag

SEQ ID NO: 195473 - DNA, 22 bp, Artificial Sequence
  Synthetic oligonucleotide; CTG chr2 60462799 60462820 60462816 60462821 +
tttcctccttgttaagtgagaa

SEQ ID NO: 195474 - DNA, 22 bp, Artificial Sequence
  Synthetic oligonucleotide; TTT chr2 60462802 60462823 60462819 60462824 +
cctccttgttaagtgagaaact

SEQ ID NO: 195475 - DNA, 22 bp, Artificial Sequence
  Synthetic oligonucleotide; TTC chr2 60462803 60462824 60462820 60462825 +
ctccttgttaagtgagaaactt

SEQ ID NO: 195476 - DNA, 22 bp, Artificial Sequence
  Synthetic oligonucleotide; CTC chr2 60462806 60462827 60462823 60462828 +
cttgttaagtgagaaacttgga

SEQ ID NO: 195477 - DNA, 22 bp, Artificial Sequence
  Synthetic oligonucleotide; CTT chr2 60462809 60462830 60462826 60462831 +
gttaagtgagaaacttggacaa

SEQ ID NO: 195478 - DNA, 22 bp, Artificial Sequence
  Synthetic oligonucleotide; TTG chr2 60462810 60462831 60462827 60462832 +
ttaagtgagaaacttggacaag

SEQ ID NO: 195479 - DNA, 22 bp, Artificial Sequence
  Synthetic oligonucleotide; TTA chr2 60462813 60462834 60462830 60462835 +
agtgagaaacttggacaaggtg

SEQ ID NO: 195480 - DNA, 22 bp, Artificial Sequence
  Synthetic oligonucleotide; CTT chr2 60462825 60462846 60462842 60462847 +
ggacaaggtgacccaaggaaac

SEQ ID NO: 195481 - DNA, 22 bp, Artificial Sequence
  Synthetic oligonucleotide; TTG chr2 60462826 60462847 60462843 60462848 +
gacaaggtgacccaaggaaact

SEQ ID NO: 195482 - DNA, 22 bp, Artificial Sequence
  Synthetic oligonucleotide; CTT chr2 60462849 60462870 60462866 60462871 +
tttggcttcctaaatcccagct

SEQ ID NO: 195483 - DNA, 22 bp, Artificial Sequence
  Synthetic oligonucleotide; TTT chr2 60462850 60462871 60462867 60462872 +
ttggcttcctaaatcccagctt

SEQ ID NO: 195484 - DNA, 22 bp, Artificial Sequence
  Synthetic oligonucleotide; TTT chr2 60462851 60462872 60462868 60462873 +
tggcttcctaaatcccagcttt

SEQ ID NO: 195485 - DNA, 22 bp, Artificial Sequence
  Synthetic oligonucleotide; TTT chr2 60462852 60462873 60462869 60462874 +
ggcttcctaaatcccagctttc

SEQ ID NO: 195486 - DNA, 22 bp, Artificial Sequence
  Synthetic oligonucleotide; TTG chr2 60462853 60462874 60462870 60462875 +
gcttcctaaatcccagctttct

SEQ ID NO: 195487 - DNA, 22 bp, Artificial Sequence
  Synthetic oligonucleotide; CTT chr2 60462857 60462878 60462874 60462879 +
cctaaatcccagctttctattc

SEQ ID NO: 195488 - DNA, 22 bp, Artificial Sequence
  Synthetic oligonucleotide; TTC chr2 60462858 60462879 60462875 60462880 +
ctaaatcccagctttctattcc

SEQ ID NO: 195489 - DNA, 22 bp, Artificial Sequence
  Synthetic oligonucleotide; CTA chr2 60462861 60462882 60462878 60462883 +
aatcccagctttctattccccc

SEQ ID NO: 195490 - DNA, 22 bp, Artificial Sequence
  Synthetic oligonucleotide; CTT chr2 60462872 60462893 60462889 60462894 +
tctattcccccctgggtgacag

SEQ ID NO: 195491 - DNA, 22 bp, Artificial Sequence
  Synthetic oligonucleotide; TTT chr2 60462873 60462894 60462890 60462895 +
ctattcccccctgggtgacagg

SEQ ID NO: 195492 - DNA, 22 bp, Artificial Sequence
  Synthetic oligonucleotide; TTC chr2 60462874 60462895 60462891 60462896 +
tattcccccctgggtgacaggt

SEQ ID NO: 195493 - DNA, 22 bp, Artificial Sequence
  Synthetic oligonucleotide; CTA chr2 60462876 60462897 60462893 60462898 +
ttcccccctgggtgacaggtga

SEQ ID NO: 195494 - DNA, 22 bp, Artificial Sequence
  Synthetic oligonucleotide; TTC chr2 60462879 60462900 60462896 60462901 +
ccccctgggtgacaggtgaact

SEQ ID NO: 195495 - DNA, 22 bp, Artificial Sequence
  Synthetic oligonucleotide; CTG chr2 60462886 60462907 60462903 60462908 +
ggtgacaggtgaactttctaaa

SEQ ID NO: 195496 - DNA, 22 bp, Artificial Sequence
  Synthetic oligonucleotide; CTT chr2 60462902 60462923 60462919 60462924 +
tctaaataggcaaacatttcat

SEQ ID NO: 195497 - DNA, 22 bp, Artificial Sequence
  Synthetic oligonucleotide; TTT chr2 60462903 60462924 60462920 60462925 +
ctaaataggcaaacatttcata

SEQ ID NO: 195498 - DNA, 22 bp, Artificial Sequence
  Synthetic oligonucleotide; TTC chr2 60462904 60462925 60462921 60462926 +
taaataggcaaacatttcatag

SEQ ID NO: 195499 - DNA, 22 bp, Artificial Sequence
  Synthetic oligonucleotide; CTA chr2 60462906 60462927 60462923 60462928 +
aataggcaaacatttcatagag

SEQ ID NO: 195500 - DNA, 22 bp, Artificial Sequence
  Synthetic oligonucleotide; TTT chr2 60462921 60462942 60462938 60462943 +
catagaggtatcaaaaaagggg

SEQ ID NO: 195501 - DNA, 22 bp, Artificial Sequence
  Synthetic oligonucleotide; TTC chr2 60462922 60462943 60462939 60462944 +
atagaggtatcaaaaaagggga

SEQ ID NO: 195502 - DNA, 22 bp, Artificial Sequence
  Synthetic oligonucleotide; CTC chr2 60462957 60462978 60462974 60462979 +
actacaatgttctatggcccta

SEQ ID NO: 195503 - DNA, 22 bp, Artificial Sequence
  Synthetic oligonucleotide; CTA chr2 60462961 60462982 60462978 60462983 +
caatgttctatggccctaaaga

SEQ ID NO: 195504 - DNA, 22 bp, Artificial Sequence
  Synthetic oligonucleotide; TTC chr2 60462969 60462990 60462986 60462991 +
tatggccctaaagatgctttca

SEQ ID NO: 195505 - DNA, 22 bp, Artificial Sequence
  Synthetic oligonucleotide; CTA chr2 60462971 60462992 60462988 60462993 +
tggccctaaagatgctttcagc

SEQ ID NO: 195506 - DNA, 22 bp, Artificial Sequence
  Synthetic oligonucleotide; CTA chr2 60462979 60463000 60462996 60463001 +
aagatgctttcagcattagcct

SEQ ID NO: 195507 - DNA, 22 bp, Artificial Sequence
  Synthetic oligonucleotide; CTT chr2 60462988 60463009 60463005 60463010 +
tcagcattagcctgaaacacac

SEQ ID NO: 195508 - DNA, 22 bp, Artificial Sequence
  Synthetic oligonucleotide; TTT chr2 60462989 60463010 60463006 60463011 +
cagcattagcctgaaacacact

SEQ ID NO: 195509 - DNA, 22 bp, Artificial Sequence
  Synthetic oligonucleotide; TTC chr2 60462990 60463011 60463007 60463012 +
agcattagcctgaaacacacta

SEQ ID NO: 195510 - DNA, 22 bp, Artificial Sequence
  Synthetic oligonucleotide; TTA chr2 60462997 60463018 60463014 60463019 +
gcctgaaacacactaattgttg

SEQ ID NO: 195511 - DNA, 22 bp, Artificial Sequence
  Synthetic oligonucleotide; CTG chr2 60463002 60463023 60463019 60463024 +
aaacacactaattgttgatatt

SEQ ID NO: 195512 - DNA, 22 bp, Artificial Sequence
  Synthetic oligonucleotide; CTA chr2 60463012 60463033 60463029 60463034 +
attgttgatattgttaaaatga

SEQ ID NO: 195513 - DNA, 22 bp, Artificial Sequence
  Synthetic oligonucleotide; TTG chr2 60463016 60463037 60463033 60463038 +
ttgatattgttaaaatgagagg

SEQ ID NO: 195514 - DNA, 22 bp, Artificial Sequence
  Synthetic oligonucleotide; TTG chr2 60463019 60463040 60463036 60463041 +
atattgttaaaatgagagggta

SEQ ID NO: 195515 - DNA, 22 bp, Artificial Sequence
  Synthetic oligonucleotide; TTG chr2 60463025 60463046 60463042 60463047 +
ttaaaatgagagggtactcata

SEQ ID NO: 195516 - DNA, 22 bp, Artificial Sequence
  Synthetic oligonucleotide; TTA chr2 60463028 60463049 60463045 60463050 +
aaatgagagggtactcataaaa

SEQ ID NO: 195517 - DNA, 22 bp, Artificial Sequence
  Synthetic oligonucleotide; CTC chr2 60463044 60463065 60463061 60463066 +
ataaaatacttccgtggaaaaa

SEQ ID NO: 195518 - DNA, 22 bp, Artificial Sequence
  Synthetic oligonucleotide; CTT chr2 60463055 60463076 60463072 60463077 +
ccgtggaaaaaagactagcaac

SEQ ID NO: 195519 - DNA, 22 bp, Artificial Sequence
  Synthetic oligonucleotide; TTC chr2 60463056 60463077 60463073 60463078 +
cgtggaaaaaagactagcaaca

SEQ ID NO: 195520 - DNA, 22 bp, Artificial Sequence
  Synthetic oligonucleotide; CTA chr2 60463072 60463093 60463089 60463094 +
gcaacattctcacaccccagac

SEQ ID NO: 195521 - DNA, 22 bp, Artificial Sequence
  Synthetic oligonucleotide; TTC chr2 60463081 60463102 60463098 60463103 +
tcacaccccagactgtgggagg

SEQ ID NO: 195522 - DNA, 22 bp, Artificial Sequence
  Synthetic oligonucleotide; CTC chr2 60463083 60463104 60463100 60463105 +
acaccccagactgtgggaggat

SEQ ID NO: 195523 - DNA, 22 bp, Artificial Sequence
  Synthetic oligonucleotide; CTG chr2 60463096 60463117 60463113 60463118 +
tgggaggatcagtgagtcccaa

SEQ ID NO: 195524 - DNA, 22 bp, Artificial Sequence
  Synthetic oligonucleotide; TTT chr2 60463121 60463142 60463138 60463143 +
tggttccacaacaccccatggg

SEQ ID NO: 195525 - DNA, 22 bp, Artificial Sequence
  Synthetic oligonucleotide; TTT chr2 60463122 60463143 60463139 60463144 +
ggttccacaacaccccatgggg

SEQ ID NO: 195526 - DNA, 22 bp, Artificial Sequence
  Synthetic oligonucleotide; TTG chr2 60463123 60463144 60463140 60463145 +
gttccacaacaccccatgggga

SEQ ID NO: 195527 - DNA, 22 bp, Artificial Sequence
  Synthetic oligonucleotide; TTC chr2 60463127 60463148 60463144 60463149 +
cacaacaccccatggggacgtc

SEQ ID NO: 195528 - DNA, 22 bp, Artificial Sequence
  Synthetic oligonucleotide; TTT chr2 60463154 60463175 60463171 60463176 +
ttatctcaaagaatgtttaaaa

SEQ ID NO: 195529 - DNA, 22 bp, Artificial Sequence
  Synthetic oligonucleotide; TTT chr2 60463155 60463176 60463172 60463177 +
tatctcaaagaatgtttaaaaa

SEQ ID NO: 195530 - DNA, 22 bp, Artificial Sequence
  Synthetic oligonucleotide; TTT chr2 60463156 60463177 60463173 60463178 +
atctcaaagaatgtttaaaaaa

SEQ ID NO: 195531 - DNA, 22 bp, Artificial Sequence
  Synthetic oligonucleotide; TTA chr2 60463157 60463178 60463174 60463179 +
tctcaaagaatgtttaaaaaat

SEQ ID NO: 195532 - DNA, 22 bp, Artificial Sequence
  Synthetic oligonucleotide; CTC chr2 60463161 60463182 60463178 60463183 +
aaagaatgtttaaaaaatctga

SEQ ID NO: 195533 - DNA, 22 bp, Artificial Sequence
  Synthetic oligonucleotide; TTT chr2 60463172 60463193 60463189 60463194 +
aaaaaatctgaaagaaaaactt

SEQ ID NO: 195534 - DNA, 22 bp, Artificial Sequence
  Synthetic oligonucleotide; TTA chr2 60463173 60463194 60463190 60463195 +
aaaaatctgaaagaaaaacttc

SEQ ID NO: 195535 - DNA, 22 bp, Artificial Sequence
  Synthetic oligonucleotide; CTG chr2 60463182 60463203 60463199 60463204 +
aaagaaaaacttcattcagatt

SEQ ID NO: 195536 - DNA, 22 bp, Artificial Sequence
  Synthetic oligonucleotide; CTT chr2 60463194 60463215 60463211 60463216 +
cattcagatttaacggataggc

SEQ ID NO: 195537 - DNA, 22 bp, Artificial Sequence
  Synthetic oligonucleotide; TTC chr2 60463195 60463216 60463212 60463217 +
attcagatttaacggataggct

SEQ ID NO: 195538 - DNA, 22 bp, Artificial Sequence
  Synthetic oligonucleotide; TTC chr2 60463199 60463220 60463216 60463221 +
agatttaacggataggctgtat

SEQ ID NO: 195539 - DNA, 22 bp, Artificial Sequence
  Synthetic oligonucleotide; TTT chr2 60463205 60463226 60463222 60463227 +
aacggataggctgtatccaatc

SEQ ID NO: 195540 - DNA, 22 bp, Artificial Sequence
  Synthetic oligonucleotide; TTA chr2 60463206 60463227 60463223 60463228 +
acggataggctgtatccaatct

SEQ ID NO: 195541 - DNA, 22 bp, Artificial Sequence
  Synthetic oligonucleotide; CTG chr2 60463218 60463239 60463235 60463240 +
tatccaatctttaggagttgtc

SEQ ID NO: 195542 - DNA, 22 bp, Artificial Sequence
  Synthetic oligonucleotide; CTT chr2 60463229 60463250 60463246 60463251 +
taggagttgtcccccggtcaga

SEQ ID NO: 195543 - DNA, 22 bp, Artificial Sequence
  Synthetic oligonucleotide; TTT chr2 60463230 60463251 60463247 60463252 +
aggagttgtcccccggtcagac

SEQ ID NO: 195544 - DNA, 22 bp, Artificial Sequence
  Synthetic oligonucleotide; TTA chr2 60463231 60463252 60463248 60463253 +
ggagttgtcccccggtcagaca

SEQ ID NO: 195545 - DNA, 22 bp, Artificial Sequence
  Synthetic oligonucleotide; TTG chr2 60463238 60463259 60463255 60463260 +
tcccccggtcagacaaatgcaa

SEQ ID NO: 195546 - DNA, 22 bp, Artificial Sequence
  Synthetic oligonucleotide; CTG chr2 60463265 60463286 60463282 60463287 +
gaaaagttaggaggagtggctg

SEQ ID NO: 195547 - DNA, 22 bp, Artificial Sequence
  Synthetic oligonucleotide; TTA chr2 60463274 60463295 60463291 60463296 +
ggaggagtggctggtgccgact

SEQ ID NO: 195548 - DNA, 22 bp, Artificial Sequence
  Synthetic oligonucleotide; CTG chr2 60463287 60463308 60463304 60463309 +
gtgccgacttaagcagacacag

SEQ ID NO: 195549 - DNA, 22 bp, Artificial Sequence
  Synthetic oligonucleotide; CTT chr2 60463297 60463318 60463314 60463319 +
aagcagacacagcatcctagtt

SEQ ID NO: 195550 - DNA, 22 bp, Artificial Sequence
  Synthetic oligonucleotide; TTA chr2 60463298 60463319 60463315 60463320 +
agcagacacagcatcctagttt

SEQ ID NO: 195551 - DNA, 22 bp, Artificial Sequence
  Synthetic oligonucleotide; CTA chr2 60463316 60463337 60463333 60463338 +
gtttaaggaacagttaaaacag

SEQ ID NO: 195552 - DNA, 22 bp, Artificial Sequence
  Synthetic oligonucleotide; TTT chr2 60463320 60463341 60463337 60463342 +
aaggaacagttaaaacagccag

SEQ ID NO: 195553 - DNA, 22 bp, Artificial Sequence
  Synthetic oligonucleotide; TTA chr2 60463321 60463342 60463338 60463343 +
aggaacagttaaaacagccagc

SEQ ID NO: 195554 - DNA, 22 bp, Artificial Sequence
  Synthetic oligonucleotide; TTA chr2 60463332 60463353 60463349 60463354 +
aaacagccagcgccatgacagg

SEQ ID NO: 195555 - DNA, 22 bp, Artificial Sequence
  Synthetic oligonucleotide; CTG chr2 60463364 60463385 60463381 60463386 +
agaaatgctacactatcctcct

SEQ ID NO: 195556 - DNA, 22 bp, Artificial Sequence
  Synthetic oligonucleotide; CTA chr2 60463374 60463395 60463391 60463396 +
cactatcctcctcctcattgtt

SEQ ID NO: 195557 - DNA, 22 bp, Artificial Sequence
  Synthetic oligonucleotide; CTA chr2 60463379 60463400 60463396 60463401 +
tcctcctcctcattgttttgag

SEQ ID NO: 195558 - DNA, 22 bp, Artificial Sequence
  Synthetic oligonucleotide; CTC chr2 60463384 60463405 60463401 60463406 +
ctcctcattgttttgagaggct

SEQ ID NO: 195559 - DNA, 22 bp, Artificial Sequence
  Synthetic oligonucleotide; CTC chr2 60463387 60463408 60463404 60463409 +
ctcattgttttgagaggctaac

SEQ ID NO: 195560 - DNA, 22 bp, Artificial Sequence
  Synthetic oligonucleotide; CTC chr2 60463390 60463411 60463407 60463412 +
attgttttgagaggctaacaac

SEQ ID NO: 195561 - DNA, 22 bp, Artificial Sequence
  Synthetic oligonucleotide; TTG chr2 60463394 60463415 60463411 60463416 +
ttttgagaggctaacaacgtga

SEQ ID NO: 195562 - DNA, 22 bp, Artificial Sequence
  Synthetic oligonucleotide; TTT chr2 60463397 60463418 60463414 60463419 +
tgagaggctaacaacgtgaacc

SEQ ID NO: 195563 - DNA, 22 bp, Artificial Sequence
  Synthetic oligonucleotide; TTT chr2 60463398 60463419 60463415 60463420 +
gagaggctaacaacgtgaacca

SEQ ID NO: 195564 - DNA, 22 bp, Artificial Sequence
  Synthetic oligonucleotide; TTG chr2 60463399 60463420 60463416 60463421 +
agaggctaacaacgtgaaccaa

SEQ ID NO: 195565 - DNA, 22 bp, Artificial Sequence
  Synthetic oligonucleotide; CTA chr2 60463407 60463428 60463424 60463429 +
acaacgtgaaccaaattataca

SEQ ID NO: 195566 - DNA, 22 bp, Artificial Sequence
  Synthetic oligonucleotide; TTA chr2 60463425 60463446 60463442 60463447 +
tacaacatcctgcgccctcggc

SEQ ID NO: 195567 - DNA, 22 bp, Artificial Sequence
  Synthetic oligonucleotide; CTG chr2 60463437 60463458 60463454 60463459 +
cgccctcggctgggactcagct

SEQ ID NO: 195568 - DNA, 22 bp, Artificial Sequence
  Synthetic oligonucleotide; CTC chr2 60463444 60463465 60463461 60463466 +
ggctgggactcagctccagttg

SEQ ID NO: 195569 - DNA, 22 bp, Artificial Sequence
  Synthetic oligonucleotide; CTG chr2 60463449 60463470 60463466 60463471 +
ggactcagctccagttgagaaa

SEQ ID NO: 195570 - DNA, 22 bp, Artificial Sequence
  Synthetic oligonucleotide; CTC chr2 60463455 60463476 60463472 60463477 +
agctccagttgagaaagaaaca

SEQ ID NO: 195571 - DNA, 22 bp, Artificial Sequence
  Synthetic oligonucleotide; CTC chr2 60463460 60463481 60463477 60463482 +
cagttgagaaagaaacagaaag

SEQ ID NO: 195572 - DNA, 22 bp, Artificial Sequence
  Synthetic oligonucleotide; TTG chr2 60463466 60463487 60463483 60463488 +
agaaagaaacagaaagatacag

SEQ ID NO: 195573 - DNA, 22 bp, Artificial Sequence
  Synthetic oligonucleotide; TTC chr2 60463491 60463512 60463508 60463513 +
agctagtcaactctggccagta

SEQ ID NO: 195574 - DNA, 22 bp, Artificial Sequence
  Synthetic oligonucleotide; CTA chr2 60463496 60463517 60463513 60463518 +
gtcaactctggccagtagccaa

SEQ ID NO: 195575 - DNA, 22 bp, Artificial Sequence
  Synthetic oligonucleotide; CTC chr2 60463504 60463525 60463521 60463526 +
tggccagtagccaagccgtctg

SEQ ID NO: 195576 - DNA, 22 bp, Artificial Sequence
  Synthetic oligonucleotide; CTG chr2 60463506 60463527 60463523 60463528 +
gccagtagccaagccgtctgga

SEQ ID NO: 195577 - DNA, 22 bp, Artificial Sequence
  Synthetic oligonucleotide; CTG chr2 60463526 60463547 60463543 60463548 +
gagaggggccctgcttaagtca

SEQ ID NO: 195578 - DNA, 22 bp, Artificial Sequence
  Synthetic oligonucleotide; CTG chr2 60463539 60463560 60463556 60463561 +
cttaagtcacattatttccctt

SEQ ID NO: 195579 - DNA, 22 bp, Artificial Sequence
  Synthetic oligonucleotide; CTT chr2 60463542 60463563 60463559 60463564 +
aagtcacattatttcccttgct

SEQ ID NO: 195580 - DNA, 22 bp, Artificial Sequence
  Synthetic oligonucleotide; TTA chr2 60463543 60463564 60463560 60463565 +
agtcacattatttcccttgctg

SEQ ID NO: 195581 - DNA, 22 bp, Artificial Sequence
  Synthetic oligonucleotide; TTA chr2 60463553 60463574 60463570 60463575 +
tttcccttgctgaaaagaaccc

SEQ ID NO: 195582 - DNA, 22 bp, Artificial Sequence
  Synthetic oligonucleotide; TTT chr2 60463556 60463577 60463573 60463578 +
cccttgctgaaaagaacccaag

SEQ ID NO: 195583 - DNA, 22 bp, Artificial Sequence
  Synthetic oligonucleotide; TTC chr2 60463557 60463578 60463574 60463579 +
ccttgctgaaaagaacccaaga

SEQ ID NO: 195584 - DNA, 22 bp, Artificial Sequence
  Synthetic oligonucleotide; CTT chr2 60463561 60463582 60463578 60463583 +
gctgaaaagaacccaagagtgg

SEQ ID NO: 195585 - DNA, 22 bp, Artificial Sequence
  Synthetic oligonucleotide; TTG chr2 60463562 60463583 60463579 60463584 +
ctgaaaagaacccaagagtggt

SEQ ID NO: 195586 - DNA, 22 bp, Artificial Sequence
  Synthetic oligonucleotide; CTG chr2 60463565 60463586 60463582 60463587 +
aaaagaacccaagagtggtaaa

SEQ ID NO: 195587 - DNA, 22 bp, Artificial Sequence
  Synthetic oligonucleotide; CTT chr2 60463595 60463616 60463612 60463617 +
tggcaaagaagggccagcttga

SEQ ID NO: 195588 - DNA, 22 bp, Artificial Sequence
  Synthetic oligonucleotide; TTT chr2 60463596 60463617 60463613 60463618 +
ggcaaagaagggccagcttgac

SEQ ID NO: 195589 - DNA, 22 bp, Artificial Sequence
  Synthetic oligonucleotide; TTG chr2 60463597 60463618 60463614 60463619 +
gcaaagaagggccagcttgact

SEQ ID NO: 195590 - DNA, 22 bp, Artificial Sequence
  Synthetic oligonucleotide; CTT chr2 60463615 60463636 60463632 60463637 +
gacttcacaaaatatttcattt

SEQ ID NO: 195591 - DNA, 22 bp, Artificial Sequence
  Synthetic oligonucleotide; TTG chr2 60463616 60463637 60463633 60463638 +
acttcacaaaatatttcatttg

SEQ ID NO: 195592 - DNA, 22 bp, Artificial Sequence
  Synthetic oligonucleotide; CTT chr2 60463620 60463641 60463637 60463642 +
cacaaaatatttcatttgggga

SEQ ID NO: 195593 - DNA, 22 bp, Artificial Sequence
  Synthetic oligonucleotide; TTC chr2 60463621 60463642 60463638 60463643 +
acaaaatatttcatttggggag

SEQ ID NO: 195594 - DNA, 22 bp, Artificial Sequence
  Synthetic oligonucleotide; TTT chr2 60463632 60463653 60463649 60463654 +
catttggggagatggctaaatt

SEQ ID NO: 195595 - DNA, 22 bp, Artificial Sequence
  Synthetic oligonucleotide; TTC chr2 60463633 60463654 60463650 60463655 +
atttggggagatggctaaatta

SEQ ID NO: 195596 - DNA, 22 bp, Artificial Sequence
  Synthetic oligonucleotide; TTT chr2 60463637 60463658 60463654 60463659 +
ggggagatggctaaattaaata

SEQ ID NO: 195597 - DNA, 22 bp, Artificial Sequence
  Synthetic oligonucleotide; TTG chr2 60463638 60463659 60463655 60463660 +
gggagatggctaaattaaatat

SEQ ID NO: 195598 - DNA, 22 bp, Artificial Sequence
  Synthetic oligonucleotide; CTA chr2 60463650 60463671 60463667 60463672 +
aattaaatatatatggggagat

SEQ ID NO: 195599 - DNA, 22 bp, Artificial Sequence
  Synthetic oligonucleotide; TTA chr2 60463655 60463676 60463672 60463677 +
aatatatatggggagatagcta

SEQ ID NO: 195600 - DNA, 22 bp, Artificial Sequence
  Synthetic oligonucleotide; CTA chr2 60463677 60463698 60463694 60463699 +
cattaaatatatatatatatgg

SEQ ID NO: 195601 - DNA, 22 bp, Artificial Sequence
  Synthetic oligonucleotide; TTA chr2 60463682 60463703 60463699 60463704 +
aatatatatatatatggaataa

SEQ ID NO: 195602 - DNA, 22 bp, Artificial Sequence
  Synthetic oligonucleotide; CTG chr2 60463707 60463728 60463724 60463729 +
accaacagtttactagtcaact

SEQ ID NO: 195603 - DNA, 22 bp, Artificial Sequence
  Synthetic oligonucleotide; TTT chr2 60463718 60463739 60463735 60463740 +
actagtcaactgcaacattaaa

SEQ ID NO: 195604 - DNA, 22 bp, Artificial Sequence
  Synthetic oligonucleotide; TTA chr2 60463719 60463740 60463736 60463741 +
ctagtcaactgcaacattaaaa

SEQ ID NO: 195605 - DNA, 22 bp, Artificial Sequence
  Synthetic oligonucleotide; CTA chr2 60463722 60463743 60463739 60463744 +
gtcaactgcaacattaaaaagg

SEQ ID NO: 195606 - DNA, 22 bp, Artificial Sequence
  Synthetic oligonucleotide; CTG chr2 60463730 60463751 60463747 60463752 +
caacattaaaaagggcagaagt

SEQ ID NO: 195607 - DNA, 22 bp, Artificial Sequence
  Synthetic oligonucleotide; TTA chr2 60463738 60463759 60463755 60463760 +
aaaagggcagaagtaatggtag

SEQ ID NO: 195608 - DNA, 22 bp, Artificial Sequence
  Synthetic oligonucleotide; CTT chr2 60463791 60463812 60463808 60463813 +
cccagagattctgaaaaaaaaa

SEQ ID NO: 195609 - DNA, 22 bp, Artificial Sequence
  Synthetic oligonucleotide; TTC chr2 60463792 60463813 60463809 60463814 +
ccagagattctgaaaaaaaaag

SEQ ID NO: 195610 - DNA, 22 bp, Artificial Sequence
  Synthetic oligonucleotide; TTC chr2 60463802 60463823 60463819 60463824 +
tgaaaaaaaaagccttaaaata

SEQ ID NO: 195611 - DNA, 22 bp, Artificial Sequence
  Synthetic oligonucleotide; CTG chr2 60463804 60463825 60463821 60463826 +
aaaaaaaaagccttaaaatata

SEQ ID NO: 195612 - DNA, 22 bp, Artificial Sequence
  Synthetic oligonucleotide; CTT chr2 60463818 60463839 60463835 60463840 +
aaaatataactgagaaataaca

SEQ ID NO: 195613 - DNA, 22 bp, Artificial Sequence
  Synthetic oligonucleotide; TTA chr2 60463819 60463840 60463836 60463841 +
aaatataactgagaaataacaa

SEQ ID NO: 195614 - DNA, 22 bp, Artificial Sequence
  Synthetic oligonucleotide; CTG chr2 60463830 60463851 60463847 60463852 +
agaaataacaaacttttctcct

SEQ ID NO: 195615 - DNA, 22 bp, Artificial Sequence
  Synthetic oligonucleotide; CTT chr2 60463845 60463866 60463862 60463867 +
ttctccttcttttaaaagaagg

SEQ ID NO: 195616 - DNA, 22 bp, Artificial Sequence
  Synthetic oligonucleotide; TTT chr2 60463846 60463867 60463863 60463868 +
tctccttcttttaaaagaaggg

SEQ ID NO: 195617 - DNA, 22 bp, Artificial Sequence
  Synthetic oligonucleotide; TTT chr2 60463847 60463868 60463864 60463869 +
ctccttcttttaaaagaagggc

SEQ ID NO: 195618 - DNA, 22 bp, Artificial Sequence
  Synthetic oligonucleotide; TTC chr2 60463848 60463869 60463865 60463870 +
tccttcttttaaaagaagggct

SEQ ID NO: 195619 - DNA, 22 bp, Artificial Sequence
  Synthetic oligonucleotide; CTC chr2 60463850 60463871 60463867 60463872 +
cttcttttaaaagaagggctgc

SEQ ID NO: 195620 - DNA, 22 bp, Artificial Sequence
  Synthetic oligonucleotide; CTT chr2 60463853 60463874 60463870 60463875 +
cttttaaaagaagggctgcaag

SEQ ID NO: 195621 - DNA, 22 bp, Artificial Sequence
  Synthetic oligonucleotide; TTC chr2 60463854 60463875 60463871 60463876 +
ttttaaaagaagggctgcaaga

SEQ ID NO: 195622 - DNA, 22 bp, Artificial Sequence
  Synthetic oligonucleotide; CTT chr2 60463856 60463877 60463873 60463878 +
ttaaaagaagggctgcaagagt

SEQ ID NO: 195623 - DNA, 22 bp, Artificial Sequence
  Synthetic oligonucleotide; TTT chr2 60463857 60463878 60463874 60463879 +
taaaagaagggctgcaagagtt

SEQ ID NO: 195624 - DNA, 22 bp, Artificial Sequence
  Synthetic oligonucleotide; TTT chr2 60463858 60463879 60463875 60463880 +
aaaagaagggctgcaagagttc

SEQ ID NO: 195625 - DNA, 22 bp, Artificial Sequence
  Synthetic oligonucleotide; TTA chr2 60463859 60463880 60463876 60463881 +
aaagaagggctgcaagagttct

SEQ ID NO: 195626 - DNA, 22 bp, Artificial Sequence
  Synthetic oligonucleotide; CTG chr2 60463871 60463892 60463888 60463893 +
caagagttctttaaggccacag

SEQ ID NO: 195627 - DNA, 22 bp, Artificial Sequence
  Synthetic oligonucleotide; TTC chr2 60463880 60463901 60463897 60463902 +
tttaaggccacagctagtattt

SEQ ID NO: 195628 - DNA, 22 bp, Artificial Sequence
  Synthetic oligonucleotide; CTT chr2 60463882 60463903 60463899 60463904 +
taaggccacagctagtatttgt

SEQ ID NO: 195629 - DNA, 22 bp, Artificial Sequence
  Synthetic oligonucleotide; TTT chr2 60463883 60463904 60463900 60463905 +
aaggccacagctagtatttgtc

SEQ ID NO: 195630 - DNA, 22 bp, Artificial Sequence
  Synthetic oligonucleotide; TTA chr2 60463884 60463905 60463901 60463906 +
aggccacagctagtatttgtca

SEQ ID NO: 195631 - DNA, 22 bp, Artificial Sequence
  Synthetic oligonucleotide; CTA chr2 60463896 60463917 60463913 60463918 +
gtatttgtcagtaactttctaa

SEQ ID NO: 195632 - DNA, 22 bp, Artificial Sequence
  Synthetic oligonucleotide; TTT chr2 60463902 60463923 60463919 60463924 +
gtcagtaactttctaagaagga

SEQ ID NO: 195633 - DNA, 22 bp, Artificial Sequence
  Synthetic oligonucleotide; TTG chr2 60463903 60463924 60463920 60463925 +
tcagtaactttctaagaaggaa

SEQ ID NO: 195634 - DNA, 22 bp, Artificial Sequence
  Synthetic oligonucleotide; CTT chr2 60463913 60463934 60463930 60463935 +
tctaagaaggaaaaaaaaaaaa

SEQ ID NO: 195635 - DNA, 22 bp, Artificial Sequence
  Synthetic oligonucleotide; TTT chr2 60463914 60463935 60463931 60463936 +
ctaagaaggaaaaaaaaaaaaa

SEQ ID NO: 195636 - DNA, 22 bp, Artificial Sequence
  Synthetic oligonucleotide; TTC chr2 60463915 60463936 60463932 60463937 +
taagaaggaaaaaaaaaaaaaa

SEQ ID NO: 195637 - DNA, 22 bp, Artificial Sequence
  Synthetic oligonucleotide; CTA chr2 60463917 60463938 60463934 60463939 +
agaaggaaaaaaaaaaaaaatc

SEQ ID NO: 195638 - DNA, 22 bp, Artificial Sequence
  Synthetic oligonucleotide; CTA chr2 60463941 60463962 60463958 60463963 +
ccagggaggttaagagtgagaa

SEQ ID NO: 195639 - DNA, 22 bp, Artificial Sequence
  Synthetic oligonucleotide; TTA chr2 60463953 60463974 60463970 60463975 +
agagtgagaatgaggaattaat

SEQ ID NO: 195640 - DNA, 22 bp, Artificial Sequence
  Synthetic oligonucleotide; TTA chr2 60463973 60463994 60463990 60463995 +
atcaattatatgatgcctccat

SEQ ID NO: 195641 - DNA, 22 bp, Artificial Sequence
  Synthetic oligonucleotide; TTA chr2 60463981 60464002 60463998 60464003 +
tatgatgcctccatttagcaag

SEQ ID NO: 195642 - DNA, 22 bp, Artificial Sequence
  Synthetic oligonucleotide; CTC chr2 60463992 60464013 60464009 60464014 +
catttagcaagtcagaaagaaa

SEQ ID NO: 195643 - DNA, 22 bp, Artificial Sequence
  Synthetic oligonucleotide; TTT chr2 60463997 60464018 60464014 60464019 +
agcaagtcagaaagaaaagccg

SEQ ID NO: 195644 - DNA, 22 bp, Artificial Sequence
  Synthetic oligonucleotide; TTA chr2 60463998 60464019 60464015 60464020 +
gcaagtcagaaagaaaagccgg

SEQ ID NO: 195645 - DNA, 22 bp, Artificial Sequence
  Synthetic oligonucleotide; CTT chr2 60464029 60464050 60464046 60464051 +
ctcaggagcccccaaacactgg

SEQ ID NO: 195646 - DNA, 22 bp, Artificial Sequence
  Synthetic oligonucleotide; TTC chr2 60464030 60464051 60464047 60464052 +
tcaggagcccccaaacactggt

SEQ ID NO: 195647 - DNA, 22 bp, Artificial Sequence
  Synthetic oligonucleotide; CTC chr2 60464032 60464053 60464049 60464054 +
aggagcccccaaacactggtat

SEQ ID NO: 195648 - DNA, 22 bp, Artificial Sequence
  Synthetic oligonucleotide; CTG chr2 60464050 60464071 60464067 60464072 +
gtattccaaaataagccagcct

SEQ ID NO: 195649 - DNA, 22 bp, Artificial Sequence
  Synthetic oligonucleotide; TTC chr2 60464056 60464077 60464073 60464078 +
caaaataagccagcctcgctca

SEQ ID NO: 195650 - DNA, 22 bp, Artificial Sequence
  Synthetic oligonucleotide; CTC chr2 60464073 60464094 60464090 60464095 +
gctcaagcacttgtctaaataa

SEQ ID NO: 195651 - DNA, 22 bp, Artificial Sequence
  Synthetic oligonucleotide; CTC chr2 60464077 60464098 60464094 60464099 +
aagcacttgtctaaataatgga

SEQ ID NO: 195652 - DNA, 22 bp, Artificial Sequence
  Synthetic oligonucleotide; CTT chr2 60464085 60464106 60464102 60464107 +
gtctaaataatggactcctgcc

SEQ ID NO: 195653 - DNA, 22 bp, Artificial Sequence
  Synthetic oligonucleotide; TTG chr2 60464086 60464107 60464103 60464108 +
tctaaataatggactcctgccc

SEQ ID NO: 195654 - DNA, 22 bp, Artificial Sequence
  Synthetic oligonucleotide; CTA chr2 60464090 60464111 60464107 60464112 +
aataatggactcctgccctgac

SEQ ID NO: 195655 - DNA, 22 bp, Artificial Sequence
  Synthetic oligonucleotide; CTC chr2 60464102 60464123 60464119 60464124 +
ctgccctgaccttgtaatttac

SEQ ID NO: 195656 - DNA, 22 bp, Artificial Sequence
  Synthetic oligonucleotide; CTG chr2 60464105 60464126 60464122 60464127 +
ccctgaccttgtaatttacttt

SEQ ID NO: 195657 - DNA, 22 bp, Artificial Sequence
  Synthetic oligonucleotide; CTG chr2 60464110 60464131 60464127 60464132 +
accttgtaatttactttacaac

SEQ ID NO: 195658 - DNA, 22 bp, Artificial Sequence
  Synthetic oligonucleotide; CTT chr2 60464115 60464136 60464132 60464137 +
gtaatttactttacaacgcatt

SEQ ID NO: 195659 - DNA, 22 bp, Artificial Sequence
  Synthetic oligonucleotide; TTG chr2 60464116 60464137 60464133 60464138 +
taatttactttacaacgcattt

SEQ ID NO: 195660 - DNA, 22 bp, Artificial Sequence
  Synthetic oligonucleotide; TTT chr2 60464122 60464143 60464139 60464144 +
actttacaacgcatttataatc

SEQ ID NO: 195661 - DNA, 22 bp, Artificial Sequence
  Synthetic oligonucleotide; TTA chr2 60464123 60464144 60464140 60464145 +
ctttacaacgcatttataatcc

SEQ ID NO: 195662 - DNA, 22 bp, Artificial Sequence
  Synthetic oligonucleotide; CTT chr2 60464126 60464147 60464143 60464148 +
tacaacgcatttataatcccac

SEQ ID NO: 195663 - DNA, 22 bp, Artificial Sequence
  Synthetic oligonucleotide; TTT chr2 60464127 60464148 60464144 60464149 +
acaacgcatttataatcccact

SEQ ID NO: 195664 - DNA, 22 bp, Artificial Sequence
  Synthetic oligonucleotide; TTA chr2 60464128 60464149 60464145 60464150 +
caacgcatttataatcccactc

SEQ ID NO: 195665 - DNA, 22 bp, Artificial Sequence
  Synthetic oligonucleotide; TTT chr2 60464138 60464159 60464155 60464160 +
ataatcccactcaatatatctc

SEQ ID NO: 195666 - DNA, 22 bp, Artificial Sequence
  Synthetic oligonucleotide; TTA chr2 60464139 60464160 60464156 60464161 +
taatcccactcaatatatctca

SEQ ID NO: 195667 - DNA, 22 bp, Artificial Sequence
  Synthetic oligonucleotide; CTC chr2 60464150 60464171 60464167 60464172 +
aatatatctcactcctgggtaa

SEQ ID NO: 195668 - DNA, 22 bp, Artificial Sequence
  Synthetic oligonucleotide; CTC chr2 60464160 60464181 60464177 60464182 +
actcctgggtaaatctcttaaa

SEQ ID NO: 195669 - DNA, 22 bp, Artificial Sequence
  Synthetic oligonucleotide; CTC chr2 60464164 60464185 60464181 60464186 +
ctgggtaaatctcttaaacaag

SEQ ID NO: 195670 - DNA, 22 bp, Artificial Sequence
  Synthetic oligonucleotide; CTG chr2 60464167 60464188 60464184 60464189 +
ggtaaatctcttaaacaagatt

SEQ ID NO: 195671 - DNA, 22 bp, Artificial Sequence
  Synthetic oligonucleotide; CTC chr2 60464177 60464198 60464194 60464199 +
ttaaacaagattagatggtaag

SEQ ID NO: 195672 - DNA, 22 bp, Artificial Sequence
  Synthetic oligonucleotide; CTT chr2 60464179 60464200 60464196 60464201 +
aaacaagattagatggtaagat

SEQ ID NO: 195673 - DNA, 22 bp, Artificial Sequence
  Synthetic oligonucleotide; TTA chr2 60464180 60464201 60464197 60464202 +
aacaagattagatggtaagata

SEQ ID NO: 195674 - DNA, 22 bp, Artificial Sequence
  Synthetic oligonucleotide; TTA chr2 60464190 60464211 60464207 60464212 +
gatggtaagataccaaaattag

SEQ ID NO: 195675 - DNA, 22 bp, Artificial Sequence
  Synthetic oligonucleotide; TTA chr2 60464211 60464232 60464228 60464233 +
ggtttcaaacatttgtctaatg

SEQ ID NO: 195676 - DNA, 22 bp, Artificial Sequence
  Synthetic oligonucleotide; TTT chr2 60464216 60464237 60464233 60464238 +
caaacatttgtctaatgtggaa

SEQ ID NO: 195677 - DNA, 22 bp, Artificial Sequence
  Synthetic oligonucleotide; TTC chr2 60464217 60464238 60464234 60464239 +
aaacatttgtctaatgtggaag

SEQ ID NO: 195678 - DNA, 22 bp, Artificial Sequence
  Synthetic oligonucleotide; TTT chr2 60464225 60464246 60464242 60464247 +
gtctaatgtggaagggggaaaa

SEQ ID NO: 195679 - DNA, 22 bp, Artificial Sequence
  Synthetic oligonucleotide; TTG chr2 60464226 60464247 60464243 60464248 +
tctaatgtggaagggggaaaaa

SEQ ID NO: 195680 - DNA, 22 bp, Artificial Sequence
  Synthetic oligonucleotide; CTA chr2 60464230 60464251 60464247 60464252 +
atgtggaagggggaaaaaaggc

SEQ ID NO: 195681 - DNA, 22 bp, Artificial Sequence
  Synthetic oligonucleotide; TTT chr2 60464262 60464283 60464279 60464284 +
tgaaagaaaacgctgacattag

SEQ ID NO: 195682 - DNA, 22 bp, Artificial Sequence
  Synthetic oligonucleotide; TTT chr2 60464263 60464284 60464280 60464285 +
gaaagaaaacgctgacattagt

SEQ ID NO: 195683 - DNA, 22 bp, Artificial Sequence
  Synthetic oligonucleotide; TTG chr2 60464264 60464285 60464281 60464286 +
aaagaaaacgctgacattagta

SEQ ID NO: 195684 - DNA, 22 bp, Artificial Sequence
  Synthetic oligonucleotide; CTG chr2 60464277 60464298 60464294 60464299 +
acattagtatcacattatctgc

SEQ ID NO: 195685 - DNA, 22 bp, Artificial Sequence
  Synthetic oligonucleotide; TTA chr2 60464283 60464304 60464300 60464305 +
gtatcacattatctgcctattt

SEQ ID NO: 195686 - DNA, 22 bp, Artificial Sequence
  Synthetic oligonucleotide; TTA chr2 60464294 60464315 60464311 60464316 +
tctgcctatttttgtttgcctc

SEQ ID NO: 195687 - DNA, 22 bp, Artificial Sequence
  Synthetic oligonucleotide; CTG chr2 60464298 60464319 60464315 60464320 +
cctatttttgtttgcctcctct

SEQ ID NO: 195688 - DNA, 22 bp, Artificial Sequence
  Synthetic oligonucleotide; CTA chr2 60464302 60464323 60464319 60464324 +
tttttgtttgcctcctctcttc

SEQ ID NO: 195689 - DNA, 22 bp, Artificial Sequence
  Synthetic oligonucleotide; TTT chr2 60464305 60464326 60464322 60464327 +
ttgtttgcctcctctcttcaaa

SEQ ID NO: 195690 - DNA, 22 bp, Artificial Sequence
  Synthetic oligonucleotide; TTT chr2 60464306 60464327 60464323 60464328 +
tgtttgcctcctctcttcaaag

SEQ ID NO: 195691 - DNA, 22 bp, Artificial Sequence
  Synthetic oligonucleotide; TTT chr2 60464307 60464328 60464324 60464329 +
gtttgcctcctctcttcaaagg

SEQ ID NO: 195692 - DNA, 22 bp, Artificial Sequence
  Synthetic oligonucleotide; TTG chr2 60464308 60464329 60464325 60464330 +
tttgcctcctctcttcaaaggg

SEQ ID NO: 195693 - DNA, 22 bp, Artificial Sequence
  Synthetic oligonucleotide; TTT chr2 60464311 60464332 60464328 60464333 +
gcctcctctcttcaaagggaaa

SEQ ID NO: 195694 - DNA, 22 bp, Artificial Sequence
  Synthetic oligonucleotide; TTG chr2 60464312 60464333 60464329 60464334 +
cctcctctcttcaaagggaaat

SEQ ID NO: 195695 - DNA, 22 bp, Artificial Sequence
  Synthetic oligonucleotide; CTC chr2 60464316 60464337 60464333 60464338 +
ctctcttcaaagggaaataaaa

SEQ ID NO: 195696 - DNA, 22 bp, Artificial Sequence
  Synthetic oligonucleotide; CTC chr2 60464319 60464340 60464336 60464341 +
tcttcaaagggaaataaaaagc

SEQ ID NO: 195697 - DNA, 22 bp, Artificial Sequence
  Synthetic oligonucleotide; CTC chr2 60464321 60464342 60464338 60464343 +
ttcaaagggaaataaaaagctt

SEQ ID NO: 195698 - DNA, 22 bp, Artificial Sequence
  Synthetic oligonucleotide; CTT chr2 60464323 60464344 60464340 60464345 +
caaagggaaataaaaagcttca

SEQ ID NO: 195699 - DNA, 22 bp, Artificial Sequence
  Synthetic oligonucleotide; TTC chr2 60464324 60464345 60464341 60464346 +
aaagggaaataaaaagcttcat

SEQ ID NO: 195700 - DNA, 22 bp, Artificial Sequence
  Synthetic oligonucleotide; CTT chr2 60464343 60464364 60464360 60464365 +
cattgagaacatttttataaat

SEQ ID NO: 195701 - DNA, 22 bp, Artificial Sequence
  Synthetic oligonucleotide; TTC chr2 60464344 60464365 60464361 60464366 +
attgagaacatttttataaatt

SEQ ID NO: 195702 - DNA, 22 bp, Artificial Sequence
  Synthetic oligonucleotide; TTG chr2 60464348 60464369 60464365 60464370 +
agaacatttttataaatttttt

SEQ ID NO: 195703 - DNA, 22 bp, Artificial Sequence
  Synthetic oligonucleotide; TTT chr2 60464357 60464378 60464374 60464379 +
ttataaattttttgttgttgtt

SEQ ID NO: 195704 - DNA, 22 bp, Artificial Sequence
  Synthetic oligonucleotide; TTT chr2 60464358 60464379 60464375 60464380 +
tataaattttttgttgttgttg

SEQ ID NO: 195705 - DNA, 22 bp, Artificial Sequence
  Synthetic oligonucleotide; TTT chr2 60464359 60464380 60464376 60464381 +
ataaattttttgttgttgttga

SEQ ID NO: 195706 - DNA, 22 bp, Artificial Sequence
  Synthetic oligonucleotide; TTA chr2 60464360 60464381 60464377 60464382 +
taaattttttgttgttgttgaa

SEQ ID NO: 195707 - DNA, 22 bp, Artificial Sequence
  Synthetic oligonucleotide; TTT chr2 60464367 60464388 60464384 60464389 +
tttgttgttgttgaacaataac

SEQ ID NO: 195708 - DNA, 22 bp, Artificial Sequence
  Synthetic oligonucleotide; TTT chr2 60464368 60464389 60464385 60464390 +
ttgttgttgttgaacaataact

SEQ ID NO: 195709 - DNA, 22 bp, Artificial Sequence
  Synthetic oligonucleotide; TTT chr2 60464369 60464390 60464386 60464391 +
tgttgttgttgaacaataactt

SEQ ID NO: 195710 - DNA, 22 bp, Artificial Sequence
  Synthetic oligonucleotide; TTT chr2 60464370 60464391 60464387 60464392 +
gttgttgttgaacaataacttg

SEQ ID NO: 195711 - DNA, 22 bp, Artificial Sequence
  Synthetic oligonucleotide; TTG chr2 60464371 60464392 60464388 60464393 +
ttgttgttgaacaataacttgg

SEQ ID NO: 195712 - DNA, 22 bp, Artificial Sequence
  Synthetic oligonucleotide; TTG chr2 60464374 60464395 60464391 60464396 +
ttgttgaacaataacttgggtc

SEQ ID NO: 195713 - DNA, 22 bp, Artificial Sequence
  Synthetic oligonucleotide; TTG chr2 60464377 60464398 60464394 60464399 +
ttgaacaataacttgggtccca

SEQ ID NO: 195714 - DNA, 22 bp, Artificial Sequence
  Synthetic oligonucleotide; TTG chr2 60464380 60464401 60464397 60464402 +
aacaataacttgggtcccaaat

SEQ ID NO: 195715 - DNA, 22 bp, Artificial Sequence
  Synthetic oligonucleotide; CTT chr2 60464391 60464412 60464408 60464413 +
gggtcccaaataggctggaaaa

SEQ ID NO: 195716 - DNA, 22 bp, Artificial Sequence
  Synthetic oligonucleotide; TTG chr2 60464392 60464413 60464409 60464414 +
ggtcccaaataggctggaaaaa

SEQ ID NO: 195717 - DNA, 22 bp, Artificial Sequence
  Synthetic oligonucleotide; CTG chr2 60464408 60464429 60464425 60464430 +
gaaaaaaaactatctggttcca

SEQ ID NO: 195718 - DNA, 22 bp, Artificial Sequence
  Synthetic oligonucleotide; CTA chr2 60464420 60464441 60464437 60464442 +
tctggttccaactacatgatcc

SEQ ID NO: 195719 - DNA, 22 bp, Artificial Sequence
  Synthetic oligonucleotide; CTG chr2 60464424 60464445 60464441 60464446 +
gttccaactacatgatcctctg

SEQ ID NO: 195720 - DNA, 22 bp, Artificial Sequence
  Synthetic oligonucleotide; TTC chr2 60464428 60464449 60464445 60464450 +
caactacatgatcctctgtggc

SEQ ID NO: 195721 - DNA, 22 bp, Artificial Sequence
  Synthetic oligonucleotide; CTA chr2 60464434 60464455 60464451 60464456 +
catgatcctctgtggcttcctc

SEQ ID NO: 195722 - DNA, 22 bp, Artificial Sequence
  Synthetic oligonucleotide; CTC chr2 60464444 60464465 60464461 60464466 +
tgtggcttcctccttgtcctcc

SEQ ID NO: 195723 - DNA, 22 bp, Artificial Sequence
  Synthetic oligonucleotide; CTG chr2 60464446 60464467 60464463 60464468 +
tggcttcctccttgtcctccct

SEQ ID NO: 195724 - DNA, 22 bp, Artificial Sequence
  Synthetic oligonucleotide; CTT chr2 60464452 60464473 60464469 60464474 +
cctccttgtcctccctagatct

SEQ ID NO: 195725 - DNA, 22 bp, Artificial Sequence
  Synthetic oligonucleotide; TTC chr2 60464453 60464474 60464470 60464475 +
ctccttgtcctccctagatctc

SEQ ID NO: 195726 - DNA, 22 bp, Artificial Sequence
  Synthetic oligonucleotide; CTC chr2 60464456 60464477 60464473 60464478 +
cttgtcctccctagatctctgg

SEQ ID NO: 195727 - DNA, 22 bp, Artificial Sequence
  Synthetic oligonucleotide; CTT chr2 60464459 60464480 60464476 60464481 +
gtcctccctagatctctgggtg

SEQ ID NO: 195728 - DNA, 22 bp, Artificial Sequence
  Synthetic oligonucleotide; TTG chr2 60464460 60464481 60464477 60464482 +
tcctccctagatctctgggtga

SEQ ID NO: 195729 - DNA, 22 bp, Artificial Sequence
  Synthetic oligonucleotide; CTC chr2 60464465 60464486 60464482 60464487 +
cctagatctctgggtgactatc

SEQ ID NO: 195730 - DNA, 22 bp, Artificial Sequence
  Synthetic oligonucleotide; CTA chr2 60464469 60464490 60464486 60464491 +
gatctctgggtgactatcattc

SEQ ID NO: 195731 - DNA, 22 bp, Artificial Sequence
  Synthetic oligonucleotide; CTC chr2 60464475 60464496 60464492 60464497 +
tgggtgactatcattcctattt

SEQ ID NO: 195732 - DNA, 22 bp, Artificial Sequence
  Synthetic oligonucleotide; CTG chr2 60464477 60464498 60464494 60464499 +
ggtgactatcattcctatttag

SEQ ID NO: 195733 - DNA, 22 bp, Artificial Sequence
  Synthetic oligonucleotide; CTA chr2 60464485 60464506 60464502 60464507 +
tcattcctatttagcctgacga

SEQ ID NO: 195734 - DNA, 22 bp, Artificial Sequence
  Synthetic oligonucleotide; TTC chr2 60464491 60464512 60464508 60464513 +
ctatttagcctgacgatctgag

SEQ ID NO: 195735 - DNA, 22 bp, Artificial Sequence
  Synthetic oligonucleotide; CTA chr2 60464494 60464515 60464511 60464516 +
tttagcctgacgatctgagttg

SEQ ID NO: 195736 - DNA, 22 bp, Artificial Sequence
  Synthetic oligonucleotide; TTT chr2 60464497 60464518 60464514 60464519 +
agcctgacgatctgagttgggc

SEQ ID NO: 195737 - DNA, 22 bp, Artificial Sequence
  Synthetic oligonucleotide; TTA chr2 60464498 60464519 60464515 60464520 +
gcctgacgatctgagttgggca

SEQ ID NO: 195738 - DNA, 22 bp, Artificial Sequence
  Synthetic oligonucleotide; CTG chr2 60464503 60464524 60464520 60464525 +
acgatctgagttgggcaagtaa

SEQ ID NO: 195739 - DNA, 22 bp, Artificial Sequence
  Synthetic oligonucleotide; CTG chr2 60464511 60464532 60464528 60464533 +
agttgggcaagtaaaaagattt

SEQ ID NO: 195740 - DNA, 22 bp, Artificial Sequence
  Synthetic oligonucleotide; TTG chr2 60464516 60464537 60464533 60464538 +
ggcaagtaaaaagatttgtctg

SEQ ID NO: 195741 - DNA, 22 bp, Artificial Sequence
  Synthetic oligonucleotide; TTT chr2 60464533 60464554 60464550 60464555 +
gtctgataatccaagtccttaa

SEQ ID NO: 195742 - DNA, 22 bp, Artificial Sequence
  Synthetic oligonucleotide; TTG chr2 60464534 60464555 60464551 60464556 +
tctgataatccaagtccttaac

SEQ ID NO: 195743 - DNA, 22 bp, Artificial Sequence
  Synthetic oligonucleotide; CTG chr2 60464538 60464559 60464555 60464560 +
ataatccaagtccttaacacgt

SEQ ID NO: 195744 - DNA, 22 bp, Artificial Sequence
  Synthetic oligonucleotide; CTT chr2 60464553 60464574 60464570 60464575 +
aacacgttcatcactccaaatg

SEQ ID NO: 195745 - DNA, 22 bp, Artificial Sequence
  Synthetic oligonucleotide; TTA chr2 60464554 60464575 60464571 60464576 +
acacgttcatcactccaaatgc

SEQ ID NO: 195746 - DNA, 22 bp, Artificial Sequence
  Synthetic oligonucleotide; TTC chr2 60464562 60464583 60464579 60464584 +
atcactccaaatgccttaaaat

SEQ ID NO: 195747 - DNA, 22 bp, Artificial Sequence
  Synthetic oligonucleotide; CTC chr2 60464569 60464590 60464586 60464591 +
caaatgccttaaaattatattt

SEQ ID NO: 195748 - DNA, 22 bp, Artificial Sequence
  Synthetic oligonucleotide; CTT chr2 60464579 60464600 60464596 60464601 +
aaaattatattttaccttataa

SEQ ID NO: 195749 - DNA, 22 bp, Artificial Sequence
  Synthetic oligonucleotide; TTA chr2 60464580 60464601 60464597 60464602 +
aaattatattttaccttataaa

SEQ ID NO: 195750 - DNA, 22 bp, Artificial Sequence
  Synthetic oligonucleotide; TTA chr2 60464586 60464607 60464603 60464608 +
tattttaccttataaaacatcg

SEQ ID NO: 195751 - DNA, 22 bp, Artificial Sequence
  Synthetic oligonucleotide; TTT chr2 60464591 60464612 60464608 60464613 +
taccttataaaacatcgattga

SEQ ID NO: 195752 - DNA, 22 bp, Artificial Sequence
  Synthetic oligonucleotide; TTT chr2 60464592 60464613 60464609 60464614 +
accttataaaacatcgattgaa

SEQ ID NO: 195753 - DNA, 22 bp, Artificial Sequence
  Synthetic oligonucleotide; TTA chr2 60464593 60464614 60464610 60464615 +
ccttataaaacatcgattgaaa

SEQ ID NO: 195754 - DNA, 22 bp, Artificial Sequence
  Synthetic oligonucleotide; CTT chr2 60464597 60464618 60464614 60464619 +
ataaaacatcgattgaaatcca

SEQ ID NO: 195755 - DNA, 22 bp, Artificial Sequence
  Synthetic oligonucleotide; TTA chr2 60464598 60464619 60464615 60464620 +
taaaacatcgattgaaatccag

SEQ ID NO: 195756 - DNA, 22 bp, Artificial Sequence
  Synthetic oligonucleotide; TTG chr2 60464612 60464633 60464629 60464634 +
aaatccaggactagactcataa

SEQ ID NO: 195757 - DNA, 22 bp, Artificial Sequence
  Synthetic oligonucleotide; CTA chr2 60464625 60464646 60464642 60464647 +
gactcataattagtggtgctgg

SEQ ID NO: 195758 - DNA, 22 bp, Artificial Sequence
  Synthetic oligonucleotide; CTC chr2 60464630 60464651 60464647 60464652 +
ataattagtggtgctggtttca

SEQ ID NO: 195759 - DNA, 22 bp, Artificial Sequence
  Synthetic oligonucleotide; TTA chr2 60464637 60464658 60464654 60464659 +
gtggtgctggtttcacatgtgc

SEQ ID NO: 195760 - DNA, 22 bp, Artificial Sequence
  Synthetic oligonucleotide; CTG chr2 60464646 60464667 60464663 60464668 +
gtttcacatgtgccatgaattg

SEQ ID NO: 195761 - DNA, 22 bp, Artificial Sequence
  Synthetic oligonucleotide; TTT chr2 60464650 60464671 60464667 60464672 +
cacatgtgccatgaattgtagt

SEQ ID NO: 195762 - DNA, 22 bp, Artificial Sequence
  Synthetic oligonucleotide; TTC chr2 60464651 60464672 60464668 60464673 +
acatgtgccatgaattgtagtc

SEQ ID NO: 195763 - DNA, 22 bp, Artificial Sequence
  Synthetic oligonucleotide; TTG chr2 60464668 60464689 60464685 60464690 +
tagtcattgataaatgccaaaa

SEQ ID NO: 195764 - DNA, 22 bp, Artificial Sequence
  Synthetic oligonucleotide; TTG chr2 60464677 60464698 60464694 60464699 +
ataaatgccaaaatctgtggca

SEQ ID NO: 195765 - DNA, 22 bp, Artificial Sequence
  Synthetic oligonucleotide; CTG chr2 60464694 60464715 60464711 60464716 +
tggcatacagcactacatcaag

SEQ ID NO: 195766 - DNA, 22 bp, Artificial Sequence
  Synthetic oligonucleotide; CTA chr2 60464709 60464730 60464726 60464731 +
catcaaggatctcatttgtatc

SEQ ID NO: 195767 - DNA, 22 bp, Artificial Sequence
  Synthetic oligonucleotide; CTC chr2 60464722 60464743 60464739 60464744 +
atttgtatcctttcaaaaaggc

SEQ ID NO: 195768 - DNA, 22 bp, Artificial Sequence
  Synthetic oligonucleotide; TTT chr2 60464726 60464747 60464743 60464748 +
gtatcctttcaaaaaggcttaa

SEQ ID NO: 195769 - DNA, 22 bp, Artificial Sequence
  Synthetic oligonucleotide; TTG chr2 60464727 60464748 60464744 60464749 +
tatcctttcaaaaaggcttaaa

SEQ ID NO: 195770 - DNA, 22 bp, Artificial Sequence
  Synthetic oligonucleotide; CTT chr2 60464734 60464755 60464751 60464756 +
tcaaaaaggcttaaatgagaaa

SEQ ID NO: 195771 - DNA, 22 bp, Artificial Sequence
  Synthetic oligonucleotide; TTT chr2 60464735 60464756 60464752 60464757 +
caaaaaggcttaaatgagaaaa

SEQ ID NO: 195772 - DNA, 22 bp, Artificial Sequence
  Synthetic oligonucleotide; TTC chr2 60464736 60464757 60464753 60464758 +
aaaaaggcttaaatgagaaaag

SEQ ID NO: 195773 - DNA, 22 bp, Artificial Sequence
  Synthetic oligonucleotide; CTT chr2 60464746 60464767 60464763 60464768 +
aaatgagaaaagtccattttat

SEQ ID NO: 195774 - DNA, 22 bp, Artificial Sequence
  Synthetic oligonucleotide; TTA chr2 60464747 60464768 60464764 60464769 +
aatgagaaaagtccattttatt

SEQ ID NO: 195775 - DNA, 22 bp, Artificial Sequence
  Synthetic oligonucleotide; TTT chr2 60464765 60464786 60464782 60464787 +
tattttgctgccctgagcatcc

SEQ ID NO: 195776 - DNA, 22 bp, Artificial Sequence
  Synthetic oligonucleotide; TTT chr2 60464766 60464787 60464783 60464788 +
attttgctgccctgagcatcct

SEQ ID NO: 195777 - DNA, 22 bp, Artificial Sequence
  Synthetic oligonucleotide; TTA chr2 60464767 60464788 60464784 60464789 +
ttttgctgccctgagcatccta

SEQ ID NO: 195778 - DNA, 22 bp, Artificial Sequence
  Synthetic oligonucleotide; TTT chr2 60464770 60464791 60464787 60464792 +
tgctgccctgagcatcctaaac

SEQ ID NO: 195779 - DNA, 22 bp, Artificial Sequence
  Synthetic oligonucleotide; TTT chr2 60464771 60464792 60464788 60464793 +
gctgccctgagcatcctaaact

SEQ ID NO: 195780 - DNA, 22 bp, Artificial Sequence
  Synthetic oligonucleotide; TTG chr2 60464772 60464793 60464789 60464794 +
ctgccctgagcatcctaaactt

SEQ ID NO: 195781 - DNA, 22 bp, Artificial Sequence
  Synthetic oligonucleotide; CTG chr2 60464775 60464796 60464792 60464797 +
ccctgagcatcctaaacttttt

SEQ ID NO: 195782 - DNA, 22 bp, Artificial Sequence
  Synthetic oligonucleotide; CTG chr2 60464780 60464801 60464797 60464802 +
agcatcctaaactttttttcag

SEQ ID NO: 195783 - DNA, 22 bp, Artificial Sequence
  Synthetic oligonucleotide; CTA chr2 60464789 60464810 60464806 60464811 +
aactttttttcagagccagtta

SEQ ID NO: 195784 - DNA, 22 bp, Artificial Sequence
  Synthetic oligonucleotide; CTT chr2 60464794 60464815 60464811 60464816 +
tttttcagagccagttatgtga

SEQ ID NO: 195785 - DNA, 22 bp, Artificial Sequence
  Synthetic oligonucleotide; TTT chr2 60464795 60464816 60464812 60464817 +
ttttcagagccagttatgtgat

SEQ ID NO: 195786 - DNA, 22 bp, Artificial Sequence
  Synthetic oligonucleotide; TTT chr2 60464796 60464817 60464813 60464818 +
tttcagagccagttatgtgatc

SEQ ID NO: 195787 - DNA, 22 bp, Artificial Sequence
  Synthetic oligonucleotide; TTT chr2 60464797 60464818 60464814 60464819 +
ttcagagccagttatgtgatca

SEQ ID NO: 195788 - DNA, 22 bp, Artificial Sequence
  Synthetic oligonucleotide; TTT chr2 60464798 60464819 60464815 60464820 +
tcagagccagttatgtgatcat

SEQ ID NO: 195789 - DNA, 22 bp, Artificial Sequence
  Synthetic oligonucleotide; TTT chr2 60464799 60464820 60464816 60464821 +
cagagccagttatgtgatcatg

SEQ ID NO: 195790 - DNA, 22 bp, Artificial Sequence
  Synthetic oligonucleotide; TTC chr2 60464800 60464821 60464817 60464822 +
agagccagttatgtgatcatgc

SEQ ID NO: 195791 - DNA, 22 bp, Artificial Sequence
  Synthetic oligonucleotide; TTA chr2 60464811 60464832 60464828 60464833 +
tgtgatcatgctacagtatgtt

SEQ ID NO: 195792 - DNA, 22 bp, Artificial Sequence
  Synthetic oligonucleotide; CTA chr2 60464824 60464845 60464841 60464846 +
cagtatgttaacactgtgatgt

SEQ ID NO: 195793 - DNA, 22 bp, Artificial Sequence
  Synthetic oligonucleotide; TTA chr2 60464834 60464855 60464851 60464856 +
acactgtgatgttatcctcccc

SEQ ID NO: 195794 - DNA, 22 bp, Artificial Sequence
  Synthetic oligonucleotide; CTG chr2 60464840 60464861 60464857 60464862 +
tgatgttatcctcccctctctc

SEQ ID NO: 195795 - DNA, 22 bp, Artificial Sequence
  Synthetic oligonucleotide; TTA chr2 60464848 60464869 60464865 60464870 +
tcctcccctctctctcatacat

SEQ ID NO: 195796 - DNA, 22 bp, Artificial Sequence
  Synthetic oligonucleotide; CTC chr2 60464853 60464874 60464870 60464875 +
ccctctctctcatacatcaggt

SEQ ID NO: 195797 - DNA, 22 bp, Artificial Sequence
  Synthetic oligonucleotide; CTC chr2 60464858 60464879 60464875 60464880 +
tctctcatacatcaggtcagag

SEQ ID NO: 195798 - DNA, 22 bp, Artificial Sequence
  Synthetic oligonucleotide; CTC chr2 60464860 60464881 60464877 60464882 +
tctcatacatcaggtcagagaa

SEQ ID NO: 195799 - DNA, 22 bp, Artificial Sequence
  Synthetic oligonucleotide; CTC chr2 60464862 60464883 60464879 60464884 +
tcatacatcaggtcagagaaaa

SEQ ID NO: 195800 - DNA, 22 bp, Artificial Sequence
  Synthetic oligonucleotide; CTC chr2 60464864 60464885 60464881 60464886 +
atacatcaggtcagagaaaatg

SEQ ID NO: 195801 - DNA, 22 bp, Artificial Sequence
  Synthetic oligonucleotide; TTT chr2 60464892 60464913 60464909 60464914 +
tatcttataatgagcatacaac

SEQ ID NO: 195802 - DNA, 22 bp, Artificial Sequence
  Synthetic oligonucleotide; TTT chr2 60464893 60464914 60464910 60464915 +
atcttataatgagcatacaaca

SEQ ID NO: 195803 - DNA, 22 bp, Artificial Sequence
  Synthetic oligonucleotide; TTA chr2 60464894 60464915 60464911 60464916 +
tcttataatgagcatacaacat

SEQ ID NO: 195804 - DNA, 22 bp, Artificial Sequence
  Synthetic oligonucleotide; CTT chr2 60464898 60464919 60464915 60464920 +
ataatgagcatacaacatacag

SEQ ID NO: 195805 - DNA, 22 bp, Artificial Sequence
  Synthetic oligonucleotide; TTA chr2 60464899 60464920 60464916 60464921 +
taatgagcatacaacatacagt

SEQ ID NO: 195806 - DNA, 22 bp, Artificial Sequence
  Synthetic oligonucleotide; TTT chr2 60464923 60464944 60464940 60464945 +
tcactatcgcattttagtattc

SEQ ID NO: 195807 - DNA, 22 bp, Artificial Sequence
  Synthetic oligonucleotide; TTT chr2 60464924 60464945 60464941 60464946 +
cactatcgcattttagtattcc

SEQ ID NO: 195808 - DNA, 22 bp, Artificial Sequence
  Synthetic oligonucleotide; TTC chr2 60464925 60464946 60464942 60464947 +
actatcgcattttagtattccc

SEQ ID NO: 195809 - DNA, 22 bp, Artificial Sequence
  Synthetic oligonucleotide; CTA chr2 60464929 60464950 60464946 60464951 +
tcgcattttagtattcccatca

SEQ ID NO: 195810 - DNA, 22 bp, Artificial Sequence
  Synthetic oligonucleotide; TTT chr2 60464937 60464958 60464954 60464959 +
tagtattcccatcaactagata

SEQ ID NO: 195811 - DNA, 22 bp, Artificial Sequence
  Synthetic oligonucleotide; TTT chr2 60464938 60464959 60464955 60464960 +
agtattcccatcaactagatat

SEQ ID NO: 195812 - DNA, 22 bp, Artificial Sequence
  Synthetic oligonucleotide; TTA chr2 60464939 60464960 60464956 60464961 +
gtattcccatcaactagatatt

SEQ ID NO: 195813 - DNA, 22 bp, Artificial Sequence
  Synthetic oligonucleotide; TTC chr2 60464945 60464966 60464962 60464967 +
ccatcaactagatattctagat

SEQ ID NO: 195814 - DNA, 22 bp, Artificial Sequence
  Synthetic oligonucleotide; CTA chr2 60464955 60464976 60464972 60464977 +
gatattctagatcatgagggca

SEQ ID NO: 195815 - DNA, 22 bp, Artificial Sequence
  Synthetic oligonucleotide; TTC chr2 60464962 60464983 60464979 60464984 +
tagatcatgagggcagctagtg

SEQ ID NO: 195816 - DNA, 22 bp, Artificial Sequence
  Synthetic oligonucleotide; CTA chr2 60464964 60464985 60464981 60464986 +
gatcatgagggcagctagtgta

SEQ ID NO: 195817 - DNA, 22 bp, Artificial Sequence
  Synthetic oligonucleotide; CTA chr2 60464981 60465002 60464998 60465003 +
gtgtaatcataatgtcaatgag

SEQ ID NO: 195818 - DNA, 22 bp, Artificial Sequence
  Synthetic oligonucleotide; CTG chr2 60465011 60465032 60465028 60465033 +
ttacgattgagactaaagatta

SEQ ID NO: 195819 - DNA, 22 bp, Artificial Sequence
  Synthetic oligonucleotide; TTA chr2 60465014 60465035 60465031 60465036 +
cgattgagactaaagattacat

SEQ ID NO: 195820 - DNA, 22 bp, Artificial Sequence
  Synthetic oligonucleotide; TTG chr2 60465020 60465041 60465037 60465042 +
agactaaagattacatggagag

SEQ ID NO: 195821 - DNA, 22 bp, Artificial Sequence
  Synthetic oligonucleotide; CTA chr2 60465026 60465047 60465043 60465048 +
aagattacatggagagagctgc

SEQ ID NO: 195822 - DNA, 22 bp, Artificial Sequence
  Synthetic oligonucleotide; TTA chr2 60465033 60465054 60465050 60465055 +
catggagagagctgctttgaaa

SEQ ID NO: 195823 - DNA, 22 bp, Artificial Sequence
  Synthetic oligonucleotide; CTG chr2 60465047 60465068 60465064 60465069 +
ctttgaaactggtaattattac

SEQ ID NO: 195824 - DNA, 22 bp, Artificial Sequence
  Synthetic oligonucleotide; CTT chr2 60465050 60465071 60465067 60465072 +
tgaaactggtaattattaccag

SEQ ID NO: 195825 - DNA, 22 bp, Artificial Sequence
  Synthetic oligonucleotide; TTT chr2 60465051 60465072 60465068 60465073 +
gaaactggtaattattaccagt

SEQ ID NO: 195826 - DNA, 22 bp, Artificial Sequence
  Synthetic oligonucleotide; TTG chr2 60465052 60465073 60465069 60465074 +
aaactggtaattattaccagtc

SEQ ID NO: 195827 - DNA, 22 bp, Artificial Sequence
  Synthetic oligonucleotide; CTG chr2 60465058 60465079 60465075 60465080 +
gtaattattaccagtccactaa

SEQ ID NO: 195828 - DNA, 22 bp, Artificial Sequence
  Synthetic oligonucleotide; TTA chr2 60465065 60465086 60465082 60465087 +
ttaccagtccactaatagcaaa

SEQ ID NO: 195829 - DNA, 22 bp, Artificial Sequence
  Synthetic oligonucleotide; TTA chr2 60465068 60465089 60465085 60465090 +
ccagtccactaatagcaaatga

SEQ ID NO: 195830 - DNA, 22 bp, Artificial Sequence
  Synthetic oligonucleotide; CTA chr2 60465079 60465100 60465096 60465101 +
atagcaaatgatgcattacaat

SEQ ID NO: 195831 - DNA, 22 bp, Artificial Sequence
  Synthetic oligonucleotide; TTA chr2 60465097 60465118 60465114 60465119 +
caatttcaccatataatctgta

SEQ ID NO: 195832 - DNA, 22 bp, Artificial Sequence
  Synthetic oligonucleotide; TTT chr2 60465103 60465124 60465120 60465125 +
caccatataatctgtatttcac

SEQ ID NO: 195833 - DNA, 22 bp, Artificial Sequence
  Synthetic oligonucleotide; TTC chr2 60465104 60465125 60465121 60465126 +
accatataatctgtatttcact

SEQ ID NO: 195834 - DNA, 22 bp, Artificial Sequence
  Synthetic oligonucleotide; CTG chr2 60465117 60465138 60465134 60465139 +
tatttcactcagctcatgccgg

SEQ ID NO: 195835 - DNA, 22 bp, Artificial Sequence
  Synthetic oligonucleotide; TTT chr2 60465122 60465143 60465139 60465144 +
cactcagctcatgccggtgtac

SEQ ID NO: 195836 - DNA, 22 bp, Artificial Sequence
  Synthetic oligonucleotide; TTC chr2 60465123 60465144 60465140 60465145 +
actcagctcatgccggtgtacc

SEQ ID NO: 195837 - DNA, 22 bp, Artificial Sequence
  Synthetic oligonucleotide; CTC chr2 60465127 60465148 60465144 60465149 +
agctcatgccggtgtaccatat

SEQ ID NO: 195838 - DNA, 22 bp, Artificial Sequence
  Synthetic oligonucleotide; CTC chr2 60465132 60465153 60465149 60465154 +
atgccggtgtaccatattatat

SEQ ID NO: 195839 - DNA, 22 bp, Artificial Sequence
  Synthetic oligonucleotide; TTA chr2 60465151 60465172 60465168 60465173 +
tattacagtgctcacagattct

SEQ ID NO: 195840 - DNA, 22 bp, Artificial Sequence
  Synthetic oligonucleotide; TTA chr2 60465156 60465177 60465173 60465178 +
cagtgctcacagattctaaatt

SEQ ID NO: 195841 - DNA, 22 bp, Artificial Sequence
  Synthetic oligonucleotide; CTC chr2 60465164 60465185 60465181 60465186 +
acagattctaaattcctaaact

SEQ ID NO: 195842 - DNA, 22 bp, Artificial Sequence
  Synthetic oligonucleotide; TTC chr2 60465172 60465193 60465189 60465194 +
taaattcctaaactgcagtcat

SEQ ID NO: 195843 - DNA, 22 bp, Artificial Sequence
  Synthetic oligonucleotide; CTA chr2 60465174 60465195 60465191 60465196 +
aattcctaaactgcagtcatca

SEQ ID NO: 195844 - DNA, 22 bp, Artificial Sequence
  Synthetic oligonucleotide; TTC chr2 60465179 60465200 60465196 60465201 +
ctaaactgcagtcatcaataaa

SEQ ID NO: 195845 - DNA, 22 bp, Artificial Sequence
  Synthetic oligonucleotide; CTA chr2 60465182 60465203 60465199 60465204 +
aactgcagtcatcaataaatgt

SEQ ID NO: 195846 - DNA, 22 bp, Artificial Sequence
  Synthetic oligonucleotide; CTG chr2 60465187 60465208 60465204 60465209 +
cagtcatcaataaatgtgttac

SEQ ID NO: 195847 - DNA, 22 bp, Artificial Sequence
  Synthetic oligonucleotide; TTA chr2 60465208 60465229 60465225 60465230 +
cttgccataatttgtgaaatta

SEQ ID NO: 195848 - DNA, 22 bp, Artificial Sequence
  Synthetic oligonucleotide; CTT chr2 60465211 60465232 60465228 60465233 +
gccataatttgtgaaattactt

SEQ ID NO: 195849 - DNA, 22 bp, Artificial Sequence
  Synthetic oligonucleotide; TTG chr2 60465212 60465233 60465229 60465234 +
ccataatttgtgaaattacttt

SEQ ID NO: 195850 - DNA, 22 bp, Artificial Sequence
  Synthetic oligonucleotide; TTT chr2 60465221 60465242 60465238 60465243 +
gtgaaattactttgttcataac

SEQ ID NO: 195851 - DNA, 22 bp, Artificial Sequence
  Synthetic oligonucleotide; TTG chr2 60465222 60465243 60465239 60465244 +
tgaaattactttgttcataaca

SEQ ID NO: 195852 - DNA, 22 bp, Artificial Sequence
  Synthetic oligonucleotide; TTA chr2 60465230 60465251 60465247 60465252 +
ctttgttcataacatctttgat

SEQ ID NO: 195853 - DNA, 22 bp, Artificial Sequence
  Synthetic oligonucleotide; CTT chr2 60465233 60465254 60465250 60465255 +
tgttcataacatctttgatgat

SEQ ID NO: 195854 - DNA, 22 bp, Artificial Sequence
  Synthetic oligonucleotide; TTT chr2 60465234 60465255 60465251 60465256 +
gttcataacatctttgatgatt

SEQ ID NO: 195855 - DNA, 22 bp, Artificial Sequence
  Synthetic oligonucleotide; TTG chr2 60465235 60465256 60465252 60465257 +
ttcataacatctttgatgattt

SEQ ID NO: 195856 - DNA, 22 bp, Artificial Sequence
  Synthetic oligonucleotide; TTC chr2 60465238 60465259 60465255 60465260 +
ataacatctttgatgatttaga

SEQ ID NO: 195857 - DNA, 22 bp, Artificial Sequence
  Synthetic oligonucleotide; CTT chr2 60465248 60465269 60465265 60465270 +
tgatgatttagaaagactggaa

SEQ ID NO: 195858 - DNA, 22 bp, Artificial Sequence
  Synthetic oligonucleotide; TTT chr2 60465249 60465270 60465266 60465271 +
gatgatttagaaagactggaat

SEQ ID NO: 195859 - DNA, 22 bp, Artificial Sequence
  Synthetic oligonucleotide; TTG chr2 60465250 60465271 60465267 60465272 +
atgatttagaaagactggaatt

SEQ ID NO: 195860 - DNA, 22 bp, Artificial Sequence
  Synthetic oligonucleotide; TTT chr2 60465257 60465278 60465274 60465279 +
agaaagactggaattgatttcc

SEQ ID NO: 195861 - DNA, 22 bp, Artificial Sequence
  Synthetic oligonucleotide; TTA chr2 60465258 60465279 60465275 60465280 +
gaaagactggaattgatttcct

SEQ ID NO: 195862 - DNA, 22 bp, Artificial Sequence
  Synthetic oligonucleotide; CTG chr2 60465267 60465288 60465284 60465289 +
gaattgatttcctgtgtggcaa

SEQ ID NO: 195863 - DNA, 22 bp, Artificial Sequence
  Synthetic oligonucleotide; TTG chr2 60465273 60465294 60465290 60465295 +
atttcctgtgtggcaaaattag

SEQ ID NO: 195864 - DNA, 22 bp, Artificial Sequence
  Synthetic oligonucleotide; TTT chr2 60465277 60465298 60465294 60465299 +
cctgtgtggcaaaattagggct

SEQ ID NO: 195865 - DNA, 22 bp, Artificial Sequence
  Synthetic oligonucleotide; TTC chr2 60465278 60465299 60465295 60465300 +
ctgtgtggcaaaattagggcta

SEQ ID NO: 195866 - DNA, 22 bp, Artificial Sequence
  Synthetic oligonucleotide; CTG chr2 60465281 60465302 60465298 60465303 +
tgtggcaaaattagggctacat

SEQ ID NO: 195867 - DNA, 22 bp, Artificial Sequence
  Synthetic oligonucleotide; TTA chr2 60465294 60465315 60465311 60465316 +
gggctacattgatttattgatg

SEQ ID NO: 195868 - DNA, 22 bp, Artificial Sequence
  Synthetic oligonucleotide; CTA chr2 60465300 60465321 60465317 60465322 +
cattgatttattgatgtgtaaa

SEQ ID NO: 195869 - DNA, 22 bp, Artificial Sequence
  Synthetic oligonucleotide; TTG chr2 60465305 60465326 60465322 60465327 +
atttattgatgtgtaaaatata

SEQ ID NO: 195870 - DNA, 22 bp, Artificial Sequence
  Synthetic oligonucleotide; TTT chr2 60465309 60465330 60465326 60465331 +
attgatgtgtaaaatataataa

SEQ ID NO: 195871 - DNA, 22 bp, Artificial Sequence
  Synthetic oligonucleotide; TTA chr2 60465310 60465331 60465327 60465332 +
ttgatgtgtaaaatataataat

SEQ ID NO: 195872 - DNA, 22 bp, Artificial Sequence
  Synthetic oligonucleotide; TTG chr2 60465313 60465334 60465330 60465335 +
atgtgtaaaatataataatatt

SEQ ID NO: 195873 - DNA, 22 bp, Artificial Sequence
  Synthetic oligonucleotide; TTC chr2 60465336 60465357 60465353 60465358 +
ttcatttactctgatgaaaatc

SEQ ID NO: 195874 - DNA, 22 bp, Artificial Sequence
  Synthetic oligonucleotide; CTT chr2 60465338 60465359 60465355 60465360 +
catttactctgatgaaaatcaa

SEQ ID NO: 195875 - DNA, 22 bp, Artificial Sequence
  Synthetic oligonucleotide; TTC chr2 60465339 60465360 60465356 60465361 +
atttactctgatgaaaatcaac

SEQ ID NO: 195876 - DNA, 22 bp, Artificial Sequence
  Synthetic oligonucleotide; TTT chr2 60465343 60465364 60465360 60465365 +
actctgatgaaaatcaacttct

SEQ ID NO: 195877 - DNA, 22 bp, Artificial Sequence
  Synthetic oligonucleotide; TTA chr2 60465344 60465365 60465361 60465366 +
ctctgatgaaaatcaacttctc

SEQ ID NO: 195878 - DNA, 22 bp, Artificial Sequence
  Synthetic oligonucleotide; CTC chr2 60465347 60465368 60465364 60465369 +
tgatgaaaatcaacttctcaat

SEQ ID NO: 195879 - DNA, 22 bp, Artificial Sequence
  Synthetic oligonucleotide; CTG chr2 60465349 60465370 60465366 60465371 +
atgaaaatcaacttctcaattt

SEQ ID NO: 195880 - DNA, 22 bp, Artificial Sequence
  Synthetic oligonucleotide; CTT chr2 60465363 60465384 60465380 60465385 +
ctcaatttgagagcctcattgg

SEQ ID NO: 195881 - DNA, 22 bp, Artificial Sequence
  Synthetic oligonucleotide; TTC chr2 60465364 60465385 60465381 60465386 +
tcaatttgagagcctcattggg

SEQ ID NO: 195882 - DNA, 22 bp, Artificial Sequence
  Synthetic oligonucleotide; CTC chr2 60465366 60465387 60465383 60465388 +
aatttgagagcctcattgggca

SEQ ID NO: 195883 - DNA, 22 bp, Artificial Sequence
  Synthetic oligonucleotide; TTT chr2 60465371 60465392 60465388 60465393 +
gagagcctcattgggcatttac

SEQ ID NO: 195884 - DNA, 22 bp, Artificial Sequence
  Synthetic oligonucleotide; TTG chr2 60465372 60465393 60465389 60465394 +
agagcctcattgggcatttacg

SEQ ID NO: 195885 - DNA, 22 bp, Artificial Sequence
  Synthetic oligonucleotide; CTC chr2 60465380 60465401 60465397 60465402 +
attgggcatttacggggattgt

SEQ ID NO: 195886 - DNA, 22 bp, Artificial Sequence
  Synthetic oligonucleotide; TTG chr2 60465384 60465405 60465401 60465406 +
ggcatttacggggattgttttg

SEQ ID NO: 195887 - DNA, 22 bp, Artificial Sequence
  Synthetic oligonucleotide; TTT chr2 60465391 60465412 60465408 60465413 +
acggggattgttttgatttaga

SEQ ID NO: 195888 - DNA, 22 bp, Artificial Sequence
  Synthetic oligonucleotide; TTA chr2 60465392 60465413 60465409 60465414 +
cggggattgttttgatttagag

SEQ ID NO: 195889 - DNA, 22 bp, Artificial Sequence
  Synthetic oligonucleotide; TTG chr2 60465401 60465422 60465418 60465423 +
ttttgatttagagcaataaact

SEQ ID NO: 195890 - DNA, 22 bp, Artificial Sequence
  Synthetic oligonucleotide; TTT chr2 60465404 60465425 60465421 60465426 +
tgatttagagcaataaactgac

SEQ ID NO: 195891 - DNA, 22 bp, Artificial Sequence
  Synthetic oligonucleotide; TTT chr2 60465405 60465426 60465422 60465427 +
gatttagagcaataaactgaca

SEQ ID NO: 195892 - DNA, 22 bp, Artificial Sequence
  Synthetic oligonucleotide; TTG chr2 60465406 60465427 60465423 60465428 +
atttagagcaataaactgacac

SEQ ID NO: 195893 - DNA, 22 bp, Artificial Sequence
  Synthetic oligonucleotide; TTT chr2 60465410 60465431 60465427 60465432 +
agagcaataaactgacacctgg

SEQ ID NO: 195894 - DNA, 22 bp, Artificial Sequence
  Synthetic oligonucleotide; TTA chr2 60465411 60465432 60465428 60465433 +
gagcaataaactgacacctggc

SEQ ID NO: 195895 - DNA, 22 bp, Artificial Sequence
  Synthetic oligonucleotide; CTG chr2 60465424 60465445 60465441 60465446 +
acacctggcccctaagcatagg

SEQ ID NO: 195896 - DNA, 22 bp, Artificial Sequence
  Synthetic oligonucleotide; CTG chr2 60465431 60465452 60465448 60465453 +
gcccctaagcataggaacttga

SEQ ID NO: 195897 - DNA, 22 bp, Artificial Sequence
  Synthetic oligonucleotide; CTA chr2 60465438 60465459 60465455 60465460 +
agcataggaacttgagacatca

SEQ ID NO: 195898 - DNA, 22 bp, Artificial Sequence
  Synthetic oligonucleotide; CTT chr2 60465451 60465472 60465468 60465473 +
gagacatcaaaagggttaaaat

SEQ ID NO: 195899 - DNA, 22 bp, Artificial Sequence
  Synthetic oligonucleotide; TTG chr2 60465452 60465473 60465469 60465474 +
agacatcaaaagggttaaaatc

SEQ ID NO: 195900 - DNA, 22 bp, Artificial Sequence
  Synthetic oligonucleotide; TTA chr2 60465469 60465490 60465486 60465491 +
aaatcagctattagcccaccta

SEQ ID NO: 195901 - DNA, 22 bp, Artificial Sequence
  Synthetic oligonucleotide; CTA chr2 60465479 60465500 60465496 60465501 +
ttagcccacctactggctttta

SEQ ID NO: 195902 - DNA, 22 bp, Artificial Sequence
  Synthetic oligonucleotide; TTA chr2 60465482 60465503 60465499 60465504 +
gcccacctactggcttttattt

SEQ ID NO: 195903 - DNA, 22 bp, Artificial Sequence
  Synthetic oligonucleotide; CTA chr2 60465491 60465512 60465508 60465513 +
ctggcttttattttatttcatt

SEQ ID NO: 195904 - DNA, 22 bp, Artificial Sequence
  Synthetic oligonucleotide; CTG chr2 60465494 60465515 60465511 60465516 +
gcttttattttatttcatttta

SEQ ID NO: 195905 - DNA, 22 bp, Artificial Sequence
  Synthetic oligonucleotide; CTT chr2 60465498 60465519 60465515 60465520 +
ttattttatttcattttacttt

SEQ ID NO: 195906 - DNA, 22 bp, Artificial Sequence
  Synthetic oligonucleotide; TTT chr2 60465499 60465520 60465516 60465521 +
tattttatttcattttacttta

SEQ ID NO: 195907 - DNA, 22 bp, Artificial Sequence
  Synthetic oligonucleotide; TTT chr2 60465500 60465521 60465517 60465522 +
attttatttcattttactttat

SEQ ID NO: 195908 - DNA, 22 bp, Artificial Sequence
  Synthetic oligonucleotide; TTA chr2 60465501 60465522 60465518 60465523 +
ttttatttcattttactttatg

SEQ ID NO: 195909 - DNA, 22 bp, Artificial Sequence
  Synthetic oligonucleotide; TTT chr2 60465504 60465525 60465521 60465526 +
tatttcattttactttatggga

SEQ ID NO: 195910 - DNA, 22 bp, Artificial Sequence
  Synthetic oligonucleotide; TTT chr2 60465505 60465526 60465522 60465527 +
atttcattttactttatgggaa

SEQ ID NO: 195911 - DNA, 22 bp, Artificial Sequence
  Synthetic oligonucleotide; TTA chr2 60465506 60465527 60465523 60465528 +
tttcattttactttatgggaag

SEQ ID NO: 195912 - DNA, 22 bp, Artificial Sequence
  Synthetic oligonucleotide; TTT chr2 60465509 60465530 60465526 60465531 +
cattttactttatgggaaggaa

SEQ ID NO: 195913 - DNA, 22 bp, Artificial Sequence
  Synthetic oligonucleotide; TTC chr2 60465510 60465531 60465527 60465532 +
attttactttatgggaaggaat

SEQ ID NO: 195914 - DNA, 22 bp, Artificial Sequence
  Synthetic oligonucleotide; TTT chr2 60465514 60465535 60465531 60465536 +
tactttatgggaaggaatgacc

SEQ ID NO: 195915 - DNA, 22 bp, Artificial Sequence
  Synthetic oligonucleotide; TTT chr2 60465515 60465536 60465532 60465537 +
actttatgggaaggaatgaccc

SEQ ID NO: 195916 - DNA, 22 bp, Artificial Sequence
  Synthetic oligonucleotide; TTA chr2 60465516 60465537 60465533 60465538 +
ctttatgggaaggaatgacccc

SEQ ID NO: 195917 - DNA, 22 bp, Artificial Sequence
  Synthetic oligonucleotide; CTT chr2 60465519 60465540 60465536 60465541 +
tatgggaaggaatgacccccat

SEQ ID NO: 195918 - DNA, 22 bp, Artificial Sequence
  Synthetic oligonucleotide; TTT chr2 60465520 60465541 60465537 60465542 +
atgggaaggaatgacccccatt

SEQ ID NO: 195919 - DNA, 22 bp, Artificial Sequence
  Synthetic oligonucleotide; TTA chr2 60465521 60465542 60465538 60465543 +
tgggaaggaatgacccccattt

SEQ ID NO: 195920 - DNA, 22 bp, Artificial Sequence
  Synthetic oligonucleotide; TTT chr2 60465543 60465564 60465560 60465565 +
ctagtatgtcaccaatgtgaaa

SEQ ID NO: 195921 - DNA, 22 bp, Artificial Sequence
  Synthetic oligonucleotide; TTC chr2 60465544 60465565 60465561 60465566 +
tagtatgtcaccaatgtgaaaa

SEQ ID NO: 195922 - DNA, 22 bp, Artificial Sequence
  Synthetic oligonucleotide; CTA chr2 60465546 60465567 60465563 60465568 +
gtatgtcaccaatgtgaaaaag

SEQ ID NO: 195923 - DNA, 22 bp, Artificial Sequence
  Synthetic oligonucleotide; CTA chr2 60465580 60465601 60465597 60465602 +
agcctcaagattcagaagaaca

SEQ ID NO: 195924 - DNA, 22 bp, Artificial Sequence
  Synthetic oligonucleotide; CTC chr2 60465586 60465607 60465603 60465608 +
aagattcagaagaacaaggagg

SEQ ID NO: 195925 - DNA, 22 bp, Artificial Sequence
  Synthetic oligonucleotide; TTC chr2 60465593 60465614 60465610 60465615 +
agaagaacaaggaggtctgaga

SEQ ID NO: 195926 - DNA, 22 bp, Artificial Sequence
  Synthetic oligonucleotide; CTG chr2 60465612 60465633 60465629 60465634 +
agactggaggcctagctctatt

SEQ ID NO: 195927 - DNA, 22 bp, Artificial Sequence
  Synthetic oligonucleotide; CTG chr2 60465618 60465639 60465635 60465640 +
gaggcctagctctattatccac

SEQ ID NO: 195928 - DNA, 22 bp, Artificial Sequence
  Synthetic oligonucleotide; CTA chr2 60465626 60465647 60465643 60465648 +
gctctattatccactagattgt

SEQ ID NO: 195929 - DNA, 22 bp, Artificial Sequence
  Synthetic oligonucleotide; CTC chr2 60465630 60465651 60465647 60465652 +
tattatccactagattgtaact

SEQ ID NO: 195930 - DNA, 22 bp, Artificial Sequence
  Synthetic oligonucleotide; CTA chr2 60465632 60465653 60465649 60465654 +
ttatccactagattgtaactct

SEQ ID NO: 195931 - DNA, 22 bp, Artificial Sequence
  Synthetic oligonucleotide; TTA chr2 60465635 60465656 60465652 60465657 +
tccactagattgtaactctggg

SEQ ID NO: 195932 - DNA, 22 bp, Artificial Sequence
  Synthetic oligonucleotide; CTA chr2 60465642 60465663 60465659 60465664 +
gattgtaactctgggatagtca

SEQ ID NO: 195933 - DNA, 22 bp, Artificial Sequence
  Synthetic oligonucleotide; TTG chr2 60465647 60465668 60465664 60465669 +
taactctgggatagtcatttga

SEQ ID NO: 195934 - DNA, 22 bp, Artificial Sequence
  Synthetic oligonucleotide; CTC chr2 60465653 60465674 60465670 60465675 +
tgggatagtcatttgatttctc

SEQ ID NO: 195935 - DNA, 22 bp, Artificial Sequence
  Synthetic oligonucleotide; CTG chr2 60465655 60465676 60465672 60465677 +
ggatagtcatttgatttctctg

SEQ ID NO: 195936 - DNA, 22 bp, Artificial Sequence
  Synthetic oligonucleotide; TTT chr2 60465667 60465688 60465684 60465689 +
gatttctctgagtcttggaatt

SEQ ID NO: 195937 - DNA, 22 bp, Artificial Sequence
  Synthetic oligonucleotide; TTG chr2 60465668 60465689 60465685 60465690 +
atttctctgagtcttggaattc

SEQ ID NO: 195938 - DNA, 22 bp, Artificial Sequence
  Synthetic oligonucleotide; TTT chr2 60465672 60465693 60465689 60465694 +
ctctgagtcttggaattcctat

SEQ ID NO: 195939 - DNA, 22 bp, Artificial Sequence
  Synthetic oligonucleotide; TTC chr2 60465673 60465694 60465690 60465695 +
tctgagtcttggaattcctatc

SEQ ID NO: 195940 - DNA, 22 bp, Artificial Sequence
  Synthetic oligonucleotide; CTC chr2 60465675 60465696 60465692 60465697 +
tgagtcttggaattcctatctg

SEQ ID NO: 195941 - DNA, 22 bp, Artificial Sequence
  Synthetic oligonucleotide; CTG chr2 60465677 60465698 60465694 60465699 +
agtcttggaattcctatctgta

SEQ ID NO: 195942 - DNA, 22 bp, Artificial Sequence
  Synthetic oligonucleotide; CTT chr2 60465683 60465704 60465700 60465705 +
ggaattcctatctgtaaaatga

SEQ ID NO: 195943 - DNA, 22 bp, Artificial Sequence
  Synthetic oligonucleotide; TTG chr2 60465684 60465705 60465701 60465706 +
gaattcctatctgtaaaatgag

SEQ ID NO: 195944 - DNA, 22 bp, Artificial Sequence
  Synthetic oligonucleotide; TTC chr2 60465690 60465711 60465707 60465712 +
ctatctgtaaaatgagcataaa

SEQ ID NO: 195945 - DNA, 22 bp, Artificial Sequence
  Synthetic oligonucleotide; CTA chr2 60465693 60465714 60465710 60465715 +
tctgtaaaatgagcataaaaac

SEQ ID NO: 195946 - DNA, 22 bp, Artificial Sequence
  Synthetic oligonucleotide; CTG chr2 60465697 60465718 60465714 60465719 +
taaaatgagcataaaaacagta

SEQ ID NO: 195947 - DNA, 22 bp, Artificial Sequence
  Synthetic oligonucleotide; CTG chr2 60465723 60465744 60465740 60465745 +
taagaattgttgggaagttcaa

SEQ ID NO: 195948 - DNA, 22 bp, Artificial Sequence
  Synthetic oligonucleotide; TTG chr2 60465732 60465753 60465749 60465754 +
ttgggaagttcaaatgacagaa

SEQ ID NO: 195949 - DNA, 22 bp, Artificial Sequence
  Synthetic oligonucleotide; TTG chr2 60465735 60465756 60465752 60465757 +
ggaagttcaaatgacagaagta

SEQ ID NO: 195950 - DNA, 22 bp, Artificial Sequence
  Synthetic oligonucleotide; TTC chr2 60465743 60465764 60465760 60465765 +
aaatgacagaagtatataaaag

SEQ ID NO: 195951 - DNA, 22 bp, Artificial Sequence
  Synthetic oligonucleotide; CTC chr2 60465770 60465791 60465787 60465792 +
tgtaaactatcaggtcgaatgt

SEQ ID NO: 195952 - DNA, 22 bp, Artificial Sequence
  Synthetic oligonucleotide; CTG chr2 60465772 60465793 60465789 60465794 +
taaactatcaggtcgaatgtga

SEQ ID NO: 195953 - DNA, 22 bp, Artificial Sequence
  Synthetic oligonucleotide; CTA chr2 60465779 60465800 60465796 60465801 +
tcaggtcgaatgtgaatgtgag

SEQ ID NO: 195954 - DNA, 22 bp, Artificial Sequence
  Synthetic oligonucleotide; TTT chr2 60465804 60465825 60465821 60465826 +
tcattactaccaggggtgatta

SEQ ID NO: 195955 - DNA, 22 bp, Artificial Sequence
  Synthetic oligonucleotide; TTT chr2 60465805 60465826 60465822 60465827 +
cattactaccaggggtgattaa

SEQ ID NO: 195956 - DNA, 22 bp, Artificial Sequence
  Synthetic oligonucleotide; TTC chr2 60465806 60465827 60465823 60465828 +
attactaccaggggtgattaat

SEQ ID NO: 195957 - DNA, 22 bp, Artificial Sequence
  Synthetic oligonucleotide; TTA chr2 60465810 60465831 60465827 60465832 +
ctaccaggggtgattaattact

SEQ ID NO: 195958 - DNA, 22 bp, Artificial Sequence
  Synthetic oligonucleotide; CTA chr2 60465813 60465834 60465830 60465835 +
ccaggggtgattaattactgag

SEQ ID NO: 195959 - DNA, 22 bp, Artificial Sequence
  Synthetic oligonucleotide; TTA chr2 60465826 60465847 60465843 60465848 +
attactgagggtaatgactaac

SEQ ID NO: 195960 - DNA, 22 bp, Artificial Sequence
  Synthetic oligonucleotide; TTA chr2 60465830 60465851 60465847 60465852 +
ctgagggtaatgactaaccaca

SEQ ID NO: 195961 - DNA, 22 bp, Artificial Sequence
  Synthetic oligonucleotide; CTG chr2 60465833 60465854 60465850 60465855 +
agggtaatgactaaccacatta

SEQ ID NO: 195962 - DNA, 22 bp, Artificial Sequence
  Synthetic oligonucleotide; CTA chr2 60465846 60465867 60465863 60465868 +
accacattacacaccccgaacg

SEQ ID NO: 195963 - DNA, 22 bp, Artificial Sequence
  Synthetic oligonucleotide; TTA chr2 60465855 60465876 60465872 60465877 +
cacaccccgaacggcttccaga

SEQ ID NO: 195964 - DNA, 22 bp, Artificial Sequence
  Synthetic oligonucleotide; CTT chr2 60465872 60465893 60465889 60465894 +
ccagaggaaggtcccagtccag

SEQ ID NO: 195965 - DNA, 22 bp, Artificial Sequence
  Synthetic oligonucleotide; TTC chr2 60465873 60465894 60465890 60465895 +
cagaggaaggtcccagtccagg

SEQ ID NO: 195966 - DNA, 22 bp, Artificial Sequence
  Synthetic oligonucleotide; CTT chr2 60465899 60465920 60465916 60465921 +
aacccaggccaaaaggaggctc

SEQ ID NO: 195967 - DNA, 22 bp, Artificial Sequence
  Synthetic oligonucleotide; TTA chr2 60465900 60465921 60465917 60465922 +
acccaggccaaaaggaggctct

SEQ ID NO: 195968 - DNA, 22 bp, Artificial Sequence
  Synthetic oligonucleotide; CTC chr2 60465921 60465942 60465938 60465943 +
tagttaaagagcaggggtgact

SEQ ID NO: 195969 - DNA, 22 bp, Artificial Sequence
  Synthetic oligonucleotide; CTA chr2 60465923 60465944 60465940 60465945 +
gttaaagagcaggggtgactgg

SEQ ID NO: 195970 - DNA, 22 bp, Artificial Sequence
  Synthetic oligonucleotide; TTA chr2 60465927 60465948 60465944 60465949 +
aagagcaggggtgactggcaca

SEQ ID NO: 195971 - DNA, 22 bp, Artificial Sequence
  Synthetic oligonucleotide; CTG chr2 60465944 60465965 60465961 60465966 +
gcacacagcagagtggccacag

SEQ ID NO: 195972 - DNA, 22 bp, Artificial Sequence
  Synthetic oligonucleotide; CTA chr2 60465976 60465997 60465993 60465998 +
tgagctctggaagccaggggca

SEQ ID NO: 195973 - DNA, 22 bp, Artificial Sequence
  Synthetic oligonucleotide; CTC chr2 60465983 60466004 60466000 60466005 +
tggaagccaggggcagcaggtt

SEQ ID NO: 195974 - DNA, 22 bp, Artificial Sequence
  Synthetic oligonucleotide; CTG chr2 60465985 60466006 60466002 60466007 +
gaagccaggggcagcaggttaa

SEQ ID NO: 195975 - DNA, 22 bp, Artificial Sequence
  Synthetic oligonucleotide; TTA chr2 60466006 60466027 60466023 60466028 +
atgccgccaagtggaatgggca

SEQ ID NO: 195976 - DNA, 22 bp, Artificial Sequence
  Synthetic oligonucleotide; TTT chr2 60466036 60466057 60466053 60466058 +
gttctagagctttctggacccc

SEQ ID NO: 195977 - DNA, 22 bp, Artificial Sequence
  Synthetic oligonucleotide; TTG chr2 60466037 60466058 60466054 60466059 +
ttctagagctttctggaccccc

SEQ ID NO: 195978 - DNA, 22 bp, Artificial Sequence
  Synthetic oligonucleotide; TTC chr2 60466040 60466061 60466057 60466062 +
tagagctttctggacccccaca

SEQ ID NO: 195979 - DNA, 22 bp, Artificial Sequence
  Synthetic oligonucleotide; CTA chr2 60466042 60466063 60466059 60466064 +
gagctttctggacccccacaac

SEQ ID NO: 195980 - DNA, 22 bp, Artificial Sequence
  Synthetic oligonucleotide; CTT chr2 60466048 60466069 60466065 60466070 +
tctggacccccacaacccactt

SEQ ID NO: 195981 - DNA, 22 bp, Artificial Sequence
  Synthetic oligonucleotide; TTT chr2 60466049 60466070 60466066 60466071 +
ctggacccccacaacccacttc

SEQ ID NO: 195982 - DNA, 22 bp, Artificial Sequence
  Synthetic oligonucleotide; TTC chr2 60466050 60466071 60466067 60466072 +
tggacccccacaacccacttcc

SEQ ID NO: 195983 - DNA, 22 bp, Artificial Sequence
  Synthetic oligonucleotide; CTG chr2 60466052 60466073 60466069 60466074 +
gacccccacaacccacttccac

SEQ ID NO: 195984 - DNA, 22 bp, Artificial Sequence
  Synthetic oligonucleotide; CTT chr2 60466070 60466091 60466087 60466092 +
ccacataccttgttctggtcac

SEQ ID NO: 195985 - DNA, 22 bp, Artificial Sequence
  Synthetic oligonucleotide; TTC chr2 60466071 60466092 60466088 60466093 +
cacataccttgttctggtcact

SEQ ID NO: 195986 - DNA, 22 bp, Artificial Sequence
  Synthetic oligonucleotide; CTT chr2 60466081 60466102 60466098 60466103 +
gttctggtcactcctaaattgg

SEQ ID NO: 195987 - DNA, 22 bp, Artificial Sequence
  Synthetic oligonucleotide; TTG chr2 60466082 60466103 60466099 60466104 +
ttctggtcactcctaaattggt

SEQ ID NO: 195988 - DNA, 22 bp, Artificial Sequence
  Synthetic oligonucleotide; TTC chr2 60466085 60466106 60466102 60466107 +
tggtcactcctaaattggtcct

SEQ ID NO: 195989 - DNA, 22 bp, Artificial Sequence
  Synthetic oligonucleotide; CTG chr2 60466087 60466108 60466104 60466109 +
gtcactcctaaattggtcctgc

SEQ ID NO: 195990 - DNA, 22 bp, Artificial Sequence
  Synthetic oligonucleotide; CTC chr2 60466094 60466115 60466111 60466116 +
ctaaattggtcctgccagcagg

SEQ ID NO: 195991 - DNA, 22 bp, Artificial Sequence
  Synthetic oligonucleotide; CTA chr2 60466097 60466118 60466114 60466119 +
aattggtcctgccagcaggggc

SEQ ID NO: 195992 - DNA, 22 bp, Artificial Sequence
  Synthetic oligonucleotide; TTG chr2 60466102 60466123 60466119 60466124 +
gtcctgccagcaggggcaccag

SEQ ID NO: 195993 - DNA, 22 bp, Artificial Sequence
  Synthetic oligonucleotide; CTG chr2 60466108 60466129 60466125 60466130 +
ccagcaggggcaccagcaaact

SEQ ID NO: 195994 - DNA, 22 bp, Artificial Sequence
  Synthetic oligonucleotide; CTA chr2 60466131 60466152 60466148 60466153 +
tgtaccctccctttgtgggaag

SEQ ID NO: 195995 - DNA, 22 bp, Artificial Sequence
  Synthetic oligonucleotide; CTC chr2 60466140 60466161 60466157 60466162 +
cctttgtgggaaggtgggagag

SEQ ID NO: 195996 - DNA, 22 bp, Artificial Sequence
  Synthetic oligonucleotide; CTT chr2 60466144 60466165 60466161 60466166 +
tgtgggaaggtgggagaggaca

SEQ ID NO: 195997 - DNA, 22 bp, Artificial Sequence
  Synthetic oligonucleotide; TTT chr2 60466145 60466166 60466162 60466167 +
gtgggaaggtgggagaggacag

SEQ ID NO: 195998 - DNA, 22 bp, Artificial Sequence
  Synthetic oligonucleotide; TTG chr2 60466146 60466167 60466163 60466168 +
tgggaaggtgggagaggacagg

SEQ ID NO: 195999 - DNA, 22 bp, Artificial Sequence
  Synthetic oligonucleotide; TTC chr2 60466173 60466194 60466190 60466195 +
cctatcaagctcagactttcct

SEQ ID NO: 196000 - DNA, 22 bp, Artificial Sequence
  Synthetic oligonucleotide; CTA chr2 60466177 60466198 60466194 60466199 +
tcaagctcagactttcctacca

SEQ ID NO: 196001 - DNA, 22 bp, Artificial Sequence
  Synthetic oligonucleotide; CTC chr2 60466185 60466206 60466202 60466207 +
agactttcctaccagtcaaatc

SEQ ID NO: 196002 - DNA, 22 bp, Artificial Sequence
  Synthetic oligonucleotide; CTT chr2 60466191 60466212 60466208 60466213 +
tcctaccagtcaaatcaaactc

SEQ ID NO: 196003 - DNA, 22 bp, Artificial Sequence
  Synthetic oligonucleotide; TTT chr2 60466192 60466213 60466209 60466214 +
cctaccagtcaaatcaaactcc

SEQ ID NO: 196004 - DNA, 22 bp, Artificial Sequence
  Synthetic oligonucleotide; TTC chr2 60466193 60466214 60466210 60466215 +
ctaccagtcaaatcaaactccc

SEQ ID NO: 196005 - DNA, 22 bp, Artificial Sequence
  Synthetic oligonucleotide; CTA chr2 60466196 60466217 60466213 60466218 +
ccagtcaaatcaaactcccagc

SEQ ID NO: 196006 - DNA, 22 bp, Artificial Sequence
  Synthetic oligonucleotide; CTC chr2 60466213 60466234 60466230 60466235 +
ccagccctcaggaagaccaggc

SEQ ID NO: 196007 - DNA, 22 bp, Artificial Sequence
  Synthetic oligonucleotide; CTC chr2 60466222 60466243 60466239 60466244 +
aggaagaccaggctgaagaccg

SEQ ID NO: 196008 - DNA, 22 bp, Artificial Sequence
  Synthetic oligonucleotide; CTG chr2 60466237 60466258 60466254 60466259 +
aagaccgagaactatgtttccc

SEQ ID NO: 196009 - DNA, 22 bp, Artificial Sequence
  Synthetic oligonucleotide; CTA chr2 60466251 60466272 60466268 60466273 +
tgtttccctggcaacagccctt

SEQ ID NO: 196010 - DNA, 22 bp, Artificial Sequence
  Synthetic oligonucleotide; TTT chr2 60466256 60466277 60466273 60466278 +
ccctggcaacagcccttggcct

SEQ ID NO: 196011 - DNA, 22 bp, Artificial Sequence
  Synthetic oligonucleotide; TTC chr2 60466257 60466278 60466274 60466279 +
cctggcaacagcccttggcctc

SEQ ID NO: 196012 - DNA, 22 bp, Artificial Sequence
  Synthetic oligonucleotide; CTG chr2 60466261 60466282 60466278 60466283 +
gcaacagcccttggcctctcaa

SEQ ID NO: 196013 - DNA, 22 bp, Artificial Sequence
  Synthetic oligonucleotide; CTT chr2 60466273 60466294 60466290 60466295 +
ggcctctcaactccaccctcct

SEQ ID NO: 196014 - DNA, 22 bp, Artificial Sequence
  Synthetic oligonucleotide; TTG chr2 60466274 60466295 60466291 60466296 +
gcctctcaactccaccctcctc

SEQ ID NO: 196015 - DNA, 22 bp, Artificial Sequence
  Synthetic oligonucleotide; CTC chr2 60466279 60466300 60466296 60466301 +
tcaactccaccctcctctgaac

SEQ ID NO: 196016 - DNA, 22 bp, Artificial Sequence
  Synthetic oligonucleotide; CTC chr2 60466281 60466302 60466298 60466303 +
aactccaccctcctctgaactg

SEQ ID NO: 196017 - DNA, 22 bp, Artificial Sequence
  Synthetic oligonucleotide; CTC chr2 60466286 60466307 60466303 60466308 +
caccctcctctgaactgctcaa

SEQ ID NO: 196018 - DNA, 22 bp, Artificial Sequence
  Synthetic oligonucleotide; CTC chr2 60466293 60466314 60466310 60466315 +
ctctgaactgctcaactccctt

SEQ ID NO: 196019 - DNA, 22 bp, Artificial Sequence
  Synthetic oligonucleotide; CTC chr2 60466296 60466317 60466313 60466318 +
tgaactgctcaactcccttcta

SEQ ID NO: 196020 - DNA, 22 bp, Artificial Sequence
  Synthetic oligonucleotide; CTG chr2 60466298 60466319 60466315 60466320 +
aactgctcaactcccttctatc

SEQ ID NO: 196021 - DNA, 22 bp, Artificial Sequence
  Synthetic oligonucleotide; CTG chr2 60466303 60466324 60466320 60466325 +
ctcaactcccttctatcccttc

SEQ ID NO: 196022 - DNA, 22 bp, Artificial Sequence
  Synthetic oligonucleotide; CTC chr2 60466306 60466327 60466323 60466328 +
aactcccttctatcccttccct

SEQ ID NO: 196023 - DNA, 22 bp, Artificial Sequence
  Synthetic oligonucleotide; CTC chr2 60466311 60466332 60466328 60466333 +
ccttctatcccttccctccaaa

SEQ ID NO: 196024 - DNA, 22 bp, Artificial Sequence
  Synthetic oligonucleotide; CTT chr2 60466315 60466336 60466332 60466337 +
ctatcccttccctccaaaagtg

SEQ ID NO: 196025 - DNA, 22 bp, Artificial Sequence
  Synthetic oligonucleotide; TTC chr2 60466316 60466337 60466333 60466338 +
tatcccttccctccaaaagtgg

SEQ ID NO: 196026 - DNA, 22 bp, Artificial Sequence
  Synthetic oligonucleotide; CTA chr2 60466318 60466339 60466335 60466340 +
tcccttccctccaaaagtggct

SEQ ID NO: 196027 - DNA, 22 bp, Artificial Sequence
  Synthetic oligonucleotide; CTT chr2 60466324 60466345 60466341 60466346 +
ccctccaaaagtggctccgttt

SEQ ID NO: 196028 - DNA, 22 bp, Artificial Sequence
  Synthetic oligonucleotide; TTC chr2 60466325 60466346 60466342 60466347 +
cctccaaaagtggctccgtttc

SEQ ID NO: 196029 - DNA, 22 bp, Artificial Sequence
  Synthetic oligonucleotide; CTC chr2 60466329 60466350 60466346 60466351 +
caaaagtggctccgtttccaca

SEQ ID NO: 196030 - DNA, 22 bp, Artificial Sequence
  Synthetic oligonucleotide; CTC chr2 60466341 60466362 60466358 60466363 +
cgtttccacagccccatgcagg

SEQ ID NO: 196031 - DNA, 22 bp, Artificial Sequence
  Synthetic oligonucleotide; TTT chr2 60466346 60466367 60466363 60466368 +
ccacagccccatgcaggcccca

SEQ ID NO: 196032 - DNA, 22 bp, Artificial Sequence
  Synthetic oligonucleotide; TTC chr2 60466347 60466368 60466364 60466369 +
cacagccccatgcaggccccag

SEQ ID NO: 196033 - DNA, 22 bp, Artificial Sequence
  Synthetic oligonucleotide; CTC chr2 60466393 60466414 60466410 60466415 +
tccccacccagccagcatgcag

SEQ ID NO: 196034 - DNA, 22 bp, Artificial Sequence
  Synthetic oligonucleotide; CTC chr2 60466395 60466416 60466412 60466417 +
cccacccagccagcatgcaggg

SEQ ID NO: 196035 - DNA, 22 bp, Artificial Sequence
  Synthetic oligonucleotide; CTA chr2 60466421 60466442 60466438 60466443 +
gaaaccgtgagcccaacctcct

SEQ ID NO: 196036 - DNA, 22 bp, Artificial Sequence
  Synthetic oligonucleotide; CTC chr2 60466441 60466462 60466458 60466463 +
ctaaaccttctgcaatctgtga

SEQ ID NO: 196037 - DNA, 22 bp, Artificial Sequence
  Synthetic oligonucleotide; CTA chr2 60466444 60466465 60466461 60466466 +
aaccttctgcaatctgtgacct

SEQ ID NO: 196038 - DNA, 22 bp, Artificial Sequence
  Synthetic oligonucleotide; CTT chr2 60466450 60466471 60466467 60466472 +
ctgcaatctgtgacctaaccca

SEQ ID NO: 196039 - DNA, 22 bp, Artificial Sequence
  Synthetic oligonucleotide; TTC chr2 60466451 60466472 60466468 60466473 +
tgcaatctgtgacctaacccag

SEQ ID NO: 196040 - DNA, 22 bp, Artificial Sequence
  Synthetic oligonucleotide; CTG chr2 60466453 60466474 60466470 60466475 +
caatctgtgacctaacccaggc

SEQ ID NO: 196041 - DNA, 22 bp, Artificial Sequence
  Synthetic oligonucleotide; CTG chr2 60466460 60466481 60466477 60466482 +
tgacctaacccaggcttaggcc

SEQ ID NO: 196042 - DNA, 22 bp, Artificial Sequence
  Synthetic oligonucleotide; CTA chr2 60466467 60466488 60466484 60466489 +
acccaggcttaggcccagcttg

SEQ ID NO: 196043 - DNA, 22 bp, Artificial Sequence
  Synthetic oligonucleotide; CTT chr2 60466477 60466498 60466494 60466499 +
aggcccagcttgggggaaggga

SEQ ID NO: 196044 - DNA, 22 bp, Artificial Sequence
  Synthetic oligonucleotide; TTA chr2 60466478 60466499 60466495 60466500 +
ggcccagcttgggggaagggag

SEQ ID NO: 196045 - DNA, 22 bp, Artificial Sequence
  Synthetic oligonucleotide; CTT chr2 60466488 60466509 60466505 60466510 +
gggggaagggagcagatgaggt

SEQ ID NO: 196046 - DNA, 22 bp, Artificial Sequence
  Synthetic oligonucleotide; TTG chr2 60466489 60466510 60466506 60466511 +
ggggaagggagcagatgaggtg

SEQ ID NO: 196047 - DNA, 22 bp, Artificial Sequence
  Synthetic oligonucleotide; CTT chr2 60466514 60466535 60466531 60466536 +
ttaacccctgaaccacccagcc

SEQ ID NO: 196048 - DNA, 22 bp, Artificial Sequence
  Synthetic oligonucleotide; TTT chr2 60466515 60466536 60466532 60466537 +
taacccctgaaccacccagccc

SEQ ID NO: 196049 - DNA, 22 bp, Artificial Sequence
  Synthetic oligonucleotide; TTT chr2 60466516 60466537 60466533 60466538 +
aacccctgaaccacccagccct

SEQ ID NO: 196050 - DNA, 22 bp, Artificial Sequence
  Synthetic oligonucleotide; TTA chr2 60466517 60466538 60466534 60466539 +
acccctgaaccacccagccctc

SEQ ID NO: 196051 - DNA, 22 bp, Artificial Sequence
  Synthetic oligonucleotide; CTG chr2 60466524 60466545 60466541 60466546 +
aaccacccagccctcaggacct

SEQ ID NO: 196052 - DNA, 22 bp, Artificial Sequence
  Synthetic oligonucleotide; CTC chr2 60466539 60466560 60466556 60466561 +
aggacctgagggcttatgaaat

SEQ ID NO: 196053 - DNA, 22 bp, Artificial Sequence
  Synthetic oligonucleotide; CTG chr2 60466547 60466568 60466564 60466569 +
agggcttatgaaattcacacaa

SEQ ID NO: 196054 - DNA, 22 bp, Artificial Sequence
  Synthetic oligonucleotide; CTT chr2 60466554 60466575 60466571 60466576 +
atgaaattcacacaataactct

SEQ ID NO: 196055 - DNA, 22 bp, Artificial Sequence
  Synthetic oligonucleotide; TTA chr2 60466555 60466576 60466572 60466577 +
tgaaattcacacaataactctt

SEQ ID NO: 196056 - DNA, 22 bp, Artificial Sequence
  Synthetic oligonucleotide; TTC chr2 60466563 60466584 60466580 60466585 +
acacaataactctttgttacct

SEQ ID NO: 196057 - DNA, 22 bp, Artificial Sequence
  Synthetic oligonucleotide; CTC chr2 60466575 60466596 60466592 60466597 +
tttgttacctaggattacctag

SEQ ID NO: 196058 - DNA, 22 bp, Artificial Sequence
  Synthetic oligonucleotide; CTT chr2 60466577 60466598 60466594 60466599 +
tgttacctaggattacctagga

SEQ ID NO: 196059 - DNA, 22 bp, Artificial Sequence
  Synthetic oligonucleotide; TTT chr2 60466578 60466599 60466595 60466600 +
gttacctaggattacctaggag

SEQ ID NO: 196060 - DNA, 22 bp, Artificial Sequence
  Synthetic oligonucleotide; TTG chr2 60466579 60466600 60466596 60466601 +
ttacctaggattacctaggagt

SEQ ID NO: 196061 - DNA, 22 bp, Artificial Sequence
  Synthetic oligonucleotide; TTA chr2 60466582 60466603 60466599 60466604 +
cctaggattacctaggagttaa

SEQ ID NO: 196062 - DNA, 22 bp, Artificial Sequence
  Synthetic oligonucleotide; CTA chr2 60466586 60466607 60466603 60466608 +
ggattacctaggagttaacaaa

SEQ ID NO: 196063 - DNA, 22 bp, Artificial Sequence
  Synthetic oligonucleotide; TTA chr2 60466592 60466613 60466609 60466614 +
cctaggagttaacaaaaataaa

SEQ ID NO: 196064 - DNA, 22 bp, Artificial Sequence
  Synthetic oligonucleotide; CTA chr2 60466596 60466617 60466613 60466618 +
ggagttaacaaaaataaacaac

SEQ ID NO: 196065 - DNA, 22 bp, Artificial Sequence
  Synthetic oligonucleotide; TTA chr2 60466603 60466624 60466620 60466625 +
acaaaaataaacaactggcttt

SEQ ID NO: 196066 - DNA, 22 bp, Artificial Sequence
  Synthetic oligonucleotide; CTG chr2 60466620 60466641 60466637 60466642 +
gctttgaatctggtctcagggt

SEQ ID NO: 196067 - DNA, 22 bp, Artificial Sequence
  Synthetic oligonucleotide; CTT chr2 60466624 60466645 60466641 60466646 +
tgaatctggtctcagggtgcat

SEQ ID NO: 196068 - DNA, 22 bp, Artificial Sequence
  Synthetic oligonucleotide; TTT chr2 60466625 60466646 60466642 60466647 +
gaatctggtctcagggtgcatg

SEQ ID NO: 196069 - DNA, 22 bp, Artificial Sequence
  Synthetic oligonucleotide; TTG chr2 60466626 60466647 60466643 60466648 +
aatctggtctcagggtgcatgc

SEQ ID NO: 196070 - DNA, 22 bp, Artificial Sequence
  Synthetic oligonucleotide; CTG chr2 60466632 60466653 60466649 60466654 +
gtctcagggtgcatgccctgct

SEQ ID NO: 196071 - DNA, 22 bp, Artificial Sequence
  Synthetic oligonucleotide; CTC chr2 60466637 60466658 60466654 60466659 +
agggtgcatgccctgctcttca

SEQ ID NO: 196072 - DNA, 22 bp, Artificial Sequence
  Synthetic oligonucleotide; CTG chr2 60466652 60466673 60466669 60466674 +
ctcttcagataccatttacaag

SEQ ID NO: 196073 - DNA, 22 bp, Artificial Sequence
  Synthetic oligonucleotide; CTC chr2 60466655 60466676 60466672 60466677 +
ttcagataccatttacaagatg

SEQ ID NO: 196074 - DNA, 22 bp, Artificial Sequence
  Synthetic oligonucleotide; CTT chr2 60466657 60466678 60466674 60466679 +
cagataccatttacaagatggg

SEQ ID NO: 196075 - DNA, 22 bp, Artificial Sequence
  Synthetic oligonucleotide; TTC chr2 60466658 60466679 60466675 60466680 +
agataccatttacaagatgggt

SEQ ID NO: 196076 - DNA, 22 bp, Artificial Sequence
  Synthetic oligonucleotide; TTT chr2 60466669 60466690 60466686 60466691 +
acaagatgggtaagtgtcatct

SEQ ID NO: 196077 - DNA, 22 bp, Artificial Sequence
  Synthetic oligonucleotide; TTA chr2 60466670 60466691 60466687 60466692 +
caagatgggtaagtgtcatctc

SEQ ID NO: 196078 - DNA, 22 bp, Artificial Sequence
  Synthetic oligonucleotide; CTC chr2 60466692 60466713 60466709 60466714 +
cctcccatctaaaaacagtccc

SEQ ID NO: 196079 - DNA, 22 bp, Artificial Sequence
  Synthetic oligonucleotide; CTC chr2 60466696 60466717 60466713 60466718 +
ccatctaaaaacagtccccctt

SEQ ID NO: 196080 - DNA, 22 bp, Artificial Sequence
  Synthetic oligonucleotide; CTA chr2 60466703 60466724 60466720 60466725 +
aaaacagtcccccttagagcct

SEQ ID NO: 196081 - DNA, 22 bp, Artificial Sequence
  Synthetic oligonucleotide; CTT chr2 60466718 60466739 60466735 60466740 +
agagccttaactctggcatctt

SEQ ID NO: 196082 - DNA, 22 bp, Artificial Sequence
  Synthetic oligonucleotide; TTA chr2 60466719 60466740 60466736 60466741 +
gagccttaactctggcatcttg

SEQ ID NO: 196083 - DNA, 22 bp, Artificial Sequence
  Synthetic oligonucleotide; CTT chr2 60466726 60466747 60466743 60466748 +
aactctggcatcttgctctttg

SEQ ID NO: 196084 - DNA, 22 bp, Artificial Sequence
  Synthetic oligonucleotide; TTA chr2 60466727 60466748 60466744 60466749 +
actctggcatcttgctctttgt

SEQ ID NO: 196085 - DNA, 22 bp, Artificial Sequence
  Synthetic oligonucleotide; CTC chr2 60466731 60466752 60466748 60466753 +
tggcatcttgctctttgttatt

SEQ ID NO: 196086 - DNA, 22 bp, Artificial Sequence
  Synthetic oligonucleotide; CTG chr2 60466733 60466754 60466750 60466755 +
gcatcttgctctttgttattct

SEQ ID NO: 196087 - DNA, 22 bp, Artificial Sequence
  Synthetic oligonucleotide; CTT chr2 60466740 60466761 60466757 60466762 +
gctctttgttattctctctcca

SEQ ID NO: 196088 - DNA, 22 bp, Artificial Sequence
  Synthetic oligonucleotide; TTG chr2 60466741 60466762 60466758 60466763 +
ctctttgttattctctctccat

SEQ ID NO: 196089 - DNA, 22 bp, Artificial Sequence
  Synthetic oligonucleotide; CTC chr2 60466744 60466765 60466761 60466766 +
tttgttattctctctccatgac

SEQ ID NO: 196090 - DNA, 22 bp, Artificial Sequence
  Synthetic oligonucleotide; CTT chr2 60466746 60466767 60466763 60466768 +
tgttattctctctccatgacct

SEQ ID NO: 196091 - DNA, 22 bp, Artificial Sequence
  Synthetic oligonucleotide; TTT chr2 60466747 60466768 60466764 60466769 +
gttattctctctccatgacctt

SEQ ID NO: 196092 - DNA, 22 bp, Artificial Sequence
  Synthetic oligonucleotide; TTG chr2 60466748 60466769 60466765 60466770 +
ttattctctctccatgaccttt

SEQ ID NO: 196093 - DNA, 22 bp, Artificial Sequence
  Synthetic oligonucleotide; TTA chr2 60466751 60466772 60466768 60466773 +
ttctctctccatgacctttttc

SEQ ID NO: 196094 - DNA, 22 bp, Artificial Sequence
  Synthetic oligonucleotide; TTC chr2 60466754 60466775 60466771 60466776 +
tctctccatgacctttttcctt

SEQ ID NO: 196095 - DNA, 22 bp, Artificial Sequence
  Synthetic oligonucleotide; CTC chr2 60466756 60466777 60466773 60466778 +
tctccatgacctttttcctttt

SEQ ID NO: 196096 - DNA, 22 bp, Artificial Sequence
  Synthetic oligonucleotide; CTC chr2 60466758 60466779 60466775 60466780 +
tccatgacctttttccttttct

SEQ ID NO: 196097 - DNA, 22 bp, Artificial Sequence
  Synthetic oligonucleotide; CTC chr2 60466760 60466781 60466777 60466782 +
catgacctttttccttttcttt

SEQ ID NO: 196098 - DNA, 22 bp, Artificial Sequence
  Synthetic oligonucleotide; CTT chr2 60466769 60466790 60466786 60466791 +
tttccttttctttttttttctt

SEQ ID NO: 196099 - DNA, 22 bp, Artificial Sequence
  Synthetic oligonucleotide; TTT chr2 60466770 60466791 60466787 60466792 +
ttccttttctttttttttcttt

SEQ ID NO: 196100 - DNA, 22 bp, Artificial Sequence
  Synthetic oligonucleotide; TTT chr2 60466771 60466792 60466788 60466793 +
tccttttctttttttttctttc

SEQ ID NO: 196101 - DNA, 22 bp, Artificial Sequence
  Synthetic oligonucleotide; TTT chr2 60466772 60466793 60466789 60466794 +
ccttttctttttttttctttcc

SEQ ID NO: 196102 - DNA, 22 bp, Artificial Sequence
  Synthetic oligonucleotide; TTC chr2 60466773 60466794 60466790 60466795 +
cttttctttttttttctttcca

SEQ ID NO: 196103 - DNA, 22 bp, Artificial Sequence
  Synthetic oligonucleotide; CTT chr2 60466776 60466797 60466793 60466798 +
ttctttttttttctttccacag

SEQ ID NO: 196104 - DNA, 22 bp, Artificial Sequence
  Synthetic oligonucleotide; TTT chr2 60466777 60466798 60466794 60466799 +
tctttttttttctttccacagc

SEQ ID NO: 196105 - DNA, 22 bp, Artificial Sequence
  Synthetic oligonucleotide; TTT chr2 60466778 60466799 60466795 60466800 +
ctttttttttctttccacagca

SEQ ID NO: 196106 - DNA, 22 bp, Artificial Sequence
  Synthetic oligonucleotide; TTC chr2 60466779 60466800 60466796 60466801 +
tttttttttctttccacagcag

SEQ ID NO: 196107 - DNA, 22 bp, Artificial Sequence
  Synthetic oligonucleotide; CTT chr2 60466781 60466802 60466798 60466803 +
tttttttctttccacagcaggt

SEQ ID NO: 196108 - DNA, 22 bp, Artificial Sequence
  Synthetic oligonucleotide; TTT chr2 60466782 60466803 60466799 60466804 +
ttttttctttccacagcaggtt

SEQ ID NO: 196109 - DNA, 22 bp, Artificial Sequence
  Synthetic oligonucleotide; TTT chr2 60466783 60466804 60466800 60466805 +
tttttctttccacagcaggtta

SEQ ID NO: 196110 - DNA, 22 bp, Artificial Sequence
  Synthetic oligonucleotide; TTT chr2 60466784 60466805 60466801 60466806 +
ttttctttccacagcaggttat

SEQ ID NO: 196111 - DNA, 22 bp, Artificial Sequence
  Synthetic oligonucleotide; TTT chr2 60466785 60466806 60466802 60466807 +
tttctttccacagcaggttatt

SEQ ID NO: 196112 - DNA, 22 bp, Artificial Sequence
  Synthetic oligonucleotide; TTT chr2 60466786 60466807 60466803 60466808 +
ttctttccacagcaggttattt

SEQ ID NO: 196113 - DNA, 22 bp, Artificial Sequence
  Synthetic oligonucleotide; TTT chr2 60466787 60466808 60466804 60466809 +
tctttccacagcaggttatttt

SEQ ID NO: 196114 - DNA, 22 bp, Artificial Sequence
  Synthetic oligonucleotide; TTT chr2 60466788 60466809 60466805 60466810 +
ctttccacagcaggttattttt

SEQ ID NO: 196115 - DNA, 22 bp, Artificial Sequence
  Synthetic oligonucleotide; TTC chr2 60466789 60466810 60466806 60466811 +
tttccacagcaggttatttttc

SEQ ID NO: 196116 - DNA, 22 bp, Artificial Sequence
  Synthetic oligonucleotide; CTT chr2 60466791 60466812 60466808 60466813 +
tccacagcaggttatttttcat

SEQ ID NO: 196117 - DNA, 22 bp, Artificial Sequence
  Synthetic oligonucleotide; TTT chr2 60466792 60466813 60466809 60466814 +
ccacagcaggttatttttcatt

SEQ ID NO: 196118 - DNA, 22 bp, Artificial Sequence
  Synthetic oligonucleotide; TTC chr2 60466793 60466814 60466810 60466815 +
cacagcaggttatttttcattt

SEQ ID NO: 196119 - DNA, 22 bp, Artificial Sequence
  Synthetic oligonucleotide; TTA chr2 60466805 60466826 60466822 60466827 +
tttttcatttactttcaaataa

SEQ ID NO: 196120 - DNA, 22 bp, Artificial Sequence
  Synthetic oligonucleotide; TTT chr2 60466808 60466829 60466825 60466830 +
ttcatttactttcaaataaaaa

SEQ ID NO: 196121 - DNA, 22 bp, Artificial Sequence
  Synthetic oligonucleotide; TTT chr2 60466809 60466830 60466826 60466831 +
tcatttactttcaaataaaaat

SEQ ID NO: 196122 - DNA, 22 bp, Artificial Sequence
  Synthetic oligonucleotide; TTT chr2 60466810 60466831 60466827 60466832 +
catttactttcaaataaaaatt

SEQ ID NO: 196123 - DNA, 22 bp, Artificial Sequence
  Synthetic oligonucleotide; TTC chr2 60466811 60466832 60466828 60466833 +
atttactttcaaataaaaatta

SEQ ID NO: 196124 - DNA, 22 bp, Artificial Sequence
  Synthetic oligonucleotide; TTT chr2 60466815 60466836 60466832 60466837 +
actttcaaataaaaattagatg

SEQ ID NO: 196125 - DNA, 22 bp, Artificial Sequence
  Synthetic oligonucleotide; TTA chr2 60466816 60466837 60466833 60466838 +
ctttcaaataaaaattagatgt

SEQ ID NO: 196126 - DNA, 22 bp, Artificial Sequence
  Synthetic oligonucleotide; CTT chr2 60466819 60466840 60466836 60466841 +
tcaaataaaaattagatgtcac

SEQ ID NO: 196127 - DNA, 22 bp, Artificial Sequence
  Synthetic oligonucleotide; TTT chr2 60466820 60466841 60466837 60466842 +
caaataaaaattagatgtcaca

SEQ ID NO: 196128 - DNA, 22 bp, Artificial Sequence
  Synthetic oligonucleotide; TTC chr2 60466821 60466842 60466838 60466843 +
aaataaaaattagatgtcacac

SEQ ID NO: 196129 - DNA, 22 bp, Artificial Sequence
  Synthetic oligonucleotide; TTA chr2 60466833 60466854 60466850 60466855 +
gatgtcacacttcttttcttct

SEQ ID NO: 196130 - DNA, 22 bp, Artificial Sequence
  Synthetic oligonucleotide; CTT chr2 60466845 60466866 60466862 60466867 +
cttttcttcttgaacctgcttt

SEQ ID NO: 196131 - DNA, 22 bp, Artificial Sequence
  Synthetic oligonucleotide; TTC chr2 60466846 60466867 60466863 60466868 +
ttttcttcttgaacctgctttt

SEQ ID NO: 196132 - DNA, 22 bp, Artificial Sequence
  Synthetic oligonucleotide; CTT chr2 60466848 60466869 60466865 60466870 +
ttcttcttgaacctgctttttt

SEQ ID NO: 196133 - DNA, 22 bp, Artificial Sequence
  Synthetic oligonucleotide; TTT chr2 60466849 60466870 60466866 60466871 +
tcttcttgaacctgcttttttg

SEQ ID NO: 196134 - DNA, 22 bp, Artificial Sequence
  Synthetic oligonucleotide; TTT chr2 60466850 60466871 60466867 60466872 +
cttcttgaacctgcttttttgt

SEQ ID NO: 196135 - DNA, 22 bp, Artificial Sequence
  Synthetic oligonucleotide; TTC chr2 60466851 60466872 60466868 60466873 +
ttcttgaacctgcttttttgtg

SEQ ID NO: 196136 - DNA, 22 bp, Artificial Sequence
  Synthetic oligonucleotide; CTT chr2 60466853 60466874 60466870 60466875 +
cttgaacctgcttttttgtgtt

SEQ ID NO: 196137 - DNA, 22 bp, Artificial Sequence
  Synthetic oligonucleotide; TTC chr2 60466854 60466875 60466871 60466876 +
ttgaacctgcttttttgtgttt

SEQ ID NO: 196138 - DNA, 22 bp, Artificial Sequence
  Synthetic oligonucleotide; CTT chr2 60466856 60466877 60466873 60466878 +
gaacctgcttttttgtgtttag

SEQ ID NO: 196139 - DNA, 22 bp, Artificial Sequence
  Synthetic oligonucleotide; TTG chr2 60466857 60466878 60466874 60466879 +
aacctgcttttttgtgtttagg

SEQ ID NO: 196140 - DNA, 22 bp, Artificial Sequence
  Synthetic oligonucleotide; CTG chr2 60466863 60466884 60466880 60466885 +
cttttttgtgtttagggtggaa

SEQ ID NO: 196141 - DNA, 22 bp, Artificial Sequence
  Synthetic oligonucleotide; CTT chr2 60466866 60466887 60466883 60466888 +
ttttgtgtttagggtggaatca

SEQ ID NO: 196142 - DNA, 22 bp, Artificial Sequence
  Synthetic oligonucleotide; TTT chr2 60466867 60466888 60466884 60466889 +
tttgtgtttagggtggaatcac

SEQ ID NO: 196143 - DNA, 22 bp, Artificial Sequence
  Synthetic oligonucleotide; TTT chr2 60466868 60466889 60466885 60466890 +
ttgtgtttagggtggaatcact

SEQ ID NO: 196144 - DNA, 22 bp, Artificial Sequence
  Synthetic oligonucleotide; TTT chr2 60466869 60466890 60466886 60466891 +
tgtgtttagggtggaatcactg

SEQ ID NO: 196145 - DNA, 22 bp, Artificial Sequence
  Synthetic oligonucleotide; TTT chr2 60466870 60466891 60466887 60466892 +
gtgtttagggtggaatcactgc

SEQ ID NO: 196146 - DNA, 22 bp, Artificial Sequence
  Synthetic oligonucleotide; TTG chr2 60466871 60466892 60466888 60466893 +
tgtttagggtggaatcactgcc

SEQ ID NO: 196147 - DNA, 22 bp, Artificial Sequence
  Synthetic oligonucleotide; TTT chr2 60466876 60466897 60466893 60466898 +
agggtggaatcactgcccaccc

SEQ ID NO: 196148 - DNA, 22 bp, Artificial Sequence
  Synthetic oligonucleotide; TTA chr2 60466877 60466898 60466894 60466899 +
gggtggaatcactgcccacccc

SEQ ID NO: 196149 - DNA, 22 bp, Artificial Sequence
  Synthetic oligonucleotide; CTG chr2 60466891 60466912 60466908 60466913 +
cccaccccctaaccttttagcc

SEQ ID NO: 196150 - DNA, 22 bp, Artificial Sequence
  Synthetic oligonucleotide; CTA chr2 60466902 60466923 60466919 60466924 +
accttttagccatgcatgattc

SEQ ID NO: 196151 - DNA, 22 bp, Artificial Sequence
  Synthetic oligonucleotide; CTT chr2 60466907 60466928 60466924 60466929 +
ttagccatgcatgattcatacc

SEQ ID NO: 196152 - DNA, 22 bp, Artificial Sequence
  Synthetic oligonucleotide; TTT chr2 60466908 60466929 60466925 60466930 +
tagccatgcatgattcatacca

SEQ ID NO: 196153 - DNA, 22 bp, Artificial Sequence
  Synthetic oligonucleotide; TTT chr2 60466909 60466930 60466926 60466931 +
agccatgcatgattcataccat

SEQ ID NO: 196154 - DNA, 22 bp, Artificial Sequence
  Synthetic oligonucleotide; TTA chr2 60466910 60466931 60466927 60466932 +
gccatgcatgattcataccatg

SEQ ID NO: 196155 - DNA, 22 bp, Artificial Sequence
  Synthetic oligonucleotide; TTC chr2 60466924 60466945 60466941 60466946 +
ataccatgtgttcctacacaga

SEQ ID NO: 196156 - DNA, 22 bp, Artificial Sequence
  Synthetic oligonucleotide; TTC chr2 60466937 60466958 60466954 60466959 +
ctacacagagaagcaaactgta

SEQ ID NO: 196157 - DNA, 22 bp, Artificial Sequence
  Synthetic oligonucleotide; CTA chr2 60466940 60466961 60466957 60466962 +
cacagagaagcaaactgtatta

SEQ ID NO: 196158 - DNA, 22 bp, Artificial Sequence
  Synthetic oligonucleotide; CTG chr2 60466957 60466978 60466974 60466979 +
tattattttctaaaacagtatc

SEQ ID NO: 196159 - DNA, 22 bp, Artificial Sequence
  Synthetic oligonucleotide; TTA chr2 60466962 60466983 60466979 60466984 +
ttttctaaaacagtatctttca

SEQ ID NO: 196160 - DNA, 22 bp, Artificial Sequence
  Synthetic oligonucleotide; TTT chr2 60466965 60466986 60466982 60466987 +
tctaaaacagtatctttcagaa

SEQ ID NO: 196161 - DNA, 22 bp, Artificial Sequence
  Synthetic oligonucleotide; TTT chr2 60466966 60466987 60466983 60466988 +
ctaaaacagtatctttcagaaa

SEQ ID NO: 196162 - DNA, 22 bp, Artificial Sequence
  Synthetic oligonucleotide; TTC chr2 60466967 60466988 60466984 60466989 +
taaaacagtatctttcagaaaa

SEQ ID NO: 196163 - DNA, 22 bp, Artificial Sequence
  Synthetic oligonucleotide; CTA chr2 60466969 60466990 60466986 60466991 +
aaacagtatctttcagaaaaca

SEQ ID NO: 196164 - DNA, 22 bp, Artificial Sequence
  Synthetic oligonucleotide; CTT chr2 60466981 60467002 60466998 60467003 +
tcagaaaacatttgtataaatg

SEQ ID NO: 196165 - DNA, 22 bp, Artificial Sequence
  Synthetic oligonucleotide; TTT chr2 60466982 60467003 60466999 60467004 +
cagaaaacatttgtataaatgg

SEQ ID NO: 196166 - DNA, 22 bp, Artificial Sequence
  Synthetic oligonucleotide; TTC chr2 60466983 60467004 60467000 60467005 +
agaaaacatttgtataaatgga

SEQ ID NO: 196167 - DNA, 22 bp, Artificial Sequence
  Synthetic oligonucleotide; TTT chr2 60466994 60467015 60467011 60467016 +
gtataaatggacaaatttaagt

SEQ ID NO: 196168 - DNA, 22 bp, Artificial Sequence
  Synthetic oligonucleotide; TTG chr2 60466995 60467016 60467012 60467017 +
tataaatggacaaatttaagtt

SEQ ID NO: 196169 - DNA, 22 bp, Artificial Sequence
  Synthetic oligonucleotide; TTT chr2 60467012 60467033 60467029 60467034 +
aagtttcataaaatggtcccta

SEQ ID NO: 196170 - DNA, 22 bp, Artificial Sequence
  Synthetic oligonucleotide; TTA chr2 60467013 60467034 60467030 60467035 +
agtttcataaaatggtccctac

SEQ ID NO: 196171 - DNA, 22 bp, Artificial Sequence
  Synthetic oligonucleotide; TTT chr2 60467018 60467039 60467035 60467040 +
cataaaatggtccctactataa

SEQ ID NO: 196172 - DNA, 22 bp, Artificial Sequence
  Synthetic oligonucleotide; TTC chr2 60467019 60467040 60467036 60467041 +
ataaaatggtccctactataaa

SEQ ID NO: 196173 - DNA, 22 bp, Artificial Sequence
  Synthetic oligonucleotide; CTA chr2 60467034 60467055 60467051 60467056 +
ctataaaagctcacttgaacaa

SEQ ID NO: 196174 - DNA, 22 bp, Artificial Sequence
  Synthetic oligonucleotide; CTA chr2 60467037 60467058 60467054 60467059 +
taaaagctcacttgaacaagta

SEQ ID NO: 196175 - DNA, 22 bp, Artificial Sequence
  Synthetic oligonucleotide; CTC chr2 60467046 60467067 60467063 60467068 +
acttgaacaagtaaatggtggt

SEQ ID NO: 196176 - DNA, 22 bp, Artificial Sequence
  Synthetic oligonucleotide; CTT chr2 60467050 60467071 60467067 60467072 +
gaacaagtaaatggtggtggca

SEQ ID NO: 196177 - DNA, 22 bp, Artificial Sequence
  Synthetic oligonucleotide; TTG chr2 60467051 60467072 60467068 60467073 +
aacaagtaaatggtggtggcag

SEQ ID NO: 196178 - DNA, 22 bp, Artificial Sequence
  Synthetic oligonucleotide; TTG chr2 60467141 60467162 60467158 60467163 +
gtggtgatggtggtggtggtgg

SEQ ID NO: 196179 - DNA, 22 bp, Artificial Sequence
  Synthetic oligonucleotide; CTG chr2 60467219 60467240 60467236 60467241 +
gtgatggtggtggtggtagtga

SEQ ID NO: 196180 - DNA, 22 bp, Artificial Sequence
  Synthetic oligonucleotide; CTG chr2 60467390 60467411 60467407 60467412 +
gtggtgatggtgatggtgatgg

SEQ ID NO: 196181 - DNA, 22 bp, Artificial Sequence
  Synthetic oligonucleotide; CTG chr2 60467417 60467438 60467434 60467439 +
gtgatggtggtggtggtagtga

SEQ ID NO: 196182 - DNA, 22 bp, Artificial Sequence
  Synthetic oligonucleotide; CTG chr2 60467519 60467540 60467536 60467541 +
gtggtgatggtgatggtgatgg

SEQ ID NO: 196183 - DNA, 22 bp, Artificial Sequence
  Synthetic oligonucleotide; CTG chr2 60467546 60467567 60467563 60467568 +
gtgatggtggtggtggtagtga

SEQ ID NO: 196184 - DNA, 22 bp, Artificial Sequence
  Synthetic oligonucleotide; CTG chr2 60467669 60467690 60467686 60467691 +
gtggtgatggtgatggtggtgg

SEQ ID NO: 196185 - DNA, 22 bp, Artificial Sequence
  Synthetic oligonucleotide; CTG chr2 60467708 60467729 60467725 60467730 +
gtggtgatggtactggtggtga

SEQ ID NO: 196186 - DNA, 22 bp, Artificial Sequence
  Synthetic oligonucleotide; CTG chr2 60467723 60467744 60467740 60467745 +
gtggtgatggtggtggtggtag

SEQ ID NO: 196187 - DNA, 22 bp, Artificial Sequence
  Synthetic oligonucleotide; TTG chr2 60467786 60467807 60467803 60467808 +
atggtgatggtactggtggtga

SEQ ID NO: 196188 - DNA, 22 bp, Artificial Sequence
  Synthetic oligonucleotide; CTG chr2 60467801 60467822 60467818 60467823 +
gtggtgatggtactggtggtga

SEQ ID NO: 196189 - DNA, 22 bp, Artificial Sequence
  Synthetic oligonucleotide; CTG chr2 60467816 60467837 60467833 60467838 +
gtggtgatggtgatggtggtgg

SEQ ID NO: 196190 - DNA, 22 bp, Artificial Sequence
  Synthetic oligonucleotide; CTA chr2 60467852 60467873 60467869 60467874 +
ctggtggtgatggtactggtgg

SEQ ID NO: 196191 - DNA, 22 bp, Artificial Sequence
  Synthetic oligonucleotide; CTG chr2 60467855 60467876 60467872 60467877 +
gtggtgatggtactggtggtga

SEQ ID NO: 196192 - DNA, 22 bp, Artificial Sequence
  Synthetic oligonucleotide; CTG chr2 60467870 60467891 60467887 60467892 +
gtggtgatggtggtggtggtag

SEQ ID NO: 196193 - DNA, 22 bp, Artificial Sequence
  Synthetic oligonucleotide; CTG chr2 60467957 60467978 60467974 60467979 +
gtggtgatggtggtggtggtag

SEQ ID NO: 196194 - DNA, 22 bp, Artificial Sequence
  Synthetic oligonucleotide; CTG chr2 60468053 60468074 60468070 60468075 +
gtggtgatggtggtggtggtag

SEQ ID NO: 196195 - DNA, 22 bp, Artificial Sequence
  Synthetic oligonucleotide; TTG chr2 60468090 60468111 60468107 60468112 +
tggtggtggtggtgatggtggc

SEQ ID NO: 196196 - DNA, 22 bp, Artificial Sequence
  Synthetic oligonucleotide; TTG chr2 60468123 60468144 60468140 60468145 +
tggtggtggtggtgatggtggt

SEQ ID NO: 196197 - DNA, 22 bp, Artificial Sequence
  Synthetic oligonucleotide; CTT chr2 60468171 60468192 60468188 60468193 +
cacattttaactacaatgatgt

SEQ ID NO: 196198 - DNA, 22 bp, Artificial Sequence
  Synthetic oligonucleotide; TTC chr2 60468172 60468193 60468189 60468194 +
acattttaactacaatgatgtg

SEQ ID NO: 196199 - DNA, 22 bp, Artificial Sequence
  Synthetic oligonucleotide; TTT chr2 60468178 60468199 60468195 60468200 +
taactacaatgatgtgcatttt

SEQ ID NO: 196200 - DNA, 22 bp, Artificial Sequence
  Synthetic oligonucleotide; TTT chr2 60468179 60468200 60468196 60468201 +
aactacaatgatgtgcattttt

SEQ ID NO: 196201 - DNA, 22 bp, Artificial Sequence
  Synthetic oligonucleotide; TTA chr2 60468180 60468201 60468197 60468202 +
actacaatgatgtgcatttttc

SEQ ID NO: 196202 - DNA, 22 bp, Artificial Sequence
  Synthetic oligonucleotide; CTA chr2 60468184 60468205 60468201 60468206 +
caatgatgtgcatttttctcta

SEQ ID NO: 196203 - DNA, 22 bp, Artificial Sequence
  Synthetic oligonucleotide; TTT chr2 60468199 60468220 60468216 60468221 +
ttctctaaaaccaggagaaaaa

SEQ ID NO: 196204 - DNA, 22 bp, Artificial Sequence
  Synthetic oligonucleotide; TTT chr2 60468200 60468221 60468217 60468222 +
tctctaaaaccaggagaaaaat

SEQ ID NO: 196205 - DNA, 22 bp, Artificial Sequence
  Synthetic oligonucleotide; TTT chr2 60468201 60468222 60468218 60468223 +
ctctaaaaccaggagaaaaatt

SEQ ID NO: 196206 - DNA, 22 bp, Artificial Sequence
  Synthetic oligonucleotide; TTC chr2 60468202 60468223 60468219 60468224 +
tctaaaaccaggagaaaaatta

SEQ ID NO: 196207 - DNA, 22 bp, Artificial Sequence
  Synthetic oligonucleotide; CTC chr2 60468204 60468225 60468221 60468226 +
taaaaccaggagaaaaattagt

SEQ ID NO: 196208 - DNA, 22 bp, Artificial Sequence
  Synthetic oligonucleotide; CTA chr2 60468206 60468227 60468223 60468228 +
aaaccaggagaaaaattagtca

SEQ ID NO: 196209 - DNA, 22 bp, Artificial Sequence
  Synthetic oligonucleotide; TTA chr2 60468224 60468245 60468241 60468246 +
gtcaaaattatgtgtgggcatg

SEQ ID NO: 196210 - DNA, 22 bp, Artificial Sequence
  Synthetic oligonucleotide; TTA chr2 60468234 60468255 60468251 60468256 +
tgtgtgggcatgaatatacaac

SEQ ID NO: 196211 - DNA, 22 bp, Artificial Sequence
  Synthetic oligonucleotide; CTA chr2 60468264 60468285 60468281 60468286 +
tgttcaaatacacatgtaaata

SEQ ID NO: 196212 - DNA, 22 bp, Artificial Sequence
  Synthetic oligonucleotide; TTC chr2 60468269 60468290 60468286 60468291 +
aaatacacatgtaaatacataa

SEQ ID NO: 196213 - DNA, 22 bp, Artificial Sequence
  Synthetic oligonucleotide; TTG chr2 60468304 60468325 60468321 60468326 +
gaataactctggaataacccta

SEQ ID NO: 196214 - DNA, 22 bp, Artificial Sequence
  Synthetic oligonucleotide; CTC chr2 60468313 60468334 60468330 60468335 +
tggaataaccctaaactgactc

SEQ ID NO: 196215 - DNA, 22 bp, Artificial Sequence
  Synthetic oligonucleotide; CTG chr2 60468315 60468336 60468332 60468337 +
gaataaccctaaactgactcct

SEQ ID NO: 196216 - DNA, 22 bp, Artificial Sequence
  Synthetic oligonucleotide; CTA chr2 60468326 60468347 60468343 60468348 +
aactgactccttttgattctgg

SEQ ID NO: 196217 - DNA, 22 bp, Artificial Sequence
  Synthetic oligonucleotide; CTG chr2 60468331 60468352 60468348 60468353 +
actccttttgattctggccttg

SEQ ID NO: 196218 - DNA, 22 bp, Artificial Sequence
  Synthetic oligonucleotide; CTC chr2 60468335 60468356 60468352 60468357 +
cttttgattctggccttggcta

SEQ ID NO: 196219 - DNA, 22 bp, Artificial Sequence
  Synthetic oligonucleotide; CTT chr2 60468338 60468359 60468355 60468360 +
ttgattctggccttggctaaag

SEQ ID NO: 196220 - DNA, 22 bp, Artificial Sequence
  Synthetic oligonucleotide; TTT chr2 60468339 60468360 60468356 60468361 +
tgattctggccttggctaaaga

SEQ ID NO: 196221 - DNA, 22 bp, Artificial Sequence
  Synthetic oligonucleotide; TTT chr2 60468340 60468361 60468357 60468362 +
gattctggccttggctaaagat

SEQ ID NO: 196222 - DNA, 22 bp, Artificial Sequence
  Synthetic oligonucleotide; TTG chr2 60468341 60468362 60468358 60468363 +
attctggccttggctaaagatg

SEQ ID NO: 196223 - DNA, 22 bp, Artificial Sequence
  Synthetic oligonucleotide; TTC chr2 60468345 60468366 60468362 60468367 +
tggccttggctaaagatgtgtg

SEQ ID NO: 196224 - DNA, 22 bp, Artificial Sequence
  Synthetic oligonucleotide; CTG chr2 60468347 60468368 60468364 60468369 +
gccttggctaaagatgtgtgcc

SEQ ID NO: 196225 - DNA, 22 bp, Artificial Sequence
  Synthetic oligonucleotide; CTT chr2 60468352 60468373 60468369 60468374 +
ggctaaagatgtgtgccatgga

SEQ ID NO: 196226 - DNA, 22 bp, Artificial Sequence
  Synthetic oligonucleotide; TTG chr2 60468353 60468374 60468370 60468375 +
gctaaagatgtgtgccatggac

SEQ ID NO: 196227 - DNA, 22 bp, Artificial Sequence
  Synthetic oligonucleotide; CTA chr2 60468357 60468378 60468374 60468379 +
aagatgtgtgccatggactata

SEQ ID NO: 196228 - DNA, 22 bp, Artificial Sequence
  Synthetic oligonucleotide; CTA chr2 60468377 60468398 60468394 60468399 +
tacccaaagtcctaaatgaggc

SEQ ID NO: 196229 - DNA, 22 bp, Artificial Sequence
  Synthetic oligonucleotide; CTA chr2 60468391 60468412 60468408 60468413 +
aatgaggccacaggagtgaatg

SEQ ID NO: 196230 - DNA, 22 bp, Artificial Sequence
  Synthetic oligonucleotide; CTC chr2 60468433 60468454 60468450 60468455 +
cagaggcacaggcatcttcaat

SEQ ID NO: 196231 - DNA, 22 bp, Artificial Sequence
  Synthetic oligonucleotide; CTT chr2 60468451 60468472 60468468 60468473 +
caatcactagccacggagcaag

SEQ ID NO: 196232 - DNA, 22 bp, Artificial Sequence
  Synthetic oligonucleotide; TTC chr2 60468452 60468473 60468469 60468474 +
aatcactagccacggagcaaga

SEQ ID NO: 196233 - DNA, 22 bp, Artificial Sequence
  Synthetic oligonucleotide; CTA chr2 60468460 60468481 60468477 60468482 +
gccacggagcaagacaagaccc

SEQ ID NO: 196234 - DNA, 22 bp, Artificial Sequence
  Synthetic oligonucleotide; CTG chr2 60468484 60468505 60468501 60468506 +
gggagaagacccacagggatga

SEQ ID NO: 196235 - DNA, 22 bp, Artificial Sequence
  Synthetic oligonucleotide; CTA chr2 60468510 60468531 60468527 60468532 +
ctatcagctcccagcctccagt

SEQ ID NO: 196236 - DNA, 22 bp, Artificial Sequence
  Synthetic oligonucleotide; CTA chr2 60468513 60468534 60468530 60468535 +
tcagctcccagcctccagtgag

SEQ ID NO: 196237 - DNA, 22 bp, Artificial Sequence
  Synthetic oligonucleotide; CTC chr2 60468520 60468541 60468537 60468542 +
ccagcctccagtgaggaaagaa

SEQ ID NO: 196238 - DNA, 22 bp, Artificial Sequence
  Synthetic oligonucleotide; CTC chr2 60468528 60468549 60468545 60468550 +
cagtgaggaaagaaaaagggga

SEQ ID NO: 196239 - DNA, 22 bp, Artificial Sequence
  Synthetic oligonucleotide; CTC chr2 60468565 60468586 60468582 60468587 +
tggggctgagtggagtggggag

SEQ ID NO: 196240 - DNA, 22 bp, Artificial Sequence
  Synthetic oligonucleotide; CTG chr2 60468567 60468588 60468584 60468589 +
gggctgagtggagtggggagcg

SEQ ID NO: 196241 - DNA, 22 bp, Artificial Sequence
  Synthetic oligonucleotide; CTG chr2 60468573 60468594 60468590 60468595 +
agtggagtggggagcggctgcc

SEQ ID NO: 196242 - DNA, 22 bp, Artificial Sequence
  Synthetic oligonucleotide; CTG chr2 60468593 60468614 60468610 60468615 +
ccaagtgagtaatggaataata

SEQ ID NO: 196243 - DNA, 22 bp, Artificial Sequence
  Synthetic oligonucleotide; CTA chr2 60468629 60468650 60468646 60468651 +
ttttggaagtaactccttcagt

SEQ ID NO: 196244 - DNA, 22 bp, Artificial Sequence
  Synthetic oligonucleotide; TTT chr2 60468632 60468653 60468649 60468654 +
tggaagtaactccttcagtact

SEQ ID NO: 196245 - DNA, 22 bp, Artificial Sequence
  Synthetic oligonucleotide; TTT chr2 60468633 60468654 60468650 60468655 +
ggaagtaactccttcagtactt

SEQ ID NO: 196246 - DNA, 22 bp, Artificial Sequence
  Synthetic oligonucleotide; TTG chr2 60468634 60468655 60468651 60468656 +
gaagtaactccttcagtactta

SEQ ID NO: 196247 - DNA, 22 bp, Artificial Sequence
  Synthetic oligonucleotide; CTC chr2 60468644 60468665 60468661 60468666 +
cttcagtacttaaaaagtaagg

SEQ ID NO: 196248 - DNA, 22 bp, Artificial Sequence
  Synthetic oligonucleotide; CTT chr2 60468647 60468668 60468664 60468669 +
cagtacttaaaaagtaagggca

SEQ ID NO: 196249 - DNA, 22 bp, Artificial Sequence
  Synthetic oligonucleotide; TTC chr2 60468648 60468669 60468665 60468670 +
agtacttaaaaagtaagggcaa

SEQ ID NO: 196250 - DNA, 22 bp, Artificial Sequence
  Synthetic oligonucleotide; CTT chr2 60468655 60468676 60468672 60468677 +
aaaaagtaagggcaatttccag

SEQ ID NO: 196251 - DNA, 22 bp, Artificial Sequence
  Synthetic oligonucleotide; TTA chr2 60468656 60468677 60468673 60468678 +
aaaagtaagggcaatttccaga

SEQ ID NO: 196252 - DNA, 22 bp, Artificial Sequence
  Synthetic oligonucleotide; TTT chr2 60468673 60468694 60468690 60468695 +
ccagaaattctcatctctatac

SEQ ID NO: 196253 - DNA, 22 bp, Artificial Sequence
  Synthetic oligonucleotide; TTC chr2 60468674 60468695 60468691 60468696 +
cagaaattctcatctctataca

SEQ ID NO: 196254 - DNA, 22 bp, Artificial Sequence
  Synthetic oligonucleotide; TTC chr2 60468683 60468704 60468700 60468705 +
tcatctctatacacatggacat

SEQ ID NO: 196255 - DNA, 22 bp, Artificial Sequence
  Synthetic oligonucleotide; CTC chr2 60468685 60468706 60468702 60468707 +
atctctatacacatggacattt

SEQ ID NO: 196256 - DNA, 22 bp, Artificial Sequence
  Synthetic oligonucleotide; CTC chr2 60468690 60468711 60468707 60468712 +
tatacacatggacatttgtaga

SEQ ID NO: 196257 - DNA, 22 bp, Artificial Sequence
  Synthetic oligonucleotide; CTA chr2 60468692 60468713 60468709 60468714 +
tacacatggacatttgtagaag

SEQ ID NO: 196258 - DNA, 22 bp, Artificial Sequence
  Synthetic oligonucleotide; TTT chr2 60468707 60468728 60468724 60468729 +
gtagaagaaataaggctcaact

SEQ ID NO: 196259 - DNA, 22 bp, Artificial Sequence
  Synthetic oligonucleotide; TTG chr2 60468708 60468729 60468725 60468730 +
tagaagaaataaggctcaactt

SEQ ID NO: 196260 - DNA, 22 bp, Artificial Sequence
  Synthetic oligonucleotide; CTC chr2 60468725 60468746 60468742 60468747 +
aacttacaaataccctgcgggg

SEQ ID NO: 196261 - DNA, 22 bp, Artificial Sequence
  Synthetic oligonucleotide; CTT chr2 60468730 60468751 60468747 60468752 +
acaaataccctgcggggcatat

SEQ ID NO: 196262 - DNA, 22 bp, Artificial Sequence
  Synthetic oligonucleotide; TTA chr2 60468731 60468752 60468748 60468753 +
caaataccctgcggggcatatt

SEQ ID NO: 196263 - DNA, 22 bp, Artificial Sequence
  Synthetic oligonucleotide; CTG chr2 60468742 60468763 60468759 60468764 +
cggggcatattctgcactcatc

SEQ ID NO: 196264 - DNA, 22 bp, Artificial Sequence
  Synthetic oligonucleotide; TTC chr2 60468754 60468775 60468771 60468776 +
tgcactcatcccaggcgtgggg

SEQ ID NO: 196265 - DNA, 22 bp, Artificial Sequence
  Synthetic oligonucleotide; CTG chr2 60468756 60468777 60468773 60468778 +
cactcatcccaggcgtggggat

SEQ ID NO: 196266 - DNA, 22 bp, Artificial Sequence
  Synthetic oligonucleotide; CTC chr2 60468761 60468782 60468778 60468783 +
atcccaggcgtggggattagag

SEQ ID NO: 196267 - DNA, 22 bp, Artificial Sequence
  Synthetic oligonucleotide; TTA chr2 60468780 60468801 60468797 60468802 +
gagctccatgtgcagaacgagg

SEQ ID NO: 196268 - DNA, 22 bp, Artificial Sequence
  Synthetic oligonucleotide; CTC chr2 60468786 60468807 60468803 60468808 +
catgtgcagaacgaggggagga

SEQ ID NO: 196269 - DNA, 22 bp, Artificial Sequence
  Synthetic oligonucleotide; CTC chr2 60468818 60468839 60468835 60468840 +
cagtgcagaagtttatctgtga

SEQ ID NO: 196270 - DNA, 22 bp, Artificial Sequence
  Synthetic oligonucleotide; TTT chr2 60468832 60468853 60468849 60468854 +
atctgtgaaagaaacccaaaat

SEQ ID NO: 196271 - DNA, 22 bp, Artificial Sequence
  Synthetic oligonucleotide; TTA chr2 60468833 60468854 60468850 60468855 +
tctgtgaaagaaacccaaaatc

SEQ ID NO: 196272 - DNA, 22 bp, Artificial Sequence
  Synthetic oligonucleotide; CTG chr2 60468837 60468858 60468854 60468859 +
tgaaagaaacccaaaatcaagc

SEQ ID NO: 196273 - DNA, 22 bp, Artificial Sequence
  Synthetic oligonucleotide; CTA chr2 60468863 60468884 60468880 60468885 +
cagctacaaacaacgtgcatca

SEQ ID NO: 196274 - DNA, 22 bp, Artificial Sequence
  Synthetic oligonucleotide; CTA chr2 60468869 60468890 60468886 60468891 +
caaacaacgtgcatcataaacc

SEQ ID NO: 196275 - DNA, 22 bp, Artificial Sequence
  Synthetic oligonucleotide; TTT chr2 60468907 60468928 60468924 60468929 +
caattccattaaaatagattac

SEQ ID NO: 196276 - DNA, 22 bp, Artificial Sequence
  Synthetic oligonucleotide; TTC chr2 60468908 60468929 60468925 60468930 +
aattccattaaaatagattaca

SEQ ID NO: 196277 - DNA, 22 bp, Artificial Sequence
  Synthetic oligonucleotide; TTC chr2 60468913 60468934 60468930 60468935 +
cattaaaatagattacaacatc

SEQ ID NO: 196278 - DNA, 22 bp, Artificial Sequence
  Synthetic oligonucleotide; TTA chr2 60468918 60468939 60468935 60468940 +
aaatagattacaacatcattac

SEQ ID NO: 196279 - DNA, 22 bp, Artificial Sequence
  Synthetic oligonucleotide; TTA chr2 60468928 60468949 60468945 60468950 +
caacatcattacaacagccttg

SEQ ID NO: 196280 - DNA, 22 bp, Artificial Sequence
  Synthetic oligonucleotide; TTA chr2 60468939 60468960 60468956 60468961 +
caacagccttgcagatagttaa

SEQ ID NO: 196281 - DNA, 22 bp, Artificial Sequence
  Synthetic oligonucleotide; CTT chr2 60468949 60468970 60468966 60468971 +
gcagatagttaacaggcccaag

SEQ ID NO: 196282 - DNA, 22 bp, Artificial Sequence
  Synthetic oligonucleotide; TTG chr2 60468950 60468971 60468967 60468972 +
cagatagttaacaggcccaagg

SEQ ID NO: 196283 - DNA, 22 bp, Artificial Sequence
  Synthetic oligonucleotide; TTA chr2 60468960 60468981 60468977 60468982 +
acaggcccaaggcctgaaacaa

SEQ ID NO: 196284 - DNA, 22 bp, Artificial Sequence
  Synthetic oligonucleotide; CTG chr2 60468976 60468997 60468993 60468998 +
aaacaaaagaagagtggtgagt

SEQ ID NO: 196285 - DNA, 22 bp, Artificial Sequence
  Synthetic oligonucleotide; TTA chr2 60469000 60469021 60469017 60469022 +
tttcccagagtttctgttttgt

SEQ ID NO: 196286 - DNA, 22 bp, Artificial Sequence
  Synthetic oligonucleotide; TTT chr2 60469003 60469024 60469020 60469025 +
cccagagtttctgttttgtttt

SEQ ID NO: 196287 - DNA, 22 bp, Artificial Sequence
  Synthetic oligonucleotide; TTC chr2 60469004 60469025 60469021 60469026 +
ccagagtttctgttttgttttc

SEQ ID NO: 196288 - DNA, 22 bp, Artificial Sequence
  Synthetic oligonucleotide; TTT chr2 60469013 60469034 60469030 60469035 +
ctgttttgttttcaatttcggt

SEQ ID NO: 196289 - DNA, 22 bp, Artificial Sequence
  Synthetic oligonucleotide; TTC chr2 60469014 60469035 60469031 60469036 +
tgttttgttttcaatttcggtc

SEQ ID NO: 196290 - DNA, 22 bp, Artificial Sequence
  Synthetic oligonucleotide; CTG chr2 60469016 60469037 60469033 60469038 +
ttttgttttcaatttcggtctt

SEQ ID NO: 196291 - DNA, 22 bp, Artificial Sequence
  Synthetic oligonucleotide; TTT chr2 60469019 60469040 60469036 60469041 +
tgttttcaatttcggtcttttt

SEQ ID NO: 196292 - DNA, 22 bp, Artificial Sequence
  Synthetic oligonucleotide; TTT chr2 60469020 60469041 60469037 60469042 +
gttttcaatttcggtctttttg

SEQ ID NO: 196293 - DNA, 22 bp, Artificial Sequence
  Synthetic oligonucleotide; TTG chr2 60469021 60469042 60469038 60469043 +
ttttcaatttcggtctttttga

SEQ ID NO: 196294 - DNA, 22 bp, Artificial Sequence
  Synthetic oligonucleotide; TTT chr2 60469024 60469045 60469041 60469046 +
tcaatttcggtctttttgacaa

SEQ ID NO: 196295 - DNA, 22 bp, Artificial Sequence
  Synthetic oligonucleotide; TTT chr2 60469025 60469046 60469042 60469047 +
caatttcggtctttttgacaaa

SEQ ID NO: 196296 - DNA, 22 bp, Artificial Sequence
  Synthetic oligonucleotide; TTC chr2 60469026 60469047 60469043 60469048 +
aatttcggtctttttgacaaaa

SEQ ID NO: 196297 - DNA, 22 bp, Artificial Sequence
  Synthetic oligonucleotide; TTT chr2 60469031 60469052 60469048 60469053 +
cggtctttttgacaaaagtgaa

SEQ ID NO: 196298 - DNA, 22 bp, Artificial Sequence
  Synthetic oligonucleotide; TTC chr2 60469032 60469053 60469049 60469054 +
ggtctttttgacaaaagtgaaa

SEQ ID NO: 196299 - DNA, 22 bp, Artificial Sequence
  Synthetic oligonucleotide; CTT chr2 60469038 60469059 60469055 60469060 +
tttgacaaaagtgaaagggttt

SEQ ID NO: 196300 - DNA, 22 bp, Artificial Sequence
  Synthetic oligonucleotide; TTT chr2 60469039 60469060 60469056 60469061 +
ttgacaaaagtgaaagggtttg

SEQ ID NO: 196301 - DNA, 22 bp, Artificial Sequence
  Synthetic oligonucleotide; TTT chr2 60469040 60469061 60469057 60469062 +
tgacaaaagtgaaagggtttgt

SEQ ID NO: 196302 - DNA, 22 bp, Artificial Sequence
  Synthetic oligonucleotide; TTT chr2 60469041 60469062 60469058 60469063 +
gacaaaagtgaaagggtttgtt

SEQ ID NO: 196303 - DNA, 22 bp, Artificial Sequence
  Synthetic oligonucleotide; TTG chr2 60469042 60469063 60469059 60469064 +
acaaaagtgaaagggtttgttt

SEQ ID NO: 196304 - DNA, 22 bp, Artificial Sequence
  Synthetic oligonucleotide; TTT chr2 60469060 60469081 60469077 60469082 +
gttttaggaaaggggagaggtg

SEQ ID NO: 196305 - DNA, 22 bp, Artificial Sequence
  Synthetic oligonucleotide; TTG chr2 60469061 60469082 60469078 60469083 +
ttttaggaaaggggagaggtgg

SEQ ID NO: 196306 - DNA, 22 bp, Artificial Sequence
  Synthetic oligonucleotide; TTT chr2 60469064 60469085 60469081 60469086 +
taggaaaggggagaggtggtct

SEQ ID NO: 196307 - DNA, 22 bp, Artificial Sequence
  Synthetic oligonucleotide; TTT chr2 60469065 60469086 60469082 60469087 +
aggaaaggggagaggtggtctt

SEQ ID NO: 196308 - DNA, 22 bp, Artificial Sequence
  Synthetic oligonucleotide; TTA chr2 60469066 60469087 60469083 60469088 +
ggaaaggggagaggtggtcttt

SEQ ID NO: 196309 - DNA, 22 bp, Artificial Sequence
  Synthetic oligonucleotide; CTT chr2 60469087 60469108 60469104 60469109 +
tggttcatttgcttatttattt

SEQ ID NO: 196310 - DNA, 22 bp, Artificial Sequence
  Synthetic oligonucleotide; TTT chr2 60469088 60469109 60469105 60469110 +
ggttcatttgcttatttatttg

SEQ ID NO: 196311 - DNA, 22 bp, Artificial Sequence
  Synthetic oligonucleotide; TTG chr2 60469089 60469110 60469106 60469111 +
gttcatttgcttatttatttgt

SEQ ID NO: 196312 - DNA, 22 bp, Artificial Sequence
  Synthetic oligonucleotide; TTC chr2 60469093 60469114 60469110 60469115 +
atttgcttatttatttgttgtt

SEQ ID NO: 196313 - DNA, 22 bp, Artificial Sequence
  Synthetic oligonucleotide; TTT chr2 60469097 60469118 60469114 60469119 +
gcttatttatttgttgttgttt

SEQ ID NO: 196314 - DNA, 22 bp, Artificial Sequence
  Synthetic oligonucleotide; TTG chr2 60469098 60469119 60469115 60469120 +
cttatttatttgttgttgtttg

SEQ ID NO: 196315 - DNA, 22 bp, Artificial Sequence
  Synthetic oligonucleotide; CTT chr2 60469101 60469122 60469118 60469123 +
atttatttgttgttgtttgatt

SEQ ID NO: 196316 - DNA, 22 bp, Artificial Sequence
  Synthetic oligonucleotide; TTA chr2 60469102 60469123 60469119 60469124 +
tttatttgttgttgtttgatta

SEQ ID NO: 196317 - DNA, 22 bp, Artificial Sequence
  Synthetic oligonucleotide; TTT chr2 60469105 60469126 60469122 60469127 +
atttgttgttgtttgattattg

SEQ ID NO: 196318 - DNA, 22 bp, Artificial Sequence
  Synthetic oligonucleotide; TTA chr2 60469106 60469127 60469123 60469128 +
tttgttgttgtttgattattgt

SEQ ID NO: 196319 - DNA, 22 bp, Artificial Sequence
  Synthetic oligonucleotide; TTT chr2 60469109 60469130 60469126 60469131 +
gttgttgtttgattattgtctt

SEQ ID NO: 196320 - DNA, 22 bp, Artificial Sequence
  Synthetic oligonucleotide; TTG chr2 60469110 60469131 60469127 60469132 +
ttgttgtttgattattgtcttg

SEQ ID NO: 196321 - DNA, 22 bp, Artificial Sequence
  Synthetic oligonucleotide; TTG chr2 60469113 60469134 60469130 60469135 +
ttgtttgattattgtcttgtgg

SEQ ID NO: 196322 - DNA, 22 bp, Artificial Sequence
  Synthetic oligonucleotide; TTG chr2 60469116 60469137 60469133 60469138 +
tttgattattgtcttgtggaaa

SEQ ID NO: 196323 - DNA, 22 bp, Artificial Sequence
  Synthetic oligonucleotide; TTT chr2 60469119 60469140 60469136 60469141 +
gattattgtcttgtggaaagaa

SEQ ID NO: 196324 - DNA, 22 bp, Artificial Sequence
  Synthetic oligonucleotide; TTG chr2 60469120 60469141 60469137 60469142 +
attattgtcttgtggaaagaag

SEQ ID NO: 196325 - DNA, 22 bp, Artificial Sequence
  Synthetic oligonucleotide; TTA chr2 60469124 60469145 60469141 60469146 +
ttgtcttgtggaaagaagatgt

SEQ ID NO: 196326 - DNA, 22 bp, Artificial Sequence
  Synthetic oligonucleotide; TTG chr2 60469127 60469148 60469144 60469149 +
tcttgtggaaagaagatgtgta

SEQ ID NO: 196327 - DNA, 22 bp, Artificial Sequence
  Synthetic oligonucleotide; CTT chr2 60469131 60469152 60469148 60469153 +
gtggaaagaagatgtgtaagca

SEQ ID NO: 196328 - DNA, 22 bp, Artificial Sequence
  Synthetic oligonucleotide; TTG chr2 60469132 60469153 60469149 60469154 +
tggaaagaagatgtgtaagcag

SEQ ID NO: 196329 - DNA, 22 bp, Artificial Sequence
  Synthetic oligonucleotide; CTG chr2 60469168 60469189 60469185 60469190 +
gtaatattgtgggtagcctgga

SEQ ID NO: 196330 - DNA, 22 bp, Artificial Sequence
  Synthetic oligonucleotide; TTG chr2 60469177 60469198 60469194 60469199 +
tgggtagcctggaaacatgggg

SEQ ID NO: 196331 - DNA, 22 bp, Artificial Sequence
  Synthetic oligonucleotide; CTG chr2 60469188 60469209 60469205 60469210 +
gaaacatggggggattttatct

SEQ ID NO: 196332 - DNA, 22 bp, Artificial Sequence
  Synthetic oligonucleotide; TTT chr2 60469205 60469226 60469222 60469227 +
tatctgcaaggctggtttacat

SEQ ID NO: 196333 - DNA, 22 bp, Artificial Sequence
  Synthetic oligonucleotide; TTT chr2 60469206 60469227 60469223 60469228 +
atctgcaaggctggtttacatg

SEQ ID NO: 196334 - DNA, 22 bp, Artificial Sequence
  Synthetic oligonucleotide; TTA chr2 60469207 60469228 60469224 60469229 +
tctgcaaggctggtttacatgc

SEQ ID NO: 196335 - DNA, 22 bp, Artificial Sequence
  Synthetic oligonucleotide; CTG chr2 60469211 60469232 60469228 60469233 +
caaggctggtttacatgcatac

SEQ ID NO: 196336 - DNA, 22 bp, Artificial Sequence
  Synthetic oligonucleotide; CTG chr2 60469219 60469240 60469236 60469241 +
gtttacatgcatacattaactt

SEQ ID NO: 196337 - DNA, 22 bp, Artificial Sequence
  Synthetic oligonucleotide; TTT chr2 60469223 60469244 60469240 60469245 +
acatgcatacattaactttact

SEQ ID NO: 196338 - DNA, 22 bp, Artificial Sequence
  Synthetic oligonucleotide; TTA chr2 60469224 60469245 60469241 60469246 +
catgcatacattaactttactt

SEQ ID NO: 196339 - DNA, 22 bp, Artificial Sequence
  Synthetic oligonucleotide; TTA chr2 60469237 60469258 60469254 60469259 +
actttactttatagacaaaccc

SEQ ID NO: 196340 - DNA, 22 bp, Artificial Sequence
  Synthetic oligonucleotide; CTT chr2 60469241 60469262 60469258 60469263 +
tactttatagacaaacccaagc

SEQ ID NO: 196341 - DNA, 22 bp, Artificial Sequence
  Synthetic oligonucleotide; TTT chr2 60469242 60469263 60469259 60469264 +
actttatagacaaacccaagca

SEQ ID NO: 196342 - DNA, 22 bp, Artificial Sequence
  Synthetic oligonucleotide; TTA chr2 60469243 60469264 60469260 60469265 +
ctttatagacaaacccaagcaa

SEQ ID NO: 196343 - DNA, 22 bp, Artificial Sequence
  Synthetic oligonucleotide; CTT chr2 60469246 60469267 60469263 60469268 +
tatagacaaacccaagcaaaaa

SEQ ID NO: 196344 - DNA, 22 bp, Artificial Sequence
  Synthetic oligonucleotide; TTT chr2 60469247 60469268 60469264 60469269 +
atagacaaacccaagcaaaaag

SEQ ID NO: 196345 - DNA, 22 bp, Artificial Sequence
  Synthetic oligonucleotide; TTA chr2 60469248 60469269 60469265 60469270 +
tagacaaacccaagcaaaaagc

SEQ ID NO: 196346 - DNA, 22 bp, Artificial Sequence
  Synthetic oligonucleotide; CTG chr2 60469279 60469300 60469296 60469301 +
ataggaaatgagtagatttgtg

SEQ ID NO: 196347 - DNA, 22 bp, Artificial Sequence
  Synthetic oligonucleotide; TTT chr2 60469298 60469319 60469315 60469320 +
gtgaatcgttttttatgggaca

SEQ ID NO: 196348 - DNA, 22 bp, Artificial Sequence
  Synthetic oligonucleotide; TTG chr2 60469299 60469320 60469316 60469321 +
tgaatcgttttttatgggacag

SEQ ID NO: 196349 - DNA, 22 bp, Artificial Sequence
  Synthetic oligonucleotide; TTT chr2 60469309 60469330 60469326 60469331 +
tttatgggacagagtcccactt

SEQ ID NO: 196350 - DNA, 22 bp, Artificial Sequence
  Synthetic oligonucleotide; TTT chr2 60469310 60469331 60469327 60469332 +
ttatgggacagagtcccacttt

SEQ ID NO: 196351 - DNA, 22 bp, Artificial Sequence
  Synthetic oligonucleotide; TTT chr2 60469311 60469332 60469328 60469333 +
tatgggacagagtcccactttg

SEQ ID NO: 196352 - DNA, 22 bp, Artificial Sequence
  Synthetic oligonucleotide; TTT chr2 60469312 60469333 60469329 60469334 +
atgggacagagtcccactttgc

SEQ ID NO: 196353 - DNA, 22 bp, Artificial Sequence
  Synthetic oligonucleotide; TTA chr2 60469313 60469334 60469330 60469335 +
tgggacagagtcccactttgct

SEQ ID NO: 196354 - DNA, 22 bp, Artificial Sequence
  Synthetic oligonucleotide; CTT chr2 60469331 60469352 60469348 60469353 +
tgctttctctgtccctctgccc

SEQ ID NO: 196355 - DNA, 22 bp, Artificial Sequence
  Synthetic oligonucleotide; TTT chr2 60469332 60469353 60469349 60469354 +
gctttctctgtccctctgcccc

SEQ ID NO: 196356 - DNA, 22 bp, Artificial Sequence
  Synthetic oligonucleotide; TTG chr2 60469333 60469354 60469350 60469355 +
ctttctctgtccctctgccccc

SEQ ID NO: 196357 - DNA, 22 bp, Artificial Sequence
  Synthetic oligonucleotide; CTT chr2 60469336 60469357 60469353 60469358 +
tctctgtccctctgcccccctc

SEQ ID NO: 196358 - DNA, 22 bp, Artificial Sequence
  Synthetic oligonucleotide; TTT chr2 60469337 60469358 60469354 60469359 +
ctctgtccctctgcccccctct

SEQ ID NO: 196359 - DNA, 22 bp, Artificial Sequence
  Synthetic oligonucleotide; TTC chr2 60469338 60469359 60469355 60469360 +
tctgtccctctgcccccctctt

SEQ ID NO: 196360 - DNA, 22 bp, Artificial Sequence
  Synthetic oligonucleotide; CTC chr2 60469340 60469361 60469357 60469362 +
tgtccctctgcccccctcttcc

SEQ ID NO: 196361 - DNA, 22 bp, Artificial Sequence
  Synthetic oligonucleotide; CTG chr2 60469342 60469363 60469359 60469364 +
tccctctgcccccctcttccca

SEQ ID NO: 196362 - DNA, 22 bp, Artificial Sequence
  Synthetic oligonucleotide; CTC chr2 60469348 60469369 60469365 60469370 +
tgcccccctcttcccatgctat

SEQ ID NO: 196363 - DNA, 22 bp, Artificial Sequence
  Synthetic oligonucleotide; CTG chr2 60469350 60469371 60469367 60469372 +
cccccctcttcccatgctatat

SEQ ID NO: 196364 - DNA, 22 bp, Artificial Sequence
  Synthetic oligonucleotide; CTC chr2 60469358 60469379 60469375 60469380 +
ttcccatgctatatttatgata

SEQ ID NO: 196365 - DNA, 22 bp, Artificial Sequence
  Synthetic oligonucleotide; CTT chr2 60469360 60469381 60469377 60469382 +
cccatgctatatttatgatagc

SEQ ID NO: 196366 - DNA, 22 bp, Artificial Sequence
  Synthetic oligonucleotide; TTC chr2 60469361 60469382 60469378 60469383 +
ccatgctatatttatgatagcg

SEQ ID NO: 196367 - DNA, 22 bp, Artificial Sequence
  Synthetic oligonucleotide; CTA chr2 60469369 60469390 60469386 60469391 +
tatttatgatagcgccttcagt

SEQ ID NO: 196368 - DNA, 22 bp, Artificial Sequence
  Synthetic oligonucleotide; TTT chr2 60469374 60469395 60469391 60469396 +
atgatagcgccttcagtgatag

SEQ ID NO: 196369 - DNA, 22 bp, Artificial Sequence
  Synthetic oligonucleotide; TTA chr2 60469375 60469396 60469392 60469397 +
tgatagcgccttcagtgatagg

SEQ ID NO: 196370 - DNA, 22 bp, Artificial Sequence
  Synthetic oligonucleotide; CTT chr2 60469387 60469408 60469404 60469409 +
cagtgataggggaaacctgggc

SEQ ID NO: 196371 - DNA, 22 bp, Artificial Sequence
  Synthetic oligonucleotide; TTC chr2 60469388 60469409 60469405 60469410 +
agtgataggggaaacctgggca

SEQ ID NO: 196372 - DNA, 22 bp, Artificial Sequence
  Synthetic oligonucleotide; CTG chr2 60469406 60469427 60469423 60469428 +
ggcatttctggactgagctggg

SEQ ID NO: 196373 - DNA, 22 bp, Artificial Sequence
  Synthetic oligonucleotide; TTT chr2 60469413 60469434 60469430 60469435 +
ctggactgagctgggccatact

SEQ ID NO: 196374 - DNA, 22 bp, Artificial Sequence
  Synthetic oligonucleotide; TTC chr2 60469414 60469435 60469431 60469436 +
tggactgagctgggccatactc

SEQ ID NO: 196375 - DNA, 22 bp, Artificial Sequence
  Synthetic oligonucleotide; CTG chr2 60469416 60469437 60469433 60469438 +
gactgagctgggccatactcta

SEQ ID NO: 196376 - DNA, 22 bp, Artificial Sequence
  Synthetic oligonucleotide; CTG chr2 60469421 60469442 60469438 60469443 +
agctgggccatactctagaatc

SEQ ID NO: 196377 - DNA, 22 bp, Artificial Sequence
  Synthetic oligonucleotide; CTG chr2 60469426 60469447 60469443 60469448 +
ggccatactctagaatcctgtc

SEQ ID NO: 196378 - DNA, 22 bp, Artificial Sequence
  Synthetic oligonucleotide; CTC chr2 60469436 60469457 60469453 60469458 +
tagaatcctgtcaactggaaac

SEQ ID NO: 196379 - DNA, 22 bp, Artificial Sequence
  Synthetic oligonucleotide; CTA chr2 60469438 60469459 60469455 60469460 +
gaatcctgtcaactggaaacct

SEQ ID NO: 196380 - DNA, 22 bp, Artificial Sequence
  Synthetic oligonucleotide; CTG chr2 60469446 60469467 60469463 60469468 +
tcaactggaaaccttacacaga

SEQ ID NO: 196381 - DNA, 22 bp, Artificial Sequence
  Synthetic oligonucleotide; CTG chr2 60469453 60469474 60469470 60469475 +
gaaaccttacacagatgtggct

SEQ ID NO: 196382 - DNA, 22 bp, Artificial Sequence
  Synthetic oligonucleotide; CTT chr2 60469461 60469482 60469478 60469483 +
acacagatgtggcttctcacaa

SEQ ID NO: 196383 - DNA, 22 bp, Artificial Sequence
  Synthetic oligonucleotide; TTA chr2 60469462 60469483 60469479 60469484 +
cacagatgtggcttctcacaat

SEQ ID NO: 196384 - DNA, 22 bp, Artificial Sequence
  Synthetic oligonucleotide; CTT chr2 60469476 60469497 60469493 60469498 +
ctcacaatacaaagcaatggaa

SEQ ID NO: 196385 - DNA, 22 bp, Artificial Sequence
  Synthetic oligonucleotide; TTC chr2 60469477 60469498 60469494 60469499 +
tcacaatacaaagcaatggaag

SEQ ID NO: 196386 - DNA, 22 bp, Artificial Sequence
  Synthetic oligonucleotide; CTC chr2 60469479 60469500 60469496 60469501 +
acaatacaaagcaatggaagat

SEQ ID NO: 196387 - DNA, 22 bp, Artificial Sequence
  Synthetic oligonucleotide; TTA chr2 60469509 60469530 60469526 60469531 +
gacttctggggtccaaataact

SEQ ID NO: 196388 - DNA, 22 bp, Artificial Sequence
  Synthetic oligonucleotide; CTT chr2 60469514 60469535 60469531 60469536 +
ctggggtccaaataactttgac

SEQ ID NO: 196389 - DNA, 22 bp, Artificial Sequence
  Synthetic oligonucleotide; TTC chr2 60469515 60469536 60469532 60469537 +
tggggtccaaataactttgacc

SEQ ID NO: 196390 - DNA, 22 bp, Artificial Sequence
  Synthetic oligonucleotide; CTG chr2 60469517 60469538 60469534 60469539 +
gggtccaaataactttgaccat

SEQ ID NO: 196391 - DNA, 22 bp, Artificial Sequence
  Synthetic oligonucleotide; CTT chr2 60469532 60469553 60469549 60469554 +
tgaccattaaatgacaaggaaa

SEQ ID NO: 196392 - DNA, 22 bp, Artificial Sequence
  Synthetic oligonucleotide; TTT chr2 60469533 60469554 60469550 60469555 +
gaccattaaatgacaaggaaag

SEQ ID NO: 196393 - DNA, 22 bp, Artificial Sequence
  Synthetic oligonucleotide; TTG chr2 60469534 60469555 60469551 60469556 +
accattaaatgacaaggaaaga

SEQ ID NO: 196394 - DNA, 22 bp, Artificial Sequence
  Synthetic oligonucleotide; TTA chr2 60469541 60469562 60469558 60469563 +
aatgacaaggaaagaaccagca

SEQ ID NO: 196395 - DNA, 22 bp, Artificial Sequence
  Synthetic oligonucleotide; TTC chr2 60469566 60469587 60469583 60469588 +
caataatgccagcacccagaaa

SEQ ID NO: 196396 - DNA, 22 bp, Artificial Sequence
  Synthetic oligonucleotide; CTG chr2 60469593 60469614 60469610 60469615 +
acccatcttcaccattttactg

SEQ ID NO: 196397 - DNA, 22 bp, Artificial Sequence
  Synthetic oligonucleotide; CTT chr2 60469602 60469623 60469619 60469624 +
caccattttactgcactttgtt

SEQ ID NO: 196398 - DNA, 22 bp, Artificial Sequence
  Synthetic oligonucleotide; TTC chr2 60469603 60469624 60469620 60469625 +
accattttactgcactttgttg

SEQ ID NO: 196399 - DNA, 22 bp, Artificial Sequence
  Synthetic oligonucleotide; TTT chr2 60469610 60469631 60469627 60469632 +
tactgcactttgttgtactctg

SEQ ID NO: 196400 - DNA, 22 bp, Artificial Sequence
  Synthetic oligonucleotide; TTT chr2 60469611 60469632 60469628 60469633 +
actgcactttgttgtactctgg

SEQ ID NO: 196401 - DNA, 22 bp, Artificial Sequence
  Synthetic oligonucleotide; TTA chr2 60469612 60469633 60469629 60469634 +
ctgcactttgttgtactctggt

SEQ ID NO: 196402 - DNA, 22 bp, Artificial Sequence
  Synthetic oligonucleotide; CTG chr2 60469615 60469636 60469632 60469637 +
cactttgttgtactctggtgaa

SEQ ID NO: 196403 - DNA, 22 bp, Artificial Sequence
  Synthetic oligonucleotide; CTT chr2 60469620 60469641 60469637 60469642 +
tgttgtactctggtgaagacaa

SEQ ID NO: 196404 - DNA, 22 bp, Artificial Sequence
  Synthetic oligonucleotide; TTT chr2 60469621 60469642 60469638 60469643 +
gttgtactctggtgaagacaag

SEQ ID NO: 196405 - DNA, 22 bp, Artificial Sequence
  Synthetic oligonucleotide; TTG chr2 60469622 60469643 60469639 60469644 +
ttgtactctggtgaagacaagt

SEQ ID NO: 196406 - DNA, 22 bp, Artificial Sequence
  Synthetic oligonucleotide; TTG chr2 60469625 60469646 60469642 60469647 +
tactctggtgaagacaagtgac

SEQ ID NO: 196407 - DNA, 22 bp, Artificial Sequence
  Synthetic oligonucleotide; CTC chr2 60469630 60469651 60469647 60469652 +
tggtgaagacaagtgacttctc

SEQ ID NO: 196408 - DNA, 22 bp, Artificial Sequence
  Synthetic oligonucleotide; CTG chr2 60469632 60469653 60469649 60469654 +
gtgaagacaagtgacttctcac

SEQ ID NO: 196409 - DNA, 22 bp, Artificial Sequence
  Synthetic oligonucleotide; CTT chr2 60469649 60469670 60469666 60469671 +
ctcacactaataaaatgaatct

SEQ ID NO: 196410 - DNA, 22 bp, Artificial Sequence
  Synthetic oligonucleotide; TTC chr2 60469650 60469671 60469667 60469672 +
tcacactaataaaatgaatcta

SEQ ID NO: 196411 - DNA, 22 bp, Artificial Sequence
  Synthetic oligonucleotide; CTC chr2 60469652 60469673 60469669 60469674 +
acactaataaaatgaatctaat

SEQ ID NO: 196412 - DNA, 22 bp, Artificial Sequence
  Synthetic oligonucleotide; CTA chr2 60469658 60469679 60469675 60469680 +
ataaaatgaatctaatagtcaa

SEQ ID NO: 196413 - DNA, 22 bp, Artificial Sequence
  Synthetic oligonucleotide; CTA chr2 60469672 60469693 60469689 60469694 +
atagtcaatgaaacatttgtag

SEQ ID NO: 196414 - DNA, 22 bp, Artificial Sequence
  Synthetic oligonucleotide; TTT chr2 60469690 60469711 60469707 60469712 +
gtagcactgagatttttttgag

SEQ ID NO: 196415 - DNA, 22 bp, Artificial Sequence
  Synthetic oligonucleotide; TTG chr2 60469691 60469712 60469708 60469713 +
tagcactgagatttttttgaga

SEQ ID NO: 196416 - DNA, 22 bp, Artificial Sequence
  Synthetic oligonucleotide; CTG chr2 60469699 60469720 60469716 60469721 +
agatttttttgagaagaggaaa

SEQ ID NO: 196417 - DNA, 22 bp, Artificial Sequence
  Synthetic oligonucleotide; TTT chr2 60469705 60469726 60469722 60469727 +
ttttgagaagaggaaaatttgg

SEQ ID NO: 196418 - DNA, 22 bp, Artificial Sequence
  Synthetic oligonucleotide; TTT chr2 60469706 60469727 60469723 60469728 +
tttgagaagaggaaaatttggt

SEQ ID NO: 196419 - DNA, 22 bp, Artificial Sequence
  Synthetic oligonucleotide; TTT chr2 60469707 60469728 60469724 60469729 +
ttgagaagaggaaaatttggtt

SEQ ID NO: 196420 - DNA, 22 bp, Artificial Sequence
  Synthetic oligonucleotide; TTT chr2 60469708 60469729 60469725 60469730 +
tgagaagaggaaaatttggttt

SEQ ID NO: 196421 - DNA, 22 bp, Artificial Sequence
  Synthetic oligonucleotide; TTT chr2 60469709 60469730 60469726 60469731 +
gagaagaggaaaatttggtttg

SEQ ID NO: 196422 - DNA, 22 bp, Artificial Sequence
  Synthetic oligonucleotide; TTG chr2 60469710 60469731 60469727 60469732 +
agaagaggaaaatttggtttgt

SEQ ID NO: 196423 - DNA, 22 bp, Artificial Sequence
  Synthetic oligonucleotide; TTT chr2 60469725 60469746 60469742 60469747 +
ggtttgtgcaatctggggattt

SEQ ID NO: 196424 - DNA, 22 bp, Artificial Sequence
  Synthetic oligonucleotide; TTG chr2 60469726 60469747 60469743 60469748 +
gtttgtgcaatctggggatttt

SEQ ID NO: 196425 - DNA, 22 bp, Artificial Sequence
  Synthetic oligonucleotide; TTT chr2 60469730 60469751 60469747 60469752 +
gtgcaatctggggattttacgg

SEQ ID NO: 196426 - DNA, 22 bp, Artificial Sequence
  Synthetic oligonucleotide; TTG chr2 60469731 60469752 60469748 60469753 +
tgcaatctggggattttacggt

SEQ ID NO: 196427 - DNA, 22 bp, Artificial Sequence
  Synthetic oligonucleotide; CTG chr2 60469740 60469761 60469757 60469762 +
gggattttacggtttatgtggt

SEQ ID NO: 196428 - DNA, 22 bp, Artificial Sequence
  Synthetic oligonucleotide; TTT chr2 60469747 60469768 60469764 60469769 +
tacggtttatgtggtaagtgcc

SEQ ID NO: 196429 - DNA, 22 bp, Artificial Sequence
  Synthetic oligonucleotide; TTT chr2 60469748 60469769 60469765 60469770 +
acggtttatgtggtaagtgcct

SEQ ID NO: 196430 - DNA, 22 bp, Artificial Sequence
  Synthetic oligonucleotide; TTA chr2 60469749 60469770 60469766 60469771 +
cggtttatgtggtaagtgccta

SEQ ID NO: 196431 - DNA, 22 bp, Artificial Sequence
  Synthetic oligonucleotide; TTT chr2 60469755 60469776 60469772 60469777 +
atgtggtaagtgcctagctttt

SEQ ID NO: 196432 - DNA, 22 bp, Artificial Sequence
  Synthetic oligonucleotide; TTA chr2 60469756 60469777 60469773 60469778 +
tgtggtaagtgcctagcttttc

SEQ ID NO: 196433 - DNA, 22 bp, Artificial Sequence
  Synthetic oligonucleotide; CTA chr2 60469771 60469792 60469788 60469793 +
gcttttccaagtcctcctctag

SEQ ID NO: 196434 - DNA, 22 bp, Artificial Sequence
  Synthetic oligonucleotide; CTT chr2 60469775 60469796 60469792 60469797 +
ttccaagtcctcctctagctaa

SEQ ID NO: 196435 - DNA, 22 bp, Artificial Sequence
  Synthetic oligonucleotide; TTT chr2 60469776 60469797 60469793 60469798 +
tccaagtcctcctctagctaac

SEQ ID NO: 196436 - DNA, 22 bp, Artificial Sequence
  Synthetic oligonucleotide; TTT chr2 60469777 60469798 60469794 60469799 +
ccaagtcctcctctagctaact

SEQ ID NO: 196437 - DNA, 22 bp, Artificial Sequence
  Synthetic oligonucleotide; TTC chr2 60469778 60469799 60469795 60469800 +
caagtcctcctctagctaacta

SEQ ID NO: 196438 - DNA, 22 bp, Artificial Sequence
  Synthetic oligonucleotide; CTC chr2 60469787 60469808 60469804 60469809 +
ctctagctaactaaccatgtag

SEQ ID NO: 196439 - DNA, 22 bp, Artificial Sequence
  Synthetic oligonucleotide; CTC chr2 60469790 60469811 60469807 60469812 +
tagctaactaaccatgtagctg

SEQ ID NO: 196440 - DNA, 22 bp, Artificial Sequence
  Synthetic oligonucleotide; CTA chr2 60469792 60469813 60469809 60469814 +
gctaactaaccatgtagctgtc

SEQ ID NO: 196441 - DNA, 22 bp, Artificial Sequence
  Synthetic oligonucleotide; CTA chr2 60469796 60469817 60469813 60469818 +
actaaccatgtagctgtccatc

SEQ ID NO: 196442 - DNA, 22 bp, Artificial Sequence
  Synthetic oligonucleotide; CTA chr2 60469800 60469821 60469817 60469822 +
accatgtagctgtccatcttga

SEQ ID NO: 196443 - DNA, 22 bp, Artificial Sequence
  Synthetic oligonucleotide; CTG chr2 60469812 60469833 60469829 60469834 +
tccatcttgagacagactggag

SEQ ID NO: 196444 - DNA, 22 bp, Artificial Sequence
  Synthetic oligonucleotide; CTT chr2 60469820 60469841 60469837 60469842 +
gagacagactggaggatagatg

SEQ ID NO: 196445 - DNA, 22 bp, Artificial Sequence
  Synthetic oligonucleotide; TTG chr2 60469821 60469842 60469838 60469843 +
agacagactggaggatagatgg

SEQ ID NO: 196446 - DNA, 22 bp, Artificial Sequence
  Synthetic oligonucleotide; CTG chr2 60469831 60469852 60469848 60469853 +
gaggatagatggtgcaggagac

SEQ ID NO: 196447 - DNA, 22 bp, Artificial Sequence
  Synthetic oligonucleotide; CTC chr2 60469857 60469878 60469874 60469879 +
tgtgtgttctagaggtttggag

SEQ ID NO: 196448 - DNA, 22 bp, Artificial Sequence
  Synthetic oligonucleotide; CTG chr2 60469859 60469880 60469876 60469881 +
tgtgttctagaggtttggagtt

SEQ ID NO: 196449 - DNA, 22 bp, Artificial Sequence
  Synthetic oligonucleotide; TTC chr2 60469866 60469887 60469883 60469888 +
tagaggtttggagttcatgatg

SEQ ID NO: 196450 - DNA, 22 bp, Artificial Sequence
  Synthetic oligonucleotide; CTA chr2 60469868 60469889 60469885 60469890 +
gaggtttggagttcatgatgat

SEQ ID NO: 196451 - DNA, 22 bp, Artificial Sequence
  Synthetic oligonucleotide; TTT chr2 60469875 60469896 60469892 60469897 +
ggagttcatgatgattggggag

SEQ ID NO: 196452 - DNA, 22 bp, Artificial Sequence
  Synthetic oligonucleotide; TTG chr2 60469876 60469897 60469893 60469898 +
gagttcatgatgattggggagg

SEQ ID NO: 196453 - DNA, 22 bp, Artificial Sequence
  Synthetic oligonucleotide; TTC chr2 60469882 60469903 60469899 60469904 +
atgatgattggggagggcggga

SEQ ID NO: 196454 - DNA, 22 bp, Artificial Sequence
  Synthetic oligonucleotide; TTG chr2 60469892 60469913 60469909 60469914 +
gggagggcgggagacaagaaaa

SEQ ID NO: 196455 - DNA, 22 bp, Artificial Sequence
  Synthetic oligonucleotide; CTT chr2 60469922 60469943 60469939 60469944 +
tgatggtgaacaaacagtatgt

SEQ ID NO: 196456 - DNA, 22 bp, Artificial Sequence
  Synthetic oligonucleotide; TTT chr2 60469923 60469944 60469940 60469945 +
gatggtgaacaaacagtatgtt

SEQ ID NO: 196457 - DNA, 22 bp, Artificial Sequence
  Synthetic oligonucleotide; TTG chr2 60469924 60469945 60469941 60469946 +
atggtgaacaaacagtatgttt

SEQ ID NO: 196458 - DNA, 22 bp, Artificial Sequence
  Synthetic oligonucleotide; TTT chr2 60469946 60469967 60469963 60469968 +
tccattagcttaatattaagag

SEQ ID NO: 196459 - DNA, 22 bp, Artificial Sequence
  Synthetic oligonucleotide; TTT chr2 60469947 60469968 60469964 60469969 +
ccattagcttaatattaagagc

SEQ ID NO: 196460 - DNA, 22 bp, Artificial Sequence
  Synthetic oligonucleotide; TTC chr2 60469948 60469969 60469965 60469970 +
cattagcttaatattaagagca

SEQ ID NO: 196461 - DNA, 22 bp, Artificial Sequence
  Synthetic oligonucleotide; TTA chr2 60469953 60469974 60469970 60469975 +
gcttaatattaagagcacttag

SEQ ID NO: 196462 - DNA, 22 bp, Artificial Sequence
  Synthetic oligonucleotide; CTT chr2 60469957 60469978 60469974 60469979 +
aatattaagagcacttagaagt

SEQ ID NO: 196463 - DNA, 22 bp, Artificial Sequence
  Synthetic oligonucleotide; TTA chr2 60469958 60469979 60469975 60469980 +
atattaagagcacttagaagtg

SEQ ID NO: 196464 - DNA, 22 bp, Artificial Sequence
  Synthetic oligonucleotide; TTA chr2 60469964 60469985 60469981 60469986 +
agagcacttagaagtgttgttg

SEQ ID NO: 196465 - DNA, 22 bp, Artificial Sequence
  Synthetic oligonucleotide; CTT chr2 60469973 60469994 60469990 60469995 +
agaagtgttgttgttgtactct

SEQ ID NO: 196466 - DNA, 22 bp, Artificial Sequence
  Synthetic oligonucleotide; TTA chr2 60469974 60469995 60469991 60469996 +
gaagtgttgttgttgtactcta

SEQ ID NO: 196467 - DNA, 22 bp, Artificial Sequence
  Synthetic oligonucleotide; TTG chr2 60469983 60470004 60470000 60470005 +
ttgttgtactctaggatagcag

SEQ ID NO: 196468 - DNA, 22 bp, Artificial Sequence
  Synthetic oligonucleotide; TTG chr2 60469986 60470007 60470003 60470008 +
ttgtactctaggatagcaggtc

SEQ ID NO: 196469 - DNA, 22 bp, Artificial Sequence
  Synthetic oligonucleotide; TTG chr2 60469989 60470010 60470006 60470011 +
tactctaggatagcaggtctca

SEQ ID NO: 196470 - DNA, 22 bp, Artificial Sequence
  Synthetic oligonucleotide; CTC chr2 60469994 60470015 60470011 60470016 +
taggatagcaggtctcaagtgt

SEQ ID NO: 196471 - DNA, 22 bp, Artificial Sequence
  Synthetic oligonucleotide; CTA chr2 60469996 60470017 60470013 60470018 +
ggatagcaggtctcaagtgtaa

SEQ ID NO: 196472 - DNA, 22 bp, Artificial Sequence
  Synthetic oligonucleotide; CTC chr2 60470010 60470031 60470027 60470032 +
aagtgtaaaatacatcctgttc

SEQ ID NO: 196473 - DNA, 22 bp, Artificial Sequence
  Synthetic oligonucleotide; CTG chr2 60470029 60470050 60470046 60470051 +
ttctccttatatagagcacact

SEQ ID NO: 196474 - DNA, 22 bp, Artificial Sequence
  Synthetic oligonucleotide; TTC chr2 60470032 60470053 60470049 60470054 +
tccttatatagagcacactgcc

SEQ ID NO: 196475 - DNA, 22 bp, Artificial Sequence
  Synthetic oligonucleotide; CTC chr2 60470034 60470055 60470051 60470056 +
cttatatagagcacactgccaa

SEQ ID NO: 196476 - DNA, 22 bp, Artificial Sequence
  Synthetic oligonucleotide; CTT chr2 60470037 60470058 60470054 60470059 +
atatagagcacactgccaagca

SEQ ID NO: 196477 - DNA, 22 bp, Artificial Sequence
  Synthetic oligonucleotide; TTA chr2 60470038 60470059 60470055 60470060 +
tatagagcacactgccaagcac

SEQ ID NO: 196478 - DNA, 22 bp, Artificial Sequence
  Synthetic oligonucleotide; CTG chr2 60470052 60470073 60470069 60470074 +
ccaagcacagccaaggcagttg

SEQ ID NO: 196479 - DNA, 22 bp, Artificial Sequence
  Synthetic oligonucleotide; TTG chr2 60470074 60470095 60470091 60470096 +
ggacaagatttcctttcgcaag

SEQ ID NO: 196480 - DNA, 22 bp, Artificial Sequence
  Synthetic oligonucleotide; TTT chr2 60470085 60470106 60470102 60470107 +
cctttcgcaaggagcctggtgg

SEQ ID NO: 196481 - DNA, 22 bp, Artificial Sequence
  Synthetic oligonucleotide; TTC chr2 60470086 60470107 60470103 60470108 +
ctttcgcaaggagcctggtggg

SEQ ID NO: 196482 - DNA, 22 bp, Artificial Sequence
  Synthetic oligonucleotide; CTT chr2 60470089 60470110 60470106 60470111 +
tcgcaaggagcctggtgggtaa

SEQ ID NO: 196483 - DNA, 22 bp, Artificial Sequence
  Synthetic oligonucleotide; TTT chr2 60470090 60470111 60470107 60470112 +
cgcaaggagcctggtgggtaac

SEQ ID NO: 196484 - DNA, 22 bp, Artificial Sequence
  Synthetic oligonucleotide; TTC chr2 60470091 60470112 60470108 60470113 +
gcaaggagcctggtgggtaacg

SEQ ID NO: 196485 - DNA, 22 bp, Artificial Sequence
  Synthetic oligonucleotide; CTG chr2 60470103 60470124 60470120 60470125 +
gtgggtaacgatggtgtgctgc

SEQ ID NO: 196486 - DNA, 22 bp, Artificial Sequence
  Synthetic oligonucleotide; CTG chr2 60470124 60470145 60470141 60470146 +
ctgagaaggctcttacacagac

SEQ ID NO: 196487 - DNA, 22 bp, Artificial Sequence
  Synthetic oligonucleotide; CTG chr2 60470127 60470148 60470144 60470149 +
agaaggctcttacacagacagc

SEQ ID NO: 196488 - DNA, 22 bp, Artificial Sequence
  Synthetic oligonucleotide; CTC chr2 60470136 60470157 60470153 60470158 +
ttacacagacagcataggtctg

SEQ ID NO: 196489 - DNA, 22 bp, Artificial Sequence
  Synthetic oligonucleotide; CTT chr2 60470138 60470159 60470155 60470160 +
acacagacagcataggtctgct

SEQ ID NO: 196490 - DNA, 22 bp, Artificial Sequence
  Synthetic oligonucleotide; TTA chr2 60470139 60470160 60470156 60470161 +
cacagacagcataggtctgctg

SEQ ID NO: 196491 - DNA, 22 bp, Artificial Sequence
  Synthetic oligonucleotide; CTG chr2 60470158 60470179 60470175 60470180 +
ctgttaccaggcctgcagaggg

SEQ ID NO: 196492 - DNA, 22 bp, Artificial Sequence
  Synthetic oligonucleotide; CTG chr2 60470161 60470182 60470178 60470183 +
ttaccaggcctgcagagggaag

SEQ ID NO: 196493 - DNA, 22 bp, Artificial Sequence
  Synthetic oligonucleotide; TTA chr2 60470164 60470185 60470181 60470186 +
ccaggcctgcagagggaagccc

SEQ ID NO: 196494 - DNA, 22 bp, Artificial Sequence
  Synthetic oligonucleotide; CTG chr2 60470173 60470194 60470190 60470195 +
cagagggaagccctggtggaag

SEQ ID NO: 196495 - DNA, 22 bp, Artificial Sequence
  Synthetic oligonucleotide; CTG chr2 60470188 60470209 60470205 60470210 +
gtggaagcaccacctagcctga

SEQ ID NO: 196496 - DNA, 22 bp, Artificial Sequence
  Synthetic oligonucleotide; CTA chr2 60470204 60470225 60470221 60470226 +
gcctgagaacatctacagagac

SEQ ID NO: 196497 - DNA, 22 bp, Artificial Sequence
  Synthetic oligonucleotide; CTG chr2 60470209 60470230 60470226 60470231 +
agaacatctacagagacatttc

SEQ ID NO: 196498 - DNA, 22 bp, Artificial Sequence
  Synthetic oligonucleotide; CTA chr2 60470219 60470240 60470236 60470241 +
cagagacatttcatcctctctg

SEQ ID NO: 196499 - DNA, 22 bp, Artificial Sequence
  Synthetic oligonucleotide; TTT chr2 60470230 60470251 60470247 60470252 +
catcctctctgacccaaaacaa

SEQ ID NO: 196500 - DNA, 22 bp, Artificial Sequence
  Synthetic oligonucleotide; TTC chr2 60470231 60470252 60470248 60470253 +
atcctctctgacccaaaacaaa

SEQ ID NO: 196501 - DNA, 22 bp, Artificial Sequence
  Synthetic oligonucleotide; CTC chr2 60470237 60470258 60470254 60470259 +
tctgacccaaaacaaaataaac

SEQ ID NO: 196502 - DNA, 22 bp, Artificial Sequence
  Synthetic oligonucleotide; CTC chr2 60470239 60470260 60470256 60470261 +
tgacccaaaacaaaataaacac

SEQ ID NO: 196503 - DNA, 22 bp, Artificial Sequence
  Synthetic oligonucleotide; CTG chr2 60470241 60470262 60470258 60470263 +
acccaaaacaaaataaacacca

SEQ ID NO: 196504 - DNA, 22 bp, Artificial Sequence
  Synthetic oligonucleotide; CTT chr2 60470298 60470319 60470315 60470320 +
aacaaacaagtatgtctacatt

SEQ ID NO: 196505 - DNA, 22 bp, Artificial Sequence
  Synthetic oligonucleotide; TTA chr2 60470299 60470320 60470316 60470321 +
acaaacaagtatgtctacattt

SEQ ID NO: 196506 - DNA, 22 bp, Artificial Sequence
  Synthetic oligonucleotide; CTA chr2 60470316 60470337 60470333 60470338 +
catttgactgtttacgtcaagt

SEQ ID NO: 196507 - DNA, 22 bp, Artificial Sequence
  Synthetic oligonucleotide; TTT chr2 60470321 60470342 60470338 60470343 +
gactgtttacgtcaagtgaatt

SEQ ID NO: 196508 - DNA, 22 bp, Artificial Sequence
  Synthetic oligonucleotide; TTG chr2 60470322 60470343 60470339 60470344 +
actgtttacgtcaagtgaattg

SEQ ID NO: 196509 - DNA, 22 bp, Artificial Sequence
  Synthetic oligonucleotide; CTG chr2 60470326 60470347 60470343 60470348 +
tttacgtcaagtgaattgagag

SEQ ID NO: 196510 - DNA, 22 bp, Artificial Sequence
  Synthetic oligonucleotide; TTT chr2 60470329 60470350 60470346 60470351 +
acgtcaagtgaattgagagtgt

SEQ ID NO: 196511 - DNA, 22 bp, Artificial Sequence
  Synthetic oligonucleotide; TTA chr2 60470330 60470351 60470347 60470352 +
cgtcaagtgaattgagagtgtg

SEQ ID NO: 196512 - DNA, 22 bp, Artificial Sequence
  Synthetic oligonucleotide; TTG chr2 60470344 60470365 60470361 60470366 +
agagtgtggcgtaaaattacta

SEQ ID NO: 196513 - DNA, 22 bp, Artificial Sequence
  Synthetic oligonucleotide; TTA chr2 60470363 60470384 60470380 60470385 +
ctacagattttgtcatggtatt

SEQ ID NO: 196514 - DNA, 22 bp, Artificial Sequence
  Synthetic oligonucleotide; CTA chr2 60470366 60470387 60470383 60470388 +
cagattttgtcatggtattttt

SEQ ID NO: 196515 - DNA, 22 bp, Artificial Sequence
  Synthetic oligonucleotide; TTT chr2 60470373 60470394 60470390 60470395 +
tgtcatggtatttttcaatgag

SEQ ID NO: 196516 - DNA, 22 bp, Artificial Sequence
  Synthetic oligonucleotide; TTT chr2 60470374 60470395 60470391 60470396 +
gtcatggtatttttcaatgaga

SEQ ID NO: 196517 - DNA, 22 bp, Artificial Sequence
  Synthetic oligonucleotide; TTG chr2 60470375 60470396 60470392 60470397 +
tcatggtatttttcaatgagaa

SEQ ID NO: 196518 - DNA, 22 bp, Artificial Sequence
  Synthetic oligonucleotide; TTT chr2 60470386 60470407 60470403 60470408 +
ttcaatgagaaatctgagaatc

SEQ ID NO: 196519 - DNA, 22 bp, Artificial Sequence
  Synthetic oligonucleotide; TTT chr2 60470387 60470408 60470404 60470409 +
tcaatgagaaatctgagaatcc

SEQ ID NO: 196520 - DNA, 22 bp, Artificial Sequence
  Synthetic oligonucleotide; TTT chr2 60470388 60470409 60470405 60470410 +
caatgagaaatctgagaatcca

SEQ ID NO: 196521 - DNA, 22 bp, Artificial Sequence
  Synthetic oligonucleotide; TTC chr2 60470389 60470410 60470406 60470411 +
aatgagaaatctgagaatccat

SEQ ID NO: 196522 - DNA, 22 bp, Artificial Sequence
  Synthetic oligonucleotide; CTG chr2 60470402 60470423 60470419 60470424 +
agaatccatctttgcacttgtt

SEQ ID NO: 196523 - DNA, 22 bp, Artificial Sequence
  Synthetic oligonucleotide; CTT chr2 60470414 60470435 60470431 60470436 +
tgcacttgtttttgcctcagcc

SEQ ID NO: 196524 - DNA, 22 bp, Artificial Sequence
  Synthetic oligonucleotide; TTT chr2 60470415 60470436 60470432 60470437 +
gcacttgtttttgcctcagccg

SEQ ID NO: 196525 - DNA, 22 bp, Artificial Sequence
  Synthetic oligonucleotide; TTG chr2 60470416 60470437 60470433 60470438 +
cacttgtttttgcctcagccgt

SEQ ID NO: 196526 - DNA, 22 bp, Artificial Sequence
  Synthetic oligonucleotide; CTT chr2 60470421 60470442 60470438 60470443 +
gtttttgcctcagccgttcact

SEQ ID NO: 196527 - DNA, 22 bp, Artificial Sequence
  Synthetic oligonucleotide; TTG chr2 60470422 60470443 60470439 60470444 +
tttttgcctcagccgttcacta

SEQ ID NO: 196528 - DNA, 22 bp, Artificial Sequence
  Synthetic oligonucleotide; TTT chr2 60470425 60470446 60470442 60470447 +
ttgcctcagccgttcactaagt

SEQ ID NO: 196529 - DNA, 22 bp, Artificial Sequence
  Synthetic oligonucleotide; TTT chr2 60470426 60470447 60470443 60470448 +
tgcctcagccgttcactaagtt

SEQ ID NO: 196530 - DNA, 22 bp, Artificial Sequence
  Synthetic oligonucleotide; TTT chr2 60470427 60470448 60470444 60470449 +
gcctcagccgttcactaagttt

SEQ ID NO: 196531 - DNA, 22 bp, Artificial Sequence
  Synthetic oligonucleotide; TTG chr2 60470428 60470449 60470445 60470450 +
cctcagccgttcactaagtttg

SEQ ID NO: 196532 - DNA, 22 bp, Artificial Sequence
  Synthetic oligonucleotide; CTC chr2 60470432 60470453 60470449 60470454 +
agccgttcactaagtttgctgc

SEQ ID NO: 196533 - DNA, 22 bp, Artificial Sequence
  Synthetic oligonucleotide; TTC chr2 60470440 60470461 60470457 60470462 +
actaagtttgctgccaaaacag

SEQ ID NO: 196534 - DNA, 22 bp, Artificial Sequence
  Synthetic oligonucleotide; CTA chr2 60470444 60470465 60470461 60470466 +
agtttgctgccaaaacagacat

SEQ ID NO: 196535 - DNA, 22 bp, Artificial Sequence
  Synthetic oligonucleotide; TTT chr2 60470449 60470470 60470466 60470471 +
gctgccaaaacagacatccttt

SEQ ID NO: 196536 - DNA, 22 bp, Artificial Sequence
  Synthetic oligonucleotide; TTG chr2 60470450 60470471 60470467 60470472 +
ctgccaaaacagacatcctttt

SEQ ID NO: 196537 - DNA, 22 bp, Artificial Sequence
  Synthetic oligonucleotide; CTG chr2 60470453 60470474 60470470 60470475 +
ccaaaacagacatccttttctt

SEQ ID NO: 196538 - DNA, 22 bp, Artificial Sequence
  Synthetic oligonucleotide; CTT chr2 60470470 60470491 60470487 60470492 +
ttcttaggaaacacaggcaacc

SEQ ID NO: 196539 - DNA, 22 bp, Artificial Sequence
  Synthetic oligonucleotide; TTT chr2 60470471 60470492 60470488 60470493 +
tcttaggaaacacaggcaaccc

SEQ ID NO: 196540 - DNA, 22 bp, Artificial Sequence
  Synthetic oligonucleotide; TTT chr2 60470472 60470493 60470489 60470494 +
cttaggaaacacaggcaaccca

SEQ ID NO: 196541 - DNA, 22 bp, Artificial Sequence
  Synthetic oligonucleotide; TTC chr2 60470473 60470494 60470490 60470495 +
ttaggaaacacaggcaacccag

SEQ ID NO: 196542 - DNA, 22 bp, Artificial Sequence
  Synthetic oligonucleotide; CTT chr2 60470475 60470496 60470492 60470497 +
aggaaacacaggcaacccaggt

SEQ ID NO: 196543 - DNA, 22 bp, Artificial Sequence
  Synthetic oligonucleotide; TTA chr2 60470476 60470497 60470493 60470498 +
ggaaacacaggcaacccaggta

SEQ ID NO: 196544 - DNA, 22 bp, Artificial Sequence
  Synthetic oligonucleotide; CTC chr2 60470502 60470523 60470519 60470524 +
tgtgatcccagcataaacgcaa

SEQ ID NO: 196545 - DNA, 22 bp, Artificial Sequence
  Synthetic oligonucleotide; CTG chr2 60470504 60470525 60470521 60470526 +
tgatcccagcataaacgcaaca

SEQ ID NO: 196546 - DNA, 22 bp, Artificial Sequence
  Synthetic oligonucleotide; CTT chr2 60470533 60470554 60470550 60470555 +
ggatccttgtatggggagtatc

SEQ ID NO: 196547 - DNA, 22 bp, Artificial Sequence
  Synthetic oligonucleotide; TTG chr2 60470534 60470555 60470551 60470556 +
gatccttgtatggggagtatca

SEQ ID NO: 196548 - DNA, 22 bp, Artificial Sequence
  Synthetic oligonucleotide; CTT chr2 60470541 60470562 60470558 60470563 +
gtatggggagtatcaaatttca

SEQ ID NO: 196549 - DNA, 22 bp, Artificial Sequence
  Synthetic oligonucleotide; TTG chr2 60470542 60470563 60470559 60470564 +
tatggggagtatcaaatttcaa

SEQ ID NO: 196550 - DNA, 22 bp, Artificial Sequence
  Synthetic oligonucleotide; TTT chr2 60470561 60470582 60470578 60470583 +
caaattctctgccacttactct

SEQ ID NO: 196551 - DNA, 22 bp, Artificial Sequence
  Synthetic oligonucleotide; TTC chr2 60470562 60470583 60470579 60470584 +
aaattctctgccacttactctg

SEQ ID NO: 196552 - DNA, 22 bp, Artificial Sequence
  Synthetic oligonucleotide; TTC chr2 60470568 60470589 60470585 60470590 +
tctgccacttactctgggaaga

SEQ ID NO: 196553 - DNA, 22 bp, Artificial Sequence
  Synthetic oligonucleotide; CTC chr2 60470570 60470591 60470587 60470592 +
tgccacttactctgggaagaga

SEQ ID NO: 196554 - DNA, 22 bp, Artificial Sequence
  Synthetic oligonucleotide; CTG chr2 60470572 60470593 60470589 60470594 +
ccacttactctgggaagagacc

SEQ ID NO: 196555 - DNA, 22 bp, Artificial Sequence
  Synthetic oligonucleotide; CTT chr2 60470578 60470599 60470595 60470600 +
actctgggaagagaccctgaag

SEQ ID NO: 196556 - DNA, 22 bp, Artificial Sequence
  Synthetic oligonucleotide; TTA chr2 60470579 60470600 60470596 60470601 +
ctctgggaagagaccctgaagt

SEQ ID NO: 196557 - DNA, 22 bp, Artificial Sequence
  Synthetic oligonucleotide; CTC chr2 60470582 60470603 60470599 60470604 +
tgggaagagaccctgaagtgct

SEQ ID NO: 196558 - DNA, 22 bp, Artificial Sequence
  Synthetic oligonucleotide; CTG chr2 60470584 60470605 60470601 60470606 +
ggaagagaccctgaagtgcttc

SEQ ID NO: 196559 - DNA, 22 bp, Artificial Sequence
  Synthetic oligonucleotide; CTG chr2 60470597 60470618 60470614 60470619 +
aagtgcttcagcaggcctccag

SEQ ID NO: 196560 - DNA, 22 bp, Artificial Sequence
  Synthetic oligonucleotide; CTT chr2 60470605 60470626 60470622 60470627 +
cagcaggcctccagcaagaaat

SEQ ID NO: 196561 - DNA, 22 bp, Artificial Sequence
  Synthetic oligonucleotide; TTC chr2 60470606 60470627 60470623 60470628 +
agcaggcctccagcaagaaatg

SEQ ID NO: 196562 - DNA, 22 bp, Artificial Sequence
  Synthetic oligonucleotide; CTC chr2 60470616 60470637 60470633 60470638 +
cagcaagaaatgggagaactgc

SEQ ID NO: 196563 - DNA, 22 bp, Artificial Sequence
  Synthetic oligonucleotide; CTG chr2 60470637 60470658 60470654 60470659 +
ctaacctaatccatgcctagcc

SEQ ID NO: 196564 - DNA, 22 bp, Artificial Sequence
  Synthetic oligonucleotide; CTA chr2 60470640 60470661 60470657 60470662 +
acctaatccatgcctagcccct

SEQ ID NO: 196565 - DNA, 22 bp, Artificial Sequence
  Synthetic oligonucleotide; CTA chr2 60470645 60470666 60470662 60470667 +
atccatgcctagcccctcgcat

SEQ ID NO: 196566 - DNA, 22 bp, Artificial Sequence
  Synthetic oligonucleotide; CTA chr2 60470656 60470677 60470673 60470678 +
gcccctcgcatgaatctcttgt

SEQ ID NO: 196567 - DNA, 22 bp, Artificial Sequence
  Synthetic oligonucleotide; CTC chr2 60470663 60470684 60470680 60470685 +
gcatgaatctcttgttggcaaa

SEQ ID NO: 196568 - DNA, 22 bp, Artificial Sequence
  Synthetic oligonucleotide; CTC chr2 60470674 60470695 60470691 60470696 +
ttgttggcaaacttgtctacaa

SEQ ID NO: 196569 - DNA, 22 bp, Artificial Sequence
  Synthetic oligonucleotide; CTT chr2 60470676 60470697 60470693 60470698 +
gttggcaaacttgtctacaaac

SEQ ID NO: 196570 - DNA, 22 bp, Artificial Sequence
  Synthetic oligonucleotide; TTG chr2 60470677 60470698 60470694 60470699 +
ttggcaaacttgtctacaaacc

SEQ ID NO: 196571 - DNA, 22 bp, Artificial Sequence
  Synthetic oligonucleotide; TTG chr2 60470680 60470701 60470697 60470702 +
gcaaacttgtctacaaacccat

SEQ ID NO: 196572 - DNA, 22 bp, Artificial Sequence
  Synthetic oligonucleotide; CTT chr2 60470688 60470709 60470705 60470710 +
gtctacaaacccattagcccta

SEQ ID NO: 196573 - DNA, 22 bp, Artificial Sequence
  Synthetic oligonucleotide; TTG chr2 60470689 60470710 60470706 60470711 +
tctacaaacccattagccctaa

SEQ ID NO: 196574 - DNA, 22 bp, Artificial Sequence
  Synthetic oligonucleotide; CTA chr2 60470693 60470714 60470710 60470715 +
caaacccattagccctaaacaa

SEQ ID NO: 196575 - DNA, 22 bp, Artificial Sequence
  Synthetic oligonucleotide; TTA chr2 60470704 60470725 60470721 60470726 +
gccctaaacaagctgacggcag

SEQ ID NO: 196576 - DNA, 22 bp, Artificial Sequence
  Synthetic oligonucleotide; CTA chr2 60470710 60470731 60470727 60470732 +
aacaagctgacggcaggaccag

SEQ ID NO: 196577 - DNA, 22 bp, Artificial Sequence
  Synthetic oligonucleotide; CTG chr2 60470719 60470740 60470736 60470741 +
acggcaggaccagatctctaca

SEQ ID NO: 196578 - DNA, 22 bp, Artificial Sequence
  Synthetic oligonucleotide; CTC chr2 60470737 60470758 60470754 60470759 +
tacagtgtctggccgtgtggca

SEQ ID NO: 196579 - DNA, 22 bp, Artificial Sequence
  Synthetic oligonucleotide; CTA chr2 60470739 60470760 60470756 60470761 +
cagtgtctggccgtgtggcaaa

SEQ ID NO: 196580 - DNA, 22 bp, Artificial Sequence
  Synthetic oligonucleotide; CTG chr2 60470748 60470769 60470765 60470770 +
gccgtgtggcaaagtgaggtct

SEQ ID NO: 196581 - DNA, 22 bp, Artificial Sequence
  Synthetic oligonucleotide; CTC chr2 60470771 60470792 60470788 60470793 +
atctgactatctggcagcatag

SEQ ID NO: 196582 - DNA, 22 bp, Artificial Sequence
  Synthetic oligonucleotide; CTG chr2 60470776 60470797 60470793 60470798 +
actatctggcagcatagtttgt

SEQ ID NO: 196583 - DNA, 22 bp, Artificial Sequence
  Synthetic oligonucleotide; CTA chr2 60470780 60470801 60470797 60470802 +
tctggcagcatagtttgttttt

SEQ ID NO: 196584 - DNA, 22 bp, Artificial Sequence
  Synthetic oligonucleotide; CTG chr2 60470784 60470805 60470801 60470806 +
gcagcatagtttgtttttgttt

SEQ ID NO: 196585 - DNA, 22 bp, Artificial Sequence
  Synthetic oligonucleotide; TTT chr2 60470796 60470817 60470813 60470818 +
gtttttgtttttgtttttgttt

SEQ ID NO: 196586 - DNA, 22 bp, Artificial Sequence
  Synthetic oligonucleotide; TTG chr2 60470797 60470818 60470814 60470819 +
tttttgtttttgtttttgtttt

SEQ ID NO: 196587 - DNA, 22 bp, Artificial Sequence
  Synthetic oligonucleotide; TTT chr2 60470800 60470821 60470817 60470822 +
ttgtttttgtttttgtttttgt

SEQ ID NO: 196588 - DNA, 22 bp, Artificial Sequence
  Synthetic oligonucleotide; TTT chr2 60470801 60470822 60470818 60470823 +
tgtttttgtttttgtttttgtt

SEQ ID NO: 196589 - DNA, 22 bp, Artificial Sequence
  Synthetic oligonucleotide; TTT chr2 60470802 60470823 60470819 60470824 +
gtttttgtttttgtttttgttt

SEQ ID NO: 196590 - DNA, 22 bp, Artificial Sequence
  Synthetic oligonucleotide; TTG chr2 60470803 60470824 60470820 60470825 +
tttttgtttttgtttttgtttt

SEQ ID NO: 196591 - DNA, 22 bp, Artificial Sequence
  Synthetic oligonucleotide; TTT chr2 60470806 60470827 60470823 60470828 +
ttgtttttgtttttgttttcta

SEQ ID NO: 196592 - DNA, 22 bp, Artificial Sequence
  Synthetic oligonucleotide; TTT chr2 60470807 60470828 60470824 60470829 +
tgtttttgtttttgttttctaa

SEQ ID NO: 196593 - DNA, 22 bp, Artificial Sequence
  Synthetic oligonucleotide; TTT chr2 60470808 60470829 60470825 60470830 +
gtttttgtttttgttttctaag

SEQ ID NO: 196594 - DNA, 22 bp, Artificial Sequence
  Synthetic oligonucleotide; TTG chr2 60470809 60470830 60470826 60470831 +
tttttgtttttgttttctaagt

SEQ ID NO: 196595 - DNA, 22 bp, Artificial Sequence
  Synthetic oligonucleotide; TTT chr2 60470812 60470833 60470829 60470834 +
ttgtttttgttttctaagttgt

SEQ ID NO: 196596 - DNA, 22 bp, Artificial Sequence
  Synthetic oligonucleotide; TTT chr2 60470813 60470834 60470830 60470835 +
tgtttttgttttctaagttgta

SEQ ID NO: 196597 - DNA, 22 bp, Artificial Sequence
  Synthetic oligonucleotide; TTT chr2 60470814 60470835 60470831 60470836 +
gtttttgttttctaagttgtaa

SEQ ID NO: 196598 - DNA, 22 bp, Artificial Sequence
  Synthetic oligonucleotide; TTG chr2 60470815 60470836 60470832 60470837 +
tttttgttttctaagttgtaaa

SEQ ID NO: 196599 - DNA, 22 bp, Artificial Sequence
  Synthetic oligonucleotide; TTT chr2 60470818 60470839 60470835 60470840 +
ttgttttctaagttgtaaaaaa

SEQ ID NO: 196600 - DNA, 22 bp, Artificial Sequence
  Synthetic oligonucleotide; TTT chr2 60470819 60470840 60470836 60470841 +
tgttttctaagttgtaaaaaac

SEQ ID NO: 196601 - DNA, 22 bp, Artificial Sequence
  Synthetic oligonucleotide; TTT chr2 60470820 60470841 60470837 60470842 +
gttttctaagttgtaaaaaacc

SEQ ID NO: 196602 - DNA, 22 bp, Artificial Sequence
  Synthetic oligonucleotide; TTG chr2 60470821 60470842 60470838 60470843 +
ttttctaagttgtaaaaaaccc

SEQ ID NO: 196603 - DNA, 22 bp, Artificial Sequence
  Synthetic oligonucleotide; TTT chr2 60470824 60470845 60470841 60470846 +
tctaagttgtaaaaaaccctag

SEQ ID NO: 196604 - DNA, 22 bp, Artificial Sequence
  Synthetic oligonucleotide; TTT chr2 60470825 60470846 60470842 60470847 +
ctaagttgtaaaaaaccctagc

SEQ ID NO: 196605 - DNA, 22 bp, Artificial Sequence
  Synthetic oligonucleotide; TTC chr2 60470826 60470847 60470843 60470848 +
taagttgtaaaaaaccctagct

SEQ ID NO: 196606 - DNA, 22 bp, Artificial Sequence
  Synthetic oligonucleotide; CTA chr2 60470828 60470849 60470845 60470850 +
agttgtaaaaaaccctagctat

SEQ ID NO: 196607 - DNA, 22 bp, Artificial Sequence
  Synthetic oligonucleotide; TTG chr2 60470833 60470854 60470850 60470855 +
taaaaaaccctagctatcatca

SEQ ID NO: 196608 - DNA, 22 bp, Artificial Sequence
  Synthetic oligonucleotide; CTA chr2 60470845 60470866 60470862 60470867 +
gctatcatcaagtctgtccctt

SEQ ID NO: 196609 - DNA, 22 bp, Artificial Sequence
  Synthetic oligonucleotide; CTA chr2 60470849 60470870 60470866 60470871 +
tcatcaagtctgtcccttcatt

SEQ ID NO: 196610 - DNA, 22 bp, Artificial Sequence
  Synthetic oligonucleotide; CTG chr2 60470861 60470882 60470878 60470883 +
tcccttcattttacagatgggg

SEQ ID NO: 196611 - DNA, 22 bp, Artificial Sequence
  Synthetic oligonucleotide; CTT chr2 60470867 60470888 60470884 60470889 +
cattttacagatggggaaactg

SEQ ID NO: 196612 - DNA, 22 bp, Artificial Sequence
  Synthetic oligonucleotide; TTC chr2 60470868 60470889 60470885 60470890 +
attttacagatggggaaactga

SEQ ID NO: 196613 - DNA, 22 bp, Artificial Sequence
  Synthetic oligonucleotide; TTT chr2 60470872 60470893 60470889 60470894 +
tacagatggggaaactgaggcc

SEQ ID NO: 196614 - DNA, 22 bp, Artificial Sequence
  Synthetic oligonucleotide; TTT chr2 60470873 60470894 60470890 60470895 +
acagatggggaaactgaggcca

SEQ ID NO: 196615 - DNA, 22 bp, Artificial Sequence
  Synthetic oligonucleotide; TTA chr2 60470874 60470895 60470891 60470896 +
cagatggggaaactgaggccat

SEQ ID NO: 196616 - DNA, 22 bp, Artificial Sequence
  Synthetic oligonucleotide; CTG chr2 60470889 60470910 60470906 60470911 +
aggccatgagaaattaagtgac

SEQ ID NO: 196617 - DNA, 22 bp, Artificial Sequence
  Synthetic oligonucleotide; TTA chr2 60470905 60470926 60470922 60470927 +
agtgacttgcccatggctacac

SEQ ID NO: 196618 - DNA, 22 bp, Artificial Sequence
  Synthetic oligonucleotide; CTT chr2 60470913 60470934 60470930 60470935 +
gcccatggctacactgatgatt

SEQ ID NO: 196619 - DNA, 22 bp, Artificial Sequence
  Synthetic oligonucleotide; TTG chr2 60470914 60470935 60470931 60470936 +
cccatggctacactgatgatta

SEQ ID NO: 196620 - DNA, 22 bp, Artificial Sequence
  Synthetic oligonucleotide; CTA chr2 60470924 60470945 60470941 60470946 +
cactgatgattaaccacaatgt

SEQ ID NO: 196621 - DNA, 22 bp, Artificial Sequence
  Synthetic oligonucleotide; CTG chr2 60470929 60470950 60470946 60470951 +
atgattaaccacaatgtgaaga

SEQ ID NO: 196622 - DNA, 22 bp, Artificial Sequence
  Synthetic oligonucleotide; TTA chr2 60470936 60470957 60470953 60470958 +
accacaatgtgaagattagaat

SEQ ID NO: 196623 - DNA, 22 bp, Artificial Sequence
  Synthetic oligonucleotide; TTA chr2 60470954 60470975 60470971 60470976 +
gaattaatctcctgactcctga

SEQ ID NO: 196624 - DNA, 22 bp, Artificial Sequence
  Synthetic oligonucleotide; TTA chr2 60470960 60470981 60470977 60470982 +
atctcctgactcctgatccagt

SEQ ID NO: 196625 - DNA, 22 bp, Artificial Sequence
  Synthetic oligonucleotide; CTC chr2 60470965 60470986 60470982 60470987 +
ctgactcctgatccagtggtct

SEQ ID NO: 196626 - DNA, 22 bp, Artificial Sequence
  Synthetic oligonucleotide; CTG chr2 60470968 60470989 60470985 60470990 +
actcctgatccagtggtctttc

SEQ ID NO: 196627 - DNA, 22 bp, Artificial Sequence
  Synthetic oligonucleotide; CTC chr2 60470972 60470993 60470989 60470994 +
ctgatccagtggtctttcctgg

SEQ ID NO: 196628 - DNA, 22 bp, Artificial Sequence
  Synthetic oligonucleotide; CTG chr2 60470975 60470996 60470992 60470997 +
atccagtggtctttcctgggaa

SEQ ID NO: 196629 - DNA, 22 bp, Artificial Sequence
  Synthetic oligonucleotide; CTT chr2 60470988 60471009 60471005 60471010 +
tcctgggaatttgtctcttccc

SEQ ID NO: 196630 - DNA, 22 bp, Artificial Sequence
  Synthetic oligonucleotide; TTT chr2 60470989 60471010 60471006 60471011 +
cctgggaatttgtctcttcccc

SEQ ID NO: 196631 - DNA, 22 bp, Artificial Sequence
  Synthetic oligonucleotide; TTC chr2 60470990 60471011 60471007 60471012 +
ctgggaatttgtctcttccccc

SEQ ID NO: 196632 - DNA, 22 bp, Artificial Sequence
  Synthetic oligonucleotide; CTG chr2 60470993 60471014 60471010 60471015 +
ggaatttgtctcttcccccctg

SEQ ID NO: 196633 - DNA, 22 bp, Artificial Sequence
  Synthetic oligonucleotide; TTT chr2 60471000 60471021 60471017 60471022 +
gtctcttcccccctgctgctcc

SEQ ID NO: 196634 - DNA, 22 bp, Artificial Sequence
  Synthetic oligonucleotide; TTG chr2 60471001 60471022 60471018 60471023 +
tctcttcccccctgctgctcct

SEQ ID NO: 196635 - DNA, 22 bp, Artificial Sequence
  Synthetic oligonucleotide; CTC chr2 60471005 60471026 60471022 60471027 +
ttcccccctgctgctcctgccg

SEQ ID NO: 196636 - DNA, 22 bp, Artificial Sequence
  Synthetic oligonucleotide; CTT chr2 60471007 60471028 60471024 60471029 +
cccccctgctgctcctgccgtg

SEQ ID NO: 196637 - DNA, 22 bp, Artificial Sequence
  Synthetic oligonucleotide; TTC chr2 60471008 60471029 60471025 60471030 +
ccccctgctgctcctgccgtgg

SEQ ID NO: 196638 - DNA, 22 bp, Artificial Sequence
  Synthetic oligonucleotide; CTG chr2 60471015 60471036 60471032 60471037 +
ctgctcctgccgtggtcttcac

SEQ ID NO: 196639 - DNA, 22 bp, Artificial Sequence
  Synthetic oligonucleotide; CTG chr2 60471018 60471039 60471035 60471040 +
ctcctgccgtggtcttcactgc

SEQ ID NO: 196640 - DNA, 22 bp, Artificial Sequence
  Synthetic oligonucleotide; CTC chr2 60471021 60471042 60471038 60471043 +
ctgccgtggtcttcactgccca

SEQ ID NO: 196641 - DNA, 22 bp, Artificial Sequence
  Synthetic oligonucleotide; CTG chr2 60471024 60471045 60471041 60471046 +
ccgtggtcttcactgcccaaca

SEQ ID NO: 196642 - DNA, 22 bp, Artificial Sequence
  Synthetic oligonucleotide; CTT chr2 60471034 60471055 60471051 60471056 +
cactgcccaacaagaaggtcct

SEQ ID NO: 196643 - DNA, 22 bp, Artificial Sequence
  Synthetic oligonucleotide; TTC chr2 60471035 60471056 60471052 60471057 +
actgcccaacaagaaggtcctg

SEQ ID NO: 196644 - DNA, 22 bp, Artificial Sequence
  Synthetic oligonucleotide; CTG chr2 60471039 60471060 60471056 60471061 +
cccaacaagaaggtcctgtttc

SEQ ID NO: 196645 - DNA, 22 bp, Artificial Sequence
  Synthetic oligonucleotide; CTG chr2 60471057 60471078 60471074 60471079 +
tttctactgatccattaagcag

SEQ ID NO: 196646 - DNA, 22 bp, Artificial Sequence
  Synthetic oligonucleotide; TTT chr2 60471060 60471081 60471077 60471082 +
ctactgatccattaagcagtac

SEQ ID NO: 196647 - DNA, 22 bp, Artificial Sequence
  Synthetic oligonucleotide; TTC chr2 60471061 60471082 60471078 60471083 +
tactgatccattaagcagtact

SEQ ID NO: 196648 - DNA, 22 bp, Artificial Sequence
  Synthetic oligonucleotide; CTA chr2 60471063 60471084 60471080 60471085 +
ctgatccattaagcagtactta

SEQ ID NO: 196649 - DNA, 22 bp, Artificial Sequence
  Synthetic oligonucleotide; CTG chr2 60471066 60471087 60471083 60471088 +
atccattaagcagtacttaacc

SEQ ID NO: 196650 - DNA, 22 bp, Artificial Sequence
  Synthetic oligonucleotide; TTA chr2 60471074 60471095 60471091 60471096 +
agcagtacttaaccgtcttggg

SEQ ID NO: 196651 - DNA, 22 bp, Artificial Sequence
  Synthetic oligonucleotide; CTT chr2 60471084 60471105 60471101 60471106 +
aaccgtcttgggggagggtcca

SEQ ID NO: 196652 - DNA, 22 bp, Artificial Sequence
  Synthetic oligonucleotide; TTA chr2 60471085 60471106 60471102 60471107 +
accgtcttgggggagggtccag

SEQ ID NO: 196653 - DNA, 22 bp, Artificial Sequence
  Synthetic oligonucleotide; CTT chr2 60471093 60471114 60471110 60471115 +
gggggagggtccagcccagcag

SEQ ID NO: 196654 - DNA, 22 bp, Artificial Sequence
  Synthetic oligonucleotide; TTG chr2 60471094 60471115 60471111 60471116 +
ggggagggtccagcccagcagc

SEQ ID NO: 196655 - DNA, 22 bp, Artificial Sequence
  Synthetic oligonucleotide; CTA chr2 60471120 60471141 60471137 60471142 +
catggggctttcgaaaggtgcc

SEQ ID NO: 196656 - DNA, 22 bp, Artificial Sequence
  Synthetic oligonucleotide; CTT chr2 60471130 60471151 60471147 60471152 +
tcgaaaggtgccaatgaactga

SEQ ID NO: 196657 - DNA, 22 bp, Artificial Sequence
  Synthetic oligonucleotide; TTT chr2 60471131 60471152 60471148 60471153 +
cgaaaggtgccaatgaactgac

SEQ ID NO: 196658 - DNA, 22 bp, Artificial Sequence
  Synthetic oligonucleotide; TTC chr2 60471132 60471153 60471149 60471154 +
gaaaggtgccaatgaactgact

SEQ ID NO: 196659 - DNA, 22 bp, Artificial Sequence
  Synthetic oligonucleotide; CTG chr2 60471151 60471172 60471168 60471173 +
acttggtctcacaattggaaaa

SEQ ID NO: 196660 - DNA, 22 bp, Artificial Sequence
  Synthetic oligonucleotide; CTT chr2 60471155 60471176 60471172 60471177 +
ggtctcacaattggaaaacaag

SEQ ID NO: 196661 - DNA, 22 bp, Artificial Sequence
  Synthetic oligonucleotide; TTG chr2 60471156 60471177 60471173 60471178 +
gtctcacaattggaaaacaagg

SEQ ID NO: 196662 - DNA, 22 bp, Artificial Sequence
  Synthetic oligonucleotide; CTC chr2 60471161 60471182 60471178 60471183 +
acaattggaaaacaaggcctgc

SEQ ID NO: 196663 - DNA, 22 bp, Artificial Sequence
  Synthetic oligonucleotide; TTG chr2 60471168 60471189 60471185 60471190 +
gaaaacaaggcctgctctgctg

SEQ ID NO: 196664 - DNA, 22 bp, Artificial Sequence
  Synthetic oligonucleotide; CTG chr2 60471182 60471203 60471199 60471204 +
ctctgctgcctgggcctcctgg

SEQ ID NO: 196665 - DNA, 22 bp, Artificial Sequence
  Synthetic oligonucleotide; CTC chr2 60471185 60471206 60471202 60471207 +
tgctgcctgggcctcctggcct

SEQ ID NO: 196666 - DNA, 22 bp, Artificial Sequence
  Synthetic oligonucleotide; CTG chr2 60471187 60471208 60471204 60471209 +
ctgcctgggcctcctggcctca

SEQ ID NO: 196667 - DNA, 22 bp, Artificial Sequence
  Synthetic oligonucleotide; CTG chr2 60471190 60471211 60471207 60471212 +
cctgggcctcctggcctcacct

SEQ ID NO: 196668 - DNA, 22 bp, Artificial Sequence
  Synthetic oligonucleotide; CTG chr2 60471194 60471215 60471211 60471216 +
ggcctcctggcctcacctttgc

SEQ ID NO: 196669 - DNA, 22 bp, Artificial Sequence
  Synthetic oligonucleotide; CTC chr2 60471200 60471221 60471217 60471222 +
ctggcctcacctttgctgtgtt

SEQ ID NO: 196670 - DNA, 22 bp, Artificial Sequence
  Synthetic oligonucleotide; CTG chr2 60471203 60471224 60471220 60471225 +
gcctcacctttgctgtgttcac

SEQ ID NO: 196671 - DNA, 22 bp, Artificial Sequence
  Synthetic oligonucleotide; CTC chr2 60471208 60471229 60471225 60471230 +
acctttgctgtgttcaccctct

SEQ ID NO: 196672 - DNA, 22 bp, Artificial Sequence
  Synthetic oligonucleotide; CTT chr2 60471213 60471234 60471230 60471235 +
tgctgtgttcaccctctacctc

SEQ ID NO: 196673 - DNA, 22 bp, Artificial Sequence
  Synthetic oligonucleotide; TTT chr2 60471214 60471235 60471231 60471236 +
gctgtgttcaccctctacctct

SEQ ID NO: 196674 - DNA, 22 bp, Artificial Sequence
  Synthetic oligonucleotide; TTG chr2 60471215 60471236 60471232 60471237 +
ctgtgttcaccctctacctctg

SEQ ID NO: 196675 - DNA, 22 bp, Artificial Sequence
  Synthetic oligonucleotide; CTG chr2 60471218 60471239 60471235 60471240 +
tgttcaccctctacctctgctt

SEQ ID NO: 196676 - DNA, 22 bp, Artificial Sequence
  Synthetic oligonucleotide; TTC chr2 60471223 60471244 60471240 60471245 +
accctctacctctgcttcccct

SEQ ID NO: 196677 - DNA, 22 bp, Artificial Sequence
  Synthetic oligonucleotide; CTC chr2 60471229 60471250 60471246 60471251 +
tacctctgcttcccctgcagaa

SEQ ID NO: 196678 - DNA, 22 bp, Artificial Sequence
  Synthetic oligonucleotide; CTA chr2 60471231 60471252 60471248 60471253 +
cctctgcttcccctgcagaatt

SEQ ID NO: 196679 - DNA, 22 bp, Artificial Sequence
  Synthetic oligonucleotide; CTC chr2 60471235 60471256 60471252 60471257 +
tgcttcccctgcagaattagac

SEQ ID NO: 196680 - DNA, 22 bp, Artificial Sequence
  Synthetic oligonucleotide; CTG chr2 60471237 60471258 60471254 60471259 +
cttcccctgcagaattagacag

SEQ ID NO: 196681 - DNA, 22 bp, Artificial Sequence
  Synthetic oligonucleotide; CTT chr2 60471240 60471261 60471257 60471262 +
cccctgcagaattagacagcta

SEQ ID NO: 196682 - DNA, 22 bp, Artificial Sequence
  Synthetic oligonucleotide; TTC chr2 60471241 60471262 60471258 60471263 +
ccctgcagaattagacagctaa

SEQ ID NO: 196683 - DNA, 22 bp, Artificial Sequence
  Synthetic oligonucleotide; CTG chr2 60471246 60471267 60471263 60471268 +
cagaattagacagctaaaaaca

SEQ ID NO: 196684 - DNA, 22 bp, Artificial Sequence
  Synthetic oligonucleotide; TTA chr2 60471254 60471275 60471271 60471276 +
gacagctaaaaacatttctatc

SEQ ID NO: 196685 - DNA, 22 bp, Artificial Sequence
  Synthetic oligonucleotide; CTA chr2 60471262 60471283 60471279 60471284 +
aaaacatttctatcagcctaag

SEQ ID NO: 196686 - DNA, 22 bp, Artificial Sequence
  Synthetic oligonucleotide; TTT chr2 60471271 60471292 60471288 60471293 +
ctatcagcctaagaagctattt

SEQ ID NO: 196687 - DNA, 22 bp, Artificial Sequence
  Synthetic oligonucleotide; TTC chr2 60471272 60471293 60471289 60471294 +
tatcagcctaagaagctattta

SEQ ID NO: 196688 - DNA, 22 bp, Artificial Sequence
  Synthetic oligonucleotide; CTA chr2 60471274 60471295 60471291 60471296 +
tcagcctaagaagctatttact

SEQ ID NO: 196689 - DNA, 22 bp, Artificial Sequence
  Synthetic oligonucleotide; CTA chr2 60471282 60471303 60471299 60471304 +
agaagctatttactttagaaaa

SEQ ID NO: 196690 - DNA, 22 bp, Artificial Sequence
  Synthetic oligonucleotide; CTA chr2 60471290 60471311 60471307 60471312 +
tttactttagaaaaaaagcaca

SEQ ID NO: 196691 - DNA, 22 bp, Artificial Sequence
  Synthetic oligonucleotide; TTT chr2 60471293 60471314 60471310 60471315 +
actttagaaaaaaagcacactg

SEQ ID NO: 196692 - DNA, 22 bp, Artificial Sequence
  Synthetic oligonucleotide; TTA chr2 60471294 60471315 60471311 60471316 +
ctttagaaaaaaagcacactgt

SEQ ID NO: 196693 - DNA, 22 bp, Artificial Sequence
  Synthetic oligonucleotide; CTT chr2 60471297 60471318 60471314 60471319 +
tagaaaaaaagcacactgtctt

SEQ ID NO: 196694 - DNA, 22 bp, Artificial Sequence
  Synthetic oligonucleotide; TTT chr2 60471298 60471319 60471315 60471320 +
agaaaaaaagcacactgtcttt

SEQ ID NO: 196695 - DNA, 22 bp, Artificial Sequence
  Synthetic oligonucleotide; TTA chr2 60471299 60471320 60471316 60471321 +
gaaaaaaagcacactgtctttg

SEQ ID NO: 196696 - DNA, 22 bp, Artificial Sequence
  Synthetic oligonucleotide; CTG chr2 60471315 60471336 60471332 60471337 +
tctttgtgagactcacccttgc

SEQ ID NO: 196697 - DNA, 22 bp, Artificial Sequence
  Synthetic oligonucleotide; CTT chr2 60471319 60471340 60471336 60471341 +
tgtgagactcacccttgcattt

SEQ ID NO: 196698 - DNA, 22 bp, Artificial Sequence
  Synthetic oligonucleotide; TTT chr2 60471320 60471341 60471337 60471342 +
gtgagactcacccttgcattta

SEQ ID NO: 196699 - DNA, 22 bp, Artificial Sequence
  Synthetic oligonucleotide; TTG chr2 60471321 60471342 60471338 60471343 +
tgagactcacccttgcatttat

SEQ ID NO: 196700 - DNA, 22 bp, Artificial Sequence
  Synthetic oligonucleotide; CTC chr2 60471329 60471350 60471346 60471351 +
acccttgcatttatcttccttc

SEQ ID NO: 196701 - DNA, 22 bp, Artificial Sequence
  Synthetic oligonucleotide; CTT chr2 60471335 60471356 60471352 60471357 +
gcatttatcttccttcaggaag

SEQ ID NO: 196702 - DNA, 22 bp, Artificial Sequence
  Synthetic oligonucleotide; TTG chr2 60471336 60471357 60471353 60471358 +
catttatcttccttcaggaaga

SEQ ID NO: 196703 - DNA, 22 bp, Artificial Sequence
  Synthetic oligonucleotide; TTT chr2 60471341 60471362 60471358 60471363 +
atcttccttcaggaagagggtc

SEQ ID NO: 196704 - DNA, 22 bp, Artificial Sequence
  Synthetic oligonucleotide; TTA chr2 60471342 60471363 60471359 60471364 +
tcttccttcaggaagagggtca

SEQ ID NO: 196705 - DNA, 22 bp, Artificial Sequence
  Synthetic oligonucleotide; CTT chr2 60471346 60471367 60471363 60471368 +
ccttcaggaagagggtcaaagc

SEQ ID NO: 196706 - DNA, 22 bp, Artificial Sequence
  Synthetic oligonucleotide; TTC chr2 60471347 60471368 60471364 60471369 +
cttcaggaagagggtcaaagca

SEQ ID NO: 196707 - DNA, 22 bp, Artificial Sequence
  Synthetic oligonucleotide; CTT chr2 60471350 60471371 60471367 60471372 +
caggaagagggtcaaagcaaag

SEQ ID NO: 196708 - DNA, 22 bp, Artificial Sequence
  Synthetic oligonucleotide; TTC chr2 60471351 60471372 60471368 60471373 +
aggaagagggtcaaagcaaagc

SEQ ID NO: 196709 - DNA, 22 bp, Artificial Sequence
  Synthetic oligonucleotide; CTG chr2 60471379 60471400 60471396 60471401 +
gggaccccagctgattctgctg

SEQ ID NO: 196710 - DNA, 22 bp, Artificial Sequence
  Synthetic oligonucleotide; CTG chr2 60471392 60471413 60471409 60471414 +
attctgctgcttcttccactaa

SEQ ID NO: 196711 - DNA, 22 bp, Artificial Sequence
  Synthetic oligonucleotide; TTC chr2 60471396 60471417 60471413 60471418 +
tgctgcttcttccactaaacac

SEQ ID NO: 196712 - DNA, 22 bp, Artificial Sequence
  Synthetic oligonucleotide; CTG chr2 60471398 60471419 60471415 60471420 +
ctgcttcttccactaaacacat

SEQ ID NO: 196713 - DNA, 22 bp, Artificial Sequence
  Synthetic oligonucleotide; CTG chr2 60471401 60471422 60471418 60471423 +
cttcttccactaaacacatcca

SEQ ID NO: 196714 - DNA, 22 bp, Artificial Sequence
  Synthetic oligonucleotide; CTT chr2 60471404 60471425 60471421 60471426 +
cttccactaaacacatccataa

SEQ ID NO: 196715 - DNA, 22 bp, Artificial Sequence
  Synthetic oligonucleotide; TTC chr2 60471405 60471426 60471422 60471427 +
ttccactaaacacatccataat

SEQ ID NO: 196716 - DNA, 22 bp, Artificial Sequence
  Synthetic oligonucleotide; CTT chr2 60471407 60471428 60471424 60471429 +
ccactaaacacatccataatat

SEQ ID NO: 196717 - DNA, 22 bp, Artificial Sequence
  Synthetic oligonucleotide; TTC chr2 60471408 60471429 60471425 60471430 +
cactaaacacatccataatatt

SEQ ID NO: 196718 - DNA, 22 bp, Artificial Sequence
  Synthetic oligonucleotide; CTA chr2 60471413 60471434 60471430 60471435 +
aacacatccataatattctctt

SEQ ID NO: 196719 - DNA, 22 bp, Artificial Sequence
  Synthetic oligonucleotide; TTC chr2 60471431 60471452 60471448 60471453 +
tctttggtaagtaaaatcgaca

SEQ ID NO: 196720 - DNA, 22 bp, Artificial Sequence
  Synthetic oligonucleotide; CTC chr2 60471433 60471454 60471450 60471455 +
tttggtaagtaaaatcgacatt

SEQ ID NO: 196721 - DNA, 22 bp, Artificial Sequence
  Synthetic oligonucleotide; CTT chr2 60471435 60471456 60471452 60471457 +
tggtaagtaaaatcgacattcc

SEQ ID NO: 196722 - DNA, 22 bp, Artificial Sequence
  Synthetic oligonucleotide; TTT chr2 60471436 60471457 60471453 60471458 +
ggtaagtaaaatcgacattccc

SEQ ID NO: 196723 - DNA, 22 bp, Artificial Sequence
  Synthetic oligonucleotide; TTG chr2 60471437 60471458 60471454 60471459 +
gtaagtaaaatcgacattccca

SEQ ID NO: 196724 - DNA, 22 bp, Artificial Sequence
  Synthetic oligonucleotide; TTC chr2 60471456 60471477 60471473 60471478 +
ccacatgaactggaaatgctaa

SEQ ID NO: 196725 - DNA, 22 bp, Artificial Sequence
  Synthetic oligonucleotide; CTG chr2 60471468 60471489 60471485 60471490 +
gaaatgctaaattgttaatagc

SEQ ID NO: 196726 - DNA, 22 bp, Artificial Sequence
  Synthetic oligonucleotide; CTA chr2 60471477 60471498 60471494 60471499 +
aattgttaatagcctccctagg

SEQ ID NO: 196727 - DNA, 22 bp, Artificial Sequence
  Synthetic oligonucleotide; TTG chr2 60471482 60471503 60471499 60471504 +
ttaatagcctccctagggctta

SEQ ID NO: 196728 - DNA, 22 bp, Artificial Sequence
  Synthetic oligonucleotide; TTA chr2 60471485 60471506 60471502 60471507 +
atagcctccctagggcttaact

SEQ ID NO: 196729 - DNA, 22 bp, Artificial Sequence
  Synthetic oligonucleotide; CTC chr2 60471493 60471514 60471510 60471515 +
cctagggcttaacttcttgcta

SEQ ID NO: 196730 - DNA, 22 bp, Artificial Sequence
  Synthetic oligonucleotide; CTA chr2 60471497 60471518 60471514 60471519 +
gggcttaacttcttgctatgat

SEQ ID NO: 196731 - DNA, 22 bp, Artificial Sequence
  Synthetic oligonucleotide; CTT chr2 60471503 60471524 60471520 60471525 +
aacttcttgctatgatgccttc

SEQ ID NO: 196732 - DNA, 22 bp, Artificial Sequence
  Synthetic oligonucleotide; TTA chr2 60471504 60471525 60471521 60471526 +
acttcttgctatgatgccttca

SEQ ID NO: 196733 - DNA, 22 bp, Artificial Sequence
  Synthetic oligonucleotide; CTT chr2 60471508 60471529 60471525 60471530 +
cttgctatgatgccttcaatta

SEQ ID NO: 196734 - DNA, 22 bp, Artificial Sequence
  Synthetic oligonucleotide; TTC chr2 60471509 60471530 60471526 60471531 +
ttgctatgatgccttcaattat

SEQ ID NO: 196735 - DNA, 22 bp, Artificial Sequence
  Synthetic oligonucleotide; CTT chr2 60471511 60471532 60471528 60471533 +
gctatgatgccttcaattattt

SEQ ID NO: 196736 - DNA, 22 bp, Artificial Sequence
  Synthetic oligonucleotide; TTG chr2 60471512 60471533 60471529 60471534 +
ctatgatgccttcaattatttc

SEQ ID NO: 196737 - DNA, 22 bp, Artificial Sequence
  Synthetic oligonucleotide; CTA chr2 60471515 60471536 60471532 60471537 +
tgatgccttcaattatttcatc

SEQ ID NO: 196738 - DNA, 22 bp, Artificial Sequence
  Synthetic oligonucleotide; CTT chr2 60471524 60471545 60471541 60471546 +
caattatttcatcacggcttag

SEQ ID NO: 196739 - DNA, 22 bp, Artificial Sequence
  Synthetic oligonucleotide; TTC chr2 60471525 60471546 60471542 60471547 +
aattatttcatcacggcttagg

SEQ ID NO: 196740 - DNA, 22 bp, Artificial Sequence
  Synthetic oligonucleotide; TTA chr2 60471530 60471551 60471547 60471552 +
tttcatcacggcttaggcaaag

SEQ ID NO: 196741 - DNA, 22 bp, Artificial Sequence
  Synthetic oligonucleotide; TTT chr2 60471533 60471554 60471550 60471555 +
catcacggcttaggcaaagtaa

SEQ ID NO: 196742 - DNA, 22 bp, Artificial Sequence
  Synthetic oligonucleotide; TTC chr2 60471534 60471555 60471551 60471556 +
atcacggcttaggcaaagtaaa

SEQ ID NO: 196743 - DNA, 22 bp, Artificial Sequence
  Synthetic oligonucleotide; CTT chr2 60471544 60471565 60471561 60471566 +
aggcaaagtaaagtatcacaat

SEQ ID NO: 196744 - DNA, 22 bp, Artificial Sequence
  Synthetic oligonucleotide; TTA chr2 60471545 60471566 60471562 60471567 +
ggcaaagtaaagtatcacaatt

SEQ ID NO: 196745 - DNA, 22 bp, Artificial Sequence
  Synthetic oligonucleotide; TTA chr2 60471568 60471589 60471585 60471590 +
atgcttctgagcgtcaaactcg

SEQ ID NO: 196746 - DNA, 22 bp, Artificial Sequence
  Synthetic oligonucleotide; CTT chr2 60471574 60471595 60471591 60471596 +
ctgagcgtcaaactcgaggagc

SEQ ID NO: 196747 - DNA, 22 bp, Artificial Sequence
  Synthetic oligonucleotide; TTC chr2 60471575 60471596 60471592 60471597 +
tgagcgtcaaactcgaggagca

SEQ ID NO: 196748 - DNA, 22 bp, Artificial Sequence
  Synthetic oligonucleotide; CTG chr2 60471577 60471598 60471594 60471599 +
agcgtcaaactcgaggagcagc

SEQ ID NO: 196749 - DNA, 22 bp, Artificial Sequence
  Synthetic oligonucleotide; CTC chr2 60471589 60471610 60471606 60471611 +
gaggagcagctctgccttccca

SEQ ID NO: 196750 - DNA, 22 bp, Artificial Sequence
  Synthetic oligonucleotide; CTC chr2 60471601 60471622 60471618 60471623 +
tgccttcccaggccaaggtggg

SEQ ID NO: 196751 - DNA, 22 bp, Artificial Sequence
  Synthetic oligonucleotide; CTG chr2 60471603 60471624 60471620 60471625 +
ccttcccaggccaaggtgggga

SEQ ID NO: 196752 - DNA, 22 bp, Artificial Sequence
  Synthetic oligonucleotide; CTT chr2 60471607 60471628 60471624 60471629 +
cccaggccaaggtggggaaaag

SEQ ID NO: 196753 - DNA, 22 bp, Artificial Sequence
  Synthetic oligonucleotide; TTC chr2 60471608 60471629 60471625 60471630 +
ccaggccaaggtggggaaaagg

SEQ ID NO: 196754 - DNA, 22 bp, Artificial Sequence
  Synthetic oligonucleotide; CTG chr2 60471635 60471656 60471652 60471657 +
cccctggttgagggcctcttct

SEQ ID NO: 196755 - DNA, 22 bp, Artificial Sequence
  Synthetic oligonucleotide; CTG chr2 60471641 60471662 60471658 60471663 +
gttgagggcctcttcttttccc

SEQ ID NO: 196756 - DNA, 22 bp, Artificial Sequence
  Synthetic oligonucleotide; TTG chr2 60471645 60471666 60471662 60471667 +
agggcctcttcttttcccacct

SEQ ID NO: 196757 - DNA, 22 bp, Artificial Sequence
  Synthetic oligonucleotide; CTC chr2 60471653 60471674 60471670 60471675 +
ttcttttcccaccttcgctttc

SEQ ID NO: 196758 - DNA, 22 bp, Artificial Sequence
  Synthetic oligonucleotide; CTT chr2 60471655 60471676 60471672 60471677 +
cttttcccaccttcgctttcat

SEQ ID NO: 196759 - DNA, 22 bp, Artificial Sequence
  Synthetic oligonucleotide; TTC chr2 60471656 60471677 60471673 60471678 +
ttttcccaccttcgctttcatt

SEQ ID NO: 196760 - DNA, 22 bp, Artificial Sequence
  Synthetic oligonucleotide; CTT chr2 60471658 60471679 60471675 60471680 +
ttcccaccttcgctttcattct

SEQ ID NO: 196761 - DNA, 22 bp, Artificial Sequence
  Synthetic oligonucleotide; TTT chr2 60471659 60471680 60471676 60471681 +
tcccaccttcgctttcattctc

SEQ ID NO: 196762 - DNA, 22 bp, Artificial Sequence
  Synthetic oligonucleotide; TTT chr2 60471660 60471681 60471677 60471682 +
cccaccttcgctttcattctcc

SEQ ID NO: 196763 - DNA, 22 bp, Artificial Sequence
  Synthetic oligonucleotide; TTC chr2 60471661 60471682 60471678 60471683 +
ccaccttcgctttcattctccc

SEQ ID NO: 196764 - DNA, 22 bp, Artificial Sequence
  Synthetic oligonucleotide; CTT chr2 60471668 60471689 60471685 60471690 +
cgctttcattctccccagccag

SEQ ID NO: 196765 - DNA, 22 bp, Artificial Sequence
  Synthetic oligonucleotide; TTC chr2 60471669 60471690 60471686 60471691 +
gctttcattctccccagccaga

SEQ ID NO: 196766 - DNA, 22 bp, Artificial Sequence
  Synthetic oligonucleotide; CTT chr2 60471673 60471694 60471690 60471695 +
tcattctccccagccagagatg

SEQ ID NO: 196767 - DNA, 22 bp, Artificial Sequence
  Synthetic oligonucleotide; TTT chr2 60471674 60471695 60471691 60471696 +
cattctccccagccagagatgg

SEQ ID NO: 196768 - DNA, 22 bp, Artificial Sequence
  Synthetic oligonucleotide; TTC chr2 60471675 60471696 60471692 60471697 +
attctccccagccagagatggg

SEQ ID NO: 196769 - DNA, 22 bp, Artificial Sequence
  Synthetic oligonucleotide; TTC chr2 60471679 60471700 60471696 60471701 +
tccccagccagagatgggctct

SEQ ID NO: 196770 - DNA, 22 bp, Artificial Sequence
  Synthetic oligonucleotide; CTC chr2 60471681 60471702 60471698 60471703 +
cccagccagagatgggctctgg

SEQ ID NO: 196771 - DNA, 22 bp, Artificial Sequence
  Synthetic oligonucleotide; CTC chr2 60471700 60471721 60471717 60471722 +
tggttgctggctaggaagtggg

SEQ ID NO: 196772 - DNA, 22 bp, Artificial Sequence
  Synthetic oligonucleotide; CTG chr2 60471702 60471723 60471719 60471724 +
gttgctggctaggaagtgggtg

SEQ ID NO: 196773 - DNA, 22 bp, Artificial Sequence
  Synthetic oligonucleotide; TTG chr2 60471706 60471727 60471723 60471728 +
ctggctaggaagtgggtgatct

SEQ ID NO: 196774 - DNA, 22 bp, Artificial Sequence
  Synthetic oligonucleotide; CTG chr2 60471709 60471730 60471726 60471731 +
gctaggaagtgggtgatctagt

SEQ ID NO: 196775 - DNA, 22 bp, Artificial Sequence
  Synthetic oligonucleotide; CTA chr2 60471713 60471734 60471730 60471735 +
ggaagtgggtgatctagttatg

SEQ ID NO: 196776 - DNA, 22 bp, Artificial Sequence
  Synthetic oligonucleotide; CTA chr2 60471729 60471750 60471746 60471751 +
gttatgtcctctttttttcttt

SEQ ID NO: 196777 - DNA, 22 bp, Artificial Sequence
  Synthetic oligonucleotide; TTA chr2 60471733 60471754 60471750 60471755 +
tgtcctctttttttctttgtta

SEQ ID NO: 196778 - DNA, 22 bp, Artificial Sequence
  Synthetic oligonucleotide; CTC chr2 60471740 60471761 60471757 60471762 +
tttttttctttgttagtgctct

SEQ ID NO: 196779 - DNA, 22 bp, Artificial Sequence
  Synthetic oligonucleotide; CTT chr2 60471742 60471763 60471759 60471764 +
tttttctttgttagtgctctta

SEQ ID NO: 196780 - DNA, 22 bp, Artificial Sequence
  Synthetic oligonucleotide; TTT chr2 60471743 60471764 60471760 60471765 +
ttttctttgttagtgctcttag

SEQ ID NO: 196781 - DNA, 22 bp, Artificial Sequence
  Synthetic oligonucleotide; TTT chr2 60471744 60471765 60471761 60471766 +
tttctttgttagtgctcttagg

SEQ ID NO: 196782 - DNA, 22 bp, Artificial Sequence
  Synthetic oligonucleotide; TTT chr2 60471745 60471766 60471762 60471767 +
ttctttgttagtgctcttaggc

SEQ ID NO: 196783 - DNA, 22 bp, Artificial Sequence
  Synthetic oligonucleotide; TTT chr2 60471746 60471767 60471763 60471768 +
tctttgttagtgctcttaggca

SEQ ID NO: 196784 - DNA, 22 bp, Artificial Sequence
  Synthetic oligonucleotide; TTT chr2 60471747 60471768 60471764 60471769 +
ctttgttagtgctcttaggcaa

SEQ ID NO: 196785 - DNA, 22 bp, Artificial Sequence
  Synthetic oligonucleotide; TTC chr2 60471748 60471769 60471765 60471770 +
tttgttagtgctcttaggcaag

SEQ ID NO: 196786 - DNA, 22 bp, Artificial Sequence
  Synthetic oligonucleotide; CTT chr2 60471750 60471771 60471767 60471772 +
tgttagtgctcttaggcaagtg

SEQ ID NO: 196787 - DNA, 22 bp, Artificial Sequence
  Synthetic oligonucleotide; TTT chr2 60471751 60471772 60471768 60471773 +
gttagtgctcttaggcaagtga

SEQ ID NO: 196788 - DNA, 22 bp, Artificial Sequence
  Synthetic oligonucleotide; TTG chr2 60471752 60471773 60471769 60471774 +
ttagtgctcttaggcaagtgat

SEQ ID NO: 196789 - DNA, 22 bp, Artificial Sequence
  Synthetic oligonucleotide; TTA chr2 60471755 60471776 60471772 60471777 +
gtgctcttaggcaagtgattct

SEQ ID NO: 196790 - DNA, 22 bp, Artificial Sequence
  Synthetic oligonucleotide; CTC chr2 60471761 60471782 60471778 60471783 +
ttaggcaagtgattctcacagc

SEQ ID NO: 196791 - DNA, 22 bp, Artificial Sequence
  Synthetic oligonucleotide; CTT chr2 60471763 60471784 60471780 60471785 +
aggcaagtgattctcacagcgc

SEQ ID NO: 196792 - DNA, 22 bp, Artificial Sequence
  Synthetic oligonucleotide; TTA chr2 60471764 60471785 60471781 60471786 +
ggcaagtgattctcacagcgca

SEQ ID NO: 196793 - DNA, 22 bp, Artificial Sequence
  Synthetic oligonucleotide; TTC chr2 60471776 60471797 60471793 60471798 +
tcacagcgcagacccaggccca

SEQ ID NO: 196794 - DNA, 22 bp, Artificial Sequence
  Synthetic oligonucleotide; CTC chr2 60471778 60471799 60471795 60471800 +
acagcgcagacccaggcccacc

SEQ ID NO: 196795 - DNA, 22 bp, Artificial Sequence
  Synthetic oligonucleotide; CTG chr2 60471818 60471839 60471835 60471840 +
ggagtttgttcaaaatgcaaat

SEQ ID NO: 196796 - DNA, 22 bp, Artificial Sequence
  Synthetic oligonucleotide; TTT chr2 60471825 60471846 60471842 60471847 +
gttcaaaatgcaaattcttggg

SEQ ID NO: 196797 - DNA, 22 bp, Artificial Sequence
  Synthetic oligonucleotide; TTG chr2 60471826 60471847 60471843 60471848 +
ttcaaaatgcaaattcttgggc

SEQ ID NO: 196798 - DNA, 22 bp, Artificial Sequence
  Synthetic oligonucleotide; TTC chr2 60471829 60471850 60471846 60471851 +
aaaatgcaaattcttgggcacc

SEQ ID NO: 196799 - DNA, 22 bp, Artificial Sequence
  Synthetic oligonucleotide; TTC chr2 60471842 60471863 60471859 60471864 +
ttgggcaccacctcagacttac

SEQ ID NO: 196800 - DNA, 22 bp, Artificial Sequence
  Synthetic oligonucleotide; CTT chr2 60471844 60471865 60471861 60471866 +
gggcaccacctcagacttactg

SEQ ID NO: 196801 - DNA, 22 bp, Artificial Sequence
  Synthetic oligonucleotide; TTG chr2 60471845 60471866 60471862 60471867 +
ggcaccacctcagacttactga

SEQ ID NO: 196802 - DNA, 22 bp, Artificial Sequence
  Synthetic oligonucleotide; CTC chr2 60471856 60471877 60471873 60471878 +
agacttactgaatcagaaattg

SEQ ID NO: 196803 - DNA, 22 bp, Artificial Sequence
  Synthetic oligonucleotide; CTT chr2 60471862 60471883 60471879 60471884 +
actgaatcagaaattgagggtg

SEQ ID NO: 196804 - DNA, 22 bp, Artificial Sequence
  Synthetic oligonucleotide; TTA chr2 60471863 60471884 60471880 60471885 +
ctgaatcagaaattgagggtgg

SEQ ID NO: 196805 - DNA, 22 bp, Artificial Sequence
  Synthetic oligonucleotide; CTG chr2 60471866 60471887 60471883 60471888 +
aatcagaaattgagggtgggga

SEQ ID NO: 196806 - DNA, 22 bp, Artificial Sequence
  Synthetic oligonucleotide; TTG chr2 60471878 60471899 60471895 60471900 +
agggtggggaagcagccttcta

SEQ ID NO: 196807 - DNA, 22 bp, Artificial Sequence
  Synthetic oligonucleotide; CTT chr2 60471897 60471918 60471914 60471919 +
ctatgttgaataaattctccag

SEQ ID NO: 196808 - DNA, 22 bp, Artificial Sequence
  Synthetic oligonucleotide; TTC chr2 60471898 60471919 60471915 60471920 +
tatgttgaataaattctccagg

SEQ ID NO: 196809 - DNA, 22 bp, Artificial Sequence
  Synthetic oligonucleotide; CTA chr2 60471900 60471921 60471917 60471922 +
tgttgaataaattctccaggtg

SEQ ID NO: 196810 - DNA, 22 bp, Artificial Sequence
  Synthetic oligonucleotide; TTG chr2 60471905 60471926 60471922 60471927 +
aataaattctccaggtgattct

SEQ ID NO: 196811 - DNA, 22 bp, Artificial Sequence
  Synthetic oligonucleotide; TTC chr2 60471914 60471935 60471931 60471936 +
tccaggtgattctcatgcacac

SEQ ID NO: 196812 - DNA, 22 bp, Artificial Sequence
  Synthetic oligonucleotide; CTC chr2 60471916 60471937 60471933 60471938 +
caggtgattctcatgcacactc

SEQ ID NO: 196813 - DNA, 22 bp, Artificial Sequence
  Synthetic oligonucleotide; TTC chr2 60471926 60471947 60471943 60471948 +
tcatgcacactcaagctgaatc

SEQ ID NO: 196814 - DNA, 22 bp, Artificial Sequence
  Synthetic oligonucleotide; CTC chr2 60471928 60471949 60471945 60471950 +
atgcacactcaagctgaatcag

SEQ ID NO: 196815 - DNA, 22 bp, Artificial Sequence
  Synthetic oligonucleotide; CTC chr2 60471938 60471959 60471955 60471960 +
aagctgaatcagcactgctgtc

SEQ ID NO: 196816 - DNA, 22 bp, Artificial Sequence
  Synthetic oligonucleotide; CTG chr2 60471944 60471965 60471961 60471966 +
aatcagcactgctgtcttaggg

SEQ ID NO: 196817 - DNA, 22 bp, Artificial Sequence
  Synthetic oligonucleotide; CTG chr2 60471955 60471976 60471972 60471977 +
ctgtcttagggtaagggaagta

SEQ ID NO: 196818 - DNA, 22 bp, Artificial Sequence
  Synthetic oligonucleotide; CTG chr2 60471958 60471979 60471975 60471980 +
tcttagggtaagggaagtatga

SEQ ID NO: 196819 - DNA, 22 bp, Artificial Sequence
  Synthetic oligonucleotide; CTT chr2 60471962 60471983 60471979 60471984 +
agggtaagggaagtatgaacgc

SEQ ID NO: 196820 - DNA, 22 bp, Artificial Sequence
  Synthetic oligonucleotide; TTA chr2 60471963 60471984 60471980 60471985 +
gggtaagggaagtatgaacgct

SEQ ID NO: 196821 - DNA, 22 bp, Artificial Sequence
  Synthetic oligonucleotide; CTG chr2 60471986 60472007 60472003 60472008 +
gaagctttgaaattccctgggc

SEQ ID NO: 196822 - DNA, 22 bp, Artificial Sequence
  Synthetic oligonucleotide; CTT chr2 60471993 60472014 60472010 60472015 +
tgaaattccctgggcagagacc

SEQ ID NO: 196823 - DNA, 22 bp, Artificial Sequence
  Synthetic oligonucleotide; TTT chr2 60471994 60472015 60472011 60472016 +
gaaattccctgggcagagaccc

SEQ ID NO: 196824 - DNA, 22 bp, Artificial Sequence
  Synthetic oligonucleotide; TTG chr2 60471995 60472016 60472012 60472017 +
aaattccctgggcagagaccca

SEQ ID NO: 196825 - DNA, 22 bp, Artificial Sequence
  Synthetic oligonucleotide; TTC chr2 60472001 60472022 60472018 60472023 +
cctgggcagagacccatgggcc

SEQ ID NO: 196826 - DNA, 22 bp, Artificial Sequence
  Synthetic oligonucleotide; CTG chr2 60472005 60472026 60472022 60472027 +
ggcagagacccatgggccatga

SEQ ID NO: 196827 - DNA, 22 bp, Artificial Sequence
  Synthetic oligonucleotide; CTG chr2 60472032 60472053 60472049 60472054 +
ttttccctcctgtccaggaccc

SEQ ID NO: 196828 - DNA, 22 bp, Artificial Sequence
  Synthetic oligonucleotide; TTT chr2 60472035 60472056 60472052 60472057 +
tccctcctgtccaggacccacc

SEQ ID NO: 196829 - DNA, 22 bp, Artificial Sequence
  Synthetic oligonucleotide; TTT chr2 60472036 60472057 60472053 60472058 +
ccctcctgtccaggacccacct

SEQ ID NO: 196830 - DNA, 22 bp, Artificial Sequence
  Synthetic oligonucleotide; TTC chr2 60472037 60472058 60472054 60472059 +
cctcctgtccaggacccacctc

SEQ ID NO: 196831 - DNA, 22 bp, Artificial Sequence
  Synthetic oligonucleotide; CTC chr2 60472041 60472062 60472058 60472063 +
ctgtccaggacccacctccttt

SEQ ID NO: 196832 - DNA, 22 bp, Artificial Sequence
  Synthetic oligonucleotide; CTG chr2 60472044 60472065 60472061 60472066 +
tccaggacccacctcctttagg

SEQ ID NO: 196833 - DNA, 22 bp, Artificial Sequence
  Synthetic oligonucleotide; CTC chr2 60472059 60472080 60472076 60472081 +
ctttaggactggaacagtcaaa

SEQ ID NO: 196834 - DNA, 22 bp, Artificial Sequence
  Synthetic oligonucleotide; CTT chr2 60472062 60472083 60472079 60472084 +
taggactggaacagtcaaaaac

SEQ ID NO: 196835 - DNA, 22 bp, Artificial Sequence
  Synthetic oligonucleotide; TTT chr2 60472063 60472084 60472080 60472085 +
aggactggaacagtcaaaaaca

SEQ ID NO: 196836 - DNA, 22 bp, Artificial Sequence
  Synthetic oligonucleotide; TTA chr2 60472064 60472085 60472081 60472086 +
ggactggaacagtcaaaaacaa

SEQ ID NO: 196837 - DNA, 22 bp, Artificial Sequence
  Synthetic oligonucleotide; CTG chr2 60472070 60472091 60472087 60472092 +
gaacagtcaaaaacaaattaag

SEQ ID NO: 196838 - DNA, 22 bp, Artificial Sequence
  Synthetic oligonucleotide; TTA chr2 60472090 60472111 60472107 60472112 +
agcttagggaatccctaaggat

SEQ ID NO: 196839 - DNA, 22 bp, Artificial Sequence
  Synthetic oligonucleotide; CTT chr2 60472095 60472116 60472112 60472117 +
agggaatccctaaggatccctc

SEQ ID NO: 196840 - DNA, 22 bp, Artificial Sequence
  Synthetic oligonucleotide; TTA chr2 60472096 60472117 60472113 60472118 +
gggaatccctaaggatccctcc

SEQ ID NO: 196841 - DNA, 22 bp, Artificial Sequence
  Synthetic oligonucleotide; CTA chr2 60472107 60472128 60472124 60472129 +
aggatccctccattaggaaatt

SEQ ID NO: 196842 - DNA, 22 bp, Artificial Sequence
  Synthetic oligonucleotide; CTC chr2 60472117 60472138 60472134 60472139 +
cattaggaaattcaggttccac

SEQ ID NO: 196843 - DNA, 22 bp, Artificial Sequence
  Synthetic oligonucleotide; TTA chr2 60472122 60472143 60472139 60472144 +
ggaaattcaggttccaccctcc

SEQ ID NO: 196844 - DNA, 22 bp, Artificial Sequence
  Synthetic oligonucleotide; TTC chr2 60472130 60472151 60472147 60472152 +
aggttccaccctccgtctgtca

SEQ ID NO: 196845 - DNA, 22 bp, Artificial Sequence
  Synthetic oligonucleotide; TTC chr2 60472136 60472157 60472153 60472158 +
caccctccgtctgtcattgata

SEQ ID NO: 196846 - DNA, 22 bp, Artificial Sequence
  Synthetic oligonucleotide; CTC chr2 60472143 60472164 60472160 60472165 +
cgtctgtcattgataaggacag

SEQ ID NO: 196847 - DNA, 22 bp, Artificial Sequence
  Synthetic oligonucleotide; CTG chr2 60472149 60472170 60472166 60472171 +
tcattgataaggacagggaaca

SEQ ID NO: 196848 - DNA, 22 bp, Artificial Sequence
  Synthetic oligonucleotide; TTG chr2 60472155 60472176 60472172 60472177 +
ataaggacagggaacaggtcca

SEQ ID NO: 196849 - DNA, 22 bp, Artificial Sequence
  Synthetic oligonucleotide; CTC chr2 60472182 60472203 60472199 60472204 +
tccatcaggtccagggccttct

SEQ ID NO: 196850 - DNA, 22 bp, Artificial Sequence
  Synthetic oligonucleotide; CTC chr2 60472184 60472205 60472201 60472206 +
catcaggtccagggccttctta

SEQ ID NO: 196851 - DNA, 22 bp, Artificial Sequence
  Synthetic oligonucleotide; CTT chr2 60472202 60472223 60472219 60472224 +
cttagcatgagacaacacccaa

SEQ ID NO: 196852 - DNA, 22 bp, Artificial Sequence
  Synthetic oligonucleotide; TTC chr2 60472203 60472224 60472220 60472225 +
ttagcatgagacaacacccaaa

SEQ ID NO: 196853 - DNA, 22 bp, Artificial Sequence
  Synthetic oligonucleotide; CTT chr2 60472205 60472226 60472222 60472227 +
agcatgagacaacacccaaacc

SEQ ID NO: 196854 - DNA, 22 bp, Artificial Sequence
  Synthetic oligonucleotide; TTA chr2 60472206 60472227 60472223 60472228 +
gcatgagacaacacccaaacca

SEQ ID NO: 196855 - DNA, 22 bp, Artificial Sequence
  Synthetic oligonucleotide; CTT chr2 60472232 60472253 60472249 60472254 +
gtgccagacagattgtgtcctc

SEQ ID NO: 196856 - DNA, 22 bp, Artificial Sequence
  Synthetic oligonucleotide; TTG chr2 60472233 60472254 60472250 60472255 +
tgccagacagattgtgtcctca

SEQ ID NO: 196857 - DNA, 22 bp, Artificial Sequence
  Synthetic oligonucleotide; TTG chr2 60472247 60472268 60472264 60472269 +
tgtcctcactgcttccattaaa

SEQ ID NO: 196858 - DNA, 22 bp, Artificial Sequence
  Synthetic oligonucleotide; CTC chr2 60472254 60472275 60472271 60472276 +
actgcttccattaaagccgaca

SEQ ID NO: 196859 - DNA, 22 bp, Artificial Sequence
  Synthetic oligonucleotide; CTG chr2 60472258 60472279 60472275 60472280 +
cttccattaaagccgacatgtc

SEQ ID NO: 196860 - DNA, 22 bp, Artificial Sequence
  Synthetic oligonucleotide; CTT chr2 60472261 60472282 60472278 60472283 +
ccattaaagccgacatgtcagc

SEQ ID NO: 196861 - DNA, 22 bp, Artificial Sequence
  Synthetic oligonucleotide; TTC chr2 60472262 60472283 60472279 60472284 +
cattaaagccgacatgtcagcg

SEQ ID NO: 196862 - DNA, 22 bp, Artificial Sequence
  Synthetic oligonucleotide; TTA chr2 60472267 60472288 60472284 60472289 +
aagccgacatgtcagcgaacgc

SEQ ID NO: 196863 - DNA, 22 bp, Artificial Sequence
  Synthetic oligonucleotide; CTG chr2 60472294 60472315 60472311 60472316 +
tggcaactgcacggacacagca

SEQ ID NO: 196864 - DNA, 22 bp, Artificial Sequence
  Synthetic oligonucleotide; CTG chr2 60472303 60472324 60472320 60472325 +
cacggacacagcaggaactgga

SEQ ID NO: 196865 - DNA, 22 bp, Artificial Sequence
  Synthetic oligonucleotide; CTG chr2 60472323 60472344 60472340 60472345 +
gactcttgtttccctttctggt

SEQ ID NO: 196866 - DNA, 22 bp, Artificial Sequence
  Synthetic oligonucleotide; CTC chr2 60472328 60472349 60472345 60472350 +
ttgtttccctttctggtctctc

SEQ ID NO: 196867 - DNA, 22 bp, Artificial Sequence
  Synthetic oligonucleotide; CTT chr2 60472330 60472351 60472347 60472352 +
gtttccctttctggtctctcaa

SEQ ID NO: 196868 - DNA, 22 bp, Artificial Sequence
  Synthetic oligonucleotide; TTG chr2 60472331 60472352 60472348 60472353 +
tttccctttctggtctctcaaa

SEQ ID NO: 196869 - DNA, 22 bp, Artificial Sequence
  Synthetic oligonucleotide; TTT chr2 60472334 60472355 60472351 60472356 +
ccctttctggtctctcaaatgg

SEQ ID NO: 196870 - DNA, 22 bp, Artificial Sequence
  Synthetic oligonucleotide; TTC chr2 60472335 60472356 60472352 60472357 +
cctttctggtctctcaaatggg

SEQ ID NO: 196871 - DNA, 22 bp, Artificial Sequence
  Synthetic oligonucleotide; CTT chr2 60472339 60472360 60472356 60472361 +
tctggtctctcaaatgggacac

SEQ ID NO: 196872 - DNA, 22 bp, Artificial Sequence
  Synthetic oligonucleotide; TTT chr2 60472340 60472361 60472357 60472362 +
ctggtctctcaaatgggacaca

SEQ ID NO: 196873 - DNA, 22 bp, Artificial Sequence
  Synthetic oligonucleotide; TTC chr2 60472341 60472362 60472358 60472363 +
tggtctctcaaatgggacacat

SEQ ID NO: 196874 - DNA, 22 bp, Artificial Sequence
  Synthetic oligonucleotide; CTG chr2 60472343 60472364 60472360 60472365 +
gtctctcaaatgggacacattt

SEQ ID NO: 196875 - DNA, 22 bp, Artificial Sequence
  Synthetic oligonucleotide; CTC chr2 60472348 60472369 60472365 60472370 +
tcaaatgggacacatttccctt

SEQ ID NO: 196876 - DNA, 22 bp, Artificial Sequence
  Synthetic oligonucleotide; CTC chr2 60472350 60472371 60472367 60472372 +
aaatgggacacatttccctttt

SEQ ID NO: 196877 - DNA, 22 bp, Artificial Sequence
  Synthetic oligonucleotide; TTT chr2 60472365 60472386 60472382 60472387 +
cccttttctgactcaatctttt

SEQ ID NO: 196878 - DNA, 22 bp, Artificial Sequence
  Synthetic oligonucleotide; TTC chr2 60472366 60472387 60472383 60472388 +
ccttttctgactcaatcttttt

SEQ ID NO: 196879 - DNA, 22 bp, Artificial Sequence
  Synthetic oligonucleotide; CTT chr2 60472370 60472391 60472387 60472392 +
ttctgactcaatcttttttcaa

SEQ ID NO: 196880 - DNA, 22 bp, Artificial Sequence
  Synthetic oligonucleotide; TTT chr2 60472371 60472392 60472388 60472393 +
tctgactcaatcttttttcaaa

SEQ ID NO: 196881 - DNA, 22 bp, Artificial Sequence
  Synthetic oligonucleotide; TTT chr2 60472372 60472393 60472389 60472394 +
ctgactcaatcttttttcaaat

SEQ ID NO: 196882 - DNA, 22 bp, Artificial Sequence
  Synthetic oligonucleotide; TTC chr2 60472373 60472394 60472390 60472395 +
tgactcaatcttttttcaaatg

SEQ ID NO: 196883 - DNA, 22 bp, Artificial Sequence
  Synthetic oligonucleotide; CTG chr2 60472375 60472396 60472392 60472397 +
actcaatcttttttcaaatgtc

SEQ ID NO: 196884 - DNA, 22 bp, Artificial Sequence
  Synthetic oligonucleotide; CTC chr2 60472379 60472400 60472396 60472401 +
aatcttttttcaaatgtcttac

SEQ ID NO: 196885 - DNA, 22 bp, Artificial Sequence
  Synthetic oligonucleotide; CTT chr2 60472385 60472406 60472402 60472407 +
ttttcaaatgtcttacactttt

SEQ ID NO: 196886 - DNA, 22 bp, Artificial Sequence
  Synthetic oligonucleotide; TTT chr2 60472386 60472407 60472403 60472408 +
tttcaaatgtcttacacttttc

SEQ ID NO: 196887 - DNA, 22 bp, Artificial Sequence
  Synthetic oligonucleotide; TTT chr2 60472387 60472408 60472404 60472409 +
ttcaaatgtcttacacttttct

SEQ ID NO: 196888 - DNA, 22 bp, Artificial Sequence
  Synthetic oligonucleotide; TTT chr2 60472388 60472409 60472405 60472410 +
tcaaatgtcttacacttttctg

SEQ ID NO: 196889 - DNA, 22 bp, Artificial Sequence
  Synthetic oligonucleotide; TTT chr2 60472389 60472410 60472406 60472411 +
caaatgtcttacacttttctgg

SEQ ID NO: 196890 - DNA, 22 bp, Artificial Sequence
  Synthetic oligonucleotide; TTC chr2 60472390 60472411 60472407 60472412 +
aaatgtcttacacttttctggt

SEQ ID NO: 196891 - DNA, 22 bp, Artificial Sequence
  Synthetic oligonucleotide; CTT chr2 60472399 60472420 60472416 60472421 +
acacttttctggtggaaggtgt

SEQ ID NO: 196892 - DNA, 22 bp, Artificial Sequence
  Synthetic oligonucleotide; TTA chr2 60472400 60472421 60472417 60472422 +
cacttttctggtggaaggtgtt

SEQ ID NO: 196893 - DNA, 22 bp, Artificial Sequence
  Synthetic oligonucleotide; CTT chr2 60472405 60472426 60472422 60472427 +
ttctggtggaaggtgtttcaac

SEQ ID NO: 196894 - DNA, 22 bp, Artificial Sequence
  Synthetic oligonucleotide; TTT chr2 60472406 60472427 60472423 60472428 +
tctggtggaaggtgtttcaacc

SEQ ID NO: 196895 - DNA, 22 bp, Artificial Sequence
  Synthetic oligonucleotide; TTT chr2 60472407 60472428 60472424 60472429 +
ctggtggaaggtgtttcaacct

SEQ ID NO: 196896 - DNA, 22 bp, Artificial Sequence
  Synthetic oligonucleotide; TTC chr2 60472408 60472429 60472425 60472430 +
tggtggaaggtgtttcaacctg

SEQ ID NO: 196897 - DNA, 22 bp, Artificial Sequence
  Synthetic oligonucleotide; CTG chr2 60472410 60472431 60472427 60472432 +
gtggaaggtgtttcaacctgtt

SEQ ID NO: 196898 - DNA, 22 bp, Artificial Sequence
  Synthetic oligonucleotide; TTT chr2 60472423 60472444 60472440 60472445 +
caacctgttctatttcataaag

SEQ ID NO: 196899 - DNA, 22 bp, Artificial Sequence
  Synthetic oligonucleotide; TTC chr2 60472424 60472445 60472441 60472446 +
aacctgttctatttcataaagg

SEQ ID NO: 196900 - DNA, 22 bp, Artificial Sequence
  Synthetic oligonucleotide; CTG chr2 60472430 60472451 60472447 60472452 +
ttctatttcataaaggtctctc

SEQ ID NO: 196901 - DNA, 22 bp, Artificial Sequence
  Synthetic oligonucleotide; TTC chr2 60472433 60472454 60472450 60472455 +
tatttcataaaggtctctctag

SEQ ID NO: 196902 - DNA, 22 bp, Artificial Sequence
  Synthetic oligonucleotide; CTA chr2 60472435 60472456 60472452 60472457 +
tttcataaaggtctctctagac

SEQ ID NO: 196903 - DNA, 22 bp, Artificial Sequence
  Synthetic oligonucleotide; TTT chr2 60472438 60472459 60472455 60472460 +
cataaaggtctctctagaccca

SEQ ID NO: 196904 - DNA, 22 bp, Artificial Sequence
  Synthetic oligonucleotide; TTC chr2 60472439 60472460 60472456 60472461 +
ataaaggtctctctagacccag

SEQ ID NO: 196905 - DNA, 22 bp, Artificial Sequence
  Synthetic oligonucleotide; CTC chr2 60472450 60472471 60472467 60472472 +
tctagacccagtatttccactt

SEQ ID NO: 196906 - DNA, 22 bp, Artificial Sequence
  Synthetic oligonucleotide; CTC chr2 60472452 60472473 60472469 60472474 +
tagacccagtatttccacttgg

SEQ ID NO: 196907 - DNA, 22 bp, Artificial Sequence
  Synthetic oligonucleotide; CTA chr2 60472454 60472475 60472471 60472476 +
gacccagtatttccacttgggg

SEQ ID NO: 196908 - DNA, 22 bp, Artificial Sequence
  Synthetic oligonucleotide; TTT chr2 60472466 60472487 60472483 60472488 +
ccacttggggcctcagaaatgc

SEQ ID NO: 196909 - DNA, 22 bp, Artificial Sequence
  Synthetic oligonucleotide; TTC chr2 60472467 60472488 60472484 60472489 +
cacttggggcctcagaaatgcc

SEQ ID NO: 196910 - DNA, 22 bp, Artificial Sequence
  Synthetic oligonucleotide; CTT chr2 60472472 60472493 60472489 60472494 +
ggggcctcagaaatgccttaca

SEQ ID NO: 196911 - DNA, 22 bp, Artificial Sequence
  Synthetic oligonucleotide; TTG chr2 60472473 60472494 60472490 60472495 +
gggcctcagaaatgccttacac

SEQ ID NO: 196912 - DNA, 22 bp, Artificial Sequence
  Synthetic oligonucleotide; CTC chr2 60472480 60472501 60472497 60472502 +
agaaatgccttacacattatta

SEQ ID NO: 196913 - DNA, 22 bp, Artificial Sequence
  Synthetic oligonucleotide; CTT chr2 60472491 60472512 60472508 60472513 +
acacattattaggttgcaaagt

SEQ ID NO: 196914 - DNA, 22 bp, Artificial Sequence
  Synthetic oligonucleotide; TTA chr2 60472492 60472513 60472509 60472514 +
cacattattaggttgcaaagtt

SEQ ID NO: 196915 - DNA, 22 bp, Artificial Sequence
  Synthetic oligonucleotide; TTA chr2 60472499 60472520 60472516 60472521 +
ttaggttgcaaagtttccttat

SEQ ID NO: 196916 - DNA, 22 bp, Artificial Sequence
  Synthetic oligonucleotide; TTA chr2 60472502 60472523 60472519 60472524 +
ggttgcaaagtttccttatggc

SEQ ID NO: 196917 - DNA, 22 bp, Artificial Sequence
  Synthetic oligonucleotide; TTG chr2 60472507 60472528 60472524 60472529 +
caaagtttccttatggctgaat

SEQ ID NO: 196918 - DNA, 22 bp, Artificial Sequence
  Synthetic oligonucleotide; TTT chr2 60472515 60472536 60472532 60472537 +
ccttatggctgaatttaaaaat

SEQ ID NO: 196919 - DNA, 22 bp, Artificial Sequence
  Synthetic oligonucleotide; TTC chr2 60472516 60472537 60472533 60472538 +
cttatggctgaatttaaaaata

SEQ ID NO: 196920 - DNA, 22 bp, Artificial Sequence
  Synthetic oligonucleotide; CTT chr2 60472519 60472540 60472536 60472541 +
atggctgaatttaaaaatagtg

SEQ ID NO: 196921 - DNA, 22 bp, Artificial Sequence
  Synthetic oligonucleotide; TTA chr2 60472520 60472541 60472537 60472542 +
tggctgaatttaaaaatagtga

SEQ ID NO: 196922 - DNA, 22 bp, Artificial Sequence
  Synthetic oligonucleotide; CTG chr2 60472526 60472547 60472543 60472548 +
aatttaaaaatagtgactctta

SEQ ID NO: 196923 - DNA, 22 bp, Artificial Sequence
  Synthetic oligonucleotide; TTT chr2 60472531 60472552 60472548 60472553 +
aaaaatagtgactcttattttt

SEQ ID NO: 196924 - DNA, 22 bp, Artificial Sequence
  Synthetic oligonucleotide; TTA chr2 60472532 60472553 60472549 60472554 +
aaaatagtgactcttatttttc

SEQ ID NO: 196925 - DNA, 22 bp, Artificial Sequence
  Synthetic oligonucleotide; CTC chr2 60472545 60472566 60472562 60472567 +
ttatttttcaggtttcattaaa

SEQ ID NO: 196926 - DNA, 22 bp, Artificial Sequence
  Synthetic oligonucleotide; CTT chr2 60472547 60472568 60472564 60472569 +
atttttcaggtttcattaaaaa

SEQ ID NO: 196927 - DNA, 22 bp, Artificial Sequence
  Synthetic oligonucleotide; TTA chr2 60472548 60472569 60472565 60472570 +
tttttcaggtttcattaaaaaa

SEQ ID NO: 196928 - DNA, 22 bp, Artificial Sequence
  Synthetic oligonucleotide; TTT chr2 60472551 60472572 60472568 60472573 +
ttcaggtttcattaaaaaatat

SEQ ID NO: 196929 - DNA, 22 bp, Artificial Sequence
  Synthetic oligonucleotide; TTT chr2 60472552 60472573 60472569 60472574 +
tcaggtttcattaaaaaatatg

SEQ ID NO: 196930 - DNA, 22 bp, Artificial Sequence
  Synthetic oligonucleotide; TTT chr2 60472553 60472574 60472570 60472575 +
caggtttcattaaaaaatatgc

SEQ ID NO: 196931 - DNA, 22 bp, Artificial Sequence
  Synthetic oligonucleotide; TTC chr2 60472554 60472575 60472571 60472576 +
aggtttcattaaaaaatatgca

SEQ ID NO: 196932 - DNA, 22 bp, Artificial Sequence
  Synthetic oligonucleotide; TTT chr2 60472560 60472581 60472577 60472582 +
cattaaaaaatatgcagcaaac

SEQ ID NO: 196933 - DNA, 22 bp, Artificial Sequence
  Synthetic oligonucleotide; TTC chr2 60472561 60472582 60472578 60472583 +
attaaaaaatatgcagcaaact

SEQ ID NO: 196934 - DNA, 22 bp, Artificial Sequence
  Synthetic oligonucleotide; TTA chr2 60472565 60472586 60472582 60472587 +
aaaaatatgcagcaaactggga

SEQ ID NO: 196935 - DNA, 22 bp, Artificial Sequence
  Synthetic oligonucleotide; CTG chr2 60472584 60472605 60472601 60472606 +
ggaatggctttgatttaatgtt

SEQ ID NO: 196936 - DNA, 22 bp, Artificial Sequence
  Synthetic oligonucleotide; CTT chr2 60472594 60472615 60472611 60472616 +
tgatttaatgttatacatttgg

SEQ ID NO: 196937 - DNA, 22 bp, Artificial Sequence
  Synthetic oligonucleotide; TTT chr2 60472595 60472616 60472612 60472617 +
gatttaatgttatacatttggt

SEQ ID NO: 196938 - DNA, 22 bp, Artificial Sequence
  Synthetic oligonucleotide; TTG chr2 60472596 60472617 60472613 60472618 +
atttaatgttatacatttggtc

SEQ ID NO: 196939 - DNA, 22 bp, Artificial Sequence
  Synthetic oligonucleotide; TTT chr2 60472600 60472621 60472617 60472622 +
aatgttatacatttggtcactt

SEQ ID NO: 196940 - DNA, 22 bp, Artificial Sequence
  Synthetic oligonucleotide; TTA chr2 60472601 60472622 60472618 60472623 +
atgttatacatttggtcacttt

SEQ ID NO: 196941 - DNA, 22 bp, Artificial Sequence
  Synthetic oligonucleotide; TTA chr2 60472607 60472628 60472624 60472629 +
tacatttggtcactttacattt

SEQ ID NO: 196942 - DNA, 22 bp, Artificial Sequence
  Synthetic oligonucleotide; TTT chr2 60472614 60472635 60472631 60472636 +
ggtcactttacatttctacata

SEQ ID NO: 196943 - DNA, 22 bp, Artificial Sequence
  Synthetic oligonucleotide; TTG chr2 60472615 60472636 60472632 60472637 +
gtcactttacatttctacatat

SEQ ID NO: 196944 - DNA, 22 bp, Artificial Sequence
  Synthetic oligonucleotide; CTT chr2 60472622 60472643 60472639 60472644 +
tacatttctacatatattgggt

SEQ ID NO: 196945 - DNA, 22 bp, Artificial Sequence
  Synthetic oligonucleotide; TTT chr2 60472623 60472644 60472640 60472645 +
acatttctacatatattgggta

SEQ ID NO: 196946 - DNA, 22 bp, Artificial Sequence
  Synthetic oligonucleotide; TTA chr2 60472624 60472645 60472641 60472646 +
catttctacatatattgggtac

SEQ ID NO: 196947 - DNA, 22 bp, Artificial Sequence
  Synthetic oligonucleotide; TTT chr2 60472629 60472650 60472646 60472651 +
ctacatatattgggtaccaact

SEQ ID NO: 196948 - DNA, 22 bp, Artificial Sequence
  Synthetic oligonucleotide; TTC chr2 60472630 60472651 60472647 60472652 +
tacatatattgggtaccaactt

SEQ ID NO: 196949 - DNA, 22 bp, Artificial Sequence
  Synthetic oligonucleotide; CTA chr2 60472632 60472653 60472649 60472654 +
catatattgggtaccaactttt

SEQ ID NO: 196950 - DNA, 22 bp, Artificial Sequence
  Synthetic oligonucleotide; TTG chr2 60472641 60472662 60472658 60472663 +
ggtaccaacttttgacaaagag

SEQ ID NO: 196951 - DNA, 22 bp, Artificial Sequence
  Synthetic oligonucleotide; CTT chr2 60472652 60472673 60472669 60472674 +
ttgacaaagagctctaagccca

SEQ ID NO: 196952 - DNA, 22 bp, Artificial Sequence
  Synthetic oligonucleotide; TTT chr2 60472653 60472674 60472670 60472675 +
tgacaaagagctctaagcccag

SEQ ID NO: 196953 - DNA, 22 bp, Artificial Sequence
  Synthetic oligonucleotide; TTT chr2 60472654 60472675 60472671 60472676 +
gacaaagagctctaagcccagt

SEQ ID NO: 196954 - DNA, 22 bp, Artificial Sequence
  Synthetic oligonucleotide; TTG chr2 60472655 60472676 60472672 60472677 +
acaaagagctctaagcccagtg

SEQ ID NO: 196955 - DNA, 22 bp, Artificial Sequence
  Synthetic oligonucleotide; CTC chr2 60472666 60472687 60472683 60472688 +
taagcccagtgggatgttcctg

SEQ ID NO: 196956 - DNA, 22 bp, Artificial Sequence
  Synthetic oligonucleotide; CTA chr2 60472668 60472689 60472685 60472690 +
agcccagtgggatgttcctgga

SEQ ID NO: 196957 - DNA, 22 bp, Artificial Sequence
  Synthetic oligonucleotide; TTC chr2 60472685 60472706 60472702 60472707 +
ctggaatttaagtcattaaatc

SEQ ID NO: 196958 - DNA, 22 bp, Artificial Sequence
  Synthetic oligonucleotide; CTG chr2 60472688 60472709 60472705 60472710 +
gaatttaagtcattaaatcaag

SEQ ID NO: 196959 - DNA, 22 bp, Artificial Sequence
  Synthetic oligonucleotide; TTT chr2 60472694 60472715 60472711 60472716 +
aagtcattaaatcaagtttttt

SEQ ID NO: 196960 - DNA, 22 bp, Artificial Sequence
  Synthetic oligonucleotide; TTA chr2 60472695 60472716 60472712 60472717 +
agtcattaaatcaagttttttg

SEQ ID NO: 196961 - DNA, 22 bp, Artificial Sequence
  Synthetic oligonucleotide; TTA chr2 60472703 60472724 60472720 60472725 +
aatcaagttttttggtttcctc

SEQ ID NO: 196962 - DNA, 22 bp, Artificial Sequence
  Synthetic oligonucleotide; TTT chr2 60472713 60472734 60472730 60472735 +
tttggtttcctcaagaacatct

SEQ ID NO: 196963 - DNA, 22 bp, Artificial Sequence
  Synthetic oligonucleotide; TTT chr2 60472714 60472735 60472731 60472736 +
ttggtttcctcaagaacatctc

SEQ ID NO: 196964 - DNA, 22 bp, Artificial Sequence
  Synthetic oligonucleotide; TTT chr2 60472715 60472736 60472732 60472737 +
tggtttcctcaagaacatctca

SEQ ID NO: 196965 - DNA, 22 bp, Artificial Sequence
  Synthetic oligonucleotide; TTT chr2 60472716 60472737 60472733 60472738 +
ggtttcctcaagaacatctcaa

SEQ ID NO: 196966 - DNA, 22 bp, Artificial Sequence
  Synthetic oligonucleotide; TTG chr2 60472717 60472738 60472734 60472739 +
gtttcctcaagaacatctcaaa

SEQ ID NO: 196967 - DNA, 22 bp, Artificial Sequence
  Synthetic oligonucleotide; TTT chr2 60472721 60472742 60472738 60472743 +
cctcaagaacatctcaaagatt

SEQ ID NO: 196968 - DNA, 22 bp, Artificial Sequence
  Synthetic oligonucleotide; TTC chr2 60472722 60472743 60472739 60472744 +
ctcaagaacatctcaaagattc

SEQ ID NO: 196969 - DNA, 22 bp, Artificial Sequence
  Synthetic oligonucleotide; CTC chr2 60472725 60472746 60472742 60472747 +
aagaacatctcaaagattcctt

SEQ ID NO: 196970 - DNA, 22 bp, Artificial Sequence
  Synthetic oligonucleotide; CTC chr2 60472736 60472757 60472753 60472758 +
aaagattccttgactattaaca

SEQ ID NO: 196971 - DNA, 22 bp, Artificial Sequence
  Synthetic oligonucleotide; TTC chr2 60472744 60472765 60472761 60472766 +
cttgactattaacatgctattt

SEQ ID NO: 196972 - DNA, 22 bp, Artificial Sequence
  Synthetic oligonucleotide; CTT chr2 60472747 60472768 60472764 60472769 +
gactattaacatgctatttgtt

SEQ ID NO: 196973 - DNA, 22 bp, Artificial Sequence
  Synthetic oligonucleotide; TTG chr2 60472748 60472769 60472765 60472770 +
actattaacatgctatttgttt

SEQ ID NO: 196974 - DNA, 22 bp, Artificial Sequence
  Synthetic oligonucleotide; CTA chr2 60472752 60472773 60472769 60472774 +
ttaacatgctatttgtttctga

SEQ ID NO: 196975 - DNA, 22 bp, Artificial Sequence
  Synthetic oligonucleotide; TTA chr2 60472755 60472776 60472772 60472777 +
acatgctatttgtttctgaaac

SEQ ID NO: 196976 - DNA, 22 bp, Artificial Sequence
  Synthetic oligonucleotide; CTA chr2 60472763 60472784 60472780 60472785 +
tttgtttctgaaactaatcact

SEQ ID NO: 196977 - DNA, 22 bp, Artificial Sequence
  Synthetic oligonucleotide; TTT chr2 60472766 60472787 60472783 60472788 +
gtttctgaaactaatcactggg

SEQ ID NO: 196978 - DNA, 22 bp, Artificial Sequence
  Synthetic oligonucleotide; TTG chr2 60472767 60472788 60472784 60472789 +
tttctgaaactaatcactgggt

SEQ ID NO: 196979 - DNA, 22 bp, Artificial Sequence
  Synthetic oligonucleotide; TTT chr2 60472770 60472791 60472787 60472792 +
ctgaaactaatcactgggtgtg

SEQ ID NO: 196980 - DNA, 22 bp, Artificial Sequence
  Synthetic oligonucleotide; TTC chr2 60472771 60472792 60472788 60472793 +
tgaaactaatcactgggtgtgt

SEQ ID NO: 196981 - DNA, 22 bp, Artificial Sequence
  Synthetic oligonucleotide; CTG chr2 60472773 60472794 60472790 60472795 +
aaactaatcactgggtgtgtaa

SEQ ID NO: 196982 - DNA, 22 bp, Artificial Sequence
  Synthetic oligonucleotide; CTA chr2 60472779 60472800 60472796 60472801 +
atcactgggtgtgtaatacagc

SEQ ID NO: 196983 - DNA, 22 bp, Artificial Sequence
  Synthetic oligonucleotide; CTG chr2 60472786 60472807 60472803 60472808 +
ggtgtgtaatacagccacatta

SEQ ID NO: 196984 - DNA, 22 bp, Artificial Sequence
  Synthetic oligonucleotide; TTA chr2 60472808 60472829 60472825 60472830 +
ctgtctactaatcaacaggtaa

SEQ ID NO: 196985 - DNA, 22 bp, Artificial Sequence
  Synthetic oligonucleotide; CTG chr2 60472811 60472832 60472828 60472833 +
tctactaatcaacaggtaatac

SEQ ID NO: 196986 - DNA, 22 bp, Artificial Sequence
  Synthetic oligonucleotide; CTA chr2 60472815 60472836 60472832 60472837 +
ctaatcaacaggtaatactgca

SEQ ID NO: 196987 - DNA, 22 bp, Artificial Sequence
  Synthetic oligonucleotide; CTA chr2 60472818 60472839 60472835 60472840 +
atcaacaggtaatactgcagat

SEQ ID NO: 196988 - DNA, 22 bp, Artificial Sequence
  Synthetic oligonucleotide; CTG chr2 60472835 60472856 60472852 60472857 +
cagatttccaaatgtgccaaaa

SEQ ID NO: 196989 - DNA, 22 bp, Artificial Sequence
  Synthetic oligonucleotide; TTT chr2 60472842 60472863 60472859 60472864 +
ccaaatgtgccaaaacagctaa

SEQ ID NO: 196990 - DNA, 22 bp, Artificial Sequence
  Synthetic oligonucleotide; TTC chr2 60472843 60472864 60472860 60472865 +
caaatgtgccaaaacagctaag

SEQ ID NO: 196991 - DNA, 22 bp, Artificial Sequence
  Synthetic oligonucleotide; CTA chr2 60472863 60472884 60472880 60472885 +
agcaaaaagcatcattccaaca

SEQ ID NO: 196992 - DNA, 22 bp, Artificial Sequence
  Synthetic oligonucleotide; TTC chr2 60472880 60472901 60472897 60472902 +
caacacgtttaatgactgcttt

SEQ ID NO: 196993 - DNA, 22 bp, Artificial Sequence
  Synthetic oligonucleotide; TTT chr2 60472890 60472911 60472907 60472912 +
aatgactgctttgggagcccaa

SEQ ID NO: 196994 - DNA, 22 bp, Artificial Sequence
  Synthetic oligonucleotide; TTA chr2 60472891 60472912 60472908 60472913 +
atgactgctttgggagcccaac

SEQ ID NO: 196995 - DNA, 22 bp, Artificial Sequence
  Synthetic oligonucleotide; CTG chr2 60472898 60472919 60472915 60472920 +
ctttgggagcccaactttaaca

SEQ ID NO: 196996 - DNA, 22 bp, Artificial Sequence
  Synthetic oligonucleotide; CTT chr2 60472901 60472922 60472918 60472923 +
tgggagcccaactttaacaggt

SEQ ID NO: 196997 - DNA, 22 bp, Artificial Sequence
  Synthetic oligonucleotide; TTT chr2 60472902 60472923 60472919 60472924 +
gggagcccaactttaacaggta

SEQ ID NO: 196998 - DNA, 22 bp, Artificial Sequence
  Synthetic oligonucleotide; TTG chr2 60472903 60472924 60472920 60472925 +
ggagcccaactttaacaggtat

SEQ ID NO: 196999 - DNA, 22 bp, Artificial Sequence
  Synthetic oligonucleotide; CTT chr2 60472915 60472936 60472932 60472937 +
taacaggtattaaaaccacagg

SEQ ID NO: 197000 - DNA, 22 bp, Artificial Sequence
  Synthetic oligonucleotide; TTT chr2 60472916 60472937 60472933 60472938 +
aacaggtattaaaaccacagga

SEQ ID NO: 197001 - DNA, 22 bp, Artificial Sequence
  Synthetic oligonucleotide; TTA chr2 60472917 60472938 60472934 60472939 +
acaggtattaaaaccacaggac

SEQ ID NO: 197002 - DNA, 22 bp, Artificial Sequence
  Synthetic oligonucleotide; TTA chr2 60472927 60472948 60472944 60472949 +
aaaccacaggactctccacagg

SEQ ID NO: 197003 - DNA, 22 bp, Artificial Sequence
  Synthetic oligonucleotide; CTC chr2 60472941 60472962 60472958 60472963 +
tccacaggagtacatagatgtg

SEQ ID NO: 197004 - DNA, 22 bp, Artificial Sequence
  Synthetic oligonucleotide; CTC chr2 60472943 60472964 60472960 60472965 +
cacaggagtacatagatgtgtg

SEQ ID NO: 197005 - DNA, 22 bp, Artificial Sequence
  Synthetic oligonucleotide; CTA chr2 60472968 60472989 60472985 60472990 +
ttcactaaaatgtacgtgtgtg

SEQ ID NO: 197006 - DNA, 22 bp, Artificial Sequence
  Synthetic oligonucleotide; TTC chr2 60472971 60472992 60472988 60472993 +
actaaaatgtacgtgtgtgtgt

SEQ ID NO: 197007 - DNA, 22 bp, Artificial Sequence
  Synthetic oligonucleotide; CTA chr2 60472975 60472996 60472992 60472997 +
aaatgtacgtgtgtgtgtgttt

SEQ ID NO: 197008 - DNA, 22 bp, Artificial Sequence
  Synthetic oligonucleotide; TTT chr2 60472997 60473018 60473014 60473019 +
gcaagcatttatgtgtacatat

SEQ ID NO: 197009 - DNA, 22 bp, Artificial Sequence
  Synthetic oligonucleotide; TTG chr2 60472998 60473019 60473015 60473020 +
caagcatttatgtgtacatatg

SEQ ID NO: 197010 - DNA, 22 bp, Artificial Sequence
  Synthetic oligonucleotide; TTT chr2 60473007 60473028 60473024 60473029 +
atgtgtacatatgtgtgttagc

SEQ ID NO: 197011 - DNA, 22 bp, Artificial Sequence
  Synthetic oligonucleotide; TTA chr2 60473008 60473029 60473025 60473030 +
tgtgtacatatgtgtgttagcg

SEQ ID NO: 197012 - DNA, 22 bp, Artificial Sequence
  Synthetic oligonucleotide; TTA chr2 60473027 60473048 60473044 60473049 +
gcgtgtgcatgcatatgtgttt

SEQ ID NO: 197013 - DNA, 22 bp, Artificial Sequence
  Synthetic oligonucleotide; TTT chr2 60473049 60473070 60473066 60473071 +
gtgagcatgtgcatgtgtgtat

SEQ ID NO: 197014 - DNA, 22 bp, Artificial Sequence
  Synthetic oligonucleotide; TTG chr2 60473050 60473071 60473067 60473072 +
tgagcatgtgcatgtgtgtata

SEQ ID NO: 197015 - DNA, 22 bp, Artificial Sequence
  Synthetic oligonucleotide; TTG chr2 60473075 60473096 60473092 60473097 +
tgactgtgtgcatgtgtgtgta

SEQ ID NO: 197016 - DNA, 22 bp, Artificial Sequence
  Synthetic oligonucleotide; CTG chr2 60473081 60473102 60473098 60473103 +
tgtgcatgtgtgtgtatgcttg

SEQ ID NO: 197017 - DNA, 22 bp, Artificial Sequence
  Synthetic oligonucleotide; CTT chr2 60473102 60473123 60473119 60473124 +
gtgcatgtgttagcatgtgcat

SEQ ID NO: 197018 - DNA, 22 bp, Artificial Sequence
  Synthetic oligonucleotide; TTG chr2 60473103 60473124 60473120 60473125 +
tgcatgtgttagcatgtgcatg

SEQ ID NO: 197019 - DNA, 22 bp, Artificial Sequence
  Synthetic oligonucleotide; TTA chr2 60473114 60473135 60473131 60473136 +
gcatgtgcatgcacatgtgtgt

SEQ ID NO: 197020 - DNA, 22 bp, Artificial Sequence
  Synthetic oligonucleotide; TTA chr2 60473138 60473159 60473155 60473160 +
gcgtgttcatgtgtgtgtatat

SEQ ID NO: 197021 - DNA, 22 bp, Artificial Sequence
  Synthetic oligonucleotide; TTC chr2 60473146 60473167 60473163 60473168 +
atgtgtgtgtatatgtgagtgt

SEQ ID NO: 197022 - DNA, 22 bp, Artificial Sequence
  Synthetic oligonucleotide; CTG chr2 60473183 60473204 60473200 60473205 +
tgtacgtgtgtgaatgtgtgta

SEQ ID NO: 197023 - DNA, 22 bp, Artificial Sequence
  Synthetic oligonucleotide; TTT chr2 60473210 60473231 60473227 60473232 +
cctaaacatatgtttttagata

SEQ ID NO: 197024 - DNA, 22 bp, Artificial Sequence
  Synthetic oligonucleotide; TTC chr2 60473211 60473232 60473228 60473233 +
ctaaacatatgtttttagataa

SEQ ID NO: 197025 - DNA, 22 bp, Artificial Sequence
  Synthetic oligonucleotide; CTA chr2 60473214 60473235 60473231 60473236 +
aacatatgtttttagataattt

SEQ ID NO: 197026 - DNA, 22 bp, Artificial Sequence
  Synthetic oligonucleotide; TTT chr2 60473225 60473246 60473242 60473247 +
ttagataatttccctgtttttt

SEQ ID NO: 197027 - DNA, 22 bp, Artificial Sequence
  Synthetic oligonucleotide; TTT chr2 60473226 60473247 60473243 60473248 +
tagataatttccctgttttttt

SEQ ID NO: 197028 - DNA, 22 bp, Artificial Sequence
  Synthetic oligonucleotide; TTT chr2 60473227 60473248 60473244 60473249 +
agataatttccctgtttttttt

SEQ ID NO: 197029 - DNA, 22 bp, Artificial Sequence
  Synthetic oligonucleotide; TTA chr2 60473228 60473249 60473245 60473250 +
gataatttccctgttttttttt

SEQ ID NO: 197030 - DNA, 22 bp, Artificial Sequence
  Synthetic oligonucleotide; TTT chr2 60473236 60473257 60473253 60473258 +
ccctgtttttttttttttttca

SEQ ID NO: 197031 - DNA, 22 bp, Artificial Sequence
  Synthetic oligonucleotide; TTC chr2 60473237 60473258 60473254 60473259 +
cctgtttttttttttttttcag

SEQ ID NO: 197032 - DNA, 22 bp, Artificial Sequence
  Synthetic oligonucleotide; CTG chr2 60473241 60473262 60473258 60473263 +
tttttttttttttttcagtgag

SEQ ID NO: 197033 - DNA, 22 bp, Artificial Sequence
  Synthetic oligonucleotide; TTT chr2 60473244 60473265 60473261 60473266 +
ttttttttttttcagtgagaca

SEQ ID NO: 197034 - DNA, 22 bp, Artificial Sequence
  Synthetic oligonucleotide; TTT chr2 60473245 60473266 60473262 60473267 +
tttttttttttcagtgagacag

SEQ ID NO: 197035 - DNA, 22 bp, Artificial Sequence
  Synthetic oligonucleotide; TTT chr2 60473246 60473267 60473263 60473268 +
ttttttttttcagtgagacagg

SEQ ID NO: 197036 - DNA, 22 bp, Artificial Sequence
  Synthetic oligonucleotide; TTT chr2 60473247 60473268 60473264 60473269 +
tttttttttcagtgagacaggc

SEQ ID NO: 197037 - DNA, 22 bp, Artificial Sequence
  Synthetic oligonucleotide; TTT chr2 60473248 60473269 60473265 60473270 +
ttttttttcagtgagacaggca

SEQ ID NO: 197038 - DNA, 22 bp, Artificial Sequence
  Synthetic oligonucleotide; TTT chr2 60473249 60473270 60473266 60473271 +
tttttttcagtgagacaggcac

SEQ ID NO: 197039 - DNA, 22 bp, Artificial Sequence
  Synthetic oligonucleotide; TTT chr2 60473250 60473271 60473267 60473272 +
ttttttcagtgagacaggcaca

SEQ ID NO: 197040 - DNA, 22 bp, Artificial Sequence
  Synthetic oligonucleotide; TTT chr2 60473251 60473272 60473268 60473273 +
tttttcagtgagacaggcacaa

SEQ ID NO: 197041 - DNA, 22 bp, Artificial Sequence
  Synthetic oligonucleotide; TTT chr2 60473252 60473273 60473269 60473274 +
ttttcagtgagacaggcacaaa

SEQ ID NO: 197042 - DNA, 22 bp, Artificial Sequence
  Synthetic oligonucleotide; TTT chr2 60473253 60473274 60473270 60473275 +
tttcagtgagacaggcacaaaa

SEQ ID NO: 197043 - DNA, 22 bp, Artificial Sequence
  Synthetic oligonucleotide; TTT chr2 60473254 60473275 60473271 60473276 +
ttcagtgagacaggcacaaaag

SEQ ID NO: 197044 - DNA, 22 bp, Artificial Sequence
  Synthetic oligonucleotide; TTT chr2 60473255 60473276 60473272 60473277 +
tcagtgagacaggcacaaaagc

SEQ ID NO: 197045 - DNA, 22 bp, Artificial Sequence
  Synthetic oligonucleotide; TTT chr2 60473256 60473277 60473273 60473278 +
cagtgagacaggcacaaaagca

SEQ ID NO: 197046 - DNA, 22 bp, Artificial Sequence
  Synthetic oligonucleotide; TTC chr2 60473257 60473278 60473274 60473279 +
agtgagacaggcacaaaagcag

SEQ ID NO: 197047 - DNA, 22 bp, Artificial Sequence
  Synthetic oligonucleotide; CTG chr2 60473287 60473308 60473304 60473309 +
tcccacgtggaatgggctatct

SEQ ID NO: 197048 - DNA, 22 bp, Artificial Sequence
  Synthetic oligonucleotide; CTA chr2 60473306 60473327 60473323 60473328 +
tctcgtgacactgtgaccccct

SEQ ID NO: 197049 - DNA, 22 bp, Artificial Sequence
  Synthetic oligonucleotide; CTC chr2 60473310 60473331 60473327 60473332 +
gtgacactgtgaccccctttct

SEQ ID NO: 197050 - DNA, 22 bp, Artificial Sequence
  Synthetic oligonucleotide; CTG chr2 60473319 60473340 60473336 60473341 +
tgaccccctttctttcaccctg

SEQ ID NO: 197051 - DNA, 22 bp, Artificial Sequence
  Synthetic oligonucleotide; CTT chr2 60473329 60473350 60473346 60473351 +
tctttcaccctgggtcttcaaa

SEQ ID NO: 197052 - DNA, 22 bp, Artificial Sequence
  Synthetic oligonucleotide; TTT chr2 60473330 60473351 60473347 60473352 +
ctttcaccctgggtcttcaaaa

SEQ ID NO: 197053 - DNA, 22 bp, Artificial Sequence
  Synthetic oligonucleotide; TTC chr2 60473331 60473352 60473348 60473353 +
tttcaccctgggtcttcaaaaa

SEQ ID NO: 197054 - DNA, 22 bp, Artificial Sequence
  Synthetic oligonucleotide; CTT chr2 60473333 60473354 60473350 60473355 +
tcaccctgggtcttcaaaaaga

SEQ ID NO: 197055 - DNA, 22 bp, Artificial Sequence
  Synthetic oligonucleotide; TTT chr2 60473334 60473355 60473351 60473356 +
caccctgggtcttcaaaaagag

SEQ ID NO: 197056 - DNA, 22 bp, Artificial Sequence
  Synthetic oligonucleotide; TTC chr2 60473335 60473356 60473352 60473357 +
accctgggtcttcaaaaagaga

SEQ ID NO: 197057 - DNA, 22 bp, Artificial Sequence
  Synthetic oligonucleotide; CTG chr2 60473341 60473362 60473358 60473363 +
ggtcttcaaaaagagaatggat

SEQ ID NO: 197058 - DNA, 22 bp, Artificial Sequence
  Synthetic oligonucleotide; CTT chr2 60473347 60473368 60473364 60473369 +
caaaaagagaatggatgacact

SEQ ID NO: 197059 - DNA, 22 bp, Artificial Sequence
  Synthetic oligonucleotide; TTC chr2 60473348 60473369 60473365 60473370 +
aaaaagagaatggatgacacta

SEQ ID NO: 197060 - DNA, 22 bp, Artificial Sequence
  Synthetic oligonucleotide; CTA chr2 60473370 60473391 60473387 60473392 +
tgatgaggaggggtctctatat

SEQ ID NO: 197061 - DNA, 22 bp, Artificial Sequence
  Synthetic oligonucleotide; CTC chr2 60473387 60473408 60473404 60473409 +
tatattggtgacaggccaaaat

SEQ ID NO: 197062 - DNA, 22 bp, Artificial Sequence
  Synthetic oligonucleotide; CTA chr2 60473389 60473410 60473406 60473411 +
tattggtgacaggccaaaatac

SEQ ID NO: 197063 - DNA, 22 bp, Artificial Sequence
  Synthetic oligonucleotide; TTG chr2 60473394 60473415 60473411 60473416 +
gtgacaggccaaaatacaggac

SEQ ID NO: 197064 - DNA, 22 bp, Artificial Sequence
  Synthetic oligonucleotide; CTA chr2 60473418 60473439 60473435 60473440 +
cctacagtcctttcgcagtcca

SEQ ID NO: 197065 - DNA, 22 bp, Artificial Sequence
  Synthetic oligonucleotide; CTA chr2 60473422 60473443 60473439 60473444 +
cagtcctttcgcagtccataat

SEQ ID NO: 197066 - DNA, 22 bp, Artificial Sequence
  Synthetic oligonucleotide; CTT chr2 60473430 60473451 60473447 60473452 +
tcgcagtccataatcctcaagt

SEQ ID NO: 197067 - DNA, 22 bp, Artificial Sequence
  Synthetic oligonucleotide; TTT chr2 60473431 60473452 60473448 60473453 +
cgcagtccataatcctcaagtc

SEQ ID NO: 197068 - DNA, 22 bp, Artificial Sequence
  Synthetic oligonucleotide; TTC chr2 60473432 60473453 60473449 60473454 +
gcagtccataatcctcaagtcc

SEQ ID NO: 197069 - DNA, 22 bp, Artificial Sequence
  Synthetic oligonucleotide; CTC chr2 60473448 60473469 60473465 60473470 +
aagtccctcagctcttccatgt

SEQ ID NO: 197070 - DNA, 22 bp, Artificial Sequence
  Synthetic oligonucleotide; CTC chr2 60473457 60473478 60473474 60473479 +
agctcttccatgtaccaccttc

SEQ ID NO: 197071 - DNA, 22 bp, Artificial Sequence
  Synthetic oligonucleotide; CTC chr2 60473462 60473483 60473479 60473484 +
ttccatgtaccaccttctagac

SEQ ID NO: 197072 - DNA, 22 bp, Artificial Sequence
  Synthetic oligonucleotide; CTT chr2 60473464 60473485 60473481 60473486 +
ccatgtaccaccttctagacta

SEQ ID NO: 197073 - DNA, 22 bp, Artificial Sequence
  Synthetic oligonucleotide; TTC chr2 60473465 60473486 60473482 60473487 +
catgtaccaccttctagactac

SEQ ID NO: 197074 - DNA, 22 bp, Artificial Sequence
  Synthetic oligonucleotide; CTT chr2 60473478 60473499 60473495 60473500 +
ctagactacacttaaaatgcat

SEQ ID NO: 197075 - DNA, 22 bp, Artificial Sequence
  Synthetic oligonucleotide; TTC chr2 60473479 60473500 60473496 60473501 +
tagactacacttaaaatgcatc

SEQ ID NO: 197076 - DNA, 22 bp, Artificial Sequence
  Synthetic oligonucleotide; CTA chr2 60473481 60473502 60473498 60473503 +
gactacacttaaaatgcatcct

SEQ ID NO: 197077 - DNA, 22 bp, Artificial Sequence
  Synthetic oligonucleotide; CTA chr2 60473486 60473507 60473503 60473508 +
cacttaaaatgcatcctgaacg

SEQ ID NO: 197078 - DNA, 22 bp, Artificial Sequence
  Synthetic oligonucleotide; CTT chr2 60473491 60473512 60473508 60473513 +
aaaatgcatcctgaacgtttgt

SEQ ID NO: 197079 - DNA, 22 bp, Artificial Sequence
  Synthetic oligonucleotide; TTA chr2 60473492 60473513 60473509 60473514 +
aaatgcatcctgaacgtttgta

SEQ ID NO: 197080 - DNA, 22 bp, Artificial Sequence
  Synthetic oligonucleotide; CTG chr2 60473504 60473525 60473521 60473526 +
aacgtttgtaaagtaccctgaa

SEQ ID NO: 197081 - DNA, 22 bp, Artificial Sequence
  Synthetic oligonucleotide; TTT chr2 60473511 60473532 60473528 60473533 +
gtaaagtaccctgaaggaaccc

SEQ ID NO: 197082 - DNA, 22 bp, Artificial Sequence
  Synthetic oligonucleotide; TTG chr2 60473512 60473533 60473529 60473534 +
taaagtaccctgaaggaaccca

SEQ ID NO: 197083 - DNA, 22 bp, Artificial Sequence
  Synthetic oligonucleotide; CTG chr2 60473524 60473545 60473541 60473546 +
aaggaacccattccagttctga

SEQ ID NO: 197084 - DNA, 22 bp, Artificial Sequence
  Synthetic oligonucleotide; TTC chr2 60473537 60473558 60473554 60473559 +
cagttctgaatccgattactag

SEQ ID NO: 197085 - DNA, 22 bp, Artificial Sequence
  Synthetic oligonucleotide; TTC chr2 60473543 60473564 60473560 60473565 +
tgaatccgattactaggttcaa

SEQ ID NO: 197086 - DNA, 22 bp, Artificial Sequence
  Synthetic oligonucleotide; CTG chr2 60473545 60473566 60473562 60473567 +
aatccgattactaggttcaagc

SEQ ID NO: 197087 - DNA, 22 bp, Artificial Sequence
  Synthetic oligonucleotide; TTA chr2 60473555 60473576 60473572 60473577 +
ctaggttcaagccacacaaata

SEQ ID NO: 197088 - DNA, 22 bp, Artificial Sequence
  Synthetic oligonucleotide; CTA chr2 60473558 60473579 60473575 60473580 +
ggttcaagccacacaaataaca

SEQ ID NO: 197089 - DNA, 22 bp, Artificial Sequence
  Synthetic oligonucleotide; TTC chr2 60473563 60473584 60473580 60473585 +
aagccacacaaataacaacagt

SEQ ID NO: 197090 - DNA, 22 bp, Artificial Sequence
  Synthetic oligonucleotide; CTA chr2 60473592 60473613 60473609 60473614 +
gtctgagctagaggcttcttta

SEQ ID NO: 197091 - DNA, 22 bp, Artificial Sequence
  Synthetic oligonucleotide; CTG chr2 60473597 60473618 60473614 60473619 +
agctagaggcttctttacctaa

SEQ ID NO: 197092 - DNA, 22 bp, Artificial Sequence
  Synthetic oligonucleotide; CTA chr2 60473602 60473623 60473619 60473624 +
gaggcttctttacctaactgca

SEQ ID NO: 197093 - DNA, 22 bp, Artificial Sequence
  Synthetic oligonucleotide; CTT chr2 60473609 60473630 60473626 60473631 +
ctttacctaactgcaaagtaaa

SEQ ID NO: 197094 - DNA, 22 bp, Artificial Sequence
  Synthetic oligonucleotide; TTC chr2 60473610 60473631 60473627 60473632 +
tttacctaactgcaaagtaaat

SEQ ID NO: 197095 - DNA, 22 bp, Artificial Sequence
  Synthetic oligonucleotide; CTT chr2 60473612 60473633 60473629 60473634 +
tacctaactgcaaagtaaatgt

SEQ ID NO: 197096 - DNA, 22 bp, Artificial Sequence
  Synthetic oligonucleotide; TTT chr2 60473613 60473634 60473630 60473635 +
acctaactgcaaagtaaatgtc

SEQ ID NO: 197097 - DNA, 22 bp, Artificial Sequence
  Synthetic oligonucleotide; TTA chr2 60473614 60473635 60473631 60473636 +
cctaactgcaaagtaaatgtcc

SEQ ID NO: 197098 - DNA, 22 bp, Artificial Sequence
  Synthetic oligonucleotide; CTA chr2 60473618 60473639 60473635 60473640 +
actgcaaagtaaatgtcctttc

SEQ ID NO: 197099 - DNA, 22 bp, Artificial Sequence
  Synthetic oligonucleotide; CTG chr2 60473622 60473643 60473639 60473644 +
caaagtaaatgtcctttctatt

SEQ ID NO: 197100 - DNA, 22 bp, Artificial Sequence
  Synthetic oligonucleotide; CTT chr2 60473638 60473659 60473655 60473660 +
tctattcagccgcatctagctc

SEQ ID NO: 197101 - DNA, 22 bp, Artificial Sequence
  Synthetic oligonucleotide; TTT chr2 60473639 60473660 60473656 60473661 +
ctattcagccgcatctagctct

SEQ ID NO: 197102 - DNA, 22 bp, Artificial Sequence
  Synthetic oligonucleotide; TTC chr2 60473640 60473661 60473657 60473662 +
tattcagccgcatctagctctt

SEQ ID NO: 197103 - DNA, 22 bp, Artificial Sequence
  Synthetic oligonucleotide; CTA chr2 60473642 60473663 60473659 60473664 +
ttcagccgcatctagctcttga

SEQ ID NO: 197104 - DNA, 22 bp, Artificial Sequence
  Synthetic oligonucleotide; TTC chr2 60473645 60473666 60473662 60473667 +
agccgcatctagctcttgaccc

SEQ ID NO: 197105 - DNA, 22 bp, Artificial Sequence
  Synthetic oligonucleotide; CTA chr2 60473656 60473677 60473673 60473678 +
gctcttgaccctatgtttacca

SEQ ID NO: 197106 - DNA, 22 bp, Artificial Sequence
  Synthetic oligonucleotide; CTC chr2 60473660 60473681 60473677 60473682 +
ttgaccctatgtttaccataga

SEQ ID NO: 197107 - DNA, 22 bp, Artificial Sequence
  Synthetic oligonucleotide; CTT chr2 60473662 60473683 60473679 60473684 +
gaccctatgtttaccatagata

SEQ ID NO: 197108 - DNA, 22 bp, Artificial Sequence
  Synthetic oligonucleotide; TTG chr2 60473663 60473684 60473680 60473685 +
accctatgtttaccatagatac

SEQ ID NO: 197109 - DNA, 22 bp, Artificial Sequence
  Synthetic oligonucleotide; CTA chr2 60473669 60473690 60473686 60473691 +
tgtttaccatagataccagttc

SEQ ID NO: 197110 - DNA, 22 bp, Artificial Sequence
  Synthetic oligonucleotide; TTT chr2 60473674 60473695 60473691 60473696 +
accatagataccagttcttctc

SEQ ID NO: 197111 - DNA, 22 bp, Artificial Sequence
  Synthetic oligonucleotide; TTA chr2 60473675 60473696 60473692 60473697 +
ccatagataccagttcttctca

SEQ ID NO: 197112 - DNA, 22 bp, Artificial Sequence
  Synthetic oligonucleotide; TTC chr2 60473691 60473712 60473708 60473713 +
ttctcacttagattctctgact

SEQ ID NO: 197113 - DNA, 22 bp, Artificial Sequence
  Synthetic oligonucleotide; CTT chr2 60473693 60473714 60473710 60473715 +
ctcacttagattctctgactta

SEQ ID NO: 197114 - DNA, 22 bp, Artificial Sequence
  Synthetic oligonucleotide; TTC chr2 60473694 60473715 60473711 60473716 +
tcacttagattctctgacttat

SEQ ID NO: 197115 - DNA, 22 bp, Artificial Sequence
  Synthetic oligonucleotide; CTC chr2 60473696 60473717 60473713 60473718 +
acttagattctctgacttatca

SEQ ID NO: 197116 - DNA, 22 bp, Artificial Sequence
  Synthetic oligonucleotide; CTT chr2 60473700 60473721 60473717 60473722 +
agattctctgacttatcagagt

SEQ ID NO: 197117 - DNA, 22 bp, Artificial Sequence
  Synthetic oligonucleotide; TTA chr2 60473701 60473722 60473718 60473723 +
gattctctgacttatcagagta

SEQ ID NO: 197118 - DNA, 22 bp, Artificial Sequence
  Synthetic oligonucleotide; TTC chr2 60473706 60473727 60473723 60473728 +
tctgacttatcagagtattata

SEQ ID NO: 197119 - DNA, 22 bp, Artificial Sequence
  Synthetic oligonucleotide; CTC chr2 60473708 60473729 60473725 60473730 +
tgacttatcagagtattataga

SEQ ID NO: 197120 - DNA, 22 bp, Artificial Sequence
  Synthetic oligonucleotide; CTG chr2 60473710 60473731 60473727 60473732 +
acttatcagagtattatagagc

SEQ ID NO: 197121 - DNA, 22 bp, Artificial Sequence
  Synthetic oligonucleotide; CTT chr2 60473714 60473735 60473731 60473736 +
atcagagtattatagagcaaac

SEQ ID NO: 197122 - DNA, 22 bp, Artificial Sequence
  Synthetic oligonucleotide; TTA chr2 60473715 60473736 60473732 60473737 +
tcagagtattatagagcaaaca

SEQ ID NO: 197123 - DNA, 22 bp, Artificial Sequence
  Synthetic oligonucleotide; TTA chr2 60473726 60473747 60473743 60473748 +
tagagcaaacattagctatgcc

SEQ ID NO: 197124 - DNA, 22 bp, Artificial Sequence
  Synthetic oligonucleotide; TTA chr2 60473740 60473761 60473757 60473762 +
gctatgcctgtgacttgagttg

SEQ ID NO: 197125 - DNA, 22 bp, Artificial Sequence
  Synthetic oligonucleotide; CTA chr2 60473744 60473765 60473761 60473766 +
tgcctgtgacttgagttgtgtc

SEQ ID NO: 197126 - DNA, 22 bp, Artificial Sequence
  Synthetic oligonucleotide; CTG chr2 60473750 60473771 60473767 60473772 +
tgacttgagttgtgtcaatctg

SEQ ID NO: 197127 - DNA, 22 bp, Artificial Sequence
  Synthetic oligonucleotide; CTT chr2 60473756 60473777 60473773 60473778 +
gagttgtgtcaatctgtaatga

SEQ ID NO: 197128 - DNA, 22 bp, Artificial Sequence
  Synthetic oligonucleotide; TTG chr2 60473757 60473778 60473774 60473779 +
agttgtgtcaatctgtaatgaa

SEQ ID NO: 197129 - DNA, 22 bp, Artificial Sequence
  Synthetic oligonucleotide; TTG chr2 60473762 60473783 60473779 60473784 +
tgtcaatctgtaatgaaaatgt

SEQ ID NO: 197130 - DNA, 22 bp, Artificial Sequence
  Synthetic oligonucleotide; CTG chr2 60473772 60473793 60473789 60473794 +
taatgaaaatgtgccagcttta

SEQ ID NO: 197131 - DNA, 22 bp, Artificial Sequence
  Synthetic oligonucleotide; CTT chr2 60473792 60473813 60473809 60473814 +
tatcatcactcacagacttctt

SEQ ID NO: 197132 - DNA, 22 bp, Artificial Sequence
  Synthetic oligonucleotide; TTT chr2 60473793 60473814 60473810 60473815 +
atcatcactcacagacttctta

SEQ ID NO: 197133 - DNA, 22 bp, Artificial Sequence
  Synthetic oligonucleotide; TTA chr2 60473794 60473815 60473811 60473816 +
tcatcactcacagacttcttaa

SEQ ID NO: 197134 - DNA, 22 bp, Artificial Sequence
  Synthetic oligonucleotide; CTC chr2 60473803 60473824 60473820 60473825 +
acagacttcttaattaaccttc

SEQ ID NO: 197135 - DNA, 22 bp, Artificial Sequence
  Synthetic oligonucleotide; CTT chr2 60473811 60473832 60473828 60473833 +
cttaattaaccttctgatattg

SEQ ID NO: 197136 - DNA, 22 bp, Artificial Sequence
  Synthetic oligonucleotide; TTC chr2 60473812 60473833 60473829 60473834 +
ttaattaaccttctgatattgt

SEQ ID NO: 197137 - DNA, 22 bp, Artificial Sequence
  Synthetic oligonucleotide; CTT chr2 60473814 60473835 60473831 60473836 +
aattaaccttctgatattgtca

SEQ ID NO: 197138 - DNA, 22 bp, Artificial Sequence
  Synthetic oligonucleotide; TTA chr2 60473815 60473836 60473832 60473837 +
attaaccttctgatattgtcaa

SEQ ID NO: 197139 - DNA, 22 bp, Artificial Sequence
  Synthetic oligonucleotide; TTA chr2 60473819 60473840 60473836 60473841 +
accttctgatattgtcaaaatc

SEQ ID NO: 197140 - DNA, 22 bp, Artificial Sequence
  Synthetic oligonucleotide; CTT chr2 60473824 60473845 60473841 60473846 +
ctgatattgtcaaaatcgcact

SEQ ID NO: 197141 - DNA, 22 bp, Artificial Sequence
  Synthetic oligonucleotide; TTC chr2 60473825 60473846 60473842 60473847 +
tgatattgtcaaaatcgcactc

SEQ ID NO: 197142 - DNA, 22 bp, Artificial Sequence
  Synthetic oligonucleotide; CTG chr2 60473827 60473848 60473844 60473849 +
atattgtcaaaatcgcactctc

SEQ ID NO: 197143 - DNA, 22 bp, Artificial Sequence
  Synthetic oligonucleotide; TTG chr2 60473833 60473854 60473850 60473855 +
tcaaaatcgcactctcttttgt

SEQ ID NO: 197144 - DNA, 22 bp, Artificial Sequence
  Synthetic oligonucleotide; CTC chr2 60473847 60473868 60473864 60473869 +
tcttttgttctagaaatgagca

SEQ ID NO: 197145 - DNA, 22 bp, Artificial Sequence
  Synthetic oligonucleotide; CTC chr2 60473849 60473870 60473866 60473871 +
ttttgttctagaaatgagcatt

SEQ ID NO: 197146 - DNA, 22 bp, Artificial Sequence
  Synthetic oligonucleotide; CTT chr2 60473851 60473872 60473868 60473873 +
ttgttctagaaatgagcattta

SEQ ID NO: 197147 - DNA, 22 bp, Artificial Sequence
  Synthetic oligonucleotide; TTT chr2 60473852 60473873 60473869 60473874 +
tgttctagaaatgagcatttac

SEQ ID NO: 197148 - DNA, 22 bp, Artificial Sequence
  Synthetic oligonucleotide; TTT chr2 60473853 60473874 60473870 60473875 +
gttctagaaatgagcatttaca

SEQ ID NO: 197149 - DNA, 22 bp, Artificial Sequence
  Synthetic oligonucleotide; TTG chr2 60473854 60473875 60473871 60473876 +
ttctagaaatgagcatttacat

SEQ ID NO: 197150 - DNA, 22 bp, Artificial Sequence
  Synthetic oligonucleotide; TTC chr2 60473857 60473878 60473874 60473879 +
tagaaatgagcatttacatgtg

SEQ ID NO: 197151 - DNA, 22 bp, Artificial Sequence
  Synthetic oligonucleotide; CTA chr2 60473859 60473880 60473876 60473881 +
gaaatgagcatttacatgtgca

SEQ ID NO: 197152 - DNA, 22 bp, Artificial Sequence
  Synthetic oligonucleotide; TTT chr2 60473872 60473893 60473889 60473894 +
acatgtgcattttttttccttc

SEQ ID NO: 197153 - DNA, 22 bp, Artificial Sequence
  Synthetic oligonucleotide; TTA chr2 60473873 60473894 60473890 60473895 +
catgtgcattttttttccttca

SEQ ID NO: 197154 - DNA, 22 bp, Artificial Sequence
  Synthetic oligonucleotide; TTT chr2 60473884 60473905 60473901 60473906 +
tttttccttcattgctttttta

SEQ ID NO: 197155 - DNA, 22 bp, Artificial Sequence
  Synthetic oligonucleotide; TTT chr2 60473885 60473906 60473902 60473907 +
ttttccttcattgcttttttac

SEQ ID NO: 197156 - DNA, 22 bp, Artificial Sequence
  Synthetic oligonucleotide; TTT chr2 60473886 60473907 60473903 60473908 +
tttccttcattgcttttttact

SEQ ID NO: 197157 - DNA, 22 bp, Artificial Sequence
  Synthetic oligonucleotide; TTT chr2 60473887 60473908 60473904 60473909 +
ttccttcattgcttttttactg

SEQ ID NO: 197158 - DNA, 22 bp, Artificial Sequence
  Synthetic oligonucleotide; TTT chr2 60473888 60473909 60473905 60473910 +
tccttcattgcttttttactgg

SEQ ID NO: 197159 - DNA, 22 bp, Artificial Sequence
  Synthetic oligonucleotide; TTT chr2 60473889 60473910 60473906 60473911 +
ccttcattgcttttttactggc

SEQ ID NO: 197160 - DNA, 22 bp, Artificial Sequence
  Synthetic oligonucleotide; TTC chr2 60473890 60473911 60473907 60473912 +
cttcattgcttttttactggct

SEQ ID NO: 197161 - DNA, 22 bp, Artificial Sequence
  Synthetic oligonucleotide; CTT chr2 60473893 60473914 60473910 60473915 +
cattgcttttttactggctgtt

SEQ ID NO: 197162 - DNA, 22 bp, Artificial Sequence
  Synthetic oligonucleotide; TTC chr2 60473894 60473915 60473911 60473916 +
attgcttttttactggctgttt

SEQ ID NO: 197163 - DNA, 22 bp, Artificial Sequence
  Synthetic oligonucleotide; TTG chr2 60473898 60473919 60473915 60473920 +
cttttttactggctgttttacc

SEQ ID NO: 197164 - DNA, 22 bp, Artificial Sequence
  Synthetic oligonucleotide; CTT chr2 60473901 60473922 60473918 60473923 +
ttttactggctgttttaccaaa

SEQ ID NO: 197165 - DNA, 22 bp, Artificial Sequence
  Synthetic oligonucleotide; TTT chr2 60473902 60473923 60473919 60473924 +
tttactggctgttttaccaaat

SEQ ID NO: 197166 - DNA, 22 bp, Artificial Sequence
  Synthetic oligonucleotide; TTT chr2 60473903 60473924 60473920 60473925 +
ttactggctgttttaccaaatc

SEQ ID NO: 197167 - DNA, 22 bp, Artificial Sequence
  Synthetic oligonucleotide; TTT chr2 60473904 60473925 60473921 60473926 +
tactggctgttttaccaaatcc

SEQ ID NO: 197168 - DNA, 22 bp, Artificial Sequence
  Synthetic oligonucleotide; TTT chr2 60473905 60473926 60473922 60473927 +
actggctgttttaccaaatcct

SEQ ID NO: 197169 - DNA, 22 bp, Artificial Sequence
  Synthetic oligonucleotide; TTA chr2 60473906 60473927 60473923 60473928 +
ctggctgttttaccaaatcctg

SEQ ID NO: 197170 - DNA, 22 bp, Artificial Sequence
  Synthetic oligonucleotide; CTG chr2 60473909 60473930 60473926 60473931 +
gctgttttaccaaatcctgatg

SEQ ID NO: 197171 - DNA, 22 bp, Artificial Sequence
  Synthetic oligonucleotide; CTG chr2 60473913 60473934 60473930 60473935 +
ttttaccaaatcctgatgttct

SEQ ID NO: 197172 - DNA, 22 bp, Artificial Sequence
  Synthetic oligonucleotide; TTT chr2 60473916 60473937 60473933 60473938 +
taccaaatcctgatgttcttta

SEQ ID NO: 197173 - DNA, 22 bp, Artificial Sequence
  Synthetic oligonucleotide; TTT chr2 60473917 60473938 60473934 60473939 +
accaaatcctgatgttctttaa

SEQ ID NO: 197174 - DNA, 22 bp, Artificial Sequence
  Synthetic oligonucleotide; TTA chr2 60473918 60473939 60473935 60473940 +
ccaaatcctgatgttctttaaa

SEQ ID NO: 197175 - DNA, 22 bp, Artificial Sequence
  Synthetic oligonucleotide; CTG chr2 60473928 60473949 60473945 60473950 +
atgttctttaaaaagtgtattc

SEQ ID NO: 197176 - DNA, 22 bp, Artificial Sequence
  Synthetic oligonucleotide; TTC chr2 60473934 60473955 60473951 60473956 +
tttaaaaagtgtattctgcaaa

SEQ ID NO: 197177 - DNA, 22 bp, Artificial Sequence
  Synthetic oligonucleotide; CTT chr2 60473936 60473957 60473953 60473958 +
taaaaagtgtattctgcaaaaa

SEQ ID NO: 197178 - DNA, 22 bp, Artificial Sequence
  Synthetic oligonucleotide; TTT chr2 60473937 60473958 60473954 60473959 +
aaaaagtgtattctgcaaaaac

SEQ ID NO: 197179 - DNA, 22 bp, Artificial Sequence
  Synthetic oligonucleotide; TTA chr2 60473938 60473959 60473955 60473960 +
aaaagtgtattctgcaaaaaca

SEQ ID NO: 197180 - DNA, 22 bp, Artificial Sequence
  Synthetic oligonucleotide; TTC chr2 60473950 60473971 60473967 60473972 +
tgcaaaaacaaaagaaagcaat

SEQ ID NO: 197181 - DNA, 22 bp, Artificial Sequence
  Synthetic oligonucleotide; CTG chr2 60473952 60473973 60473969 60473974 +
caaaaacaaaagaaagcaataa

SEQ ID NO: 197182 - DNA, 22 bp, Artificial Sequence
  Synthetic oligonucleotide; TTA chr2 60473977 60473998 60473994 60473999 +
tagacactacaatatagaattt

SEQ ID NO: 197183 - DNA, 22 bp, Artificial Sequence
  Synthetic oligonucleotide; CTA chr2 60473986 60474007 60474003 60474008 +
caatatagaatttcttccctga

SEQ ID NO: 197184 - DNA, 22 bp, Artificial Sequence
  Synthetic oligonucleotide; TTT chr2 60473999 60474020 60474016 60474021 +
cttccctgaaactctctcatgg

SEQ ID NO: 197185 - DNA, 22 bp, Artificial Sequence
  Synthetic oligonucleotide; TTC chr2 60474000 60474021 60474017 60474022 +
ttccctgaaactctctcatggt

SEQ ID NO: 197186 - DNA, 22 bp, Artificial Sequence
  Synthetic oligonucleotide; CTT chr2 60474002 60474023 60474019 60474024 +
ccctgaaactctctcatggtcc

SEQ ID NO: 197187 - DNA, 22 bp, Artificial Sequence
  Synthetic oligonucleotide; TTC chr2 60474003 60474024 60474020 60474025 +
cctgaaactctctcatggtcct

SEQ ID NO: 197188 - DNA, 22 bp, Artificial Sequence
  Synthetic oligonucleotide; CTG chr2 60474007 60474028 60474024 60474029 +
aaactctctcatggtccttaga

SEQ ID NO: 197189 - DNA, 22 bp, Artificial Sequence
  Synthetic oligonucleotide; CTC chr2 60474013 60474034 60474030 60474035 +
tctcatggtccttagattcctt

SEQ ID NO: 197190 - DNA, 22 bp, Artificial Sequence
  Synthetic oligonucleotide; CTC chr2 60474015 60474036 60474032 60474037 +
tcatggtccttagattccttga

SEQ ID NO: 197191 - DNA, 22 bp, Artificial Sequence
  Synthetic oligonucleotide; CTC chr2 60474017 60474038 60474034 60474039 +
atggtccttagattccttgata

SEQ ID NO: 197192 - DNA, 22 bp, Artificial Sequence
  Synthetic oligonucleotide; CTT chr2 60474026 60474047 60474043 60474048 +
agattccttgatacttcaccag

SEQ ID NO: 197193 - DNA, 22 bp, Artificial Sequence
  Synthetic oligonucleotide; TTA chr2 60474027 60474048 60474044 60474049 +
gattccttgatacttcaccagt

SEQ ID NO: 197194 - DNA, 22 bp, Artificial Sequence
  Synthetic oligonucleotide; TTC chr2 60474032 60474053 60474049 60474054 +
cttgatacttcaccagtgactt

SEQ ID NO: 197195 - DNA, 22 bp, Artificial Sequence
  Synthetic oligonucleotide; CTT chr2 60474035 60474056 60474052 60474057 +
gatacttcaccagtgactttaa

SEQ ID NO: 197196 - DNA, 22 bp, Artificial Sequence
  Synthetic oligonucleotide; TTG chr2 60474036 60474057 60474053 60474058 +
atacttcaccagtgactttaat

SEQ ID NO: 197197 - DNA, 22 bp, Artificial Sequence
  Synthetic oligonucleotide; CTT chr2 60474042 60474063 60474059 60474064 +
caccagtgactttaataacatc

SEQ ID NO: 197198 - DNA, 22 bp, Artificial Sequence
  Synthetic oligonucleotide; TTC chr2 60474043 60474064 60474060 60474065 +
accagtgactttaataacatca

SEQ ID NO: 197199 - DNA, 22 bp, Artificial Sequence
  Synthetic oligonucleotide; CTT chr2 60474054 60474075 60474071 60474076 +
taataacatcaatcactcattt

SEQ ID NO: 197200 - DNA, 22 bp, Artificial Sequence
  Synthetic oligonucleotide; TTT chr2 60474055 60474076 60474072 60474077 +
aataacatcaatcactcatttt

SEQ ID NO: 197201 - DNA, 22 bp, Artificial Sequence
  Synthetic oligonucleotide; TTA chr2 60474056 60474077 60474073 60474078 +
ataacatcaatcactcatttta

SEQ ID NO: 197202 - DNA, 22 bp, Artificial Sequence
  Synthetic oligonucleotide; CTC chr2 60474072 60474093 60474089 60474094 +
attttaaaactcttttttgatc

SEQ ID NO: 197203 - DNA, 22 bp, Artificial Sequence
  Synthetic oligonucleotide; TTT chr2 60474076 60474097 60474093 60474098 +
taaaactcttttttgatcaatg

SEQ ID NO: 197204 - DNA, 22 bp, Artificial Sequence
  Synthetic oligonucleotide; TTT chr2 60474077 60474098 60474094 60474099 +
aaaactcttttttgatcaatgc

SEQ ID NO: 197205 - DNA, 22 bp, Artificial Sequence
  Synthetic oligonucleotide; TTA chr2 60474078 60474099 60474095 60474100 +
aaactcttttttgatcaatgct

SEQ ID NO: 197206 - DNA, 22 bp, Artificial Sequence
  Synthetic oligonucleotide; CTC chr2 60474084 60474105 60474101 60474106 +
ttttttgatcaatgctatcctc

SEQ ID NO: 197207 - DNA, 22 bp, Artificial Sequence
  Synthetic oligonucleotide; CTT chr2 60474086 60474107 60474103 60474108 +
ttttgatcaatgctatcctctt

SEQ ID NO: 197208 - DNA, 22 bp, Artificial Sequence
  Synthetic oligonucleotide; TTT chr2 60474087 60474108 60474104 60474109 +
tttgatcaatgctatcctctta

SEQ ID NO: 197209 - DNA, 22 bp, Artificial Sequence
  Synthetic oligonucleotide; TTT chr2 60474088 60474109 60474105 60474110 +
ttgatcaatgctatcctcttag

SEQ ID NO: 197210 - DNA, 22 bp, Artificial Sequence
  Synthetic oligonucleotide; TTT chr2 60474089 60474110 60474106 60474111 +
tgatcaatgctatcctcttaga

SEQ ID NO: 197211 - DNA, 22 bp, Artificial Sequence
  Synthetic oligonucleotide; TTT chr2 60474090 60474111 60474107 60474112 +
gatcaatgctatcctcttagag

SEQ ID NO: 197212 - DNA, 22 bp, Artificial Sequence
  Synthetic oligonucleotide; TTG chr2 60474091 60474112 60474108 60474113 +
atcaatgctatcctcttagagc

SEQ ID NO: 197213 - DNA, 22 bp, Artificial Sequence
  Synthetic oligonucleotide; CTA chr2 60474101 60474122 60474118 60474123 +
tcctcttagagccttgattact

SEQ ID NO: 197214 - DNA, 22 bp, Artificial Sequence
  Synthetic oligonucleotide; CTC chr2 60474106 60474127 60474123 60474128 +
ttagagccttgattactcaaac

SEQ ID NO: 197215 - DNA, 22 bp, Artificial Sequence
  Synthetic oligonucleotide; CTT chr2 60474108 60474129 60474125 60474130 +
agagccttgattactcaaacaa

SEQ ID NO: 197216 - DNA, 22 bp, Artificial Sequence
  Synthetic oligonucleotide; TTA chr2 60474109 60474130 60474126 60474131 +
gagccttgattactcaaacaac

SEQ ID NO: 197217 - DNA, 22 bp, Artificial Sequence
  Synthetic oligonucleotide; CTT chr2 60474116 60474137 60474133 60474138 +
gattactcaaacaacaggttac

SEQ ID NO: 197218 - DNA, 22 bp, Artificial Sequence
  Synthetic oligonucleotide; TTG chr2 60474117 60474138 60474134 60474139 +
attactcaaacaacaggttact

SEQ ID NO: 197219 - DNA, 22 bp, Artificial Sequence
  Synthetic oligonucleotide; TTA chr2 60474121 60474142 60474138 60474143 +
ctcaaacaacaggttactaact

SEQ ID NO: 197220 - DNA, 22 bp, Artificial Sequence
  Synthetic oligonucleotide; CTC chr2 60474124 60474145 60474141 60474146 +
aaacaacaggttactaacttca

SEQ ID NO: 197221 - DNA, 22 bp, Artificial Sequence
  Synthetic oligonucleotide; TTA chr2 60474137 60474158 60474154 60474159 +
ctaacttcaccttttaagagtt

SEQ ID NO: 197222 - DNA, 22 bp, Artificial Sequence
  Synthetic oligonucleotide; CTA chr2 60474140 60474161 60474157 60474162 +
acttcaccttttaagagttctc

SEQ ID NO: 197223 - DNA, 22 bp, Artificial Sequence
  Synthetic oligonucleotide; CTT chr2 60474144 60474165 60474161 60474166 +
caccttttaagagttctcctcc

SEQ ID NO: 197224 - DNA, 22 bp, Artificial Sequence
  Synthetic oligonucleotide; TTC chr2 60474145 60474166 60474162 60474167 +
accttttaagagttctcctcct

SEQ ID NO: 197225 - DNA, 22 bp, Artificial Sequence
  Synthetic oligonucleotide; CTT chr2 60474150 60474171 60474167 60474172 +
ttaagagttctcctcctaggct

SEQ ID NO: 197226 - DNA, 22 bp, Artificial Sequence
  Synthetic oligonucleotide; TTT chr2 60474151 60474172 60474168 60474173 +
taagagttctcctcctaggctt

SEQ ID NO: 197227 - DNA, 22 bp, Artificial Sequence
  Synthetic oligonucleotide; TTT chr2 60474152 60474173 60474169 60474174 +
aagagttctcctcctaggcttt

SEQ ID NO: 197228 - DNA, 22 bp, Artificial Sequence
  Synthetic oligonucleotide; TTA chr2 60474153 60474174 60474170 60474175 +
agagttctcctcctaggctttt

SEQ ID NO: 197229 - DNA, 22 bp, Artificial Sequence
  Synthetic oligonucleotide; TTC chr2 60474160 60474181 60474177 60474182 +
tcctcctaggctttttctcaat

SEQ ID NO: 197230 - DNA, 22 bp, Artificial Sequence
  Synthetic oligonucleotide; CTC chr2 60474162 60474183 60474179 60474184 +
ctcctaggctttttctcaataa

SEQ ID NO: 197231 - DNA, 22 bp, Artificial Sequence
  Synthetic oligonucleotide; CTC chr2 60474165 60474186 60474182 60474187 +
ctaggctttttctcaataaagg

SEQ ID NO: 197232 - DNA, 22 bp, Artificial Sequence
  Synthetic oligonucleotide; CTA chr2 60474168 60474189 60474185 60474190 +
ggctttttctcaataaagggag

SEQ ID NO: 197233 - DNA, 22 bp, Artificial Sequence
  Synthetic oligonucleotide; CTT chr2 60474173 60474194 60474190 60474195 +
tttctcaataaagggaggaagt

SEQ ID NO: 197234 - DNA, 22 bp, Artificial Sequence
  Synthetic oligonucleotide; TTT chr2 60474174 60474195 60474191 60474196 +
ttctcaataaagggaggaagta

SEQ ID NO: 197235 - DNA, 22 bp, Artificial Sequence
  Synthetic oligonucleotide; TTT chr2 60474175 60474196 60474192 60474197 +
tctcaataaagggaggaagtag

SEQ ID NO: 197236 - DNA, 22 bp, Artificial Sequence
  Synthetic oligonucleotide; TTT chr2 60474176 60474197 60474193 60474198 +
ctcaataaagggaggaagtaga

SEQ ID NO: 197237 - DNA, 22 bp, Artificial Sequence
  Synthetic oligonucleotide; TTC chr2 60474177 60474198 60474194 60474199 +
tcaataaagggaggaagtagag

SEQ ID NO: 197238 - DNA, 22 bp, Artificial Sequence
  Synthetic oligonucleotide; CTC chr2 60474179 60474200 60474196 60474201 +
aataaagggaggaagtagagat

SEQ ID NO: 197239 - DNA, 22 bp, Artificial Sequence
  Synthetic oligonucleotide; TTT chr2 60474208 60474229 60474225 60474230 +
tgcgtgcccctttatctataaa

SEQ ID NO: 197240 - DNA, 22 bp, Artificial Sequence
  Synthetic oligonucleotide; TTT chr2 60474209 60474230 60474226 60474231 +
gcgtgcccctttatctataaaa

SEQ ID NO: 197241 - DNA, 22 bp, Artificial Sequence
  Synthetic oligonucleotide; TTG chr2 60474210 60474231 60474227 60474232 +
cgtgcccctttatctataaaaa

SEQ ID NO: 197242 - DNA, 22 bp, Artificial Sequence
  Synthetic oligonucleotide; CTT chr2 60474220 60474241 60474237 60474242 +
tatctataaaaatgccagccac

SEQ ID NO: 197243 - DNA, 22 bp, Artificial Sequence
  Synthetic oligonucleotide; TTT chr2 60474221 60474242 60474238 60474243 +
atctataaaaatgccagccacc

SEQ ID NO: 197244 - DNA, 22 bp, Artificial Sequence
  Synthetic oligonucleotide; TTA chr2 60474222 60474243 60474239 60474244 +
tctataaaaatgccagccacca

SEQ ID NO: 197245 - DNA, 22 bp, Artificial Sequence
  Synthetic oligonucleotide; CTA chr2 60474226 60474247 60474243 60474248 +
taaaaatgccagccaccaatct

SEQ ID NO: 197246 - DNA, 22 bp, Artificial Sequence
  Synthetic oligonucleotide; CTG chr2 60474249 60474270 60474266 60474271 +
tcaggcctaaacaaaatttttc

SEQ ID NO: 197247 - DNA, 22 bp, Artificial Sequence
  Synthetic oligonucleotide; CTA chr2 60474258 60474279 60474275 60474280 +
aacaaaatttttctgcaagctg

SEQ ID NO: 197248 - DNA, 22 bp, Artificial Sequence
  Synthetic oligonucleotide; TTT chr2 60474268 60474289 60474285 60474290 +
ttctgcaagctgtgtctttaac

SEQ ID NO: 197249 - DNA, 22 bp, Artificial Sequence
  Synthetic oligonucleotide; TTT chr2 60474269 60474290 60474286 60474291 +
tctgcaagctgtgtctttaaca

SEQ ID NO: 197250 - DNA, 22 bp, Artificial Sequence
  Synthetic oligonucleotide; TTT chr2 60474270 60474291 60474287 60474292 +
ctgcaagctgtgtctttaacat

SEQ ID NO: 197251 - DNA, 22 bp, Artificial Sequence
  Synthetic oligonucleotide; TTC chr2 60474271 60474292 60474288 60474293 +
tgcaagctgtgtctttaacata

SEQ ID NO: 197252 - DNA, 22 bp, Artificial Sequence
  Synthetic oligonucleotide; CTG chr2 60474273 60474294 60474290 60474295 +
caagctgtgtctttaacataag

SEQ ID NO: 197253 - DNA, 22 bp, Artificial Sequence
  Synthetic oligonucleotide; CTG chr2 60474280 60474301 60474297 60474302 +
tgtctttaacataagcaaagca

SEQ ID NO: 197254 - DNA, 22 bp, Artificial Sequence
  Synthetic oligonucleotide; CTT chr2 60474286 60474307 60474303 60474308 +
taacataagcaaagcatataat

SEQ ID NO: 197255 - DNA, 22 bp, Artificial Sequence
  Synthetic oligonucleotide; TTT chr2 60474287 60474308 60474304 60474309 +
aacataagcaaagcatataatt

SEQ ID NO: 197256 - DNA, 22 bp, Artificial Sequence
  Synthetic oligonucleotide; TTA chr2 60474288 60474309 60474305 60474310 +
acataagcaaagcatataattc

SEQ ID NO: 197257 - DNA, 22 bp, Artificial Sequence
  Synthetic oligonucleotide; TTC chr2 60474310 60474331 60474327 60474332 +
caaaaaaaaaaaatcttgcttt

SEQ ID NO: 197258 - DNA, 22 bp, Artificial Sequence
  Synthetic oligonucleotide; CTT chr2 60474327 60474348 60474344 60474349 +
gcttttctgaaaagcaactaag

SEQ ID NO: 197259 - DNA, 22 bp, Artificial Sequence
  Synthetic oligonucleotide; TTG chr2 60474328 60474349 60474345 60474350 +
cttttctgaaaagcaactaagc

SEQ ID NO: 197260 - DNA, 22 bp, Artificial Sequence
  Synthetic oligonucleotide; CTT chr2 60474331 60474352 60474348 60474353 +
ttctgaaaagcaactaagccaa

SEQ ID NO: 197261 - DNA, 22 bp, Artificial Sequence
  Synthetic oligonucleotide; TTT chr2 60474332 60474353 60474349 60474354 +
tctgaaaagcaactaagccaaa

SEQ ID NO: 197262 - DNA, 22 bp, Artificial Sequence
  Synthetic oligonucleotide; TTT chr2 60474333 60474354 60474350 60474355 +
ctgaaaagcaactaagccaaag

SEQ ID NO: 197263 - DNA, 22 bp, Artificial Sequence
  Synthetic oligonucleotide; TTC chr2 60474334 60474355 60474351 60474356 +
tgaaaagcaactaagccaaaga

SEQ ID NO: 197264 - DNA, 22 bp, Artificial Sequence
  Synthetic oligonucleotide; CTG chr2 60474336 60474357 60474353 60474358 +
aaaagcaactaagccaaagaca

SEQ ID NO: 197265 - DNA, 22 bp, Artificial Sequence
  Synthetic oligonucleotide; CTA chr2 60474347 60474368 60474364 60474369 +
agccaaagacattgtgttccat

SEQ ID NO: 197266 - DNA, 22 bp, Artificial Sequence
  Synthetic oligonucleotide; TTG chr2 60474361 60474382 60474378 60474383 +
tgttccatctttgtgttgaaat

SEQ ID NO: 197267 - DNA, 22 bp, Artificial Sequence
  Synthetic oligonucleotide; TTC chr2 60474366 60474387 60474383 60474388 +
catctttgtgttgaaatgcaga

SEQ ID NO: 197268 - DNA, 22 bp, Artificial Sequence
  Synthetic oligonucleotide; CTT chr2 60474372 60474393 60474389 60474394 +
tgtgttgaaatgcagatttccc

SEQ ID NO: 197269 - DNA, 22 bp, Artificial Sequence
  Synthetic oligonucleotide; TTT chr2 60474373 60474394 60474390 60474395 +
gtgttgaaatgcagatttccca

SEQ ID NO: 197270 - DNA, 22 bp, Artificial Sequence
  Synthetic oligonucleotide; TTG chr2 60474374 60474395 60474391 60474396 +
tgttgaaatgcagatttcccac

SEQ ID NO: 197271 - DNA, 22 bp, Artificial Sequence
  Synthetic oligonucleotide; TTG chr2 60474379 60474400 60474396 60474401 +
aaatgcagatttcccactaaaa

SEQ ID NO: 197272 - DNA, 22 bp, Artificial Sequence
  Synthetic oligonucleotide; TTT chr2 60474391 60474412 60474408 60474413 +
cccactaaaaggcaaatccttc

SEQ ID NO: 197273 - DNA, 22 bp, Artificial Sequence
  Synthetic oligonucleotide; TTC chr2 60474392 60474413 60474409 60474414 +
ccactaaaaggcaaatccttca

SEQ ID NO: 197274 - DNA, 22 bp, Artificial Sequence
  Synthetic oligonucleotide; CTA chr2 60474398 60474419 60474415 60474420 +
aaaggcaaatccttcatttcaa

SEQ ID NO: 197275 - DNA, 22 bp, Artificial Sequence
  Synthetic oligonucleotide; CTT chr2 60474412 60474433 60474429 60474434 +
catttcaaaaggttgaatagga

SEQ ID NO: 197276 - DNA, 22 bp, Artificial Sequence
  Synthetic oligonucleotide; TTC chr2 60474413 60474434 60474430 60474435 +
atttcaaaaggttgaataggat

SEQ ID NO: 197277 - DNA, 22 bp, Artificial Sequence
  Synthetic oligonucleotide; TTT chr2 60474417 60474438 60474434 60474439 +
caaaaggttgaataggatggta

SEQ ID NO: 197278 - DNA, 22 bp, Artificial Sequence
  Synthetic oligonucleotide; TTC chr2 60474418 60474439 60474435 60474440 +
aaaaggttgaataggatggtac

SEQ ID NO: 197279 - DNA, 22 bp, Artificial Sequence
  Synthetic oligonucleotide; TTG chr2 60474427 60474448 60474444 60474449 +
aataggatggtacttaaaaaaa

SEQ ID NO: 197280 - DNA, 22 bp, Artificial Sequence
  Synthetic oligonucleotide; CTT chr2 60474442 60474463 60474459 60474464 +
aaaaaaagaattccagctggtt

SEQ ID NO: 197281 - DNA, 22 bp, Artificial Sequence
  Synthetic oligonucleotide; TTA chr2 60474443 60474464 60474460 60474465 +
aaaaaagaattccagctggtta

SEQ ID NO: 197282 - DNA, 22 bp, Artificial Sequence
  Synthetic oligonucleotide; TTC chr2 60474455 60474476 60474472 60474477 +
cagctggttaaatttagggtgt

SEQ ID NO: 197283 - DNA, 22 bp, Artificial Sequence
  Synthetic oligonucleotide; CTG chr2 60474461 60474482 60474478 60474483 +
gttaaatttagggtgttaaaaa

SEQ ID NO: 197284 - DNA, 22 bp, Artificial Sequence
  Synthetic oligonucleotide; TTA chr2 60474465 60474486 60474482 60474487 +
aatttagggtgttaaaaaaagt

SEQ ID NO: 197285 - DNA, 22 bp, Artificial Sequence
  Synthetic oligonucleotide; TTT chr2 60474470 60474491 60474487 60474492 +
agggtgttaaaaaaagttcact

SEQ ID NO: 197286 - DNA, 22 bp, Artificial Sequence
  Synthetic oligonucleotide; TTA chr2 60474471 60474492 60474488 60474493 +
gggtgttaaaaaaagttcactc

SEQ ID NO: 197287 - DNA, 22 bp, Artificial Sequence
  Synthetic oligonucleotide; TTA chr2 60474479 60474500 60474496 60474501 +
aaaaaagttcactccaataata

SEQ ID NO: 197288 - DNA, 22 bp, Artificial Sequence
  Synthetic oligonucleotide; TTC chr2 60474489 60474510 60474506 60474511 +
actccaataatattctttggct

SEQ ID NO: 197289 - DNA, 22 bp, Artificial Sequence
  Synthetic oligonucleotide; CTC chr2 60474493 60474514 60474510 60474515 +
caataatattctttggctctgg

SEQ ID NO: 197290 - DNA, 22 bp, Artificial Sequence
  Synthetic oligonucleotide; TTC chr2 60474504 60474525 60474521 60474526 +
tttggctctgggcccaaagtat

SEQ ID NO: 197291 - DNA, 22 bp, Artificial Sequence
  Synthetic oligonucleotide; CTT chr2 60474506 60474527 60474523 60474528 +
tggctctgggcccaaagtattt

SEQ ID NO: 197292 - DNA, 22 bp, Artificial Sequence
  Synthetic oligonucleotide; TTT chr2 60474507 60474528 60474524 60474529 +
ggctctgggcccaaagtatttt

SEQ ID NO: 197293 - DNA, 22 bp, Artificial Sequence
  Synthetic oligonucleotide; TTG chr2 60474508 60474529 60474525 60474530 +
gctctgggcccaaagtattttc

SEQ ID NO: 197294 - DNA, 22 bp, Artificial Sequence
  Synthetic oligonucleotide; CTC chr2 60474512 60474533 60474529 60474534 +
tgggcccaaagtattttcactt

SEQ ID NO: 197295 - DNA, 22 bp, Artificial Sequence
  Synthetic oligonucleotide; CTG chr2 60474514 60474535 60474531 60474536 +
ggcccaaagtattttcacttga

SEQ ID NO: 197296 - DNA, 22 bp, Artificial Sequence
  Synthetic oligonucleotide; TTT chr2 60474528 60474549 60474545 60474550 +
tcacttgatcgtgaattagata

SEQ ID NO: 197297 - DNA, 22 bp, Artificial Sequence
  Synthetic oligonucleotide; TTT chr2 60474529 60474550 60474546 60474551 +
cacttgatcgtgaattagataa

SEQ ID NO: 197298 - DNA, 22 bp, Artificial Sequence
  Synthetic oligonucleotide; TTC chr2 60474530 60474551 60474547 60474552 +
acttgatcgtgaattagataaa

SEQ ID NO: 197299 - DNA, 22 bp, Artificial Sequence
  Synthetic oligonucleotide; CTT chr2 60474534 60474555 60474551 60474556 +
gatcgtgaattagataaatttt

SEQ ID NO: 197300 - DNA, 22 bp, Artificial Sequence
  Synthetic oligonucleotide; TTG chr2 60474535 60474556 60474552 60474557 +
atcgtgaattagataaattttt

SEQ ID NO: 197301 - DNA, 22 bp, Artificial Sequence
  Synthetic oligonucleotide; TTA chr2 60474546 60474567 60474563 60474568 +
gataaatttttattacacttta

SEQ ID NO: 197302 - DNA, 22 bp, Artificial Sequence
  Synthetic oligonucleotide; TTT chr2 60474555 60474576 60474572 60474577 +
ttattacactttaagcttttgc

SEQ ID NO: 197303 - DNA, 22 bp, Artificial Sequence
  Synthetic oligonucleotide; TTT chr2 60474556 60474577 60474573 60474578 +
tattacactttaagcttttgcc

SEQ ID NO: 197304 - DNA, 22 bp, Artificial Sequence
  Synthetic oligonucleotide; TTT chr2 60474557 60474578 60474574 60474579 +
attacactttaagcttttgcct

SEQ ID NO: 197305 - DNA, 22 bp, Artificial Sequence
  Synthetic oligonucleotide; TTA chr2 60474558 60474579 60474575 60474580 +
ttacactttaagcttttgcctt

SEQ ID NO: 197306 - DNA, 22 bp, Artificial Sequence
  Synthetic oligonucleotide; TTA chr2 60474561 60474582 60474578 60474583 +
cactttaagcttttgccttaga

SEQ ID NO: 197307 - DNA, 22 bp, Artificial Sequence
  Synthetic oligonucleotide; CTT chr2 60474566 60474587 60474583 60474588 +
taagcttttgccttagaatggc

SEQ ID NO: 197308 - DNA, 22 bp, Artificial Sequence
  Synthetic oligonucleotide; TTT chr2 60474567 60474588 60474584 60474589 +
aagcttttgccttagaatggcg

SEQ ID NO: 197309 - DNA, 22 bp, Artificial Sequence
  Synthetic oligonucleotide; TTA chr2 60474568 60474589 60474585 60474590 +
agcttttgccttagaatggcgg

SEQ ID NO: 197310 - DNA, 22 bp, Artificial Sequence
  Synthetic oligonucleotide; CTT chr2 60474573 60474594 60474590 60474595 +
ttgccttagaatggcggaactt

SEQ ID NO: 197311 - DNA, 22 bp, Artificial Sequence
  Synthetic oligonucleotide; TTT chr2 60474574 60474595 60474591 60474596 +
tgccttagaatggcggaactta

SEQ ID NO: 197312 - DNA, 22 bp, Artificial Sequence
  Synthetic oligonucleotide; TTT chr2 60474575 60474596 60474592 60474597 +
gccttagaatggcggaacttat

SEQ ID NO: 197313 - DNA, 22 bp, Artificial Sequence
  Synthetic oligonucleotide; TTG chr2 60474576 60474597 60474593 60474598 +
ccttagaatggcggaacttatc

SEQ ID NO: 197314 - DNA, 22 bp, Artificial Sequence
  Synthetic oligonucleotide; CTT chr2 60474580 60474601 60474597 60474602 +
agaatggcggaacttatctagg

SEQ ID NO: 197315 - DNA, 22 bp, Artificial Sequence
  Synthetic oligonucleotide; TTA chr2 60474581 60474602 60474598 60474603 +
gaatggcggaacttatctagga

SEQ ID NO: 197316 - DNA, 22 bp, Artificial Sequence
  Synthetic oligonucleotide; CTT chr2 60474595 60474616 60474612 60474617 +
atctaggagactgagagggcag

SEQ ID NO: 197317 - DNA, 22 bp, Artificial Sequence
  Synthetic oligonucleotide; TTA chr2 60474596 60474617 60474613 60474618 +
tctaggagactgagagggcagc

SEQ ID NO: 197318 - DNA, 22 bp, Artificial Sequence
  Synthetic oligonucleotide; CTA chr2 60474600 60474621 60474617 60474622 +
ggagactgagagggcagctgca

SEQ ID NO: 197319 - DNA, 22 bp, Artificial Sequence
  Synthetic oligonucleotide; CTG chr2 60474608 60474629 60474625 60474630 +
agagggcagctgcataaaaaga

SEQ ID NO: 197320 - DNA, 22 bp, Artificial Sequence
  Synthetic oligonucleotide; CTG chr2 60474620 60474641 60474637 60474642 +
cataaaaagacaaattgtctta

SEQ ID NO: 197321 - DNA, 22 bp, Artificial Sequence
  Synthetic oligonucleotide; TTG chr2 60474637 60474658 60474654 60474659 +
tcttaggacaatttttttttgt

SEQ ID NO: 197322 - DNA, 22 bp, Artificial Sequence
  Synthetic oligonucleotide; CTT chr2 60474641 60474662 60474658 60474663 +
aggacaatttttttttgtttgt

SEQ ID NO: 197323 - DNA, 22 bp, Artificial Sequence
  Synthetic oligonucleotide; TTA chr2 60474642 60474663 60474659 60474664 +
ggacaatttttttttgtttgtt

SEQ ID NO: 197324 - DNA, 22 bp, Artificial Sequence
  Synthetic oligonucleotide; TTT chr2 60474651 60474672 60474668 60474673 +
ttttttgtttgtttaatcacat

SEQ ID NO: 197325 - DNA, 22 bp, Artificial Sequence
  Synthetic oligonucleotide; TTT chr2 60474652 60474673 60474669 60474674 +
tttttgtttgtttaatcacata

SEQ ID NO: 197326 - DNA, 22 bp, Artificial Sequence
  Synthetic oligonucleotide; TTT chr2 60474653 60474674 60474670 60474675 +
ttttgtttgtttaatcacatac

SEQ ID NO: 197327 - DNA, 22 bp, Artificial Sequence
  Synthetic oligonucleotide; TTT chr2 60474654 60474675 60474671 60474676 +
tttgtttgtttaatcacatacc

SEQ ID NO: 197328 - DNA, 22 bp, Artificial Sequence
  Synthetic oligonucleotide; TTT chr2 60474655 60474676 60474672 60474677 +
ttgtttgtttaatcacatacct

SEQ ID NO: 197329 - DNA, 22 bp, Artificial Sequence
  Synthetic oligonucleotide; TTT chr2 60474656 60474677 60474673 60474678 +
tgtttgtttaatcacatacctc

SEQ ID NO: 197330 - DNA, 22 bp, Artificial Sequence
  Synthetic oligonucleotide; TTT chr2 60474657 60474678 60474674 60474679 +
gtttgtttaatcacatacctca

SEQ ID NO: 197331 - DNA, 22 bp, Artificial Sequence
  Synthetic oligonucleotide; TTG chr2 60474658 60474679 60474675 60474680 +
tttgtttaatcacatacctcac

SEQ ID NO: 197332 - DNA, 22 bp, Artificial Sequence
  Synthetic oligonucleotide; TTT chr2 60474661 60474682 60474678 60474683 +
gtttaatcacatacctcactat

SEQ ID NO: 197333 - DNA, 22 bp, Artificial Sequence
  Synthetic oligonucleotide; TTG chr2 60474662 60474683 60474679 60474684 +
tttaatcacatacctcactatg

SEQ ID NO: 197334 - DNA, 22 bp, Artificial Sequence
  Synthetic oligonucleotide; TTT chr2 60474665 60474686 60474682 60474687 +
aatcacatacctcactatgcaa

SEQ ID NO: 197335 - DNA, 22 bp, Artificial Sequence
  Synthetic oligonucleotide; TTA chr2 60474666 60474687 60474683 60474688 +
atcacatacctcactatgcaaa

SEQ ID NO: 197336 - DNA, 22 bp, Artificial Sequence
  Synthetic oligonucleotide; CTC chr2 60474678 60474699 60474695 60474700 +
actatgcaaaatgtgtgttccc

SEQ ID NO: 197337 - DNA, 22 bp, Artificial Sequence
  Synthetic oligonucleotide; CTA chr2 60474682 60474703 60474699 60474704 +
tgcaaaatgtgtgttcccagga

SEQ ID NO: 197338 - DNA, 22 bp, Artificial Sequence
  Synthetic oligonucleotide; TTC chr2 60474698 60474719 60474715 60474720 +
ccaggataaattccattcattc

SEQ ID NO: 197339 - DNA, 22 bp, Artificial Sequence
  Synthetic oligonucleotide; TTC chr2 60474711 60474732 60474728 60474733 +
cattcattcattctctcatgca

SEQ ID NO: 197340 - DNA, 22 bp, Artificial Sequence
  Synthetic oligonucleotide; TTC chr2 60474716 60474737 60474733 60474738 +
attcattctctcatgcattcat

SEQ ID NO: 197341 - DNA, 22 bp, Artificial Sequence
  Synthetic oligonucleotide; TTC chr2 60474720 60474741 60474737 60474742 +
attctctcatgcattcattcaa

SEQ ID NO: 197342 - DNA, 22 bp, Artificial Sequence
  Synthetic oligonucleotide; TTC chr2 60474724 60474745 60474741 60474746 +
tctcatgcattcattcaacctc

SEQ ID NO: 197343 - DNA, 22 bp, Artificial Sequence
  Synthetic oligonucleotide; CTC chr2 60474726 60474747 60474743 60474748 +
tcatgcattcattcaacctctc

SEQ ID NO: 197344 - DNA, 22 bp, Artificial Sequence
  Synthetic oligonucleotide; CTC chr2 60474728 60474749 60474745 60474750 +
atgcattcattcaacctctcat

SEQ ID NO: 197345 - DNA, 22 bp, Artificial Sequence
  Synthetic oligonucleotide; TTC chr2 60474736 60474757 60474753 60474758 +
attcaacctctcatgcattcat

SEQ ID NO: 197346 - DNA, 22 bp, Artificial Sequence
  Synthetic oligonucleotide; TTC chr2 60474740 60474761 60474757 60474762 +
aacctctcatgcattcattcaa

SEQ ID NO: 197347 - DNA, 22 bp, Artificial Sequence
  Synthetic oligonucleotide; CTC chr2 60474746 60474767 60474763 60474768 +
tcatgcattcattcaacaaata

SEQ ID NO: 197348 - DNA, 22 bp, Artificial Sequence
  Synthetic oligonucleotide; CTC chr2 60474748 60474769 60474765 60474770 +
atgcattcattcaacaaatatt

SEQ ID NO: 197349 - DNA, 22 bp, Artificial Sequence
  Synthetic oligonucleotide; TTC chr2 60474756 60474777 60474773 60474778 +
attcaacaaatatttaccgagt

SEQ ID NO: 197350 - DNA, 22 bp, Artificial Sequence
  Synthetic oligonucleotide; TTC chr2 60474760 60474781 60474777 60474782 +
aacaaatatttaccgagtgcct

SEQ ID NO: 197351 - DNA, 22 bp, Artificial Sequence
  Synthetic oligonucleotide; TTT chr2 60474771 60474792 60474788 60474793 +
accgagtgcctacaatgcccaa

SEQ ID NO: 197352 - DNA, 22 bp, Artificial Sequence
  Synthetic oligonucleotide; TTA chr2 60474772 60474793 60474789 60474794 +
ccgagtgcctacaatgcccaaa

SEQ ID NO: 197353 - DNA, 22 bp, Artificial Sequence
  Synthetic oligonucleotide; CTA chr2 60474783 60474804 60474800 60474805 +
caatgcccaaagcaatgggcta

SEQ ID NO: 197354 - DNA, 22 bp, Artificial Sequence
  Synthetic oligonucleotide; CTA chr2 60474805 60474826 60474822 60474827 +
gccgctgtgggcagtacaaaga

SEQ ID NO: 197355 - DNA, 22 bp, Artificial Sequence
  Synthetic oligonucleotide; CTG chr2 60474812 60474833 60474829 60474834 +
tgggcagtacaaagaaaacacg

SEQ ID NO: 197356 - DNA, 22 bp, Artificial Sequence
  Synthetic oligonucleotide; TTT chr2 60474845 60474866 60474862 60474867 +
ctcccacagcaggcttcattta

SEQ ID NO: 197357 - DNA, 22 bp, Artificial Sequence
  Synthetic oligonucleotide; TTC chr2 60474846 60474867 60474863 60474868 +
tcccacagcaggcttcatttag

SEQ ID NO: 197358 - DNA, 22 bp, Artificial Sequence
  Synthetic oligonucleotide; CTC chr2 60474848 60474869 60474865 60474870 +
ccacagcaggcttcatttagta

SEQ ID NO: 197359 - DNA, 22 bp, Artificial Sequence
  Synthetic oligonucleotide; CTT chr2 60474861 60474882 60474878 60474883 +
catttagtagaaaaggtaaggc

SEQ ID NO: 197360 - DNA, 22 bp, Artificial Sequence
  Synthetic oligonucleotide; TTC chr2 60474862 60474883 60474879 60474884 +
atttagtagaaaaggtaaggcc

SEQ ID NO: 197361 - DNA, 22 bp, Artificial Sequence
  Synthetic oligonucleotide; TTT chr2 60474866 60474887 60474883 60474888 +
agtagaaaaggtaaggcctgca

SEQ ID NO: 197362 - DNA, 22 bp, Artificial Sequence
  Synthetic oligonucleotide; TTA chr2 60474867 60474888 60474884 60474889 +
gtagaaaaggtaaggcctgcac

SEQ ID NO: 197363 - DNA, 22 bp, Artificial Sequence
  Synthetic oligonucleotide; CTG chr2 60474886 60474907 60474903 60474908 +
cacagaaattgctctaccccca

SEQ ID NO: 197364 - DNA, 22 bp, Artificial Sequence
  Synthetic oligonucleotide; TTG chr2 60474897 60474918 60474914 60474919 +
ctctacccccatgtagaaagtg

SEQ ID NO: 197365 - DNA, 22 bp, Artificial Sequence
  Synthetic oligonucleotide; CTC chr2 60474900 60474921 60474917 60474922 +
tacccccatgtagaaagtgtgt

SEQ ID NO: 197366 - DNA, 22 bp, Artificial Sequence
  Synthetic oligonucleotide; CTA chr2 60474902 60474923 60474919 60474924 +
cccccatgtagaaagtgtgtca

SEQ ID NO: 197367 - DNA, 22 bp, Artificial Sequence
  Synthetic oligonucleotide; CTG chr2 60474946 60474967 60474963 60474968 +
ctatggaaattcaaaggaagag

SEQ ID NO: 197368 - DNA, 22 bp, Artificial Sequence
  Synthetic oligonucleotide; CTA chr2 60474949 60474970 60474966 60474971 +
tggaaattcaaaggaagagaaa

SEQ ID NO: 197369 - DNA, 22 bp, Artificial Sequence
  Synthetic oligonucleotide; TTC chr2 60474958 60474979 60474975 60474980 +
aaaggaagagaaattatttcca

SEQ ID NO: 197370 - DNA, 22 bp, Artificial Sequence
  Synthetic oligonucleotide; TTA chr2 60474974 60474995 60474991 60474996 +
tttccatttggaagggagggag

SEQ ID NO: 197371 - DNA, 22 bp, Artificial Sequence
  Synthetic oligonucleotide; TTT chr2 60474977 60474998 60474994 60474999 +
ccatttggaagggagggagaga

SEQ ID NO: 197372 - DNA, 22 bp, Artificial Sequence
  Synthetic oligonucleotide; TTC chr2 60474978 60474999 60474995 60475000 +
catttggaagggagggagagag

SEQ ID NO: 197373 - DNA, 22 bp, Artificial Sequence
  Synthetic oligonucleotide; TTT chr2 60474983 60475004 60475000 60475005 +
ggaagggagggagagaggcttt

SEQ ID NO: 197374 - DNA, 22 bp, Artificial Sequence
  Synthetic oligonucleotide; TTG chr2 60474984 60475005 60475001 60475006 +
gaagggagggagagaggctttg

SEQ ID NO: 197375 - DNA, 22 bp, Artificial Sequence
  Synthetic oligonucleotide; CTT chr2 60475004 60475025 60475021 60475026 +
tgggaaagaggaaaacttatga

SEQ ID NO: 197376 - DNA, 22 bp, Artificial Sequence
  Synthetic oligonucleotide; TTT chr2 60475005 60475026 60475022 60475027 +
gggaaagaggaaaacttatgag

SEQ ID NO: 197377 - DNA, 22 bp, Artificial Sequence
  Synthetic oligonucleotide; TTG chr2 60475006 60475027 60475023 60475028 +
ggaaagaggaaaacttatgagt

SEQ ID NO: 197378 - DNA, 22 bp, Artificial Sequence
  Synthetic oligonucleotide; CTT chr2 60475022 60475043 60475039 60475044 +
atgagttaaacctggagagcca

SEQ ID NO: 197379 - DNA, 22 bp, Artificial Sequence
  Synthetic oligonucleotide; TTA chr2 60475023 60475044 60475040 60475045 +
tgagttaaacctggagagccaa

SEQ ID NO: 197380 - DNA, 22 bp, Artificial Sequence
  Synthetic oligonucleotide; TTA chr2 60475030 60475051 60475047 60475052 +
aacctggagagccaagagaaag

SEQ ID NO: 197381 - DNA, 22 bp, Artificial Sequence
  Synthetic oligonucleotide; CTG chr2 60475036 60475057 60475053 60475058 +
gagagccaagagaaaggatatc

SEQ ID NO: 197382 - DNA, 22 bp, Artificial Sequence
  Synthetic oligonucleotide; CTA chr2 60475061 60475082 60475078 60475083 +
gataaaaagaaaaagcaggtaa

SEQ ID NO: 197383 - DNA, 22 bp, Artificial Sequence
  Synthetic oligonucleotide; CTT chr2 60475091 60475112 60475108 60475113 +
agagagaagcaaagcccaaggt

SEQ ID NO: 197384 - DNA, 22 bp, Artificial Sequence
  Synthetic oligonucleotide; TTA chr2 60475092 60475113 60475109 60475114 +
gagagaagcaaagcccaaggtg

SEQ ID NO: 197385 - DNA, 22 bp, Artificial Sequence
  Synthetic oligonucleotide; TTA chr2 60475147 60475168 60475164 60475169 +
cattcacatcaaaatattgcac

SEQ ID NO: 197386 - DNA, 22 bp, Artificial Sequence
  Synthetic oligonucleotide; TTC chr2 60475152 60475173 60475169 60475174 +
acatcaaaatattgcacactga

SEQ ID NO: 197387 - DNA, 22 bp, Artificial Sequence
  Synthetic oligonucleotide; TTG chr2 60475166 60475187 60475183 60475188 +
cacactgattcatccagttgac

SEQ ID NO: 197388 - DNA, 22 bp, Artificial Sequence
  Synthetic oligonucleotide; CTG chr2 60475173 60475194 60475190 60475195 +
attcatccagttgacagcggag

SEQ ID NO: 197389 - DNA, 22 bp, Artificial Sequence
  Synthetic oligonucleotide; TTC chr2 60475177 60475198 60475194 60475199 +
atccagttgacagcggaggata

SEQ ID NO: 197390 - DNA, 22 bp, Artificial Sequence
  Synthetic oligonucleotide; TTG chr2 60475186 60475207 60475203 60475208 +
acagcggaggatacgaccatct

SEQ ID NO: 197391 - DNA, 22 bp, Artificial Sequence
  Synthetic oligonucleotide; CTA chr2 60475209 60475230 60475226 60475231 +
aataaatcctctgaagatttct

SEQ ID NO: 197392 - DNA, 22 bp, Artificial Sequence
  Synthetic oligonucleotide; CTC chr2 60475220 60475241 60475237 60475242 +
tgaagatttctgtgacatcttc

SEQ ID NO: 197393 - DNA, 22 bp, Artificial Sequence
  Synthetic oligonucleotide; CTG chr2 60475222 60475243 60475239 60475244 +
aagatttctgtgacatcttcag

SEQ ID NO: 197394 - DNA, 22 bp, Artificial Sequence
  Synthetic oligonucleotide; TTT chr2 60475229 60475250 60475246 60475251 +
ctgtgacatcttcagctttcac

SEQ ID NO: 197395 - DNA, 22 bp, Artificial Sequence
  Synthetic oligonucleotide; TTC chr2 60475230 60475251 60475247 60475252 +
tgtgacatcttcagctttcaca

SEQ ID NO: 197396 - DNA, 22 bp, Artificial Sequence
  Synthetic oligonucleotide; CTG chr2 60475232 60475253 60475249 60475254 +
tgacatcttcagctttcacaag

SEQ ID NO: 197397 - DNA, 22 bp, Artificial Sequence
  Synthetic oligonucleotide; CTT chr2 60475241 60475262 60475258 60475263 +
cagctttcacaagtgcgtattt

SEQ ID NO: 197398 - DNA, 22 bp, Artificial Sequence
  Synthetic oligonucleotide; TTC chr2 60475242 60475263 60475259 60475264 +
agctttcacaagtgcgtatttt

SEQ ID NO: 197399 - DNA, 22 bp, Artificial Sequence
  Synthetic oligonucleotide; CTT chr2 60475247 60475268 60475264 60475269 +
tcacaagtgcgtattttccaat

SEQ ID NO: 197400 - DNA, 22 bp, Artificial Sequence
  Synthetic oligonucleotide; TTT chr2 60475248 60475269 60475265 60475270 +
cacaagtgcgtattttccaatt

SEQ ID NO: 197401 - DNA, 22 bp, Artificial Sequence
  Synthetic oligonucleotide; TTC chr2 60475249 60475270 60475266 60475271 +
acaagtgcgtattttccaattt

SEQ ID NO: 197402 - DNA, 22 bp, Artificial Sequence
  Synthetic oligonucleotide; TTT chr2 60475263 60475284 60475280 60475285 +
tccaatttcacattttctgaaa

SEQ ID NO: 197403 - DNA, 22 bp, Artificial Sequence
  Synthetic oligonucleotide; TTT chr2 60475264 60475285 60475281 60475286 +
ccaatttcacattttctgaaaa

SEQ ID NO: 197404 - DNA, 22 bp, Artificial Sequence
  Synthetic oligonucleotide; TTC chr2 60475265 60475286 60475282 60475287 +
caatttcacattttctgaaaat

SEQ ID NO: 197405 - DNA, 22 bp, Artificial Sequence
  Synthetic oligonucleotide; TTT chr2 60475271 60475292 60475288 60475293 +
cacattttctgaaaataaggga

SEQ ID NO: 197406 - DNA, 22 bp, Artificial Sequence
  Synthetic oligonucleotide; TTC chr2 60475272 60475293 60475289 60475294 +
acattttctgaaaataagggac

SEQ ID NO: 197407 - DNA, 22 bp, Artificial Sequence
  Synthetic oligonucleotide; TTT chr2 60475278 60475299 60475295 60475300 +
tctgaaaataagggacacaacc

SEQ ID NO: 197408 - DNA, 22 bp, Artificial Sequence
  Synthetic oligonucleotide; TTT chr2 60475279 60475300 60475296 60475301 +
ctgaaaataagggacacaacca

SEQ ID NO: 197409 - DNA, 22 bp, Artificial Sequence
  Synthetic oligonucleotide; TTC chr2 60475280 60475301 60475297 60475302 +
tgaaaataagggacacaaccat

SEQ ID NO: 197410 - DNA, 22 bp, Artificial Sequence
  Synthetic oligonucleotide; CTG chr2 60475282 60475303 60475299 60475304 +
aaaataagggacacaaccatgt

SEQ ID NO: 197411 - DNA, 22 bp, Artificial Sequence
  Synthetic oligonucleotide; CTC chr2 60475310 60475331 60475327 60475332 +
ttgtgaaactccatgaaggttc

SEQ ID NO: 197412 - DNA, 22 bp, Artificial Sequence
  Synthetic oligonucleotide; CTT chr2 60475312 60475333 60475329 60475334 +
gtgaaactccatgaaggttcat

SEQ ID NO: 197413 - DNA, 22 bp, Artificial Sequence
  Synthetic oligonucleotide; TTG chr2 60475313 60475334 60475330 60475335 +
tgaaactccatgaaggttcatc

SEQ ID NO: 197414 - DNA, 22 bp, Artificial Sequence
  Synthetic oligonucleotide; CTC chr2 60475321 60475342 60475338 60475343 +
catgaaggttcatctgttctgt

SEQ ID NO: 197415 - DNA, 22 bp, Artificial Sequence
  Synthetic oligonucleotide; TTC chr2 60475332 60475353 60475349 60475354 +
atctgttctgttttccccccac

SEQ ID NO: 197416 - DNA, 22 bp, Artificial Sequence
  Synthetic oligonucleotide; CTG chr2 60475337 60475358 60475354 60475359 +
ttctgttttccccccacctcaa

SEQ ID NO: 197417 - DNA, 22 bp, Artificial Sequence
  Synthetic oligonucleotide; TTC chr2 60475340 60475361 60475357 60475362 +
tgttttccccccacctcaattg

SEQ ID NO: 197418 - DNA, 22 bp, Artificial Sequence
  Synthetic oligonucleotide; CTG chr2 60475342 60475363 60475359 60475364 +
ttttccccccacctcaattgtt

SEQ ID NO: 197419 - DNA, 22 bp, Artificial Sequence
  Synthetic oligonucleotide; TTT chr2 60475345 60475366 60475362 60475367 +
tccccccacctcaattgtttct

SEQ ID NO: 197420 - DNA, 22 bp, Artificial Sequence
  Synthetic oligonucleotide; TTT chr2 60475346 60475367 60475363 60475368 +
ccccccacctcaattgtttctt

SEQ ID NO: 197421 - DNA, 22 bp, Artificial Sequence
  Synthetic oligonucleotide; TTC chr2 60475347 60475368 60475364 60475369 +
cccccacctcaattgtttcttc

SEQ ID NO: 197422 - DNA, 22 bp, Artificial Sequence
  Synthetic oligonucleotide; CTC chr2 60475357 60475378 60475374 60475379 +
aattgtttcttcccccaatgaa

SEQ ID NO: 197423 - DNA, 22 bp, Artificial Sequence
  Synthetic oligonucleotide; TTG chr2 60475362 60475383 60475379 60475384 +
tttcttcccccaatgaatgtgg

SEQ ID NO: 197424 - DNA, 22 bp, Artificial Sequence
  Synthetic oligonucleotide; TTT chr2 60475365 60475386 60475382 60475387 +
cttcccccaatgaatgtgggtg

SEQ ID NO: 197425 - DNA, 22 bp, Artificial Sequence
  Synthetic oligonucleotide; TTC chr2 60475366 60475387 60475383 60475388 +
ttcccccaatgaatgtgggtgg

SEQ ID NO: 197426 - DNA, 22 bp, Artificial Sequence
  Synthetic oligonucleotide; CTT chr2 60475368 60475389 60475385 60475390 +
cccccaatgaatgtgggtggcc

SEQ ID NO: 197427 - DNA, 22 bp, Artificial Sequence
  Synthetic oligonucleotide; TTC chr2 60475369 60475390 60475386 60475391 +
ccccaatgaatgtgggtggccc

SEQ ID NO: 197428 - DNA, 22 bp, Artificial Sequence
  Synthetic oligonucleotide; CTA chr2 60475395 60475416 60475412 60475417 +
aggcaaaatttactatgtttta

SEQ ID NO: 197429 - DNA, 22 bp, Artificial Sequence
  Synthetic oligonucleotide; TTT chr2 60475406 60475427 60475423 60475428 +
actatgttttattcctctgagt

SEQ ID NO: 197430 - DNA, 22 bp, Artificial Sequence
  Synthetic oligonucleotide; TTA chr2 60475407 60475428 60475424 60475429 +
ctatgttttattcctctgagtc

SEQ ID NO: 197431 - DNA, 22 bp, Artificial Sequence
  Synthetic oligonucleotide; CTA chr2 60475410 60475431 60475427 60475432 +
tgttttattcctctgagtcaga

SEQ ID NO: 197432 - DNA, 22 bp, Artificial Sequence
  Synthetic oligonucleotide; TTT chr2 60475415 60475436 60475432 60475437 +
tattcctctgagtcagacaaac

SEQ ID NO: 197433 - DNA, 22 bp, Artificial Sequence
  Synthetic oligonucleotide; TTT chr2 60475416 60475437 60475433 60475438 +
attcctctgagtcagacaaaca

SEQ ID NO: 197434 - DNA, 22 bp, Artificial Sequence
  Synthetic oligonucleotide; TTA chr2 60475417 60475438 60475434 60475439 +
ttcctctgagtcagacaaacaa

SEQ ID NO: 197435 - DNA, 22 bp, Artificial Sequence
  Synthetic oligonucleotide; TTC chr2 60475420 60475441 60475437 60475442 +
ctctgagtcagacaaacaagtg

SEQ ID NO: 197436 - DNA, 22 bp, Artificial Sequence
  Synthetic oligonucleotide; CTC chr2 60475423 60475444 60475440 60475445 +
tgagtcagacaaacaagtgttg

SEQ ID NO: 197437 - DNA, 22 bp, Artificial Sequence
  Synthetic oligonucleotide; CTG chr2 60475425 60475446 60475442 60475447 +
agtcagacaaacaagtgttgat

SEQ ID NO: 197438 - DNA, 22 bp, Artificial Sequence
  Synthetic oligonucleotide; TTG chr2 60475445 60475466 60475462 60475467 +
atagccatgttcttccttgcaa

SEQ ID NO: 197439 - DNA, 22 bp, Artificial Sequence
  Synthetic oligonucleotide; TTC chr2 60475457 60475478 60475474 60475479 +
ttccttgcaatactgcctccct

SEQ ID NO: 197440 - DNA, 22 bp, Artificial Sequence
  Synthetic oligonucleotide; CTT chr2 60475459 60475480 60475476 60475481 +
ccttgcaatactgcctccctgg

SEQ ID NO: 197441 - DNA, 22 bp, Artificial Sequence
  Synthetic oligonucleotide; TTC chr2 60475460 60475481 60475477 60475482 +
cttgcaatactgcctccctggc

SEQ ID NO: 197442 - DNA, 22 bp, Artificial Sequence
  Synthetic oligonucleotide; CTT chr2 60475463 60475484 60475480 60475485 +
gcaatactgcctccctggctta

SEQ ID NO: 197443 - DNA, 22 bp, Artificial Sequence
  Synthetic oligonucleotide; TTG chr2 60475464 60475485 60475481 60475486 +
caatactgcctccctggcttaa

SEQ ID NO: 197444 - DNA, 22 bp, Artificial Sequence
  Synthetic oligonucleotide; CTG chr2 60475472 60475493 60475489 60475494 +
cctccctggcttaaataatcta

SEQ ID NO: 197445 - DNA, 22 bp, Artificial Sequence
  Synthetic oligonucleotide; CTC chr2 60475476 60475497 60475493 60475498 +
cctggcttaaataatctatttc

SEQ ID NO: 197446 - DNA, 22 bp, Artificial Sequence
  Synthetic oligonucleotide; CTG chr2 60475480 60475501 60475497 60475502 +
gcttaaataatctatttcagat

SEQ ID NO: 197447 - DNA, 22 bp, Artificial Sequence
  Synthetic oligonucleotide; CTT chr2 60475484 60475505 60475501 60475506 +
aaataatctatttcagatgtct

SEQ ID NO: 197448 - DNA, 22 bp, Artificial Sequence
  Synthetic oligonucleotide; TTA chr2 60475485 60475506 60475502 60475507 +
aataatctatttcagatgtctc

SEQ ID NO: 197449 - DNA, 22 bp, Artificial Sequence
  Synthetic oligonucleotide; CTA chr2 60475494 60475515 60475511 60475516 +
tttcagatgtctcattgccagt

SEQ ID NO: 197450 - DNA, 22 bp, Artificial Sequence
  Synthetic oligonucleotide; TTT chr2 60475497 60475518 60475514 60475519 +
cagatgtctcattgccagttta

SEQ ID NO: 197451 - DNA, 22 bp, Artificial Sequence
  Synthetic oligonucleotide; TTC chr2 60475498 60475519 60475515 60475520 +
agatgtctcattgccagtttaa

SEQ ID NO: 197452 - DNA, 22 bp, Artificial Sequence
  Synthetic oligonucleotide; CTC chr2 60475507 60475528 60475524 60475529 +
attgccagtttaagatgggctt

SEQ ID NO: 197453 - DNA, 22 bp, Artificial Sequence
  Synthetic oligonucleotide; TTG chr2 60475511 60475532 60475528 60475533 +
ccagtttaagatgggcttgtac

SEQ ID NO: 197454 - DNA, 22 bp, Artificial Sequence
  Synthetic oligonucleotide; TTT chr2 60475518 60475539 60475535 60475540 +
aagatgggcttgtacttgctga

SEQ ID NO: 197455 - DNA, 22 bp, Artificial Sequence
  Synthetic oligonucleotide; TTA chr2 60475519 60475540 60475536 60475541 +
agatgggcttgtacttgctgac

SEQ ID NO: 197456 - DNA, 22 bp, Artificial Sequence
  Synthetic oligonucleotide; CTT chr2 60475529 60475550 60475546 60475551 +
gtacttgctgacacattttcaa

SEQ ID NO: 197457 - DNA, 22 bp, Artificial Sequence
  Synthetic oligonucleotide; TTG chr2 60475530 60475551 60475547 60475552 +
tacttgctgacacattttcaac

SEQ ID NO: 197458 - DNA, 22 bp, Artificial Sequence
  Synthetic oligonucleotide; CTT chr2 60475535 60475556 60475552 60475557 +
gctgacacattttcaacaaatg

SEQ ID NO: 197459 - DNA, 22 bp, Artificial Sequence
  Synthetic oligonucleotide; TTG chr2 60475536 60475557 60475553 60475558 +
ctgacacattttcaacaaatga

SEQ ID NO: 197460 - DNA, 22 bp, Artificial Sequence
  Synthetic oligonucleotide; CTG chr2 60475539 60475560 60475556 60475561 +
acacattttcaacaaatgactg

SEQ ID NO: 197461 - DNA, 22 bp, Artificial Sequence
  Synthetic oligonucleotide; TTT chr2 60475547 60475568 60475564 60475569 +
tcaacaaatgactgtgcaagaa

SEQ ID NO: 197462 - DNA, 22 bp, Artificial Sequence
  Synthetic oligonucleotide; TTT chr2 60475548 60475569 60475565 60475570 +
caacaaatgactgtgcaagaaa

SEQ ID NO: 197463 - DNA, 22 bp, Artificial Sequence
  Synthetic oligonucleotide; TTC chr2 60475549 60475570 60475566 60475571 +
aacaaatgactgtgcaagaaac

SEQ ID NO: 197464 - DNA, 22 bp, Artificial Sequence
  Synthetic oligonucleotide; CTG chr2 60475561 60475582 60475578 60475583 +
tgcaagaaacattgagattttc

SEQ ID NO: 197465 - DNA, 22 bp, Artificial Sequence
  Synthetic oligonucleotide; TTG chr2 60475575 60475596 60475592 60475597 +
agattttcctacactactttgt

SEQ ID NO: 197466 - DNA, 22 bp, Artificial Sequence
  Synthetic oligonucleotide; TTT chr2 60475581 60475602 60475598 60475603 +
tcctacactactttgtctcttc

SEQ ID NO: 197467 - DNA, 22 bp, Artificial Sequence
  Synthetic oligonucleotide; TTT chr2 60475582 60475603 60475599 60475604 +
cctacactactttgtctcttca

SEQ ID NO: 197468 - DNA, 22 bp, Artificial Sequence
  Synthetic oligonucleotide; TTC chr2 60475583 60475604 60475600 60475605 +
ctacactactttgtctcttcaa

SEQ ID NO: 197469 - DNA, 22 bp, Artificial Sequence
  Synthetic oligonucleotide; CTA chr2 60475586 60475607 60475603 60475608 +
cactactttgtctcttcaatca

SEQ ID NO: 197470 - DNA, 22 bp, Artificial Sequence
  Synthetic oligonucleotide; CTA chr2 60475591 60475612 60475608 60475613 +
ctttgtctcttcaatcatcaac

SEQ ID NO: 197471 - DNA, 22 bp, Artificial Sequence
  Synthetic oligonucleotide; CTT chr2 60475594 60475615 60475611 60475616 +
tgtctcttcaatcatcaacttg

SEQ ID NO: 197472 - DNA, 22 bp, Artificial Sequence
  Synthetic oligonucleotide; TTT chr2 60475595 60475616 60475612 60475617 +
gtctcttcaatcatcaacttga

SEQ ID NO: 197473 - DNA, 22 bp, Artificial Sequence
  Synthetic oligonucleotide; TTG chr2 60475596 60475617 60475613 60475618 +
tctcttcaatcatcaacttgac

SEQ ID NO: 197474 - DNA, 22 bp, Artificial Sequence
  Synthetic oligonucleotide; CTC chr2 60475600 60475621 60475617 60475622 +
ttcaatcatcaacttgaccatc

SEQ ID NO: 197475 - DNA, 22 bp, Artificial Sequence
  Synthetic oligonucleotide; CTT chr2 60475602 60475623 60475619 60475624 +
caatcatcaacttgaccatccc

SEQ ID NO: 197476 - DNA, 22 bp, Artificial Sequence
  Synthetic oligonucleotide; TTC chr2 60475603 60475624 60475620 60475625 +
aatcatcaacttgaccatccct

SEQ ID NO: 197477 - DNA, 22 bp, Artificial Sequence
  Synthetic oligonucleotide; CTT chr2 60475615 60475636 60475632 60475637 +
gaccatccctccaaatttcccc

SEQ ID NO: 197478 - DNA, 22 bp, Artificial Sequence
  Synthetic oligonucleotide; TTG chr2 60475616 60475637 60475633 60475638 +
accatccctccaaatttcccct

SEQ ID NO: 197479 - DNA, 22 bp, Artificial Sequence
  Synthetic oligonucleotide; CTC chr2 60475626 60475647 60475643 60475648 +
caaatttcccctctttcttctt

SEQ ID NO: 197480 - DNA, 22 bp, Artificial Sequence
  Synthetic oligonucleotide; TTT chr2 60475633 60475654 60475650 60475655 +
cccctctttcttcttttcaaag

SEQ ID NO: 197481 - DNA, 22 bp, Artificial Sequence
  Synthetic oligonucleotide; TTC chr2 60475634 60475655 60475651 60475656 +
ccctctttcttcttttcaaagc

SEQ ID NO: 197482 - DNA, 22 bp, Artificial Sequence
  Synthetic oligonucleotide; CTC chr2 60475639 60475660 60475656 60475661 +
tttcttcttttcaaagccatgg

SEQ ID NO: 197483 - DNA, 22 bp, Artificial Sequence
  Synthetic oligonucleotide; CTT chr2 60475641 60475662 60475658 60475663 +
tcttcttttcaaagccatgggg

SEQ ID NO: 197484 - DNA, 22 bp, Artificial Sequence
  Synthetic oligonucleotide; TTT chr2 60475642 60475663 60475659 60475664 +
cttcttttcaaagccatgggga

SEQ ID NO: 197485 - DNA, 22 bp, Artificial Sequence
  Synthetic oligonucleotide; TTC chr2 60475643 60475664 60475660 60475665 +
ttcttttcaaagccatggggag

SEQ ID NO: 197486 - DNA, 22 bp, Artificial Sequence
  Synthetic oligonucleotide; CTT chr2 60475645 60475666 60475662 60475667 +
cttttcaaagccatggggagga

SEQ ID NO: 197487 - DNA, 22 bp, Artificial Sequence
  Synthetic oligonucleotide; TTC chr2 60475646 60475667 60475663 60475668 +
ttttcaaagccatggggaggat

SEQ ID NO: 197488 - DNA, 22 bp, Artificial Sequence
  Synthetic oligonucleotide; CTT chr2 60475648 60475669 60475665 60475670 +
ttcaaagccatggggaggatag

SEQ ID NO: 197489 - DNA, 22 bp, Artificial Sequence
  Synthetic oligonucleotide; TTT chr2 60475649 60475670 60475666 60475671 +
tcaaagccatggggaggatagg

SEQ ID NO: 197490 - DNA, 22 bp, Artificial Sequence
  Synthetic oligonucleotide; TTT chr2 60475650 60475671 60475667 60475672 +
caaagccatggggaggataggg

SEQ ID NO: 197491 - DNA, 22 bp, Artificial Sequence
  Synthetic oligonucleotide; TTC chr2 60475651 60475672 60475668 60475673 +
aaagccatggggaggatagggg

SEQ ID NO: 197492 - DNA, 22 bp, Artificial Sequence
  Synthetic oligonucleotide; CTT chr2 60475680 60475701 60475697 60475702 +
actcctgctctgagtcctcagc

SEQ ID NO: 197493 - DNA, 22 bp, Artificial Sequence
  Synthetic oligonucleotide; TTA chr2 60475681 60475702 60475698 60475703 +
ctcctgctctgagtcctcagct

SEQ ID NO: 197494 - DNA, 22 bp, Artificial Sequence
  Synthetic oligonucleotide; CTC chr2 60475684 60475705 60475701 60475706 +
ctgctctgagtcctcagctgag

SEQ ID NO: 197495 - DNA, 22 bp, Artificial Sequence
  Synthetic oligonucleotide; CTG chr2 60475687 60475708 60475704 60475709 +
ctctgagtcctcagctgaggat

SEQ ID NO: 197496 - DNA, 22 bp, Artificial Sequence
  Synthetic oligonucleotide; CTC chr2 60475690 60475711 60475707 60475712 +
tgagtcctcagctgaggatctt

SEQ ID NO: 197497 - DNA, 22 bp, Artificial Sequence
  Synthetic oligonucleotide; CTG chr2 60475692 60475713 60475709 60475714 +
agtcctcagctgaggatcttgt

SEQ ID NO: 197498 - DNA, 22 bp, Artificial Sequence
  Synthetic oligonucleotide; CTC chr2 60475699 60475720 60475716 60475721 +
agctgaggatcttgtttgtgtg

SEQ ID NO: 197499 - DNA, 22 bp, Artificial Sequence
  Synthetic oligonucleotide; CTG chr2 60475704 60475725 60475721 60475726 +
aggatcttgtttgtgtgtagtg

SEQ ID NO: 197500 - DNA, 22 bp, Artificial Sequence
  Synthetic oligonucleotide; CTT chr2 60475712 60475733 60475729 60475734 +
gtttgtgtgtagtgggggcagg

SEQ ID NO: 197501 - DNA, 22 bp, Artificial Sequence
  Synthetic oligonucleotide; TTG chr2 60475713 60475734 60475730 60475735 +
tttgtgtgtagtgggggcaggg

SEQ ID NO: 197502 - DNA, 22 bp, Artificial Sequence
  Synthetic oligonucleotide; TTT chr2 60475716 60475737 60475733 60475738 +
gtgtgtagtgggggcaggggga

SEQ ID NO: 197503 - DNA, 22 bp, Artificial Sequence
  Synthetic oligonucleotide; TTG chr2 60475717 60475738 60475734 60475739 +
tgtgtagtgggggcagggggag

SEQ ID NO: 197504 - DNA, 22 bp, Artificial Sequence
  Synthetic oligonucleotide; CTT chr2 60475751 60475772 60475768 60475773 +
gcctctatccgaggtatttatc

SEQ ID NO: 197505 - DNA, 22 bp, Artificial Sequence
  Synthetic oligonucleotide; TTG chr2 60475752 60475773 60475769 60475774 +
cctctatccgaggtatttatca

SEQ ID NO: 197506 - DNA, 22 bp, Artificial Sequence
  Synthetic oligonucleotide; CTC chr2 60475756 60475777 60475773 60475778 +
tatccgaggtatttatcaggtt

SEQ ID NO: 197507 - DNA, 22 bp, Artificial Sequence
  Synthetic oligonucleotide; CTA chr2 60475758 60475779 60475775 60475780 +
tccgaggtatttatcaggttat

SEQ ID NO: 197508 - DNA, 22 bp, Artificial Sequence
  Synthetic oligonucleotide; TTT chr2 60475770 60475791 60475787 60475792 +
atcaggttatttgggagctact

SEQ ID NO: 197509 - DNA, 22 bp, Artificial Sequence
  Synthetic oligonucleotide; TTA chr2 60475771 60475792 60475788 60475793 +
tcaggttatttgggagctactt

SEQ ID NO: 197510 - DNA, 22 bp, Artificial Sequence
  Synthetic oligonucleotide; TTA chr2 60475779 60475800 60475796 60475801 +
tttgggagctactttcagagat

SEQ ID NO: 197511 - DNA, 22 bp, Artificial Sequence
  Synthetic oligonucleotide; TTT chr2 60475782 60475803 60475799 60475804 +
gggagctactttcagagatgcc

SEQ ID NO: 197512 - DNA, 22 bp, Artificial Sequence
  Synthetic oligonucleotide; TTG chr2 60475783 60475804 60475800 60475805 +
ggagctactttcagagatgccc

SEQ ID NO: 197513 - DNA, 22 bp, Artificial Sequence
  Synthetic oligonucleotide; CTA chr2 60475790 60475811 60475807 60475812 +
ctttcagagatgcccttgctct

SEQ ID NO: 197514 - DNA, 22 bp, Artificial Sequence
  Synthetic oligonucleotide; CTT chr2 60475793 60475814 60475810 60475815 +
tcagagatgcccttgctctatg

SEQ ID NO: 197515 - DNA, 22 bp, Artificial Sequence
  Synthetic oligonucleotide; TTT chr2 60475794 60475815 60475811 60475816 +
cagagatgcccttgctctatgt

SEQ ID NO: 197516 - DNA, 22 bp, Artificial Sequence
  Synthetic oligonucleotide; TTC chr2 60475795 60475816 60475812 60475817 +
agagatgcccttgctctatgta

SEQ ID NO: 197517 - DNA, 22 bp, Artificial Sequence
  Synthetic oligonucleotide; CTT chr2 60475807 60475828 60475824 60475829 +
gctctatgtattcccactgcca

SEQ ID NO: 197518 - DNA, 22 bp, Artificial Sequence
  Synthetic oligonucleotide; TTG chr2 60475808 60475829 60475825 60475830 +
ctctatgtattcccactgccac

SEQ ID NO: 197519 - DNA, 22 bp, Artificial Sequence
  Synthetic oligonucleotide; CTC chr2 60475811 60475832 60475828 60475833 +
tatgtattcccactgccaccac

SEQ ID NO: 197520 - DNA, 22 bp, Artificial Sequence
  Synthetic oligonucleotide; CTA chr2 60475813 60475834 60475830 60475835 +
tgtattcccactgccaccactc

SEQ ID NO: 197521 - DNA, 22 bp, Artificial Sequence
  Synthetic oligonucleotide; TTC chr2 60475820 60475841 60475837 60475842 +
ccactgccaccactccccggat

SEQ ID NO: 197522 - DNA, 22 bp, Artificial Sequence
  Synthetic oligonucleotide; CTG chr2 60475826 60475847 60475843 60475848 +
ccaccactccccggattctttt

SEQ ID NO: 197523 - DNA, 22 bp, Artificial Sequence
  Synthetic oligonucleotide; CTC chr2 60475835 60475856 60475852 60475857 +
cccggattcttttcttccttta

SEQ ID NO: 197524 - DNA, 22 bp, Artificial Sequence
  Synthetic oligonucleotide; TTC chr2 60475844 60475865 60475861 60475866 +
ttttcttcctttaggaagcagg

SEQ ID NO: 197525 - DNA, 22 bp, Artificial Sequence
  Synthetic oligonucleotide; CTT chr2 60475846 60475867 60475863 60475868 +
ttcttcctttaggaagcaggga

SEQ ID NO: 197526 - DNA, 22 bp, Artificial Sequence
  Synthetic oligonucleotide; TTT chr2 60475847 60475868 60475864 60475869 +
tcttcctttaggaagcagggac

SEQ ID NO: 197527 - DNA, 22 bp, Artificial Sequence
  Synthetic oligonucleotide; TTT chr2 60475848 60475869 60475865 60475870 +
cttcctttaggaagcagggact

SEQ ID NO: 197528 - DNA, 22 bp, Artificial Sequence
  Synthetic oligonucleotide; TTC chr2 60475849 60475870 60475866 60475871 +
ttcctttaggaagcagggactt

SEQ ID NO: 197529 - DNA, 22 bp, Artificial Sequence
  Synthetic oligonucleotide; CTT chr2 60475851 60475872 60475868 60475873 +
cctttaggaagcagggacttgt

SEQ ID NO: 197530 - DNA, 22 bp, Artificial Sequence
  Synthetic oligonucleotide; TTC chr2 60475852 60475873 60475869 60475874 +
ctttaggaagcagggacttgtt

SEQ ID NO: 197531 - DNA, 22 bp, Artificial Sequence
  Synthetic oligonucleotide; CTT chr2 60475855 60475876 60475872 60475877 +
taggaagcagggacttgttcct

SEQ ID NO: 197532 - DNA, 22 bp, Artificial Sequence
  Synthetic oligonucleotide; TTT chr2 60475856 60475877 60475873 60475878 +
aggaagcagggacttgttcctc

SEQ ID NO: 197533 - DNA, 22 bp, Artificial Sequence
  Synthetic oligonucleotide; TTA chr2 60475857 60475878 60475874 60475879 +
ggaagcagggacttgttcctct

SEQ ID NO: 197534 - DNA, 22 bp, Artificial Sequence
  Synthetic oligonucleotide; CTT chr2 60475871 60475892 60475888 60475893 +
gttcctctggagagactgctag

SEQ ID NO: 197535 - DNA, 22 bp, Artificial Sequence
  Synthetic oligonucleotide; TTG chr2 60475872 60475893 60475889 60475894 +
ttcctctggagagactgctaga

SEQ ID NO: 197536 - DNA, 22 bp, Artificial Sequence
  Synthetic oligonucleotide; TTC chr2 60475875 60475896 60475892 60475897 +
ctctggagagactgctagagga

SEQ ID NO: 197537 - DNA, 22 bp, Artificial Sequence
  Synthetic oligonucleotide; CTC chr2 60475878 60475899 60475895 60475900 +
tggagagactgctagaggaaag

SEQ ID NO: 197538 - DNA, 22 bp, Artificial Sequence
  Synthetic oligonucleotide; CTG chr2 60475880 60475901 60475897 60475902 +
gagagactgctagaggaaagtc

SEQ ID NO: 197539 - DNA, 22 bp, Artificial Sequence
  Synthetic oligonucleotide; CTG chr2 60475889 60475910 60475906 60475911 +
ctagaggaaagtcaggaaccta

SEQ ID NO: 197540 - DNA, 22 bp, Artificial Sequence
  Synthetic oligonucleotide; CTA chr2 60475892 60475913 60475909 60475914 +
gaggaaagtcaggaacctaagt

SEQ ID NO: 197541 - DNA, 22 bp, Artificial Sequence
  Synthetic oligonucleotide; CTA chr2 60475911 60475932 60475928 60475933 +
agttctgcaaccccaactctgc

SEQ ID NO: 197542 - DNA, 22 bp, Artificial Sequence
  Synthetic oligonucleotide; TTC chr2 60475916 60475937 60475933 60475938 +
tgcaaccccaactctgccactc

SEQ ID NO: 197543 - DNA, 22 bp, Artificial Sequence
  Synthetic oligonucleotide; CTG chr2 60475918 60475939 60475935 60475940 +
caaccccaactctgccactcac

SEQ ID NO: 197544 - DNA, 22 bp, Artificial Sequence
  Synthetic oligonucleotide; CTC chr2 60475930 60475951 60475947 60475952 +
tgccactcaccagctgtttcgt

SEQ ID NO: 197545 - DNA, 22 bp, Artificial Sequence
  Synthetic oligonucleotide; CTG chr2 60475932 60475953 60475949 60475954 +
ccactcaccagctgtttcgtga

SEQ ID NO: 197546 - DNA, 22 bp, Artificial Sequence
  Synthetic oligonucleotide; CTC chr2 60475938 60475959 60475955 60475960 +
accagctgtttcgtgactttga

SEQ ID NO: 197547 - DNA, 22 bp, Artificial Sequence
  Synthetic oligonucleotide; CTG chr2 60475946 60475967 60475963 60475968 +
tttcgtgactttgaataaatcc

SEQ ID NO: 197548 - DNA, 22 bp, Artificial Sequence
  Synthetic oligonucleotide; TTT chr2 60475949 60475970 60475966 60475971 +
cgtgactttgaataaatccttt

SEQ ID NO: 197549 - DNA, 22 bp, Artificial Sequence
  Synthetic oligonucleotide; TTC chr2 60475950 60475971 60475967 60475972 +
gtgactttgaataaatcctttc

SEQ ID NO: 197550 - DNA, 22 bp, Artificial Sequence
  Synthetic oligonucleotide; CTT chr2 60475957 60475978 60475974 60475979 +
tgaataaatcctttctttctgg

SEQ ID NO: 197551 - DNA, 22 bp, Artificial Sequence
  Synthetic oligonucleotide; TTT chr2 60475958 60475979 60475975 60475980 +
gaataaatcctttctttctggc

SEQ ID NO: 197552 - DNA, 22 bp, Artificial Sequence
  Synthetic oligonucleotide; TTG chr2 60475959 60475980 60475976 60475981 +
aataaatcctttctttctggcc

SEQ ID NO: 197553 - DNA, 22 bp, Artificial Sequence
  Synthetic oligonucleotide; CTT chr2 60475970 60475991 60475987 60475992 +
tctttctggccctaagtgtttc

SEQ ID NO: 197554 - DNA, 22 bp, Artificial Sequence
  Synthetic oligonucleotide; TTT chr2 60475971 60475992 60475988 60475993 +
ctttctggccctaagtgtttcc

SEQ ID NO: 197555 - DNA, 22 bp, Artificial Sequence
  Synthetic oligonucleotide; TTC chr2 60475972 60475993 60475989 60475994 +
tttctggccctaagtgtttcca

SEQ ID NO: 197556 - DNA, 22 bp, Artificial Sequence
  Synthetic oligonucleotide; CTT chr2 60475974 60475995 60475991 60475996 +
tctggccctaagtgtttccatc

SEQ ID NO: 197557 - DNA, 22 bp, Artificial Sequence
  Synthetic oligonucleotide; TTT chr2 60475975 60475996 60475992 60475997 +
ctggccctaagtgtttccatct

SEQ ID NO: 197558 - DNA, 22 bp, Artificial Sequence
  Synthetic oligonucleotide; TTC chr2 60475976 60475997 60475993 60475998 +
tggccctaagtgtttccatctt

SEQ ID NO: 197559 - DNA, 22 bp, Artificial Sequence
  Synthetic oligonucleotide; CTG chr2 60475978 60475999 60475995 60476000 +
gccctaagtgtttccatcttta

SEQ ID NO: 197560 - DNA, 22 bp, Artificial Sequence
  Synthetic oligonucleotide; CTA chr2 60475984 60476005 60476001 60476006 +
agtgtttccatctttaaaagga

SEQ ID NO: 197561 - DNA, 22 bp, Artificial Sequence
  Synthetic oligonucleotide; TTT chr2 60475991 60476012 60476008 60476013 +
ccatctttaaaaggagaagact

SEQ ID NO: 197562 - DNA, 22 bp, Artificial Sequence
  Synthetic oligonucleotide; TTC chr2 60475992 60476013 60476009 60476014 +
catctttaaaaggagaagactg

SEQ ID NO: 197563 - DNA, 22 bp, Artificial Sequence
  Synthetic oligonucleotide; CTT chr2 60475998 60476019 60476015 60476020 +
taaaaggagaagactggattag

SEQ ID NO: 197564 - DNA, 22 bp, Artificial Sequence
  Synthetic oligonucleotide; TTT chr2 60475999 60476020 60476016 60476021 +
aaaaggagaagactggattaga

SEQ ID NO: 197565 - DNA, 22 bp, Artificial Sequence
  Synthetic oligonucleotide; TTA chr2 60476000 60476021 60476017 60476022 +
aaaggagaagactggattagat

SEQ ID NO: 197566 - DNA, 22 bp, Artificial Sequence
  Synthetic oligonucleotide; CTG chr2 60476014 60476035 60476031 60476036 +
gattagatggggtggcttctct

SEQ ID NO: 197567 - DNA, 22 bp, Artificial Sequence
  Synthetic oligonucleotide; TTA chr2 60476019 60476040 60476036 60476041 +
gatggggtggcttctctctcct

SEQ ID NO: 197568 - DNA, 22 bp, Artificial Sequence
  Synthetic oligonucleotide; CTT chr2 60476032 60476053 60476049 60476054 +
ctctctcctgcctcccatgcaa

SEQ ID NO: 197569 - DNA, 22 bp, Artificial Sequence
  Synthetic oligonucleotide; TTC chr2 60476033 60476054 60476050 60476055 +
tctctcctgcctcccatgcaag

SEQ ID NO: 197570 - DNA, 22 bp, Artificial Sequence
  Synthetic oligonucleotide; CTC chr2 60476035 60476056 60476052 60476057 +
tctcctgcctcccatgcaagtc

SEQ ID NO: 197571 - DNA, 22 bp, Artificial Sequence
  Synthetic oligonucleotide; CTC chr2 60476037 60476058 60476054 60476059 +
tcctgcctcccatgcaagtcca

SEQ ID NO: 197572 - DNA, 22 bp, Artificial Sequence
  Synthetic oligonucleotide; CTC chr2 60476039 60476060 60476056 60476061 +
ctgcctcccatgcaagtccagg

SEQ ID NO: 197573 - DNA, 22 bp, Artificial Sequence
  Synthetic oligonucleotide; CTG chr2 60476042 60476063 60476059 60476064 +
cctcccatgcaagtccaggcct

SEQ ID NO: 197574 - DNA, 22 bp, Artificial Sequence
  Synthetic oligonucleotide; CTC chr2 60476046 60476067 60476063 60476068 +
ccatgcaagtccaggcctcctt

SEQ ID NO: 197575 - DNA, 22 bp, Artificial Sequence
  Synthetic oligonucleotide; CTC chr2 60476065 60476086 60476082 60476087 +
ctttggaccaaccaagagacct

SEQ ID NO: 197576 - DNA, 22 bp, Artificial Sequence
  Synthetic oligonucleotide; CTT chr2 60476068 60476089 60476085 60476090 +
tggaccaaccaagagacctact

SEQ ID NO: 197577 - DNA, 22 bp, Artificial Sequence
  Synthetic oligonucleotide; TTT chr2 60476069 60476090 60476086 60476091 +
ggaccaaccaagagacctacta

SEQ ID NO: 197578 - DNA, 22 bp, Artificial Sequence
  Synthetic oligonucleotide; TTG chr2 60476070 60476091 60476087 60476092 +
gaccaaccaagagacctactat

SEQ ID NO: 197579 - DNA, 22 bp, Artificial Sequence
  Synthetic oligonucleotide; CTA chr2 60476088 60476109 60476105 60476110 +
ctataggccgtgctagaagctg

SEQ ID NO: 197580 - DNA, 22 bp, Artificial Sequence
  Synthetic oligonucleotide; CTA chr2 60476091 60476112 60476108 60476113 +
taggccgtgctagaagctggcc

SEQ ID NO: 197581 - DNA, 22 bp, Artificial Sequence
  Synthetic oligonucleotide; CTA chr2 60476103 60476124 60476120 60476125 +
gaagctggccaggatacacctg

SEQ ID NO: 197582 - DNA, 22 bp, Artificial Sequence
  Synthetic oligonucleotide; CTG chr2 60476110 60476131 60476127 60476132 +
gccaggatacacctgttcccct

SEQ ID NO: 197583 - DNA, 22 bp, Artificial Sequence
  Synthetic oligonucleotide; CTG chr2 60476125 60476146 60476142 60476147 +
ttcccctcatgaccttgacctg

SEQ ID NO: 197584 - DNA, 22 bp, Artificial Sequence
  Synthetic oligonucleotide; TTC chr2 60476128 60476149 60476145 60476150 +
ccctcatgaccttgacctggat

SEQ ID NO: 197585 - DNA, 22 bp, Artificial Sequence
  Synthetic oligonucleotide; CTC chr2 60476133 60476154 60476150 60476155 +
atgaccttgacctggatgagga

SEQ ID NO: 197586 - DNA, 22 bp, Artificial Sequence
  Synthetic oligonucleotide; CTT chr2 60476141 60476162 60476158 60476163 +
gacctggatgaggagggcctta

SEQ ID NO: 197587 - DNA, 22 bp, Artificial Sequence
  Synthetic oligonucleotide; TTG chr2 60476142 60476163 60476159 60476164 +
acctggatgaggagggccttat

SEQ ID NO: 197588 - DNA, 22 bp, Artificial Sequence
  Synthetic oligonucleotide; CTG chr2 60476147 60476168 60476164 60476169 +
gatgaggagggccttataggag

SEQ ID NO: 197589 - DNA, 22 bp, Artificial Sequence
  Synthetic oligonucleotide; CTT chr2 60476162 60476183 60476179 60476184 +
ataggagagttcagggctgggc

SEQ ID NO: 197590 - DNA, 22 bp, Artificial Sequence
  Synthetic oligonucleotide; TTA chr2 60476163 60476184 60476180 60476185 +
taggagagttcagggctgggct

SEQ ID NO: 197591 - DNA, 22 bp, Artificial Sequence
  Synthetic oligonucleotide; TTC chr2 60476174 60476195 60476191 60476196 +
agggctgggcttggtccccagg

SEQ ID NO: 197592 - DNA, 22 bp, Artificial Sequence
  Synthetic oligonucleotide; CTG chr2 60476181 60476202 60476198 60476203 +
ggcttggtccccaggctaatcc

SEQ ID NO: 197593 - DNA, 22 bp, Artificial Sequence
  Synthetic oligonucleotide; CTT chr2 60476186 60476207 60476203 60476208 +
ggtccccaggctaatccttagg

SEQ ID NO: 197594 - DNA, 22 bp, Artificial Sequence
  Synthetic oligonucleotide; TTG chr2 60476187 60476208 60476204 60476209 +
gtccccaggctaatccttaggc

SEQ ID NO: 197595 - DNA, 22 bp, Artificial Sequence
  Synthetic oligonucleotide; CTA chr2 60476199 60476220 60476216 60476221 +
atccttaggcttagagagtgag

SEQ ID NO: 197596 - DNA, 22 bp, Artificial Sequence
  Synthetic oligonucleotide; CTT chr2 60476205 60476226 60476222 60476227 +
aggcttagagagtgagcctgat

SEQ ID NO: 197597 - DNA, 22 bp, Artificial Sequence
  Synthetic oligonucleotide; TTA chr2 60476206 60476227 60476223 60476228 +
ggcttagagagtgagcctgatg

SEQ ID NO: 197598 - DNA, 22 bp, Artificial Sequence
  Synthetic oligonucleotide; CTT chr2 60476211 60476232 60476228 60476233 +
agagagtgagcctgatgatgga

SEQ ID NO: 197599 - DNA, 22 bp, Artificial Sequence
  Synthetic oligonucleotide; TTA chr2 60476212 60476233 60476229 60476234 +
gagagtgagcctgatgatggat

SEQ ID NO: 197600 - DNA, 22 bp, Artificial Sequence
  Synthetic oligonucleotide; CTG chr2 60476225 60476246 60476242 60476247 +
atgatggatttcaacctcctgg

SEQ ID NO: 197601 - DNA, 22 bp, Artificial Sequence
  Synthetic oligonucleotide; TTT chr2 60476236 60476257 60476253 60476258 +
caacctcctgggacacagtctt

SEQ ID NO: 197602 - DNA, 22 bp, Artificial Sequence
  Synthetic oligonucleotide; TTC chr2 60476237 60476258 60476254 60476259 +
aacctcctgggacacagtcttg

SEQ ID NO: 197603 - DNA, 22 bp, Artificial Sequence
  Synthetic oligonucleotide; CTC chr2 60476243 60476264 60476260 60476265 +
ctgggacacagtcttgcaaagt

SEQ ID NO: 197604 - DNA, 22 bp, Artificial Sequence
  Synthetic oligonucleotide; CTG chr2 60476246 60476267 60476263 60476268 +
ggacacagtcttgcaaagttta

SEQ ID NO: 197605 - DNA, 22 bp, Artificial Sequence
  Synthetic oligonucleotide; CTT chr2 60476258 60476279 60476275 60476280 +
gcaaagtttacatgtctgagct

SEQ ID NO: 197606 - DNA, 22 bp, Artificial Sequence
  Synthetic oligonucleotide; TTG chr2 60476259 60476280 60476276 60476281 +
caaagtttacatgtctgagctt

SEQ ID NO: 197607 - DNA, 22 bp, Artificial Sequence
  Synthetic oligonucleotide; TTT chr2 60476267 60476288 60476284 60476289 +
acatgtctgagcttcaaggagg

SEQ ID NO: 197608 - DNA, 22 bp, Artificial Sequence
  Synthetic oligonucleotide; TTA chr2 60476268 60476289 60476285 60476290 +
catgtctgagcttcaaggagga

SEQ ID NO: 197609 - DNA, 22 bp, Artificial Sequence
  Synthetic oligonucleotide; CTG chr2 60476276 60476297 60476293 60476298 +
agcttcaaggaggaaacctagg

SEQ ID NO: 197610 - DNA, 22 bp, Artificial Sequence
  Synthetic oligonucleotide; CTT chr2 60476281 60476302 60476298 60476303 +
caaggaggaaacctaggtgtgt

SEQ ID NO: 197611 - DNA, 22 bp, Artificial Sequence
  Synthetic oligonucleotide; TTC chr2 60476282 60476303 60476299 60476304 +
aaggaggaaacctaggtgtgtc

SEQ ID NO: 197612 - DNA, 22 bp, Artificial Sequence
  Synthetic oligonucleotide; CTA chr2 60476296 60476317 60476313 60476318 +
ggtgtgtcctgagccaatgaga

SEQ ID NO: 197613 - DNA, 22 bp, Artificial Sequence
  Synthetic oligonucleotide; CTG chr2 60476307 60476328 60476324 60476329 +
agccaatgagactgaaggtcag

SEQ ID NO: 197614 - DNA, 22 bp, Artificial Sequence
  Synthetic oligonucleotide; CTG chr2 60476321 60476342 60476338 60476343 +
aaggtcagagaaccaggaagaa

SEQ ID NO: 197615 - DNA, 22 bp, Artificial Sequence
  Synthetic oligonucleotide; CTT chr2 60476347 60476368 60476364 60476369 +
ccccaaacccaggctaaatgtc

SEQ ID NO: 197616 - DNA, 22 bp, Artificial Sequence
  Synthetic oligonucleotide; TTC chr2 60476348 60476369 60476365 60476370 +
cccaaacccaggctaaatgtca

SEQ ID NO: 197617 - DNA, 22 bp, Artificial Sequence
  Synthetic oligonucleotide; CTA chr2 60476363 60476384 60476380 60476385 +
aatgtcaagggaaaaggtctca

SEQ ID NO: 197618 - DNA, 22 bp, Artificial Sequence
  Synthetic oligonucleotide; CTC chr2 60476384 60476405 60476401 60476406 +
agtggctcatgccagaagtcca

SEQ ID NO: 197619 - DNA, 22 bp, Artificial Sequence
  Synthetic oligonucleotide; CTC chr2 60476392 60476413 60476409 60476414 +
atgccagaagtccagtagcaaa

SEQ ID NO: 197620 - DNA, 22 bp, Artificial Sequence
  Synthetic oligonucleotide; CTC chr2 60476418 60476439 60476435 60476440 +
ggcctcatgccagagcctggca

SEQ ID NO: 197621 - DNA, 22 bp, Artificial Sequence
  Synthetic oligonucleotide; CTC chr2 60476424 60476445 60476441 60476446 +
atgccagagcctggcacccatt

SEQ ID NO: 197622 - DNA, 22 bp, Artificial Sequence
  Synthetic oligonucleotide; CTG chr2 60476437 60476458 60476454 60476459 +
gcacccattgctcacaaaggca

SEQ ID NO: 197623 - DNA, 22 bp, Artificial Sequence
  Synthetic oligonucleotide; TTG chr2 60476447 60476468 60476464 60476469 +
ctcacaaaggcacacacaggac

SEQ ID NO: 197624 - DNA, 22 bp, Artificial Sequence
  Synthetic oligonucleotide; CTC chr2 60476450 60476471 60476467 60476472 +
acaaaggcacacacaggactct

SEQ ID NO: 197625 - DNA, 22 bp, Artificial Sequence
  Synthetic oligonucleotide; CTC chr2 60476471 60476492 60476488 60476493 +
taagaaaagggagtcctctccc

SEQ ID NO: 197626 - DNA, 22 bp, Artificial Sequence
  Synthetic oligonucleotide; CTA chr2 60476473 60476494 60476490 60476495 +
agaaaagggagtcctctcccca

SEQ ID NO: 197627 - DNA, 22 bp, Artificial Sequence
  Synthetic oligonucleotide; CTC chr2 60476489 60476510 60476506 60476511 +
tccccagccaccacaaaccagg

SEQ ID NO: 197628 - DNA, 22 bp, Artificial Sequence
  Synthetic oligonucleotide; CTC chr2 60476491 60476512 60476508 60476513 +
cccagccaccacaaaccaggac

SEQ ID NO: 197629 - DNA, 22 bp, Artificial Sequence
  Synthetic oligonucleotide; CTG chr2 60476532 60476553 60476549 60476554 +
tggtccttgacctcccaccaca

SEQ ID NO: 197630 - DNA, 22 bp, Artificial Sequence
  Synthetic oligonucleotide; CTT chr2 60476540 60476561 60476557 60476562 +
gacctcccaccacaccccatca

SEQ ID NO: 197631 - DNA, 22 bp, Artificial Sequence
  Synthetic oligonucleotide; TTG chr2 60476541 60476562 60476558 60476563 +
acctcccaccacaccccatcag

SEQ ID NO: 197632 - DNA, 22 bp, Artificial Sequence
  Synthetic oligonucleotide; CTC chr2 60476546 60476567 60476563 60476568 +
ccaccacaccccatcagcatgg

SEQ ID NO: 197633 - DNA, 22 bp, Artificial Sequence
  Synthetic oligonucleotide; TTC chr2 60476575 60476596 60476592 60476597 +
ttggaaagccatgtgtaaaatg

SEQ ID NO: 197634 - DNA, 22 bp, Artificial Sequence
  Synthetic oligonucleotide; CTT chr2 60476577 60476598 60476594 60476599 +
ggaaagccatgtgtaaaatgaa

SEQ ID NO: 197635 - DNA, 22 bp, Artificial Sequence
  Synthetic oligonucleotide; TTG chr2 60476578 60476599 60476595 60476600 +
gaaagccatgtgtaaaatgaat

SEQ ID NO: 197636 - DNA, 22 bp, Artificial Sequence
  Synthetic oligonucleotide; TTT chr2 60476602 60476623 60476619 60476624 +
ctgtaaaataaatcatatttgc

SEQ ID NO: 197637 - DNA, 22 bp, Artificial Sequence
  Synthetic oligonucleotide; TTC chr2 60476603 60476624 60476620 60476625 +
tgtaaaataaatcatatttgct

SEQ ID NO: 197638 - DNA, 22 bp, Artificial Sequence
  Synthetic oligonucleotide; CTG chr2 60476605 60476626 60476622 60476627 +
taaaataaatcatatttgctaa

SEQ ID NO: 197639 - DNA, 22 bp, Artificial Sequence
  Synthetic oligonucleotide; TTT chr2 60476622 60476643 60476639 60476644 +
gctaaccaacataatttcagag

SEQ ID NO: 197640 - DNA, 22 bp, Artificial Sequence
  Synthetic oligonucleotide; TTG chr2 60476623 60476644 60476640 60476645 +
ctaaccaacataatttcagaga

SEQ ID NO: 197641 - DNA, 22 bp, Artificial Sequence
  Synthetic oligonucleotide; CTA chr2 60476626 60476647 60476643 60476648 +
accaacataatttcagagatgt

SEQ ID NO: 197642 - DNA, 22 bp, Artificial Sequence
  Synthetic oligonucleotide; TTT chr2 60476639 60476660 60476656 60476661 +
cagagatgtttcgtcacccttc

SEQ ID NO: 197643 - DNA, 22 bp, Artificial Sequence
  Synthetic oligonucleotide; TTC chr2 60476640 60476661 60476657 60476662 +
agagatgtttcgtcacccttcc

SEQ ID NO: 197644 - DNA, 22 bp, Artificial Sequence
  Synthetic oligonucleotide; TTT chr2 60476650 60476671 60476667 60476672 +
cgtcacccttccaggctcattg

SEQ ID NO: 197645 - DNA, 22 bp, Artificial Sequence
  Synthetic oligonucleotide; TTC chr2 60476651 60476672 60476668 60476673 +
gtcacccttccaggctcattga

SEQ ID NO: 197646 - DNA, 22 bp, Artificial Sequence
  Synthetic oligonucleotide; CTT chr2 60476660 60476681 60476677 60476682 +
ccaggctcattgaaaattggca

SEQ ID NO: 197647 - DNA, 22 bp, Artificial Sequence
  Synthetic oligonucleotide; TTC chr2 60476661 60476682 60476678 60476683 +
caggctcattgaaaattggcag

SEQ ID NO: 197648 - DNA, 22 bp, Artificial Sequence
  Synthetic oligonucleotide; CTC chr2 60476668 60476689 60476685 60476690 +
attgaaaattggcagggcttct

SEQ ID NO: 197649 - DNA, 22 bp, Artificial Sequence
  Synthetic oligonucleotide; TTG chr2 60476672 60476693 60476689 60476694 +
aaaattggcagggcttctaaca

SEQ ID NO: 197650 - DNA, 22 bp, Artificial Sequence
  Synthetic oligonucleotide; TTG chr2 60476679 60476700 60476696 60476701 +
gcagggcttctaacattttacc

SEQ ID NO: 197651 - DNA, 22 bp, Artificial Sequence
  Synthetic oligonucleotide; CTT chr2 60476688 60476709 60476705 60476710 +
ctaacattttaccttttaagtg

SEQ ID NO: 197652 - DNA, 22 bp, Artificial Sequence
  Synthetic oligonucleotide; TTC chr2 60476689 60476710 60476706 60476711 +
taacattttaccttttaagtgt

SEQ ID NO: 197653 - DNA, 22 bp, Artificial Sequence
  Synthetic oligonucleotide; CTA chr2 60476691 60476712 60476708 60476713 +
acattttaccttttaagtgtgt

SEQ ID NO: 197654 - DNA, 22 bp, Artificial Sequence
  Synthetic oligonucleotide; TTT chr2 60476697 60476718 60476714 60476719 +
taccttttaagtgtgtcttcct

SEQ ID NO: 197655 - DNA, 22 bp, Artificial Sequence
  Synthetic oligonucleotide; TTT chr2 60476698 60476719 60476715 60476720 +
accttttaagtgtgtcttcctt

SEQ ID NO: 197656 - DNA, 22 bp, Artificial Sequence
  Synthetic oligonucleotide; TTA chr2 60476699 60476720 60476716 60476721 +
ccttttaagtgtgtcttccttc

SEQ ID NO: 197657 - DNA, 22 bp, Artificial Sequence
  Synthetic oligonucleotide; CTT chr2 60476703 60476724 60476720 60476725 +
ttaagtgtgtcttccttccccc

SEQ ID NO: 197658 - DNA, 22 bp, Artificial Sequence
  Synthetic oligonucleotide; TTT chr2 60476704 60476725 60476721 60476726 +
taagtgtgtcttccttccccca

SEQ ID NO: 197659 - DNA, 22 bp, Artificial Sequence
  Synthetic oligonucleotide; TTT chr2 60476705 60476726 60476722 60476727 +
aagtgtgtcttccttcccccaa

SEQ ID NO: 197660 - DNA, 22 bp, Artificial Sequence
  Synthetic oligonucleotide; TTA chr2 60476706 60476727 60476723 60476728 +
agtgtgtcttccttcccccaac

SEQ ID NO: 197661 - DNA, 22 bp, Artificial Sequence
  Synthetic oligonucleotide; CTT chr2 60476716 60476737 60476733 60476738 +
ccttcccccaacccccaatatc

SEQ ID NO: 197662 - DNA, 22 bp, Artificial Sequence
  Synthetic oligonucleotide; TTC chr2 60476717 60476738 60476734 60476739 +
cttcccccaacccccaatatcc

SEQ ID NO: 197663 - DNA, 22 bp, Artificial Sequence
  Synthetic oligonucleotide; CTT chr2 60476720 60476741 60476737 60476742 +
cccccaacccccaatatcctct

SEQ ID NO: 197664 - DNA, 22 bp, Artificial Sequence
  Synthetic oligonucleotide; TTC chr2 60476721 60476742 60476738 60476743 +
ccccaacccccaatatcctctc

SEQ ID NO: 197665 - DNA, 22 bp, Artificial Sequence
  Synthetic oligonucleotide; CTC chr2 60476741 60476762 60476758 60476763 +
tctgtcaagtagttaatgatct

SEQ ID NO: 197666 - DNA, 22 bp, Artificial Sequence
  Synthetic oligonucleotide; CTC chr2 60476743 60476764 60476760 60476765 +
tgtcaagtagttaatgatctgt

SEQ ID NO: 197667 - DNA, 22 bp, Artificial Sequence
  Synthetic oligonucleotide; CTG chr2 60476745 60476766 60476762 60476767 +
tcaagtagttaatgatctgtaa

SEQ ID NO: 197668 - DNA, 22 bp, Artificial Sequence
  Synthetic oligonucleotide; TTA chr2 60476756 60476777 60476773 60476778 +
atgatctgtaaacaaacacttt

SEQ ID NO: 197669 - DNA, 22 bp, Artificial Sequence
  Synthetic oligonucleotide; CTG chr2 60476764 60476785 60476781 60476786 +
taaacaaacactttaaattcag

SEQ ID NO: 197670 - DNA, 22 bp, Artificial Sequence
  Synthetic oligonucleotide; CTT chr2 60476777 60476798 60476794 60476799 +
taaattcagtgggggagctcac

SEQ ID NO: 197671 - DNA, 22 bp, Artificial Sequence
  Synthetic oligonucleotide; TTT chr2 60476778 60476799 60476795 60476800 +
aaattcagtgggggagctcact

SEQ ID NO: 197672 - DNA, 22 bp, Artificial Sequence
  Synthetic oligonucleotide; TTA chr2 60476779 60476800 60476796 60476801 +
aattcagtgggggagctcacta

SEQ ID NO: 197673 - DNA, 22 bp, Artificial Sequence
  Synthetic oligonucleotide; TTC chr2 60476784 60476805 60476801 60476806 +
agtgggggagctcactatttaa

SEQ ID NO: 197674 - DNA, 22 bp, Artificial Sequence
  Synthetic oligonucleotide; CTC chr2 60476797 60476818 60476814 60476819 +
actatttaaagaaaccctgtgg

SEQ ID NO: 197675 - DNA, 22 bp, Artificial Sequence
  Synthetic oligonucleotide; CTA chr2 60476801 60476822 60476818 60476823 +
tttaaagaaaccctgtggtgaa

SEQ ID NO: 197676 - DNA, 22 bp, Artificial Sequence
  Synthetic oligonucleotide; TTT chr2 60476804 60476825 60476821 60476826 +
aaagaaaccctgtggtgaaacc

SEQ ID NO: 197677 - DNA, 22 bp, Artificial Sequence
  Synthetic oligonucleotide; TTA chr2 60476805 60476826 60476822 60476827 +
aagaaaccctgtggtgaaacct

SEQ ID NO: 197678 - DNA, 22 bp, Artificial Sequence
  Synthetic oligonucleotide; CTG chr2 60476816 60476837 60476833 60476838 +
tggtgaaaccttttgaaaagtt

SEQ ID NO: 197679 - DNA, 22 bp, Artificial Sequence
  Synthetic oligonucleotide; CTT chr2 60476828 60476849 60476845 60476850 +
ttgaaaagttaacaatctttct

SEQ ID NO: 197680 - DNA, 22 bp, Artificial Sequence
  Synthetic oligonucleotide; TTT chr2 60476829 60476850 60476846 60476851 +
tgaaaagttaacaatctttctg

SEQ ID NO: 197681 - DNA, 22 bp, Artificial Sequence
  Synthetic oligonucleotide; TTT chr2 60476830 60476851 60476847 60476852 +
gaaaagttaacaatctttctgt

SEQ ID NO: 197682 - DNA, 22 bp, Artificial Sequence
  Synthetic oligonucleotide; TTG chr2 60476831 60476852 60476848 60476853 +
aaaagttaacaatctttctgta

SEQ ID NO: 197683 - DNA, 22 bp, Artificial Sequence
  Synthetic oligonucleotide; TTA chr2 60476839 60476860 60476856 60476861 +
acaatctttctgtaatgtgaaa

SEQ ID NO: 197684 - DNA, 22 bp, Artificial Sequence
  Synthetic oligonucleotide; CTT chr2 60476847 60476868 60476864 60476869 +
tctgtaatgtgaaaaatcactc

SEQ ID NO: 197685 - DNA, 22 bp, Artificial Sequence
  Synthetic oligonucleotide; TTT chr2 60476848 60476869 60476865 60476870 +
ctgtaatgtgaaaaatcactct

SEQ ID NO: 197686 - DNA, 22 bp, Artificial Sequence
  Synthetic oligonucleotide; TTC chr2 60476849 60476870 60476866 60476871 +
tgtaatgtgaaaaatcactctc

SEQ ID NO: 197687 - DNA, 22 bp, Artificial Sequence
  Synthetic oligonucleotide; CTG chr2 60476851 60476872 60476868 60476873 +
taatgtgaaaaatcactctcta

SEQ ID NO: 197688 - DNA, 22 bp, Artificial Sequence
  Synthetic oligonucleotide; CTC chr2 60476869 60476890 60476886 60476891 +
tctaatttatcagtttccatta

SEQ ID NO: 197689 - DNA, 22 bp, Artificial Sequence
  Synthetic oligonucleotide; CTC chr2 60476871 60476892 60476888 60476893 +
taatttatcagtttccattaat

SEQ ID NO: 197690 - DNA, 22 bp, Artificial Sequence
  Synthetic oligonucleotide; CTA chr2 60476873 60476894 60476890 60476895 +
atttatcagtttccattaatga

SEQ ID NO: 197691 - DNA, 22 bp, Artificial Sequence
  Synthetic oligonucleotide; TTT chr2 60476877 60476898 60476894 60476899 +
atcagtttccattaatgagatt

SEQ ID NO: 197692 - DNA, 22 bp, Artificial Sequence
  Synthetic oligonucleotide; TTA chr2 60476878 60476899 60476895 60476900 +
tcagtttccattaatgagattt

SEQ ID NO: 197693 - DNA, 22 bp, Artificial Sequence
  Synthetic oligonucleotide; TTT chr2 60476885 60476906 60476902 60476907 +
ccattaatgagatttttgtgtg

SEQ ID NO: 197694 - DNA, 22 bp, Artificial Sequence
  Synthetic oligonucleotide; TTC chr2 60476886 60476907 60476903 60476908 +
cattaatgagatttttgtgtgt

SEQ ID NO: 197695 - DNA, 22 bp, Artificial Sequence
  Synthetic oligonucleotide; TTA chr2 60476891 60476912 60476908 60476913 +
atgagatttttgtgtgtattgg

SEQ ID NO: 197696 - DNA, 22 bp, Artificial Sequence
  Synthetic oligonucleotide; TTT chr2 60476900 60476921 60476917 60476922 +
ttgtgtgtattgggccttctga

SEQ ID NO: 197697 - DNA, 22 bp, Artificial Sequence
  Synthetic oligonucleotide; TTT chr2 60476901 60476922 60476918 60476923 +
tgtgtgtattgggccttctgaa

SEQ ID NO: 197698 - DNA, 22 bp, Artificial Sequence
  Synthetic oligonucleotide; TTT chr2 60476902 60476923 60476919 60476924 +
gtgtgtattgggccttctgaaa

SEQ ID NO: 197699 - DNA, 22 bp, Artificial Sequence
  Synthetic oligonucleotide; TTG chr2 60476903 60476924 60476920 60476925 +
tgtgtattgggccttctgaaag

SEQ ID NO: 197700 - DNA, 22 bp, Artificial Sequence
  Synthetic oligonucleotide; TTG chr2 60476912 60476933 60476929 60476934 +
ggccttctgaaagtggggctca

SEQ ID NO: 197701 - DNA, 22 bp, Artificial Sequence
  Synthetic oligonucleotide; CTT chr2 60476918 60476939 60476935 60476940 +
ctgaaagtggggctcaactgca

SEQ ID NO: 197702 - DNA, 22 bp, Artificial Sequence
  Synthetic oligonucleotide; TTC chr2 60476919 60476940 60476936 60476941 +
tgaaagtggggctcaactgcaa

SEQ ID NO: 197703 - DNA, 22 bp, Artificial Sequence
  Synthetic oligonucleotide; CTG chr2 60476921 60476942 60476938 60476943 +
aaagtggggctcaactgcaatc

SEQ ID NO: 197704 - DNA, 22 bp, Artificial Sequence
  Synthetic oligonucleotide; CTC chr2 60476933 60476954 60476950 60476955 +
aactgcaatccatgcctttgta

SEQ ID NO: 197705 - DNA, 22 bp, Artificial Sequence
  Synthetic oligonucleotide; CTG chr2 60476938 60476959 60476955 60476960 +
caatccatgcctttgtagttag

SEQ ID NO: 197706 - DNA, 22 bp, Artificial Sequence
  Synthetic oligonucleotide; CTT chr2 60476951 60476972 60476968 60476973 +
tgtagttagaagggacgataaa

SEQ ID NO: 197707 - DNA, 22 bp, Artificial Sequence
  Synthetic oligonucleotide; TTT chr2 60476952 60476973 60476969 60476974 +
gtagttagaagggacgataaaa

SEQ ID NO: 197708 - DNA, 22 bp, Artificial Sequence
  Synthetic oligonucleotide; TTG chr2 60476953 60476974 60476970 60476975 +
tagttagaagggacgataaaag

SEQ ID NO: 197709 - DNA, 22 bp, Artificial Sequence
  Synthetic oligonucleotide; TTA chr2 60476959 60476980 60476976 60476981 +
gaagggacgataaaagacactg

SEQ ID NO: 197710 - DNA, 22 bp, Artificial Sequence
  Synthetic oligonucleotide; CTG chr2 60476981 60477002 60476998 60477003 +
ccctgaacatatttctgtcacc

SEQ ID NO: 197711 - DNA, 22 bp, Artificial Sequence
  Synthetic oligonucleotide; CTG chr2 60476986 60477007 60477003 60477008 +
aacatatttctgtcacccgaat

SEQ ID NO: 197712 - DNA, 22 bp, Artificial Sequence
  Synthetic oligonucleotide; TTT chr2 60476995 60477016 60477012 60477017 +
ctgtcacccgaattgtccagct

SEQ ID NO: 197713 - DNA, 22 bp, Artificial Sequence
  Synthetic oligonucleotide; TTC chr2 60476996 60477017 60477013 60477018 +
tgtcacccgaattgtccagctt

SEQ ID NO: 197714 - DNA, 22 bp, Artificial Sequence
  Synthetic oligonucleotide; CTG chr2 60476998 60477019 60477015 60477020 +
tcacccgaattgtccagcttca

SEQ ID NO: 197715 - DNA, 22 bp, Artificial Sequence
  Synthetic oligonucleotide; TTG chr2 60477010 60477031 60477027 60477032 +
tccagcttcacacaaacgtatc

SEQ ID NO: 197716 - DNA, 22 bp, Artificial Sequence
  Synthetic oligonucleotide; CTT chr2 60477018 60477039 60477035 60477040 +
cacacaaacgtatcacaaacac

SEQ ID NO: 197717 - DNA, 22 bp, Artificial Sequence
  Synthetic oligonucleotide; TTC chr2 60477019 60477040 60477036 60477041 +
acacaaacgtatcacaaacacc

SEQ ID NO: 197718 - DNA, 22 bp, Artificial Sequence
  Synthetic oligonucleotide; CTC chr2 60477051 60477072 60477068 60477073 +
cctgccccactcgagaaatgaa

SEQ ID NO: 197719 - DNA, 22 bp, Artificial Sequence
  Synthetic oligonucleotide; CTG chr2 60477055 60477076 60477072 60477077 +
ccccactcgagaaatgaagaaa

SEQ ID NO: 197720 - DNA, 22 bp, Artificial Sequence
  Synthetic oligonucleotide; CTC chr2 60477063 60477084 60477080 60477085 +
gagaaatgaagaaaaggatggg

SEQ ID NO: 197721 - DNA, 22 bp, Artificial Sequence
  Synthetic oligonucleotide; TTT chr2 60477097 60477118 60477114 60477119 +
ggacacctggaaagccttgcaa

SEQ ID NO: 197722 - DNA, 22 bp, Artificial Sequence
  Synthetic oligonucleotide; TTG chr2 60477098 60477119 60477115 60477120 +
gacacctggaaagccttgcaaa

SEQ ID NO: 197723 - DNA, 22 bp, Artificial Sequence
  Synthetic oligonucleotide; CTG chr2 60477106 60477127 60477123 60477128 +
gaaagccttgcaaaccacactt

SEQ ID NO: 197724 - DNA, 22 bp, Artificial Sequence
  Synthetic oligonucleotide; CTT chr2 60477115 60477136 60477132 60477137 +
gcaaaccacacttgcgtttctc

SEQ ID NO: 197725 - DNA, 22 bp, Artificial Sequence
  Synthetic oligonucleotide; TTG chr2 60477116 60477137 60477133 60477138 +
caaaccacacttgcgtttctcc

SEQ ID NO: 197726 - DNA, 22 bp, Artificial Sequence
  Synthetic oligonucleotide; CTT chr2 60477128 60477149 60477145 60477150 +
gcgtttctcccaggttaagtat

SEQ ID NO: 197727 - DNA, 22 bp, Artificial Sequence
  Synthetic oligonucleotide; TTG chr2 60477129 60477150 60477146 60477151 +
cgtttctcccaggttaagtatt

SEQ ID NO: 197728 - DNA, 22 bp, Artificial Sequence
  Synthetic oligonucleotide; TTT chr2 60477134 60477155 60477151 60477156 +
ctcccaggttaagtattagata

SEQ ID NO: 197729 - DNA, 22 bp, Artificial Sequence
  Synthetic oligonucleotide; TTC chr2 60477135 60477156 60477152 60477157 +
tcccaggttaagtattagatac

SEQ ID NO: 197730 - DNA, 22 bp, Artificial Sequence
  Synthetic oligonucleotide; CTC chr2 60477137 60477158 60477154 60477159 +
ccaggttaagtattagatacct

SEQ ID NO: 197731 - DNA, 22 bp, Artificial Sequence
  Synthetic oligonucleotide; TTA chr2 60477145 60477166 60477162 60477167 +
agtattagatacctgaggaagg

SEQ ID NO: 197732 - DNA, 22 bp, Artificial Sequence
  Synthetic oligonucleotide; TTA chr2 60477152 60477173 60477169 60477174 +
gatacctgaggaaggtgaaata

SEQ ID NO: 197733 - DNA, 22 bp, Artificial Sequence
  Synthetic oligonucleotide; CTG chr2 60477160 60477181 60477177 60477182 +
aggaaggtgaaatacgcatttt

SEQ ID NO: 197734 - DNA, 22 bp, Artificial Sequence
  Synthetic oligonucleotide; TTT chr2 60477181 60477202 60477198 60477203 +
tcaactgagcattcaggaagag

SEQ ID NO: 197735 - DNA, 22 bp, Artificial Sequence
  Synthetic oligonucleotide; TTT chr2 60477182 60477203 60477199 60477204 +
caactgagcattcaggaagagg

SEQ ID NO: 197736 - DNA, 22 bp, Artificial Sequence
  Synthetic oligonucleotide; TTC chr2 60477183 60477204 60477200 60477205 +
aactgagcattcaggaagaggc

SEQ ID NO: 197737 - DNA, 22 bp, Artificial Sequence
  Synthetic oligonucleotide; CTG chr2 60477188 60477209 60477205 60477210 +
agcattcaggaagaggcatggg

SEQ ID NO: 197738 - DNA, 22 bp, Artificial Sequence
  Synthetic oligonucleotide; TTC chr2 60477195 60477216 60477212 60477217 +
aggaagaggcatggggctgtga

SEQ ID NO: 197739 - DNA, 22 bp, Artificial Sequence
  Synthetic oligonucleotide; CTG chr2 60477214 60477235 60477231 60477236 +
tgaagatggatgcgatgagaat

SEQ ID NO: 197740 - DNA, 22 bp, Artificial Sequence
  Synthetic oligonucleotide; TTT chr2 60477244 60477265 60477261 60477266 +
gcaaacgtttgattctgataac

SEQ ID NO: 197741 - DNA, 22 bp, Artificial Sequence
  Synthetic oligonucleotide; TTG chr2 60477245 60477266 60477262 60477267 +
caaacgtttgattctgataaca

SEQ ID NO: 197742 - DNA, 22 bp, Artificial Sequence
  Synthetic oligonucleotide; TTT chr2 60477254 60477275 60477271 60477276 +
gattctgataacacctgccaga

SEQ ID NO: 197743 - DNA, 22 bp, Artificial Sequence
  Synthetic oligonucleotide; TTG chr2 60477255 60477276 60477272 60477277 +
attctgataacacctgccagag

SEQ ID NO: 197744 - DNA, 22 bp, Artificial Sequence
  Synthetic oligonucleotide; TTC chr2 60477259 60477280 60477276 60477281 +
tgataacacctgccagagcaga

SEQ ID NO: 197745 - DNA, 22 bp, Artificial Sequence
  Synthetic oligonucleotide; CTG chr2 60477261 60477282 60477278 60477283 +
ataacacctgccagagcagaga

SEQ ID NO: 197746 - DNA, 22 bp, Artificial Sequence
  Synthetic oligonucleotide; CTG chr2 60477271 60477292 60477288 60477293 +
ccagagcagagaagggcttgtc

SEQ ID NO: 197747 - DNA, 22 bp, Artificial Sequence
  Synthetic oligonucleotide; CTT chr2 60477290 60477311 60477307 60477312 +
gtctatcaaagccagcagaaca

SEQ ID NO: 197748 - DNA, 22 bp, Artificial Sequence
  Synthetic oligonucleotide; TTG chr2 60477291 60477312 60477308 60477313 +
tctatcaaagccagcagaacac

SEQ ID NO: 197749 - DNA, 22 bp, Artificial Sequence
  Synthetic oligonucleotide; CTA chr2 60477295 60477316 60477312 60477317 +
tcaaagccagcagaacacacaa

SEQ ID NO: 197750 - DNA, 22 bp, Artificial Sequence
  Synthetic oligonucleotide; CTC chr2 60477320 60477341 60477337 60477342 +
ccaaattactctgaagaccacc

SEQ ID NO: 197751 - DNA, 22 bp, Artificial Sequence
  Synthetic oligonucleotide; TTA chr2 60477328 60477349 60477345 60477350 +
ctctgaagaccaccccaagcct

SEQ ID NO: 197752 - DNA, 22 bp, Artificial Sequence
  Synthetic oligonucleotide; CTC chr2 60477331 60477352 60477348 60477353 +
tgaagaccaccccaagcctttt

SEQ ID NO: 197753 - DNA, 22 bp, Artificial Sequence
  Synthetic oligonucleotide; CTG chr2 60477333 60477354 60477350 60477355 +
aagaccaccccaagccttttta

SEQ ID NO: 197754 - DNA, 22 bp, Artificial Sequence
  Synthetic oligonucleotide; CTT chr2 60477351 60477372 60477368 60477373 +
tttatctgcatcaactcacaac

SEQ ID NO: 197755 - DNA, 22 bp, Artificial Sequence
  Synthetic oligonucleotide; TTT chr2 60477352 60477373 60477369 60477374 +
ttatctgcatcaactcacaaca

SEQ ID NO: 197756 - DNA, 22 bp, Artificial Sequence
  Synthetic oligonucleotide; TTT chr2 60477353 60477374 60477370 60477375 +
tatctgcatcaactcacaacaa

SEQ ID NO: 197757 - DNA, 22 bp, Artificial Sequence
  Synthetic oligonucleotide; TTT chr2 60477354 60477375 60477371 60477376 +
atctgcatcaactcacaacaaa

SEQ ID NO: 197758 - DNA, 22 bp, Artificial Sequence
  Synthetic oligonucleotide; TTA chr2 60477355 60477376 60477372 60477377 +
tctgcatcaactcacaacaaat

SEQ ID NO: 197759 - DNA, 22 bp, Artificial Sequence
  Synthetic oligonucleotide; CTG chr2 60477359 60477380 60477376 60477381 +
catcaactcacaacaaatgtgc

SEQ ID NO: 197760 - DNA, 22 bp, Artificial Sequence
  Synthetic oligonucleotide; CTC chr2 60477368 60477389 60477385 60477390 +
acaacaaatgtgctttatgcct

SEQ ID NO: 197761 - DNA, 22 bp, Artificial Sequence
  Synthetic oligonucleotide; CTT chr2 60477383 60477404 60477400 60477405 +
tatgcctctatattatcatttc

SEQ ID NO: 197762 - DNA, 22 bp, Artificial Sequence
  Synthetic oligonucleotide; TTT chr2 60477384 60477405 60477401 60477406 +
atgcctctatattatcatttcg

SEQ ID NO: 197763 - DNA, 22 bp, Artificial Sequence
  Synthetic oligonucleotide; TTA chr2 60477385 60477406 60477402 60477407 +
tgcctctatattatcatttcga

SEQ ID NO: 197764 - DNA, 22 bp, Artificial Sequence
  Synthetic oligonucleotide; CTC chr2 60477391 60477412 60477408 60477413 +
tatattatcatttcgatcggtc

SEQ ID NO: 197765 - DNA, 22 bp, Artificial Sequence
  Synthetic oligonucleotide; CTA chr2 60477393 60477414 60477410 60477415 +
tattatcatttcgatcggtctt

SEQ ID NO: 197766 - DNA, 22 bp, Artificial Sequence
  Synthetic oligonucleotide; TTA chr2 60477398 60477419 60477415 60477420 +
tcatttcgatcggtcttgagaa

SEQ ID NO: 197767 - DNA, 22 bp, Artificial Sequence
  Synthetic oligonucleotide; TTT chr2 60477404 60477425 60477421 60477426 +
cgatcggtcttgagaaaatact

SEQ ID NO: 197768 - DNA, 22 bp, Artificial Sequence
  Synthetic oligonucleotide; TTC chr2 60477405 60477426 60477422 60477427 +
gatcggtcttgagaaaatacta

SEQ ID NO: 197769 - DNA, 22 bp, Artificial Sequence
  Synthetic oligonucleotide; CTT chr2 60477415 60477436 60477432 60477437 +
gagaaaatactagaataagcta

SEQ ID NO: 197770 - DNA, 22 bp, Artificial Sequence
  Synthetic oligonucleotide; TTG chr2 60477416 60477437 60477433 60477438 +
agaaaatactagaataagctaa

SEQ ID NO: 197771 - DNA, 22 bp, Artificial Sequence
  Synthetic oligonucleotide; CTA chr2 60477427 60477448 60477444 60477449 +
gaataagctaaagaaaaccaaa

SEQ ID NO: 197772 - DNA, 22 bp, Artificial Sequence
  Synthetic oligonucleotide; CTA chr2 60477437 60477458 60477454 60477459 +
aagaaaaccaaacatgggtgga

SEQ ID NO: 197773 - DNA, 22 bp, Artificial Sequence
  Synthetic oligonucleotide; TTA chr2 60477483 60477504 60477500 60477505 +
ggagaaatgcctaatgtagatg

SEQ ID NO: 197774 - DNA, 22 bp, Artificial Sequence
  Synthetic oligonucleotide; CTA chr2 60477496 60477517 60477513 60477518 +
atgtagatgatgggttgatagg

SEQ ID NO: 197775 - DNA, 22 bp, Artificial Sequence
  Synthetic oligonucleotide; TTG chr2 60477513 60477534 60477530 60477535 +
ataggtgcagcaaaccaccatg

SEQ ID NO: 197776 - DNA, 22 bp, Artificial Sequence
  Synthetic oligonucleotide; CTT chr2 60477549 60477570 60477566 60477571 +
atgtaacaaacctgcacattct

SEQ ID NO: 197777 - DNA, 22 bp, Artificial Sequence
  Synthetic oligonucleotide; TTA chr2 60477550 60477571 60477567 60477572 +
tgtaacaaacctgcacattctg

SEQ ID NO: 197778 - DNA, 22 bp, Artificial Sequence
  Synthetic oligonucleotide; CTG chr2 60477563 60477584 60477580 60477585 +
cacattctgcacatgtatccca

SEQ ID NO: 197779 - DNA, 22 bp, Artificial Sequence
  Synthetic oligonucleotide; TTC chr2 60477570 60477591 60477587 60477592 +
tgcacatgtatcccagaactta

SEQ ID NO: 197780 - DNA, 22 bp, Artificial Sequence
  Synthetic oligonucleotide; CTG chr2 60477572 60477593 60477589 60477594 +
cacatgtatcccagaacttaga

SEQ ID NO: 197781 - DNA, 22 bp, Artificial Sequence
  Synthetic oligonucleotide; CTT chr2 60477591 60477612 60477608 60477613 +
agagtaaaataaataaagaaag

SEQ ID NO: 197782 - DNA, 22 bp, Artificial Sequence
  Synthetic oligonucleotide; TTA chr2 60477592 60477613 60477609 60477614 +
gagtaaaataaataaagaaaga

SEQ ID NO: 197783 - DNA, 22 bp, Artificial Sequence
  Synthetic oligonucleotide; TTT chr2 60477646 60477667 60477663 60477668 +
ccaagagactcctgatgttttg

SEQ ID NO: 197784 - DNA, 22 bp, Artificial Sequence
  Synthetic oligonucleotide; TTC chr2 60477647 60477668 60477664 60477669 +
caagagactcctgatgttttgt

SEQ ID NO: 197785 - DNA, 22 bp, Artificial Sequence
  Synthetic oligonucleotide; CTC chr2 60477657 60477678 60477674 60477679 +
ctgatgttttgttcgtgggcac

SEQ ID NO: 197786 - DNA, 22 bp, Artificial Sequence
  Synthetic oligonucleotide; CTG chr2 60477660 60477681 60477677 60477682 +
atgttttgttcgtgggcactgt

SEQ ID NO: 197787 - DNA, 22 bp, Artificial Sequence
  Synthetic oligonucleotide; TTT chr2 60477666 60477687 60477683 60477688 +
tgttcgtgggcactgtggaaac

SEQ ID NO: 197788 - DNA, 22 bp, Artificial Sequence
  Synthetic oligonucleotide; TTT chr2 60477667 60477688 60477684 60477689 +
gttcgtgggcactgtggaaaca

SEQ ID NO: 197789 - DNA, 22 bp, Artificial Sequence
  Synthetic oligonucleotide; TTG chr2 60477668 60477689 60477685 60477690 +
ttcgtgggcactgtggaaacag

SEQ ID NO: 197790 - DNA, 22 bp, Artificial Sequence
  Synthetic oligonucleotide; TTC chr2 60477671 60477692 60477688 60477693 +
gtgggcactgtggaaacagggg

SEQ ID NO: 197791 - DNA, 22 bp, Artificial Sequence
  Synthetic oligonucleotide; CTG chr2 60477681 60477702 60477698 60477703 +
tggaaacaggggcagtggtgct

SEQ ID NO: 197792 - DNA, 22 bp, Artificial Sequence
  Synthetic oligonucleotide; CTG chr2 60477704 60477725 60477721 60477726 +
tgagagacaagggagtggggag

SEQ ID NO: 197793 - DNA, 22 bp, Artificial Sequence
  Synthetic oligonucleotide; CTG chr2 60477763 60477784 60477780 60477785 +
cagcccggccaggtggagggct

SEQ ID NO: 197794 - DNA, 22 bp, Artificial Sequence
  Synthetic oligonucleotide; CTT chr2 60477786 60477807 60477803 60477808 +
tcctgacttatcatccaagact

SEQ ID NO: 197795 - DNA, 22 bp, Artificial Sequence
  Synthetic oligonucleotide; TTT chr2 60477787 60477808 60477804 60477809 +
cctgacttatcatccaagactg

SEQ ID NO: 197796 - DNA, 22 bp, Artificial Sequence
  Synthetic oligonucleotide; TTC chr2 60477788 60477809 60477805 60477810 +
ctgacttatcatccaagactgg

SEQ ID NO: 197797 - DNA, 22 bp, Artificial Sequence
  Synthetic oligonucleotide; CTG chr2 60477791 60477812 60477808 60477813 +
acttatcatccaagactggtct

SEQ ID NO: 197798 - DNA, 22 bp, Artificial Sequence
  Synthetic oligonucleotide; CTT chr2 60477795 60477816 60477812 60477817 +
atcatccaagactggtctgtgc

SEQ ID NO: 197799 - DNA, 22 bp, Artificial Sequence
  Synthetic oligonucleotide; TTA chr2 60477796 60477817 60477813 60477818 +
tcatccaagactggtctgtgca

SEQ ID NO: 197800 - DNA, 22 bp, Artificial Sequence
  Synthetic oligonucleotide; CTG chr2 60477809 60477830 60477826 60477831 +
gtctgtgcacggagaaggggcc

SEQ ID NO: 197801 - DNA, 22 bp, Artificial Sequence
  Synthetic oligonucleotide; CTG chr2 60477814 60477835 60477831 60477836 +
tgcacggagaaggggccagaag

SEQ ID NO: 197802 - DNA, 22 bp, Artificial Sequence
  Synthetic oligonucleotide; CTC chr2 60477859 60477880 60477876 60477881 +
tgtcaggcctcccccaaggcca

SEQ ID NO: 197803 - DNA, 22 bp, Artificial Sequence
  Synthetic oligonucleotide; CTG chr2 60477861 60477882 60477878 60477883 +
tcaggcctcccccaaggccaac

SEQ ID NO: 197804 - DNA, 22 bp, Artificial Sequence
  Synthetic oligonucleotide; CTC chr2 60477870 60477891 60477887 60477892 +
ccccaaggccaacaagcccaga

SEQ ID NO: 197805 - DNA, 22 bp, Artificial Sequence
  Synthetic oligonucleotide; CTC chr2 60477907 60477928 60477924 60477929 +
caactctagcccttcttaagga

SEQ ID NO: 197806 - DNA, 22 bp, Artificial Sequence
  Synthetic oligonucleotide; CTC chr2 60477913 60477934 60477930 60477935 +
tagcccttcttaaggaagcaca

SEQ ID NO: 197807 - DNA, 22 bp, Artificial Sequence
  Synthetic oligonucleotide; CTA chr2 60477915 60477936 60477932 60477937 +
gcccttcttaaggaagcacatc

SEQ ID NO: 197808 - DNA, 22 bp, Artificial Sequence
  Synthetic oligonucleotide; CTT chr2 60477921 60477942 60477938 60477943 +
cttaaggaagcacatctgtcct

SEQ ID NO: 197809 - DNA, 22 bp, Artificial Sequence
  Synthetic oligonucleotide; TTC chr2 60477922 60477943 60477939 60477944 +
ttaaggaagcacatctgtcctg

SEQ ID NO: 197810 - DNA, 22 bp, Artificial Sequence
  Synthetic oligonucleotide; CTT chr2 60477924 60477945 60477941 60477946 +
aaggaagcacatctgtcctggc

SEQ ID NO: 197811 - DNA, 22 bp, Artificial Sequence
  Synthetic oligonucleotide; TTA chr2 60477925 60477946 60477942 60477947 +
aggaagcacatctgtcctggcc

SEQ ID NO: 197812 - DNA, 22 bp, Artificial Sequence
  Synthetic oligonucleotide; CTG chr2 60477939 60477960 60477956 60477961 +
tcctggcctttatggaaagctt

SEQ ID NO: 197813 - DNA, 22 bp, Artificial Sequence
  Synthetic oligonucleotide; CTG chr2 60477944 60477965 60477961 60477966 +
gcctttatggaaagcttttttt

SEQ ID NO: 197814 - DNA, 22 bp, Artificial Sequence
  Synthetic oligonucleotide; CTT chr2 60477949 60477970 60477966 60477971 +
tatggaaagctttttttttttt

SEQ ID NO: 197815 - DNA, 22 bp, Artificial Sequence
  Synthetic oligonucleotide; TTT chr2 60477950 60477971 60477967 60477972 +
atggaaagcttttttttttttt

SEQ ID NO: 197816 - DNA, 22 bp, Artificial Sequence
  Synthetic oligonucleotide; TTA chr2 60477951 60477972 60477968 60477973 +
tggaaagctttttttttttttt

SEQ ID NO: 197817 - DNA, 22 bp, Artificial Sequence
  Synthetic oligonucleotide; CTT chr2 60477961 60477982 60477978 60477983 +
ttttttttttttttttaattga

SEQ ID NO: 197818 - DNA, 22 bp, Artificial Sequence
  Synthetic oligonucleotide; TTT chr2 60477962 60477983 60477979 60477984 +
tttttttttttttttaattgag

SEQ ID NO: 197819 - DNA, 22 bp, Artificial Sequence
  Synthetic oligonucleotide; TTT chr2 60477963 60477984 60477980 60477985 +
ttttttttttttttaattgaga

SEQ ID NO: 197820 - DNA, 22 bp, Artificial Sequence
  Synthetic oligonucleotide; TTT chr2 60477964 60477985 60477981 60477986 +
tttttttttttttaattgagac

SEQ ID NO: 197821 - DNA, 22 bp, Artificial Sequence
  Synthetic oligonucleotide; TTT chr2 60477965 60477986 60477982 60477987 +
ttttttttttttaattgagaca

SEQ ID NO: 197822 - DNA, 22 bp, Artificial Sequence
  Synthetic oligonucleotide; TTT chr2 60477966 60477987 60477983 60477988 +
tttttttttttaattgagacat

SEQ ID NO: 197823 - DNA, 22 bp, Artificial Sequence
  Synthetic oligonucleotide; TTT chr2 60477967 60477988 60477984 60477989 +
ttttttttttaattgagacatg

SEQ ID NO: 197824 - DNA, 22 bp, Artificial Sequence
  Synthetic oligonucleotide; TTT chr2 60477968 60477989 60477985 60477990 +
tttttttttaattgagacatgg

SEQ ID NO: 197825 - DNA, 22 bp, Artificial Sequence
  Synthetic oligonucleotide; TTT chr2 60477969 60477990 60477986 60477991 +
ttttttttaattgagacatggt

SEQ ID NO: 197826 - DNA, 22 bp, Artificial Sequence
  Synthetic oligonucleotide; TTT chr2 60477970 60477991 60477987 60477992 +
tttttttaattgagacatggtc

SEQ ID NO: 197827 - DNA, 22 bp, Artificial Sequence
  Synthetic oligonucleotide; TTT chr2 60477971 60477992 60477988 60477993 +
ttttttaattgagacatggtct

SEQ ID NO: 197828 - DNA, 22 bp, Artificial Sequence
  Synthetic oligonucleotide; TTT chr2 60477972 60477993 60477989 60477994 +
tttttaattgagacatggtctc

SEQ ID NO: 197829 - DNA, 22 bp, Artificial Sequence
  Synthetic oligonucleotide; TTT chr2 60477973 60477994 60477990 60477995 +
ttttaattgagacatggtctca

SEQ ID NO: 197830 - DNA, 22 bp, Artificial Sequence
  Synthetic oligonucleotide; TTT chr2 60477974 60477995 60477991 60477996 +
tttaattgagacatggtctcac

SEQ ID NO: 197831 - DNA, 22 bp, Artificial Sequence
  Synthetic oligonucleotide; TTT chr2 60477975 60477996 60477992 60477997 +
ttaattgagacatggtctcact

SEQ ID NO: 197832 - DNA, 22 bp, Artificial Sequence
  Synthetic oligonucleotide; TTT chr2 60477976 60477997 60477993 60477998 +
taattgagacatggtctcactc

SEQ ID NO: 197833 - DNA, 22 bp, Artificial Sequence
  Synthetic oligonucleotide; TTT chr2 60477977 60477998 60477994 60477999 +
aattgagacatggtctcactct

SEQ ID NO: 197834 - DNA, 22 bp, Artificial Sequence
  Synthetic oligonucleotide; TTA chr2 60477978 60477999 60477995 60478000 +
attgagacatggtctcactctg

SEQ ID NO: 197835 - DNA, 22 bp, Artificial Sequence
  Synthetic oligonucleotide; TTG chr2 60477982 60478003 60477999 60478004 +
agacatggtctcactctgttgc

SEQ ID NO: 197836 - DNA, 22 bp, Artificial Sequence
  Synthetic oligonucleotide; CTC chr2 60477994 60478015 60478011 60478016 +
actctgttgcccaggctggagt

SEQ ID NO: 197837 - DNA, 22 bp, Artificial Sequence
  Synthetic oligonucleotide; CTC chr2 60477998 60478019 60478015 60478020 +
tgttgcccaggctggagtgcag

SEQ ID NO: 197838 - DNA, 22 bp, Artificial Sequence
  Synthetic oligonucleotide; CTG chr2 60478000 60478021 60478017 60478022 +
ttgcccaggctggagtgcagtg

SEQ ID NO: 197839 - DNA, 22 bp, Artificial Sequence
  Synthetic oligonucleotide; TTG chr2 60478003 60478024 60478020 60478025 +
cccaggctggagtgcagtggtg

SEQ ID NO: 197840 - DNA, 22 bp, Artificial Sequence
  Synthetic oligonucleotide; CTG chr2 60478012 60478033 60478029 60478034 +
gagtgcagtggtgcaatcttgg

SEQ ID NO: 197841 - DNA, 22 bp, Artificial Sequence
  Synthetic oligonucleotide; CTT chr2 60478032 60478053 60478049 60478054 +
ggctcactgcaacctccgcctc

SEQ ID NO: 197842 - DNA, 22 bp, Artificial Sequence
  Synthetic oligonucleotide; TTG chr2 60478033 60478054 60478050 60478055 +
gctcactgcaacctccgcctcc

SEQ ID NO: 197843 - DNA, 22 bp, Artificial Sequence
  Synthetic oligonucleotide; CTC chr2 60478037 60478058 60478054 60478059 +
actgcaacctccgcctcccgag

SEQ ID NO: 197844 - DNA, 22 bp, Artificial Sequence
  Synthetic oligonucleotide; CTG chr2 60478041 60478062 60478058 60478063 +
caacctccgcctcccgagttca

SEQ ID NO: 197845 - DNA, 22 bp, Artificial Sequence
  Synthetic oligonucleotide; CTC chr2 60478048 60478069 60478065 60478070 +
cgcctcccgagttcaagcagtc

SEQ ID NO: 197846 - DNA, 22 bp, Artificial Sequence
  Synthetic oligonucleotide; CTC chr2 60478054 60478075 60478071 60478076 +
ccgagttcaagcagtcctcctg

SEQ ID NO: 197847 - DNA, 22 bp, Artificial Sequence
  Synthetic oligonucleotide; TTC chr2 60478062 60478083 60478079 60478084 +
aagcagtcctcctgcctcagct

SEQ ID NO: 197848 - DNA, 22 bp, Artificial Sequence
  Synthetic oligonucleotide; CTC chr2 60478073 60478094 60478090 60478095 +
ctgcctcagctctcaagtagct

SEQ ID NO: 197849 - DNA, 22 bp, Artificial Sequence
  Synthetic oligonucleotide; CTG chr2 60478076 60478097 60478093 60478098 +
cctcagctctcaagtagctagg

SEQ ID NO: 197850 - DNA, 22 bp, Artificial Sequence
  Synthetic oligonucleotide; CTC chr2 60478080 60478101 60478097 60478102 +
agctctcaagtagctaggacta

SEQ ID NO: 197851 - DNA, 22 bp, Artificial Sequence
  Synthetic oligonucleotide; CTC chr2 60478085 60478106 60478102 60478107 +
tcaagtagctaggactacaggc

SEQ ID NO: 197852 - DNA, 22 bp, Artificial Sequence
  Synthetic oligonucleotide; CTC chr2 60478087 60478108 60478104 60478109 +
aagtagctaggactacaggcat

SEQ ID NO: 197853 - DNA, 22 bp, Artificial Sequence
  Synthetic oligonucleotide; CTA chr2 60478096 60478117 60478113 60478118 +
ggactacaggcatgcgccacca

SEQ ID NO: 197854 - DNA, 22 bp, Artificial Sequence
  Synthetic oligonucleotide; CTA chr2 60478102 60478123 60478119 60478124 +
caggcatgcgccaccaccacac

SEQ ID NO: 197855 - DNA, 22 bp, Artificial Sequence
  Synthetic oligonucleotide; CTG chr2 60478127 60478148 60478144 60478149 +
gctaatttttgtattttttgta

SEQ ID NO: 197856 - DNA, 22 bp, Artificial Sequence
  Synthetic oligonucleotide; CTA chr2 60478131 60478152 60478148 60478153 +
atttttgtattttttgtagaga

SEQ ID NO: 197857 - DNA, 22 bp, Artificial Sequence
  Synthetic oligonucleotide; TTT chr2 60478135 60478156 60478152 60478157 +
ttgtattttttgtagagatggg

SEQ ID NO: 197858 - DNA, 22 bp, Artificial Sequence
  Synthetic oligonucleotide; TTT chr2 60478136 60478157 60478153 60478158 +
tgtattttttgtagagatggga

SEQ ID NO: 197859 - DNA, 22 bp, Artificial Sequence
  Synthetic oligonucleotide; TTT chr2 60478137 60478158 60478154 60478159 +
gtattttttgtagagatgggat

SEQ ID NO: 197860 - DNA, 22 bp, Artificial Sequence
  Synthetic oligonucleotide; TTG chr2 60478138 60478159 60478155 60478160 +
tattttttgtagagatgggatc

SEQ ID NO: 197861 - DNA, 22 bp, Artificial Sequence
  Synthetic oligonucleotide; TTT chr2 60478143 60478164 60478160 60478165 +
tttgtagagatgggatctcacc

SEQ ID NO: 197862 - DNA, 22 bp, Artificial Sequence
  Synthetic oligonucleotide; TTT chr2 60478144 60478165 60478161 60478166 +
ttgtagagatgggatctcacca

SEQ ID NO: 197863 - DNA, 22 bp, Artificial Sequence
  Synthetic oligonucleotide; TTT chr2 60478145 60478166 60478162 60478167 +
tgtagagatgggatctcaccat

SEQ ID NO: 197864 - DNA, 22 bp, Artificial Sequence
  Synthetic oligonucleotide; TTT chr2 60478146 60478167 60478163 60478168 +
gtagagatgggatctcaccatg

SEQ ID NO: 197865 - DNA, 22 bp, Artificial Sequence
  Synthetic oligonucleotide; TTG chr2 60478147 60478168 60478164 60478169 +
tagagatgggatctcaccatgt

SEQ ID NO: 197866 - DNA, 22 bp, Artificial Sequence
  Synthetic oligonucleotide; CTC chr2 60478162 60478183 60478179 60478184 +
accatgttgcccaggctgggtg

SEQ ID NO: 197867 - DNA, 22 bp, Artificial Sequence
  Synthetic oligonucleotide; TTG chr2 60478171 60478192 60478188 60478193 +
cccaggctgggtggaaagtgtt

SEQ ID NO: 197868 - DNA, 22 bp, Artificial Sequence
  Synthetic oligonucleotide; CTG chr2 60478180 60478201 60478197 60478202 +
ggtggaaagtgttatgttcttc

SEQ ID NO: 197869 - DNA, 22 bp, Artificial Sequence
  Synthetic oligonucleotide; TTA chr2 60478194 60478215 60478211 60478216 +
tgttcttcccaaagtactctcc

SEQ ID NO: 197870 - DNA, 22 bp, Artificial Sequence
  Synthetic oligonucleotide; TTC chr2 60478199 60478220 60478216 60478221 +
ttcccaaagtactctcctcaca

SEQ ID NO: 197871 - DNA, 22 bp, Artificial Sequence
  Synthetic oligonucleotide; CTT chr2 60478201 60478222 60478218 60478223 +
cccaaagtactctcctcacatc

SEQ ID NO: 197872 - DNA, 22 bp, Artificial Sequence
  Synthetic oligonucleotide; TTC chr2 60478202 60478223 60478219 60478224 +
ccaaagtactctcctcacatcc

SEQ ID NO: 197873 - DNA, 22 bp, Artificial Sequence
  Synthetic oligonucleotide; CTC chr2 60478213 60478234 60478230 60478235 +
tcctcacatcctgccccaacag

SEQ ID NO: 197874 - DNA, 22 bp, Artificial Sequence
  Synthetic oligonucleotide; CTC chr2 60478215 60478236 60478232 60478237 +
ctcacatcctgccccaacagtc

SEQ ID NO: 197875 - DNA, 22 bp, Artificial Sequence
  Synthetic oligonucleotide; CTC chr2 60478218 60478239 60478235 60478240 +
acatcctgccccaacagtcgcc

SEQ ID NO: 197876 - DNA, 22 bp, Artificial Sequence
  Synthetic oligonucleotide; CTG chr2 60478226 60478247 60478243 60478248 +
ccccaacagtcgccctgtggaa

SEQ ID NO: 197877 - DNA, 22 bp, Artificial Sequence
  Synthetic oligonucleotide; CTG chr2 60478243 60478264 60478260 60478265 +
tggaatgagggaaggtattagc

SEQ ID NO: 197878 - DNA, 22 bp, Artificial Sequence
  Synthetic oligonucleotide; TTA chr2 60478263 60478284 60478280 60478285 +
gcctcacctcccagtgaggaac

SEQ ID NO: 197879 - DNA, 22 bp, Artificial Sequence
  Synthetic oligonucleotide; CTC chr2 60478268 60478289 60478285 60478290 +
acctcccagtgaggaactcgaa

SEQ ID NO: 197880 - DNA, 22 bp, Artificial Sequence
  Synthetic oligonucleotide; CTC chr2 60478273 60478294 60478290 60478295 +
ccagtgaggaactcgaagatct

SEQ ID NO: 197881 - DNA, 22 bp, Artificial Sequence
  Synthetic oligonucleotide; CTC chr2 60478287 60478308 60478304 60478309 +
gaagatctcagaagtgtcctgc

SEQ ID NO: 197882 - DNA, 22 bp, Artificial Sequence
  Synthetic oligonucleotide; CTC chr2 60478296 60478317 60478313 60478318 +
agaagtgtcctgctgtggacag

SEQ ID NO: 197883 - DNA, 22 bp, Artificial Sequence
  Synthetic oligonucleotide; CTG chr2 60478308 60478329 60478325 60478330 +
ctgtggacagggaggacagggc

SEQ ID NO: 197884 - DNA, 22 bp, Artificial Sequence
  Synthetic oligonucleotide; CTG chr2 60478311 60478332 60478328 60478333 +
tggacagggaggacagggctgg

SEQ ID NO: 197885 - DNA, 22 bp, Artificial Sequence
  Synthetic oligonucleotide; CTG chr2 60478332 60478353 60478349 60478354 +
ggcttcaggaccctgcccacct

SEQ ID NO: 197886 - DNA, 22 bp, Artificial Sequence
  Synthetic oligonucleotide; CTT chr2 60478337 60478358 60478354 60478359 +
caggaccctgcccaccttctga

SEQ ID NO: 197887 - DNA, 22 bp, Artificial Sequence
  Synthetic oligonucleotide; TTC chr2 60478338 60478359 60478355 60478360 +
aggaccctgcccaccttctgac

SEQ ID NO: 197888 - DNA, 22 bp, Artificial Sequence
  Synthetic oligonucleotide; CTG chr2 60478347 60478368 60478364 60478369 +
cccaccttctgacaaacccctc

SEQ ID NO: 197889 - DNA, 22 bp, Artificial Sequence
  Synthetic oligonucleotide; CTT chr2 60478355 60478376 60478372 60478377 +
ctgacaaacccctcccactgcc

SEQ ID NO: 197890 - DNA, 22 bp, Artificial Sequence
  Synthetic oligonucleotide; TTC chr2 60478356 60478377 60478373 60478378 +
tgacaaacccctcccactgcca

SEQ ID NO: 197891 - DNA, 22 bp, Artificial Sequence
  Synthetic oligonucleotide; CTG chr2 60478358 60478379 60478375 60478380 +
acaaacccctcccactgccacc

SEQ ID NO: 197892 - DNA, 22 bp, Artificial Sequence
  Synthetic oligonucleotide; CTC chr2 60478369 60478390 60478386 60478391 +
ccactgccacctcagggccgcg

SEQ ID NO: 197893 - DNA, 22 bp, Artificial Sequence
  Synthetic oligonucleotide; CTG chr2 60478375 60478396 60478392 60478397 +
ccacctcagggccgcggcagaa

SEQ ID NO: 197894 - DNA, 22 bp, Artificial Sequence
  Synthetic oligonucleotide; CTC chr2 60478382 60478403 60478399 60478404 +
agggccgcggcagaaacctgtc

SEQ ID NO: 197895 - DNA, 22 bp, Artificial Sequence
  Synthetic oligonucleotide; CTG chr2 60478402 60478423 60478419 60478424 +
tcgtctggacactggtcataca

SEQ ID NO: 197896 - DNA, 22 bp, Artificial Sequence
  Synthetic oligonucleotide; CTG chr2 60478409 60478430 60478426 60478431 +
gacactggtcatacagcccctt

SEQ ID NO: 197897 - DNA, 22 bp, Artificial Sequence
  Synthetic oligonucleotide; CTG chr2 60478416 60478437 60478433 60478438 +
gtcatacagcccctttcaggca

SEQ ID NO: 197898 - DNA, 22 bp, Artificial Sequence
  Synthetic oligonucleotide; CTT chr2 60478431 60478452 60478448 60478453 +
tcaggcaatctcctcacttgcc

SEQ ID NO: 197899 - DNA, 22 bp, Artificial Sequence
  Synthetic oligonucleotide; TTT chr2 60478432 60478453 60478449 60478454 +
caggcaatctcctcacttgcct

SEQ ID NO: 197900 - DNA, 22 bp, Artificial Sequence
  Synthetic oligonucleotide; TTC chr2 60478433 60478454 60478450 60478455 +
aggcaatctcctcacttgcctt

SEQ ID NO: 197901 - DNA, 22 bp, Artificial Sequence
  Synthetic oligonucleotide; CTC chr2 60478443 60478464 60478460 60478465 +
ctcacttgcctttctggcacta

SEQ ID NO: 197902 - DNA, 22 bp, Artificial Sequence
  Synthetic oligonucleotide; CTC chr2 60478446 60478467 60478463 60478468 +
acttgcctttctggcactattg

SEQ ID NO: 197903 - DNA, 22 bp, Artificial Sequence
  Synthetic oligonucleotide; CTT chr2 60478450 60478471 60478467 60478472 +
gcctttctggcactattgagtg

SEQ ID NO: 197904 - DNA, 22 bp, Artificial Sequence
  Synthetic oligonucleotide; TTG chr2 60478451 60478472 60478468 60478473 +
cctttctggcactattgagtga

SEQ ID NO: 197905 - DNA, 22 bp, Artificial Sequence
  Synthetic oligonucleotide; CTT chr2 60478455 60478476 60478472 60478477 +
tctggcactattgagtgactgg

SEQ ID NO: 197906 - DNA, 22 bp, Artificial Sequence
  Synthetic oligonucleotide; TTT chr2 60478456 60478477 60478473 60478478 +
ctggcactattgagtgactggt

SEQ ID NO: 197907 - DNA, 22 bp, Artificial Sequence
  Synthetic oligonucleotide; TTC chr2 60478457 60478478 60478474 60478479 +
tggcactattgagtgactggtg

SEQ ID NO: 197908 - DNA, 22 bp, Artificial Sequence
  Synthetic oligonucleotide; CTG chr2 60478459 60478480 60478476 60478481 +
gcactattgagtgactggtgtg

SEQ ID NO: 197909 - DNA, 22 bp, Artificial Sequence
  Synthetic oligonucleotide; CTA chr2 60478465 60478486 60478482 60478487 +
ttgagtgactggtgtgtggact

SEQ ID NO: 197910 - DNA, 22 bp, Artificial Sequence
  Synthetic oligonucleotide; TTG chr2 60478468 60478489 60478485 60478490 +
agtgactggtgtgtggacttca

SEQ ID NO: 197911 - DNA, 22 bp, Artificial Sequence
  Synthetic oligonucleotide; CTG chr2 60478476 60478497 60478493 60478498 +
gtgtgtggacttcaggggaagc

SEQ ID NO: 197912 - DNA, 22 bp, Artificial Sequence
  Synthetic oligonucleotide; CTT chr2 60478488 60478509 60478505 60478510 +
caggggaagcgtggaaggcact

SEQ ID NO: 197913 - DNA, 22 bp, Artificial Sequence
  Synthetic oligonucleotide; TTC chr2 60478489 60478510 60478506 60478511 +
aggggaagcgtggaaggcactt

SEQ ID NO: 197914 - DNA, 22 bp, Artificial Sequence
  Synthetic oligonucleotide; CTT chr2 60478511 60478532 60478528 60478533 +
cacaggcctaatactctgtgac

SEQ ID NO: 197915 - DNA, 22 bp, Artificial Sequence
  Synthetic oligonucleotide; TTC chr2 60478512 60478533 60478529 60478534 +
acaggcctaatactctgtgaca

SEQ ID NO: 197916 - DNA, 22 bp, Artificial Sequence
  Synthetic oligonucleotide; CTA chr2 60478521 60478542 60478538 60478543 +
atactctgtgacagtcttggcc

SEQ ID NO: 197917 - DNA, 22 bp, Artificial Sequence
  Synthetic oligonucleotide; CTC chr2 60478527 60478548 60478544 60478549 +
tgtgacagtcttggccaagaga

SEQ ID NO: 197918 - DNA, 22 bp, Artificial Sequence
  Synthetic oligonucleotide; CTG chr2 60478529 60478550 60478546 60478551 +
tgacagtcttggccaagagatt

SEQ ID NO: 197919 - DNA, 22 bp, Artificial Sequence
  Synthetic oligonucleotide; CTT chr2 60478539 60478560 60478556 60478561 +
ggccaagagattctgagaacca

SEQ ID NO: 197920 - DNA, 22 bp, Artificial Sequence
  Synthetic oligonucleotide; TTG chr2 60478540 60478561 60478557 60478562 +
gccaagagattctgagaaccag

SEQ ID NO: 197921 - DNA, 22 bp, Artificial Sequence
  Synthetic oligonucleotide; TTC chr2 60478552 60478573 60478569 60478574 +
tgagaaccagaactggccattc

SEQ ID NO: 197922 - DNA, 22 bp, Artificial Sequence
  Synthetic oligonucleotide; CTG chr2 60478554 60478575 60478571 60478576 +
agaaccagaactggccattctc

SEQ ID NO: 197923 - DNA, 22 bp, Artificial Sequence
  Synthetic oligonucleotide; CTG chr2 60478567 60478588 60478584 60478589 +
gccattctccagaattaaaacc

SEQ ID NO: 197924 - DNA, 22 bp, Artificial Sequence
  Synthetic oligonucleotide; TTC chr2 60478574 60478595 60478591 60478596 +
tccagaattaaaacctattatg

SEQ ID NO: 197925 - DNA, 22 bp, Artificial Sequence
  Synthetic oligonucleotide; CTC chr2 60478576 60478597 60478593 60478598 +
cagaattaaaacctattatgtc

SEQ ID NO: 197926 - DNA, 22 bp, Artificial Sequence
  Synthetic oligonucleotide; TTA chr2 60478584 60478605 60478601 60478606 +
aaacctattatgtcctatggtt

SEQ ID NO: 197927 - DNA, 22 bp, Artificial Sequence
  Synthetic oligonucleotide; CTA chr2 60478591 60478612 60478608 60478613 +
ttatgtcctatggttaacacag

SEQ ID NO: 197928 - DNA, 22 bp, Artificial Sequence
  Synthetic oligonucleotide; TTA chr2 60478594 60478615 60478611 60478616 +
tgtcctatggttaacacagagc

SEQ ID NO: 197929 - DNA, 22 bp, Artificial Sequence
  Synthetic oligonucleotide; CTA chr2 60478601 60478622 60478618 60478623 +
tggttaacacagagctgctcag

SEQ ID NO: 197930 - DNA, 22 bp, Artificial Sequence
  Synthetic oligonucleotide; TTA chr2 60478607 60478628 60478624 60478629 +
acacagagctgctcagaaatta

SEQ ID NO: 197931 - DNA, 22 bp, Artificial Sequence
  Synthetic oligonucleotide; CTG chr2 60478618 60478639 60478635 60478640 +
ctcagaaattatgagaactaat

SEQ ID NO: 197932 - DNA, 22 bp, Artificial Sequence
  Synthetic oligonucleotide; CTC chr2 60478621 60478642 60478638 60478643 +
agaaattatgagaactaattta

SEQ ID NO: 197933 - DNA, 22 bp, Artificial Sequence
  Synthetic oligonucleotide; TTA chr2 60478629 60478650 60478646 60478651 +
tgagaactaatttaaggcttca

SEQ ID NO: 197934 - DNA, 22 bp, Artificial Sequence
  Synthetic oligonucleotide; CTA chr2 60478638 60478659 60478655 60478660 +
atttaaggcttcaaagctctac

SEQ ID NO: 197935 - DNA, 22 bp, Artificial Sequence
  Synthetic oligonucleotide; TTT chr2 60478642 60478663 60478659 60478664 +
aaggcttcaaagctctaccaaa

SEQ ID NO: 197936 - DNA, 22 bp, Artificial Sequence
  Synthetic oligonucleotide; TTA chr2 60478643 60478664 60478660 60478665 +
aggcttcaaagctctaccaaaa

SEQ ID NO: 197937 - DNA, 22 bp, Artificial Sequence
  Synthetic oligonucleotide; CTT chr2 60478649 60478670 60478666 60478671 +
caaagctctaccaaaaaaaatg

SEQ ID NO: 197938 - DNA, 22 bp, Artificial Sequence
  Synthetic oligonucleotide; TTC chr2 60478650 60478671 60478667 60478672 +
aaagctctaccaaaaaaaatgg

SEQ ID NO: 197939 - DNA, 22 bp, Artificial Sequence
  Synthetic oligonucleotide; CTC chr2 60478657 60478678 60478674 60478679 +
taccaaaaaaaatggtctagca

SEQ ID NO: 197940 - DNA, 22 bp, Artificial Sequence
  Synthetic oligonucleotide; CTA chr2 60478659 60478680 60478676 60478681 +
ccaaaaaaaatggtctagcagg

SEQ ID NO: 197941 - DNA, 22 bp, Artificial Sequence
  Synthetic oligonucleotide; CTA chr2 60478676 60478697 60478693 60478698 +
gcaggtcaggctctaacatttc

SEQ ID NO: 197942 - DNA, 22 bp, Artificial Sequence
  Synthetic oligonucleotide; CTC chr2 60478689 60478710 60478706 60478711 +
taacatttcttcaggaataaaa

SEQ ID NO: 197943 - DNA, 22 bp, Artificial Sequence
  Synthetic oligonucleotide; CTA chr2 60478691 60478712 60478708 60478713 +
acatttcttcaggaataaaact

SEQ ID NO: 197944 - DNA, 22 bp, Artificial Sequence
  Synthetic oligonucleotide; TTT chr2 60478697 60478718 60478714 60478719 +
cttcaggaataaaactaggctg

SEQ ID NO: 197945 - DNA, 22 bp, Artificial Sequence
  Synthetic oligonucleotide; TTC chr2 60478698 60478719 60478715 60478720 +
ttcaggaataaaactaggctgc

SEQ ID NO: 197946 - DNA, 22 bp, Artificial Sequence
  Synthetic oligonucleotide; CTT chr2 60478700 60478721 60478717 60478722 +
caggaataaaactaggctgccc

SEQ ID NO: 197947 - DNA, 22 bp, Artificial Sequence
  Synthetic oligonucleotide; TTC chr2 60478701 60478722 60478718 60478723 +
aggaataaaactaggctgccct

SEQ ID NO: 197948 - DNA, 22 bp, Artificial Sequence
  Synthetic oligonucleotide; CTA chr2 60478714 60478735 60478731 60478736 +
ggctgccctctcgcctgaggtg

SEQ ID NO: 197949 - DNA, 22 bp, Artificial Sequence
  Synthetic oligonucleotide; CTG chr2 60478719 60478740 60478736 60478741 +
ccctctcgcctgaggtgaggct

SEQ ID NO: 197950 - DNA, 22 bp, Artificial Sequence
  Synthetic oligonucleotide; CTC chr2 60478724 60478745 60478741 60478746 +
tcgcctgaggtgaggctgaatg

SEQ ID NO: 197951 - DNA, 22 bp, Artificial Sequence
  Synthetic oligonucleotide; CTC chr2 60478726 60478747 60478743 60478748 +
gcctgaggtgaggctgaatgaa

SEQ ID NO: 197952 - DNA, 22 bp, Artificial Sequence
  Synthetic oligonucleotide; CTG chr2 60478731 60478752 60478748 60478753 +
aggtgaggctgaatgaaggagc

SEQ ID NO: 197953 - DNA, 22 bp, Artificial Sequence
  Synthetic oligonucleotide; CTG chr2 60478742 60478763 60478759 60478764 +
aatgaaggagcgctctggtgct

SEQ ID NO: 197954 - DNA, 22 bp, Artificial Sequence
  Synthetic oligonucleotide; CTC chr2 60478757 60478778 60478774 60478779 +
tggtgctgcgaggccaggcctc

SEQ ID NO: 197955 - DNA, 22 bp, Artificial Sequence
  Synthetic oligonucleotide; CTG chr2 60478759 60478780 60478776 60478781 +
gtgctgcgaggccaggcctcct

SEQ ID NO: 197956 - DNA, 22 bp, Artificial Sequence
  Synthetic oligonucleotide; CTG chr2 60478765 60478786 60478782 60478787 +
cgaggccaggcctcctcccatg

SEQ ID NO: 197957 - DNA, 22 bp, Artificial Sequence
  Synthetic oligonucleotide; CTC chr2 60478779 60478800 60478796 60478801 +
ctcccatgacggcaagtccttc

SEQ ID NO: 197958 - DNA, 22 bp, Artificial Sequence
  Synthetic oligonucleotide; CTC chr2 60478782 60478803 60478799 60478804 +
ccatgacggcaagtccttcttt

SEQ ID NO: 197959 - DNA, 22 bp, Artificial Sequence
  Synthetic oligonucleotide; CTT chr2 60478800 60478821 60478817 60478822 +
ctttcagaaaacaggcctctgc

SEQ ID NO: 197960 - DNA, 22 bp, Artificial Sequence
  Synthetic oligonucleotide; TTC chr2 60478801 60478822 60478818 60478823 +
tttcagaaaacaggcctctgcc

SEQ ID NO: 197961 - DNA, 22 bp, Artificial Sequence
  Synthetic oligonucleotide; CTT chr2 60478803 60478824 60478820 60478825 +
tcagaaaacaggcctctgcccg

SEQ ID NO: 197962 - DNA, 22 bp, Artificial Sequence
  Synthetic oligonucleotide; TTT chr2 60478804 60478825 60478821 60478826 +
cagaaaacaggcctctgcccgg

SEQ ID NO: 197963 - DNA, 22 bp, Artificial Sequence
  Synthetic oligonucleotide; TTC chr2 60478805 60478826 60478822 60478827 +
agaaaacaggcctctgcccggg

SEQ ID NO: 197964 - DNA, 22 bp, Artificial Sequence
  Synthetic oligonucleotide; CTC chr2 60478819 60478840 60478836 60478841 +
tgcccggggcatgctgcagctg

SEQ ID NO: 197965 - DNA, 22 bp, Artificial Sequence
  Synthetic oligonucleotide; CTG chr2 60478821 60478842 60478838 60478843 +
cccggggcatgctgcagctgct

SEQ ID NO: 197966 - DNA, 22 bp, Artificial Sequence
  Synthetic oligonucleotide; CTG chr2 60478835 60478856 60478852 60478857 +
cagctgcttctctgcagtgcct

SEQ ID NO: 197967 - DNA, 22 bp, Artificial Sequence
  Synthetic oligonucleotide; CTG chr2 60478841 60478862 60478858 60478863 +
cttctctgcagtgcctcagcac

SEQ ID NO: 197968 - DNA, 22 bp, Artificial Sequence
  Synthetic oligonucleotide; CTT chr2 60478844 60478865 60478861 60478866 +
ctctgcagtgcctcagcacctt

SEQ ID NO: 197969 - DNA, 22 bp, Artificial Sequence
  Synthetic oligonucleotide; TTC chr2 60478845 60478866 60478862 60478867 +
tctgcagtgcctcagcaccttc

SEQ ID NO: 197970 - DNA, 22 bp, Artificial Sequence
  Synthetic oligonucleotide; CTC chr2 60478847 60478868 60478864 60478869 +
tgcagtgcctcagcaccttccc

SEQ ID NO: 197971 - DNA, 22 bp, Artificial Sequence
  Synthetic oligonucleotide; CTG chr2 60478849 60478870 60478866 60478871 +
cagtgcctcagcaccttcccgc

SEQ ID NO: 197972 - DNA, 22 bp, Artificial Sequence
  Synthetic oligonucleotide; CTC chr2 60478858 60478879 60478875 60478880 +
agcaccttcccgcctcccaggc

SEQ ID NO: 197973 - DNA, 22 bp, Artificial Sequence
  Synthetic oligonucleotide; CTT chr2 60478866 60478887 60478883 60478888 +
cccgcctcccaggcacacagca

SEQ ID NO: 197974 - DNA, 22 bp, Artificial Sequence
  Synthetic oligonucleotide; TTC chr2 60478867 60478888 60478884 60478889 +
ccgcctcccaggcacacagcag

SEQ ID NO: 197975 - DNA, 22 bp, Artificial Sequence
  Synthetic oligonucleotide; CTC chr2 60478874 60478895 60478891 60478896 +
ccaggcacacagcagcccagcc

SEQ ID NO: 197976 - DNA, 22 bp, Artificial Sequence
  Synthetic oligonucleotide; CTC chr2 60478898 60478919 60478915 60478920 +
agtcctcatctctctggcaaag

SEQ ID NO: 197977 - DNA, 22 bp, Artificial Sequence
  Synthetic oligonucleotide; CTC chr2 60478905 60478926 60478922 60478927 +
atctctctggcaaagtcccaca

SEQ ID NO: 197978 - DNA, 22 bp, Artificial Sequence
  Synthetic oligonucleotide; CTC chr2 60478910 60478931 60478927 60478932 +
tctggcaaagtcccacagaaca

SEQ ID NO: 197979 - DNA, 22 bp, Artificial Sequence
  Synthetic oligonucleotide; CTC chr2 60478912 60478933 60478929 60478934 +
tggcaaagtcccacagaacaaa

SEQ ID NO: 197980 - DNA, 22 bp, Artificial Sequence
  Synthetic oligonucleotide; CTG chr2 60478914 60478935 60478931 60478936 +
gcaaagtcccacagaacaaaac

SEQ ID NO: 197981 - DNA, 22 bp, Artificial Sequence
  Synthetic oligonucleotide; CTT chr2 60478945 60478966 60478962 60478967 +
ggctttgacgtgctttgttttt

SEQ ID NO: 197982 - DNA, 22 bp, Artificial Sequence
  Synthetic oligonucleotide; TTG chr2 60478946 60478967 60478963 60478968 +
gctttgacgtgctttgtttttt

SEQ ID NO: 197983 - DNA, 22 bp, Artificial Sequence
  Synthetic oligonucleotide; CTT chr2 60478950 60478971 60478967 60478972 +
tgacgtgctttgttttttgttt

SEQ ID NO: 197984 - DNA, 22 bp, Artificial Sequence
  Synthetic oligonucleotide; TTT chr2 60478951 60478972 60478968 60478973 +
gacgtgctttgttttttgtttt

SEQ ID NO: 197985 - DNA, 22 bp, Artificial Sequence
  Synthetic oligonucleotide; TTG chr2 60478952 60478973 60478969 60478974 +
acgtgctttgttttttgttttt

SEQ ID NO: 197986 - DNA, 22 bp, Artificial Sequence
  Synthetic oligonucleotide; CTT chr2 60478960 60478981 60478977 60478982 +
tgttttttgttttttttttttc

SEQ ID NO: 197987 - DNA, 22 bp, Artificial Sequence
  Synthetic oligonucleotide; TTT chr2 60478961 60478982 60478978 60478983 +
gttttttgttttttttttttcc

SEQ ID NO: 197988 - DNA, 22 bp, Artificial Sequence
  Synthetic oligonucleotide; TTG chr2 60478962 60478983 60478979 60478984 +
ttttttgttttttttttttccc

SEQ ID NO: 197989 - DNA, 22 bp, Artificial Sequence
  Synthetic oligonucleotide; TTT chr2 60478965 60478986 60478982 60478987 +
tttgttttttttttttccctcc

SEQ ID NO: 197990 - DNA, 22 bp, Artificial Sequence
  Synthetic oligonucleotide; TTT chr2 60478966 60478987 60478983 60478988 +
ttgttttttttttttccctcct

SEQ ID NO: 197991 - DNA, 22 bp, Artificial Sequence
  Synthetic oligonucleotide; TTT chr2 60478967 60478988 60478984 60478989 +
tgttttttttttttccctcctc

SEQ ID NO: 197992 - DNA, 22 bp, Artificial Sequence
  Synthetic oligonucleotide; TTT chr2 60478968 60478989 60478985 60478990 +
gttttttttttttccctcctcc

SEQ ID NO: 197993 - DNA, 22 bp, Artificial Sequence
  Synthetic oligonucleotide; TTG chr2 60478969 60478990 60478986 60478991 +
ttttttttttttccctcctccc

SEQ ID NO: 197994 - DNA, 22 bp, Artificial Sequence
  Synthetic oligonucleotide; TTT chr2 60478972 60478993 60478989 60478994 +
tttttttttccctcctccctgg

SEQ ID NO: 197995 - DNA, 22 bp, Artificial Sequence
  Synthetic oligonucleotide; TTT chr2 60478973 60478994 60478990 60478995 +
ttttttttccctcctccctggc

SEQ ID NO: 197996 - DNA, 22 bp, Artificial Sequence
  Synthetic oligonucleotide; TTT chr2 60478974 60478995 60478991 60478996 +
tttttttccctcctccctggct

SEQ ID NO: 197997 - DNA, 22 bp, Artificial Sequence
  Synthetic oligonucleotide; TTT chr2 60478975 60478996 60478992 60478997 +
ttttttccctcctccctggctt

SEQ ID NO: 197998 - DNA, 22 bp, Artificial Sequence
  Synthetic oligonucleotide; TTT chr2 60478976 60478997 60478993 60478998 +
tttttccctcctccctggcttt

SEQ ID NO: 197999 - DNA, 22 bp, Artificial Sequence
  Synthetic oligonucleotide; TTT chr2 60478977 60478998 60478994 60478999 +
ttttccctcctccctggctttt

SEQ ID NO: 198000 - DNA, 22 bp, Artificial Sequence
  Synthetic oligonucleotide; TTT chr2 60478978 60478999 60478995 60479000 +
tttccctcctccctggcttttt

SEQ ID NO: 198001 - DNA, 22 bp, Artificial Sequence
  Synthetic oligonucleotide; TTT chr2 60478979 60479000 60478996 60479001 +
ttccctcctccctggcttttta

SEQ ID NO: 198002 - DNA, 22 bp, Artificial Sequence
  Synthetic oligonucleotide; TTT chr2 60478980 60479001 60478997 60479002 +
tccctcctccctggctttttac

SEQ ID NO: 198003 - DNA, 22 bp, Artificial Sequence
  Synthetic oligonucleotide; TTT chr2 60478981 60479002 60478998 60479003 +
ccctcctccctggctttttacc

SEQ ID NO: 198004 - DNA, 22 bp, Artificial Sequence
  Synthetic oligonucleotide; TTC chr2 60478982 60479003 60478999 60479004 +
cctcctccctggctttttaccc

SEQ ID NO: 198005 - DNA, 22 bp, Artificial Sequence
  Synthetic oligonucleotide; CTC chr2 60478986 60479007 60479003 60479008 +
ctccctggctttttacccaatt

SEQ ID NO: 198006 - DNA, 22 bp, Artificial Sequence
  Synthetic oligonucleotide; CTC chr2 60478989 60479010 60479006 60479011 +
cctggctttttacccaatttcc

SEQ ID NO: 198007 - DNA, 22 bp, Artificial Sequence
  Synthetic oligonucleotide; CTG chr2 60478993 60479014 60479010 60479015 +
gctttttacccaatttcctaat

SEQ ID NO: 198008 - DNA, 22 bp, Artificial Sequence
  Synthetic oligonucleotide; CTT chr2 60478997 60479018 60479014 60479019 +
tttacccaatttcctaatcctt

SEQ ID NO: 198009 - DNA, 22 bp, Artificial Sequence
  Synthetic oligonucleotide; TTT chr2 60478998 60479019 60479015 60479020 +
ttacccaatttcctaatccttc

SEQ ID NO: 198010 - DNA, 22 bp, Artificial Sequence
  Synthetic oligonucleotide; TTT chr2 60478999 60479020 60479016 60479021 +
tacccaatttcctaatccttca

SEQ ID NO: 198011 - DNA, 22 bp, Artificial Sequence
  Synthetic oligonucleotide; TTT chr2 60479000 60479021 60479017 60479022 +
acccaatttcctaatccttcat

SEQ ID NO: 198012 - DNA, 22 bp, Artificial Sequence
  Synthetic oligonucleotide; TTA chr2 60479001 60479022 60479018 60479023 +
cccaatttcctaatccttcatt

SEQ ID NO: 198013 - DNA, 22 bp, Artificial Sequence
  Synthetic oligonucleotide; TTT chr2 60479009 60479030 60479026 60479031 +
cctaatccttcatttataccac

SEQ ID NO: 198014 - DNA, 22 bp, Artificial Sequence
  Synthetic oligonucleotide; TTC chr2 60479010 60479031 60479027 60479032 +
ctaatccttcatttataccact

SEQ ID NO: 198015 - DNA, 22 bp, Artificial Sequence
  Synthetic oligonucleotide; CTA chr2 60479013 60479034 60479030 60479035 +
atccttcatttataccactgac

SEQ ID NO: 198016 - DNA, 22 bp, Artificial Sequence
  Synthetic oligonucleotide; CTT chr2 60479019 60479040 60479036 60479041 +
catttataccactgaccaatct

SEQ ID NO: 198017 - DNA, 22 bp, Artificial Sequence
  Synthetic oligonucleotide; TTC chr2 60479020 60479041 60479037 60479042 +
atttataccactgaccaatctg

SEQ ID NO: 198018 - DNA, 22 bp, Artificial Sequence
  Synthetic oligonucleotide; TTT chr2 60479024 60479045 60479041 60479046 +
ataccactgaccaatctggaaa

SEQ ID NO: 198019 - DNA, 22 bp, Artificial Sequence
  Synthetic oligonucleotide; TTA chr2 60479025 60479046 60479042 60479047 +
taccactgaccaatctggaaag

SEQ ID NO: 198020 - DNA, 22 bp, Artificial Sequence
  Synthetic oligonucleotide; CTG chr2 60479033 60479054 60479050 60479055 +
accaatctggaaagagttccct

SEQ ID NO: 198021 - DNA, 22 bp, Artificial Sequence
  Synthetic oligonucleotide; CTG chr2 60479042 60479063 60479059 60479064 +
gaaagagttccctgagcaaatt

SEQ ID NO: 198022 - DNA, 22 bp, Artificial Sequence
  Synthetic oligonucleotide; TTC chr2 60479052 60479073 60479069 60479074 +
cctgagcaaattggagatgccc

SEQ ID NO: 198023 - DNA, 22 bp, Artificial Sequence
  Synthetic oligonucleotide; CTG chr2 60479056 60479077 60479073 60479078 +
agcaaattggagatgcccgcag

SEQ ID NO: 198024 - DNA, 22 bp, Artificial Sequence
  Synthetic oligonucleotide; TTG chr2 60479065 60479086 60479082 60479087 +
gagatgcccgcagatacaacct

SEQ ID NO: 198025 - DNA, 22 bp, Artificial Sequence
  Synthetic oligonucleotide; CTG chr2 60479088 60479109 60479105 60479110 +
ccatcattggagcagcctcagt

SEQ ID NO: 198026 - DNA, 22 bp, Artificial Sequence
  Synthetic oligonucleotide; TTG chr2 60479097 60479118 60479114 60479119 +
gagcagcctcagtccagccatg

SEQ ID NO: 198027 - DNA, 22 bp, Artificial Sequence
  Synthetic oligonucleotide; CTC chr2 60479107 60479128 60479124 60479129 +
agtccagccatggggtgtggca

SEQ ID NO: 198028 - DNA, 22 bp, Artificial Sequence
  Synthetic oligonucleotide; CTG chr2 60479132 60479153 60479149 60479154 +
ccgtctgttcttggctctacta

SEQ ID NO: 198029 - DNA, 22 bp, Artificial Sequence
  Synthetic oligonucleotide; CTG chr2 60479139 60479160 60479156 60479161 +
ttcttggctctactaattctgc

SEQ ID NO: 198030 - DNA, 22 bp, Artificial Sequence
  Synthetic oligonucleotide; TTC chr2 60479142 60479163 60479159 60479164 +
ttggctctactaattctgctga

SEQ ID NO: 198031 - DNA, 22 bp, Artificial Sequence
  Synthetic oligonucleotide; CTT chr2 60479144 60479165 60479161 60479166 +
ggctctactaattctgctgatt

SEQ ID NO: 198032 - DNA, 22 bp, Artificial Sequence
  Synthetic oligonucleotide; TTG chr2 60479145 60479166 60479162 60479167 +
gctctactaattctgctgattc

SEQ ID NO: 198033 - DNA, 22 bp, Artificial Sequence
  Synthetic oligonucleotide; CTC chr2 60479149 60479170 60479166 60479171 +
tactaattctgctgattccata

SEQ ID NO: 198034 - DNA, 22 bp, Artificial Sequence
  Synthetic oligonucleotide; CTA chr2 60479151 60479172 60479168 60479173 +
ctaattctgctgattccatatg

SEQ ID NO: 198035 - DNA, 22 bp, Artificial Sequence
  Synthetic oligonucleotide; CTA chr2 60479154 60479175 60479171 60479176 +
attctgctgattccatatgagt

SEQ ID NO: 198036 - DNA, 22 bp, Artificial Sequence
  Synthetic oligonucleotide; TTC chr2 60479158 60479179 60479175 60479180 +
tgctgattccatatgagtaaca

SEQ ID NO: 198037 - DNA, 22 bp, Artificial Sequence
  Synthetic oligonucleotide; CTG chr2 60479160 60479181 60479177 60479182 +
ctgattccatatgagtaacatc

SEQ ID NO: 198038 - DNA, 22 bp, Artificial Sequence
  Synthetic oligonucleotide; CTG chr2 60479163 60479184 60479180 60479185 +
attccatatgagtaacatccaa

SEQ ID NO: 198039 - DNA, 22 bp, Artificial Sequence
  Synthetic oligonucleotide; TTC chr2 60479167 60479188 60479184 60479189 +
catatgagtaacatccaatgtt

SEQ ID NO: 198040 - DNA, 22 bp, Artificial Sequence
  Synthetic oligonucleotide; TTC chr2 60479190 60479211 60479207 60479212 +
ccagacacctccaagctcctcc

SEQ ID NO: 198041 - DNA, 22 bp, Artificial Sequence
  Synthetic oligonucleotide; CTC chr2 60479201 60479222 60479218 60479223 +
caagctcctccaaccaacagca

SEQ ID NO: 198042 - DNA, 22 bp, Artificial Sequence
  Synthetic oligonucleotide; CTC chr2 60479208 60479229 60479225 60479230 +
ctccaaccaacagcacaacatc

SEQ ID NO: 198043 - DNA, 22 bp, Artificial Sequence
  Synthetic oligonucleotide; CTC chr2 60479211 60479232 60479228 60479233 +
caaccaacagcacaacatcttc

SEQ ID NO: 198044 - DNA, 22 bp, Artificial Sequence
  Synthetic oligonucleotide; CTT chr2 60479232 60479253 60479249 60479254 +
caactcctttctacccacctag

SEQ ID NO: 198045 - DNA, 22 bp, Artificial Sequence
  Synthetic oligonucleotide; TTC chr2 60479233 60479254 60479250 60479255 +
aactcctttctacccacctagc

SEQ ID NO: 198046 - DNA, 22 bp, Artificial Sequence
  Synthetic oligonucleotide; CTC chr2 60479238 60479259 60479255 60479260 +
ctttctacccacctagcaggtc

SEQ ID NO: 198047 - DNA, 22 bp, Artificial Sequence
  Synthetic oligonucleotide; CTT chr2 60479241 60479262 60479258 60479263 +
tctacccacctagcaggtccac

SEQ ID NO: 198048 - DNA, 22 bp, Artificial Sequence
  Synthetic oligonucleotide; TTT chr2 60479242 60479263 60479259 60479264 +
ctacccacctagcaggtccacg

SEQ ID NO: 198049 - DNA, 22 bp, Artificial Sequence
  Synthetic oligonucleotide; TTC chr2 60479243 60479264 60479260 60479265 +
tacccacctagcaggtccacgt

SEQ ID NO: 198050 - DNA, 22 bp, Artificial Sequence
  Synthetic oligonucleotide; CTA chr2 60479245 60479266 60479262 60479267 +
cccacctagcaggtccacgtgg

SEQ ID NO: 198051 - DNA, 22 bp, Artificial Sequence
  Synthetic oligonucleotide; CTA chr2 60479253 60479274 60479270 60479275 +
gcaggtccacgtggggactcag

SEQ ID NO: 198052 - DNA, 22 bp, Artificial Sequence
  Synthetic oligonucleotide; CTC chr2 60479273 60479294 60479290 60479295 +
agcctatggacacctggcctct

SEQ ID NO: 198053 - DNA, 22 bp, Artificial Sequence
  Synthetic oligonucleotide; CTA chr2 60479279 60479300 60479296 60479301 +
tggacacctggcctctgcgggc

SEQ ID NO: 198054 - DNA, 22 bp, Artificial Sequence
  Synthetic oligonucleotide; CTG chr2 60479289 60479310 60479306 60479311 +
gcctctgcgggcacagcggcca

SEQ ID NO: 198055 - DNA, 22 bp, Artificial Sequence
  Synthetic oligonucleotide; CTC chr2 60479294 60479315 60479311 60479316 +
tgcgggcacagcggccacacac

SEQ ID NO: 198056 - DNA, 22 bp, Artificial Sequence
  Synthetic oligonucleotide; CTG chr2 60479296 60479317 60479313 60479318 +
cgggcacagcggccacacacca

SEQ ID NO: 198057 - DNA, 22 bp, Artificial Sequence
  Synthetic oligonucleotide; TTT chr2 60479340 60479361 60479357 60479362 +
tttgttttgagtctctctaaga

SEQ ID NO: 198058 - DNA, 22 bp, Artificial Sequence
  Synthetic oligonucleotide; TTT chr2 60479341 60479362 60479358 60479363 +
ttgttttgagtctctctaagac

SEQ ID NO: 198059 - DNA, 22 bp, Artificial Sequence
  Synthetic oligonucleotide; TTT chr2 60479342 60479363 60479359 60479364 +
tgttttgagtctctctaagact

SEQ ID NO: 198060 - DNA, 22 bp, Artificial Sequence
  Synthetic oligonucleotide; TTT chr2 60479343 60479364 60479360 60479365 +
gttttgagtctctctaagactg

SEQ ID NO: 198061 - DNA, 22 bp, Artificial Sequence
  Synthetic oligonucleotide; TTG chr2 60479344 60479365 60479361 60479366 +
ttttgagtctctctaagactgc

SEQ ID NO: 198062 - DNA, 22 bp, Artificial Sequence
  Synthetic oligonucleotide; TTT chr2 60479347 60479368 60479364 60479369 +
tgagtctctctaagactgcttg

SEQ ID NO: 198063 - DNA, 22 bp, Artificial Sequence
  Synthetic oligonucleotide; TTT chr2 60479348 60479369 60479365 60479370 +
gagtctctctaagactgcttgg

SEQ ID NO: 198064 - DNA, 22 bp, Artificial Sequence
  Synthetic oligonucleotide; TTG chr2 60479349 60479370 60479366 60479371 +
agtctctctaagactgcttggg

SEQ ID NO: 198065 - DNA, 22 bp, Artificial Sequence
  Synthetic oligonucleotide; CTC chr2 60479355 60479376 60479372 60479377 +
tctaagactgcttgggaaatga

SEQ ID NO: 198066 - DNA, 22 bp, Artificial Sequence
  Synthetic oligonucleotide; CTC chr2 60479357 60479378 60479374 60479379 +
taagactgcttgggaaatgagg

SEQ ID NO: 198067 - DNA, 22 bp, Artificial Sequence
  Synthetic oligonucleotide; CTA chr2 60479359 60479380 60479376 60479381 +
agactgcttgggaaatgaggtc

SEQ ID NO: 198068 - DNA, 22 bp, Artificial Sequence
  Synthetic oligonucleotide; CTG chr2 60479365 60479386 60479382 60479387 +
cttgggaaatgaggtctctcag

SEQ ID NO: 198069 - DNA, 22 bp, Artificial Sequence
  Synthetic oligonucleotide; CTT chr2 60479368 60479389 60479385 60479390 +
gggaaatgaggtctctcaggtc

SEQ ID NO: 198070 - DNA, 22 bp, Artificial Sequence
  Synthetic oligonucleotide; TTG chr2 60479369 60479390 60479386 60479391 +
ggaaatgaggtctctcaggtct

SEQ ID NO: 198071 - DNA, 22 bp, Artificial Sequence
  Synthetic oligonucleotide; CTC chr2 60479383 60479404 60479400 60479405 +
tcaggtctagcatttccacgca

SEQ ID NO: 198072 - DNA, 22 bp, Artificial Sequence
  Synthetic oligonucleotide; CTC chr2 60479385 60479406 60479402 60479407 +
aggtctagcatttccacgcagt

SEQ ID NO: 198073 - DNA, 22 bp, Artificial Sequence
  Synthetic oligonucleotide; CTA chr2 60479392 60479413 60479409 60479414 +
gcatttccacgcagtcccaacc

SEQ ID NO: 198074 - DNA, 22 bp, Artificial Sequence
  Synthetic oligonucleotide; TTT chr2 60479398 60479419 60479415 60479420 +
ccacgcagtcccaaccatgagg

SEQ ID NO: 198075 - DNA, 22 bp, Artificial Sequence
  Synthetic oligonucleotide; TTC chr2 60479399 60479420 60479416 60479421 +
cacgcagtcccaaccatgaggc

SEQ ID NO: 198076 - DNA, 22 bp, Artificial Sequence
  Synthetic oligonucleotide; CTG chr2 60479423 60479444 60479440 60479445 +
accagaggccaccaacgtcaag

SEQ ID NO: 198077 - DNA, 22 bp, Artificial Sequence
  Synthetic oligonucleotide; CTC chr2 60479448 60479469 60479465 60479470 +
tctcaggtctactaggaacagg

SEQ ID NO: 198078 - DNA, 22 bp, Artificial Sequence
  Synthetic oligonucleotide; CTC chr2 60479450 60479471 60479467 60479472 +
tcaggtctactaggaacaggaa

SEQ ID NO: 198079 - DNA, 22 bp, Artificial Sequence
  Synthetic oligonucleotide; CTC chr2 60479452 60479473 60479469 60479474 +
aggtctactaggaacaggaaag

SEQ ID NO: 198080 - DNA, 22 bp, Artificial Sequence
  Synthetic oligonucleotide; CTA chr2 60479459 60479480 60479476 60479481 +
ctaggaacaggaaagaataact

SEQ ID NO: 198081 - DNA, 22 bp, Artificial Sequence
  Synthetic oligonucleotide; CTA chr2 60479462 60479483 60479479 60479484 +
ggaacaggaaagaataactctc

SEQ ID NO: 198082 - DNA, 22 bp, Artificial Sequence
  Synthetic oligonucleotide; CTC chr2 60479482 60479503 60479499 60479504 +
tcccttaacaagcccctcaggc

SEQ ID NO: 198083 - DNA, 22 bp, Artificial Sequence
  Synthetic oligonucleotide; CTC chr2 60479484 60479505 60479501 60479506 +
ccttaacaagcccctcaggctg

SEQ ID NO: 198084 - DNA, 22 bp, Artificial Sequence
  Synthetic oligonucleotide; CTT chr2 60479488 60479509 60479505 60479510 +
aacaagcccctcaggctgaaat

SEQ ID NO: 198085 - DNA, 22 bp, Artificial Sequence
  Synthetic oligonucleotide; TTA chr2 60479489 60479510 60479506 60479511 +
acaagcccctcaggctgaaatc

SEQ ID NO: 198086 - DNA, 22 bp, Artificial Sequence
  Synthetic oligonucleotide; CTC chr2 60479500 60479521 60479517 60479522 +
aggctgaaatccttttgcttcc

SEQ ID NO: 198087 - DNA, 22 bp, Artificial Sequence
  Synthetic oligonucleotide; CTG chr2 60479506 60479527 60479523 60479528 +
aaatccttttgcttccagggcc

SEQ ID NO: 198088 - DNA, 22 bp, Artificial Sequence
  Synthetic oligonucleotide; CTT chr2 60479514 60479535 60479531 60479536 +
ttgcttccagggcctcaacctt

SEQ ID NO: 198089 - DNA, 22 bp, Artificial Sequence
  Synthetic oligonucleotide; TTT chr2 60479515 60479536 60479532 60479537 +
tgcttccagggcctcaaccttc

SEQ ID NO: 198090 - DNA, 22 bp, Artificial Sequence
  Synthetic oligonucleotide; TTT chr2 60479516 60479537 60479533 60479538 +
gcttccagggcctcaaccttct

SEQ ID NO: 198091 - DNA, 22 bp, Artificial Sequence
  Synthetic oligonucleotide; TTG chr2 60479517 60479538 60479534 60479539 +
cttccagggcctcaaccttcta

SEQ ID NO: 198092 - DNA, 22 bp, Artificial Sequence
  Synthetic oligonucleotide; CTT chr2 60479520 60479541 60479537 60479542 +
ccagggcctcaaccttctactg

SEQ ID NO: 198093 - DNA, 22 bp, Artificial Sequence
  Synthetic oligonucleotide; TTC chr2 60479521 60479542 60479538 60479543 +
cagggcctcaaccttctactgc

SEQ ID NO: 198094 - DNA, 22 bp, Artificial Sequence
  Synthetic oligonucleotide; CTC chr2 60479530 60479551 60479547 60479552 +
aaccttctactgctgggtagaa

SEQ ID NO: 198095 - DNA, 22 bp, Artificial Sequence
  Synthetic oligonucleotide; CTT chr2 60479536 60479557 60479553 60479558 +
ctactgctgggtagaaagcccc

SEQ ID NO: 198096 - DNA, 22 bp, Artificial Sequence
  Synthetic oligonucleotide; TTC chr2 60479537 60479558 60479554 60479559 +
tactgctgggtagaaagccccc

SEQ ID NO: 198097 - DNA, 22 bp, Artificial Sequence
  Synthetic oligonucleotide; CTA chr2 60479539 60479560 60479556 60479561 +
ctgctgggtagaaagccccctc

SEQ ID NO: 198098 - DNA, 22 bp, Artificial Sequence
  Synthetic oligonucleotide; CTG chr2 60479542 60479563 60479559 60479564 +
ctgggtagaaagccccctctgt

SEQ ID NO: 198099 - DNA, 22 bp, Artificial Sequence
  Synthetic oligonucleotide; CTG chr2 60479545 60479566 60479562 60479567 +
ggtagaaagccccctctgtcac

SEQ ID NO: 198100 - DNA, 22 bp, Artificial Sequence
  Synthetic oligonucleotide; CTC chr2 60479561 60479582 60479578 60479583 +
tgtcaccggcccacagatctca

SEQ ID NO: 198101 - DNA, 22 bp, Artificial Sequence
  Synthetic oligonucleotide; CTG chr2 60479563 60479584 60479580 60479585 +
tcaccggcccacagatctcagc

SEQ ID NO: 198102 - DNA, 22 bp, Artificial Sequence
  Synthetic oligonucleotide; CTC chr2 60479582 60479603 60479599 60479604 +
agctgccatcgcactcaaaccc

SEQ ID NO: 198103 - DNA, 22 bp, Artificial Sequence
  Synthetic oligonucleotide; CTG chr2 60479587 60479608 60479604 60479609 +
ccatcgcactcaaaccctgtca

SEQ ID NO: 198104 - DNA, 22 bp, Artificial Sequence
  Synthetic oligonucleotide; CTC chr2 60479598 60479619 60479615 60479620 +
aaaccctgtcaggcggtggaga

SEQ ID NO: 198105 - DNA, 22 bp, Artificial Sequence
  Synthetic oligonucleotide; CTG chr2 60479606 60479627 60479623 60479628 +
tcaggcggtggagagtgtggac

SEQ ID NO: 198106 - DNA, 22 bp, Artificial Sequence
  Synthetic oligonucleotide; CTG chr2 60479637 60479658 60479654 60479659 +
acgcggtttcaaagaggccgac

SEQ ID NO: 198107 - DNA, 22 bp, Artificial Sequence
  Synthetic oligonucleotide; TTT chr2 60479646 60479667 60479663 60479668 +
caaagaggccgaccaggcaaga

SEQ ID NO: 198108 - DNA, 22 bp, Artificial Sequence
  Synthetic oligonucleotide; TTC chr2 60479647 60479668 60479664 60479669 +
aaagaggccgaccaggcaagaa

SEQ ID NO: 198109 - DNA, 22 bp, Artificial Sequence
  Synthetic oligonucleotide; CTG chr2 60479677 60479698 60479694 60479699 +
tactcctgccccagctctaatg

SEQ ID NO: 198110 - DNA, 22 bp, Artificial Sequence
  Synthetic oligonucleotide; CTC chr2 60479682 60479703 60479699 60479704 +
ctgccccagctctaatgcaata

SEQ ID NO: 198111 - DNA, 22 bp, Artificial Sequence
  Synthetic oligonucleotide; CTG chr2 60479685 60479706 60479702 60479707 +
ccccagctctaatgcaataaaa

SEQ ID NO: 198112 - DNA, 22 bp, Artificial Sequence
  Synthetic oligonucleotide; CTC chr2 60479694 60479715 60479711 60479716 +
taatgcaataaaatgtctttta

SEQ ID NO: 198113 - DNA, 22 bp, Artificial Sequence
  Synthetic oligonucleotide; CTA chr2 60479696 60479717 60479713 60479718 +
atgcaataaaatgtcttttatc

SEQ ID NO: 198114 - DNA, 22 bp, Artificial Sequence
  Synthetic oligonucleotide; CTT chr2 60479713 60479734 60479730 60479735 +
ttatcaatgtaattcaaggcaa

SEQ ID NO: 198115 - DNA, 22 bp, Artificial Sequence
  Synthetic oligonucleotide; TTT chr2 60479714 60479735 60479731 60479736 +
tatcaatgtaattcaaggcaaa

SEQ ID NO: 198116 - DNA, 22 bp, Artificial Sequence
  Synthetic oligonucleotide; TTT chr2 60479715 60479736 60479732 60479737 +
atcaatgtaattcaaggcaaag

SEQ ID NO: 198117 - DNA, 22 bp, Artificial Sequence
  Synthetic oligonucleotide; TTA chr2 60479716 60479737 60479733 60479738 +
tcaatgtaattcaaggcaaaga

SEQ ID NO: 198118 - DNA, 22 bp, Artificial Sequence
  Synthetic oligonucleotide; TTC chr2 60479728 60479749 60479745 60479750 +
aaggcaaagagtcaagggtctg

SEQ ID NO: 198119 - DNA, 22 bp, Artificial Sequence
  Synthetic oligonucleotide; CTG chr2 60479750 60479771 60479767 60479772 +
tcaccattttaaagaggcttat

SEQ ID NO: 198120 - DNA, 22 bp, Artificial Sequence
  Synthetic oligonucleotide; TTT chr2 60479759 60479780 60479776 60479781 +
taaagaggcttattacatggcc

SEQ ID NO: 198121 - DNA, 22 bp, Artificial Sequence
  Synthetic oligonucleotide; TTT chr2 60479760 60479781 60479777 60479782 +
aaagaggcttattacatggcca

SEQ ID NO: 198122 - DNA, 22 bp, Artificial Sequence
  Synthetic oligonucleotide; TTA chr2 60479761 60479782 60479778 60479783 +
aagaggcttattacatggccac

SEQ ID NO: 198123 - DNA, 22 bp, Artificial Sequence
  Synthetic oligonucleotide; CTT chr2 60479770 60479791 60479787 60479792 +
attacatggccacaaaaatttg

SEQ ID NO: 198124 - DNA, 22 bp, Artificial Sequence
  Synthetic oligonucleotide; TTA chr2 60479771 60479792 60479788 60479793 +
ttacatggccacaaaaatttgc

SEQ ID NO: 198125 - DNA, 22 bp, Artificial Sequence
  Synthetic oligonucleotide; TTA chr2 60479774 60479795 60479791 60479796 +
catggccacaaaaatttgcctc

SEQ ID NO: 198126 - DNA, 22 bp, Artificial Sequence
  Synthetic oligonucleotide; TTT chr2 60479791 60479812 60479808 60479813 +
gcctcaggctcaaacctggcat

SEQ ID NO: 198127 - DNA, 22 bp, Artificial Sequence
  Synthetic oligonucleotide; TTG chr2 60479792 60479813 60479809 60479814 +
cctcaggctcaaacctggcatg

SEQ ID NO: 198128 - DNA, 22 bp, Artificial Sequence
  Synthetic oligonucleotide; CTC chr2 60479796 60479817 60479813 60479818 +
aggctcaaacctggcatgtaag

SEQ ID NO: 198129 - DNA, 22 bp, Artificial Sequence
  Synthetic oligonucleotide; CTC chr2 60479802 60479823 60479819 60479824 +
aaacctggcatgtaaggtatca

SEQ ID NO: 198130 - DNA, 22 bp, Artificial Sequence
  Synthetic oligonucleotide; CTG chr2 60479809 60479830 60479826 60479831 +
gcatgtaaggtatcagcgtggg

SEQ ID NO: 198131 - DNA, 22 bp, Artificial Sequence
  Synthetic oligonucleotide; TTC chr2 60479839 60479860 60479856 60479861 +
ttttgattttattttattttct

SEQ ID NO: 198132 - DNA, 22 bp, Artificial Sequence
  Synthetic oligonucleotide; CTT chr2 60479841 60479862 60479858 60479863 +
ttgattttattttattttctta

SEQ ID NO: 198133 - DNA, 22 bp, Artificial Sequence
  Synthetic oligonucleotide; TTT chr2 60479842 60479863 60479859 60479864 +
tgattttattttattttcttac

SEQ ID NO: 198134 - DNA, 22 bp, Artificial Sequence
  Synthetic oligonucleotide; TTT chr2 60479843 60479864 60479860 60479865 +
gattttattttattttcttaca

SEQ ID NO: 198135 - DNA, 22 bp, Artificial Sequence
  Synthetic oligonucleotide; TTG chr2 60479844 60479865 60479861 60479866 +
attttattttattttcttacaa

SEQ ID NO: 198136 - DNA, 22 bp, Artificial Sequence
  Synthetic oligonucleotide; TTT chr2 60479848 60479869 60479865 60479870 +
tattttattttcttacaaaatc

SEQ ID NO: 198137 - DNA, 22 bp, Artificial Sequence
  Synthetic oligonucleotide; TTT chr2 60479849 60479870 60479866 60479871 +
attttattttcttacaaaatct

SEQ ID NO: 198138 - DNA, 22 bp, Artificial Sequence
  Synthetic oligonucleotide; TTA chr2 60479850 60479871 60479867 60479872 +
ttttattttcttacaaaatctg

SEQ ID NO: 198139 - DNA, 22 bp, Artificial Sequence
  Synthetic oligonucleotide; TTT chr2 60479853 60479874 60479870 60479875 +
tattttcttacaaaatctgaaa

SEQ ID NO: 198140 - DNA, 22 bp, Artificial Sequence
  Synthetic oligonucleotide; TTT chr2 60479854 60479875 60479871 60479876 +
attttcttacaaaatctgaaaa

SEQ ID NO: 198141 - DNA, 22 bp, Artificial Sequence
  Synthetic oligonucleotide; TTA chr2 60479855 60479876 60479872 60479877 +
ttttcttacaaaatctgaaaat

SEQ ID NO: 198142 - DNA, 22 bp, Artificial Sequence
  Synthetic oligonucleotide; TTT chr2 60479858 60479879 60479875 60479880 +
tcttacaaaatctgaaaatgaa

SEQ ID NO: 198143 - DNA, 22 bp, Artificial Sequence
  Synthetic oligonucleotide; TTT chr2 60479859 60479880 60479876 60479881 +
cttacaaaatctgaaaatgaaa

SEQ ID NO: 198144 - DNA, 22 bp, Artificial Sequence
  Synthetic oligonucleotide; TTC chr2 60479860 60479881 60479877 60479882 +
ttacaaaatctgaaaatgaaac

SEQ ID NO: 198145 - DNA, 22 bp, Artificial Sequence
  Synthetic oligonucleotide; CTT chr2 60479862 60479883 60479879 60479884 +
acaaaatctgaaaatgaaacgc

SEQ ID NO: 198146 - DNA, 22 bp, Artificial Sequence
  Synthetic oligonucleotide; TTA chr2 60479863 60479884 60479880 60479885 +
caaaatctgaaaatgaaacgct

SEQ ID NO: 198147 - DNA, 22 bp, Artificial Sequence
  Synthetic oligonucleotide; CTG chr2 60479872 60479893 60479889 60479894 +
aaaatgaaacgcttctgtccct

SEQ ID NO: 198148 - DNA, 22 bp, Artificial Sequence
  Synthetic oligonucleotide; CTT chr2 60479886 60479907 60479903 60479908 +
ctgtccctcccttccaccaacc

SEQ ID NO: 198149 - DNA, 22 bp, Artificial Sequence
  Synthetic oligonucleotide; TTC chr2 60479887 60479908 60479904 60479909 +
tgtccctcccttccaccaaccg

SEQ ID NO: 198150 - DNA, 22 bp, Artificial Sequence
  Synthetic oligonucleotide; CTG chr2 60479889 60479910 60479906 60479911 +
tccctcccttccaccaaccgtt

SEQ ID NO: 198151 - DNA, 22 bp, Artificial Sequence
  Synthetic oligonucleotide; CTC chr2 60479895 60479916 60479912 60479917 +
ccttccaccaaccgttttttga

SEQ ID NO: 198152 - DNA, 22 bp, Artificial Sequence
  Synthetic oligonucleotide; CTT chr2 60479899 60479920 60479916 60479921 +
ccaccaaccgttttttgattta

SEQ ID NO: 198153 - DNA, 22 bp, Artificial Sequence
  Synthetic oligonucleotide; TTC chr2 60479900 60479921 60479917 60479922 +
caccaaccgttttttgatttat

SEQ ID NO: 198154 - DNA, 22 bp, Artificial Sequence
  Synthetic oligonucleotide; TTT chr2 60479912 60479933 60479929 60479934 +
tttgatttatggggaggaggaa

SEQ ID NO: 198155 - DNA, 22 bp, Artificial Sequence
  Synthetic oligonucleotide; TTT chr2 60479913 60479934 60479930 60479935 +
ttgatttatggggaggaggaaa

SEQ ID NO: 198156 - DNA, 22 bp, Artificial Sequence
  Synthetic oligonucleotide; TTT chr2 60479914 60479935 60479931 60479936 +
tgatttatggggaggaggaaag

SEQ ID NO: 198157 - DNA, 22 bp, Artificial Sequence
  Synthetic oligonucleotide; TTT chr2 60479915 60479936 60479932 60479937 +
gatttatggggaggaggaaaga

SEQ ID NO: 198158 - DNA, 22 bp, Artificial Sequence
  Synthetic oligonucleotide; TTG chr2 60479916 60479937 60479933 60479938 +
atttatggggaggaggaaagaa

SEQ ID NO: 198159 - DNA, 22 bp, Artificial Sequence
  Synthetic oligonucleotide; TTT chr2 60479920 60479941 60479937 60479942 +
atggggaggaggaaagaaatct

SEQ ID NO: 198160 - DNA, 22 bp, Artificial Sequence
  Synthetic oligonucleotide; TTA chr2 60479921 60479942 60479938 60479943 +
tggggaggaggaaagaaatctg

SEQ ID NO: 198161 - DNA, 22 bp, Artificial Sequence
  Synthetic oligonucleotide; CTG chr2 60479943 60479964 60479960 60479965 +
aagttgacaggttgggacaact

SEQ ID NO: 198162 - DNA, 22 bp, Artificial Sequence
  Synthetic oligonucleotide; TTG chr2 60479949 60479970 60479966 60479971 +
acaggttgggacaactccactc

SEQ ID NO: 198163 - DNA, 22 bp, Artificial Sequence
  Synthetic oligonucleotide; TTG chr2 60479957 60479978 60479974 60479979 +
ggacaactccactcagctttct

SEQ ID NO: 198164 - DNA, 22 bp, Artificial Sequence
  Synthetic oligonucleotide; CTC chr2 60479966 60479987 60479983 60479988 +
cactcagctttctcactcaaaa

SEQ ID NO: 198165 - DNA, 22 bp, Artificial Sequence
  Synthetic oligonucleotide; CTC chr2 60479971 60479992 60479988 60479993 +
agctttctcactcaaaagctgc

SEQ ID NO: 198166 - DNA, 22 bp, Artificial Sequence
  Synthetic oligonucleotide; CTT chr2 60479976 60479997 60479993 60479998 +
tctcactcaaaagctgcttttg

SEQ ID NO: 198167 - DNA, 22 bp, Artificial Sequence
  Synthetic oligonucleotide; TTT chr2 60479977 60479998 60479994 60479999 +
ctcactcaaaagctgcttttgt

SEQ ID NO: 198168 - DNA, 22 bp, Artificial Sequence
  Synthetic oligonucleotide; TTC chr2 60479978 60479999 60479995 60480000 +
tcactcaaaagctgcttttgtt

SEQ ID NO: 198169 - DNA, 22 bp, Artificial Sequence
  Synthetic oligonucleotide; CTC chr2 60479980 60480001 60479997 60480002 +
actcaaaagctgcttttgttaa

SEQ ID NO: 198170 - DNA, 22 bp, Artificial Sequence
  Synthetic oligonucleotide; CTC chr2 60479984 60480005 60480001 60480006 +
aaaagctgcttttgttaaatca

SEQ ID NO: 198171 - DNA, 22 bp, Artificial Sequence
  Synthetic oligonucleotide; CTG chr2 60479992 60480013 60480009 60480014 +
cttttgttaaatcatactttgc

SEQ ID NO: 198172 - DNA, 22 bp, Artificial Sequence
  Synthetic oligonucleotide; CTT chr2 60479995 60480016 60480012 60480017 +
ttgttaaatcatactttgcatt

SEQ ID NO: 198173 - DNA, 22 bp, Artificial Sequence
  Synthetic oligonucleotide; TTT chr2 60479996 60480017 60480013 60480018 +
tgttaaatcatactttgcattt

SEQ ID NO: 198174 - DNA, 22 bp, Artificial Sequence
  Synthetic oligonucleotide; TTT chr2 60479997 60480018 60480014 60480019 +
gttaaatcatactttgcattta

SEQ ID NO: 198175 - DNA, 22 bp, Artificial Sequence
  Synthetic oligonucleotide; TTG chr2 60479998 60480019 60480015 60480020 +
ttaaatcatactttgcatttat

SEQ ID NO: 198176 - DNA, 22 bp, Artificial Sequence
  Synthetic oligonucleotide; TTA chr2 60480001 60480022 60480018 60480023 +
aatcatactttgcatttatggc

SEQ ID NO: 198177 - DNA, 22 bp, Artificial Sequence
  Synthetic oligonucleotide; CTT chr2 60480011 60480032 60480028 60480033 +
tgcatttatggcctgcggctct

SEQ ID NO: 198178 - DNA, 22 bp, Artificial Sequence
  Synthetic oligonucleotide; TTT chr2 60480012 60480033 60480029 60480034 +
gcatttatggcctgcggctctt

SEQ ID NO: 198179 - DNA, 22 bp, Artificial Sequence
  Synthetic oligonucleotide; TTG chr2 60480013 60480034 60480030 60480035 +
catttatggcctgcggctcttg

SEQ ID NO: 198180 - DNA, 22 bp, Artificial Sequence
  Synthetic oligonucleotide; TTT chr2 60480018 60480039 60480035 60480040 +
atggcctgcggctcttggctga

SEQ ID NO: 198181 - DNA, 22 bp, Artificial Sequence
  Synthetic oligonucleotide; TTA chr2 60480019 60480040 60480036 60480041 +
tggcctgcggctcttggctgac

SEQ ID NO: 198182 - DNA, 22 bp, Artificial Sequence
  Synthetic oligonucleotide; CTG chr2 60480026 60480047 60480043 60480048 +
cggctcttggctgactttggcg

SEQ ID NO: 198183 - DNA, 22 bp, Artificial Sequence
  Synthetic oligonucleotide; CTC chr2 60480032 60480053 60480049 60480054 +
ttggctgactttggcggctcct

SEQ ID NO: 198184 - DNA, 22 bp, Artificial Sequence
  Synthetic oligonucleotide; CTT chr2 60480034 60480055 60480051 60480056 +
ggctgactttggcggctcctcc

SEQ ID NO: 198185 - DNA, 22 bp, Artificial Sequence
  Synthetic oligonucleotide; TTG chr2 60480035 60480056 60480052 60480057 +
gctgactttggcggctcctccg

SEQ ID NO: 198186 - DNA, 22 bp, Artificial Sequence
  Synthetic oligonucleotide; CTG chr2 60480039 60480060 60480056 60480061 +
actttggcggctcctccggtgt

SEQ ID NO: 198187 - DNA, 22 bp, Artificial Sequence
  Synthetic oligonucleotide; CTT chr2 60480043 60480064 60480060 60480065 +
tggcggctcctccggtgtggag

SEQ ID NO: 198188 - DNA, 22 bp, Artificial Sequence
  Synthetic oligonucleotide; TTT chr2 60480044 60480065 60480061 60480066 +
ggcggctcctccggtgtggagc

SEQ ID NO: 198189 - DNA, 22 bp, Artificial Sequence
  Synthetic oligonucleotide; TTG chr2 60480045 60480066 60480062 60480067 +
gcggctcctccggtgtggagca

SEQ ID NO: 198190 - DNA, 22 bp, Artificial Sequence
  Synthetic oligonucleotide; CTC chr2 60480052 60480073 60480069 60480074 +
ctccggtgtggagcaagctgtg

SEQ ID NO: 198191 - DNA, 22 bp, Artificial Sequence
  Synthetic oligonucleotide; CTC chr2 60480055 60480076 60480072 60480077 +
cggtgtggagcaagctgtggac

SEQ ID NO: 198192 - DNA, 22 bp, Artificial Sequence
  Synthetic oligonucleotide; CTG chr2 60480072 60480093 60480089 60480094 +
tggacttccccgggaggaggcc

SEQ ID NO: 198193 - DNA, 22 bp, Artificial Sequence
  Synthetic oligonucleotide; CTT chr2 60480079 60480100 60480096 60480101 +
ccccgggaggaggccccactga

SEQ ID NO: 198194 - DNA, 22 bp, Artificial Sequence
  Synthetic oligonucleotide; TTC chr2 60480080 60480101 60480097 60480102 +
cccgggaggaggccccactgag

SEQ ID NO: 198195 - DNA, 22 bp, Artificial Sequence
  Synthetic oligonucleotide; CTG chr2 60480100 60480121 60480117 60480122 +
agatgactgccccactctgcac

SEQ ID NO: 198196 - DNA, 22 bp, Artificial Sequence
  Synthetic oligonucleotide; CTG chr2 60480109 60480130 60480126 60480131 +
ccccactctgcaccaaggacag

SEQ ID NO: 198197 - DNA, 22 bp, Artificial Sequence
  Synthetic oligonucleotide; CTC chr2 60480117 60480138 60480134 60480139 +
tgcaccaaggacagcgaggagg

SEQ ID NO: 198198 - DNA, 22 bp, Artificial Sequence
  Synthetic oligonucleotide; CTG chr2 60480119 60480140 60480136 60480141 +
caccaaggacagcgaggagggg

SEQ ID NO: 198199 - DNA, 22 bp, Artificial Sequence
  Synthetic oligonucleotide; CTG chr2 60480164 60480185 60480181 60480186 +
gaggccagggggctggggacat

SEQ ID NO: 198200 - DNA, 22 bp, Artificial Sequence
  Synthetic oligonucleotide; CTG chr2 60480179 60480200 60480196 60480201 +
gggacatgaaggcactggctag

SEQ ID NO: 198201 - DNA, 22 bp, Artificial Sequence
  Synthetic oligonucleotide; CTG chr2 60480196 60480217 60480213 60480218 +
gctaggtaacacaaaggcctgt

SEQ ID NO: 198202 - DNA, 22 bp, Artificial Sequence
  Synthetic oligonucleotide; CTA chr2 60480200 60480221 60480217 60480222 +
ggtaacacaaaggcctgtaaag

SEQ ID NO: 198203 - DNA, 22 bp, Artificial Sequence
  Synthetic oligonucleotide; CTG chr2 60480217 60480238 60480234 60480239 +
taaaggatatgtctctcttctg

SEQ ID NO: 198204 - DNA, 22 bp, Artificial Sequence
  Synthetic oligonucleotide; CTC chr2 60480232 60480253 60480249 60480254 +
tcttctgaacctggctctccac

SEQ ID NO: 198205 - DNA, 22 bp, Artificial Sequence
  Synthetic oligonucleotide; CTC chr2 60480234 60480255 60480251 60480256 +
ttctgaacctggctctccactc

SEQ ID NO: 198206 - DNA, 22 bp, Artificial Sequence
  Synthetic oligonucleotide; CTT chr2 60480236 60480257 60480253 60480258 +
ctgaacctggctctccactcca

SEQ ID NO: 198207 - DNA, 22 bp, Artificial Sequence
  Synthetic oligonucleotide; TTC chr2 60480237 60480258 60480254 60480259 +
tgaacctggctctccactccat

SEQ ID NO: 198208 - DNA, 22 bp, Artificial Sequence
  Synthetic oligonucleotide; CTG chr2 60480239 60480260 60480256 60480261 +
aacctggctctccactccattt

SEQ ID NO: 198209 - DNA, 22 bp, Artificial Sequence
  Synthetic oligonucleotide; CTG chr2 60480245 60480266 60480262 60480267 +
gctctccactccatttctcctg

SEQ ID NO: 198210 - DNA, 22 bp, Artificial Sequence
  Synthetic oligonucleotide; CTC chr2 60480249 60480270 60480266 60480271 +
tccactccatttctcctggatc

SEQ ID NO: 198211 - DNA, 22 bp, Artificial Sequence
  Synthetic oligonucleotide; CTC chr2 60480251 60480272 60480268 60480273 +
cactccatttctcctggatcca

SEQ ID NO: 198212 - DNA, 22 bp, Artificial Sequence
  Synthetic oligonucleotide; CTC chr2 60480256 60480277 60480273 60480278 +
catttctcctggatccaagtct

SEQ ID NO: 198213 - DNA, 22 bp, Artificial Sequence
  Synthetic oligonucleotide; TTT chr2 60480261 60480282 60480278 60480283 +
ctcctggatccaagtctccctg

SEQ ID NO: 198214 - DNA, 22 bp, Artificial Sequence
  Synthetic oligonucleotide; TTC chr2 60480262 60480283 60480279 60480284 +
tcctggatccaagtctccctgt

SEQ ID NO: 198215 - DNA, 22 bp, Artificial Sequence
  Synthetic oligonucleotide; CTC chr2 60480264 60480285 60480281 60480286 +
ctggatccaagtctccctgtaa

SEQ ID NO: 198216 - DNA, 22 bp, Artificial Sequence
  Synthetic oligonucleotide; CTG chr2 60480267 60480288 60480284 60480289 +
gatccaagtctccctgtaatca

SEQ ID NO: 198217 - DNA, 22 bp, Artificial Sequence
  Synthetic oligonucleotide; CTC chr2 60480279 60480300 60480296 60480301 +
cctgtaatcagcatgtatctac

SEQ ID NO: 198218 - DNA, 22 bp, Artificial Sequence
  Synthetic oligonucleotide; CTG chr2 60480283 60480304 60480300 60480305 +
taatcagcatgtatctaccact

SEQ ID NO: 198219 - DNA, 22 bp, Artificial Sequence
  Synthetic oligonucleotide; CTA chr2 60480300 60480321 60480317 60480322 +
ccactggttctccaactaaaag

SEQ ID NO: 198220 - DNA, 22 bp, Artificial Sequence
  Synthetic oligonucleotide; CTG chr2 60480306 60480327 60480323 60480328 +
gttctccaactaaaagttcaag

SEQ ID NO: 198221 - DNA, 22 bp, Artificial Sequence
  Synthetic oligonucleotide; TTC chr2 60480310 60480331 60480327 60480332 +
tccaactaaaagttcaaggctt

SEQ ID NO: 198222 - DNA, 22 bp, Artificial Sequence
  Synthetic oligonucleotide; CTC chr2 60480312 60480333 60480329 60480334 +
caactaaaagttcaaggcttct

SEQ ID NO: 198223 - DNA, 22 bp, Artificial Sequence
  Synthetic oligonucleotide; CTA chr2 60480318 60480339 60480335 60480340 +
aaagttcaaggcttctaagaac

SEQ ID NO: 198224 - DNA, 22 bp, Artificial Sequence
  Synthetic oligonucleotide; TTC chr2 60480325 60480346 60480342 60480347 +
aaggcttctaagaaccaagact

SEQ ID NO: 198225 - DNA, 22 bp, Artificial Sequence
  Synthetic oligonucleotide; CTT chr2 60480332 60480353 60480349 60480354 +
ctaagaaccaagactcagtggt

SEQ ID NO: 198226 - DNA, 22 bp, Artificial Sequence
  Synthetic oligonucleotide; TTC chr2 60480333 60480354 60480350 60480355 +
taagaaccaagactcagtggtc

SEQ ID NO: 198227 - DNA, 22 bp, Artificial Sequence
  Synthetic oligonucleotide; CTA chr2 60480335 60480356 60480352 60480357 +
agaaccaagactcagtggtcta

SEQ ID NO: 198228 - DNA, 22 bp, Artificial Sequence
  Synthetic oligonucleotide; CTC chr2 60480348 60480369 60480365 60480370 +
agtggtctacctctgactgtcc

SEQ ID NO: 198229 - DNA, 22 bp, Artificial Sequence
  Synthetic oligonucleotide; CTA chr2 60480357 60480378 60480374 60480379 +
cctctgactgtccagcaccatg

SEQ ID NO: 198230 - DNA, 22 bp, Artificial Sequence
  Synthetic oligonucleotide; CTC chr2 60480361 60480382 60480378 60480383 +
tgactgtccagcaccatgctgg

SEQ ID NO: 198231 - DNA, 22 bp, Artificial Sequence
  Synthetic oligonucleotide; CTG chr2 60480363 60480384 60480380 60480385 +
actgtccagcaccatgctgggc

SEQ ID NO: 198232 - DNA, 22 bp, Artificial Sequence
  Synthetic oligonucleotide; CTG chr2 60480367 60480388 60480384 60480389 +
tccagcaccatgctgggcaaag

SEQ ID NO: 198233 - DNA, 22 bp, Artificial Sequence
  Synthetic oligonucleotide; CTG chr2 60480382 60480403 60480399 60480404 +
ggcaaagaagagcccctcaata

SEQ ID NO: 198234 - DNA, 22 bp, Artificial Sequence
  Synthetic oligonucleotide; CTC chr2 60480400 60480421 60480417 60480422 +
aataaataattaggattcaagc

SEQ ID NO: 198235 - DNA, 22 bp, Artificial Sequence
  Synthetic oligonucleotide; TTA chr2 60480412 60480433 60480429 60480434 +
ggattcaagcgctgtgcagtga

SEQ ID NO: 198236 - DNA, 22 bp, Artificial Sequence
  Synthetic oligonucleotide; TTC chr2 60480418 60480439 60480435 60480440 +
aagcgctgtgcagtgaactttt

SEQ ID NO: 198237 - DNA, 22 bp, Artificial Sequence
  Synthetic oligonucleotide; CTG chr2 60480426 60480447 60480443 60480448 +
tgcagtgaacttttcttcctgt

SEQ ID NO: 198238 - DNA, 22 bp, Artificial Sequence
  Synthetic oligonucleotide; CTT chr2 60480438 60480459 60480455 60480460 +
ttcttcctgttggagagccatt

SEQ ID NO: 198239 - DNA, 22 bp, Artificial Sequence
  Synthetic oligonucleotide; TTT chr2 60480439 60480460 60480456 60480461 +
tcttcctgttggagagccattc

SEQ ID NO: 198240 - DNA, 22 bp, Artificial Sequence
  Synthetic oligonucleotide; TTT chr2 60480440 60480461 60480457 60480462 +
cttcctgttggagagccattct

SEQ ID NO: 198241 - DNA, 22 bp, Artificial Sequence
  Synthetic oligonucleotide; TTC chr2 60480441 60480462 60480458 60480463 +
ttcctgttggagagccattcta

SEQ ID NO: 198242 - DNA, 22 bp, Artificial Sequence
  Synthetic oligonucleotide; CTT chr2 60480443 60480464 60480460 60480465 +
cctgttggagagccattctaaa

SEQ ID NO: 198243 - DNA, 22 bp, Artificial Sequence
  Synthetic oligonucleotide; TTC chr2 60480444 60480465 60480461 60480466 +
ctgttggagagccattctaaat

SEQ ID NO: 198244 - DNA, 22 bp, Artificial Sequence
  Synthetic oligonucleotide; CTG chr2 60480447 60480468 60480464 60480469 +
ttggagagccattctaaatgac

SEQ ID NO: 198245 - DNA, 22 bp, Artificial Sequence
  Synthetic oligonucleotide; TTG chr2 60480450 60480471 60480467 60480472 +
gagagccattctaaatgacctg

SEQ ID NO: 198246 - DNA, 22 bp, Artificial Sequence
  Synthetic oligonucleotide; TTC chr2 60480461 60480482 60480478 60480483 +
taaatgacctggctggaaggac

SEQ ID NO: 198247 - DNA, 22 bp, Artificial Sequence
  Synthetic oligonucleotide; CTA chr2 60480463 60480484 60480480 60480485 +
aatgacctggctggaaggacca

SEQ ID NO: 198248 - DNA, 22 bp, Artificial Sequence
  Synthetic oligonucleotide; CTG chr2 60480472 60480493 60480489 60480494 +
gctggaaggaccaggccatgga

SEQ ID NO: 198249 - DNA, 22 bp, Artificial Sequence
  Synthetic oligonucleotide; CTG chr2 60480476 60480497 60480493 60480498 +
gaaggaccaggccatggagcca

SEQ ID NO: 198250 - DNA, 22 bp, Artificial Sequence
  Synthetic oligonucleotide; CTT chr2 60480519 60480540 60480536 60480541 +
ccctagtaaatgattcactaac

SEQ ID NO: 198251 - DNA, 22 bp, Artificial Sequence
  Synthetic oligonucleotide; TTC chr2 60480520 60480541 60480537 60480542 +
cctagtaaatgattcactaacc

SEQ ID NO: 198252 - DNA, 22 bp, Artificial Sequence
  Synthetic oligonucleotide; CTA chr2 60480524 60480545 60480541 60480546 +
gtaaatgattcactaaccaagg

SEQ ID NO: 198253 - DNA, 22 bp, Artificial Sequence
  Synthetic oligonucleotide; TTC chr2 60480535 60480556 60480552 60480557 +
actaaccaaggagcctctgggt

SEQ ID NO: 198254 - DNA, 22 bp, Artificial Sequence
  Synthetic oligonucleotide; CTA chr2 60480539 60480560 60480556 60480561 +
accaaggagcctctgggtcagc

SEQ ID NO: 198255 - DNA, 22 bp, Artificial Sequence
  Synthetic oligonucleotide; CTC chr2 60480552 60480573 60480569 60480574 +
tgggtcagccttgacccaggag

SEQ ID NO: 198256 - DNA, 22 bp, Artificial Sequence
  Synthetic oligonucleotide; CTG chr2 60480554 60480575 60480571 60480576 +
ggtcagccttgacccaggagag

SEQ ID NO: 198257 - DNA, 22 bp, Artificial Sequence
  Synthetic oligonucleotide; CTT chr2 60480564 60480585 60480581 60480586 +
gacccaggagaggattacagcc

SEQ ID NO: 198258 - DNA, 22 bp, Artificial Sequence
  Synthetic oligonucleotide; TTG chr2 60480565 60480586 60480582 60480587 +
acccaggagaggattacagccc

SEQ ID NO: 198259 - DNA, 22 bp, Artificial Sequence
  Synthetic oligonucleotide; TTA chr2 60480581 60480602 60480598 60480603 +
cagccccttgaaagtggctgct

SEQ ID NO: 198260 - DNA, 22 bp, Artificial Sequence
  Synthetic oligonucleotide; CTT chr2 60480590 60480611 60480607 60480612 +
gaaagtggctgctggtccatcg

SEQ ID NO: 198261 - DNA, 22 bp, Artificial Sequence
  Synthetic oligonucleotide; TTG chr2 60480591 60480612 60480608 60480613 +
aaagtggctgctggtccatcgc

SEQ ID NO: 198262 - DNA, 22 bp, Artificial Sequence
  Synthetic oligonucleotide; CTG chr2 60480601 60480622 60480618 60480623 +
ctggtccatcgcttcactgtac

SEQ ID NO: 198263 - DNA, 22 bp, Artificial Sequence
  Synthetic oligonucleotide; CTG chr2 60480604 60480625 60480621 60480626 +
gtccatcgcttcactgtactat

SEQ ID NO: 198264 - DNA, 22 bp, Artificial Sequence
  Synthetic oligonucleotide; CTT chr2 60480615 60480636 60480632 60480637 +
cactgtactattttggcaatct

SEQ ID NO: 198265 - DNA, 22 bp, Artificial Sequence
  Synthetic oligonucleotide; TTC chr2 60480616 60480637 60480633 60480638 +
actgtactattttggcaatctg

SEQ ID NO: 198266 - DNA, 22 bp, Artificial Sequence
  Synthetic oligonucleotide; CTG chr2 60480620 60480641 60480637 60480642 +
tactattttggcaatctgtaat

SEQ ID NO: 198267 - DNA, 22 bp, Artificial Sequence
  Synthetic oligonucleotide; CTA chr2 60480625 60480646 60480642 60480647 +
ttttggcaatctgtaatagtgt

SEQ ID NO: 198268 - DNA, 22 bp, Artificial Sequence
  Synthetic oligonucleotide; TTT chr2 60480628 60480649 60480645 60480650 +
tggcaatctgtaatagtgtatt

SEQ ID NO: 198269 - DNA, 22 bp, Artificial Sequence
  Synthetic oligonucleotide; TTT chr2 60480629 60480650 60480646 60480651 +
ggcaatctgtaatagtgtattt

SEQ ID NO: 198270 - DNA, 22 bp, Artificial Sequence
  Synthetic oligonucleotide; TTG chr2 60480630 60480651 60480647 60480652 +
gcaatctgtaatagtgtattta

SEQ ID NO: 198271 - DNA, 22 bp, Artificial Sequence
  Synthetic oligonucleotide; CTG chr2 60480638 60480659 60480655 60480660 +
taatagtgtatttactcaatgg

SEQ ID NO: 198272 - DNA, 22 bp, Artificial Sequence
  Synthetic oligonucleotide; TTT chr2 60480651 60480672 60480668 60480673 +
actcaatggttgttatggacaa

SEQ ID NO: 198273 - DNA, 22 bp, Artificial Sequence
  Synthetic oligonucleotide; TTA chr2 60480652 60480673 60480669 60480674 +
ctcaatggttgttatggacaat

SEQ ID NO: 198274 - DNA, 22 bp, Artificial Sequence
  Synthetic oligonucleotide; CTC chr2 60480655 60480676 60480672 60480677 +
aatggttgttatggacaatcag

SEQ ID NO: 198275 - DNA, 22 bp, Artificial Sequence
  Synthetic oligonucleotide; TTG chr2 60480663 60480684 60480680 60480685 +
ttatggacaatcaggttaatca

SEQ ID NO: 198276 - DNA, 22 bp, Artificial Sequence
  Synthetic oligonucleotide; TTA chr2 60480666 60480687 60480683 60480688 +
tggacaatcaggttaatcattc

SEQ ID NO: 198277 - DNA, 22 bp, Artificial Sequence
  Synthetic oligonucleotide; TTA chr2 60480681 60480702 60480698 60480703 +
atcattcactttccaaatgctg

SEQ ID NO: 198278 - DNA, 22 bp, Artificial Sequence
  Synthetic oligonucleotide; TTC chr2 60480688 60480709 60480705 60480710 +
actttccaaatgctgtgtaatt

SEQ ID NO: 198279 - DNA, 22 bp, Artificial Sequence
  Synthetic oligonucleotide; CTT chr2 60480692 60480713 60480709 60480714 +
tccaaatgctgtgtaattacac

SEQ ID NO: 198280 - DNA, 22 bp, Artificial Sequence
  Synthetic oligonucleotide; TTT chr2 60480693 60480714 60480710 60480715 +
ccaaatgctgtgtaattacaca

SEQ ID NO: 198281 - DNA, 22 bp, Artificial Sequence
  Synthetic oligonucleotide; TTC chr2 60480694 60480715 60480711 60480716 +
caaatgctgtgtaattacacag

SEQ ID NO: 198282 - DNA, 22 bp, Artificial Sequence
  Synthetic oligonucleotide; CTG chr2 60480703 60480724 60480720 60480725 +
tgtaattacacagttaaaagag

SEQ ID NO: 198283 - DNA, 22 bp, Artificial Sequence
  Synthetic oligonucleotide; TTA chr2 60480711 60480732 60480728 60480733 +
cacagttaaaagagctacagcg

SEQ ID NO: 198284 - DNA, 22 bp, Artificial Sequence
  Synthetic oligonucleotide; TTA chr2 60480719 60480740 60480736 60480741 +
aaagagctacagcggatgtcaa

SEQ ID NO: 198285 - DNA, 22 bp, Artificial Sequence
  Synthetic oligonucleotide; CTA chr2 60480728 60480749 60480745 60480750 +
cagcggatgtcaaatttcctta

SEQ ID NO: 198286 - DNA, 22 bp, Artificial Sequence
  Synthetic oligonucleotide; TTT chr2 60480745 60480766 60480762 60480767 +
ccttaagtcttctggtgaattg

SEQ ID NO: 198287 - DNA, 22 bp, Artificial Sequence
  Synthetic oligonucleotide; TTC chr2 60480746 60480767 60480763 60480768 +
cttaagtcttctggtgaattgg

SEQ ID NO: 198288 - DNA, 22 bp, Artificial Sequence
  Synthetic oligonucleotide; CTT chr2 60480749 60480770 60480766 60480771 +
aagtcttctggtgaattggtct

SEQ ID NO: 198289 - DNA, 22 bp, Artificial Sequence
  Synthetic oligonucleotide; TTA chr2 60480750 60480771 60480767 60480772 +
agtcttctggtgaattggtctc

SEQ ID NO: 198290 - DNA, 22 bp, Artificial Sequence
  Synthetic oligonucleotide; CTT chr2 60480756 60480777 60480773 60480778 +
ctggtgaattggtctcaattac

SEQ ID NO: 198291 - DNA, 22 bp, Artificial Sequence
  Synthetic oligonucleotide; TTC chr2 60480757 60480778 60480774 60480779 +
tggtgaattggtctcaattact

SEQ ID NO: 198292 - DNA, 22 bp, Artificial Sequence
  Synthetic oligonucleotide; CTG chr2 60480759 60480780 60480776 60480781 +
gtgaattggtctcaattactag

SEQ ID NO: 198293 - DNA, 22 bp, Artificial Sequence
  Synthetic oligonucleotide; TTG chr2 60480767 60480788 60480784 60480789 +
gtctcaattactagtctgggtc

SEQ ID NO: 198294 - DNA, 22 bp, Artificial Sequence
  Synthetic oligonucleotide; CTC chr2 60480772 60480793 60480789 60480794 +
aattactagtctgggtcccttt

SEQ ID NO: 198295 - DNA, 22 bp, Artificial Sequence
  Synthetic oligonucleotide; TTA chr2 60480777 60480798 60480794 60480799 +
ctagtctgggtccctttcttcc

SEQ ID NO: 198296 - DNA, 22 bp, Artificial Sequence
  Synthetic oligonucleotide; CTA chr2 60480780 60480801 60480797 60480802 +
gtctgggtccctttcttccttc

SEQ ID NO: 198297 - DNA, 22 bp, Artificial Sequence
  Synthetic oligonucleotide; CTG chr2 60480785 60480806 60480802 60480807 +
ggtccctttcttccttcctctc

SEQ ID NO: 198298 - DNA, 22 bp, Artificial Sequence
  Synthetic oligonucleotide; CTT chr2 60480793 60480814 60480810 60480815 +
tcttccttcctctctcaatttg

SEQ ID NO: 198299 - DNA, 22 bp, Artificial Sequence
  Synthetic oligonucleotide; TTT chr2 60480794 60480815 60480811 60480816 +
cttccttcctctctcaatttgt

SEQ ID NO: 198300 - DNA, 22 bp, Artificial Sequence
  Synthetic oligonucleotide; TTC chr2 60480795 60480816 60480812 60480817 +
ttccttcctctctcaatttgtt

SEQ ID NO: 198301 - DNA, 22 bp, Artificial Sequence
  Synthetic oligonucleotide; CTT chr2 60480797 60480818 60480814 60480819 +
ccttcctctctcaatttgtttt

SEQ ID NO: 198302 - DNA, 22 bp, Artificial Sequence
  Synthetic oligonucleotide; TTC chr2 60480798 60480819 60480815 60480820 +
cttcctctctcaatttgtttta

SEQ ID NO: 198303 - DNA, 22 bp, Artificial Sequence
  Synthetic oligonucleotide; CTT chr2 60480801 60480822 60480818 60480823 +
cctctctcaatttgttttagca

SEQ ID NO: 198304 - DNA, 22 bp, Artificial Sequence
  Synthetic oligonucleotide; TTC chr2 60480802 60480823 60480819 60480824 +
ctctctcaatttgttttagcaa

SEQ ID NO: 198305 - DNA, 22 bp, Artificial Sequence
  Synthetic oligonucleotide; CTC chr2 60480805 60480826 60480822 60480827 +
tctcaatttgttttagcaatcc

SEQ ID NO: 198306 - DNA, 22 bp, Artificial Sequence
  Synthetic oligonucleotide; CTC chr2 60480807 60480828 60480824 60480829 +
tcaatttgttttagcaatcctc

SEQ ID NO: 198307 - DNA, 22 bp, Artificial Sequence
  Synthetic oligonucleotide; CTC chr2 60480809 60480830 60480826 60480831 +
aatttgttttagcaatcctcca

SEQ ID NO: 198308 - DNA, 22 bp, Artificial Sequence
  Synthetic oligonucleotide; TTT chr2 60480814 60480835 60480831 60480836 +
gttttagcaatcctccacattt

SEQ ID NO: 198309 - DNA, 22 bp, Artificial Sequence
  Synthetic oligonucleotide; TTG chr2 60480815 60480836 60480832 60480837 +
ttttagcaatcctccacatttt

SEQ ID NO: 198310 - DNA, 22 bp, Artificial Sequence
  Synthetic oligonucleotide; TTT chr2 60480818 60480839 60480835 60480840 +
tagcaatcctccacattttcct

SEQ ID NO: 198311 - DNA, 22 bp, Artificial Sequence
  Synthetic oligonucleotide; TTT chr2 60480819 60480840 60480836 60480841 +
agcaatcctccacattttcctc

SEQ ID NO: 198312 - DNA, 22 bp, Artificial Sequence
  Synthetic oligonucleotide; TTA chr2 60480820 60480841 60480837 60480842 +
gcaatcctccacattttcctct

SEQ ID NO: 198313 - DNA, 22 bp, Artificial Sequence
  Synthetic oligonucleotide; CTC chr2 60480829 60480850 60480846 60480851 +
cacattttcctctattctcatc

SEQ ID NO: 198314 - DNA, 22 bp, Artificial Sequence
  Synthetic oligonucleotide; TTT chr2 60480836 60480857 60480853 60480858 +
tcctctattctcatcccctacc

SEQ ID NO: 198315 - DNA, 22 bp, Artificial Sequence
  Synthetic oligonucleotide; TTT chr2 60480837 60480858 60480854 60480859 +
cctctattctcatcccctacct

SEQ ID NO: 198316 - DNA, 22 bp, Artificial Sequence
  Synthetic oligonucleotide; TTC chr2 60480838 60480859 60480855 60480860 +
ctctattctcatcccctacctg

SEQ ID NO: 198317 - DNA, 22 bp, Artificial Sequence
  Synthetic oligonucleotide; CTC chr2 60480841 60480862 60480858 60480863 +
tattctcatcccctacctgcac

SEQ ID NO: 198318 - DNA, 22 bp, Artificial Sequence
  Synthetic oligonucleotide; CTA chr2 60480843 60480864 60480860 60480865 +
ttctcatcccctacctgcaccc

SEQ ID NO: 198319 - DNA, 22 bp, Artificial Sequence
  Synthetic oligonucleotide; TTC chr2 60480846 60480867 60480863 60480868 +
tcatcccctacctgcaccccca

SEQ ID NO: 198320 - DNA, 22 bp, Artificial Sequence
  Synthetic oligonucleotide; CTC chr2 60480848 60480869 60480865 60480870 +
atcccctacctgcacccccatc

SEQ ID NO: 198321 - DNA, 22 bp, Artificial Sequence
  Synthetic oligonucleotide; CTA chr2 60480856 60480877 60480873 60480878 +
cctgcacccccatctctgtccc

SEQ ID NO: 198322 - DNA, 22 bp, Artificial Sequence
  Synthetic oligonucleotide; CTG chr2 60480860 60480881 60480877 60480882 +
cacccccatctctgtcccaaga

SEQ ID NO: 198323 - DNA, 22 bp, Artificial Sequence
  Synthetic oligonucleotide; CTC chr2 60480872 60480893 60480889 60480894 +
tgtcccaagagaaagaacagtg

SEQ ID NO: 198324 - DNA, 22 bp, Artificial Sequence
  Synthetic oligonucleotide; CTG chr2 60480874 60480895 60480891 60480896 +
tcccaagagaaagaacagtgtg

SEQ ID NO: 198325 - DNA, 22 bp, Artificial Sequence
  Synthetic oligonucleotide; CTC chr2 60480905 60480926 60480922 60480927 +
cgcttgaataatcctatttttg

SEQ ID NO: 198326 - DNA, 22 bp, Artificial Sequence
  Synthetic oligonucleotide; CTT chr2 60480910 60480931 60480927 60480932 +
gaataatcctatttttgaactc

SEQ ID NO: 198327 - DNA, 22 bp, Artificial Sequence
  Synthetic oligonucleotide; TTG chr2 60480911 60480932 60480928 60480933 +
aataatcctatttttgaactca

SEQ ID NO: 198328 - DNA, 22 bp, Artificial Sequence
  Synthetic oligonucleotide; CTA chr2 60480921 60480942 60480938 60480943 +
tttttgaactcatagttctaaa

SEQ ID NO: 198329 - DNA, 22 bp, Artificial Sequence
  Synthetic oligonucleotide; TTT chr2 60480924 60480945 60480941 60480946 +
ttgaactcatagttctaaatag

SEQ ID NO: 198330 - DNA, 22 bp, Artificial Sequence
  Synthetic oligonucleotide; TTT chr2 60480925 60480946 60480942 60480947 +
tgaactcatagttctaaatagt

SEQ ID NO: 198331 - DNA, 22 bp, Artificial Sequence
  Synthetic oligonucleotide; TTT chr2 60480926 60480947 60480943 60480948 +
gaactcatagttctaaatagtt

SEQ ID NO: 198332 - DNA, 22 bp, Artificial Sequence
  Synthetic oligonucleotide; TTG chr2 60480927 60480948 60480944 60480949 +
aactcatagttctaaatagttt

SEQ ID NO: 198333 - DNA, 22 bp, Artificial Sequence
  Synthetic oligonucleotide; CTC chr2 60480932 60480953 60480949 60480954 +
atagttctaaatagtttttgct

SEQ ID NO: 198334 - DNA, 22 bp, Artificial Sequence
  Synthetic oligonucleotide; TTC chr2 60480939 60480960 60480956 60480961 +
taaatagtttttgctccactaa

SEQ ID NO: 198335 - DNA, 22 bp, Artificial Sequence
  Synthetic oligonucleotide; CTA chr2 60480941 60480962 60480958 60480963 +
aatagtttttgctccactaaaa

SEQ ID NO: 198336 - DNA, 22 bp, Artificial Sequence
  Synthetic oligonucleotide; TTT chr2 60480949 60480970 60480966 60480971 +
ttgctccactaaaagggcttaa

SEQ ID NO: 198337 - DNA, 22 bp, Artificial Sequence
  Synthetic oligonucleotide; TTT chr2 60480950 60480971 60480967 60480972 +
tgctccactaaaagggcttaaa

SEQ ID NO: 198338 - DNA, 22 bp, Artificial Sequence
  Synthetic oligonucleotide; TTT chr2 60480951 60480972 60480968 60480973 +
gctccactaaaagggcttaaaa

SEQ ID NO: 198339 - DNA, 22 bp, Artificial Sequence
  Synthetic oligonucleotide; TTG chr2 60480952 60480973 60480969 60480974 +
ctccactaaaagggcttaaaaa

SEQ ID NO: 198340 - DNA, 22 bp, Artificial Sequence
  Synthetic oligonucleotide; CTC chr2 60480955 60480976 60480972 60480977 +
cactaaaagggcttaaaaataa

SEQ ID NO: 198341 - DNA, 22 bp, Artificial Sequence
  Synthetic oligonucleotide; CTA chr2 60480960 60480981 60480977 60480982 +
aaagggcttaaaaataaggcta

SEQ ID NO: 198342 - DNA, 22 bp, Artificial Sequence
  Synthetic oligonucleotide; CTT chr2 60480969 60480990 60480986 60480991 +
aaaaataaggctaggaagctag

SEQ ID NO: 198343 - DNA, 22 bp, Artificial Sequence
  Synthetic oligonucleotide; TTA chr2 60480970 60480991 60480987 60480992 +
aaaataaggctaggaagctaga

SEQ ID NO: 198344 - DNA, 22 bp, Artificial Sequence
  Synthetic oligonucleotide; CTA chr2 60480982 60481003 60480999 60481004 +
ggaagctagacctgggaggggc

SEQ ID NO: 198345 - DNA, 22 bp, Artificial Sequence
  Synthetic oligonucleotide; CTA chr2 60480990 60481011 60481007 60481012 +
gacctgggaggggcattacagg

SEQ ID NO: 198346 - DNA, 22 bp, Artificial Sequence
  Synthetic oligonucleotide; CTG chr2 60480996 60481017 60481013 60481018 +
ggaggggcattacaggctggct

SEQ ID NO: 198347 - DNA, 22 bp, Artificial Sequence
  Synthetic oligonucleotide; TTA chr2 60481008 60481029 60481025 60481030 +
caggctggctggaagcccccag

SEQ ID NO: 198348 - DNA, 22 bp, Artificial Sequence
  Synthetic oligonucleotide; CTG chr2 60481015 60481036 60481032 60481037 +
gctggaagcccccagctgcctc

SEQ ID NO: 198349 - DNA, 22 bp, Artificial Sequence
  Synthetic oligonucleotide; CTG chr2 60481019 60481040 60481036 60481041 +
gaagcccccagctgcctccctg

SEQ ID NO: 198350 - DNA, 22 bp, Artificial Sequence
  Synthetic oligonucleotide; CTG chr2 60481033 60481054 60481050 60481055 +
cctccctgcctcagatgcaggg

SEQ ID NO: 198351 - DNA, 22 bp, Artificial Sequence
  Synthetic oligonucleotide; CTC chr2 60481037 60481058 60481054 60481059 +
cctgcctcagatgcagggagaa

SEQ ID NO: 198352 - DNA, 22 bp, Artificial Sequence
  Synthetic oligonucleotide; CTG chr2 60481041 60481062 60481058 60481063 +
cctcagatgcagggagaacacc

SEQ ID NO: 198353 - DNA, 22 bp, Artificial Sequence
  Synthetic oligonucleotide; CTC chr2 60481045 60481066 60481062 60481067 +
agatgcagggagaacacctgca

SEQ ID NO: 198354 - DNA, 22 bp, Artificial Sequence
  Synthetic oligonucleotide; CTG chr2 60481065 60481086 60481082 60481087 +
cagccacccacaccttgtcacc

SEQ ID NO: 198355 - DNA, 22 bp, Artificial Sequence
  Synthetic oligonucleotide; CTT chr2 60481081 60481102 60481098 60481103 +
gtcacccaagttgcactagatc

SEQ ID NO: 198356 - DNA, 22 bp, Artificial Sequence
  Synthetic oligonucleotide; TTG chr2 60481082 60481103 60481099 60481104 +
tcacccaagttgcactagatcc

SEQ ID NO: 198357 - DNA, 22 bp, Artificial Sequence
  Synthetic oligonucleotide; TTG chr2 60481094 60481115 60481111 60481116 +
cactagatcctggtacagccca

SEQ ID NO: 198358 - DNA, 22 bp, Artificial Sequence
  Synthetic oligonucleotide; CTA chr2 60481099 60481120 60481116 60481121 +
gatcctggtacagcccagtggt

SEQ ID NO: 198359 - DNA, 22 bp, Artificial Sequence
  Synthetic oligonucleotide; CTG chr2 60481106 60481127 60481123 60481128 +
gtacagcccagtggtggccgca

SEQ ID NO: 198360 - DNA, 22 bp, Artificial Sequence
  Synthetic oligonucleotide; CTC chr2 60481132 60481153 60481149 60481154 +
agggaagaaagaaggcaaagcc

SEQ ID NO: 198361 - DNA, 22 bp, Artificial Sequence
  Synthetic oligonucleotide; CTG chr2 60481157 60481178 60481174 60481179 +
ctgtgctcaaggagattgaggc

SEQ ID NO: 198362 - DNA, 22 bp, Artificial Sequence
  Synthetic oligonucleotide; CTG chr2 60481160 60481181 60481177 60481182 +
tgctcaaggagattgaggcttc

SEQ ID NO: 198363 - DNA, 22 bp, Artificial Sequence
  Synthetic oligonucleotide; CTC chr2 60481165 60481186 60481182 60481187 +
aaggagattgaggcttcccagc

SEQ ID NO: 198364 - DNA, 22 bp, Artificial Sequence
  Synthetic oligonucleotide; TTG chr2 60481175 60481196 60481192 60481197 +
aggcttcccagccccaaaactg

SEQ ID NO: 198365 - DNA, 22 bp, Artificial Sequence
  Synthetic oligonucleotide; CTT chr2 60481181 60481202 60481198 60481203 +
cccagccccaaaactgggaagg

SEQ ID NO: 198366 - DNA, 22 bp, Artificial Sequence
  Synthetic oligonucleotide; TTC chr2 60481182 60481203 60481199 60481204 +
ccagccccaaaactgggaaggg

SEQ ID NO: 198367 - DNA, 22 bp, Artificial Sequence
  Synthetic oligonucleotide; CTG chr2 60481197 60481218 60481214 60481219 +
ggaagggccctggaatgggata

SEQ ID NO: 198368 - DNA, 22 bp, Artificial Sequence
  Synthetic oligonucleotide; CTG chr2 60481209 60481230 60481226 60481231 +
gaatgggatatcccctcccctc

SEQ ID NO: 198369 - DNA, 22 bp, Artificial Sequence
  Synthetic oligonucleotide; CTC chr2 60481226 60481247 60481243 60481248 +
ccctcccagcaccccattccca

SEQ ID NO: 198370 - DNA, 22 bp, Artificial Sequence
  Synthetic oligonucleotide; CTC chr2 60481231 60481252 60481248 60481253 +
ccagcaccccattcccaaacct

SEQ ID NO: 198371 - DNA, 22 bp, Artificial Sequence
  Synthetic oligonucleotide; TTC chr2 60481245 60481266 60481262 60481267 +
ccaaacctagccacccatctct

SEQ ID NO: 198372 - DNA, 22 bp, Artificial Sequence
  Synthetic oligonucleotide; CTA chr2 60481254 60481275 60481271 60481276 +
gccacccatctctgcttgggac

SEQ ID NO: 198373 - DNA, 22 bp, Artificial Sequence
  Synthetic oligonucleotide; CTC chr2 60481266 60481287 60481283 60481288 +
tgcttgggacatgctggaaggc

SEQ ID NO: 198374 - DNA, 22 bp, Artificial Sequence
  Synthetic oligonucleotide; CTG chr2 60481268 60481289 60481285 60481290 +
cttgggacatgctggaaggcaa

SEQ ID NO: 198375 - DNA, 22 bp, Artificial Sequence
  Synthetic oligonucleotide; CTT chr2 60481271 60481292 60481288 60481293 +
gggacatgctggaaggcaagaa

SEQ ID NO: 198376 - DNA, 22 bp, Artificial Sequence
  Synthetic oligonucleotide; TTG chr2 60481272 60481293 60481289 60481294 +
ggacatgctggaaggcaagaag

SEQ ID NO: 198377 - DNA, 22 bp, Artificial Sequence
  Synthetic oligonucleotide; CTG chr2 60481282 60481303 60481299 60481304 +
gaaggcaagaagagagaaacaa

SEQ ID NO: 198378 - DNA, 22 bp, Artificial Sequence
  Synthetic oligonucleotide; CTC chr2 60481311 60481332 60481328 60481333 +
cttgaaaacaaaaatgaagcag

SEQ ID NO: 198379 - DNA, 22 bp, Artificial Sequence
  Synthetic oligonucleotide; CTT chr2 60481314 60481335 60481331 60481336 +
gaaaacaaaaatgaagcaggga

SEQ ID NO: 198380 - DNA, 22 bp, Artificial Sequence
  Synthetic oligonucleotide; TTG chr2 60481315 60481336 60481332 60481337 +
aaaacaaaaatgaagcagggat

SEQ ID NO: 198381 - DNA, 22 bp, Artificial Sequence
  Synthetic oligonucleotide; CTA chr2 60481341 60481362 60481358 60481363 +
ggaaaagtaaaaacattcagaa

SEQ ID NO: 198382 - DNA, 22 bp, Artificial Sequence
  Synthetic oligonucleotide; TTC chr2 60481359 60481380 60481376 60481381 +
agaacccagggccttctctctg

SEQ ID NO: 198383 - DNA, 22 bp, Artificial Sequence
  Synthetic oligonucleotide; CTT chr2 60481374 60481395 60481391 60481396 +
ctctctgtctcccacgacctac

SEQ ID NO: 198384 - DNA, 22 bp, Artificial Sequence
  Synthetic oligonucleotide; TTC chr2 60481375 60481396 60481392 60481397 +
tctctgtctcccacgacctaca

SEQ ID NO: 198385 - DNA, 22 bp, Artificial Sequence
  Synthetic oligonucleotide; CTC chr2 60481377 60481398 60481394 60481399 +
tctgtctcccacgacctacacc

SEQ ID NO: 198386 - DNA, 22 bp, Artificial Sequence
  Synthetic oligonucleotide; CTC chr2 60481379 60481400 60481396 60481401 +
tgtctcccacgacctacaccag

SEQ ID NO: 198387 - DNA, 22 bp, Artificial Sequence
  Synthetic oligonucleotide; CTG chr2 60481381 60481402 60481398 60481403 +
tctcccacgacctacaccaggc

SEQ ID NO: 198388 - DNA, 22 bp, Artificial Sequence
  Synthetic oligonucleotide; CTC chr2 60481385 60481406 60481402 60481407 +
ccacgacctacaccaggccctt

SEQ ID NO: 198389 - DNA, 22 bp, Artificial Sequence
  Synthetic oligonucleotide; CTA chr2 60481395 60481416 60481412 60481417 +
caccaggcccttcgcacctctg

SEQ ID NO: 198390 - DNA, 22 bp, Artificial Sequence
  Synthetic oligonucleotide; CTT chr2 60481407 60481428 60481424 60481429 +
cgcacctctgctttgcggcttt

SEQ ID NO: 198391 - DNA, 22 bp, Artificial Sequence
  Synthetic oligonucleotide; TTC chr2 60481408 60481429 60481425 60481430 +
gcacctctgctttgcggcttta

SEQ ID NO: 198392 - DNA, 22 bp, Artificial Sequence
  Synthetic oligonucleotide; CTC chr2 60481415 60481436 60481432 60481437 +
tgctttgcggctttaacgcact

SEQ ID NO: 198393 - DNA, 22 bp, Artificial Sequence
  Synthetic oligonucleotide; CTG chr2 60481417 60481438 60481434 60481439 +
ctttgcggctttaacgcactac

SEQ ID NO: 198394 - DNA, 22 bp, Artificial Sequence
  Synthetic oligonucleotide; CTT chr2 60481420 60481441 60481437 60481442 +
tgcggctttaacgcactacacc

SEQ ID NO: 198395 - DNA, 22 bp, Artificial Sequence
  Synthetic oligonucleotide; TTT chr2 60481421 60481442 60481438 60481443 +
gcggctttaacgcactacaccc

SEQ ID NO: 198396 - DNA, 22 bp, Artificial Sequence
  Synthetic oligonucleotide; TTG chr2 60481422 60481443 60481439 60481444 +
cggctttaacgcactacacccc

SEQ ID NO: 198397 - DNA, 22 bp, Artificial Sequence
  Synthetic oligonucleotide; CTT chr2 60481428 60481449 60481445 60481450 +
taacgcactacaccccacccac

SEQ ID NO: 198398 - DNA, 22 bp, Artificial Sequence
  Synthetic oligonucleotide; TTT chr2 60481429 60481450 60481446 60481451 +
aacgcactacaccccacccacc

SEQ ID NO: 198399 - DNA, 22 bp, Artificial Sequence
  Synthetic oligonucleotide; TTA chr2 60481430 60481451 60481447 60481452 +
acgcactacaccccacccacca

SEQ ID NO: 198400 - DNA, 22 bp, Artificial Sequence
  Synthetic oligonucleotide; CTA chr2 60481438 60481459 60481455 60481460 +
caccccacccaccacaagcaca

SEQ ID NO: 198401 - DNA, 22 bp, Artificial Sequence
  Synthetic oligonucleotide; CTC chr2 60481471 60481492 60481488 60481493 +
tcaggagtcagagggtcaccca

SEQ ID NO: 198402 - DNA, 22 bp, Artificial Sequence
  Synthetic oligonucleotide; CTC chr2 60481473 60481494 60481490 60481495 +
aggagtcagagggtcacccagg

SEQ ID NO: 198403 - DNA, 22 bp, Artificial Sequence
  Synthetic oligonucleotide; CTA chr2 60481499 60481520 60481516 60481521 +
gaacttaagccacccagcccac

SEQ ID NO: 198404 - DNA, 22 bp, Artificial Sequence
  Synthetic oligonucleotide; CTT chr2 60481505 60481526 60481522 60481527 +
aagccacccagcccacaagctg

SEQ ID NO: 198405 - DNA, 22 bp, Artificial Sequence
  Synthetic oligonucleotide; TTA chr2 60481506 60481527 60481523 60481528 +
agccacccagcccacaagctgg

SEQ ID NO: 198406 - DNA, 22 bp, Artificial Sequence
  Synthetic oligonucleotide; CTG chr2 60481527 60481548 60481544 60481549 +
gcaggtgaaggaggacagggat

SEQ ID NO: 198407 - DNA, 22 bp, Artificial Sequence
  Synthetic oligonucleotide; CTG chr2 60481565 60481586 60481582 60481587 +
tccacgctggcccctggctaag

SEQ ID NO: 198408 - DNA, 22 bp, Artificial Sequence
  Synthetic oligonucleotide; CTG chr2 60481574 60481595 60481591 60481596 +
gcccctggctaagagcaactgc

SEQ ID NO: 198409 - DNA, 22 bp, Artificial Sequence
  Synthetic oligonucleotide; CTG chr2 60481581 60481602 60481598 60481603 +
gctaagagcaactgcagcagaa

SEQ ID NO: 198410 - DNA, 22 bp, Artificial Sequence
  Synthetic oligonucleotide; CTA chr2 60481585 60481606 60481602 60481607 +
agagcaactgcagcagaaacag

SEQ ID NO: 198411 - DNA, 22 bp, Artificial Sequence
  Synthetic oligonucleotide; CTG chr2 60481595 60481616 60481612 60481617 +
cagcagaaacagtgtttcttct

SEQ ID NO: 198412 - DNA, 22 bp, Artificial Sequence
  Synthetic oligonucleotide; TTT chr2 60481612 60481633 60481629 60481634 +
cttctccatttccatggctcgt

SEQ ID NO: 198413 - DNA, 22 bp, Artificial Sequence
  Synthetic oligonucleotide; TTC chr2 60481613 60481634 60481630 60481635 +
ttctccatttccatggctcgtg

SEQ ID NO: 198414 - DNA, 22 bp, Artificial Sequence
  Synthetic oligonucleotide; CTT chr2 60481615 60481636 60481632 60481637 +
ctccatttccatggctcgtgaa

SEQ ID NO: 198415 - DNA, 22 bp, Artificial Sequence
  Synthetic oligonucleotide; TTC chr2 60481616 60481637 60481633 60481638 +
tccatttccatggctcgtgaat

SEQ ID NO: 198416 - DNA, 22 bp, Artificial Sequence
  Synthetic oligonucleotide; CTC chr2 60481618 60481639 60481635 60481640 +
catttccatggctcgtgaattt

SEQ ID NO: 198417 - DNA, 22 bp, Artificial Sequence
  Synthetic oligonucleotide; TTT chr2 60481623 60481644 60481640 60481645 +
ccatggctcgtgaatttttttg

SEQ ID NO: 198418 - DNA, 22 bp, Artificial Sequence
  Synthetic oligonucleotide; TTC chr2 60481624 60481645 60481641 60481646 +
catggctcgtgaatttttttgt

SEQ ID NO: 198419 - DNA, 22 bp, Artificial Sequence
  Synthetic oligonucleotide; CTC chr2 60481632 60481653 60481649 60481654 +
gtgaatttttttgtcttgtttt

SEQ ID NO: 198420 - DNA, 22 bp, Artificial Sequence
  Synthetic oligonucleotide; TTT chr2 60481640 60481661 60481657 60481662 +
ttttgtcttgtttttcttgacg

SEQ ID NO: 198421 - DNA, 22 bp, Artificial Sequence
  Synthetic oligonucleotide; TTT chr2 60481641 60481662 60481658 60481663 +
tttgtcttgtttttcttgacgc

SEQ ID NO: 198422 - DNA, 22 bp, Artificial Sequence
  Synthetic oligonucleotide; TTT chr2 60481642 60481663 60481659 60481664 +
ttgtcttgtttttcttgacgct

SEQ ID NO: 198423 - DNA, 22 bp, Artificial Sequence
  Synthetic oligonucleotide; TTT chr2 60481643 60481664 60481660 60481665 +
tgtcttgtttttcttgacgctc

SEQ ID NO: 198424 - DNA, 22 bp, Artificial Sequence
  Synthetic oligonucleotide; TTT chr2 60481644 60481665 60481661 60481666 +
gtcttgtttttcttgacgctcc

SEQ ID NO: 198425 - DNA, 22 bp, Artificial Sequence
  Synthetic oligonucleotide; TTG chr2 60481645 60481666 60481662 60481667 +
tcttgtttttcttgacgctcca

SEQ ID NO: 198426 - DNA, 22 bp, Artificial Sequence
  Synthetic oligonucleotide; CTT chr2 60481649 60481670 60481666 60481671 +
gtttttcttgacgctccacccc

SEQ ID NO: 198427 - DNA, 22 bp, Artificial Sequence
  Synthetic oligonucleotide; TTG chr2 60481650 60481671 60481667 60481672 +
tttttcttgacgctccaccccc

SEQ ID NO: 198428 - DNA, 22 bp, Artificial Sequence
  Synthetic oligonucleotide; TTT chr2 60481653 60481674 60481670 60481675 +
ttcttgacgctccaccccctac

SEQ ID NO: 198429 - DNA, 22 bp, Artificial Sequence
  Synthetic oligonucleotide; TTT chr2 60481654 60481675 60481671 60481676 +
tcttgacgctccaccccctaca

SEQ ID NO: 198430 - DNA, 22 bp, Artificial Sequence
  Synthetic oligonucleotide; TTT chr2 60481655 60481676 60481672 60481677 +
cttgacgctccaccccctacat

SEQ ID NO: 198431 - DNA, 22 bp, Artificial Sequence
  Synthetic oligonucleotide; TTC chr2 60481656 60481677 60481673 60481678 +
ttgacgctccaccccctacatc

SEQ ID NO: 198432 - DNA, 22 bp, Artificial Sequence
  Synthetic oligonucleotide; CTT chr2 60481658 60481679 60481675 60481680 +
gacgctccaccccctacatctt

SEQ ID NO: 198433 - DNA, 22 bp, Artificial Sequence
  Synthetic oligonucleotide; TTG chr2 60481659 60481680 60481676 60481681 +
acgctccaccccctacatcttt

SEQ ID NO: 198434 - DNA, 22 bp, Artificial Sequence
  Synthetic oligonucleotide; CTC chr2 60481665 60481686 60481682 60481687 +
caccccctacatctttcttttc

SEQ ID NO: 198435 - DNA, 22 bp, Artificial Sequence
  Synthetic oligonucleotide; CTA chr2 60481674 60481695 60481691 60481696 +
catctttcttttccccacatgc

SEQ ID NO: 198436 - DNA, 22 bp, Artificial Sequence
  Synthetic oligonucleotide; CTT chr2 60481680 60481701 60481697 60481702 +
tcttttccccacatgctccagc

SEQ ID NO: 198437 - DNA, 22 bp, Artificial Sequence
  Synthetic oligonucleotide; TTT chr2 60481681 60481702 60481698 60481703 +
cttttccccacatgctccagca

SEQ ID NO: 198438 - DNA, 22 bp, Artificial Sequence
  Synthetic oligonucleotide; TTC chr2 60481682 60481703 60481699 60481704 +
ttttccccacatgctccagcac

SEQ ID NO: 198439 - DNA, 22 bp, Artificial Sequence
  Synthetic oligonucleotide; CTT chr2 60481684 60481705 60481701 60481706 +
ttccccacatgctccagcacat

SEQ ID NO: 198440 - DNA, 22 bp, Artificial Sequence
  Synthetic oligonucleotide; TTT chr2 60481685 60481706 60481702 60481707 +
tccccacatgctccagcacata

SEQ ID NO: 198441 - DNA, 22 bp, Artificial Sequence
  Synthetic oligonucleotide; TTT chr2 60481686 60481707 60481703 60481708 +
ccccacatgctccagcacatac

SEQ ID NO: 198442 - DNA, 22 bp, Artificial Sequence
  Synthetic oligonucleotide; TTC chr2 60481687 60481708 60481704 60481709 +
cccacatgctccagcacataca

SEQ ID NO: 198443 - DNA, 22 bp, Artificial Sequence
  Synthetic oligonucleotide; CTC chr2 60481698 60481719 60481715 60481720 +
cagcacatacaactcagggctc

SEQ ID NO: 198444 - DNA, 22 bp, Artificial Sequence
  Synthetic oligonucleotide; CTC chr2 60481713 60481734 60481730 60481735 +
agggctccagtgttttaagggc

SEQ ID NO: 198445 - DNA, 22 bp, Artificial Sequence
  Synthetic oligonucleotide; CTC chr2 60481720 60481741 60481737 60481742 +
cagtgttttaagggcatttttt

SEQ ID NO: 198446 - DNA, 22 bp, Artificial Sequence
  Synthetic oligonucleotide; TTT chr2 60481728 60481749 60481745 60481750 +
taagggcattttttttccacaa

SEQ ID NO: 198447 - DNA, 22 bp, Artificial Sequence
  Synthetic oligonucleotide; TTT chr2 60481729 60481750 60481746 60481751 +
aagggcattttttttccacaag

SEQ ID NO: 198448 - DNA, 22 bp, Artificial Sequence
  Synthetic oligonucleotide; TTA chr2 60481730 60481751 60481747 60481752 +
agggcattttttttccacaagt

SEQ ID NO: 198449 - DNA, 22 bp, Artificial Sequence
  Synthetic oligonucleotide; TTT chr2 60481739 60481760 60481756 60481761 +
tttttccacaagtgagattaat

SEQ ID NO: 198450 - DNA, 22 bp, Artificial Sequence
  Synthetic oligonucleotide; TTT chr2 60481740 60481761 60481757 60481762 +
ttttccacaagtgagattaatt

SEQ ID NO: 198451 - DNA, 22 bp, Artificial Sequence
  Synthetic oligonucleotide; TTT chr2 60481741 60481762 60481758 60481763 +
tttccacaagtgagattaattt

SEQ ID NO: 198452 - DNA, 22 bp, Artificial Sequence
  Synthetic oligonucleotide; TTT chr2 60481742 60481763 60481759 60481764 +
ttccacaagtgagattaatttt

SEQ ID NO: 198453 - DNA, 22 bp, Artificial Sequence
  Synthetic oligonucleotide; TTT chr2 60481743 60481764 60481760 60481765 +
tccacaagtgagattaattttc

SEQ ID NO: 198454 - DNA, 22 bp, Artificial Sequence
  Synthetic oligonucleotide; TTT chr2 60481744 60481765 60481761 60481766 +
ccacaagtgagattaattttct

SEQ ID NO: 198455 - DNA, 22 bp, Artificial Sequence
  Synthetic oligonucleotide; TTC chr2 60481745 60481766 60481762 60481767 +
cacaagtgagattaattttcta

SEQ ID NO: 198456 - DNA, 22 bp, Artificial Sequence
  Synthetic oligonucleotide; TTA chr2 60481759 60481780 60481776 60481781 +
attttctaacagaaccctagta

SEQ ID NO: 198457 - DNA, 22 bp, Artificial Sequence
  Synthetic oligonucleotide; TTT chr2 60481763 60481784 60481780 60481785 +
tctaacagaaccctagtacatt

SEQ ID NO: 198458 - DNA, 22 bp, Artificial Sequence
  Synthetic oligonucleotide; TTT chr2 60481764 60481785 60481781 60481786 +
ctaacagaaccctagtacattc

SEQ ID NO: 198459 - DNA, 22 bp, Artificial Sequence
  Synthetic oligonucleotide; TTC chr2 60481765 60481786 60481782 60481787 +
taacagaaccctagtacattct

SEQ ID NO: 198460 - DNA, 22 bp, Artificial Sequence
  Synthetic oligonucleotide; CTA chr2 60481767 60481788 60481784 60481789 +
acagaaccctagtacattctgt

SEQ ID NO: 198461 - DNA, 22 bp, Artificial Sequence
  Synthetic oligonucleotide; CTA chr2 60481778 60481799 60481795 60481800 +
gtacattctgtgtgatggtggg

SEQ ID NO: 198462 - DNA, 22 bp, Artificial Sequence
  Synthetic oligonucleotide; TTC chr2 60481786 60481807 60481803 60481808 +
tgtgtgatggtgggagagcctt

SEQ ID NO: 198463 - DNA, 22 bp, Artificial Sequence
  Synthetic oligonucleotide; CTG chr2 60481788 60481809 60481805 60481810 +
tgtgatggtgggagagcctttt

SEQ ID NO: 198464 - DNA, 22 bp, Artificial Sequence
  Synthetic oligonucleotide; CTT chr2 60481808 60481829 60481825 60481830 +
ttgaccatcacagtgtcctgga

SEQ ID NO: 198465 - DNA, 22 bp, Artificial Sequence
  Synthetic oligonucleotide; TTT chr2 60481809 60481830 60481826 60481831 +
tgaccatcacagtgtcctggaa

SEQ ID NO: 198466 - DNA, 22 bp, Artificial Sequence
  Synthetic oligonucleotide; TTT chr2 60481810 60481831 60481827 60481832 +
gaccatcacagtgtcctggaat

SEQ ID NO: 198467 - DNA, 22 bp, Artificial Sequence
  Synthetic oligonucleotide; TTG chr2 60481811 60481832 60481828 60481833 +
accatcacagtgtcctggaatg

SEQ ID NO: 198468 - DNA, 22 bp, Artificial Sequence
  Synthetic oligonucleotide; CTG chr2 60481828 60481849 60481845 60481850 +
gaatgagctcagcatgctctct

SEQ ID NO: 198469 - DNA, 22 bp, Artificial Sequence
  Synthetic oligonucleotide; CTC chr2 60481838 60481859 60481855 60481860 +
agcatgctctctgggaagtgaa

SEQ ID NO: 198470 - DNA, 22 bp, Artificial Sequence
  Synthetic oligonucleotide; CTC chr2 60481847 60481868 60481864 60481869 +
tctgggaagtgaattgggaaag

SEQ ID NO: 198471 - DNA, 22 bp, Artificial Sequence
  Synthetic oligonucleotide; CTC chr2 60481849 60481870 60481866 60481871 +
tgggaagtgaattgggaaagtg

SEQ ID NO: 198472 - DNA, 22 bp, Artificial Sequence
  Synthetic oligonucleotide; CTG chr2 60481851 60481872 60481868 60481873 +
ggaagtgaattgggaaagtgaa

SEQ ID NO: 198473 - DNA, 22 bp, Artificial Sequence
  Synthetic oligonucleotide; TTG chr2 60481863 60481884 60481880 60481885 +
ggaaagtgaatggggaaaagcc

SEQ ID NO: 198474 - DNA, 22 bp, Artificial Sequence
  Synthetic oligonucleotide; CTC chr2 60481887 60481908 60481904 60481909 +
aacacacagacagccccatgga

SEQ ID NO: 198475 - DNA, 22 bp, Artificial Sequence
  Synthetic oligonucleotide; TTC chr2 60481915 60481936 60481932 60481937 +
tccagctcaggaaacccaccta

SEQ ID NO: 198476 - DNA, 22 bp, Artificial Sequence
  Synthetic oligonucleotide; CTC chr2 60481917 60481938 60481934 60481939 +
cagctcaggaaacccacctagg

SEQ ID NO: 198477 - DNA, 22 bp, Artificial Sequence
  Synthetic oligonucleotide; CTC chr2 60481923 60481944 60481940 60481945 +
aggaaacccacctaggtataga

SEQ ID NO: 198478 - DNA, 22 bp, Artificial Sequence
  Synthetic oligonucleotide; CTA chr2 60481937 60481958 60481954 60481959 +
ggtatagagaccttctccggaa

SEQ ID NO: 198479 - DNA, 22 bp, Artificial Sequence
  Synthetic oligonucleotide; CTT chr2 60481951 60481972 60481968 60481973 +
ctccggaacctctggtctgttc

SEQ ID NO: 198480 - DNA, 22 bp, Artificial Sequence
  Synthetic oligonucleotide; TTC chr2 60481952 60481973 60481969 60481974 +
tccggaacctctggtctgttct

SEQ ID NO: 198481 - DNA, 22 bp, Artificial Sequence
  Synthetic oligonucleotide; CTC chr2 60481954 60481975 60481971 60481976 +
cggaacctctggtctgttctag

SEQ ID NO: 198482 - DNA, 22 bp, Artificial Sequence
  Synthetic oligonucleotide; CTC chr2 60481963 60481984 60481980 60481985 +
tggtctgttctagtcctgctgt

SEQ ID NO: 198483 - DNA, 22 bp, Artificial Sequence
  Synthetic oligonucleotide; CTG chr2 60481965 60481986 60481982 60481987 +
gtctgttctagtcctgctgtca

SEQ ID NO: 198484 - DNA, 22 bp, Artificial Sequence
  Synthetic oligonucleotide; CTG chr2 60481970 60481991 60481987 60481992 +
ttctagtcctgctgtcaaaaga

SEQ ID NO: 198485 - DNA, 22 bp, Artificial Sequence
  Synthetic oligonucleotide; TTC chr2 60481973 60481994 60481990 60481995 +
tagtcctgctgtcaaaagaaag

SEQ ID NO: 198486 - DNA, 22 bp, Artificial Sequence
  Synthetic oligonucleotide; CTA chr2 60481975 60481996 60481992 60481997 +
gtcctgctgtcaaaagaaaggg

SEQ ID NO: 198487 - DNA, 22 bp, Artificial Sequence
  Synthetic oligonucleotide; CTG chr2 60481981 60482002 60481998 60482003 +
ctgtcaaaagaaaggggttgga

SEQ ID NO: 198488 - DNA, 22 bp, Artificial Sequence
  Synthetic oligonucleotide; CTG chr2 60481984 60482005 60482001 60482006 +
tcaaaagaaaggggttggactg

SEQ ID NO: 198489 - DNA, 22 bp, Artificial Sequence
  Synthetic oligonucleotide; TTG chr2 60482001 60482022 60482018 60482023 +
gactgatgtttcccagtggagg

SEQ ID NO: 198490 - DNA, 22 bp, Artificial Sequence
  Synthetic oligonucleotide; CTG chr2 60482006 60482027 60482023 60482028 +
atgtttcccagtggagggcttg

SEQ ID NO: 198491 - DNA, 22 bp, Artificial Sequence
  Synthetic oligonucleotide; TTT chr2 60482012 60482033 60482029 60482034 +
cccagtggagggcttgtttgtc

SEQ ID NO: 198492 - DNA, 22 bp, Artificial Sequence
  Synthetic oligonucleotide; TTC chr2 60482013 60482034 60482030 60482035 +
ccagtggagggcttgtttgtca

SEQ ID NO: 198493 - DNA, 22 bp, Artificial Sequence
  Synthetic oligonucleotide; CTT chr2 60482027 60482048 60482044 60482049 +
gtttgtcatttttggacctaac

SEQ ID NO: 198494 - DNA, 22 bp, Artificial Sequence
  Synthetic oligonucleotide; TTG chr2 60482028 60482049 60482045 60482050 +
tttgtcatttttggacctaaca

SEQ ID NO: 198495 - DNA, 22 bp, Artificial Sequence
  Synthetic oligonucleotide; TTT chr2 60482031 60482052 60482048 60482053 +
gtcatttttggacctaacatcc

SEQ ID NO: 198496 - DNA, 22 bp, Artificial Sequence
  Synthetic oligonucleotide; TTG chr2 60482032 60482053 60482049 60482054 +
tcatttttggacctaacatcca

SEQ ID NO: 198497 - DNA, 22 bp, Artificial Sequence
  Synthetic oligonucleotide; TTT chr2 60482038 60482059 60482055 60482060 +
ttggacctaacatccagttcat

SEQ ID NO: 198498 - DNA, 22 bp, Artificial Sequence
  Synthetic oligonucleotide; TTT chr2 60482039 60482060 60482056 60482061 +
tggacctaacatccagttcatc

SEQ ID NO: 198499 - DNA, 22 bp, Artificial Sequence
  Synthetic oligonucleotide; TTT chr2 60482040 60482061 60482057 60482062 +
ggacctaacatccagttcatca

SEQ ID NO: 198500 - DNA, 22 bp, Artificial Sequence
  Synthetic oligonucleotide; TTG chr2 60482041 60482062 60482058 60482063 +
gacctaacatccagttcatcaa

SEQ ID NO: 198501 - DNA, 22 bp, Artificial Sequence
  Synthetic oligonucleotide; CTA chr2 60482047 60482068 60482064 60482069 +
acatccagttcatcaaggtcac

SEQ ID NO: 198502 - DNA, 22 bp, Artificial Sequence
  Synthetic oligonucleotide; TTC chr2 60482058 60482079 60482075 60482080 +
atcaaggtcacttctgactccc

SEQ ID NO: 198503 - DNA, 22 bp, Artificial Sequence
  Synthetic oligonucleotide; CTT chr2 60482071 60482092 60482088 60482093 +
ctgactcccaggaagagaggca

SEQ ID NO: 198504 - DNA, 22 bp, Artificial Sequence
  Synthetic oligonucleotide; TTC chr2 60482072 60482093 60482089 60482094 +
tgactcccaggaagagaggcag

SEQ ID NO: 198505 - DNA, 22 bp, Artificial Sequence
  Synthetic oligonucleotide; CTG chr2 60482074 60482095 60482091 60482096 +
actcccaggaagagaggcagac

SEQ ID NO: 198506 - DNA, 22 bp, Artificial Sequence
  Synthetic oligonucleotide; CTC chr2 60482078 60482099 60482095 60482100 +
ccaggaagagaggcagacctgt

SEQ ID NO: 198507 - DNA, 22 bp, Artificial Sequence
  Synthetic oligonucleotide; CTG chr2 60482099 60482120 60482116 60482121 +
ttaaggggcgggtggtttgagc

SEQ ID NO: 198508 - DNA, 22 bp, Artificial Sequence
  Synthetic oligonucleotide; TTA chr2 60482102 60482123 60482119 60482124 +
aggggcgggtggtttgagccac

SEQ ID NO: 198509 - DNA, 22 bp, Artificial Sequence
  Synthetic oligonucleotide; TTT chr2 60482117 60482138 60482134 60482139 +
gagccacttaggacattttgga

SEQ ID NO: 198510 - DNA, 22 bp, Artificial Sequence
  Synthetic oligonucleotide; TTG chr2 60482118 60482139 60482135 60482140 +
agccacttaggacattttggac

SEQ ID NO: 198511 - DNA, 22 bp, Artificial Sequence
  Synthetic oligonucleotide; CTT chr2 60482126 60482147 60482143 60482148 +
aggacattttggacattttgca

SEQ ID NO: 198512 - DNA, 22 bp, Artificial Sequence
  Synthetic oligonucleotide; TTA chr2 60482127 60482148 60482144 60482149 +
ggacattttggacattttgcat

SEQ ID NO: 198513 - DNA, 22 bp, Artificial Sequence
  Synthetic oligonucleotide; TTT chr2 60482135 60482156 60482152 60482157 +
tggacattttgcatctctcatg

SEQ ID NO: 198514 - DNA, 22 bp, Artificial Sequence
  Synthetic oligonucleotide; TTT chr2 60482136 60482157 60482153 60482158 +
ggacattttgcatctctcatga

SEQ ID NO: 198515 - DNA, 22 bp, Artificial Sequence
  Synthetic oligonucleotide; TTG chr2 60482137 60482158 60482154 60482159 +
gacattttgcatctctcatgat

SEQ ID NO: 198516 - DNA, 22 bp, Artificial Sequence
  Synthetic oligonucleotide; TTT chr2 60482144 60482165 60482161 60482166 +
tgcatctctcatgattctatct

SEQ ID NO: 198517 - DNA, 22 bp, Artificial Sequence
  Synthetic oligonucleotide; TTT chr2 60482145 60482166 60482162 60482167 +
gcatctctcatgattctatctt

SEQ ID NO: 198518 - DNA, 22 bp, Artificial Sequence
  Synthetic oligonucleotide; TTG chr2 60482146 60482167 60482163 60482168 +
catctctcatgattctatcttg

SEQ ID NO: 198519 - DNA, 22 bp, Artificial Sequence
  Synthetic oligonucleotide; CTC chr2 60482152 60482173 60482169 60482174 +
tcatgattctatcttgagagtt

SEQ ID NO: 198520 - DNA, 22 bp, Artificial Sequence
  Synthetic oligonucleotide; CTC chr2 60482154 60482175 60482171 60482176 +
atgattctatcttgagagttta

SEQ ID NO: 198521 - DNA, 22 bp, Artificial Sequence
  Synthetic oligonucleotide; TTC chr2 60482161 60482182 60482178 60482183 +
tatcttgagagtttagtttggt

SEQ ID NO: 198522 - DNA, 22 bp, Artificial Sequence
  Synthetic oligonucleotide; CTA chr2 60482163 60482184 60482180 60482185 +
tcttgagagtttagtttggttg

SEQ ID NO: 198523 - DNA, 22 bp, Artificial Sequence
  Synthetic oligonucleotide; CTT chr2 60482167 60482188 60482184 60482189 +
gagagtttagtttggttggagt

SEQ ID NO: 198524 - DNA, 22 bp, Artificial Sequence
  Synthetic oligonucleotide; TTG chr2 60482168 60482189 60482185 60482190 +
agagtttagtttggttggagtt

SEQ ID NO: 198525 - DNA, 22 bp, Artificial Sequence
  Synthetic oligonucleotide; TTT chr2 60482175 60482196 60482192 60482197 +
agtttggttggagtttagtttt

SEQ ID NO: 198526 - DNA, 22 bp, Artificial Sequence
  Synthetic oligonucleotide; TTA chr2 60482176 60482197 60482193 60482198 +
gtttggttggagtttagttttt

SEQ ID NO: 198527 - DNA, 22 bp, Artificial Sequence
  Synthetic oligonucleotide; TTT chr2 60482180 60482201 60482197 60482202 +
ggttggagtttagtttttgagt

SEQ ID NO: 198528 - DNA, 22 bp, Artificial Sequence
  Synthetic oligonucleotide; TTG chr2 60482181 60482202 60482198 60482203 +
gttggagtttagtttttgagtt

SEQ ID NO: 198529 - DNA, 22 bp, Artificial Sequence
  Synthetic oligonucleotide; TTG chr2 60482185 60482206 60482202 60482207 +
gagtttagtttttgagtttttt

SEQ ID NO: 198530 - DNA, 22 bp, Artificial Sequence
  Synthetic oligonucleotide; TTT chr2 60482191 60482212 60482208 60482213 +
agtttttgagttttttgttcgg

SEQ ID NO: 198531 - DNA, 22 bp, Artificial Sequence
  Synthetic oligonucleotide; TTA chr2 60482192 60482213 60482209 60482214 +
gtttttgagttttttgttcggg

SEQ ID NO: 198532 - DNA, 22 bp, Artificial Sequence
  Synthetic oligonucleotide; TTT chr2 60482196 60482217 60482213 60482218 +
ttgagttttttgttcgggttgt

SEQ ID NO: 198533 - DNA, 22 bp, Artificial Sequence
  Synthetic oligonucleotide; TTT chr2 60482197 60482218 60482214 60482219 +
tgagttttttgttcgggttgtg

SEQ ID NO: 198534 - DNA, 22 bp, Artificial Sequence
  Synthetic oligonucleotide; TTT chr2 60482198 60482219 60482215 60482220 +
gagttttttgttcgggttgtgg

SEQ ID NO: 198535 - DNA, 22 bp, Artificial Sequence
  Synthetic oligonucleotide; TTG chr2 60482199 60482220 60482216 60482221 +
agttttttgttcgggttgtggt

SEQ ID NO: 198536 - DNA, 22 bp, Artificial Sequence
  Synthetic oligonucleotide; TTT chr2 60482204 60482225 60482221 60482226 +
tttgttcgggttgtggtttctc

SEQ ID NO: 198537 - DNA, 22 bp, Artificial Sequence
  Synthetic oligonucleotide; TTT chr2 60482205 60482226 60482222 60482227 +
ttgttcgggttgtggtttctct

SEQ ID NO: 198538 - DNA, 22 bp, Artificial Sequence
  Synthetic oligonucleotide; TTT chr2 60482206 60482227 60482223 60482228 +
tgttcgggttgtggtttctctt

SEQ ID NO: 198539 - DNA, 22 bp, Artificial Sequence
  Synthetic oligonucleotide; TTT chr2 60482207 60482228 60482224 60482229 +
gttcgggttgtggtttctcttc

SEQ ID NO: 198540 - DNA, 22 bp, Artificial Sequence
  Synthetic oligonucleotide; TTG chr2 60482208 60482229 60482225 60482230 +
ttcgggttgtggtttctcttcc

SEQ ID NO: 198541 - DNA, 22 bp, Artificial Sequence
  Synthetic oligonucleotide; TTC chr2 60482211 60482232 60482228 60482233 +
gggttgtggtttctcttcctcc

SEQ ID NO: 198542 - DNA, 22 bp, Artificial Sequence
  Synthetic oligonucleotide; TTG chr2 60482217 60482238 60482234 60482239 +
tggtttctcttcctccattaaa

SEQ ID NO: 198543 - DNA, 22 bp, Artificial Sequence
  Synthetic oligonucleotide; TTT chr2 60482223 60482244 60482240 60482245 +
ctcttcctccattaaaaaaaaa

SEQ ID NO: 198544 - DNA, 22 bp, Artificial Sequence
  Synthetic oligonucleotide; TTC chr2 60482224 60482245 60482241 60482246 +
tcttcctccattaaaaaaaaaa

SEQ ID NO: 198545 - DNA, 22 bp, Artificial Sequence
  Synthetic oligonucleotide; CTC chr2 60482226 60482247 60482243 60482248 +
ttcctccattaaaaaaaaaaat

SEQ ID NO: 198546 - DNA, 22 bp, Artificial Sequence
  Synthetic oligonucleotide; CTT chr2 60482228 60482249 60482245 60482250 +
cctccattaaaaaaaaaaattg

SEQ ID NO: 198547 - DNA, 22 bp, Artificial Sequence
  Synthetic oligonucleotide; TTC chr2 60482229 60482250 60482246 60482251 +
ctccattaaaaaaaaaaattgg

SEQ ID NO: 198548 - DNA, 22 bp, Artificial Sequence
  Synthetic oligonucleotide; CTC chr2 60482232 60482253 60482249 60482254 +
cattaaaaaaaaaaattggagc

SEQ ID NO: 198549 - DNA, 22 bp, Artificial Sequence
  Synthetic oligonucleotide; TTA chr2 60482237 60482258 60482254 60482259 +
aaaaaaaaaattggagctgtat

SEQ ID NO: 198550 - DNA, 22 bp, Artificial Sequence
  Synthetic oligonucleotide; TTG chr2 60482250 60482271 60482267 60482272 +
gagctgtatttctgtttcctgt

SEQ ID NO: 198551 - DNA, 22 bp, Artificial Sequence
  Synthetic oligonucleotide; CTG chr2 60482256 60482277 60482273 60482278 +
tatttctgtttcctgttcacgg

SEQ ID NO: 198552 - DNA, 22 bp, Artificial Sequence
  Synthetic oligonucleotide; TTT chr2 60482261 60482282 60482278 60482283 +
ctgtttcctgttcacggagcgg

SEQ ID NO: 198553 - DNA, 22 bp, Artificial Sequence
  Synthetic oligonucleotide; TTC chr2 60482262 60482283 60482279 60482284 +
tgtttcctgttcacggagcgga

SEQ ID NO: 198554 - DNA, 22 bp, Artificial Sequence
  Synthetic oligonucleotide; CTG chr2 60482264 60482285 60482281 60482286 +
tttcctgttcacggagcggaca

SEQ ID NO: 198555 - DNA, 22 bp, Artificial Sequence
  Synthetic oligonucleotide; TTT chr2 60482267 60482288 60482284 60482289 +
cctgttcacggagcggacagaa

SEQ ID NO: 198556 - DNA, 22 bp, Artificial Sequence
  Synthetic oligonucleotide; TTC chr2 60482268 60482289 60482285 60482290 +
ctgttcacggagcggacagaag

SEQ ID NO: 198557 - DNA, 22 bp, Artificial Sequence
  Synthetic oligonucleotide; CTG chr2 60482271 60482292 60482288 60482293 +
ttcacggagcggacagaaggag

SEQ ID NO: 198558 - DNA, 22 bp, Artificial Sequence
  Synthetic oligonucleotide; TTC chr2 60482274 60482295 60482291 60482296 +
acggagcggacagaaggagggt

SEQ ID NO: 198559 - DNA, 22 bp, Artificial Sequence
  Synthetic oligonucleotide; CTG chr2 60482329 60482350 60482346 60482351 +
atacatggagcagagccgagaa

SEQ ID NO: 198560 - DNA, 22 bp, Artificial Sequence
  Synthetic oligonucleotide; CTG chr2 60482363 60482384 60482380 60482385 +
gagaaaagtgagaaatggagct

SEQ ID NO: 198561 - DNA, 22 bp, Artificial Sequence
  Synthetic oligonucleotide; CTT chr2 60482386 60482407 60482403 60482408 +
ttttcttggcttccaaacagtt

SEQ ID NO: 198562 - DNA, 22 bp, Artificial Sequence
  Synthetic oligonucleotide; TTT chr2 60482387 60482408 60482404 60482409 +
tttcttggcttccaaacagttg

SEQ ID NO: 198563 - DNA, 22 bp, Artificial Sequence
  Synthetic oligonucleotide; TTT chr2 60482388 60482409 60482405 60482410 +
ttcttggcttccaaacagttgt

SEQ ID NO: 198564 - DNA, 22 bp, Artificial Sequence
  Synthetic oligonucleotide; TTT chr2 60482389 60482410 60482406 60482411 +
tcttggcttccaaacagttgta

SEQ ID NO: 198565 - DNA, 22 bp, Artificial Sequence
  Synthetic oligonucleotide; TTT chr2 60482390 60482411 60482407 60482412 +
cttggcttccaaacagttgtaa

SEQ ID NO: 198566 - DNA, 22 bp, Artificial Sequence
  Synthetic oligonucleotide; TTC chr2 60482391 60482412 60482408 60482413 +
ttggcttccaaacagttgtaat

SEQ ID NO: 198567 - DNA, 22 bp, Artificial Sequence
  Synthetic oligonucleotide; CTT chr2 60482393 60482414 60482410 60482415 +
ggcttccaaacagttgtaattt

SEQ ID NO: 198568 - DNA, 22 bp, Artificial Sequence
  Synthetic oligonucleotide; TTG chr2 60482394 60482415 60482411 60482416 +
gcttccaaacagttgtaatttc

SEQ ID NO: 198569 - DNA, 22 bp, Artificial Sequence
  Synthetic oligonucleotide; CTT chr2 60482398 60482419 60482415 60482420 +
ccaaacagttgtaatttccact

SEQ ID NO: 198570 - DNA, 22 bp, Artificial Sequence
  Synthetic oligonucleotide; TTC chr2 60482399 60482420 60482416 60482421 +
caaacagttgtaatttccactg

SEQ ID NO: 198571 - DNA, 22 bp, Artificial Sequence
  Synthetic oligonucleotide; TTG chr2 60482409 60482430 60482426 60482431 +
taatttccactgccactgctta

SEQ ID NO: 198572 - DNA, 22 bp, Artificial Sequence
  Synthetic oligonucleotide; TTT chr2 60482415 60482436 60482432 60482437 +
ccactgccactgcttagttcct

SEQ ID NO: 198573 - DNA, 22 bp, Artificial Sequence
  Synthetic oligonucleotide; TTC chr2 60482416 60482437 60482433 60482438 +
cactgccactgcttagttcctg

SEQ ID NO: 198574 - DNA, 22 bp, Artificial Sequence
  Synthetic oligonucleotide; CTG chr2 60482421 60482442 60482438 60482443 +
ccactgcttagttcctgggcac

SEQ ID NO: 198575 - DNA, 22 bp, Artificial Sequence
  Synthetic oligonucleotide; CTG chr2 60482427 60482448 60482444 60482449 +
cttagttcctgggcaccaggca

SEQ ID NO: 198576 - DNA, 22 bp, Artificial Sequence
  Synthetic oligonucleotide; CTT chr2 60482430 60482451 60482447 60482452 +
agttcctgggcaccaggcatac

SEQ ID NO: 198577 - DNA, 22 bp, Artificial Sequence
  Synthetic oligonucleotide; TTA chr2 60482431 60482452 60482448 60482453 +
gttcctgggcaccaggcataca

SEQ ID NO: 198578 - DNA, 22 bp, Artificial Sequence
  Synthetic oligonucleotide; TTC chr2 60482435 60482456 60482452 60482457 +
ctgggcaccaggcatacagagt

SEQ ID NO: 198579 - DNA, 22 bp, Artificial Sequence
  Synthetic oligonucleotide; CTG chr2 60482438 60482459 60482455 60482460 +
ggcaccaggcatacagagtggg

SEQ ID NO: 198580 - DNA, 22 bp, Artificial Sequence
  Synthetic oligonucleotide; CTT chr2 60482480 60482501 60482497 60482502 +
tgccacaaatcaggatttggca

SEQ ID NO: 198581 - DNA, 22 bp, Artificial Sequence
  Synthetic oligonucleotide; TTT chr2 60482481 60482502 60482498 60482503 +
gccacaaatcaggatttggcat

SEQ ID NO: 198582 - DNA, 22 bp, Artificial Sequence
  Synthetic oligonucleotide; TTG chr2 60482482 60482503 60482499 60482504 +
ccacaaatcaggatttggcatt

SEQ ID NO: 198583 - DNA, 22 bp, Artificial Sequence
  Synthetic oligonucleotide; TTT chr2 60482498 60482519 60482515 60482520 +
ggcatttaaatccacaggaagc

SEQ ID NO: 198584 - DNA, 22 bp, Artificial Sequence
  Synthetic oligonucleotide; TTG chr2 60482499 60482520 60482516 60482521 +
gcatttaaatccacaggaagca

SEQ ID NO: 198585 - DNA, 22 bp, Artificial Sequence
  Synthetic oligonucleotide; TTT chr2 60482505 60482526 60482522 60482527 +
aaatccacaggaagcaagaaga

SEQ ID NO: 198586 - DNA, 22 bp, Artificial Sequence
  Synthetic oligonucleotide; TTA chr2 60482506 60482527 60482523 60482528 +
aatccacaggaagcaagaagaa

SEQ ID NO: 198587 - DNA, 22 bp, Artificial Sequence
  Synthetic oligonucleotide; CTG chr2 60482539 60482560 60482556 60482561 +
cttatttatagatttgcagatg

SEQ ID NO: 198588 - DNA, 22 bp, Artificial Sequence
  Synthetic oligonucleotide; CTT chr2 60482542 60482563 60482559 60482564 +
atttatagatttgcagatgaat

SEQ ID NO: 198589 - DNA, 22 bp, Artificial Sequence
  Synthetic oligonucleotide; TTA chr2 60482543 60482564 60482560 60482565 +
tttatagatttgcagatgaatg

SEQ ID NO: 198590 - DNA, 22 bp, Artificial Sequence
  Synthetic oligonucleotide; TTT chr2 60482546 60482567 60482563 60482568 +
atagatttgcagatgaatgaga

SEQ ID NO: 198591 - DNA, 22 bp, Artificial Sequence
  Synthetic oligonucleotide; TTA chr2 60482547 60482568 60482564 60482569 +
tagatttgcagatgaatgagat

SEQ ID NO: 198592 - DNA, 22 bp, Artificial Sequence
  Synthetic oligonucleotide; TTT chr2 60482554 60482575 60482571 60482576 +
gcagatgaatgagataaccaaa

SEQ ID NO: 198593 - DNA, 22 bp, Artificial Sequence
  Synthetic oligonucleotide; TTG chr2 60482555 60482576 60482572 60482577 +
cagatgaatgagataaccaaaa

SEQ ID NO: 198594 - DNA, 22 bp, Artificial Sequence
  Synthetic oligonucleotide; CTT chr2 60482584 60482605 60482601 60482606 +
ctcgcgtatgtgaaggagcaat

SEQ ID NO: 198595 - DNA, 22 bp, Artificial Sequence
  Synthetic oligonucleotide; TTC chr2 60482585 60482606 60482602 60482607 +
tcgcgtatgtgaaggagcaatt

SEQ ID NO: 198596 - DNA, 22 bp, Artificial Sequence
  Synthetic oligonucleotide; CTC chr2 60482587 60482608 60482604 60482609 +
gcgtatgtgaaggagcaattcc

SEQ ID NO: 198597 - DNA, 22 bp, Artificial Sequence
  Synthetic oligonucleotide; TTC chr2 60482608 60482629 60482625 60482630 +
cattttcagacttggaaagttc

SEQ ID NO: 198598 - DNA, 22 bp, Artificial Sequence
  Synthetic oligonucleotide; TTT chr2 60482613 60482634 60482630 60482635 +
tcagacttggaaagttctccat

SEQ ID NO: 198599 - DNA, 22 bp, Artificial Sequence
  Synthetic oligonucleotide; TTT chr2 60482614 60482635 60482631 60482636 +
cagacttggaaagttctccata

SEQ ID NO: 198600 - DNA, 22 bp, Artificial Sequence
  Synthetic oligonucleotide; TTC chr2 60482615 60482636 60482632 60482637 +
agacttggaaagttctccataa

SEQ ID NO: 198601 - DNA, 22 bp, Artificial Sequence
  Synthetic oligonucleotide; CTT chr2 60482621 60482642 60482638 60482643 +
ggaaagttctccataattaagt

SEQ ID NO: 198602 - DNA, 22 bp, Artificial Sequence
  Synthetic oligonucleotide; TTG chr2 60482622 60482643 60482639 60482644 +
gaaagttctccataattaagta

SEQ ID NO: 198603 - DNA, 22 bp, Artificial Sequence
  Synthetic oligonucleotide; TTC chr2 60482630 60482651 60482647 60482652 +
tccataattaagtatcacccaa

SEQ ID NO: 198604 - DNA, 22 bp, Artificial Sequence
  Synthetic oligonucleotide; CTC chr2 60482632 60482653 60482649 60482654 +
cataattaagtatcacccaacc

SEQ ID NO: 198605 - DNA, 22 bp, Artificial Sequence
  Synthetic oligonucleotide; TTA chr2 60482640 60482661 60482657 60482662 +
agtatcacccaaccctgaaagc

SEQ ID NO: 198606 - DNA, 22 bp, Artificial Sequence
  Synthetic oligonucleotide; CTG chr2 60482657 60482678 60482674 60482679 +
aaagcacactgcatcccaaggt

SEQ ID NO: 198607 - DNA, 22 bp, Artificial Sequence
  Synthetic oligonucleotide; CTG chr2 60482668 60482689 60482685 60482690 +
catcccaaggttaagatcagct

SEQ ID NO: 198608 - DNA, 22 bp, Artificial Sequence
  Synthetic oligonucleotide; TTA chr2 60482681 60482702 60482698 60482703 +
agatcagcttcctgaaaacagg

SEQ ID NO: 198609 - DNA, 22 bp, Artificial Sequence
  Synthetic oligonucleotide; CTT chr2 60482691 60482712 60482708 60482713 +
cctgaaaacagggcagaagact

SEQ ID NO: 198610 - DNA, 22 bp, Artificial Sequence
  Synthetic oligonucleotide; TTC chr2 60482692 60482713 60482709 60482714 +
ctgaaaacagggcagaagactg

SEQ ID NO: 198611 - DNA, 22 bp, Artificial Sequence
  Synthetic oligonucleotide; CTG chr2 60482695 60482716 60482712 60482717 +
aaaacagggcagaagactgctg

SEQ ID NO: 198612 - DNA, 22 bp, Artificial Sequence
  Synthetic oligonucleotide; CTG chr2 60482714 60482735 60482731 60482736 +
ctgcttcagtggtagctcaaaa

SEQ ID NO: 198613 - DNA, 22 bp, Artificial Sequence
  Synthetic oligonucleotide; CTG chr2 60482717 60482738 60482734 60482739 +
cttcagtggtagctcaaaaatt

SEQ ID NO: 198614 - DNA, 22 bp, Artificial Sequence
  Synthetic oligonucleotide; CTT chr2 60482720 60482741 60482737 60482742 +
cagtggtagctcaaaaattcta

SEQ ID NO: 198615 - DNA, 22 bp, Artificial Sequence
  Synthetic oligonucleotide; TTC chr2 60482721 60482742 60482738 60482743 +
agtggtagctcaaaaattctat

SEQ ID NO: 198616 - DNA, 22 bp, Artificial Sequence
  Synthetic oligonucleotide; CTC chr2 60482732 60482753 60482749 60482754 +
aaaaattctattttgaaggaca

SEQ ID NO: 198617 - DNA, 22 bp, Artificial Sequence
  Synthetic oligonucleotide; TTC chr2 60482740 60482761 60482757 60482762 +
tattttgaaggacaggttagta

SEQ ID NO: 198618 - DNA, 22 bp, Artificial Sequence
  Synthetic oligonucleotide; CTA chr2 60482742 60482763 60482759 60482764 +
ttttgaaggacaggttagtacc

SEQ ID NO: 198619 - DNA, 22 bp, Artificial Sequence
  Synthetic oligonucleotide; TTT chr2 60482745 60482766 60482762 60482767 +
tgaaggacaggttagtaccaca

SEQ ID NO: 198620 - DNA, 22 bp, Artificial Sequence
  Synthetic oligonucleotide; TTT chr2 60482746 60482767 60482763 60482768 +
gaaggacaggttagtaccacac

SEQ ID NO: 198621 - DNA, 22 bp, Artificial Sequence
  Synthetic oligonucleotide; TTG chr2 60482747 60482768 60482764 60482769 +
aaggacaggttagtaccacact

SEQ ID NO: 198622 - DNA, 22 bp, Artificial Sequence
  Synthetic oligonucleotide; TTA chr2 60482759 60482780 60482776 60482781 +
gtaccacactacatttaactgg

SEQ ID NO: 198623 - DNA, 22 bp, Artificial Sequence
  Synthetic oligonucleotide; CTA chr2 60482770 60482791 60482787 60482792 +
catttaactggattcagttcat

SEQ ID NO: 198624 - DNA, 22 bp, Artificial Sequence
  Synthetic oligonucleotide; TTT chr2 60482775 60482796 60482792 60482797 +
aactggattcagttcatgtgat

SEQ ID NO: 198625 - DNA, 22 bp, Artificial Sequence
  Synthetic oligonucleotide; TTA chr2 60482776 60482797 60482793 60482798 +
actggattcagttcatgtgatt

SEQ ID NO: 198626 - DNA, 22 bp, Artificial Sequence
  Synthetic oligonucleotide; CTG chr2 60482780 60482801 60482797 60482802 +
gattcagttcatgtgattatac

SEQ ID NO: 198627 - DNA, 22 bp, Artificial Sequence
  Synthetic oligonucleotide; TTC chr2 60482785 60482806 60482802 60482807 +
agttcatgtgattatacagtgc

SEQ ID NO: 198628 - DNA, 22 bp, Artificial Sequence
  Synthetic oligonucleotide; TTC chr2 60482790 60482811 60482807 60482812 +
atgtgattatacagtgccttgc

SEQ ID NO: 198629 - DNA, 22 bp, Artificial Sequence
  Synthetic oligonucleotide; TTA chr2 60482799 60482820 60482816 60482821 +
tacagtgccttgctttctagaa

SEQ ID NO: 198630 - DNA, 22 bp, Artificial Sequence
  Synthetic oligonucleotide; CTT chr2 60482810 60482831 60482827 60482832 +
gctttctagaatgtgtaatcat

SEQ ID NO: 198631 - DNA, 22 bp, Artificial Sequence
  Synthetic oligonucleotide; TTG chr2 60482811 60482832 60482828 60482833 +
ctttctagaatgtgtaatcatc

SEQ ID NO: 198632 - DNA, 22 bp, Artificial Sequence
  Synthetic oligonucleotide; CTT chr2 60482814 60482835 60482831 60482836 +
tctagaatgtgtaatcatctct

SEQ ID NO: 198633 - DNA, 22 bp, Artificial Sequence
  Synthetic oligonucleotide; TTT chr2 60482815 60482836 60482832 60482837 +
ctagaatgtgtaatcatctctt

SEQ ID NO: 198634 - DNA, 22 bp, Artificial Sequence
  Synthetic oligonucleotide; TTC chr2 60482816 60482837 60482833 60482838 +
tagaatgtgtaatcatctcttt

SEQ ID NO: 198635 - DNA, 22 bp, Artificial Sequence
  Synthetic oligonucleotide; CTA chr2 60482818 60482839 60482835 60482840 +
gaatgtgtaatcatctctttct

SEQ ID NO: 198636 - DNA, 22 bp, Artificial Sequence
  Synthetic oligonucleotide; CTC chr2 60482835 60482856 60482852 60482857 +
tttctgatgacattttaaatat

SEQ ID NO: 198637 - DNA, 22 bp, Artificial Sequence
  Synthetic oligonucleotide; CTT chr2 60482837 60482858 60482854 60482859 +
tctgatgacattttaaatatcc

SEQ ID NO: 198638 - DNA, 22 bp, Artificial Sequence
  Synthetic oligonucleotide; TTT chr2 60482838 60482859 60482855 60482860 +
ctgatgacattttaaatatcca

SEQ ID NO: 198639 - DNA, 22 bp, Artificial Sequence
  Synthetic oligonucleotide; TTC chr2 60482839 60482860 60482856 60482861 +
tgatgacattttaaatatccaa

SEQ ID NO: 198640 - DNA, 22 bp, Artificial Sequence
  Synthetic oligonucleotide; CTG chr2 60482841 60482862 60482858 60482863 +
atgacattttaaatatccaact

SEQ ID NO: 198641 - DNA, 22 bp, Artificial Sequence
  Synthetic oligonucleotide; TTT chr2 60482850 60482871 60482867 60482872 +
taaatatccaactagacaaata

SEQ ID NO: 198642 - DNA, 22 bp, Artificial Sequence
  Synthetic oligonucleotide; TTT chr2 60482851 60482872 60482868 60482873 +
aaatatccaactagacaaataa

SEQ ID NO: 198643 - DNA, 22 bp, Artificial Sequence
  Synthetic oligonucleotide; TTA chr2 60482852 60482873 60482869 60482874 +
aatatccaactagacaaataat

SEQ ID NO: 198644 - DNA, 22 bp, Artificial Sequence
  Synthetic oligonucleotide; CTA chr2 60482864 60482885 60482881 60482886 +
gacaaataattgcagcaataat

SEQ ID NO: 198645 - DNA, 22 bp, Artificial Sequence
  Synthetic oligonucleotide; TTG chr2 60482876 60482897 60482893 60482898 +
cagcaataattgatagcagagt

SEQ ID NO: 198646 - DNA, 22 bp, Artificial Sequence
  Synthetic oligonucleotide; TTG chr2 60482888 60482909 60482905 60482910 +
atagcagagtcaagctggaaga

SEQ ID NO: 198647 - DNA, 22 bp, Artificial Sequence
  Synthetic oligonucleotide; CTG chr2 60482905 60482926 60482922 60482927 +
gaagatcattgattggcagagt

SEQ ID NO: 198648 - DNA, 22 bp, Artificial Sequence
  Synthetic oligonucleotide; TTG chr2 60482916 60482937 60482933 60482938 +
attggcagagtccccactgaaa

SEQ ID NO: 198649 - DNA, 22 bp, Artificial Sequence
  Synthetic oligonucleotide; TTG chr2 60482920 60482941 60482937 60482942 +
gcagagtccccactgaaacaaa

SEQ ID NO: 198650 - DNA, 22 bp, Artificial Sequence
  Synthetic oligonucleotide; CTG chr2 60482935 60482956 60482952 60482957 +
aaacaaatctttctttcaaaca

SEQ ID NO: 198651 - DNA, 22 bp, Artificial Sequence
  Synthetic oligonucleotide; CTT chr2 60482946 60482967 60482963 60482968 +
tctttcaaacattacagaaatg

SEQ ID NO: 198652 - DNA, 22 bp, Artificial Sequence
  Synthetic oligonucleotide; TTT chr2 60482947 60482968 60482964 60482969 +
ctttcaaacattacagaaatga

SEQ ID NO: 198653 - DNA, 22 bp, Artificial Sequence
  Synthetic oligonucleotide; TTC chr2 60482948 60482969 60482965 60482970 +
tttcaaacattacagaaatgat

SEQ ID NO: 198654 - DNA, 22 bp, Artificial Sequence
  Synthetic oligonucleotide; CTT chr2 60482950 60482971 60482967 60482972 +
tcaaacattacagaaatgatga

SEQ ID NO: 198655 - DNA, 22 bp, Artificial Sequence
  Synthetic oligonucleotide; TTT chr2 60482951 60482972 60482968 60482973 +
caaacattacagaaatgatgat

SEQ ID NO: 198656 - DNA, 22 bp, Artificial Sequence
  Synthetic oligonucleotide; TTC chr2 60482952 60482973 60482969 60482974 +
aaacattacagaaatgatgatg

SEQ ID NO: 198657 - DNA, 22 bp, Artificial Sequence
  Synthetic oligonucleotide; TTA chr2 60482960 60482981 60482977 60482982 +
cagaaatgatgatgtttaagtc

SEQ ID NO: 198658 - DNA, 22 bp, Artificial Sequence
  Synthetic oligonucleotide; TTT chr2 60482977 60482998 60482994 60482999 +
aagtctaacttttgctgataaa

SEQ ID NO: 198659 - DNA, 22 bp, Artificial Sequence
  Synthetic oligonucleotide; TTA chr2 60482978 60482999 60482995 60483000 +
agtctaacttttgctgataaat

SEQ ID NO: 198660 - DNA, 22 bp, Artificial Sequence
  Synthetic oligonucleotide; CTA chr2 60482984 60483005 60483001 60483006 +
acttttgctgataaatgctcaa

SEQ ID NO: 198661 - DNA, 22 bp, Artificial Sequence
  Synthetic oligonucleotide; CTT chr2 60482988 60483009 60483005 60483010 +
ttgctgataaatgctcaaaatc

SEQ ID NO: 198662 - DNA, 22 bp, Artificial Sequence
  Synthetic oligonucleotide; TTT chr2 60482989 60483010 60483006 60483011 +
tgctgataaatgctcaaaatct

SEQ ID NO: 198663 - DNA, 22 bp, Artificial Sequence
  Synthetic oligonucleotide; TTT chr2 60482990 60483011 60483007 60483012 +
gctgataaatgctcaaaatctg

SEQ ID NO: 198664 - DNA, 22 bp, Artificial Sequence
  Synthetic oligonucleotide; TTG chr2 60482991 60483012 60483008 60483013 +
ctgataaatgctcaaaatctga

SEQ ID NO: 198665 - DNA, 22 bp, Artificial Sequence
  Synthetic oligonucleotide; CTG chr2 60482994 60483015 60483011 60483016 +
ataaatgctcaaaatctgattt

SEQ ID NO: 198666 - DNA, 22 bp, Artificial Sequence
  Synthetic oligonucleotide; CTC chr2 60483004 60483025 60483021 60483026 +
aaaatctgatttactgataaag

SEQ ID NO: 198667 - DNA, 22 bp, Artificial Sequence
  Synthetic oligonucleotide; CTG chr2 60483012 60483033 60483029 60483034 +
atttactgataaaggcactgca

SEQ ID NO: 198668 - DNA, 22 bp, Artificial Sequence
  Synthetic oligonucleotide; TTT chr2 60483016 60483037 60483033 60483038 +
actgataaaggcactgcaagaa

SEQ ID NO: 198669 - DNA, 22 bp, Artificial Sequence
  Synthetic oligonucleotide; TTA chr2 60483017 60483038 60483034 60483039 +
ctgataaaggcactgcaagaaa

SEQ ID NO: 198670 - DNA, 22 bp, Artificial Sequence
  Synthetic oligonucleotide; CTG chr2 60483020 60483041 60483037 60483042 +
ataaaggcactgcaagaaaacc

SEQ ID NO: 198671 - DNA, 22 bp, Artificial Sequence
  Synthetic oligonucleotide; CTG chr2 60483032 60483053 60483049 60483054 +
caagaaaacctgcacttcagcc

SEQ ID NO: 198672 - DNA, 22 bp, Artificial Sequence
  Synthetic oligonucleotide; CTG chr2 60483044 60483065 60483061 60483066 +
cacttcagcccatgattacttt

SEQ ID NO: 198673 - DNA, 22 bp, Artificial Sequence
  Synthetic oligonucleotide; CTT chr2 60483049 60483070 60483066 60483071 +
cagcccatgattactttgcgag

SEQ ID NO: 198674 - DNA, 22 bp, Artificial Sequence
  Synthetic oligonucleotide; TTC chr2 60483050 60483071 60483067 60483072 +
agcccatgattactttgcgaga

SEQ ID NO: 198675 - DNA, 22 bp, Artificial Sequence
  Synthetic oligonucleotide; TTA chr2 60483062 60483083 60483079 60483084 +
ctttgcgagatgtttgagaaga

SEQ ID NO: 198676 - DNA, 22 bp, Artificial Sequence
  Synthetic oligonucleotide; CTT chr2 60483065 60483086 60483082 60483087 +
tgcgagatgtttgagaagaatc

SEQ ID NO: 198677 - DNA, 22 bp, Artificial Sequence
  Synthetic oligonucleotide; TTT chr2 60483066 60483087 60483083 60483088 +
gcgagatgtttgagaagaatca

SEQ ID NO: 198678 - DNA, 22 bp, Artificial Sequence
  Synthetic oligonucleotide; TTG chr2 60483067 60483088 60483084 60483089 +
cgagatgtttgagaagaatcag

SEQ ID NO: 198679 - DNA, 22 bp, Artificial Sequence
  Synthetic oligonucleotide; TTT chr2 60483077 60483098 60483094 60483099 +
gagaagaatcaggcagtgtgat

SEQ ID NO: 198680 - DNA, 22 bp, Artificial Sequence
  Synthetic oligonucleotide; TTG chr2 60483078 60483099 60483095 60483100 +
agaagaatcaggcagtgtgatt

SEQ ID NO: 198681 - DNA, 22 bp, Artificial Sequence
  Synthetic oligonucleotide; TTT chr2 60483101 60483122 60483118 60483123 +
atattatttcccatgaataact

SEQ ID NO: 198682 - DNA, 22 bp, Artificial Sequence
  Synthetic oligonucleotide; TTA chr2 60483102 60483123 60483119 60483124 +
tattatttcccatgaataactg

SEQ ID NO: 198683 - DNA, 22 bp, Artificial Sequence
  Synthetic oligonucleotide; TTA chr2 60483107 60483128 60483124 60483129 +
tttcccatgaataactgcaagg

SEQ ID NO: 198684 - DNA, 22 bp, Artificial Sequence
  Synthetic oligonucleotide; TTT chr2 60483110 60483131 60483127 60483132 +
cccatgaataactgcaaggata

SEQ ID NO: 198685 - DNA, 22 bp, Artificial Sequence
  Synthetic oligonucleotide; TTC chr2 60483111 60483132 60483128 60483133 +
ccatgaataactgcaaggatag

SEQ ID NO: 198686 - DNA, 22 bp, Artificial Sequence
  Synthetic oligonucleotide; CTG chr2 60483124 60483145 60483141 60483146 +
caaggatagtgtgggtagttgg

SEQ ID NO: 198687 - DNA, 22 bp, Artificial Sequence
  Synthetic oligonucleotide; TTG chr2 60483145 60483166 60483162 60483167 +
gaggagaatcaacacaggcgag

SEQ ID NO: 198688 - DNA, 22 bp, Artificial Sequence
  Synthetic oligonucleotide; TTG chr2 60483177 60483198 60483194 60483199 +
ctccttaatgctacacttcctg

SEQ ID NO: 198689 - DNA, 22 bp, Artificial Sequence
  Synthetic oligonucleotide; CTC chr2 60483180 60483201 60483197 60483202 +
cttaatgctacacttcctgaac

SEQ ID NO: 198690 - DNA, 22 bp, Artificial Sequence
  Synthetic oligonucleotide; CTT chr2 60483183 60483204 60483200 60483205 +
aatgctacacttcctgaacaat

SEQ ID NO: 198691 - DNA, 22 bp, Artificial Sequence
  Synthetic oligonucleotide; TTA chr2 60483184 60483205 60483201 60483206 +
atgctacacttcctgaacaatg

SEQ ID NO: 198692 - DNA, 22 bp, Artificial Sequence
  Synthetic oligonucleotide; CTA chr2 60483190 60483211 60483207 60483212 +
cacttcctgaacaatgctagcc

SEQ ID NO: 198693 - DNA, 22 bp, Artificial Sequence
  Synthetic oligonucleotide; CTT chr2 60483195 60483216 60483212 60483217 +
cctgaacaatgctagccaacaa

SEQ ID NO: 198694 - DNA, 22 bp, Artificial Sequence
  Synthetic oligonucleotide; TTC chr2 60483196 60483217 60483213 60483218 +
ctgaacaatgctagccaacaat

SEQ ID NO: 198695 - DNA, 22 bp, Artificial Sequence
  Synthetic oligonucleotide; CTG chr2 60483199 60483220 60483216 60483221 +
aacaatgctagccaacaatcag

SEQ ID NO: 198696 - DNA, 22 bp, Artificial Sequence
  Synthetic oligonucleotide; CTA chr2 60483209 60483230 60483226 60483231 +
gccaacaatcagggtttacagc

SEQ ID NO: 198697 - DNA, 22 bp, Artificial Sequence
  Synthetic oligonucleotide; TTT chr2 60483226 60483247 60483243 60483248 +
acagccgttttcccctctaata

SEQ ID NO: 198698 - DNA, 22 bp, Artificial Sequence
  Synthetic oligonucleotide; TTA chr2 60483227 60483248 60483244 60483249 +
cagccgttttcccctctaatat

SEQ ID NO: 198699 - DNA, 22 bp, Artificial Sequence
  Synthetic oligonucleotide; TTT chr2 60483236 60483257 60483253 60483258 +
tcccctctaatatatatcccgt

SEQ ID NO: 198700 - DNA, 22 bp, Artificial Sequence
  Synthetic oligonucleotide; TTT chr2 60483237 60483258 60483254 60483259 +
cccctctaatatatatcccgtg

SEQ ID NO: 198701 - DNA, 22 bp, Artificial Sequence
  Synthetic oligonucleotide; TTC chr2 60483238 60483259 60483255 60483260 +
ccctctaatatatatcccgtgg

SEQ ID NO: 198702 - DNA, 22 bp, Artificial Sequence
  Synthetic oligonucleotide; CTC chr2 60483243 60483264 60483260 60483265 +
taatatatatcccgtggtagag

SEQ ID NO: 198703 - DNA, 22 bp, Artificial Sequence
  Synthetic oligonucleotide; CTA chr2 60483245 60483266 60483262 60483267 +
atatatatcccgtggtagagaa

SEQ ID NO: 198704 - DNA, 22 bp, Artificial Sequence
  Synthetic oligonucleotide; CTT chr2 60483275 60483296 60483292 60483297 +
gacaaggggaagaccaggaaaa

SEQ ID NO: 198705 - DNA, 22 bp, Artificial Sequence
  Synthetic oligonucleotide; TTG chr2 60483276 60483297 60483293 60483298 +
acaaggggaagaccaggaaaag

SEQ ID NO: 198706 - DNA, 22 bp, Artificial Sequence
  Synthetic oligonucleotide; CTC chr2 60483320 60483341 60483337 60483342 +
cattcaggcctttgaaaagtgg

SEQ ID NO: 198707 - DNA, 22 bp, Artificial Sequence
  Synthetic oligonucleotide; TTC chr2 60483325 60483346 60483342 60483347 +
aggcctttgaaaagtggtttaa

SEQ ID NO: 198708 - DNA, 22 bp, Artificial Sequence
  Synthetic oligonucleotide; CTT chr2 60483332 60483353 60483349 60483354 +
tgaaaagtggtttaaatcgatg

SEQ ID NO: 198709 - DNA, 22 bp, Artificial Sequence
  Synthetic oligonucleotide; TTT chr2 60483333 60483354 60483350 60483355 +
gaaaagtggtttaaatcgatgc

SEQ ID NO: 198710 - DNA, 22 bp, Artificial Sequence
  Synthetic oligonucleotide; TTG chr2 60483334 60483355 60483351 60483356 +
aaaagtggtttaaatcgatgcc

SEQ ID NO: 198711 - DNA, 22 bp, Artificial Sequence
  Synthetic oligonucleotide; TTT chr2 60483345 60483366 60483362 60483367 +
aaatcgatgcctcaaattggga

SEQ ID NO: 198712 - DNA, 22 bp, Artificial Sequence
  Synthetic oligonucleotide; TTA chr2 60483346 60483367 60483363 60483368 +
aatcgatgcctcaaattgggac

SEQ ID NO: 198713 - DNA, 22 bp, Artificial Sequence
  Synthetic oligonucleotide; CTC chr2 60483358 60483379 60483375 60483380 +
aaattgggactcaaattcccct

SEQ ID NO: 198714 - DNA, 22 bp, Artificial Sequence
  Synthetic oligonucleotide; TTG chr2 60483364 60483385 60483381 60483386 +
ggactcaaattcccctgcccag

SEQ ID NO: 198715 - DNA, 22 bp, Artificial Sequence
  Synthetic oligonucleotide; CTC chr2 60483370 60483391 60483387 60483392 +
aaattcccctgcccagtgcaaa

SEQ ID NO: 198716 - DNA, 22 bp, Artificial Sequence
  Synthetic oligonucleotide; TTC chr2 60483376 60483397 60483393 60483398 +
ccctgcccagtgcaaagatccc

SEQ ID NO: 198717 - DNA, 22 bp, Artificial Sequence
  Synthetic oligonucleotide; CTG chr2 60483381 60483402 60483398 60483403 +
cccagtgcaaagatccctggcc

SEQ ID NO: 198718 - DNA, 22 bp, Artificial Sequence
  Synthetic oligonucleotide; CTG chr2 60483400 60483421 60483417 60483422 +
gccaaggtcagaagacttgaga

SEQ ID NO: 198719 - DNA, 22 bp, Artificial Sequence
  Synthetic oligonucleotide; CTT chr2 60483418 60483439 60483435 60483440 +
gagaccaggcaagtcccagatg

SEQ ID NO: 198720 - DNA, 22 bp, Artificial Sequence
  Synthetic oligonucleotide; TTG chr2 60483419 60483440 60483436 60483441 +
agaccaggcaagtcccagatga

SEQ ID NO: 198721 - DNA, 22 bp, Artificial Sequence
  Synthetic oligonucleotide; CTC chr2 60483445 60483466 60483462 60483467 +
aggcaagtccccaggtatagct

SEQ ID NO: 198722 - DNA, 22 bp, Artificial Sequence
  Synthetic oligonucleotide; CTG chr2 60483468 60483489 60483485 60483490 +
cagtccctttagccccagtctg

SEQ ID NO: 198723 - DNA, 22 bp, Artificial Sequence
  Synthetic oligonucleotide; CTT chr2 60483477 60483498 60483494 60483499 +
tagccccagtctgtttctctgt

SEQ ID NO: 198724 - DNA, 22 bp, Artificial Sequence
  Synthetic oligonucleotide; TTT chr2 60483478 60483499 60483495 60483500 +
agccccagtctgtttctctgtc

SEQ ID NO: 198725 - DNA, 22 bp, Artificial Sequence
  Synthetic oligonucleotide; TTA chr2 60483479 60483500 60483496 60483501 +
gccccagtctgtttctctgtcc

SEQ ID NO: 198726 - DNA, 22 bp, Artificial Sequence
  Synthetic oligonucleotide; CTG chr2 60483490 60483511 60483507 60483512 +
tttctctgtccaaggcagaacc

SEQ ID NO: 198727 - DNA, 22 bp, Artificial Sequence
  Synthetic oligonucleotide; TTT chr2 60483493 60483514 60483510 60483515 +
ctctgtccaaggcagaacccaa

SEQ ID NO: 198728 - DNA, 22 bp, Artificial Sequence
  Synthetic oligonucleotide; TTC chr2 60483494 60483515 60483511 60483516 +
tctgtccaaggcagaacccaaa

SEQ ID NO: 198729 - DNA, 22 bp, Artificial Sequence
  Synthetic oligonucleotide; CTC chr2 60483496 60483517 60483513 60483518 +
tgtccaaggcagaacccaaatc

SEQ ID NO: 198730 - DNA, 22 bp, Artificial Sequence
  Synthetic oligonucleotide; CTG chr2 60483498 60483519 60483515 60483520 +
tccaaggcagaacccaaatcaa

SEQ ID NO: 198731 - DNA, 22 bp, Artificial Sequence
  Synthetic oligonucleotide; CTG chr2 60483523 60483544 60483540 60483545 +
ctgtctatgtcatgtgttttga

SEQ ID NO: 198732 - DNA, 22 bp, Artificial Sequence
  Synthetic oligonucleotide; CTG chr2 60483526 60483547 60483543 60483548 +
tctatgtcatgtgttttgattg

SEQ ID NO: 198733 - DNA, 22 bp, Artificial Sequence
  Synthetic oligonucleotide; CTA chr2 60483530 60483551 60483547 60483552 +
tgtcatgtgttttgattgtaat

SEQ ID NO: 198734 - DNA, 22 bp, Artificial Sequence
  Synthetic oligonucleotide; TTT chr2 60483542 60483563 60483559 60483564 +
tgattgtaatatttaagttagg

SEQ ID NO: 198735 - DNA, 22 bp, Artificial Sequence
  Synthetic oligonucleotide; TTT chr2 60483543 60483564 60483560 60483565 +
gattgtaatatttaagttaggg

SEQ ID NO: 198736 - DNA, 22 bp, Artificial Sequence
  Synthetic oligonucleotide; TTG chr2 60483544 60483565 60483561 60483566 +
attgtaatatttaagttagggc

SEQ ID NO: 198737 - DNA, 22 bp, Artificial Sequence
  Synthetic oligonucleotide; TTG chr2 60483548 60483569 60483565 60483570 +
taatatttaagttagggcactg

SEQ ID NO: 198738 - DNA, 22 bp, Artificial Sequence
  Synthetic oligonucleotide; TTT chr2 60483556 60483577 60483573 60483578 +
aagttagggcactgtgttcaac

SEQ ID NO: 198739 - DNA, 22 bp, Artificial Sequence
  Synthetic oligonucleotide; TTA chr2 60483557 60483578 60483574 60483579 +
agttagggcactgtgttcaaca

SEQ ID NO: 198740 - DNA, 22 bp, Artificial Sequence
  Synthetic oligonucleotide; TTA chr2 60483562 60483583 60483579 60483584 +
gggcactgtgttcaacaactca

SEQ ID NO: 198741 - DNA, 22 bp, Artificial Sequence
  Synthetic oligonucleotide; CTG chr2 60483570 60483591 60483587 60483592 +
tgttcaacaactcagaccctgt

SEQ ID NO: 198742 - DNA, 22 bp, Artificial Sequence
  Synthetic oligonucleotide; TTC chr2 60483575 60483596 60483592 60483597 +
aacaactcagaccctgtggaat

SEQ ID NO: 198743 - DNA, 22 bp, Artificial Sequence
  Synthetic oligonucleotide; CTC chr2 60483583 60483604 60483600 60483605 +
agaccctgtggaatgctgcagt

SEQ ID NO: 198744 - DNA, 22 bp, Artificial Sequence
  Synthetic oligonucleotide; CTG chr2 60483591 60483612 60483608 60483613 +
tggaatgctgcagttgtcagaa

SEQ ID NO: 198745 - DNA, 22 bp, Artificial Sequence
  Synthetic oligonucleotide; CTG chr2 60483601 60483622 60483618 60483623 +
cagttgtcagaaataactcaag

SEQ ID NO: 198746 - DNA, 22 bp, Artificial Sequence
  Synthetic oligonucleotide; TTG chr2 60483607 60483628 60483624 60483629 +
tcagaaataactcaagagagga

SEQ ID NO: 198747 - DNA, 22 bp, Artificial Sequence
  Synthetic oligonucleotide; CTC chr2 60483620 60483641 60483637 60483642 +
aagagaggatgctcgtccccag

SEQ ID NO: 198748 - DNA, 22 bp, Artificial Sequence
  Synthetic oligonucleotide; CTC chr2 60483634 60483655 60483651 60483656 +
gtccccaggaaacatcaaatga

SEQ ID NO: 198749 - DNA, 22 bp, Artificial Sequence
  Synthetic oligonucleotide; CTG chr2 60483664 60483685 60483681 60483686 +
gcatattagcagacgtggatta

SEQ ID NO: 198750 - DNA, 22 bp, Artificial Sequence
  Synthetic oligonucleotide; TTA chr2 60483672 60483693 60483689 60483694 +
gcagacgtggattacagtaagg

SEQ ID NO: 198751 - DNA, 22 bp, Artificial Sequence
  Synthetic oligonucleotide; TTA chr2 60483686 60483707 60483703 60483708 +
cagtaaggaaaatctaaaacag

SEQ ID NO: 198752 - DNA, 22 bp, Artificial Sequence
  Synthetic oligonucleotide; CTA chr2 60483702 60483723 60483719 60483724 +
aaacagaagatgtatctggatg

SEQ ID NO: 198753 - DNA, 22 bp, Artificial Sequence
  Synthetic oligonucleotide; CTG chr2 60483720 60483741 60483737 60483742 +
gatgcttcagcagacaacaaag

SEQ ID NO: 198754 - DNA, 22 bp, Artificial Sequence
  Synthetic oligonucleotide; CTT chr2 60483727 60483748 60483744 60483749 +
cagcagacaacaaaggaagaat

SEQ ID NO: 198755 - DNA, 22 bp, Artificial Sequence
  Synthetic oligonucleotide; TTC chr2 60483728 60483749 60483745 60483750 +
agcagacaacaaaggaagaatt

SEQ ID NO: 198756 - DNA, 22 bp, Artificial Sequence
  Synthetic oligonucleotide; TTT chr2 60483751 60483772 60483768 60483773 +
ggggactgggtctaagcactcg

SEQ ID NO: 198757 - DNA, 22 bp, Artificial Sequence
  Synthetic oligonucleotide; TTG chr2 60483752 60483773 60483769 60483774 +
gggactgggtctaagcactcgc

SEQ ID NO: 198758 - DNA, 22 bp, Artificial Sequence
  Synthetic oligonucleotide; CTG chr2 60483759 60483780 60483776 60483781 +
ggtctaagcactcgcccaaagc

SEQ ID NO: 198759 - DNA, 22 bp, Artificial Sequence
  Synthetic oligonucleotide; CTA chr2 60483765 60483786 60483782 60483787 +
agcactcgcccaaagcactaga

SEQ ID NO: 198760 - DNA, 22 bp, Artificial Sequence
  Synthetic oligonucleotide; CTC chr2 60483772 60483793 60483789 60483794 +
gcccaaagcactagaaggagga

SEQ ID NO: 198761 - DNA, 22 bp, Artificial Sequence
  Synthetic oligonucleotide; CTA chr2 60483785 60483806 60483802 60483807 +
gaaggaggatttctttttattt

SEQ ID NO: 198762 - DNA, 22 bp, Artificial Sequence
  Synthetic oligonucleotide; TTT chr2 60483797 60483818 60483814 60483819 +
ctttttatttttctttcctatt

SEQ ID NO: 198763 - DNA, 22 bp, Artificial Sequence
  Synthetic oligonucleotide; TTC chr2 60483798 60483819 60483815 60483820 +
tttttatttttctttcctattt

SEQ ID NO: 198764 - DNA, 22 bp, Artificial Sequence
  Synthetic oligonucleotide; CTT chr2 60483800 60483821 60483817 60483822 +
tttatttttctttcctattttt

SEQ ID NO: 198765 - DNA, 22 bp, Artificial Sequence
  Synthetic oligonucleotide; TTT chr2 60483801 60483822 60483818 60483823 +
ttatttttctttcctatttttg

SEQ ID NO: 198766 - DNA, 22 bp, Artificial Sequence
  Synthetic oligonucleotide; TTT chr2 60483802 60483823 60483819 60483824 +
tatttttctttcctatttttgt

SEQ ID NO: 198767 - DNA, 22 bp, Artificial Sequence
  Synthetic oligonucleotide; TTT chr2 60483803 60483824 60483820 60483825 +
atttttctttcctatttttgtt

SEQ ID NO: 198768 - DNA, 22 bp, Artificial Sequence
  Synthetic oligonucleotide; TTA chr2 60483804 60483825 60483821 60483826 +
tttttctttcctatttttgttc

SEQ ID NO: 198769 - DNA, 22 bp, Artificial Sequence
  Synthetic oligonucleotide; TTT chr2 60483807 60483828 60483824 60483829 +
ttctttcctatttttgttcttc

SEQ ID NO: 198770 - DNA, 22 bp, Artificial Sequence
  Synthetic oligonucleotide; TTT chr2 60483808 60483829 60483825 60483830 +
tctttcctatttttgttcttct

SEQ ID NO: 198771 - DNA, 22 bp, Artificial Sequence
  Synthetic oligonucleotide; TTT chr2 60483809 60483830 60483826 60483831 +
ctttcctatttttgttcttctg

SEQ ID NO: 198772 - DNA, 22 bp, Artificial Sequence
  Synthetic oligonucleotide; TTC chr2 60483810 60483831 60483827 60483832 +
tttcctatttttgttcttctgg

SEQ ID NO: 198773 - DNA, 22 bp, Artificial Sequence
  Synthetic oligonucleotide; CTT chr2 60483812 60483833 60483829 60483834 +
tcctatttttgttcttctggtt

SEQ ID NO: 198774 - DNA, 22 bp, Artificial Sequence
  Synthetic oligonucleotide; TTT chr2 60483813 60483834 60483830 60483835 +
cctatttttgttcttctggttg

SEQ ID NO: 198775 - DNA, 22 bp, Artificial Sequence
  Synthetic oligonucleotide; TTC chr2 60483814 60483835 60483831 60483836 +
ctatttttgttcttctggttgt

SEQ ID NO: 198776 - DNA, 22 bp, Artificial Sequence
  Synthetic oligonucleotide; CTA chr2 60483817 60483838 60483834 60483839 +
tttttgttcttctggttgttct

SEQ ID NO: 198777 - DNA, 22 bp, Artificial Sequence
  Synthetic oligonucleotide; TTT chr2 60483820 60483841 60483837 60483842 +
ttgttcttctggttgttctttc

SEQ ID NO: 198778 - DNA, 22 bp, Artificial Sequence
  Synthetic oligonucleotide; TTT chr2 60483821 60483842 60483838 60483843 +
tgttcttctggttgttctttct

SEQ ID NO: 198779 - DNA, 22 bp, Artificial Sequence
  Synthetic oligonucleotide; TTT chr2 60483822 60483843 60483839 60483844 +
gttcttctggttgttctttctt

SEQ ID NO: 198780 - DNA, 22 bp, Artificial Sequence
  Synthetic oligonucleotide; TTG chr2 60483823 60483844 60483840 60483845 +
ttcttctggttgttctttcttt

SEQ ID NO: 198781 - DNA, 22 bp, Artificial Sequence
  Synthetic oligonucleotide; TTC chr2 60483826 60483847 60483843 60483848 +
ttctggttgttctttctttctt

SEQ ID NO: 198782 - DNA, 22 bp, Artificial Sequence
  Synthetic oligonucleotide; CTT chr2 60483828 60483849 60483845 60483850 +
ctggttgttctttctttcttcc

SEQ ID NO: 198783 - DNA, 22 bp, Artificial Sequence
  Synthetic oligonucleotide; TTC chr2 60483829 60483850 60483846 60483851 +
tggttgttctttctttcttcct

SEQ ID NO: 198784 - DNA, 22 bp, Artificial Sequence
  Synthetic oligonucleotide; CTG chr2 60483831 60483852 60483848 60483853 +
gttgttctttctttcttccttt

SEQ ID NO: 198785 - DNA, 22 bp, Artificial Sequence
  Synthetic oligonucleotide; TTG chr2 60483835 60483856 60483852 60483857 +
ttctttctttcttccttttctc

SEQ ID NO: 198786 - DNA, 22 bp, Artificial Sequence
  Synthetic oligonucleotide; TTC chr2 60483838 60483859 60483855 60483860 +
tttctttcttccttttctccct

SEQ ID NO: 198787 - DNA, 22 bp, Artificial Sequence
  Synthetic oligonucleotide; CTT chr2 60483840 60483861 60483857 60483862 +
tctttcttccttttctcccttt

SEQ ID NO: 198788 - DNA, 22 bp, Artificial Sequence
  Synthetic oligonucleotide; TTT chr2 60483841 60483862 60483858 60483863 +
ctttcttccttttctccctttt

SEQ ID NO: 198789 - DNA, 22 bp, Artificial Sequence
  Synthetic oligonucleotide; TTC chr2 60483842 60483863 60483859 60483864 +
tttcttccttttctcccttttt

SEQ ID NO: 198790 - DNA, 22 bp, Artificial Sequence
  Synthetic oligonucleotide; CTT chr2 60483844 60483865 60483861 60483866 +
tcttccttttctcccttttttt

SEQ ID NO: 198791 - DNA, 22 bp, Artificial Sequence
  Synthetic oligonucleotide; TTT chr2 60483845 60483866 60483862 60483867 +
cttccttttctccctttttttc

SEQ ID NO: 198792 - DNA, 22 bp, Artificial Sequence
  Synthetic oligonucleotide; TTC chr2 60483846 60483867 60483863 60483868 +
ttccttttctccctttttttct

SEQ ID NO: 198793 - DNA, 22 bp, Artificial Sequence
  Synthetic oligonucleotide; CTT chr2 60483848 60483869 60483865 60483870 +
ccttttctccctttttttcttt

SEQ ID NO: 198794 - DNA, 22 bp, Artificial Sequence
  Synthetic oligonucleotide; TTC chr2 60483849 60483870 60483866 60483871 +
cttttctccctttttttctttc

SEQ ID NO: 198795 - DNA, 22 bp, Artificial Sequence
  Synthetic oligonucleotide; CTT chr2 60483852 60483873 60483869 60483874 +
ttctccctttttttctttcctt

SEQ ID NO: 198796 - DNA, 22 bp, Artificial Sequence
  Synthetic oligonucleotide; TTT chr2 60483853 60483874 60483870 60483875 +
tctccctttttttctttccttc

SEQ ID NO: 198797 - DNA, 22 bp, Artificial Sequence
  Synthetic oligonucleotide; TTT chr2 60483854 60483875 60483871 60483876 +
ctccctttttttctttccttct

SEQ ID NO: 198798 - DNA, 22 bp, Artificial Sequence
  Synthetic oligonucleotide; TTC chr2 60483855 60483876 60483872 60483877 +
tccctttttttctttccttctt

SEQ ID NO: 198799 - DNA, 22 bp, Artificial Sequence
  Synthetic oligonucleotide; CTC chr2 60483857 60483878 60483874 60483879 +
cctttttttctttccttctttt

SEQ ID NO: 198800 - DNA, 22 bp, Artificial Sequence
  Synthetic oligonucleotide; CTT chr2 60483861 60483882 60483878 60483883 +
tttttctttccttctttttctt

SEQ ID NO: 198801 - DNA, 22 bp, Artificial Sequence
  Synthetic oligonucleotide; TTT chr2 60483862 60483883 60483879 60483884 +
ttttctttccttctttttcttt

SEQ ID NO: 198802 - DNA, 22 bp, Artificial Sequence
  Synthetic oligonucleotide; TTT chr2 60483863 60483884 60483880 60483885 +
tttctttccttctttttctttc

SEQ ID NO: 198803 - DNA, 22 bp, Artificial Sequence
  Synthetic oligonucleotide; TTT chr2 60483864 60483885 60483881 60483886 +
ttctttccttctttttctttct

SEQ ID NO: 198804 - DNA, 22 bp, Artificial Sequence
  Synthetic oligonucleotide; TTT chr2 60483865 60483886 60483882 60483887 +
tctttccttctttttctttctt

SEQ ID NO: 198805 - DNA, 22 bp, Artificial Sequence
  Synthetic oligonucleotide; TTT chr2 60483866 60483887 60483883 60483888 +
ctttccttctttttctttcttg

SEQ ID NO: 198806 - DNA, 22 bp, Artificial Sequence
  Synthetic oligonucleotide; TTC chr2 60483867 60483888 60483884 60483889 +
tttccttctttttctttcttgg

SEQ ID NO: 198807 - DNA, 22 bp, Artificial Sequence
  Synthetic oligonucleotide; CTT chr2 60483869 60483890 60483886 60483891 +
tccttctttttctttcttggtt

SEQ ID NO: 198808 - DNA, 22 bp, Artificial Sequence
  Synthetic oligonucleotide; TTT chr2 60483870 60483891 60483887 60483892 +
ccttctttttctttcttggttg

SEQ ID NO: 198809 - DNA, 22 bp, Artificial Sequence
  Synthetic oligonucleotide; TTC chr2 60483871 60483892 60483888 60483893 +
cttctttttctttcttggttgc

SEQ ID NO: 198810 - DNA, 22 bp, Artificial Sequence
  Synthetic oligonucleotide; CTT chr2 60483874 60483895 60483891 60483896 +
ctttttctttcttggttgcttt

SEQ ID NO: 198811 - DNA, 22 bp, Artificial Sequence
  Synthetic oligonucleotide; TTC chr2 60483875 60483896 60483892 60483897 +
tttttctttcttggttgctttt

SEQ ID NO: 198812 - DNA, 22 bp, Artificial Sequence
  Synthetic oligonucleotide; CTT chr2 60483877 60483898 60483894 60483899 +
tttctttcttggttgctttttt

SEQ ID NO: 198813 - DNA, 22 bp, Artificial Sequence
  Synthetic oligonucleotide; TTT chr2 60483878 60483899 60483895 60483900 +
ttctttcttggttgcttttttt

SEQ ID NO: 198814 - DNA, 22 bp, Artificial Sequence
  Synthetic oligonucleotide; TTT chr2 60483879 60483900 60483896 60483901 +
tctttcttggttgctttttttt

SEQ ID NO: 198815 - DNA, 22 bp, Artificial Sequence
  Synthetic oligonucleotide; TTT chr2 60483880 60483901 60483897 60483902 +
ctttcttggttgcttttttttc

SEQ ID NO: 198816 - DNA, 22 bp, Artificial Sequence
  Synthetic oligonucleotide; TTC chr2 60483881 60483902 60483898 60483903 +
tttcttggttgcttttttttcc

SEQ ID NO: 198817 - DNA, 22 bp, Artificial Sequence
  Synthetic oligonucleotide; CTT chr2 60483883 60483904 60483900 60483905 +
tcttggttgcttttttttcccc

SEQ ID NO: 198818 - DNA, 22 bp, Artificial Sequence
  Synthetic oligonucleotide; TTT chr2 60483884 60483905 60483901 60483906 +
cttggttgcttttttttccccc

SEQ ID NO: 198819 - DNA, 22 bp, Artificial Sequence
  Synthetic oligonucleotide; TTC chr2 60483885 60483906 60483902 60483907 +
ttggttgcttttttttccccct

SEQ ID NO: 198820 - DNA, 22 bp, Artificial Sequence
  Synthetic oligonucleotide; CTT chr2 60483887 60483908 60483904 60483909 +
ggttgcttttttttcccccttt

SEQ ID NO: 198821 - DNA, 22 bp, Artificial Sequence
  Synthetic oligonucleotide; TTG chr2 60483888 60483909 60483905 60483910 +
gttgcttttttttccccctttg

SEQ ID NO: 198822 - DNA, 22 bp, Artificial Sequence
  Synthetic oligonucleotide; TTG chr2 60483892 60483913 60483909 60483914 +
cttttttttccccctttgaaac

SEQ ID NO: 198823 - DNA, 22 bp, Artificial Sequence
  Synthetic oligonucleotide; CTT chr2 60483895 60483916 60483912 60483917 +
ttttttccccctttgaaactga

SEQ ID NO: 198824 - DNA, 22 bp, Artificial Sequence
  Synthetic oligonucleotide; TTT chr2 60483896 60483917 60483913 60483918 +
tttttccccctttgaaactgaa

SEQ ID NO: 198825 - DNA, 22 bp, Artificial Sequence
  Synthetic oligonucleotide; TTT chr2 60483897 60483918 60483914 60483919 +
ttttccccctttgaaactgaac

SEQ ID NO: 198826 - DNA, 22 bp, Artificial Sequence
  Synthetic oligonucleotide; TTT chr2 60483898 60483919 60483915 60483920 +
tttccccctttgaaactgaacc

SEQ ID NO: 198827 - DNA, 22 bp, Artificial Sequence
  Synthetic oligonucleotide; TTT chr2 60483899 60483920 60483916 60483921 +
ttccccctttgaaactgaacca

SEQ ID NO: 198828 - DNA, 22 bp, Artificial Sequence
  Synthetic oligonucleotide; TTT chr2 60483900 60483921 60483917 60483922 +
tccccctttgaaactgaaccat

SEQ ID NO: 198829 - DNA, 22 bp, Artificial Sequence
  Synthetic oligonucleotide; TTT chr2 60483901 60483922 60483918 60483923 +
ccccctttgaaactgaaccatt

SEQ ID NO: 198830 - DNA, 22 bp, Artificial Sequence
  Synthetic oligonucleotide; TTC chr2 60483902 60483923 60483919 60483924 +
cccctttgaaactgaaccatta

SEQ ID NO: 198831 - DNA, 22 bp, Artificial Sequence
  Synthetic oligonucleotide; CTT chr2 60483908 60483929 60483925 60483930 +
tgaaactgaaccattataaatg

SEQ ID NO: 198832 - DNA, 22 bp, Artificial Sequence
  Synthetic oligonucleotide; TTT chr2 60483909 60483930 60483926 60483931 +
gaaactgaaccattataaatga

SEQ ID NO: 198833 - DNA, 22 bp, Artificial Sequence
  Synthetic oligonucleotide; TTG chr2 60483910 60483931 60483927 60483932 +
aaactgaaccattataaatgag

SEQ ID NO: 198834 - DNA, 22 bp, Artificial Sequence
  Synthetic oligonucleotide; CTG chr2 60483916 60483937 60483933 60483938 +
aaccattataaatgagttggtc

SEQ ID NO: 198835 - DNA, 22 bp, Artificial Sequence
  Synthetic oligonucleotide; TTA chr2 60483924 60483945 60483941 60483946 +
taaatgagttggtctcatagct

SEQ ID NO: 198836 - DNA, 22 bp, Artificial Sequence
  Synthetic oligonucleotide; TTG chr2 60483935 60483956 60483952 60483957 +
gtctcatagcttctgttaaaaa

SEQ ID NO: 198837 - DNA, 22 bp, Artificial Sequence
  Synthetic oligonucleotide; CTC chr2 60483940 60483961 60483957 60483962 +
atagcttctgttaaaaatcaga

SEQ ID NO: 198838 - DNA, 22 bp, Artificial Sequence
  Synthetic oligonucleotide; CTT chr2 60483947 60483968 60483964 60483969 +
ctgttaaaaatcagaagcttgt

SEQ ID NO: 198839 - DNA, 22 bp, Artificial Sequence
  Synthetic oligonucleotide; TTC chr2 60483948 60483969 60483965 60483970 +
tgttaaaaatcagaagcttgtt

SEQ ID NO: 198840 - DNA, 22 bp, Artificial Sequence
  Synthetic oligonucleotide; CTG chr2 60483950 60483971 60483967 60483972 +
ttaaaaatcagaagcttgttag

SEQ ID NO: 198841 - DNA, 22 bp, Artificial Sequence
  Synthetic oligonucleotide; TTA chr2 60483953 60483974 60483970 60483975 +
aaaatcagaagcttgttagatg

SEQ ID NO: 198842 - DNA, 22 bp, Artificial Sequence
  Synthetic oligonucleotide; CTT chr2 60483967 60483988 60483984 60483989 +
gttagatgtaatgattatctgc

SEQ ID NO: 198843 - DNA, 22 bp, Artificial Sequence
  Synthetic oligonucleotide; TTG chr2 60483968 60483989 60483985 60483990 +
ttagatgtaatgattatctgca

SEQ ID NO: 198844 - DNA, 22 bp, Artificial Sequence
  Synthetic oligonucleotide; TTA chr2 60483971 60483992 60483988 60483993 +
gatgtaatgattatctgcattg

SEQ ID NO: 198845 - DNA, 22 bp, Artificial Sequence
  Synthetic oligonucleotide; TTA chr2 60483984 60484005 60484001 60484006 +
tctgcattgtgacacttaccgc

SEQ ID NO: 198846 - DNA, 22 bp, Artificial Sequence
  Synthetic oligonucleotide; CTG chr2 60483988 60484009 60484005 60484010 +
cattgtgacacttaccgcgtat

SEQ ID NO: 198847 - DNA, 22 bp, Artificial Sequence
  Synthetic oligonucleotide; TTG chr2 60483993 60484014 60484010 60484015 +
tgacacttaccgcgtatgaggg

SEQ ID NO: 198848 - DNA, 22 bp, Artificial Sequence
  Synthetic oligonucleotide; CTT chr2 60484001 60484022 60484018 60484023 +
accgcgtatgaggggtcttgtc

SEQ ID NO: 198849 - DNA, 22 bp, Artificial Sequence
  Synthetic oligonucleotide; TTA chr2 60484002 60484023 60484019 60484024 +
ccgcgtatgaggggtcttgtcg

SEQ ID NO: 198850 - DNA, 22 bp, Artificial Sequence
  Synthetic oligonucleotide; CTT chr2 60484020 60484041 60484037 60484042 +
gtcgaacagctttactctaatt

SEQ ID NO: 198851 - DNA, 22 bp, Artificial Sequence
  Synthetic oligonucleotide; TTG chr2 60484021 60484042 60484038 60484043 +
tcgaacagctttactctaattt

SEQ ID NO: 198852 - DNA, 22 bp, Artificial Sequence
  Synthetic oligonucleotide; CTT chr2 60484032 60484053 60484049 60484054 +
tactctaatttagagctcctct

SEQ ID NO: 198853 - DNA, 22 bp, Artificial Sequence
  Synthetic oligonucleotide; TTT chr2 60484033 60484054 60484050 60484055 +
actctaatttagagctcctctg

SEQ ID NO: 198854 - DNA, 22 bp, Artificial Sequence
  Synthetic oligonucleotide; TTA chr2 60484034 60484055 60484051 60484056 +
ctctaatttagagctcctctgt

SEQ ID NO: 198855 - DNA, 22 bp, Artificial Sequence
  Synthetic oligonucleotide; CTC chr2 60484037 60484058 60484054 60484059 +
taatttagagctcctctgttaa

SEQ ID NO: 198856 - DNA, 22 bp, Artificial Sequence
  Synthetic oligonucleotide; CTA chr2 60484039 60484060 60484056 60484061 +
atttagagctcctctgttaatt

SEQ ID NO: 198857 - DNA, 22 bp, Artificial Sequence
  Synthetic oligonucleotide; TTT chr2 60484043 60484064 60484060 60484065 +
agagctcctctgttaattagaa

SEQ ID NO: 198858 - DNA, 22 bp, Artificial Sequence
  Synthetic oligonucleotide; TTA chr2 60484044 60484065 60484061 60484066 +
gagctcctctgttaattagaaa

SEQ ID NO: 198859 - DNA, 22 bp, Artificial Sequence
  Synthetic oligonucleotide; CTC chr2 60484050 60484071 60484067 60484072 +
ctctgttaattagaaagccctc

SEQ ID NO: 198860 - DNA, 22 bp, Artificial Sequence
  Synthetic oligonucleotide; CTC chr2 60484053 60484074 60484070 60484075 +
tgttaattagaaagccctcaga

SEQ ID NO: 198861 - DNA, 22 bp, Artificial Sequence
  Synthetic oligonucleotide; CTG chr2 60484055 60484076 60484072 60484077 +
ttaattagaaagccctcagatt

SEQ ID NO: 198862 - DNA, 22 bp, Artificial Sequence
  Synthetic oligonucleotide; TTA chr2 60484058 60484079 60484075 60484080 +
attagaaagccctcagattttc

SEQ ID NO: 198863 - DNA, 22 bp, Artificial Sequence
  Synthetic oligonucleotide; TTA chr2 60484062 60484083 60484079 60484084 +
gaaagccctcagattttctgca

SEQ ID NO: 198864 - DNA, 22 bp, Artificial Sequence
  Synthetic oligonucleotide; CTC chr2 60484072 60484093 60484089 60484094 +
agattttctgcaaatgcaggtc

SEQ ID NO: 198865 - DNA, 22 bp, Artificial Sequence
  Synthetic oligonucleotide; TTT chr2 60484078 60484099 60484095 60484100 +
tctgcaaatgcaggtcactatc

SEQ ID NO: 198866 - DNA, 22 bp, Artificial Sequence
  Synthetic oligonucleotide; TTT chr2 60484079 60484100 60484096 60484101 +
ctgcaaatgcaggtcactatcg

SEQ ID NO: 198867 - DNA, 22 bp, Artificial Sequence
  Synthetic oligonucleotide; TTC chr2 60484080 60484101 60484097 60484102 +
tgcaaatgcaggtcactatcga

SEQ ID NO: 198868 - DNA, 22 bp, Artificial Sequence
  Synthetic oligonucleotide; CTG chr2 60484082 60484103 60484099 60484104 +
caaatgcaggtcactatcgaca

SEQ ID NO: 198869 - DNA, 22 bp, Artificial Sequence
  Synthetic oligonucleotide; CTA chr2 60484098 60484119 60484115 60484120 +
tcgacagctcatgcttttgatg

SEQ ID NO: 198870 - DNA, 22 bp, Artificial Sequence
  Synthetic oligonucleotide; CTC chr2 60484108 60484129 60484125 60484130 +
atgcttttgatgcttcgtctgt

SEQ ID NO: 198871 - DNA, 22 bp, Artificial Sequence
  Synthetic oligonucleotide; CTT chr2 60484114 60484135 60484131 60484136 +
ttgatgcttcgtctgtgacagt

SEQ ID NO: 198872 - DNA, 22 bp, Artificial Sequence
  Synthetic oligonucleotide; TTT chr2 60484115 60484136 60484132 60484137 +
tgatgcttcgtctgtgacagtt

SEQ ID NO: 198873 - DNA, 22 bp, Artificial Sequence
  Synthetic oligonucleotide; TTT chr2 60484116 60484137 60484133 60484138 +
gatgcttcgtctgtgacagttg

SEQ ID NO: 198874 - DNA, 22 bp, Artificial Sequence
  Synthetic oligonucleotide; TTG chr2 60484117 60484138 60484134 60484139 +
atgcttcgtctgtgacagttgt

SEQ ID NO: 198875 - DNA, 22 bp, Artificial Sequence
  Synthetic oligonucleotide; CTT chr2 60484123 60484144 60484140 60484145 +
cgtctgtgacagttgttgggtt

SEQ ID NO: 198876 - DNA, 22 bp, Artificial Sequence
  Synthetic oligonucleotide; TTC chr2 60484124 60484145 60484141 60484146 +
gtctgtgacagttgttgggttg

SEQ ID NO: 198877 - DNA, 22 bp, Artificial Sequence
  Synthetic oligonucleotide; CTG chr2 60484129 60484150 60484146 60484151 +
tgacagttgttgggttgccctt

SEQ ID NO: 198878 - DNA, 22 bp, Artificial Sequence
  Synthetic oligonucleotide; TTG chr2 60484138 60484159 60484155 60484160 +
ttgggttgcccttctaggagct

SEQ ID NO: 198879 - DNA, 22 bp, Artificial Sequence
  Synthetic oligonucleotide; TTG chr2 60484141 60484162 60484158 60484163 +
ggttgcccttctaggagctggc

SEQ ID NO: 198880 - DNA, 22 bp, Artificial Sequence
  Synthetic oligonucleotide; TTG chr2 60484146 60484167 60484163 60484168 +
cccttctaggagctggcagggt

SEQ ID NO: 198881 - DNA, 22 bp, Artificial Sequence
  Synthetic oligonucleotide; CTT chr2 60484151 60484172 60484168 60484173 +
ctaggagctggcagggttgtcc

SEQ ID NO: 198882 - DNA, 22 bp, Artificial Sequence
  Synthetic oligonucleotide; TTC chr2 60484152 60484173 60484169 60484174 +
taggagctggcagggttgtcca

SEQ ID NO: 198883 - DNA, 22 bp, Artificial Sequence
  Synthetic oligonucleotide; CTA chr2 60484154 60484175 60484171 60484176 +
ggagctggcagggttgtccaga

SEQ ID NO: 198884 - DNA, 22 bp, Artificial Sequence
  Synthetic oligonucleotide; CTG chr2 60484161 60484182 60484178 60484183 +
gcagggttgtccagactctgac

SEQ ID NO: 198885 - DNA, 22 bp, Artificial Sequence
  Synthetic oligonucleotide; TTG chr2 60484170 60484191 60484187 60484192 +
tccagactctgacagtgtcaga

SEQ ID NO: 198886 - DNA, 22 bp, Artificial Sequence
  Synthetic oligonucleotide; CTC chr2 60484179 60484200 60484196 60484201 +
tgacagtgtcagaaaatgcagt

SEQ ID NO: 198887 - DNA, 22 bp, Artificial Sequence
  Synthetic oligonucleotide; CTG chr2 60484181 60484202 60484198 60484203 +
acagtgtcagaaaatgcagtca

SEQ ID NO: 198888 - DNA, 22 bp, Artificial Sequence
  Synthetic oligonucleotide; CTG chr2 60484212 60484233 60484229 60484234 +
cttcacaggaagttacacgcaa

SEQ ID NO: 198889 - DNA, 22 bp, Artificial Sequence
  Synthetic oligonucleotide; CTT chr2 60484215 60484236 60484232 60484237 +
cacaggaagttacacgcaaggt

SEQ ID NO: 198890 - DNA, 22 bp, Artificial Sequence
  Synthetic oligonucleotide; TTC chr2 60484216 60484237 60484233 60484238 +
acaggaagttacacgcaaggtc

SEQ ID NO: 198891 - DNA, 22 bp, Artificial Sequence
  Synthetic oligonucleotide; TTA chr2 60484227 60484248 60484244 60484249 +
cacgcaaggtccgcacacagtc

SEQ ID NO: 198892 - DNA, 22 bp, Artificial Sequence
  Synthetic oligonucleotide; TTT chr2 60484254 60484275 60484271 60484276 +
ccctgtagcccagaagcctgat

SEQ ID NO: 198893 - DNA, 22 bp, Artificial Sequence
  Synthetic oligonucleotide; TTC chr2 60484255 60484276 60484272 60484277 +
cctgtagcccagaagcctgatg

SEQ ID NO: 198894 - DNA, 22 bp, Artificial Sequence
  Synthetic oligonucleotide; CTG chr2 60484259 60484280 60484276 60484281 +
tagcccagaagcctgatgaaat

SEQ ID NO: 198895 - DNA, 22 bp, Artificial Sequence
  Synthetic oligonucleotide; CTG chr2 60484274 60484295 60484291 60484296 +
atgaaatctgcactcacattca

SEQ ID NO: 198896 - DNA, 22 bp, Artificial Sequence
  Synthetic oligonucleotide; CTG chr2 60484284 60484305 60484301 60484306 +
cactcacattcagctgaaaata

SEQ ID NO: 198897 - DNA, 22 bp, Artificial Sequence
  Synthetic oligonucleotide; CTC chr2 60484289 60484310 60484306 60484311 +
acattcagctgaaaatagctcg

SEQ ID NO: 198898 - DNA, 22 bp, Artificial Sequence
  Synthetic oligonucleotide; TTC chr2 60484295 60484316 60484312 60484317 +
agctgaaaatagctcgaattcc

SEQ ID NO: 198899 - DNA, 22 bp, Artificial Sequence
  Synthetic oligonucleotide; CTG chr2 60484300 60484321 60484317 60484322 +
aaaatagctcgaattccaaccc

SEQ ID NO: 198900 - DNA, 22 bp, Artificial Sequence
  Synthetic oligonucleotide; CTC chr2 60484310 60484331 60484327 60484332 +
gaattccaaccctctctccccc

SEQ ID NO: 198901 - DNA, 22 bp, Artificial Sequence
  Synthetic oligonucleotide; TTC chr2 60484316 60484337 60484333 60484338 +
caaccctctctccccctgcctc

SEQ ID NO: 198902 - DNA, 22 bp, Artificial Sequence
  Synthetic oligonucleotide; CTC chr2 60484324 60484345 60484341 60484346 +
tctccccctgcctcctctcttc

SEQ ID NO: 198903 - DNA, 22 bp, Artificial Sequence
  Synthetic oligonucleotide; CTC chr2 60484326 60484347 60484343 60484348 +
tccccctgcctcctctcttccc

SEQ ID NO: 198904 - DNA, 22 bp, Artificial Sequence
  Synthetic oligonucleotide; CTC chr2 60484328 60484349 60484345 60484350 +
cccctgcctcctctcttcccct

SEQ ID NO: 198905 - DNA, 22 bp, Artificial Sequence
  Synthetic oligonucleotide; CTG chr2 60484334 60484355 60484351 60484356 +
cctcctctcttccccttttcct

SEQ ID NO: 198906 - DNA, 22 bp, Artificial Sequence
  Synthetic oligonucleotide; CTC chr2 60484338 60484359 60484355 60484360 +
ctctcttccccttttcctcctt

SEQ ID NO: 198907 - DNA, 22 bp, Artificial Sequence
  Synthetic oligonucleotide; CTC chr2 60484341 60484362 60484358 60484363 +
tcttccccttttcctcctttct

SEQ ID NO: 198908 - DNA, 22 bp, Artificial Sequence
  Synthetic oligonucleotide; CTC chr2 60484343 60484364 60484360 60484365 +
ttccccttttcctcctttctac

SEQ ID NO: 198909 - DNA, 22 bp, Artificial Sequence
  Synthetic oligonucleotide; CTT chr2 60484345 60484366 60484362 60484367 +
ccccttttcctcctttctactt

SEQ ID NO: 198910 - DNA, 22 bp, Artificial Sequence
  Synthetic oligonucleotide; TTC chr2 60484346 60484367 60484363 60484368 +
cccttttcctcctttctacttc

SEQ ID NO: 198911 - DNA, 22 bp, Artificial Sequence
  Synthetic oligonucleotide; CTT chr2 60484351 60484372 60484368 60484373 +
ttcctcctttctacttccttgc

SEQ ID NO: 198912 - DNA, 22 bp, Artificial Sequence
  Synthetic oligonucleotide; TTT chr2 60484352 60484373 60484369 60484374 +
tcctcctttctacttccttgcc

SEQ ID NO: 198913 - DNA, 22 bp, Artificial Sequence
  Synthetic oligonucleotide; TTT chr2 60484353 60484374 60484370 60484375 +
cctcctttctacttccttgcct

SEQ ID NO: 198914 - DNA, 22 bp, Artificial Sequence
  Synthetic oligonucleotide; TTC chr2 60484354 60484375 60484371 60484376 +
ctcctttctacttccttgcctc

SEQ ID NO: 198915 - DNA, 22 bp, Artificial Sequence
  Synthetic oligonucleotide; CTC chr2 60484357 60484378 60484374 60484379 +
ctttctacttccttgcctctct

SEQ ID NO: 198916 - DNA, 22 bp, Artificial Sequence
  Synthetic oligonucleotide; CTT chr2 60484360 60484381 60484377 60484382 +
tctacttccttgcctctctttc

SEQ ID NO: 198917 - DNA, 22 bp, Artificial Sequence
  Synthetic oligonucleotide; TTT chr2 60484361 60484382 60484378 60484383 +
ctacttccttgcctctctttct

SEQ ID NO: 198918 - DNA, 22 bp, Artificial Sequence
  Synthetic oligonucleotide; TTC chr2 60484362 60484383 60484379 60484384 +
tacttccttgcctctctttctc

SEQ ID NO: 198919 - DNA, 22 bp, Artificial Sequence
  Synthetic oligonucleotide; CTA chr2 60484364 60484385 60484381 60484386 +
cttccttgcctctctttctcca

SEQ ID NO: 198920 - DNA, 22 bp, Artificial Sequence
  Synthetic oligonucleotide; CTT chr2 60484367 60484388 60484384 60484389 +
ccttgcctctctttctccaacc

SEQ ID NO: 198921 - DNA, 22 bp, Artificial Sequence
  Synthetic oligonucleotide; TTC chr2 60484368 60484389 60484385 60484390 +
cttgcctctctttctccaacct

SEQ ID NO: 198922 - DNA, 22 bp, Artificial Sequence
  Synthetic oligonucleotide; CTT chr2 60484371 60484392 60484388 60484393 +
gcctctctttctccaacctctg

SEQ ID NO: 198923 - DNA, 22 bp, Artificial Sequence
  Synthetic oligonucleotide; TTG chr2 60484372 60484393 60484389 60484394 +
cctctctttctccaacctctgt

SEQ ID NO: 198924 - DNA, 22 bp, Artificial Sequence
  Synthetic oligonucleotide; CTC chr2 60484376 60484397 60484393 60484398 +
tctttctccaacctctgtttcc

SEQ ID NO: 198925 - DNA, 22 bp, Artificial Sequence
  Synthetic oligonucleotide; CTC chr2 60484378 60484399 60484395 60484400 +
tttctccaacctctgtttccag

SEQ ID NO: 198926 - DNA, 22 bp, Artificial Sequence
  Synthetic oligonucleotide; CTT chr2 60484380 60484401 60484397 60484402 +
tctccaacctctgtttccagca

SEQ ID NO: 198927 - DNA, 22 bp, Artificial Sequence
  Synthetic oligonucleotide; TTT chr2 60484381 60484402 60484398 60484403 +
ctccaacctctgtttccagcat

SEQ ID NO: 198928 - DNA, 22 bp, Artificial Sequence
  Synthetic oligonucleotide; TTC chr2 60484382 60484403 60484399 60484404 +
tccaacctctgtttccagcatc

SEQ ID NO: 198929 - DNA, 22 bp, Artificial Sequence
  Synthetic oligonucleotide; CTC chr2 60484384 60484405 60484401 60484406 +
caacctctgtttccagcatctt

SEQ ID NO: 198930 - DNA, 22 bp, Artificial Sequence
  Synthetic oligonucleotide; CTC chr2 60484391 60484412 60484408 60484413 +
tgtttccagcatcttctttctc

SEQ ID NO: 198931 - DNA, 22 bp, Artificial Sequence
  Synthetic oligonucleotide; CTG chr2 60484393 60484414 60484410 60484415 +
tttccagcatcttctttctcat

SEQ ID NO: 198932 - DNA, 22 bp, Artificial Sequence
  Synthetic oligonucleotide; TTT chr2 60484396 60484417 60484413 60484418 +
ccagcatcttctttctcatctt

SEQ ID NO: 198933 - DNA, 22 bp, Artificial Sequence
  Synthetic oligonucleotide; TTC chr2 60484397 60484418 60484414 60484419 +
cagcatcttctttctcatcttc

SEQ ID NO: 198934 - DNA, 22 bp, Artificial Sequence
  Synthetic oligonucleotide; CTT chr2 60484406 60484427 60484423 60484428 +
ctttctcatcttctctctcttt

SEQ ID NO: 198935 - DNA, 22 bp, Artificial Sequence
  Synthetic oligonucleotide; TTC chr2 60484407 60484428 60484424 60484429 +
tttctcatcttctctctcttta

SEQ ID NO: 198936 - DNA, 22 bp, Artificial Sequence
  Synthetic oligonucleotide; CTT chr2 60484409 60484430 60484426 60484431 +
tctcatcttctctctctttagt

SEQ ID NO: 198937 - DNA, 22 bp, Artificial Sequence
  Synthetic oligonucleotide; TTT chr2 60484410 60484431 60484427 60484432 +
ctcatcttctctctctttagtc

SEQ ID NO: 198938 - DNA, 22 bp, Artificial Sequence
  Synthetic oligonucleotide; TTC chr2 60484411 60484432 60484428 60484433 +
tcatcttctctctctttagtcc

SEQ ID NO: 198939 - DNA, 22 bp, Artificial Sequence
  Synthetic oligonucleotide; CTC chr2 60484413 60484434 60484430 60484435 +
atcttctctctctttagtcctc

SEQ ID NO: 198940 - DNA, 22 bp, Artificial Sequence
  Synthetic oligonucleotide; CTT chr2 60484418 60484439 60484435 60484440 +
ctctctctttagtcctcaacaa

SEQ ID NO: 198941 - DNA, 22 bp, Artificial Sequence
  Synthetic oligonucleotide; TTC chr2 60484419 60484440 60484436 60484441 +
tctctctttagtcctcaacaac

SEQ ID NO: 198942 - DNA, 22 bp, Artificial Sequence
  Synthetic oligonucleotide; CTC chr2 60484421 60484442 60484438 60484443 +
tctctttagtcctcaacaactg

SEQ ID NO: 198943 - DNA, 22 bp, Artificial Sequence
  Synthetic oligonucleotide; CTC chr2 60484423 60484444 60484440 60484445 +
tctttagtcctcaacaactggg

SEQ ID NO: 198944 - DNA, 22 bp, Artificial Sequence
  Synthetic oligonucleotide; CTC chr2 60484425 60484446 60484442 60484447 +
tttagtcctcaacaactggggt

SEQ ID NO: 198945 - DNA, 22 bp, Artificial Sequence
  Synthetic oligonucleotide; CTT chr2 60484427 60484448 60484444 60484449 +
tagtcctcaacaactggggtcc

SEQ ID NO: 198946 - DNA, 22 bp, Artificial Sequence
  Synthetic oligonucleotide; TTT chr2 60484428 60484449 60484445 60484450 +
agtcctcaacaactggggtcct

SEQ ID NO: 198947 - DNA, 22 bp, Artificial Sequence
  Synthetic oligonucleotide; TTA chr2 60484429 60484450 60484446 60484451 +
gtcctcaacaactggggtcctc

SEQ ID NO: 198948 - DNA, 22 bp, Artificial Sequence
  Synthetic oligonucleotide; CTC chr2 60484435 60484456 60484452 60484457 +
aacaactggggtcctctgctgt

SEQ ID NO: 198949 - DNA, 22 bp, Artificial Sequence
  Synthetic oligonucleotide; CTG chr2 60484443 60484464 60484460 60484465 +
gggtcctctgctgtcaaaaaca

SEQ ID NO: 198950 - DNA, 22 bp, Artificial Sequence
  Synthetic oligonucleotide; CTC chr2 60484451 60484472 60484468 60484473 +
tgctgtcaaaaacagccacatt

SEQ ID NO: 198951 - DNA, 22 bp, Artificial Sequence
  Synthetic oligonucleotide; CTG chr2 60484453 60484474 60484470 60484475 +
ctgtcaaaaacagccacattca

SEQ ID NO: 198952 - DNA, 22 bp, Artificial Sequence
  Synthetic oligonucleotide; CTG chr2 60484456 60484477 60484473 60484478 +
tcaaaaacagccacattcacca

SEQ ID NO: 198953 - DNA, 22 bp, Artificial Sequence
  Synthetic oligonucleotide; TTC chr2 60484474 60484495 60484491 60484496 +
accagaaagggaagtaggtttt

SEQ ID NO: 198954 - DNA, 22 bp, Artificial Sequence
  Synthetic oligonucleotide; TTT chr2 60484495 60484516 60484512 60484517 +
tacagataaaccgggttgcttt

SEQ ID NO: 198955 - DNA, 22 bp, Artificial Sequence
  Synthetic oligonucleotide; TTT chr2 60484496 60484517 60484513 60484518 +
acagataaaccgggttgctttt

SEQ ID NO: 198956 - DNA, 22 bp, Artificial Sequence
  Synthetic oligonucleotide; TTA chr2 60484497 60484518 60484514 60484519 +
cagataaaccgggttgcttttc

SEQ ID NO: 198957 - DNA, 22 bp, Artificial Sequence
  Synthetic oligonucleotide; TTG chr2 60484513 60484534 60484530 60484535 +
cttttcactgaaacagcagtga

SEQ ID NO: 198958 - DNA, 22 bp, Artificial Sequence
  Synthetic oligonucleotide; CTT chr2 60484516 60484537 60484533 60484538 +
ttcactgaaacagcagtgattg

SEQ ID NO: 198959 - DNA, 22 bp, Artificial Sequence
  Synthetic oligonucleotide; TTT chr2 60484517 60484538 60484534 60484539 +
tcactgaaacagcagtgattgt

SEQ ID NO: 198960 - DNA, 22 bp, Artificial Sequence
  Synthetic oligonucleotide; TTT chr2 60484518 60484539 60484535 60484540 +
cactgaaacagcagtgattgtg

SEQ ID NO: 198961 - DNA, 22 bp, Artificial Sequence
  Synthetic oligonucleotide; TTC chr2 60484519 60484540 60484536 60484541 +
actgaaacagcagtgattgtgg

SEQ ID NO: 198962 - DNA, 22 bp, Artificial Sequence
  Synthetic oligonucleotide; CTG chr2 60484523 60484544 60484540 60484545 +
aaacagcagtgattgtggaaca

SEQ ID NO: 198963 - DNA, 22 bp, Artificial Sequence
  Synthetic oligonucleotide; TTG chr2 60484538 60484559 60484555 60484560 +
tggaacagaaactctcccctcc

SEQ ID NO: 198964 - DNA, 22 bp, Artificial Sequence
  Synthetic oligonucleotide; CTC chr2 60484552 60484573 60484569 60484574 +
tcccctccctgccttttaaata

SEQ ID NO: 198965 - DNA, 22 bp, Artificial Sequence
  Synthetic oligonucleotide; CTC chr2 60484554 60484575 60484571 60484576 +
ccctccctgccttttaaataat

SEQ ID NO: 198966 - DNA, 22 bp, Artificial Sequence
  Synthetic oligonucleotide; CTC chr2 60484559 60484580 60484576 60484581 +
cctgccttttaaataatatttc

SEQ ID NO: 198967 - DNA, 22 bp, Artificial Sequence
  Synthetic oligonucleotide; CTG chr2 60484563 60484584 60484580 60484585 +
ccttttaaataatatttcctat

SEQ ID NO: 198968 - DNA, 22 bp, Artificial Sequence
  Synthetic oligonucleotide; CTT chr2 60484567 60484588 60484584 60484589 +
ttaaataatatttcctattttt

SEQ ID NO: 198969 - DNA, 22 bp, Artificial Sequence
  Synthetic oligonucleotide; TTT chr2 60484568 60484589 60484585 60484590 +
taaataatatttcctatttttt

SEQ ID NO: 198970 - DNA, 22 bp, Artificial Sequence
  Synthetic oligonucleotide; TTT chr2 60484569 60484590 60484586 60484591 +
aaataatatttcctattttttt

SEQ ID NO: 198971 - DNA, 22 bp, Artificial Sequence
  Synthetic oligonucleotide; TTA chr2 60484570 60484591 60484587 60484592 +
aataatatttcctatttttttg

SEQ ID NO: 198972 - DNA, 22 bp, Artificial Sequence
  Synthetic oligonucleotide; TTT chr2 60484580 60484601 60484597 60484602 +
cctatttttttgcaccggtcag

SEQ ID NO: 198973 - DNA, 22 bp, Artificial Sequence
  Synthetic oligonucleotide; TTC chr2 60484581 60484602 60484598 60484603 +
ctatttttttgcaccggtcagc

SEQ ID NO: 198974 - DNA, 22 bp, Artificial Sequence
  Synthetic oligonucleotide; CTA chr2 60484584 60484605 60484601 60484606 +
tttttttgcaccggtcagcagc

SEQ ID NO: 198975 - DNA, 22 bp, Artificial Sequence
  Synthetic oligonucleotide; TTT chr2 60484587 60484608 60484604 60484609 +
ttttgcaccggtcagcagccgc

SEQ ID NO: 198976 - DNA, 22 bp, Artificial Sequence
  Synthetic oligonucleotide; TTT chr2 60484588 60484609 60484605 60484610 +
tttgcaccggtcagcagccgca

SEQ ID NO: 198977 - DNA, 22 bp, Artificial Sequence
  Synthetic oligonucleotide; TTT chr2 60484589 60484610 60484606 60484611 +
ttgcaccggtcagcagccgcac

SEQ ID NO: 198978 - DNA, 22 bp, Artificial Sequence
  Synthetic oligonucleotide; TTT chr2 60484590 60484611 60484607 60484612 +
tgcaccggtcagcagccgcacc

SEQ ID NO: 198979 - DNA, 22 bp, Artificial Sequence
  Synthetic oligonucleotide; TTT chr2 60484591 60484612 60484608 60484613 +
gcaccggtcagcagccgcacct

SEQ ID NO: 198980 - DNA, 22 bp, Artificial Sequence
  Synthetic oligonucleotide; TTG chr2 60484592 60484613 60484609 60484614 +
caccggtcagcagccgcacctg

SEQ ID NO: 198981 - DNA, 22 bp, Artificial Sequence
  Synthetic oligonucleotide; CTG chr2 60484614 60484635 60484631 60484636 +
gtgaggctgaggtcaaggctgt

SEQ ID NO: 198982 - DNA, 22 bp, Artificial Sequence
  Synthetic oligonucleotide; CTG chr2 60484623 60484644 60484640 60484645 +
aggtcaaggctgtacttccaac

SEQ ID NO: 198983 - DNA, 22 bp, Artificial Sequence
  Synthetic oligonucleotide; CTG chr2 60484635 60484656 60484652 60484657 +
tacttccaacatggctcacgtg

SEQ ID NO: 198984 - DNA, 22 bp, Artificial Sequence
  Synthetic oligonucleotide; CTT chr2 60484640 60484661 60484657 60484662 +
ccaacatggctcacgtgttttt

SEQ ID NO: 198985 - DNA, 22 bp, Artificial Sequence
  Synthetic oligonucleotide; TTC chr2 60484641 60484662 60484658 60484663 +
caacatggctcacgtgtttttt

SEQ ID NO: 198986 - DNA, 22 bp, Artificial Sequence
  Synthetic oligonucleotide; CTC chr2 60484652 60484673 60484669 60484674 +
acgtgttttttcttaagagaag

SEQ ID NO: 198987 - DNA, 22 bp, Artificial Sequence
  Synthetic oligonucleotide; TTT chr2 60484660 60484681 60484677 60484682 +
tttcttaagagaagggggaatt

SEQ ID NO: 198988 - DNA, 22 bp, Artificial Sequence
  Synthetic oligonucleotide; TTT chr2 60484661 60484682 60484678 60484683 +
ttcttaagagaagggggaattt

SEQ ID NO: 198989 - DNA, 22 bp, Artificial Sequence
  Synthetic oligonucleotide; TTT chr2 60484662 60484683 60484679 60484684 +
tcttaagagaagggggaatttg

SEQ ID NO: 198990 - DNA, 22 bp, Artificial Sequence
  Synthetic oligonucleotide; TTT chr2 60484663 60484684 60484680 60484685 +
cttaagagaagggggaatttgg

SEQ ID NO: 198991 - DNA, 22 bp, Artificial Sequence
  Synthetic oligonucleotide; TTC chr2 60484664 60484685 60484681 60484686 +
ttaagagaagggggaatttgga

SEQ ID NO: 198992 - DNA, 22 bp, Artificial Sequence
  Synthetic oligonucleotide; CTT chr2 60484666 60484687 60484683 60484688 +
aagagaagggggaatttggagg

SEQ ID NO: 198993 - DNA, 22 bp, Artificial Sequence
  Synthetic oligonucleotide; TTA chr2 60484667 60484688 60484684 60484689 +
agagaagggggaatttggaggg

SEQ ID NO: 198994 - DNA, 22 bp, Artificial Sequence
  Synthetic oligonucleotide; TTT chr2 60484683 60484704 60484700 60484705 +
ggaggggggcaaaaaaagaagg

SEQ ID NO: 198995 - DNA, 22 bp, Artificial Sequence
  Synthetic oligonucleotide; TTG chr2 60484684 60484705 60484701 60484706 +
gaggggggcaaaaaaagaagga

SEQ ID NO: 198996 - DNA, 22 bp, Artificial Sequence
  Synthetic oligonucleotide; TTA chr2 60484724 60484745 60484741 60484746 +
accactcgagaaaaaatgcaca

SEQ ID NO: 198997 - DNA, 22 bp, Artificial Sequence
  Synthetic oligonucleotide; CTC chr2 60484731 60484752 60484748 60484753 +
gagaaaaaatgcacatgggctg

SEQ ID NO: 198998 - DNA, 22 bp, Artificial Sequence
  Synthetic oligonucleotide; CTG chr2 60484753 60484774 60484770 60484775 +
aggtttcctgcccttatcacca

SEQ ID NO: 198999 - DNA, 22 bp, Artificial Sequence
  Synthetic oligonucleotide; TTT chr2 60484759 60484780 60484776 60484781 +
cctgcccttatcaccattccag

SEQ ID NO: 199000 - DNA, 22 bp, Artificial Sequence
  Synthetic oligonucleotide; TTC chr2 60484760 60484781 60484777 60484782 +
ctgcccttatcaccattccagt

SEQ ID NO: 199001 - DNA, 22 bp, Artificial Sequence
  Synthetic oligonucleotide; CTG chr2 60484763 60484784 60484780 60484785 +
cccttatcaccattccagtata

SEQ ID NO: 199002 - DNA, 22 bp, Artificial Sequence
  Synthetic oligonucleotide; CTT chr2 60484768 60484789 60484785 60484790 +
atcaccattccagtataaaacc

SEQ ID NO: 199003 - DNA, 22 bp, Artificial Sequence
  Synthetic oligonucleotide; TTA chr2 60484769 60484790 60484786 60484791 +
tcaccattccagtataaaacct

SEQ ID NO: 199004 - DNA, 22 bp, Artificial Sequence
  Synthetic oligonucleotide; TTC chr2 60484778 60484799 60484795 60484800 +
cagtataaaacctcaaattatg

SEQ ID NO: 199005 - DNA, 22 bp, Artificial Sequence
  Synthetic oligonucleotide; CTC chr2 60484792 60484813 60484809 60484814 +
aaattatgggaattctcactta

SEQ ID NO: 199006 - DNA, 22 bp, Artificial Sequence
  Synthetic oligonucleotide; TTA chr2 60484798 60484819 60484815 60484820 +
tgggaattctcacttaggaaca

SEQ ID NO: 199007 - DNA, 22 bp, Artificial Sequence
  Synthetic oligonucleotide; TTC chr2 60484807 60484828 60484824 60484829 +
tcacttaggaacacctcattat

SEQ ID NO: 199008 - DNA, 22 bp, Artificial Sequence
  Synthetic oligonucleotide; CTC chr2 60484809 60484830 60484826 60484831 +
acttaggaacacctcattatgg

SEQ ID NO: 199009 - DNA, 22 bp, Artificial Sequence
  Synthetic oligonucleotide; CTT chr2 60484813 60484834 60484830 60484835 +
aggaacacctcattatggaaca

SEQ ID NO: 199010 - DNA, 22 bp, Artificial Sequence
  Synthetic oligonucleotide; TTA chr2 60484814 60484835 60484831 60484836 +
ggaacacctcattatggaacat

SEQ ID NO: 199011 - DNA, 22 bp, Artificial Sequence
  Synthetic oligonucleotide; CTC chr2 60484824 60484845 60484841 60484846 +
attatggaacatatgtgctggg

SEQ ID NO: 199012 - DNA, 22 bp, Artificial Sequence
  Synthetic oligonucleotide; TTA chr2 60484828 60484849 60484845 60484850 +
tggaacatatgtgctgggggtc

SEQ ID NO: 199013 - DNA, 22 bp, Artificial Sequence
  Synthetic oligonucleotide; CTG chr2 60484844 60484865 60484861 60484866 +
ggggtctggggagatgggagaa

SEQ ID NO: 199014 - DNA, 22 bp, Artificial Sequence
  Synthetic oligonucleotide; CTG chr2 60484852 60484873 60484869 60484874 +
gggagatgggagaaggggtgtg

SEQ ID NO: 199015 - DNA, 22 bp, Artificial Sequence
  Synthetic oligonucleotide; TTC chr2 60484879 60484900 60484896 60484901 +
atgaccatgtgtgtaaacttgt

SEQ ID NO: 199016 - DNA, 22 bp, Artificial Sequence
  Synthetic oligonucleotide; CTT chr2 60484899 60484920 60484916 60484921 +
gtgtgctccaaattttatcaag

SEQ ID NO: 199017 - DNA, 22 bp, Artificial Sequence
  Synthetic oligonucleotide; TTG chr2 60484900 60484921 60484917 60484922 +
tgtgctccaaattttatcaagt

SEQ ID NO: 199018 - DNA, 22 bp, Artificial Sequence
  Synthetic oligonucleotide; CTC chr2 60484907 60484928 60484924 60484929 +
caaattttatcaagttcaagcc

SEQ ID NO: 199019 - DNA, 22 bp, Artificial Sequence
  Synthetic oligonucleotide; TTT chr2 60484914 60484935 60484931 60484936 +
tatcaagttcaagccaaaaaga

SEQ ID NO: 199020 - DNA, 22 bp, Artificial Sequence
  Synthetic oligonucleotide; TTT chr2 60484915 60484936 60484932 60484937 +
atcaagttcaagccaaaaagaa

SEQ ID NO: 199021 - DNA, 22 bp, Artificial Sequence
  Synthetic oligonucleotide; TTA chr2 60484916 60484937 60484933 60484938 +
tcaagttcaagccaaaaagaaa

SEQ ID NO: 199022 - DNA, 22 bp, Artificial Sequence
  Synthetic oligonucleotide; TTC chr2 60484924 60484945 60484941 60484946 +
aagccaaaaagaaatcctctgt

SEQ ID NO: 199023 - DNA, 22 bp, Artificial Sequence
  Synthetic oligonucleotide; CTC chr2 60484943 60484964 60484960 60484965 +
tgtggcacttgtttaggactta

SEQ ID NO: 199024 - DNA, 22 bp, Artificial Sequence
  Synthetic oligonucleotide; CTG chr2 60484945 60484966 60484962 60484967 +
tggcacttgtttaggacttaaa

SEQ ID NO: 199025 - DNA, 22 bp, Artificial Sequence
  Synthetic oligonucleotide; CTT chr2 60484953 60484974 60484970 60484975 +
gtttaggacttaaaaaaaaaaa

SEQ ID NO: 199026 - DNA, 22 bp, Artificial Sequence
  Synthetic oligonucleotide; TTG chr2 60484954 60484975 60484971 60484976 +
tttaggacttaaaaaaaaaaaa

SEQ ID NO: 199027 - DNA, 22 bp, Artificial Sequence
  Synthetic oligonucleotide; TTT chr2 60484957 60484978 60484974 60484979 +
aggacttaaaaaaaaaaaaaaa

SEQ ID NO: 199028 - DNA, 22 bp, Artificial Sequence
  Synthetic oligonucleotide; TTA chr2 60484958 60484979 60484975 60484980 +
ggacttaaaaaaaaaaaaaaaa

SEQ ID NO: 199029 - DNA, 22 bp, Artificial Sequence
  Synthetic oligonucleotide; CTT chr2 60484964 60484985 60484981 60484986 +
aaaaaaaaaaaaaaaaaaccaa

SEQ ID NO: 199030 - DNA, 22 bp, Artificial Sequence
  Synthetic oligonucleotide; TTA chr2 60484965 60484986 60484982 60484987 +
aaaaaaaaaaaaaaaaaccaac

SEQ ID NO: 199031 - DNA, 22 bp, Artificial Sequence
  Synthetic oligonucleotide; TTT chr2 60485010 60485031 60485027 60485032 +
aaatcaaaataggaaatacaaa

SEQ ID NO: 199032 - DNA, 22 bp, Artificial Sequence
  Synthetic oligonucleotide; TTA chr2 60485011 60485032 60485028 60485033 +
aatcaaaataggaaatacaaaa

SEQ ID NO: 199033 - DNA, 22 bp, Artificial Sequence
  Synthetic oligonucleotide; TTT chr2 60485041 60485062 60485058 60485063 +
gtacaccctcaccaccaccacc

SEQ ID NO: 199034 - DNA, 22 bp, Artificial Sequence
  Synthetic oligonucleotide; TTG chr2 60485042 60485063 60485059 60485064 +
tacaccctcaccaccaccacca

SEQ ID NO: 199035 - DNA, 22 bp, Artificial Sequence
  Synthetic oligonucleotide; CTC chr2 60485051 60485072 60485068 60485073 +
accaccaccaccaaggcatagc

SEQ ID NO: 199036 - DNA, 22 bp, Artificial Sequence
  Synthetic oligonucleotide; CTT chr2 60485076 60485097 60485093 60485098 +
ggaagaaaaaggcatcccttgc

SEQ ID NO: 199037 - DNA, 22 bp, Artificial Sequence
  Synthetic oligonucleotide; TTG chr2 60485077 60485098 60485094 60485099 +
gaagaaaaaggcatcccttgca

SEQ ID NO: 199038 - DNA, 22 bp, Artificial Sequence
  Synthetic oligonucleotide; CTT chr2 60485096 60485117 60485113 60485118 +
gcagccacaatttcgcaagttg

SEQ ID NO: 199039 - DNA, 22 bp, Artificial Sequence
  Synthetic oligonucleotide; TTG chr2 60485097 60485118 60485114 60485119 +
cagccacaatttcgcaagttga

SEQ ID NO: 199040 - DNA, 22 bp, Artificial Sequence
  Synthetic oligonucleotide; TTT chr2 60485109 60485130 60485126 60485131 +
cgcaagttgaccttttcaccag

SEQ ID NO: 199041 - DNA, 22 bp, Artificial Sequence
  Synthetic oligonucleotide; TTC chr2 60485110 60485131 60485127 60485132 +
gcaagttgaccttttcaccagg

SEQ ID NO: 199042 - DNA, 22 bp, Artificial Sequence
  Synthetic oligonucleotide; TTG chr2 60485118 60485139 60485135 60485140 +
accttttcaccaggccagtgcc

SEQ ID NO: 199043 - DNA, 22 bp, Artificial Sequence
  Synthetic oligonucleotide; CTT chr2 60485123 60485144 60485140 60485145 +
ttcaccaggccagtgcctaatt

SEQ ID NO: 199044 - DNA, 22 bp, Artificial Sequence
  Synthetic oligonucleotide; TTT chr2 60485124 60485145 60485141 60485146 +
tcaccaggccagtgcctaattt

SEQ ID NO: 199045 - DNA, 22 bp, Artificial Sequence
  Synthetic oligonucleotide; TTT chr2 60485125 60485146 60485142 60485147 +
caccaggccagtgcctaatttc

SEQ ID NO: 199046 - DNA, 22 bp, Artificial Sequence
  Synthetic oligonucleotide; TTC chr2 60485126 60485147 60485143 60485148 +
accaggccagtgcctaatttcc

SEQ ID NO: 199047 - DNA, 22 bp, Artificial Sequence
  Synthetic oligonucleotide; CTA chr2 60485142 60485163 60485159 60485164 +
atttcctaaacaggccccttct

SEQ ID NO: 199048 - DNA, 22 bp, Artificial Sequence
  Synthetic oligonucleotide; TTT chr2 60485146 60485167 60485163 60485168 +
cctaaacaggccccttcttcct

SEQ ID NO: 199049 - DNA, 22 bp, Artificial Sequence
  Synthetic oligonucleotide; TTC chr2 60485147 60485168 60485164 60485169 +
ctaaacaggccccttcttcctt

SEQ ID NO: 199050 - DNA, 22 bp, Artificial Sequence
  Synthetic oligonucleotide; CTA chr2 60485150 60485171 60485167 60485172 +
aacaggccccttcttccttgaa

SEQ ID NO: 199051 - DNA, 22 bp, Artificial Sequence
  Synthetic oligonucleotide; CTT chr2 60485162 60485183 60485179 60485184 +
cttccttgaagtcactgcaaat

SEQ ID NO: 199052 - DNA, 22 bp, Artificial Sequence
  Synthetic oligonucleotide; TTC chr2 60485163 60485184 60485180 60485185 +
ttccttgaagtcactgcaaata

SEQ ID NO: 199053 - DNA, 22 bp, Artificial Sequence
  Synthetic oligonucleotide; CTT chr2 60485165 60485186 60485182 60485187 +
ccttgaagtcactgcaaataaa

SEQ ID NO: 199054 - DNA, 22 bp, Artificial Sequence
  Synthetic oligonucleotide; TTC chr2 60485166 60485187 60485183 60485188 +
cttgaagtcactgcaaataaat

SEQ ID NO: 199055 - DNA, 22 bp, Artificial Sequence
  Synthetic oligonucleotide; CTT chr2 60485169 60485190 60485186 60485191 +
gaagtcactgcaaataaatgca

SEQ ID NO: 199056 - DNA, 22 bp, Artificial Sequence
  Synthetic oligonucleotide; TTG chr2 60485170 60485191 60485187 60485192 +
aagtcactgcaaataaatgcag

SEQ ID NO: 199057 - DNA, 22 bp, Artificial Sequence
  Synthetic oligonucleotide; CTG chr2 60485179 60485200 60485196 60485201 +
caaataaatgcagtcatccaga

SEQ ID NO: 199058 - DNA, 22 bp, Artificial Sequence
  Synthetic oligonucleotide; CTG chr2 60485217 60485238 60485234 60485239 +
gccttggagttactggcttatg

SEQ ID NO: 199059 - DNA, 22 bp, Artificial Sequence
  Synthetic oligonucleotide; CTT chr2 60485222 60485243 60485239 60485244 +
ggagttactggcttatgaaatg

SEQ ID NO: 199060 - DNA, 22 bp, Artificial Sequence
  Synthetic oligonucleotide; TTG chr2 60485223 60485244 60485240 60485245 +
gagttactggcttatgaaatgc

SEQ ID NO: 199061 - DNA, 22 bp, Artificial Sequence
  Synthetic oligonucleotide; TTA chr2 60485229 60485250 60485246 60485251 +
ctggcttatgaaatgcaatggg

SEQ ID NO: 199062 - DNA, 22 bp, Artificial Sequence
  Synthetic oligonucleotide; CTG chr2 60485232 60485253 60485249 60485254 +
gcttatgaaatgcaatgggatg

SEQ ID NO: 199063 - DNA, 22 bp, Artificial Sequence
  Synthetic oligonucleotide; CTT chr2 60485236 60485257 60485253 60485258 +
atgaaatgcaatgggatgaggt

SEQ ID NO: 199064 - DNA, 22 bp, Artificial Sequence
  Synthetic oligonucleotide; TTA chr2 60485237 60485258 60485254 60485259 +
tgaaatgcaatgggatgaggtg

SEQ ID NO: 199065 - DNA, 22 bp, Artificial Sequence
  Synthetic oligonucleotide; CTG chr2 60485284 60485305 60485301 60485306 +
aacggcacagtgaccaggtagg

SEQ ID NO: 199066 - DNA, 22 bp, Artificial Sequence
  Synthetic oligonucleotide; CTC chr2 60485323 60485344 60485340 60485345 +
cagcaagaatgccaaggatagc

SEQ ID NO: 199067 - DNA, 22 bp, Artificial Sequence
  Synthetic oligonucleotide; CTG chr2 60485348 60485369 60485365 60485370 +
cagtgggttattagccccagca

SEQ ID NO: 199068 - DNA, 22 bp, Artificial Sequence
  Synthetic oligonucleotide; TTA chr2 60485358 60485379 60485375 60485380 +
ttagccccagcagggcccatgc

SEQ ID NO: 199069 - DNA, 22 bp, Artificial Sequence
  Synthetic oligonucleotide; TTA chr2 60485361 60485382 60485378 60485383 +
gccccagcagggcccatgcctc

SEQ ID NO: 199070 - DNA, 22 bp, Artificial Sequence
  Synthetic oligonucleotide; CTC chr2 60485383 60485404 60485400 60485405 +
tacggccatgttgctgtcatct

SEQ ID NO: 199071 - DNA, 22 bp, Artificial Sequence
  Synthetic oligonucleotide; CTA chr2 60485385 60485406 60485402 60485407 +
cggccatgttgctgtcatcttc

SEQ ID NO: 199072 - DNA, 22 bp, Artificial Sequence
  Synthetic oligonucleotide; TTG chr2 60485396 60485417 60485413 60485418 +
ctgtcatcttcgttcttggcta

SEQ ID NO: 199073 - DNA, 22 bp, Artificial Sequence
  Synthetic oligonucleotide; CTG chr2 60485399 60485420 60485416 60485421 +
tcatcttcgttcttggctagca

SEQ ID NO: 199074 - DNA, 22 bp, Artificial Sequence
  Synthetic oligonucleotide; CTT chr2 60485406 60485427 60485423 60485428 +
cgttcttggctagcagatgcta

SEQ ID NO: 199075 - DNA, 22 bp, Artificial Sequence
  Synthetic oligonucleotide; TTC chr2 60485407 60485428 60485424 60485429 +
gttcttggctagcagatgctag

SEQ ID NO: 199076 - DNA, 22 bp, Artificial Sequence
  Synthetic oligonucleotide; TTC chr2 60485411 60485432 60485428 60485433 +
ttggctagcagatgctagtccc

SEQ ID NO: 199077 - DNA, 22 bp, Artificial Sequence
  Synthetic oligonucleotide; CTT chr2 60485413 60485434 60485430 60485435 +
ggctagcagatgctagtcccag

SEQ ID NO: 199078 - DNA, 22 bp, Artificial Sequence
  Synthetic oligonucleotide; TTG chr2 60485414 60485435 60485431 60485436 +
gctagcagatgctagtcccagg

SEQ ID NO: 199079 - DNA, 22 bp, Artificial Sequence
  Synthetic oligonucleotide; CTA chr2 60485418 60485439 60485435 60485440 +
gcagatgctagtcccaggaatg

SEQ ID NO: 199080 - DNA, 22 bp, Artificial Sequence
  Synthetic oligonucleotide; CTA chr2 60485428 60485449 60485445 60485450 +
gtcccaggaatgtcctccatgc

SEQ ID NO: 199081 - DNA, 22 bp, Artificial Sequence
  Synthetic oligonucleotide; CTC chr2 60485445 60485466 60485462 60485467 +
catgcctttaagctaactgcaa

SEQ ID NO: 199082 - DNA, 22 bp, Artificial Sequence
  Synthetic oligonucleotide; CTT chr2 60485453 60485474 60485470 60485475 +
taagctaactgcaaaaacagaa

SEQ ID NO: 199083 - DNA, 22 bp, Artificial Sequence
  Synthetic oligonucleotide; TTT chr2 60485454 60485475 60485471 60485476 +
aagctaactgcaaaaacagaac

SEQ ID NO: 199084 - DNA, 22 bp, Artificial Sequence
  Synthetic oligonucleotide; TTA chr2 60485455 60485476 60485472 60485477 +
agctaactgcaaaaacagaacg

SEQ ID NO: 199085 - DNA, 22 bp, Artificial Sequence
  Synthetic oligonucleotide; CTA chr2 60485460 60485481 60485477 60485482 +
actgcaaaaacagaacggtgtg

SEQ ID NO: 199086 - DNA, 22 bp, Artificial Sequence
  Synthetic oligonucleotide; CTG chr2 60485464 60485485 60485481 60485486 +
caaaaacagaacggtgtgagcc

SEQ ID NO: 199087 - DNA, 22 bp, Artificial Sequence
  Synthetic oligonucleotide; CTC chr2 60485504 60485525 60485521 60485526 +
ttttatattctacctataaggg

SEQ ID NO: 199088 - DNA, 22 bp, Artificial Sequence
  Synthetic oligonucleotide; CTT chr2 60485506 60485527 60485523 60485528 +
ttatattctacctataagggaa

SEQ ID NO: 199089 - DNA, 22 bp, Artificial Sequence
  Synthetic oligonucleotide; TTT chr2 60485507 60485528 60485524 60485529 +
tatattctacctataagggaaa

SEQ ID NO: 199090 - DNA, 22 bp, Artificial Sequence
  Synthetic oligonucleotide; TTT chr2 60485508 60485529 60485525 60485530 +
atattctacctataagggaaaa

SEQ ID NO: 199091 - DNA, 22 bp, Artificial Sequence
  Synthetic oligonucleotide; TTA chr2 60485509 60485530 60485526 60485531 +
tattctacctataagggaaaaa

SEQ ID NO: 199092 - DNA, 22 bp, Artificial Sequence
  Synthetic oligonucleotide; TTC chr2 60485514 60485535 60485531 60485536 +
tacctataagggaaaaataaac

SEQ ID NO: 199093 - DNA, 22 bp, Artificial Sequence
  Synthetic oligonucleotide; CTA chr2 60485516 60485537 60485533 60485538 +
cctataagggaaaaataaacct

SEQ ID NO: 199094 - DNA, 22 bp, Artificial Sequence
  Synthetic oligonucleotide; CTA chr2 60485520 60485541 60485537 60485542 +
taagggaaaaataaacctagac

SEQ ID NO: 199095 - DNA, 22 bp, Artificial Sequence
  Synthetic oligonucleotide; CTA chr2 60485539 60485560 60485556 60485561 +
gacctggaaaacaatgtgtaaa

SEQ ID NO: 199096 - DNA, 22 bp, Artificial Sequence
  Synthetic oligonucleotide; CTG chr2 60485545 60485566 60485562 60485567 +
gaaaacaatgtgtaaagtggca

SEQ ID NO: 199097 - DNA, 22 bp, Artificial Sequence
  Synthetic oligonucleotide; CTC chr2 60485582 60485603 60485599 60485604 +
atttaaaaagaaaaaccctcca

SEQ ID NO: 199098 - DNA, 22 bp, Artificial Sequence
  Synthetic oligonucleotide; TTT chr2 60485586 60485607 60485603 60485608 +
aaaaagaaaaaccctccatcca

SEQ ID NO: 199099 - DNA, 22 bp, Artificial Sequence
  Synthetic oligonucleotide; TTA chr2 60485587 60485608 60485604 60485609 +
aaaagaaaaaccctccatccaa

SEQ ID NO: 199100 - DNA, 22 bp, Artificial Sequence
  Synthetic oligonucleotide; CTC chr2 60485602 60485623 60485619 60485624 +
catccaacgtcacgaagctgct

SEQ ID NO: 199101 - DNA, 22 bp, Artificial Sequence
  Synthetic oligonucleotide; CTG chr2 60485622 60485643 60485639 60485644 +
ctgaatattaggttcctgggaa

SEQ ID NO: 199102 - DNA, 22 bp, Artificial Sequence
  Synthetic oligonucleotide; CTG chr2 60485625 60485646 60485642 60485647 +
aatattaggttcctgggaagct

SEQ ID NO: 199103 - DNA, 22 bp, Artificial Sequence
  Synthetic oligonucleotide; TTA chr2 60485632 60485653 60485649 60485654 +
ggttcctgggaagctgtcccag

SEQ ID NO: 199104 - DNA, 22 bp, Artificial Sequence
  Synthetic oligonucleotide; TTC chr2 60485637 60485658 60485654 60485659 +
ctgggaagctgtcccagcaacc

SEQ ID NO: 199105 - DNA, 22 bp, Artificial Sequence
  Synthetic oligonucleotide; CTG chr2 60485640 60485661 60485657 60485662 +
ggaagctgtcccagcaacctag

SEQ ID NO: 199106 - DNA, 22 bp, Artificial Sequence
  Synthetic oligonucleotide; CTG chr2 60485648 60485669 60485665 60485670 +
tcccagcaacctagatatgaga

SEQ ID NO: 199107 - DNA, 22 bp, Artificial Sequence
  Synthetic oligonucleotide; CTA chr2 60485661 60485682 60485678 60485683 +
gatatgagaaacaacgcttgct

SEQ ID NO: 199108 - DNA, 22 bp, Artificial Sequence
  Synthetic oligonucleotide; CTT chr2 60485680 60485701 60485697 60485702 +
gctattctggggtgagaagtga

SEQ ID NO: 199109 - DNA, 22 bp, Artificial Sequence
  Synthetic oligonucleotide; TTG chr2 60485681 60485702 60485698 60485703 +
ctattctggggtgagaagtgaa

SEQ ID NO: 199110 - DNA, 22 bp, Artificial Sequence
  Synthetic oligonucleotide; CTA chr2 60485684 60485705 60485701 60485706 +
ttctggggtgagaagtgaagtt

SEQ ID NO: 199111 - DNA, 22 bp, Artificial Sequence
  Synthetic oligonucleotide; TTC chr2 60485687 60485708 60485704 60485709 +
tggggtgagaagtgaagttgcc

SEQ ID NO: 199112 - DNA, 22 bp, Artificial Sequence
  Synthetic oligonucleotide; CTG chr2 60485689 60485710 60485706 60485711 +
gggtgagaagtgaagttgcctt

SEQ ID NO: 199113 - DNA, 22 bp, Artificial Sequence
  Synthetic oligonucleotide; TTG chr2 60485707 60485728 60485724 60485729 +
cctttcactcgggactgtcaaa

SEQ ID NO: 199114 - DNA, 22 bp, Artificial Sequence
  Synthetic oligonucleotide; CTT chr2 60485711 60485732 60485728 60485733 +
tcactcgggactgtcaaacaca

SEQ ID NO: 199115 - DNA, 22 bp, Artificial Sequence
  Synthetic oligonucleotide; TTT chr2 60485712 60485733 60485729 60485734 +
cactcgggactgtcaaacacag

SEQ ID NO: 199116 - DNA, 22 bp, Artificial Sequence
  Synthetic oligonucleotide; TTC chr2 60485713 60485734 60485730 60485735 +
actcgggactgtcaaacacagt

SEQ ID NO: 199117 - DNA, 22 bp, Artificial Sequence
  Synthetic oligonucleotide; CTC chr2 60485717 60485738 60485734 60485739 +
gggactgtcaaacacagtctat

SEQ ID NO: 199118 - DNA, 22 bp, Artificial Sequence
  Synthetic oligonucleotide; CTG chr2 60485724 60485745 60485741 60485746 +
tcaaacacagtctataaatacc

SEQ ID NO: 199119 - DNA, 22 bp, Artificial Sequence
  Synthetic oligonucleotide; CTA chr2 60485738 60485759 60485755 60485760 +
taaataccagcaatgccccttg

SEQ ID NO: 199120 - DNA, 22 bp, Artificial Sequence
  Synthetic oligonucleotide; CTT chr2 60485759 60485780 60485776 60485781 +
gtgaactacgggctgagctcaa

SEQ ID NO: 199121 - DNA, 22 bp, Artificial Sequence
  Synthetic oligonucleotide; TTG chr2 60485760 60485781 60485777 60485782 +
tgaactacgggctgagctcaac

SEQ ID NO: 199122 - DNA, 22 bp, Artificial Sequence
  Synthetic oligonucleotide; CTA chr2 60485767 60485788 60485784 60485789 +
cgggctgagctcaacccagaga

SEQ ID NO: 199123 - DNA, 22 bp, Artificial Sequence
  Synthetic oligonucleotide; CTG chr2 60485774 60485795 60485791 60485796 +
agctcaacccagagaaggcaag

SEQ ID NO: 199124 - DNA, 22 bp, Artificial Sequence
  Synthetic oligonucleotide; CTC chr2 60485779 60485800 60485796 60485801 +
aacccagagaaggcaagtgttt

SEQ ID NO: 199125 - DNA, 22 bp, Artificial Sequence
  Synthetic oligonucleotide; TTT chr2 60485801 60485822 60485818 60485823 +
cccaaaggtcacacagcaattc

SEQ ID NO: 199126 - DNA, 22 bp, Artificial Sequence
  Synthetic oligonucleotide; TTC chr2 60485802 60485823 60485819 60485824 +
ccaaaggtcacacagcaattcc

SEQ ID NO: 199127 - DNA, 22 bp, Artificial Sequence
  Synthetic oligonucleotide; TTC chr2 60485823 60485844 60485840 60485845 +
caggtcccccagaagtagccct

SEQ ID NO: 199128 - DNA, 22 bp, Artificial Sequence
  Synthetic oligonucleotide; CTT chr2 60485846 60485867 60485863 60485868 +
caccagatggatcccatcacca

SEQ ID NO: 199129 - DNA, 22 bp, Artificial Sequence
  Synthetic oligonucleotide; TTC chr2 60485847 60485868 60485864 60485869 +
accagatggatcccatcaccag

SEQ ID NO: 199130 - DNA, 22 bp, Artificial Sequence
  Synthetic oligonucleotide; CTC chr2 60485876 60485897 60485893 60485898 +
ttggaaataatacattgctgca

SEQ ID NO: 199131 - DNA, 22 bp, Artificial Sequence
  Synthetic oligonucleotide; CTT chr2 60485878 60485899 60485895 60485900 +
ggaaataatacattgctgcatc

SEQ ID NO: 199132 - DNA, 22 bp, Artificial Sequence
  Synthetic oligonucleotide; TTG chr2 60485879 60485900 60485896 60485901 +
gaaataatacattgctgcatct

SEQ ID NO: 199133 - DNA, 22 bp, Artificial Sequence
  Synthetic oligonucleotide; TTG chr2 60485893 60485914 60485910 60485915 +
ctgcatctgattctcattttca

SEQ ID NO: 199134 - DNA, 22 bp, Artificial Sequence
  Synthetic oligonucleotide; CTG chr2 60485896 60485917 60485913 60485918 +
catctgattctcattttcaaca

SEQ ID NO: 199135 - DNA, 22 bp, Artificial Sequence
  Synthetic oligonucleotide; CTG chr2 60485902 60485923 60485919 60485924 +
attctcattttcaacaagaagg

SEQ ID NO: 199136 - DNA, 22 bp, Artificial Sequence
  Synthetic oligonucleotide; TTC chr2 60485906 60485927 60485923 60485928 +
tcattttcaacaagaaggctga

SEQ ID NO: 199137 - DNA, 22 bp, Artificial Sequence
  Synthetic oligonucleotide; CTC chr2 60485908 60485929 60485925 60485930 +
attttcaacaagaaggctgagg

SEQ ID NO: 199138 - DNA, 22 bp, Artificial Sequence
  Synthetic oligonucleotide; TTT chr2 60485912 60485933 60485929 60485934 +
tcaacaagaaggctgaggaatg

SEQ ID NO: 199139 - DNA, 22 bp, Artificial Sequence
  Synthetic oligonucleotide; TTT chr2 60485913 60485934 60485930 60485935 +
caacaagaaggctgaggaatga

SEQ ID NO: 199140 - DNA, 22 bp, Artificial Sequence
  Synthetic oligonucleotide; TTC chr2 60485914 60485935 60485931 60485936 +
aacaagaaggctgaggaatgag

SEQ ID NO: 199141 - DNA, 22 bp, Artificial Sequence
  Synthetic oligonucleotide; CTG chr2 60485927 60485948 60485944 60485949 +
aggaatgagattgcacatttta

SEQ ID NO: 199142 - DNA, 22 bp, Artificial Sequence
  Synthetic oligonucleotide; TTG chr2 60485940 60485961 60485957 60485962 +
cacattttagtttccttcccca

SEQ ID NO: 199143 - DNA, 22 bp, Artificial Sequence
  Synthetic oligonucleotide; TTT chr2 60485947 60485968 60485964 60485969 +
tagtttccttccccaactttct

SEQ ID NO: 199144 - DNA, 22 bp, Artificial Sequence
  Synthetic oligonucleotide; TTT chr2 60485948 60485969 60485965 60485970 +
agtttccttccccaactttctt

SEQ ID NO: 199145 - DNA, 22 bp, Artificial Sequence
  Synthetic oligonucleotide; TTA chr2 60485949 60485970 60485966 60485971 +
gtttccttccccaactttcttt

SEQ ID NO: 199146 - DNA, 22 bp, Artificial Sequence
  Synthetic oligonucleotide; TTT chr2 60485953 60485974 60485970 60485975 +
ccttccccaactttctttctcc

SEQ ID NO: 199147 - DNA, 22 bp, Artificial Sequence
  Synthetic oligonucleotide; TTC chr2 60485954 60485975 60485971 60485976 +
cttccccaactttctttctcca

SEQ ID NO: 199148 - DNA, 22 bp, Artificial Sequence
  Synthetic oligonucleotide; CTT chr2 60485957 60485978 60485974 60485979 +
ccccaactttctttctccaacc

SEQ ID NO: 199149 - DNA, 22 bp, Artificial Sequence
  Synthetic oligonucleotide; TTC chr2 60485958 60485979 60485975 60485980 +
cccaactttctttctccaacct

SEQ ID NO: 199150 - DNA, 22 bp, Artificial Sequence
  Synthetic oligonucleotide; CTT chr2 60485966 60485987 60485983 60485988 +
tctttctccaaccttctgctct

SEQ ID NO: 199151 - DNA, 22 bp, Artificial Sequence
  Synthetic oligonucleotide; TTT chr2 60485967 60485988 60485984 60485989 +
ctttctccaaccttctgctctg

SEQ ID NO: 199152 - DNA, 22 bp, Artificial Sequence
  Synthetic oligonucleotide; TTC chr2 60485968 60485989 60485985 60485990 +
tttctccaaccttctgctctgg

SEQ ID NO: 199153 - DNA, 22 bp, Artificial Sequence
  Synthetic oligonucleotide; CTT chr2 60485970 60485991 60485987 60485992 +
tctccaaccttctgctctggtt

SEQ ID NO: 199154 - DNA, 22 bp, Artificial Sequence
  Synthetic oligonucleotide; TTT chr2 60485971 60485992 60485988 60485993 +
ctccaaccttctgctctggttc

SEQ ID NO: 199155 - DNA, 22 bp, Artificial Sequence
  Synthetic oligonucleotide; TTC chr2 60485972 60485993 60485989 60485994 +
tccaaccttctgctctggttct

SEQ ID NO: 199156 - DNA, 22 bp, Artificial Sequence
  Synthetic oligonucleotide; CTC chr2 60485974 60485995 60485991 60485996 +
caaccttctgctctggttctcc

SEQ ID NO: 199157 - DNA, 22 bp, Artificial Sequence
  Synthetic oligonucleotide; CTT chr2 60485981 60486002 60485998 60486003 +
ctgctctggttctcctctcccc

SEQ ID NO: 199158 - DNA, 22 bp, Artificial Sequence
  Synthetic oligonucleotide; TTC chr2 60485982 60486003 60485999 60486004 +
tgctctggttctcctctccccc

SEQ ID NO: 199159 - DNA, 22 bp, Artificial Sequence
  Synthetic oligonucleotide; CTG chr2 60485984 60486005 60486001 60486006 +
ctctggttctcctctcccccac

SEQ ID NO: 199160 - DNA, 22 bp, Artificial Sequence
  Synthetic oligonucleotide; CTC chr2 60485987 60486008 60486004 60486009 +
tggttctcctctcccccaccac

SEQ ID NO: 199161 - DNA, 22 bp, Artificial Sequence
  Synthetic oligonucleotide; CTG chr2 60485989 60486010 60486006 60486011 +
gttctcctctcccccaccacac

SEQ ID NO: 199162 - DNA, 22 bp, Artificial Sequence
  Synthetic oligonucleotide; TTC chr2 60485993 60486014 60486010 60486015 +
tcctctcccccaccacacgtac

SEQ ID NO: 199163 - DNA, 22 bp, Artificial Sequence
  Synthetic oligonucleotide; CTC chr2 60485995 60486016 60486012 60486017 +
ctctcccccaccacacgtacaa

SEQ ID NO: 199164 - DNA, 22 bp, Artificial Sequence
  Synthetic oligonucleotide; CTC chr2 60485998 60486019 60486015 60486020 +
tcccccaccacacgtacaaaaa

SEQ ID NO: 199165 - DNA, 22 bp, Artificial Sequence
  Synthetic oligonucleotide; CTC chr2 60486000 60486021 60486017 60486022 +
ccccaccacacgtacaaaaaaa

SEQ ID NO: 199166 - DNA, 22 bp, Artificial Sequence
  Synthetic oligonucleotide; CTT chr2 60486027 60486048 60486044 60486049 +
tttagtatgtttagggatctat

SEQ ID NO: 199167 - DNA, 22 bp, Artificial Sequence
  Synthetic oligonucleotide; TTT chr2 60486028 60486049 60486045 60486050 +
ttagtatgtttagggatctatt

SEQ ID NO: 199168 - DNA, 22 bp, Artificial Sequence
  Synthetic oligonucleotide; TTT chr2 60486029 60486050 60486046 60486051 +
tagtatgtttagggatctattt

SEQ ID NO: 199169 - DNA, 22 bp, Artificial Sequence
  Synthetic oligonucleotide; TTT chr2 60486030 60486051 60486047 60486052 +
agtatgtttagggatctatttc

SEQ ID NO: 199170 - DNA, 22 bp, Artificial Sequence
  Synthetic oligonucleotide; TTA chr2 60486031 60486052 60486048 60486053 +
gtatgtttagggatctatttcc

SEQ ID NO: 199171 - DNA, 22 bp, Artificial Sequence
  Synthetic oligonucleotide; TTT chr2 60486039 60486060 60486056 60486061 +
agggatctatttccatatctac

SEQ ID NO: 199172 - DNA, 22 bp, Artificial Sequence
  Synthetic oligonucleotide; TTA chr2 60486040 60486061 60486057 60486062 +
gggatctatttccatatctacc

SEQ ID NO: 199173 - DNA, 22 bp, Artificial Sequence
  Synthetic oligonucleotide; CTA chr2 60486048 60486069 60486065 60486070 +
tttccatatctacccaaaatct

SEQ ID NO: 199174 - DNA, 22 bp, Artificial Sequence
  Synthetic oligonucleotide; TTT chr2 60486051 60486072 60486068 60486073 +
ccatatctacccaaaatctcca

SEQ ID NO: 199175 - DNA, 22 bp, Artificial Sequence
  Synthetic oligonucleotide; TTC chr2 60486052 60486073 60486069 60486074 +
catatctacccaaaatctccaa

SEQ ID NO: 199176 - DNA, 22 bp, Artificial Sequence
  Synthetic oligonucleotide; CTA chr2 60486060 60486081 60486077 60486082 +
cccaaaatctccaagccccttg

SEQ ID NO: 199177 - DNA, 22 bp, Artificial Sequence
  Synthetic oligonucleotide; CTC chr2 60486071 60486092 60486088 60486093 +
caagccccttgttctatcagca

SEQ ID NO: 199178 - DNA, 22 bp, Artificial Sequence
  Synthetic oligonucleotide; CTT chr2 60486081 60486102 60486098 60486103 +
gttctatcagcaggtcaagagt

SEQ ID NO: 199179 - DNA, 22 bp, Artificial Sequence
  Synthetic oligonucleotide; TTG chr2 60486082 60486103 60486099 60486104 +
ttctatcagcaggtcaagagta

SEQ ID NO: 199180 - DNA, 22 bp, Artificial Sequence
  Synthetic oligonucleotide; TTC chr2 60486085 60486106 60486102 60486107 +
tatcagcaggtcaagagtagag

SEQ ID NO: 199181 - DNA, 22 bp, Artificial Sequence
  Synthetic oligonucleotide; CTA chr2 60486087 60486108 60486104 60486109 +
tcagcaggtcaagagtagagaa

SEQ ID NO: 199182 - DNA, 22 bp, Artificial Sequence
  Synthetic oligonucleotide; CTG chr2 60486112 60486133 60486129 60486134 +
tgacaagctgttctccattctg

SEQ ID NO: 199183 - DNA, 22 bp, Artificial Sequence
  Synthetic oligonucleotide; CTG chr2 60486122 60486143 60486139 60486144 +
ttctccattctgaaatggattt

SEQ ID NO: 199184 - DNA, 22 bp, Artificial Sequence
  Synthetic oligonucleotide; TTC chr2 60486125 60486146 60486142 60486147 +
tccattctgaaatggatttgac

SEQ ID NO: 199185 - DNA, 22 bp, Artificial Sequence
  Synthetic oligonucleotide; CTC chr2 60486127 60486148 60486144 60486149 +
cattctgaaatggatttgactg

SEQ ID NO: 199186 - DNA, 22 bp, Artificial Sequence
  Synthetic oligonucleotide; TTC chr2 60486132 60486153 60486149 60486154 +
tgaaatggatttgactgaacag

SEQ ID NO: 199187 - DNA, 22 bp, Artificial Sequence
  Synthetic oligonucleotide; CTG chr2 60486134 60486155 60486151 60486156 +
aaatggatttgactgaacagct

SEQ ID NO: 199188 - DNA, 22 bp, Artificial Sequence
  Synthetic oligonucleotide; TTT chr2 60486144 60486165 60486161 60486166 +
gactgaacagctgctgaaaggc

SEQ ID NO: 199189 - DNA, 22 bp, Artificial Sequence
  Synthetic oligonucleotide; TTG chr2 60486145 60486166 60486162 60486167 +
actgaacagctgctgaaaggca

SEQ ID NO: 199190 - DNA, 22 bp, Artificial Sequence
  Synthetic oligonucleotide; CTG chr2 60486149 60486170 60486166 60486171 +
aacagctgctgaaaggcaagac

SEQ ID NO: 199191 - DNA, 22 bp, Artificial Sequence
  Synthetic oligonucleotide; CTG chr2 60486157 60486178 60486174 60486179 +
ctgaaaggcaagacatcctagg

SEQ ID NO: 199192 - DNA, 22 bp, Artificial Sequence
  Synthetic oligonucleotide; CTG chr2 60486160 60486181 60486177 60486182 +
aaaggcaagacatcctagggag

SEQ ID NO: 199193 - DNA, 22 bp, Artificial Sequence
  Synthetic oligonucleotide; CTA chr2 60486177 60486198 60486194 60486199 +
gggagactggtactggggattt

SEQ ID NO: 199194 - DNA, 22 bp, Artificial Sequence
  Synthetic oligonucleotide; CTG chr2 60486186 60486207 60486203 60486208 +
gtactggggatttcagggtcct

SEQ ID NO: 199195 - DNA, 22 bp, Artificial Sequence
  Synthetic oligonucleotide; CTG chr2 60486192 60486213 60486209 60486214 +
gggatttcagggtccttgttct

SEQ ID NO: 199196 - DNA, 22 bp, Artificial Sequence
  Synthetic oligonucleotide; TTT chr2 60486199 60486220 60486216 60486221 +
cagggtccttgttctgtgggtg

SEQ ID NO: 199197 - DNA, 22 bp, Artificial Sequence
  Synthetic oligonucleotide; TTC chr2 60486200 60486221 60486217 60486222 +
agggtccttgttctgtgggtgg

SEQ ID NO: 199198 - DNA, 22 bp, Artificial Sequence
  Synthetic oligonucleotide; CTT chr2 60486209 60486230 60486226 60486231 +
gttctgtgggtggaccatggct

SEQ ID NO: 199199 - DNA, 22 bp, Artificial Sequence
  Synthetic oligonucleotide; TTG chr2 60486210 60486231 60486227 60486232 +
ttctgtgggtggaccatggctc

SEQ ID NO: 199200 - DNA, 22 bp, Artificial Sequence
  Synthetic oligonucleotide; TTC chr2 60486213 60486234 60486230 60486235 +
tgtgggtggaccatggctcctt

SEQ ID NO: 199201 - DNA, 22 bp, Artificial Sequence
  Synthetic oligonucleotide; CTG chr2 60486215 60486236 60486232 60486237 +
tgggtggaccatggctcctttc

SEQ ID NO: 199202 - DNA, 22 bp, Artificial Sequence
  Synthetic oligonucleotide; CTC chr2 60486232 60486253 60486249 60486254 +
ctttccagagaatgacttgtga

SEQ ID NO: 199203 - DNA, 22 bp, Artificial Sequence
  Synthetic oligonucleotide; CTT chr2 60486235 60486256 60486252 60486257 +
tccagagaatgacttgtgattt

SEQ ID NO: 199204 - DNA, 22 bp, Artificial Sequence
  Synthetic oligonucleotide; TTT chr2 60486236 60486257 60486253 60486258 +
ccagagaatgacttgtgatttg

SEQ ID NO: 199205 - DNA, 22 bp, Artificial Sequence
  Synthetic oligonucleotide; TTC chr2 60486237 60486258 60486254 60486259 +
cagagaatgacttgtgatttgt

SEQ ID NO: 199206 - DNA, 22 bp, Artificial Sequence
  Synthetic oligonucleotide; CTT chr2 60486250 60486271 60486267 60486272 +
gtgatttgttctctctcctaca

SEQ ID NO: 199207 - DNA, 22 bp, Artificial Sequence
  Synthetic oligonucleotide; TTG chr2 60486251 60486272 60486268 60486273 +
tgatttgttctctctcctacac

SEQ ID NO: 199208 - DNA, 22 bp, Artificial Sequence
  Synthetic oligonucleotide; TTT chr2 60486257 60486278 60486274 60486279 +
gttctctctcctacacatcaaa

SEQ ID NO: 199209 - DNA, 22 bp, Artificial Sequence
  Synthetic oligonucleotide; TTG chr2 60486258 60486279 60486275 60486280 +
ttctctctcctacacatcaaag

SEQ ID NO: 199210 - DNA, 22 bp, Artificial Sequence
  Synthetic oligonucleotide; TTC chr2 60486261 60486282 60486278 60486283 +
tctctcctacacatcaaagtga

SEQ ID NO: 199211 - DNA, 22 bp, Artificial Sequence
  Synthetic oligonucleotide; CTC chr2 60486263 60486284 60486280 60486285 +
tctcctacacatcaaagtgaga

SEQ ID NO: 199212 - DNA, 22 bp, Artificial Sequence
  Synthetic oligonucleotide; CTC chr2 60486265 60486286 60486282 60486287 +
tcctacacatcaaagtgagaca

SEQ ID NO: 199213 - DNA, 22 bp, Artificial Sequence
  Synthetic oligonucleotide; CTC chr2 60486267 60486288 60486284 60486289 +
ctacacatcaaagtgagacacc

SEQ ID NO: 199214 - DNA, 22 bp, Artificial Sequence
  Synthetic oligonucleotide; CTA chr2 60486270 60486291 60486287 60486292 +
cacatcaaagtgagacaccaat

SEQ ID NO: 199215 - DNA, 22 bp, Artificial Sequence
  Synthetic oligonucleotide; CTC chr2 60486300 60486321 60486317 60486322 +
tactggcccaccttgccccacc

SEQ ID NO: 199216 - DNA, 22 bp, Artificial Sequence
  Synthetic oligonucleotide; CTA chr2 60486302 60486323 60486319 60486324 +
ctggcccaccttgccccacctc

SEQ ID NO: 199217 - DNA, 22 bp, Artificial Sequence
  Synthetic oligonucleotide; CTG chr2 60486305 60486326 60486322 60486327 +
gcccaccttgccccacctccaa

SEQ ID NO: 199218 - DNA, 22 bp, Artificial Sequence
  Synthetic oligonucleotide; CTT chr2 60486314 60486335 60486331 60486336 +
gccccacctccaatttggcaac

SEQ ID NO: 199219 - DNA, 22 bp, Artificial Sequence
  Synthetic oligonucleotide; TTG chr2 60486315 60486336 60486332 60486337 +
ccccacctccaatttggcaact

SEQ ID NO: 199220 - DNA, 22 bp, Artificial Sequence
  Synthetic oligonucleotide; CTC chr2 60486324 60486345 60486341 60486346 +
caatttggcaactttgcctcct

SEQ ID NO: 199221 - DNA, 22 bp, Artificial Sequence
  Synthetic oligonucleotide; TTT chr2 60486330 60486351 60486347 60486352 +
ggcaactttgcctccttctcac

SEQ ID NO: 199222 - DNA, 22 bp, Artificial Sequence
  Synthetic oligonucleotide; TTG chr2 60486331 60486352 60486348 60486353 +
gcaactttgcctccttctcaca

SEQ ID NO: 199223 - DNA, 22 bp, Artificial Sequence
  Synthetic oligonucleotide; CTT chr2 60486338 60486359 60486355 60486360 +
tgcctccttctcacacaatgag

SEQ ID NO: 199224 - DNA, 22 bp, Artificial Sequence
  Synthetic oligonucleotide; TTT chr2 60486339 60486360 60486356 60486361 +
gcctccttctcacacaatgaga

SEQ ID NO: 199225 - DNA, 22 bp, Artificial Sequence
  Synthetic oligonucleotide; TTG chr2 60486340 60486361 60486357 60486362 +
cctccttctcacacaatgagaa

SEQ ID NO: 199226 - DNA, 22 bp, Artificial Sequence
  Synthetic oligonucleotide; CTC chr2 60486344 60486365 60486361 60486366 +
cttctcacacaatgagaaagaa

SEQ ID NO: 199227 - DNA, 22 bp, Artificial Sequence
  Synthetic oligonucleotide; CTT chr2 60486347 60486368 60486364 60486369 +
ctcacacaatgagaaagaacgg

SEQ ID NO: 199228 - DNA, 22 bp, Artificial Sequence
  Synthetic oligonucleotide; TTC chr2 60486348 60486369 60486365 60486370 +
tcacacaatgagaaagaacgga

SEQ ID NO: 199229 - DNA, 22 bp, Artificial Sequence
  Synthetic oligonucleotide; CTC chr2 60486350 60486371 60486367 60486372 +
acacaatgagaaagaacggata

SEQ ID NO: 199230 - DNA, 22 bp, Artificial Sequence
  Synthetic oligonucleotide; TTC chr2 60486381 60486402 60486398 60486403 +
taagagttcactttctgcacat

SEQ ID NO: 199231 - DNA, 22 bp, Artificial Sequence
  Synthetic oligonucleotide; CTA chr2 60486383 60486404 60486400 60486405 +
agagttcactttctgcacatat

SEQ ID NO: 199232 - DNA, 22 bp, Artificial Sequence
  Synthetic oligonucleotide; TTC chr2 60486390 60486411 60486407 60486412 +
actttctgcacatatgtgtagt

SEQ ID NO: 199233 - DNA, 22 bp, Artificial Sequence
  Synthetic oligonucleotide; CTT chr2 60486394 60486415 60486411 60486416 +
tctgcacatatgtgtagttaag

SEQ ID NO: 199234 - DNA, 22 bp, Artificial Sequence
  Synthetic oligonucleotide; TTT chr2 60486395 60486416 60486412 60486417 +
ctgcacatatgtgtagttaagt

SEQ ID NO: 199235 - DNA, 22 bp, Artificial Sequence
  Synthetic oligonucleotide; TTC chr2 60486396 60486417 60486413 60486418 +
tgcacatatgtgtagttaagta

SEQ ID NO: 199236 - DNA, 22 bp, Artificial Sequence
  Synthetic oligonucleotide; CTG chr2 60486398 60486419 60486415 60486420 +
cacatatgtgtagttaagtact

SEQ ID NO: 199237 - DNA, 22 bp, Artificial Sequence
  Synthetic oligonucleotide; TTA chr2 60486414 60486435 60486431 60486436 +
agtactgaagtgagaaattcaa

SEQ ID NO: 199238 - DNA, 22 bp, Artificial Sequence
  Synthetic oligonucleotide; CTG chr2 60486421 60486442 60486438 60486443 +
aagtgagaaattcaagaaaact

SEQ ID NO: 199239 - DNA, 22 bp, Artificial Sequence
  Synthetic oligonucleotide; TTC chr2 60486434 60486455 60486451 60486456 +
aagaaaactatacttaggcaca

SEQ ID NO: 199240 - DNA, 22 bp, Artificial Sequence
  Synthetic oligonucleotide; CTA chr2 60486444 60486465 60486461 60486466 +
tacttaggcacacacacacaca

SEQ ID NO: 199241 - DNA, 22 bp, Artificial Sequence
  Synthetic oligonucleotide; CTT chr2 60486449 60486470 60486466 60486471 +
aggcacacacacacacattttg

SEQ ID NO: 199242 - DNA, 22 bp, Artificial Sequence
  Synthetic oligonucleotide; TTA chr2 60486450 60486471 60486467 60486472 +
ggcacacacacacacattttga

SEQ ID NO: 199243 - DNA, 22 bp, Artificial Sequence
  Synthetic oligonucleotide; TTT chr2 60486469 60486490 60486486 60486491 +
tgagagataatttctaaagacc

SEQ ID NO: 199244 - DNA, 22 bp, Artificial Sequence
  Synthetic oligonucleotide; TTT chr2 60486470 60486491 60486487 60486492 +
gagagataatttctaaagacct

SEQ ID NO: 199245 - DNA, 22 bp, Artificial Sequence
  Synthetic oligonucleotide; TTG chr2 60486471 60486492 60486488 60486493 +
agagataatttctaaagaccta

SEQ ID NO: 199246 - DNA, 22 bp, Artificial Sequence
  Synthetic oligonucleotide; TTT chr2 60486482 60486503 60486499 60486504 +
ctaaagacctaccaatctaaga

SEQ ID NO: 199247 - DNA, 22 bp, Artificial Sequence
  Synthetic oligonucleotide; TTC chr2 60486483 60486504 60486500 60486505 +
taaagacctaccaatctaagat

SEQ ID NO: 199248 - DNA, 22 bp, Artificial Sequence
  Synthetic oligonucleotide; CTA chr2 60486485 60486506 60486502 60486507 +
aagacctaccaatctaagatac

SEQ ID NO: 199249 - DNA, 22 bp, Artificial Sequence
  Synthetic oligonucleotide; CTA chr2 60486493 60486514 60486510 60486515 +
ccaatctaagatactgaaagaa

SEQ ID NO: 199250 - DNA, 22 bp, Artificial Sequence
  Synthetic oligonucleotide; CTA chr2 60486501 60486522 60486518 60486523 +
agatactgaaagaaaatggcta

SEQ ID NO: 199251 - DNA, 22 bp, Artificial Sequence
  Synthetic oligonucleotide; CTG chr2 60486509 60486530 60486526 60486531 +
aaagaaaatggctacatcaggc

SEQ ID NO: 199252 - DNA, 22 bp, Artificial Sequence
  Synthetic oligonucleotide; CTA chr2 60486523 60486544 60486540 60486545 +
catcaggcccagaaaagccttg

SEQ ID NO: 199253 - DNA, 22 bp, Artificial Sequence
  Synthetic oligonucleotide; CTT chr2 60486544 60486565 60486561 60486566 +
gaaattttccctatccacagac

SEQ ID NO: 199254 - DNA, 22 bp, Artificial Sequence
  Synthetic oligonucleotide; TTG chr2 60486545 60486566 60486562 60486567 +
aaattttccctatccacagacc

SEQ ID NO: 199255 - DNA, 22 bp, Artificial Sequence
  Synthetic oligonucleotide; TTT chr2 60486551 60486572 60486568 60486573 +
tccctatccacagaccacagcc

SEQ ID NO: 199256 - DNA, 22 bp, Artificial Sequence
  Synthetic oligonucleotide; TTT chr2 60486552 60486573 60486569 60486574 +
ccctatccacagaccacagccc

SEQ ID NO: 199257 - DNA, 22 bp, Artificial Sequence
  Synthetic oligonucleotide; TTC chr2 60486553 60486574 60486570 60486575 +
cctatccacagaccacagccct

SEQ ID NO: 199258 - DNA, 22 bp, Artificial Sequence
  Synthetic oligonucleotide; CTA chr2 60486557 60486578 60486574 60486579 +
tccacagaccacagccctgtga

SEQ ID NO: 199259 - DNA, 22 bp, Artificial Sequence
  Synthetic oligonucleotide; CTG chr2 60486576 60486597 60486593 60486598 +
tgatggacatgagatcctctgg

SEQ ID NO: 199260 - DNA, 22 bp, Artificial Sequence
  Synthetic oligonucleotide; CTC chr2 60486595 60486616 60486612 60486617 +
tggctttgagatgaataatgca

SEQ ID NO: 199261 - DNA, 22 bp, Artificial Sequence
  Synthetic oligonucleotide; CTG chr2 60486597 60486618 60486614 60486619 +
gctttgagatgaataatgcaca

SEQ ID NO: 199262 - DNA, 22 bp, Artificial Sequence
  Synthetic oligonucleotide; CTT chr2 60486601 60486622 60486618 60486623 +
tgagatgaataatgcacagaaa

SEQ ID NO: 199263 - DNA, 22 bp, Artificial Sequence
  Synthetic oligonucleotide; TTT chr2 60486602 60486623 60486619 60486624 +
gagatgaataatgcacagaaat

SEQ ID NO: 199264 - DNA, 22 bp, Artificial Sequence
  Synthetic oligonucleotide; TTG chr2 60486603 60486624 60486620 60486625 +
agatgaataatgcacagaaatg

SEQ ID NO: 199265 - DNA, 22 bp, Artificial Sequence
  Synthetic oligonucleotide; TTA chr2 60486642 60486663 60486659 60486664 +
gctggcagattattaccagaca

SEQ ID NO: 199266 - DNA, 22 bp, Artificial Sequence
  Synthetic oligonucleotide; CTG chr2 60486646 60486667 60486663 60486668 +
gcagattattaccagacatgtg

SEQ ID NO: 199267 - DNA, 22 bp, Artificial Sequence
  Synthetic oligonucleotide; TTA chr2 60486654 60486675 60486671 60486676 +
ttaccagacatgtgaacatgcc

SEQ ID NO: 199268 - DNA, 22 bp, Artificial Sequence
  Synthetic oligonucleotide; TTA chr2 60486657 60486678 60486674 60486679 +
ccagacatgtgaacatgccaac

SEQ ID NO: 199269 - DNA, 22 bp, Artificial Sequence
  Synthetic oligonucleotide; CTC chr2 60486681 60486702 60486698 60486703 +
aacatcaggattgggcctgaaa

SEQ ID NO: 199270 - DNA, 22 bp, Artificial Sequence
  Synthetic oligonucleotide; TTG chr2 60486694 60486715 60486711 60486716 +
ggcctgaaacttctctcaggaa

SEQ ID NO: 199271 - DNA, 22 bp, Artificial Sequence
  Synthetic oligonucleotide; CTG chr2 60486700 60486721 60486717 60486722 +
aaacttctctcaggaaggcctt

SEQ ID NO: 199272 - DNA, 22 bp, Artificial Sequence
  Synthetic oligonucleotide; CTT chr2 60486706 60486727 60486723 60486728 +
ctctcaggaaggccttgatagc

SEQ ID NO: 199273 - DNA, 22 bp, Artificial Sequence
  Synthetic oligonucleotide; TTC chr2 60486707 60486728 60486724 60486729 +
tctcaggaaggccttgatagca

SEQ ID NO: 199274 - DNA, 22 bp, Artificial Sequence
  Synthetic oligonucleotide; CTC chr2 60486709 60486730 60486726 60486731 +
tcaggaaggccttgatagcatt

SEQ ID NO: 199275 - DNA, 22 bp, Artificial Sequence
  Synthetic oligonucleotide; CTC chr2 60486711 60486732 60486728 60486733 +
aggaaggccttgatagcattag

SEQ ID NO: 199276 - DNA, 22 bp, Artificial Sequence
  Synthetic oligonucleotide; CTT chr2 60486722 60486743 60486739 60486744 +
gatagcattagatggttgacag

SEQ ID NO: 199277 - DNA, 22 bp, Artificial Sequence
  Synthetic oligonucleotide; TTG chr2 60486723 60486744 60486740 60486745 +
atagcattagatggttgacaga

SEQ ID NO: 199278 - DNA, 22 bp, Artificial Sequence
  Synthetic oligonucleotide; TTA chr2 60486732 60486753 60486749 60486754 +
gatggttgacagaggtattaca

SEQ ID NO: 199279 - DNA, 22 bp, Artificial Sequence
  Synthetic oligonucleotide; TTG chr2 60486740 60486761 60486757 60486762 +
acagaggtattacagtgtgaca

SEQ ID NO: 199280 - DNA, 22 bp, Artificial Sequence
  Synthetic oligonucleotide; TTA chr2 60486752 60486773 60486769 60486774 +
cagtgtgacagagtctgagccc

SEQ ID NO: 199281 - DNA, 22 bp, Artificial Sequence
  Synthetic oligonucleotide; CTG chr2 60486769 60486790 60486786 60486791 +
agcccacagtctgagaatgacc

SEQ ID NO: 199282 - DNA, 22 bp, Artificial Sequence
  Synthetic oligonucleotide; CTG chr2 60486782 60486803 60486799 60486804 +
agaatgaccacatcccttccca

SEQ ID NO: 199283 - DNA, 22 bp, Artificial Sequence
  Synthetic oligonucleotide; CTT chr2 60486800 60486821 60486817 60486822 +
cccagggagacgttcccactca

SEQ ID NO: 199284 - DNA, 22 bp, Artificial Sequence
  Synthetic oligonucleotide; TTC chr2 60486801 60486822 60486818 60486823 +
ccagggagacgttcccactcaa

SEQ ID NO: 199285 - DNA, 22 bp, Artificial Sequence
  Synthetic oligonucleotide; TTC chr2 60486815 60486836 60486832 60486837 +
ccactcaacaccctgggaagac

SEQ ID NO: 199286 - DNA, 22 bp, Artificial Sequence
  Synthetic oligonucleotide; CTC chr2 60486821 60486842 60486838 60486843 +
aacaccctgggaagactactgc

SEQ ID NO: 199287 - DNA, 22 bp, Artificial Sequence
  Synthetic oligonucleotide; CTG chr2 60486830 60486851 60486847 60486852 +
ggaagactactgcgaatcactc

SEQ ID NO: 199288 - DNA, 22 bp, Artificial Sequence
  Synthetic oligonucleotide; CTA chr2 60486839 60486860 60486856 60486861 +
ctgcgaatcactctgtctctca

SEQ ID NO: 199289 - DNA, 22 bp, Artificial Sequence
  Synthetic oligonucleotide; CTG chr2 60486842 60486863 60486859 60486864 +
cgaatcactctgtctctcaaac

SEQ ID NO: 199290 - DNA, 22 bp, Artificial Sequence
  Synthetic oligonucleotide; CTC chr2 60486852 60486873 60486869 60486874 +
tgtctctcaaacctggccatgg

SEQ ID NO: 199291 - DNA, 22 bp, Artificial Sequence
  Synthetic oligonucleotide; CTG chr2 60486854 60486875 60486871 60486876 +
tctctcaaacctggccatggct

SEQ ID NO: 199292 - DNA, 22 bp, Artificial Sequence
  Synthetic oligonucleotide; CTC chr2 60486858 60486879 60486875 60486880 +
tcaaacctggccatggctcagc

SEQ ID NO: 199293 - DNA, 22 bp, Artificial Sequence
  Synthetic oligonucleotide; CTC chr2 60486860 60486881 60486877 60486882 +
aaacctggccatggctcagccc

SEQ ID NO: 199294 - DNA, 22 bp, Artificial Sequence
  Synthetic oligonucleotide; CTG chr2 60486867 60486888 60486884 60486889 +
gccatggctcagcccacgccct

SEQ ID NO: 199295 - DNA, 22 bp, Artificial Sequence
  Synthetic oligonucleotide; CTC chr2 60486877 60486898 60486894 60486899 +
agcccacgccctttcatgtatt

SEQ ID NO: 199296 - DNA, 22 bp, Artificial Sequence
  Synthetic oligonucleotide; CTT chr2 60486890 60486911 60486907 60486912 +
tcatgtatttgcccttttccct

SEQ ID NO: 199297 - DNA, 22 bp, Artificial Sequence
  Synthetic oligonucleotide; TTT chr2 60486891 60486912 60486908 60486913 +
catgtatttgcccttttccctg

SEQ ID NO: 199298 - DNA, 22 bp, Artificial Sequence
  Synthetic oligonucleotide; TTC chr2 60486892 60486913 60486909 60486914 +
atgtatttgcccttttccctgc

SEQ ID NO: 199299 - DNA, 22 bp, Artificial Sequence
  Synthetic oligonucleotide; TTT chr2 60486900 60486921 60486917 60486922 +
gcccttttccctgctaacagaa

SEQ ID NO: 199300 - DNA, 22 bp, Artificial Sequence
  Synthetic oligonucleotide; TTG chr2 60486901 60486922 60486918 60486923 +
cccttttccctgctaacagaaa

SEQ ID NO: 199301 - DNA, 22 bp, Artificial Sequence
  Synthetic oligonucleotide; CTT chr2 60486906 60486927 60486923 60486928 +
ttccctgctaacagaaatggaa

SEQ ID NO: 199302 - DNA, 22 bp, Artificial Sequence
  Synthetic oligonucleotide; TTT chr2 60486907 60486928 60486924 60486929 +
tccctgctaacagaaatggaat

SEQ ID NO: 199303 - DNA, 22 bp, Artificial Sequence
  Synthetic oligonucleotide; TTT chr2 60486908 60486929 60486925 60486930 +
ccctgctaacagaaatggaatc

SEQ ID NO: 199304 - DNA, 22 bp, Artificial Sequence
  Synthetic oligonucleotide; TTC chr2 60486909 60486930 60486926 60486931 +
cctgctaacagaaatggaatca

SEQ ID NO: 199305 - DNA, 22 bp, Artificial Sequence
  Synthetic oligonucleotide; CTG chr2 60486913 60486934 60486930 60486935 +
ctaacagaaatggaatcagaac

SEQ ID NO: 199306 - DNA, 22 bp, Artificial Sequence
  Synthetic oligonucleotide; CTA chr2 60486916 60486937 60486933 60486938 +
acagaaatggaatcagaacaaa

SEQ ID NO: 199307 - DNA, 22 bp, Artificial Sequence
  Synthetic oligonucleotide; TTA chr2 60486941 60486962 60486958 60486963 +
atatttaattttaagattacta

SEQ ID NO: 199308 - DNA, 22 bp, Artificial Sequence
  Synthetic oligonucleotide; TTT chr2 60486947 60486968 60486964 60486969 +
aattttaagattactattctat

SEQ ID NO: 199309 - DNA, 22 bp, Artificial Sequence
  Synthetic oligonucleotide; TTA chr2 60486948 60486969 60486965 60486970 +
attttaagattactattctatc

SEQ ID NO: 199310 - DNA, 22 bp, Artificial Sequence
  Synthetic oligonucleotide; TTT chr2 60486952 60486973 60486969 60486974 +
taagattactattctatcagaa

SEQ ID NO: 199311 - DNA, 22 bp, Artificial Sequence
  Synthetic oligonucleotide; TTT chr2 60486953 60486974 60486970 60486975 +
aagattactattctatcagaat

SEQ ID NO: 199312 - DNA, 22 bp, Artificial Sequence
  Synthetic oligonucleotide; TTA chr2 60486954 60486975 60486971 60486976 +
agattactattctatcagaata

SEQ ID NO: 199313 - DNA, 22 bp, Artificial Sequence
  Synthetic oligonucleotide; TTA chr2 60486960 60486981 60486977 60486982 +
ctattctatcagaataaaaaag

SEQ ID NO: 199314 - DNA, 22 bp, Artificial Sequence
  Synthetic oligonucleotide; CTA chr2 60486963 60486984 60486980 60486985 +
ttctatcagaataaaaaagact

SEQ ID NO: 199315 - DNA, 22 bp, Artificial Sequence
  Synthetic oligonucleotide; TTC chr2 60486966 60486987 60486983 60486988 +
tatcagaataaaaaagactcgg

SEQ ID NO: 199316 - DNA, 22 bp, Artificial Sequence
  Synthetic oligonucleotide; CTA chr2 60486968 60486989 60486985 60486990 +
tcagaataaaaaagactcggga

SEQ ID NO: 199317 - DNA, 22 bp, Artificial Sequence
  Synthetic oligonucleotide; CTC chr2 60486986 60487007 60487003 60487008 +
gggagattcaaagcgaaggcaa

SEQ ID NO: 199318 - DNA, 22 bp, Artificial Sequence
  Synthetic oligonucleotide; TTC chr2 60486995 60487016 60487012 60487017 +
aaagcgaaggcaaatgcccctc

SEQ ID NO: 199319 - DNA, 22 bp, Artificial Sequence
  Synthetic oligonucleotide; CTC chr2 60487017 60487038 60487034 60487039 +
ctttaagtctaacgttgctatt

SEQ ID NO: 199320 - DNA, 22 bp, Artificial Sequence
  Synthetic oligonucleotide; CTT chr2 60487020 60487041 60487037 60487042 +
taagtctaacgttgctattcag

SEQ ID NO: 199321 - DNA, 22 bp, Artificial Sequence
  Synthetic oligonucleotide; TTT chr2 60487021 60487042 60487038 60487043 +
aagtctaacgttgctattcagg

SEQ ID NO: 199322 - DNA, 22 bp, Artificial Sequence
  Synthetic oligonucleotide; TTA chr2 60487022 60487043 60487039 60487044 +
agtctaacgttgctattcaggc

SEQ ID NO: 199323 - DNA, 22 bp, Artificial Sequence
  Synthetic oligonucleotide; CTA chr2 60487028 60487049 60487045 60487050 +
acgttgctattcaggcatttag

SEQ ID NO: 199324 - DNA, 22 bp, Artificial Sequence
  Synthetic oligonucleotide; TTG chr2 60487034 60487055 60487051 60487056 +
ctattcaggcatttaggagcgc

SEQ ID NO: 199325 - DNA, 22 bp, Artificial Sequence
  Synthetic oligonucleotide; CTA chr2 60487037 60487058 60487054 60487059 +
ttcaggcatttaggagcgctag

SEQ ID NO: 199326 - DNA, 22 bp, Artificial Sequence
  Synthetic oligonucleotide; TTC chr2 60487040 60487061 60487057 60487062 +
aggcatttaggagcgctagaca

SEQ ID NO: 199327 - DNA, 22 bp, Artificial Sequence
  Synthetic oligonucleotide; TTT chr2 60487048 60487069 60487065 60487070 +
aggagcgctagacacagtgagt

SEQ ID NO: 199328 - DNA, 22 bp, Artificial Sequence
  Synthetic oligonucleotide; TTA chr2 60487049 60487070 60487066 60487071 +
ggagcgctagacacagtgagtt

SEQ ID NO: 199329 - DNA, 22 bp, Artificial Sequence
  Synthetic oligonucleotide; CTA chr2 60487058 60487079 60487075 60487080 +
gacacagtgagtttccctgcct

SEQ ID NO: 199330 - DNA, 22 bp, Artificial Sequence
  Synthetic oligonucleotide; TTT chr2 60487072 60487093 60487089 60487094 +
ccctgcctccaacctgtgattt

SEQ ID NO: 199331 - DNA, 22 bp, Artificial Sequence
  Synthetic oligonucleotide; TTC chr2 60487073 60487094 60487090 60487095 +
cctgcctccaacctgtgatttg

SEQ ID NO: 199332 - DNA, 22 bp, Artificial Sequence
  Synthetic oligonucleotide; CTG chr2 60487077 60487098 60487094 60487099 +
cctccaacctgtgatttgccac

SEQ ID NO: 199333 - DNA, 22 bp, Artificial Sequence
  Synthetic oligonucleotide; CTC chr2 60487081 60487102 60487098 60487103 +
caacctgtgatttgccacaagg

SEQ ID NO: 199334 - DNA, 22 bp, Artificial Sequence
  Synthetic oligonucleotide; CTG chr2 60487088 60487109 60487105 60487110 +
tgatttgccacaaggcaggaag

SEQ ID NO: 199335 - DNA, 22 bp, Artificial Sequence
  Synthetic oligonucleotide; TTT chr2 60487094 60487115 60487111 60487116 +
gccacaaggcaggaaggggaag

SEQ ID NO: 199336 - DNA, 22 bp, Artificial Sequence
  Synthetic oligonucleotide; TTG chr2 60487095 60487116 60487112 60487117 +
ccacaaggcaggaaggggaagg

SEQ ID NO: 199337 - DNA, 22 bp, Artificial Sequence
  Synthetic oligonucleotide; CTA chr2 60487134 60487155 60487151 60487156 +
agtgtgtgaagttctaaccttt

SEQ ID NO: 199338 - DNA, 22 bp, Artificial Sequence
  Synthetic oligonucleotide; TTC chr2 60487148 60487169 60487165 60487170 +
taaccttttacccatgtaatga

SEQ ID NO: 199339 - DNA, 22 bp, Artificial Sequence
  Synthetic oligonucleotide; CTA chr2 60487150 60487171 60487167 60487172 +
accttttacccatgtaatgatc

SEQ ID NO: 199340 - DNA, 22 bp, Artificial Sequence
  Synthetic oligonucleotide; CTT chr2 60487155 60487176 60487172 60487177 +
ttacccatgtaatgatctagtt

SEQ ID NO: 199341 - DNA, 22 bp, Artificial Sequence
  Synthetic oligonucleotide; TTT chr2 60487156 60487177 60487173 60487178 +
tacccatgtaatgatctagtta

SEQ ID NO: 199342 - DNA, 22 bp, Artificial Sequence
  Synthetic oligonucleotide; TTT chr2 60487157 60487178 60487174 60487179 +
acccatgtaatgatctagttaa

SEQ ID NO: 199343 - DNA, 22 bp, Artificial Sequence
  Synthetic oligonucleotide; TTA chr2 60487158 60487179 60487175 60487180 +
cccatgtaatgatctagttaat

SEQ ID NO: 199344 - DNA, 22 bp, Artificial Sequence
  Synthetic oligonucleotide; CTA chr2 60487174 60487195 60487191 60487196 +
gttaatgtaatattttgccttt

SEQ ID NO: 199345 - DNA, 22 bp, Artificial Sequence
  Synthetic oligonucleotide; TTA chr2 60487178 60487199 60487195 60487200 +
atgtaatattttgcctttaatc

SEQ ID NO: 199346 - DNA, 22 bp, Artificial Sequence
  Synthetic oligonucleotide; TTT chr2 60487189 60487210 60487206 60487211 +
tgcctttaatcaatgaaagagt

SEQ ID NO: 199347 - DNA, 22 bp, Artificial Sequence
  Synthetic oligonucleotide; TTT chr2 60487190 60487211 60487207 60487212 +
gcctttaatcaatgaaagagta

SEQ ID NO: 199348 - DNA, 22 bp, Artificial Sequence
  Synthetic oligonucleotide; TTG chr2 60487191 60487212 60487208 60487213 +
cctttaatcaatgaaagagtaa

SEQ ID NO: 199349 - DNA, 22 bp, Artificial Sequence
  Synthetic oligonucleotide; CTT chr2 60487195 60487216 60487212 60487217 +
taatcaatgaaagagtaagata

SEQ ID NO: 199350 - DNA, 22 bp, Artificial Sequence
  Synthetic oligonucleotide; TTT chr2 60487196 60487217 60487213 60487218 +
aatcaatgaaagagtaagataa

SEQ ID NO: 199351 - DNA, 22 bp, Artificial Sequence
  Synthetic oligonucleotide; TTA chr2 60487197 60487218 60487214 60487219 +
atcaatgaaagagtaagataat

SEQ ID NO: 199352 - DNA, 22 bp, Artificial Sequence
  Synthetic oligonucleotide; TTT chr2 60487221 60487242 60487238 60487243 +
gatatcctataaaactccctaa

SEQ ID NO: 199353 - DNA, 22 bp, Artificial Sequence
  Synthetic oligonucleotide; TTG chr2 60487222 60487243 60487239 60487244 +
atatcctataaaactccctaac

SEQ ID NO: 199354 - DNA, 22 bp, Artificial Sequence
  Synthetic oligonucleotide; CTA chr2 60487230 60487251 60487247 60487252 +
taaaactccctaacctatattt

SEQ ID NO: 199355 - DNA, 22 bp, Artificial Sequence
  Synthetic oligonucleotide; CTC chr2 60487238 60487259 60487255 60487260 +
cctaacctatattttgcaagtc

SEQ ID NO: 199356 - DNA, 22 bp, Artificial Sequence
  Synthetic oligonucleotide; CTA chr2 60487242 60487263 60487259 60487264 +
acctatattttgcaagtcgatt

SEQ ID NO: 199357 - DNA, 22 bp, Artificial Sequence
  Synthetic oligonucleotide; CTA chr2 60487247 60487268 60487264 60487269 +
tattttgcaagtcgattagcta

SEQ ID NO: 199358 - DNA, 22 bp, Artificial Sequence
  Synthetic oligonucleotide; TTT chr2 60487252 60487273 60487269 60487274 +
tgcaagtcgattagctaagctc

SEQ ID NO: 199359 - DNA, 22 bp, Artificial Sequence
  Synthetic oligonucleotide; TTT chr2 60487253 60487274 60487270 60487275 +
gcaagtcgattagctaagctct

SEQ ID NO: 199360 - DNA, 22 bp, Artificial Sequence
  Synthetic oligonucleotide; TTG chr2 60487254 60487275 60487271 60487276 +
caagtcgattagctaagctctt

SEQ ID NO: 199361 - DNA, 22 bp, Artificial Sequence
  Synthetic oligonucleotide; TTA chr2 60487265 60487286 60487282 60487287 +
gctaagctcttcatgctaatgt

SEQ ID NO: 199362 - DNA, 22 bp, Artificial Sequence
  Synthetic oligonucleotide; CTA chr2 60487269 60487290 60487286 60487291 +
agctcttcatgctaatgtcagc

SEQ ID NO: 199363 - DNA, 22 bp, Artificial Sequence
  Synthetic oligonucleotide; CTC chr2 60487274 60487295 60487291 60487296 +
ttcatgctaatgtcagcagagc

SEQ ID NO: 199364 - DNA, 22 bp, Artificial Sequence
  Synthetic oligonucleotide; CTT chr2 60487276 60487297 60487293 60487298 +
catgctaatgtcagcagagccc

SEQ ID NO: 199365 - DNA, 22 bp, Artificial Sequence
  Synthetic oligonucleotide; TTC chr2 60487277 60487298 60487294 60487299 +
atgctaatgtcagcagagccca

SEQ ID NO: 199366 - DNA, 22 bp, Artificial Sequence
  Synthetic oligonucleotide; CTA chr2 60487283 60487304 60487300 60487305 +
atgtcagcagagcccatgttac

SEQ ID NO: 199367 - DNA, 22 bp, Artificial Sequence
  Synthetic oligonucleotide; TTA chr2 60487304 60487325 60487321 60487326 +
catctccagtcaggctttcagg

SEQ ID NO: 199368 - DNA, 22 bp, Artificial Sequence
  Synthetic oligonucleotide; CTC chr2 60487310 60487331 60487327 60487332 +
cagtcaggctttcaggtgtctg

SEQ ID NO: 199369 - DNA, 22 bp, Artificial Sequence
  Synthetic oligonucleotide; CTT chr2 60487321 60487342 60487338 60487343 +
tcaggtgtctgcaccccacaat

SEQ ID NO: 199370 - DNA, 22 bp, Artificial Sequence
  Synthetic oligonucleotide; TTT chr2 60487322 60487343 60487339 60487344 +
caggtgtctgcaccccacaatg

SEQ ID NO: 199371 - DNA, 22 bp, Artificial Sequence
  Synthetic oligonucleotide; TTC chr2 60487323 60487344 60487340 60487345 +
aggtgtctgcaccccacaatgc

SEQ ID NO: 199372 - DNA, 22 bp, Artificial Sequence
  Synthetic oligonucleotide; CTG chr2 60487332 60487353 60487349 60487354 +
caccccacaatgccacacaccg

SEQ ID NO: 199373 - DNA, 22 bp, Artificial Sequence
  Synthetic oligonucleotide; TTC chr2 60487374 60487395 60487391 60487396 +
agcagggggagcagtgtagtgg

SEQ ID NO: 199374 - DNA, 22 bp, Artificial Sequence
  Synthetic oligonucleotide; TTA chr2 60487403 60487424 60487420 60487425 +
cgttttcgtcatctgtatggaa

SEQ ID NO: 199375 - DNA, 22 bp, Artificial Sequence
  Synthetic oligonucleotide; TTT chr2 60487408 60487429 60487425 60487430 +
tcgtcatctgtatggaaattgg

SEQ ID NO: 199376 - DNA, 22 bp, Artificial Sequence
  Synthetic oligonucleotide; TTT chr2 60487409 60487430 60487426 60487431 +
cgtcatctgtatggaaattggg

SEQ ID NO: 199377 - DNA, 22 bp, Artificial Sequence
  Synthetic oligonucleotide; TTC chr2 60487410 60487431 60487427 60487432 +
gtcatctgtatggaaattggga

SEQ ID NO: 199378 - DNA, 22 bp, Artificial Sequence
  Synthetic oligonucleotide; CTG chr2 60487418 60487439 60487435 60487440 +
tatggaaattgggaaatcgtct

SEQ ID NO: 199379 - DNA, 22 bp, Artificial Sequence
  Synthetic oligonucleotide; TTG chr2 60487429 60487450 60487446 60487451 +
ggaaatcgtcttctcaaatgta

SEQ ID NO: 199380 - DNA, 22 bp, Artificial Sequence
  Synthetic oligonucleotide; CTT chr2 60487441 60487462 60487458 60487463 +
ctcaaatgtagattatcttccc

SEQ ID NO: 199381 - DNA, 22 bp, Artificial Sequence
  Synthetic oligonucleotide; TTC chr2 60487442 60487463 60487459 60487464 +
tcaaatgtagattatcttccct

SEQ ID NO: 199382 - DNA, 22 bp, Artificial Sequence
  Synthetic oligonucleotide; CTC chr2 60487444 60487465 60487461 60487466 +
aaatgtagattatcttcccttg

SEQ ID NO: 199383 - DNA, 22 bp, Artificial Sequence
  Synthetic oligonucleotide; TTA chr2 60487456 60487477 60487473 60487478 +
tcttcccttgggatccttctgg

SEQ ID NO: 199384 - DNA, 22 bp, Artificial Sequence
  Synthetic oligonucleotide; CTT chr2 60487460 60487481 60487477 60487482 +
cccttgggatccttctggaggg

SEQ ID NO: 199385 - DNA, 22 bp, Artificial Sequence
  Synthetic oligonucleotide; TTC chr2 60487461 60487482 60487478 60487483 +
ccttgggatccttctggagggc

SEQ ID NO: 199386 - DNA, 22 bp, Artificial Sequence
  Synthetic oligonucleotide; CTT chr2 60487465 60487486 60487482 60487487 +
gggatccttctggagggctata

SEQ ID NO: 199387 - DNA, 22 bp, Artificial Sequence
  Synthetic oligonucleotide; TTG chr2 60487466 60487487 60487483 60487488 +
ggatccttctggagggctataa

SEQ ID NO: 199388 - DNA, 22 bp, Artificial Sequence
  Synthetic oligonucleotide; CTT chr2 60487474 60487495 60487491 60487496 +
ctggagggctataaataataga

SEQ ID NO: 199389 - DNA, 22 bp, Artificial Sequence
  Synthetic oligonucleotide; TTC chr2 60487475 60487496 60487492 60487497 +
tggagggctataaataatagaa

SEQ ID NO: 199390 - DNA, 22 bp, Artificial Sequence
  Synthetic oligonucleotide; CTG chr2 60487477 60487498 60487494 60487499 +
gagggctataaataatagaaca

SEQ ID NO: 199391 - DNA, 22 bp, Artificial Sequence
  Synthetic oligonucleotide; CTA chr2 60487485 60487506 60487502 60487507 +
taaataatagaacatactaatc

SEQ ID NO: 199392 - DNA, 22 bp, Artificial Sequence
  Synthetic oligonucleotide; CTA chr2 60487504 60487525 60487521 60487526 +
atcaacattagatatttaaaaa

SEQ ID NO: 199393 - DNA, 22 bp, Artificial Sequence
  Synthetic oligonucleotide; TTA chr2 60487514 60487535 60487531 60487536 +
gatatttaaaaatgaatacaga

SEQ ID NO: 199394 - DNA, 22 bp, Artificial Sequence
  Synthetic oligonucleotide; TTT chr2 60487521 60487542 60487538 60487543 +
aaaaatgaatacagattcagat

SEQ ID NO: 199395 - DNA, 22 bp, Artificial Sequence
  Synthetic oligonucleotide; TTA chr2 60487522 60487543 60487539 60487544 +
aaaatgaatacagattcagatt

SEQ ID NO: 199396 - DNA, 22 bp, Artificial Sequence
  Synthetic oligonucleotide; TTC chr2 60487539 60487560 60487556 60487561 +
agattaagggaaaactaaatga

SEQ ID NO: 199397 - DNA, 22 bp, Artificial Sequence
  Synthetic oligonucleotide; TTA chr2 60487545 60487566 60487562 60487567 +
agggaaaactaaatgatgcctt

SEQ ID NO: 199398 - DNA, 22 bp, Artificial Sequence
  Synthetic oligonucleotide; CTA chr2 60487556 60487577 60487573 60487578 +
aatgatgcctttataaaatcca

SEQ ID NO: 199399 - DNA, 22 bp, Artificial Sequence
  Synthetic oligonucleotide; CTT chr2 60487567 60487588 60487584 60487589 +
tataaaatccagaacaaaacaa

SEQ ID NO: 199400 - DNA, 22 bp, Artificial Sequence
  Synthetic oligonucleotide; TTT chr2 60487568 60487589 60487585 60487590 +
ataaaatccagaacaaaacaaa

SEQ ID NO: 199401 - DNA, 22 bp, Artificial Sequence
  Synthetic oligonucleotide; TTA chr2 60487569 60487590 60487586 60487591 +
taaaatccagaacaaaacaaaa

SEQ ID NO: 199402 - DNA, 22 bp, Artificial Sequence
  Synthetic oligonucleotide; CTT chr2 60487618 60487639 60487635 60487640 +
agcggatcccccttaagttagc

SEQ ID NO: 199403 - DNA, 22 bp, Artificial Sequence
  Synthetic oligonucleotide; TTA chr2 60487619 60487640 60487636 60487641 +
gcggatcccccttaagttagcc

SEQ ID NO: 199404 - DNA, 22 bp, Artificial Sequence
  Synthetic oligonucleotide; CTT chr2 60487632 60487653 60487649 60487654 +
aagttagccctattctctggca

SEQ ID NO: 199405 - DNA, 22 bp, Artificial Sequence
  Synthetic oligonucleotide; TTA chr2 60487633 60487654 60487650 60487655 +
agttagccctattctctggcaa

SEQ ID NO: 199406 - DNA, 22 bp, Artificial Sequence
  Synthetic oligonucleotide; TTA chr2 60487638 60487659 60487655 60487660 +
gccctattctctggcaaccaca

SEQ ID NO: 199407 - DNA, 22 bp, Artificial Sequence
  Synthetic oligonucleotide; CTA chr2 60487644 60487665 60487661 60487666 +
ttctctggcaaccacaccagcc

SEQ ID NO: 199408 - DNA, 22 bp, Artificial Sequence
  Synthetic oligonucleotide; TTC chr2 60487647 60487668 60487664 60487669 +
tctggcaaccacaccagccttt

SEQ ID NO: 199409 - DNA, 22 bp, Artificial Sequence
  Synthetic oligonucleotide; CTC chr2 60487649 60487670 60487666 60487671 +
tggcaaccacaccagcctttaa

SEQ ID NO: 199410 - DNA, 22 bp, Artificial Sequence
  Synthetic oligonucleotide; CTG chr2 60487651 60487672 60487668 60487673 +
gcaaccacaccagcctttaacg

SEQ ID NO: 199411 - DNA, 22 bp, Artificial Sequence
  Synthetic oligonucleotide; CTT chr2 60487668 60487689 60487685 60487690 +
taacgagggtgttcaaagtaac

SEQ ID NO: 199412 - DNA, 22 bp, Artificial Sequence
  Synthetic oligonucleotide; TTT chr2 60487669 60487690 60487686 60487691 +
aacgagggtgttcaaagtaacc

SEQ ID NO: 199413 - DNA, 22 bp, Artificial Sequence
  Synthetic oligonucleotide; TTA chr2 60487670 60487691 60487687 60487692 +
acgagggtgttcaaagtaacca

SEQ ID NO: 199414 - DNA, 22 bp, Artificial Sequence
  Synthetic oligonucleotide; TTC chr2 60487682 60487703 60487699 60487704 +
aaagtaaccatttcccactccc

SEQ ID NO: 199415 - DNA, 22 bp, Artificial Sequence
  Synthetic oligonucleotide; TTT chr2 60487695 60487716 60487712 60487717 +
cccactcccttatttatgagca

SEQ ID NO: 199416 - DNA, 22 bp, Artificial Sequence
  Synthetic oligonucleotide; TTC chr2 60487696 60487717 60487713 60487718 +
ccactcccttatttatgagcag

SEQ ID NO: 199417 - DNA, 22 bp, Artificial Sequence
  Synthetic oligonucleotide; CTC chr2 60487702 60487723 60487719 60487724 +
ccttatttatgagcagcagaat

SEQ ID NO: 199418 - DNA, 22 bp, Artificial Sequence
  Synthetic oligonucleotide; CTT chr2 60487706 60487727 60487723 60487728 +
atttatgagcagcagaatgtaa

SEQ ID NO: 199419 - DNA, 22 bp, Artificial Sequence
  Synthetic oligonucleotide; TTA chr2 60487707 60487728 60487724 60487729 +
tttatgagcagcagaatgtaaa

SEQ ID NO: 199420 - DNA, 22 bp, Artificial Sequence
  Synthetic oligonucleotide; TTT chr2 60487710 60487731 60487727 60487732 +
atgagcagcagaatgtaaaaag

SEQ ID NO: 199421 - DNA, 22 bp, Artificial Sequence
  Synthetic oligonucleotide; TTA chr2 60487711 60487732 60487728 60487733 +
tgagcagcagaatgtaaaaagc

SEQ ID NO: 199422 - DNA, 22 bp, Artificial Sequence
  Synthetic oligonucleotide; CTT chr2 60487742 60487763 60487759 60487764 +
aattttaatgcggtaattttct

SEQ ID NO: 199423 - DNA, 22 bp, Artificial Sequence
  Synthetic oligonucleotide; TTA chr2 60487743 60487764 60487760 60487765 +
attttaatgcggtaattttctc

SEQ ID NO: 199424 - DNA, 22 bp, Artificial Sequence
  Synthetic oligonucleotide; TTT chr2 60487747 60487768 60487764 60487769 +
taatgcggtaattttctcatca

SEQ ID NO: 199425 - DNA, 22 bp, Artificial Sequence
  Synthetic oligonucleotide; TTT chr2 60487748 60487769 60487765 60487770 +
aatgcggtaattttctcatcaa

SEQ ID NO: 199426 - DNA, 22 bp, Artificial Sequence
  Synthetic oligonucleotide; TTA chr2 60487749 60487770 60487766 60487771 +
atgcggtaattttctcatcaac

SEQ ID NO: 199427 - DNA, 22 bp, Artificial Sequence
  Synthetic oligonucleotide; TTT chr2 60487761 60487782 60487778 60487783 +
tctcatcaaccattctatctaa

SEQ ID NO: 199428 - DNA, 22 bp, Artificial Sequence
  Synthetic oligonucleotide; TTT chr2 60487762 60487783 60487779 60487784 +
ctcatcaaccattctatctaag

SEQ ID NO: 199429 - DNA, 22 bp, Artificial Sequence
  Synthetic oligonucleotide; TTC chr2 60487763 60487784 60487780 60487785 +
tcatcaaccattctatctaagg

SEQ ID NO: 199430 - DNA, 22 bp, Artificial Sequence
  Synthetic oligonucleotide; CTC chr2 60487765 60487786 60487782 60487787 +
atcaaccattctatctaaggaa

SEQ ID NO: 199431 - DNA, 22 bp, Artificial Sequence
  Synthetic oligonucleotide; TTC chr2 60487776 60487797 60487793 60487798 +
tatctaaggaagctgcagaaag

SEQ ID NO: 199432 - DNA, 22 bp, Artificial Sequence
  Synthetic oligonucleotide; CTA chr2 60487778 60487799 60487795 60487800 +
tctaaggaagctgcagaaaggt

SEQ ID NO: 199433 - DNA, 22 bp, Artificial Sequence
  Synthetic oligonucleotide; CTA chr2 60487782 60487803 60487799 60487804 +
aggaagctgcagaaaggtgaaa

SEQ ID NO: 199434 - DNA, 22 bp, Artificial Sequence
  Synthetic oligonucleotide; CTG chr2 60487791 60487812 60487808 60487813 +
cagaaaggtgaaaactggaaat

SEQ ID NO: 199435 - DNA, 22 bp, Artificial Sequence
  Synthetic oligonucleotide; CTG chr2 60487808 60487829 60487825 60487830 +
gaaatttatgaacctttaatgg

SEQ ID NO: 199436 - DNA, 22 bp, Artificial Sequence
  Synthetic oligonucleotide; TTT chr2 60487815 60487836 60487832 60487837 +
atgaacctttaatgggaaatct

SEQ ID NO: 199437 - DNA, 22 bp, Artificial Sequence
  Synthetic oligonucleotide; TTA chr2 60487816 60487837 60487833 60487838 +
tgaacctttaatgggaaatctg

SEQ ID NO: 199438 - DNA, 22 bp, Artificial Sequence
  Synthetic oligonucleotide; CTT chr2 60487824 60487845 60487841 60487846 +
taatgggaaatctggataagaa

SEQ ID NO: 199439 - DNA, 22 bp, Artificial Sequence
  Synthetic oligonucleotide; TTT chr2 60487825 60487846 60487842 60487847 +
aatgggaaatctggataagaat

SEQ ID NO: 199440 - DNA, 22 bp, Artificial Sequence
  Synthetic oligonucleotide; TTA chr2 60487826 60487847 60487843 60487848 +
atgggaaatctggataagaatt

SEQ ID NO: 199441 - DNA, 22 bp, Artificial Sequence
  Synthetic oligonucleotide; CTG chr2 60487838 60487859 60487855 60487860 +
gataagaatttggtctaaatat

SEQ ID NO: 199442 - DNA, 22 bp, Artificial Sequence
  Synthetic oligonucleotide; TTT chr2 60487849 60487870 60487866 60487871 +
ggtctaaatatatgaagaggaa

SEQ ID NO: 199443 - DNA, 22 bp, Artificial Sequence
  Synthetic oligonucleotide; TTG chr2 60487850 60487871 60487867 60487872 +
gtctaaatatatgaagaggaac

SEQ ID NO: 199444 - DNA, 22 bp, Artificial Sequence
  Synthetic oligonucleotide; CTA chr2 60487855 60487876 60487872 60487877 +
aatatatgaagaggaacatgga

SEQ ID NO: 199445 - DNA, 22 bp, Artificial Sequence
  Synthetic oligonucleotide; CTG chr2 60487883 60487904 60487900 60487905 +
gcacaaacacaaaatgcaagta

SEQ ID NO: 199446 - DNA, 22 bp, Artificial Sequence
  Synthetic oligonucleotide; CTC chr2 60487908 60487929 60487925 60487930 +
caactccagctccctgataaca

SEQ ID NO: 199447 - DNA, 22 bp, Artificial Sequence
  Synthetic oligonucleotide; CTC chr2 60487914 60487935 60487931 60487936 +
cagctccctgataacatctgcc

SEQ ID NO: 199448 - DNA, 22 bp, Artificial Sequence
  Synthetic oligonucleotide; CTC chr2 60487920 60487941 60487937 60487942 +
cctgataacatctgccactaaa

SEQ ID NO: 199449 - DNA, 22 bp, Artificial Sequence
  Synthetic oligonucleotide; CTG chr2 60487924 60487945 60487941 60487946 +
ataacatctgccactaaaggtt

SEQ ID NO: 199450 - DNA, 22 bp, Artificial Sequence
  Synthetic oligonucleotide; CTG chr2 60487934 60487955 60487951 60487956 +
ccactaaaggtttactgacttg

SEQ ID NO: 199451 - DNA, 22 bp, Artificial Sequence
  Synthetic oligonucleotide; CTA chr2 60487940 60487961 60487957 60487962 +
aaggtttactgacttggttttc

SEQ ID NO: 199452 - DNA, 22 bp, Artificial Sequence
  Synthetic oligonucleotide; TTT chr2 60487947 60487968 60487964 60487969 +
actgacttggttttcccaactc

SEQ ID NO: 199453 - DNA, 22 bp, Artificial Sequence
  Synthetic oligonucleotide; TTA chr2 60487948 60487969 60487965 60487970 +
ctgacttggttttcccaactct

SEQ ID NO: 199454 - DNA, 22 bp, Artificial Sequence
  Synthetic oligonucleotide; CTG chr2 60487951 60487972 60487968 60487973 +
acttggttttcccaactctaga

SEQ ID NO: 199455 - DNA, 22 bp, Artificial Sequence
  Synthetic oligonucleotide; CTT chr2 60487955 60487976 60487972 60487977 +
ggttttcccaactctagaatgg

SEQ ID NO: 199456 - DNA, 22 bp, Artificial Sequence
  Synthetic oligonucleotide; TTG chr2 60487956 60487977 60487973 60487978 +
gttttcccaactctagaatgga

SEQ ID NO: 199457 - DNA, 22 bp, Artificial Sequence
  Synthetic oligonucleotide; TTT chr2 60487960 60487981 60487977 60487982 +
tcccaactctagaatggagccc

SEQ ID NO: 199458 - DNA, 22 bp, Artificial Sequence
  Synthetic oligonucleotide; TTT chr2 60487961 60487982 60487978 60487983 +
cccaactctagaatggagccct

SEQ ID NO: 199459 - DNA, 22 bp, Artificial Sequence
  Synthetic oligonucleotide; TTC chr2 60487962 60487983 60487979 60487984 +
ccaactctagaatggagccctc

SEQ ID NO: 199460 - DNA, 22 bp, Artificial Sequence
  Synthetic oligonucleotide; CTC chr2 60487969 60487990 60487986 60487991 +
tagaatggagccctcatctaaa

SEQ ID NO: 199461 - DNA, 22 bp, Artificial Sequence
  Synthetic oligonucleotide; CTA chr2 60487971 60487992 60487988 60487993 +
gaatggagccctcatctaaacc

SEQ ID NO: 199462 - DNA, 22 bp, Artificial Sequence
  Synthetic oligonucleotide; CTC chr2 60487984 60488005 60488001 60488006 +
atctaaacctggggaagcaata

SEQ ID NO: 199463 - DNA, 22 bp, Artificial Sequence
  Synthetic oligonucleotide; CTA chr2 60487989 60488010 60488006 60488011 +
aacctggggaagcaatatatga

SEQ ID NO: 199464 - DNA, 22 bp, Artificial Sequence
  Synthetic oligonucleotide; CTG chr2 60487995 60488016 60488012 60488017 +
gggaagcaatatatgaacaatt

SEQ ID NO: 199465 - DNA, 22 bp, Artificial Sequence
  Synthetic oligonucleotide; TTA chr2 60488018 60488039 60488035 60488040 +
gatattaaatgcttatagatcc

SEQ ID NO: 199466 - DNA, 22 bp, Artificial Sequence
  Synthetic oligonucleotide; TTA chr2 60488025 60488046 60488042 60488047 +
aatgcttatagatccctctctg

SEQ ID NO: 199467 - DNA, 22 bp, Artificial Sequence
  Synthetic oligonucleotide; CTT chr2 60488032 60488053 60488049 60488054 +
atagatccctctctgtgctatt

SEQ ID NO: 199468 - DNA, 22 bp, Artificial Sequence
  Synthetic oligonucleotide; TTA chr2 60488033 60488054 60488050 60488055 +
tagatccctctctgtgctatta

SEQ ID NO: 199469 - DNA, 22 bp, Artificial Sequence
  Synthetic oligonucleotide; CTC chr2 60488043 60488064 60488060 60488065 +
tctgtgctattacttttgacct

SEQ ID NO: 199470 - DNA, 22 bp, Artificial Sequence
  Synthetic oligonucleotide; CTC chr2 60488045 60488066 60488062 60488067 +
tgtgctattacttttgacctgg

SEQ ID NO: 199471 - DNA, 22 bp, Artificial Sequence
  Synthetic oligonucleotide; CTG chr2 60488047 60488068 60488064 60488069 +
tgctattacttttgacctgggt

SEQ ID NO: 199472 - DNA, 22 bp, Artificial Sequence
  Synthetic oligonucleotide; CTA chr2 60488052 60488073 60488069 60488074 +
ttacttttgacctgggttttaa

SEQ ID NO: 199473 - DNA, 22 bp, Artificial Sequence
  Synthetic oligonucleotide; TTA chr2 60488055 60488076 60488072 60488077 +
cttttgacctgggttttaaaaa

SEQ ID NO: 199474 - DNA, 22 bp, Artificial Sequence
  Synthetic oligonucleotide; CTT chr2 60488058 60488079 60488075 60488080 +
ttgacctgggttttaaaaacac

SEQ ID NO: 199475 - DNA, 22 bp, Artificial Sequence
  Synthetic oligonucleotide; TTT chr2 60488059 60488080 60488076 60488081 +
tgacctgggttttaaaaacaca

SEQ ID NO: 199476 - DNA, 22 bp, Artificial Sequence
  Synthetic oligonucleotide; TTT chr2 60488060 60488081 60488077 60488082 +
gacctgggttttaaaaacacag

SEQ ID NO: 199477 - DNA, 22 bp, Artificial Sequence
  Synthetic oligonucleotide; TTG chr2 60488061 60488082 60488078 60488083 +
acctgggttttaaaaacacagt

SEQ ID NO: 199478 - DNA, 22 bp, Artificial Sequence
  Synthetic oligonucleotide; CTG chr2 60488066 60488087 60488083 60488088 +
ggttttaaaaacacagtaacac

SEQ ID NO: 199479 - DNA, 22 bp, Artificial Sequence
  Synthetic oligonucleotide; TTT chr2 60488071 60488092 60488088 60488093 +
taaaaacacagtaacacttaca

SEQ ID NO: 199480 - DNA, 22 bp, Artificial Sequence
  Synthetic oligonucleotide; TTT chr2 60488072 60488093 60488089 60488094 +
aaaaacacagtaacacttacaa

SEQ ID NO: 199481 - DNA, 22 bp, Artificial Sequence
  Synthetic oligonucleotide; TTA chr2 60488073 60488094 60488090 60488095 +
aaaacacagtaacacttacaat

SEQ ID NO: 199482 - DNA, 22 bp, Artificial Sequence
  Synthetic oligonucleotide; CTT chr2 60488090 60488111 60488107 60488112 +
acaatttattctcattatgtag

SEQ ID NO: 199483 - DNA, 22 bp, Artificial Sequence
  Synthetic oligonucleotide; TTA chr2 60488091 60488112 60488108 60488113 +
caatttattctcattatgtaga

SEQ ID NO: 199484 - DNA, 22 bp, Artificial Sequence
  Synthetic oligonucleotide; TTT chr2 60488097 60488118 60488114 60488119 +
attctcattatgtagaaacatt

SEQ ID NO: 199485 - DNA, 22 bp, Artificial Sequence
  Synthetic oligonucleotide; TTA chr2 60488098 60488119 60488115 60488120 +
ttctcattatgtagaaacattt

SEQ ID NO: 199486 - DNA, 22 bp, Artificial Sequence
  Synthetic oligonucleotide; TTC chr2 60488101 60488122 60488118 60488123 +
tcattatgtagaaacatttaaa

SEQ ID NO: 199487 - DNA, 22 bp, Artificial Sequence
  Synthetic oligonucleotide; CTC chr2 60488103 60488124 60488120 60488125 +
attatgtagaaacatttaaatt

SEQ ID NO: 199488 - DNA, 22 bp, Artificial Sequence
  Synthetic oligonucleotide; TTA chr2 60488107 60488128 60488124 60488129 +
tgtagaaacatttaaattatcc

SEQ ID NO: 199489 - DNA, 22 bp, Artificial Sequence
  Synthetic oligonucleotide; TTT chr2 60488120 60488141 60488137 60488142 +
aaattatcctggaagagtttgt

SEQ ID NO: 199490 - DNA, 22 bp, Artificial Sequence
  Synthetic oligonucleotide; TTA chr2 60488121 60488142 60488138 60488143 +
aattatcctggaagagtttgtc

SEQ ID NO: 199491 - DNA, 22 bp, Artificial Sequence
  Synthetic oligonucleotide; TTA chr2 60488126 60488147 60488143 60488148 +
tcctggaagagtttgtctcacg

SEQ ID NO: 199492 - DNA, 22 bp, Artificial Sequence
  Synthetic oligonucleotide; CTG chr2 60488131 60488152 60488148 60488153 +
gaagagtttgtctcacgggctg

SEQ ID NO: 199493 - DNA, 22 bp, Artificial Sequence
  Synthetic oligonucleotide; TTT chr2 60488140 60488161 60488157 60488162 +
gtctcacgggctgttcaaagag

SEQ ID NO: 199494 - DNA, 22 bp, Artificial Sequence
  Synthetic oligonucleotide; TTG chr2 60488141 60488162 60488158 60488163 +
tctcacgggctgttcaaagagt

SEQ ID NO: 199495 - DNA, 22 bp, Artificial Sequence
  Synthetic oligonucleotide; CTC chr2 60488145 60488166 60488162 60488167 +
acgggctgttcaaagagtgttt

SEQ ID NO: 199496 - DNA, 22 bp, Artificial Sequence
  Synthetic oligonucleotide; CTG chr2 60488153 60488174 60488170 60488175 +
ttcaaagagtgtttcttccttt

SEQ ID NO: 199497 - DNA, 22 bp, Artificial Sequence
  Synthetic oligonucleotide; TTC chr2 60488156 60488177 60488173 60488178 +
aaagagtgtttcttcctttcct

SEQ ID NO: 199498 - DNA, 22 bp, Artificial Sequence
  Synthetic oligonucleotide; TTT chr2 60488167 60488188 60488184 60488189 +
cttcctttccttctaggaacat

SEQ ID NO: 199499 - DNA, 22 bp, Artificial Sequence
  Synthetic oligonucleotide; TTC chr2 60488168 60488189 60488185 60488190 +
ttcctttccttctaggaacatg

SEQ ID NO: 199500 - DNA, 22 bp, Artificial Sequence
  Synthetic oligonucleotide; CTT chr2 60488170 60488191 60488187 60488192 +
cctttccttctaggaacatgag

SEQ ID NO: 199501 - DNA, 22 bp, Artificial Sequence
  Synthetic oligonucleotide; TTC chr2 60488171 60488192 60488188 60488193 +
ctttccttctaggaacatgagg

SEQ ID NO: 199502 - DNA, 22 bp, Artificial Sequence
  Synthetic oligonucleotide; CTT chr2 60488174 60488195 60488191 60488196 +
tccttctaggaacatgaggagt

SEQ ID NO: 199503 - DNA, 22 bp, Artificial Sequence
  Synthetic oligonucleotide; TTT chr2 60488175 60488196 60488192 60488197 +
ccttctaggaacatgaggagtg

SEQ ID NO: 199504 - DNA, 22 bp, Artificial Sequence
  Synthetic oligonucleotide; TTC chr2 60488176 60488197 60488193 60488198 +
cttctaggaacatgaggagtga

SEQ ID NO: 199505 - DNA, 22 bp, Artificial Sequence
  Synthetic oligonucleotide; CTT chr2 60488179 60488200 60488196 60488201 +
ctaggaacatgaggagtgaatc

SEQ ID NO: 199506 - DNA, 22 bp, Artificial Sequence
  Synthetic oligonucleotide; TTC chr2 60488180 60488201 60488197 60488202 +
taggaacatgaggagtgaatct

SEQ ID NO: 199507 - DNA, 22 bp, Artificial Sequence
  Synthetic oligonucleotide; CTA chr2 60488182 60488203 60488199 60488204 +
ggaacatgaggagtgaatctga

SEQ ID NO: 199508 - DNA, 22 bp, Artificial Sequence
  Synthetic oligonucleotide; CTG chr2 60488203 60488224 60488220 60488225 +
actatttcatcaaagcctgtaa

SEQ ID NO: 199509 - DNA, 22 bp, Artificial Sequence
  Synthetic oligonucleotide; CTA chr2 60488207 60488228 60488224 60488229 +
tttcatcaaagcctgtaaaaga

SEQ ID NO: 199510 - DNA, 22 bp, Artificial Sequence
  Synthetic oligonucleotide; TTT chr2 60488210 60488231 60488227 60488232 +
catcaaagcctgtaaaagatac

SEQ ID NO: 199511 - DNA, 22 bp, Artificial Sequence
  Synthetic oligonucleotide; TTC chr2 60488211 60488232 60488228 60488233 +
atcaaagcctgtaaaagatacc

SEQ ID NO: 199512 - DNA, 22 bp, Artificial Sequence
  Synthetic oligonucleotide; CTG chr2 60488222 60488243 60488239 60488244 +
taaaagatacctgagtcatgat

SEQ ID NO: 199513 - DNA, 22 bp, Artificial Sequence
  Synthetic oligonucleotide; CTG chr2 60488235 60488256 60488252 60488257 +
agtcatgattttaactgaacaa

SEQ ID NO: 199514 - DNA, 22 bp, Artificial Sequence
  Synthetic oligonucleotide; TTT chr2 60488246 60488267 60488263 60488268 +
taactgaacaatgtctccaaga

SEQ ID NO: 199515 - DNA, 22 bp, Artificial Sequence
  Synthetic oligonucleotide; TTT chr2 60488247 60488268 60488264 60488269 +
aactgaacaatgtctccaagaa

SEQ ID NO: 199516 - DNA, 22 bp, Artificial Sequence
  Synthetic oligonucleotide; TTA chr2 60488248 60488269 60488265 60488270 +
actgaacaatgtctccaagaat

SEQ ID NO: 199517 - DNA, 22 bp, Artificial Sequence
  Synthetic oligonucleotide; CTG chr2 60488252 60488273 60488269 60488274 +
aacaatgtctccaagaattcag

SEQ ID NO: 199518 - DNA, 22 bp, Artificial Sequence
  Synthetic oligonucleotide; CTC chr2 60488263 60488284 60488280 60488285 +
caagaattcagactgtgagagg

SEQ ID NO: 199519 - DNA, 22 bp, Artificial Sequence
  Synthetic oligonucleotide; TTC chr2 60488272 60488293 60488289 60488294 +
agactgtgagagggggaagaag

SEQ ID NO: 199520 - DNA, 22 bp, Artificial Sequence
  Synthetic oligonucleotide; CTG chr2 60488278 60488299 60488295 60488300 +
tgagagggggaagaagaccgtc

SEQ ID NO: 199521 - DNA, 22 bp, Artificial Sequence
  Synthetic oligonucleotide; CTC chr2 60488302 60488323 60488319 60488324 +
tttggtgcagtgggaattgcca

SEQ ID NO: 199522 - DNA, 22 bp, Artificial Sequence
  Synthetic oligonucleotide; CTT chr2 60488304 60488325 60488321 60488326 +
tggtgcagtgggaattgccatt

SEQ ID NO: 199523 - DNA, 22 bp, Artificial Sequence
  Synthetic oligonucleotide; TTT chr2 60488305 60488326 60488322 60488327 +
ggtgcagtgggaattgccattg

SEQ ID NO: 199524 - DNA, 22 bp, Artificial Sequence
  Synthetic oligonucleotide; TTG chr2 60488306 60488327 60488323 60488328 +
gtgcagtgggaattgccattgt

SEQ ID NO: 199525 - DNA, 22 bp, Artificial Sequence
  Synthetic oligonucleotide; TTG chr2 60488321 60488342 60488338 60488343 +
ccattgtgtcctccctggttcc

SEQ ID NO: 199526 - DNA, 22 bp, Artificial Sequence
  Synthetic oligonucleotide; TTG chr2 60488327 60488348 60488344 60488349 +
tgtcctccctggttcctctcct

SEQ ID NO: 199527 - DNA, 22 bp, Artificial Sequence
  Synthetic oligonucleotide; CTC chr2 60488334 60488355 60488351 60488356 +
cctggttcctctcctctgtcct

SEQ ID NO: 199528 - DNA, 22 bp, Artificial Sequence
  Synthetic oligonucleotide; CTG chr2 60488338 60488359 60488355 60488360 +
gttcctctcctctgtccttggc

SEQ ID NO: 199529 - DNA, 22 bp, Artificial Sequence
  Synthetic oligonucleotide; TTC chr2 60488342 60488363 60488359 60488364 +
ctctcctctgtccttggcaatc

SEQ ID NO: 199530 - DNA, 22 bp, Artificial Sequence
  Synthetic oligonucleotide; CTC chr2 60488345 60488366 60488362 60488367 +
tcctctgtccttggcaatccag

SEQ ID NO: 199531 - DNA, 22 bp, Artificial Sequence
  Synthetic oligonucleotide; CTC chr2 60488347 60488368 60488364 60488369 +
ctctgtccttggcaatccagtt

SEQ ID NO: 199532 - DNA, 22 bp, Artificial Sequence
  Synthetic oligonucleotide; CTC chr2 60488350 60488371 60488367 60488372 +
tgtccttggcaatccagttaca

SEQ ID NO: 199533 - DNA, 22 bp, Artificial Sequence
  Synthetic oligonucleotide; CTG chr2 60488352 60488373 60488369 60488374 +
tccttggcaatccagttacaat

SEQ ID NO: 199534 - DNA, 22 bp, Artificial Sequence
  Synthetic oligonucleotide; CTT chr2 60488357 60488378 60488374 60488379 +
ggcaatccagttacaatttgac

SEQ ID NO: 199535 - DNA, 22 bp, Artificial Sequence
  Synthetic oligonucleotide; TTG chr2 60488358 60488379 60488375 60488380 +
gcaatccagttacaatttgaca

SEQ ID NO: 199536 - DNA, 22 bp, Artificial Sequence
  Synthetic oligonucleotide; TTA chr2 60488370 60488391 60488387 60488392 +
caatttgacagcatttaaagat

SEQ ID NO: 199537 - DNA, 22 bp, Artificial Sequence
  Synthetic oligonucleotide; TTT chr2 60488376 60488397 60488393 60488398 +
gacagcatttaaagatgacagt

SEQ ID NO: 199538 - DNA, 22 bp, Artificial Sequence
  Synthetic oligonucleotide; TTG chr2 60488377 60488398 60488394 60488399 +
acagcatttaaagatgacagta

SEQ ID NO: 199539 - DNA, 22 bp, Artificial Sequence
  Synthetic oligonucleotide; TTT chr2 60488386 60488407 60488403 60488408 +
aaagatgacagtacttgagata

SEQ ID NO: 199540 - DNA, 22 bp, Artificial Sequence
  Synthetic oligonucleotide; TTA chr2 60488387 60488408 60488404 60488409 +
aagatgacagtacttgagataa

SEQ ID NO: 199541 - DNA, 22 bp, Artificial Sequence
  Synthetic oligonucleotide; CTT chr2 60488402 60488423 60488419 60488424 +
gagataataggacaatgccata

SEQ ID NO: 199542 - DNA, 22 bp, Artificial Sequence
  Synthetic oligonucleotide; TTG chr2 60488403 60488424 60488420 60488425 +
agataataggacaatgccataa

SEQ ID NO: 199543 - DNA, 22 bp, Artificial Sequence
  Synthetic oligonucleotide; TTA chr2 60488433 60488454 60488450 60488455 +
cagcaaatgtgaaagaaaggac

SEQ ID NO: 199544 - DNA, 22 bp, Artificial Sequence
  Synthetic oligonucleotide; CTG chr2 60488469 60488490 60488486 60488491 +
tcatttaggtaatgtcatctat

SEQ ID NO: 199545 - DNA, 22 bp, Artificial Sequence
  Synthetic oligonucleotide; TTT chr2 60488475 60488496 60488492 60488497 +
aggtaatgtcatctatgatcag

SEQ ID NO: 199546 - DNA, 22 bp, Artificial Sequence
  Synthetic oligonucleotide; TTA chr2 60488476 60488497 60488493 60488498 +
ggtaatgtcatctatgatcagt

SEQ ID NO: 199547 - DNA, 22 bp, Artificial Sequence
  Synthetic oligonucleotide; CTA chr2 60488490 60488511 60488507 60488512 +
tgatcagtttttgtttcatttt

SEQ ID NO: 199548 - DNA, 22 bp, Artificial Sequence
  Synthetic oligonucleotide; TTT chr2 60488500 60488521 60488517 60488522 +
ttgtttcattttttgctgacac

SEQ ID NO: 199549 - DNA, 22 bp, Artificial Sequence
  Synthetic oligonucleotide; TTT chr2 60488501 60488522 60488518 60488523 +
tgtttcattttttgctgacaca

SEQ ID NO: 199550 - DNA, 22 bp, Artificial Sequence
  Synthetic oligonucleotide; TTT chr2 60488502 60488523 60488519 60488524 +
gtttcattttttgctgacacag

SEQ ID NO: 199551 - DNA, 22 bp, Artificial Sequence
  Synthetic oligonucleotide; TTG chr2 60488503 60488524 60488520 60488525 +
tttcattttttgctgacacaga

SEQ ID NO: 199552 - DNA, 22 bp, Artificial Sequence
  Synthetic oligonucleotide; TTT chr2 60488506 60488527 60488523 60488528 +
cattttttgctgacacagaact

SEQ ID NO: 199553 - DNA, 22 bp, Artificial Sequence
  Synthetic oligonucleotide; TTC chr2 60488507 60488528 60488524 60488529 +
attttttgctgacacagaactc

SEQ ID NO: 199554 - DNA, 22 bp, Artificial Sequence
  Synthetic oligonucleotide; TTT chr2 60488511 60488532 60488528 60488533 +
tttgctgacacagaactcagtg

SEQ ID NO: 199555 - DNA, 22 bp, Artificial Sequence
  Synthetic oligonucleotide; TTT chr2 60488512 60488533 60488529 60488534 +
ttgctgacacagaactcagtgc

SEQ ID NO: 199556 - DNA, 22 bp, Artificial Sequence
  Synthetic oligonucleotide; TTT chr2 60488513 60488534 60488530 60488535 +
tgctgacacagaactcagtgct

SEQ ID NO: 199557 - DNA, 22 bp, Artificial Sequence
  Synthetic oligonucleotide; TTT chr2 60488514 60488535 60488531 60488536 +
gctgacacagaactcagtgcta

SEQ ID NO: 199558 - DNA, 22 bp, Artificial Sequence
  Synthetic oligonucleotide; TTG chr2 60488515 60488536 60488532 60488537 +
ctgacacagaactcagtgctac

SEQ ID NO: 199559 - DNA, 22 bp, Artificial Sequence
  Synthetic oligonucleotide; CTG chr2 60488518 60488539 60488535 60488540 +
acacagaactcagtgctactta

SEQ ID NO: 199560 - DNA, 22 bp, Artificial Sequence
  Synthetic oligonucleotide; CTC chr2 60488529 60488550 60488546 60488551 +
agtgctacttatacaattcact

SEQ ID NO: 199561 - DNA, 22 bp, Artificial Sequence
  Synthetic oligonucleotide; CTA chr2 60488536 60488557 60488553 60488558 +
cttatacaattcactggaaacc

SEQ ID NO: 199562 - DNA, 22 bp, Artificial Sequence
  Synthetic oligonucleotide; CTT chr2 60488539 60488560 60488556 60488561 +
atacaattcactggaaaccctg

SEQ ID NO: 199563 - DNA, 22 bp, Artificial Sequence
  Synthetic oligonucleotide; TTA chr2 60488540 60488561 60488557 60488562 +
tacaattcactggaaaccctgt

SEQ ID NO: 199564 - DNA, 22 bp, Artificial Sequence
  Synthetic oligonucleotide; TTC chr2 60488548 60488569 60488565 60488570 +
actggaaaccctgttatggctg

SEQ ID NO: 199565 - DNA, 22 bp, Artificial Sequence
  Synthetic oligonucleotide; CTG chr2 60488552 60488573 60488569 60488574 +
gaaaccctgttatggctgtaaa

SEQ ID NO: 199566 - DNA, 22 bp, Artificial Sequence
  Synthetic oligonucleotide; CTG chr2 60488561 60488582 60488578 60488583 +
ttatggctgtaaatagtttgct

SEQ ID NO: 199567 - DNA, 22 bp, Artificial Sequence
  Synthetic oligonucleotide; TTA chr2 60488564 60488585 60488581 60488586 +
tggctgtaaatagtttgcttcc

SEQ ID NO: 199568 - DNA, 22 bp, Artificial Sequence
  Synthetic oligonucleotide; CTG chr2 60488570 60488591 60488587 60488592 +
taaatagtttgcttcccccaat

SEQ ID NO: 199569 - DNA, 22 bp, Artificial Sequence
  Synthetic oligonucleotide; TTT chr2 60488580 60488601 60488597 60488602 +
gcttcccccaatgaaagaaaat

SEQ ID NO: 199570 - DNA, 22 bp, Artificial Sequence
  Synthetic oligonucleotide; TTG chr2 60488581 60488602 60488598 60488603 +
cttcccccaatgaaagaaaata

SEQ ID NO: 199571 - DNA, 22 bp, Artificial Sequence
  Synthetic oligonucleotide; CTT chr2 60488584 60488605 60488601 60488606 +
cccccaatgaaagaaaatactt

SEQ ID NO: 199572 - DNA, 22 bp, Artificial Sequence
  Synthetic oligonucleotide; TTC chr2 60488585 60488606 60488602 60488607 +
ccccaatgaaagaaaatactta

SEQ ID NO: 199573 - DNA, 22 bp, Artificial Sequence
  Synthetic oligonucleotide; CTT chr2 60488606 60488627 60488623 60488628 +
actgtactgcaggggaattcgg

SEQ ID NO: 199574 - DNA, 22 bp, Artificial Sequence
  Synthetic oligonucleotide; TTA chr2 60488607 60488628 60488624 60488629 +
ctgtactgcaggggaattcggt

SEQ ID NO: 199575 - DNA, 22 bp, Artificial Sequence
  Synthetic oligonucleotide; CTG chr2 60488610 60488631 60488627 60488632 +
tactgcaggggaattcggtaaa

SEQ ID NO: 199576 - DNA, 22 bp, Artificial Sequence
  Synthetic oligonucleotide; CTG chr2 60488615 60488636 60488632 60488637 +
caggggaattcggtaaaacttt

SEQ ID NO: 199577 - DNA, 22 bp, Artificial Sequence
  Synthetic oligonucleotide; TTC chr2 60488626 60488647 60488643 60488648 +
ggtaaaactttctagttttgct

SEQ ID NO: 199578 - DNA, 22 bp, Artificial Sequence
  Synthetic oligonucleotide; CTT chr2 60488636 60488657 60488653 60488658 +
tctagttttgcttaacatgaaa

SEQ ID NO: 199579 - DNA, 22 bp, Artificial Sequence
  Synthetic oligonucleotide; TTT chr2 60488637 60488658 60488654 60488659 +
ctagttttgcttaacatgaaaa

SEQ ID NO: 199580 - DNA, 22 bp, Artificial Sequence
  Synthetic oligonucleotide; TTC chr2 60488638 60488659 60488655 60488660 +
tagttttgcttaacatgaaaat

SEQ ID NO: 199581 - DNA, 22 bp, Artificial Sequence
  Synthetic oligonucleotide; CTA chr2 60488640 60488661 60488657 60488662 +
gttttgcttaacatgaaaataa

SEQ ID NO: 199582 - DNA, 22 bp, Artificial Sequence
  Synthetic oligonucleotide; TTT chr2 60488644 60488665 60488661 60488666 +
tgcttaacatgaaaataataac

SEQ ID NO: 199583 - DNA, 22 bp, Artificial Sequence
  Synthetic oligonucleotide; TTT chr2 60488645 60488666 60488662 60488667 +
gcttaacatgaaaataataaca

SEQ ID NO: 199584 - DNA, 22 bp, Artificial Sequence
  Synthetic oligonucleotide; TTG chr2 60488646 60488667 60488663 60488668 +
cttaacatgaaaataataacaa

SEQ ID NO: 199585 - DNA, 22 bp, Artificial Sequence
  Synthetic oligonucleotide; CTT chr2 60488649 60488670 60488666 60488671 +
aacatgaaaataataacaaaaa

SEQ ID NO: 199586 - DNA, 22 bp, Artificial Sequence
  Synthetic oligonucleotide; TTA chr2 60488650 60488671 60488667 60488672 +
acatgaaaataataacaaaaaa

SEQ ID NO: 199587 - DNA, 22 bp, Artificial Sequence
  Synthetic oligonucleotide; TTT chr2 60488675 60488696 60488692 60488697 +
caaatcagtatcaatagccaaa

SEQ ID NO: 199588 - DNA, 22 bp, Artificial Sequence
  Synthetic oligonucleotide; TTC chr2 60488676 60488697 60488693 60488698 +
aaatcagtatcaatagccaaag

SEQ ID NO: 199589 - DNA, 22 bp, Artificial Sequence
  Synthetic oligonucleotide; CTA chr2 60488714 60488735 60488731 60488736 +
aagccactgctacccaaaacga

SEQ ID NO: 199590 - DNA, 22 bp, Artificial Sequence
  Synthetic oligonucleotide; CTG chr2 60488723 60488744 60488740 60488745 +
ctacccaaaacgattttgtttg

SEQ ID NO: 199591 - DNA, 22 bp, Artificial Sequence
  Synthetic oligonucleotide; CTA chr2 60488726 60488747 60488743 60488748 +
cccaaaacgattttgtttgttt

SEQ ID NO: 199592 - DNA, 22 bp, Artificial Sequence
  Synthetic oligonucleotide; TTT chr2 60488739 60488760 60488756 60488761 +
tgtttgtttgtttgtttgtttg

SEQ ID NO: 199593 - DNA, 22 bp, Artificial Sequence
  Synthetic oligonucleotide; TTT chr2 60488740 60488761 60488757 60488762 +
gtttgtttgtttgtttgtttgt

SEQ ID NO: 199594 - DNA, 22 bp, Artificial Sequence
  Synthetic oligonucleotide; TTG chr2 60488741 60488762 60488758 60488763 +
tttgtttgtttgtttgtttgtt

SEQ ID NO: 199595 - DNA, 22 bp, Artificial Sequence
  Synthetic oligonucleotide; TTT chr2 60488744 60488765 60488761 60488766 +
gtttgtttgtttgtttgtttgt

SEQ ID NO: 199596 - DNA, 22 bp, Artificial Sequence
  Synthetic oligonucleotide; TTG chr2 60488745 60488766 60488762 60488767 +
tttgtttgtttgtttgtttgtt

SEQ ID NO: 199597 - DNA, 22 bp, Artificial Sequence
  Synthetic oligonucleotide; TTT chr2 60488748 60488769 60488765 60488770 +
gtttgtttgtttgtttgttttt

SEQ ID NO: 199598 - DNA, 22 bp, Artificial Sequence
  Synthetic oligonucleotide; TTG chr2 60488749 60488770 60488766 60488771 +
tttgtttgtttgtttgtttttt

SEQ ID NO: 199599 - DNA, 22 bp, Artificial Sequence
  Synthetic oligonucleotide; TTT chr2 60488752 60488773 60488769 60488774 +
gtttgtttgtttgttttttgtt

SEQ ID NO: 199600 - DNA, 22 bp, Artificial Sequence
  Synthetic oligonucleotide; TTG chr2 60488753 60488774 60488770 60488775 +
tttgtttgtttgttttttgttt

SEQ ID NO: 199601 - DNA, 22 bp, Artificial Sequence
  Synthetic oligonucleotide; TTT chr2 60488756 60488777 60488773 60488778 +
gtttgtttgttttttgtttctg

SEQ ID NO: 199602 - DNA, 22 bp, Artificial Sequence
  Synthetic oligonucleotide; TTG chr2 60488757 60488778 60488774 60488779 +
tttgtttgttttttgtttctga

SEQ ID NO: 199603 - DNA, 22 bp, Artificial Sequence
  Synthetic oligonucleotide; TTT chr2 60488760 60488781 60488777 60488782 +
gtttgttttttgtttctgaggt

SEQ ID NO: 199604 - DNA, 22 bp, Artificial Sequence
  Synthetic oligonucleotide; TTG chr2 60488761 60488782 60488778 60488783 +
tttgttttttgtttctgaggtg

SEQ ID NO: 199605 - DNA, 22 bp, Artificial Sequence
  Synthetic oligonucleotide; TTT chr2 60488764 60488785 60488781 60488786 +
gttttttgtttctgaggtggag

SEQ ID NO: 199606 - DNA, 22 bp, Artificial Sequence
  Synthetic oligonucleotide; TTG chr2 60488765 60488786 60488782 60488787 +
ttttttgtttctgaggtggagt

SEQ ID NO: 199607 - DNA, 22 bp, Artificial Sequence
  Synthetic oligonucleotide; TTT chr2 60488768 60488789 60488785 60488790 +
tttgtttctgaggtggagtttc

SEQ ID NO: 199608 - DNA, 22 bp, Artificial Sequence
  Synthetic oligonucleotide; TTT chr2 60488769 60488790 60488786 60488791 +
ttgtttctgaggtggagtttcg

SEQ ID NO: 199609 - DNA, 22 bp, Artificial Sequence
  Synthetic oligonucleotide; TTT chr2 60488770 60488791 60488787 60488792 +
tgtttctgaggtggagtttcgc

SEQ ID NO: 199610 - DNA, 22 bp, Artificial Sequence
  Synthetic oligonucleotide; TTT chr2 60488771 60488792 60488788 60488793 +
gtttctgaggtggagtttcgct

SEQ ID NO: 199611 - DNA, 22 bp, Artificial Sequence
  Synthetic oligonucleotide; TTG chr2 60488772 60488793 60488789 60488794 +
tttctgaggtggagtttcgctc

SEQ ID NO: 199612 - DNA, 22 bp, Artificial Sequence
  Synthetic oligonucleotide; TTT chr2 60488775 60488796 60488792 60488797 +
ctgaggtggagtttcgctcttg

SEQ ID NO: 199613 - DNA, 22 bp, Artificial Sequence
  Synthetic oligonucleotide; TTC chr2 60488776 60488797 60488793 60488798 +
tgaggtggagtttcgctcttgt

SEQ ID NO: 199614 - DNA, 22 bp, Artificial Sequence
  Synthetic oligonucleotide; CTG chr2 60488778 60488799 60488795 60488800 +
aggtggagtttcgctcttgttg

SEQ ID NO: 199615 - DNA, 22 bp, Artificial Sequence
  Synthetic oligonucleotide; TTT chr2 60488789 60488810 60488806 60488811 +
cgctcttgttgcccgggctgga

SEQ ID NO: 199616 - DNA, 22 bp, Artificial Sequence
  Synthetic oligonucleotide; TTC chr2 60488790 60488811 60488807 60488812 +
gctcttgttgcccgggctggag

SEQ ID NO: 199617 - DNA, 22 bp, Artificial Sequence
  Synthetic oligonucleotide; CTC chr2 60488794 60488815 60488811 60488816 +
ttgttgcccgggctggagtgca

SEQ ID NO: 199618 - DNA, 22 bp, Artificial Sequence
  Synthetic oligonucleotide; CTT chr2 60488796 60488817 60488813 60488818 +
gttgcccgggctggagtgcaat

SEQ ID NO: 199619 - DNA, 22 bp, Artificial Sequence
  Synthetic oligonucleotide; TTG chr2 60488797 60488818 60488814 60488819 +
ttgcccgggctggagtgcaatg

SEQ ID NO: 199620 - DNA, 22 bp, Artificial Sequence
  Synthetic oligonucleotide; TTG chr2 60488800 60488821 60488817 60488822 +
cccgggctggagtgcaatggcg

SEQ ID NO: 199621 - DNA, 22 bp, Artificial Sequence
  Synthetic oligonucleotide; CTG chr2 60488809 60488830 60488826 60488831 +
gagtgcaatggcgcaatctcgg

SEQ ID NO: 199622 - DNA, 22 bp, Artificial Sequence
  Synthetic oligonucleotide; CTC chr2 60488829 60488850 60488846 60488851 +
ggctcaccgcaatctccgcctc

SEQ ID NO: 199623 - DNA, 22 bp, Artificial Sequence
  Synthetic oligonucleotide; CTC chr2 60488834 60488855 60488851 60488856 +
accgcaatctccgcctcccggg

SEQ ID NO: 199624 - DNA, 22 bp, Artificial Sequence
  Synthetic oligonucleotide; CTC chr2 60488845 60488866 60488862 60488867 +
cgcctcccgggttcaagcgatt

SEQ ID NO: 199625 - DNA, 22 bp, Artificial Sequence
  Synthetic oligonucleotide; CTC chr2 60488851 60488872 60488868 60488873 +
ccgggttcaagcgattctcctg

SEQ ID NO: 199626 - DNA, 22 bp, Artificial Sequence
  Synthetic oligonucleotide; TTC chr2 60488859 60488880 60488876 60488881 +
aagcgattctcctgcctcagcc

SEQ ID NO: 199627 - DNA, 22 bp, Artificial Sequence
  Synthetic oligonucleotide; TTC chr2 60488868 60488889 60488885 60488890 +
tcctgcctcagcctcccaagta

SEQ ID NO: 199628 - DNA, 22 bp, Artificial Sequence
  Synthetic oligonucleotide; CTC chr2 60488870 60488891 60488887 60488892 +
ctgcctcagcctcccaagtagc

SEQ ID NO: 199629 - DNA, 22 bp, Artificial Sequence
  Synthetic oligonucleotide; CTG chr2 60488873 60488894 60488890 60488895 +
cctcagcctcccaagtagctgg

SEQ ID NO: 199630 - DNA, 22 bp, Artificial Sequence
  Synthetic oligonucleotide; CTC chr2 60488877 60488898 60488894 60488899 +
agcctcccaagtagctgggatt

SEQ ID NO: 199631 - DNA, 22 bp, Artificial Sequence
  Synthetic oligonucleotide; CTC chr2 60488883 60488904 60488900 60488905 +
ccaagtagctgggattataggc

SEQ ID NO: 199632 - DNA, 22 bp, Artificial Sequence
  Synthetic oligonucleotide; CTG chr2 60488894 60488915 60488911 60488916 +
ggattataggcatgcgccacca

SEQ ID NO: 199633 - DNA, 22 bp, Artificial Sequence
  Synthetic oligonucleotide; TTA chr2 60488900 60488921 60488917 60488922 +
taggcatgcgccaccacacgcg

SEQ ID NO: 199634 - DNA, 22 bp, Artificial Sequence
  Synthetic oligonucleotide; CTA chr2 60488926 60488947 60488943 60488948 +
atttctgtatttttggtagaga

SEQ ID NO: 199635 - DNA, 22 bp, Artificial Sequence
  Synthetic oligonucleotide; TTT chr2 60488930 60488951 60488947 60488952 +
ctgtatttttggtagagacggg

SEQ ID NO: 199636 - DNA, 22 bp, Artificial Sequence
  Synthetic oligonucleotide; TTC chr2 60488931 60488952 60488948 60488953 +
tgtatttttggtagagacgggg

SEQ ID NO: 199637 - DNA, 22 bp, Artificial Sequence
  Synthetic oligonucleotide; CTG chr2 60488933 60488954 60488950 60488955 +
tatttttggtagagacggggtt

SEQ ID NO: 199638 - DNA, 22 bp, Artificial Sequence
  Synthetic oligonucleotide; TTT chr2 60488938 60488959 60488955 60488960 +
ttggtagagacggggtttctcc

SEQ ID NO: 199639 - DNA, 22 bp, Artificial Sequence
  Synthetic oligonucleotide; TTT chr2 60488939 60488960 60488956 60488961 +
tggtagagacggggtttctcca

SEQ ID NO: 199640 - DNA, 22 bp, Artificial Sequence
  Synthetic oligonucleotide; TTT chr2 60488940 60488961 60488957 60488962 +
ggtagagacggggtttctccat

SEQ ID NO: 199641 - DNA, 22 bp, Artificial Sequence
  Synthetic oligonucleotide; TTG chr2 60488941 60488962 60488958 60488963 +
gtagagacggggtttctccatg

SEQ ID NO: 199642 - DNA, 22 bp, Artificial Sequence
  Synthetic oligonucleotide; TTT chr2 60488956 60488977 60488973 60488978 +
ctccatgttggtcaggctggtc

SEQ ID NO: 199643 - DNA, 22 bp, Artificial Sequence
  Synthetic oligonucleotide; TTC chr2 60488957 60488978 60488974 60488979 +
tccatgttggtcaggctggtct

SEQ ID NO: 199644 - DNA, 22 bp, Artificial Sequence
  Synthetic oligonucleotide; CTC chr2 60488959 60488980 60488976 60488981 +
catgttggtcaggctggtctca

SEQ ID NO: 199645 - DNA, 22 bp, Artificial Sequence
  Synthetic oligonucleotide; TTG chr2 60488966 60488987 60488983 60488988 +
gtcaggctggtctcaaactccc

SEQ ID NO: 199646 - DNA, 22 bp, Artificial Sequence
  Synthetic oligonucleotide; CTG chr2 60488975 60488996 60488992 60488997 +
gtctcaaactcccgaccttagg

SEQ ID NO: 199647 - DNA, 22 bp, Artificial Sequence
  Synthetic oligonucleotide; CTC chr2 60488980 60489001 60488997 60489002 +
aaactcccgaccttaggtgatc

SEQ ID NO: 199648 - DNA, 22 bp, Artificial Sequence
  Synthetic oligonucleotide; CTC chr2 60488986 60489007 60489003 60489008 +
ccgaccttaggtgatccaccca

SEQ ID NO: 199649 - DNA, 22 bp, Artificial Sequence
  Synthetic oligonucleotide; CTT chr2 60488994 60489015 60489011 60489016 +
aggtgatccacccacctcagcc

SEQ ID NO: 199650 - DNA, 22 bp, Artificial Sequence
  Synthetic oligonucleotide; TTA chr2 60488995 60489016 60489012 60489017 +
ggtgatccacccacctcagcct

SEQ ID NO: 199651 - DNA, 22 bp, Artificial Sequence
  Synthetic oligonucleotide; CTC chr2 60489012 60489033 60489029 60489034 +
agcctcccaaagtgctgggatt

SEQ ID NO: 199652 - DNA, 22 bp, Artificial Sequence
  Synthetic oligonucleotide; CTC chr2 60489018 60489039 60489035 60489040 +
ccaaagtgctgggattataggc

SEQ ID NO: 199653 - DNA, 22 bp, Artificial Sequence
  Synthetic oligonucleotide; CTG chr2 60489029 60489050 60489046 60489051 +
ggattataggcataagctacca

SEQ ID NO: 199654 - DNA, 22 bp, Artificial Sequence
  Synthetic oligonucleotide; TTA chr2 60489035 60489056 60489052 60489057 +
taggcataagctaccacaccca

SEQ ID NO: 199655 - DNA, 22 bp, Artificial Sequence
  Synthetic oligonucleotide; CTA chr2 60489048 60489069 60489065 60489070 +
ccacacccagccatacccaaaa

SEQ ID NO: 199656 - DNA, 22 bp, Artificial Sequence
  Synthetic oligonucleotide; TTT chr2 60489077 60489098 60489094 60489099 +
atcttcaaagaaaaaaaatgct

SEQ ID NO: 199657 - DNA, 22 bp, Artificial Sequence
  Synthetic oligonucleotide; TTA chr2 60489078 60489099 60489095 60489100 +
tcttcaaagaaaaaaaatgctg

SEQ ID NO: 199658 - DNA, 22 bp, Artificial Sequence
  Synthetic oligonucleotide; CTT chr2 60489082 60489103 60489099 60489104 +
caaagaaaaaaaatgctgtgtg

SEQ ID NO: 199659 - DNA, 22 bp, Artificial Sequence
  Synthetic oligonucleotide; TTC chr2 60489083 60489104 60489100 60489105 +
aaagaaaaaaaatgctgtgtgt

SEQ ID NO: 199660 - DNA, 22 bp, Artificial Sequence
  Synthetic oligonucleotide; CTG chr2 60489100 60489121 60489117 60489122 +
tgtgtcctaaataataggtggt

SEQ ID NO: 199661 - DNA, 22 bp, Artificial Sequence
  Synthetic oligonucleotide; CTA chr2 60489109 60489130 60489126 60489131 +
aataataggtggtcaaaatgtt

SEQ ID NO: 199662 - DNA, 22 bp, Artificial Sequence
  Synthetic oligonucleotide; TTT chr2 60489132 60489153 60489149 60489154 +
ctaaagggtaccttagacccca

SEQ ID NO: 199663 - DNA, 22 bp, Artificial Sequence
  Synthetic oligonucleotide; TTC chr2 60489133 60489154 60489150 60489155 +
taaagggtaccttagaccccaa

SEQ ID NO: 199664 - DNA, 22 bp, Artificial Sequence
  Synthetic oligonucleotide; CTA chr2 60489135 60489156 60489152 60489157 +
aagggtaccttagaccccaatt

SEQ ID NO: 199665 - DNA, 22 bp, Artificial Sequence
  Synthetic oligonucleotide; CTT chr2 60489146 60489167 60489163 60489168 +
agaccccaattaaactgttgct

SEQ ID NO: 199666 - DNA, 22 bp, Artificial Sequence
  Synthetic oligonucleotide; TTA chr2 60489147 60489168 60489164 60489169 +
gaccccaattaaactgttgctt

SEQ ID NO: 199667 - DNA, 22 bp, Artificial Sequence
  Synthetic oligonucleotide; TTA chr2 60489158 60489179 60489175 60489180 +
aactgttgctttagagtttggg

SEQ ID NO: 199668 - DNA, 22 bp, Artificial Sequence
  Synthetic oligonucleotide; CTG chr2 60489163 60489184 60489180 60489185 +
ttgctttagagtttggggaaaa

SEQ ID NO: 199669 - DNA, 22 bp, Artificial Sequence
  Synthetic oligonucleotide; TTG chr2 60489166 60489187 60489183 60489188 +
ctttagagtttggggaaaataa

SEQ ID NO: 199670 - DNA, 22 bp, Artificial Sequence
  Synthetic oligonucleotide; CTT chr2 60489169 60489190 60489186 60489191 +
tagagtttggggaaaataaagt

SEQ ID NO: 199671 - DNA, 22 bp, Artificial Sequence
  Synthetic oligonucleotide; TTT chr2 60489170 60489191 60489187 60489192 +
agagtttggggaaaataaagtg

SEQ ID NO: 199672 - DNA, 22 bp, Artificial Sequence
  Synthetic oligonucleotide; TTA chr2 60489171 60489192 60489188 60489193 +
gagtttggggaaaataaagtgg

SEQ ID NO: 199673 - DNA, 22 bp, Artificial Sequence
  Synthetic oligonucleotide; TTT chr2 60489177 60489198 60489194 60489199 +
ggggaaaataaagtggaaacac

SEQ ID NO: 199674 - DNA, 22 bp, Artificial Sequence
  Synthetic oligonucleotide; TTG chr2 60489178 60489199 60489195 60489200 +
gggaaaataaagtggaaacacc

SEQ ID NO: 199675 - DNA, 22 bp, Artificial Sequence
  Synthetic oligonucleotide; CTA chr2 60489202 60489223 60489219 60489224 +
actaaattcacactgtgagagc

SEQ ID NO: 199676 - DNA, 22 bp, Artificial Sequence
  Synthetic oligonucleotide; CTA chr2 60489206 60489227 60489223 60489228 +
aattcacactgtgagagccagt

SEQ ID NO: 199677 - DNA, 22 bp, Artificial Sequence
  Synthetic oligonucleotide; TTC chr2 60489211 60489232 60489228 60489233 +
acactgtgagagccagtcaaca

SEQ ID NO: 199678 - DNA, 22 bp, Artificial Sequence
  Synthetic oligonucleotide; CTG chr2 60489217 60489238 60489234 60489239 +
tgagagccagtcaacactagcc

SEQ ID NO: 199679 - DNA, 22 bp, Artificial Sequence
  Synthetic oligonucleotide; CTA chr2 60489236 60489257 60489253 60489258 +
gcccacatgccaatggggtcct

SEQ ID NO: 199680 - DNA, 22 bp, Artificial Sequence
  Synthetic oligonucleotide; CTT chr2 60489259 60489280 60489276 60489281 +
gtcagtcacttacactatttct

SEQ ID NO: 199681 - DNA, 22 bp, Artificial Sequence
  Synthetic oligonucleotide; TTG chr2 60489260 60489281 60489277 60489282 +
tcagtcacttacactatttctc

SEQ ID NO: 199682 - DNA, 22 bp, Artificial Sequence
  Synthetic oligonucleotide; CTT chr2 60489270 60489291 60489287 60489292 +
acactatttctcattccatttc

SEQ ID NO: 199683 - DNA, 22 bp, Artificial Sequence
  Synthetic oligonucleotide; TTA chr2 60489271 60489292 60489288 60489293 +
cactatttctcattccatttct

SEQ ID NO: 199684 - DNA, 22 bp, Artificial Sequence
  Synthetic oligonucleotide; CTA chr2 60489276 60489297 60489293 60489298 +
tttctcattccatttcttttat

SEQ ID NO: 199685 - DNA, 22 bp, Artificial Sequence
  Synthetic oligonucleotide; TTT chr2 60489279 60489300 60489296 60489301 +
ctcattccatttcttttatgtc

SEQ ID NO: 199686 - DNA, 22 bp, Artificial Sequence
  Synthetic oligonucleotide; TTC chr2 60489280 60489301 60489297 60489302 +
tcattccatttcttttatgtca

SEQ ID NO: 199687 - DNA, 22 bp, Artificial Sequence
  Synthetic oligonucleotide; CTC chr2 60489282 60489303 60489299 60489304 +
attccatttcttttatgtcatt

SEQ ID NO: 199688 - DNA, 22 bp, Artificial Sequence
  Synthetic oligonucleotide; TTC chr2 60489286 60489307 60489303 60489308 +
catttcttttatgtcattttgc

SEQ ID NO: 199689 - DNA, 22 bp, Artificial Sequence
  Synthetic oligonucleotide; TTT chr2 60489291 60489312 60489308 60489313 +
cttttatgtcattttgcccaca

SEQ ID NO: 199690 - DNA, 22 bp, Artificial Sequence
  Synthetic oligonucleotide; TTC chr2 60489292 60489313 60489309 60489314 +
ttttatgtcattttgcccacaa

SEQ ID NO: 199691 - DNA, 22 bp, Artificial Sequence
  Synthetic oligonucleotide; CTT chr2 60489294 60489315 60489311 60489316 +
ttatgtcattttgcccacaaca

SEQ ID NO: 199692 - DNA, 22 bp, Artificial Sequence
  Synthetic oligonucleotide; TTT chr2 60489295 60489316 60489312 60489317 +
tatgtcattttgcccacaacat

SEQ ID NO: 199693 - DNA, 22 bp, Artificial Sequence
  Synthetic oligonucleotide; TTT chr2 60489296 60489317 60489313 60489318 +
atgtcattttgcccacaacata

SEQ ID NO: 199694 - DNA, 22 bp, Artificial Sequence
  Synthetic oligonucleotide; TTA chr2 60489297 60489318 60489314 60489319 +
tgtcattttgcccacaacatat

SEQ ID NO: 199695 - DNA, 22 bp, Artificial Sequence
  Synthetic oligonucleotide; TTT chr2 60489305 60489326 60489322 60489327 +
tgcccacaacatatccaaattc

SEQ ID NO: 199696 - DNA, 22 bp, Artificial Sequence
  Synthetic oligonucleotide; TTT chr2 60489306 60489327 60489323 60489328 +
gcccacaacatatccaaattca

SEQ ID NO: 199697 - DNA, 22 bp, Artificial Sequence
  Synthetic oligonucleotide; TTG chr2 60489307 60489328 60489324 60489329 +
cccacaacatatccaaattcat

SEQ ID NO: 199698 - DNA, 22 bp, Artificial Sequence
  Synthetic oligonucleotide; TTC chr2 60489327 60489348 60489344 60489349 +
atacaatagaggcatttggaac

SEQ ID NO: 199699 - DNA, 22 bp, Artificial Sequence
  Synthetic oligonucleotide; TTT chr2 60489344 60489365 60489361 60489366 +
ggaacccagtgctactctgctt

SEQ ID NO: 199700 - DNA, 22 bp, Artificial Sequence
  Synthetic oligonucleotide; TTG chr2 60489345 60489366 60489362 60489367 +
gaacccagtgctactctgcttc

SEQ ID NO: 199701 - DNA, 22 bp, Artificial Sequence
  Synthetic oligonucleotide; CTA chr2 60489358 60489379 60489375 60489380 +
ctctgcttcctaactaatttct

SEQ ID NO: 199702 - DNA, 22 bp, Artificial Sequence
  Synthetic oligonucleotide; CTC chr2 60489361 60489382 60489378 60489383 +
tgcttcctaactaatttctgcc

SEQ ID NO: 199703 - DNA, 22 bp, Artificial Sequence
  Synthetic oligonucleotide; CTG chr2 60489363 60489384 60489380 60489385 +
cttcctaactaatttctgccgc

SEQ ID NO: 199704 - DNA, 22 bp, Artificial Sequence
  Synthetic oligonucleotide; CTT chr2 60489366 60489387 60489383 60489388 +
cctaactaatttctgccgctgg

SEQ ID NO: 199705 - DNA, 22 bp, Artificial Sequence
  Synthetic oligonucleotide; TTC chr2 60489367 60489388 60489384 60489389 +
ctaactaatttctgccgctgga

SEQ ID NO: 199706 - DNA, 22 bp, Artificial Sequence
  Synthetic oligonucleotide; CTA chr2 60489370 60489391 60489387 60489392 +
actaatttctgccgctggaagt

SEQ ID NO: 199707 - DNA, 22 bp, Artificial Sequence
  Synthetic oligonucleotide; CTA chr2 60489374 60489395 60489391 60489396 +
atttctgccgctggaagtttgt

SEQ ID NO: 199708 - DNA, 22 bp, Artificial Sequence
  Synthetic oligonucleotide; TTT chr2 60489378 60489399 60489395 60489400 +
ctgccgctggaagtttgttcct

SEQ ID NO: 199709 - DNA, 22 bp, Artificial Sequence
  Synthetic oligonucleotide; TTC chr2 60489379 60489400 60489396 60489401 +
tgccgctggaagtttgttccta

SEQ ID NO: 199710 - DNA, 22 bp, Artificial Sequence
  Synthetic oligonucleotide; CTG chr2 60489381 60489402 60489398 60489403 +
ccgctggaagtttgttcctaaa

SEQ ID NO: 199711 - DNA, 22 bp, Artificial Sequence
  Synthetic oligonucleotide; CTG chr2 60489387 60489408 60489404 60489409 +
gaagtttgttcctaaagccacc

SEQ ID NO: 199712 - DNA, 22 bp, Artificial Sequence
  Synthetic oligonucleotide; TTT chr2 60489394 60489415 60489411 60489416 +
gttcctaaagccaccaagtctc

SEQ ID NO: 199713 - DNA, 22 bp, Artificial Sequence
  Synthetic oligonucleotide; TTG chr2 60489395 60489416 60489412 60489417 +
ttcctaaagccaccaagtctcc

SEQ ID NO: 199714 - DNA, 22 bp, Artificial Sequence
  Synthetic oligonucleotide; TTC chr2 60489398 60489419 60489415 60489420 +
ctaaagccaccaagtctcctag

SEQ ID NO: 199715 - DNA, 22 bp, Artificial Sequence
  Synthetic oligonucleotide; CTA chr2 60489401 60489422 60489418 60489423 +
aagccaccaagtctcctagaag

SEQ ID NO: 199716 - DNA, 22 bp, Artificial Sequence
  Synthetic oligonucleotide; CTC chr2 60489416 60489437 60489433 60489438 +
ctagaagcccttatttcttggc

SEQ ID NO: 199717 - DNA, 22 bp, Artificial Sequence
  Synthetic oligonucleotide; CTA chr2 60489419 60489440 60489436 60489441 +
gaagcccttatttcttggcagt

SEQ ID NO: 199718 - DNA, 22 bp, Artificial Sequence
  Synthetic oligonucleotide; CTT chr2 60489428 60489449 60489445 60489450 +
atttcttggcagtaaacacacg

SEQ ID NO: 199719 - DNA, 22 bp, Artificial Sequence
  Synthetic oligonucleotide; TTA chr2 60489429 60489450 60489446 60489451 +
tttcttggcagtaaacacacgg

SEQ ID NO: 199720 - DNA, 22 bp, Artificial Sequence
  Synthetic oligonucleotide; TTT chr2 60489432 60489453 60489449 60489454 +
cttggcagtaaacacacggcgg

SEQ ID NO: 199721 - DNA, 22 bp, Artificial Sequence
  Synthetic oligonucleotide; TTC chr2 60489433 60489454 60489450 60489455 +
ttggcagtaaacacacggcggc

SEQ ID NO: 199722 - DNA, 22 bp, Artificial Sequence
  Synthetic oligonucleotide; CTT chr2 60489435 60489456 60489452 60489457 +
ggcagtaaacacacggcggccc

SEQ ID NO: 199723 - DNA, 22 bp, Artificial Sequence
  Synthetic oligonucleotide; TTG chr2 60489436 60489457 60489453 60489458 +
gcagtaaacacacggcggccct

SEQ ID NO: 199724 - DNA, 22 bp, Artificial Sequence
  Synthetic oligonucleotide; CTG chr2 60489459 60489480 60489476 60489481 +
cgtgccattaaaatagctgcct

SEQ ID NO: 199725 - DNA, 22 bp, Artificial Sequence
  Synthetic oligonucleotide; TTA chr2 60489469 60489490 60489486 60489491 +
aaatagctgcctcatcatccag

SEQ ID NO: 199726 - DNA, 22 bp, Artificial Sequence
  Synthetic oligonucleotide; CTG chr2 60489478 60489499 60489495 60489500 +
cctcatcatccaggatgacaaa

SEQ ID NO: 199727 - DNA, 22 bp, Artificial Sequence
  Synthetic oligonucleotide; CTC chr2 60489482 60489503 60489499 60489504 +
atcatccaggatgacaaacagc

SEQ ID NO: 199728 - DNA, 22 bp, Artificial Sequence
  Synthetic oligonucleotide; CTG chr2 60489511 60489532 60489528 60489533 +
tgtgccaagtgaccagccacaa

SEQ ID NO: 199729 - DNA, 22 bp, Artificial Sequence
  Synthetic oligonucleotide; CTT chr2 60489543 60489564 60489560 60489565 +
gtttgaccagcacctatctcaa

SEQ ID NO: 199730 - DNA, 22 bp, Artificial Sequence
  Synthetic oligonucleotide; TTG chr2 60489544 60489565 60489561 60489566 +
tttgaccagcacctatctcaaa

SEQ ID NO: 199731 - DNA, 22 bp, Artificial Sequence
  Synthetic oligonucleotide; TTT chr2 60489547 60489568 60489564 60489569 +
gaccagcacctatctcaaaaga

SEQ ID NO: 199732 - DNA, 22 bp, Artificial Sequence
  Synthetic oligonucleotide; TTG chr2 60489548 60489569 60489565 60489570 +
accagcacctatctcaaaagaa

SEQ ID NO: 199733 - DNA, 22 bp, Artificial Sequence
  Synthetic oligonucleotide; CTA chr2 60489559 60489580 60489576 60489581 +
tctcaaaagaaaattctgagta

SEQ ID NO: 199734 - DNA, 22 bp, Artificial Sequence
  Synthetic oligonucleotide; CTC chr2 60489563 60489584 60489580 60489585 +
aaaagaaaattctgagtagaag

SEQ ID NO: 199735 - DNA, 22 bp, Artificial Sequence
  Synthetic oligonucleotide; TTC chr2 60489575 60489596 60489592 60489597 +
tgagtagaagaggaagcacctg

SEQ ID NO: 199736 - DNA, 22 bp, Artificial Sequence
  Synthetic oligonucleotide; CTG chr2 60489577 60489598 60489594 60489599 +
agtagaagaggaagcacctgaa

SEQ ID NO: 199737 - DNA, 22 bp, Artificial Sequence
  Synthetic oligonucleotide; CTG chr2 60489597 60489618 60489614 60489619 +
aaggaagctgaaaagaaagtct

SEQ ID NO: 199738 - DNA, 22 bp, Artificial Sequence
  Synthetic oligonucleotide; CTG chr2 60489607 60489628 60489624 60489629 +
aaaagaaagtctgacatttgaa

SEQ ID NO: 199739 - DNA, 22 bp, Artificial Sequence
  Synthetic oligonucleotide; CTG chr2 60489620 60489641 60489637 60489642 +
acatttgaaattctaacagagg

SEQ ID NO: 199740 - DNA, 22 bp, Artificial Sequence
  Synthetic oligonucleotide; TTT chr2 60489626 60489647 60489643 60489648 +
gaaattctaacagaggttcttt

SEQ ID NO: 199741 - DNA, 22 bp, Artificial Sequence
  Synthetic oligonucleotide; TTG chr2 60489627 60489648 60489644 60489649 +
aaattctaacagaggttctttc

SEQ ID NO: 199742 - DNA, 22 bp, Artificial Sequence
  Synthetic oligonucleotide; TTC chr2 60489633 60489654 60489650 60489655 +
taacagaggttctttcccctct

SEQ ID NO: 199743 - DNA, 22 bp, Artificial Sequence
  Synthetic oligonucleotide; CTA chr2 60489635 60489656 60489652 60489657 +
acagaggttctttcccctctag

SEQ ID NO: 199744 - DNA, 22 bp, Artificial Sequence
  Synthetic oligonucleotide; TTC chr2 60489645 60489666 60489662 60489667 +
tttcccctctaggacactctgg

SEQ ID NO: 199745 - DNA, 22 bp, Artificial Sequence
  Synthetic oligonucleotide; CTT chr2 60489647 60489668 60489664 60489669 +
tcccctctaggacactctgggt

SEQ ID NO: 199746 - DNA, 22 bp, Artificial Sequence
  Synthetic oligonucleotide; TTT chr2 60489648 60489669 60489665 60489670 +
cccctctaggacactctgggtc

SEQ ID NO: 199747 - DNA, 22 bp, Artificial Sequence
  Synthetic oligonucleotide; TTC chr2 60489649 60489670 60489666 60489671 +
ccctctaggacactctgggtca

SEQ ID NO: 199748 - DNA, 22 bp, Artificial Sequence
  Synthetic oligonucleotide; CTC chr2 60489654 60489675 60489671 60489676 +
taggacactctgggtcactagc

SEQ ID NO: 199749 - DNA, 22 bp, Artificial Sequence
  Synthetic oligonucleotide; CTA chr2 60489656 60489677 60489673 60489678 +
ggacactctgggtcactagcat

SEQ ID NO: 199750 - DNA, 22 bp, Artificial Sequence
  Synthetic oligonucleotide; CTC chr2 60489664 60489685 60489681 60489686 +
tgggtcactagcatctctgctt

SEQ ID NO: 199751 - DNA, 22 bp, Artificial Sequence
  Synthetic oligonucleotide; CTG chr2 60489666 60489687 60489683 60489688 +
ggtcactagcatctctgctttc

SEQ ID NO: 199752 - DNA, 22 bp, Artificial Sequence
  Synthetic oligonucleotide; CTA chr2 60489674 60489695 60489691 60489696 +
gcatctctgctttccttgttcc

SEQ ID NO: 199753 - DNA, 22 bp, Artificial Sequence
  Synthetic oligonucleotide; CTC chr2 60489681 60489702 60489698 60489703 +
tgctttccttgttccctggctc

SEQ ID NO: 199754 - DNA, 22 bp, Artificial Sequence
  Synthetic oligonucleotide; CTG chr2 60489683 60489704 60489700 60489705 +
ctttccttgttccctggctcat

SEQ ID NO: 199755 - DNA, 22 bp, Artificial Sequence
  Synthetic oligonucleotide; CTT chr2 60489686 60489707 60489703 60489708 +
tccttgttccctggctcatctc

SEQ ID NO: 199756 - DNA, 22 bp, Artificial Sequence
  Synthetic oligonucleotide; TTT chr2 60489687 60489708 60489704 60489709 +
ccttgttccctggctcatctcc

SEQ ID NO: 199757 - DNA, 22 bp, Artificial Sequence
  Synthetic oligonucleotide; TTC chr2 60489688 60489709 60489705 60489710 +
cttgttccctggctcatctcct

SEQ ID NO: 199758 - DNA, 22 bp, Artificial Sequence
  Synthetic oligonucleotide; CTT chr2 60489691 60489712 60489708 60489713 +
gttccctggctcatctcctgag

SEQ ID NO: 199759 - DNA, 22 bp, Artificial Sequence
  Synthetic oligonucleotide; TTG chr2 60489692 60489713 60489709 60489714 +
ttccctggctcatctcctgagc

SEQ ID NO: 199760 - DNA, 22 bp, Artificial Sequence
  Synthetic oligonucleotide; TTC chr2 60489695 60489716 60489712 60489717 +
cctggctcatctcctgagcccc

SEQ ID NO: 199761 - DNA, 22 bp, Artificial Sequence
  Synthetic oligonucleotide; CTG chr2 60489699 60489720 60489716 60489721 +
gctcatctcctgagcccccggg

SEQ ID NO: 199762 - DNA, 22 bp, Artificial Sequence
  Synthetic oligonucleotide; CTC chr2 60489703 60489724 60489720 60489725 +
atctcctgagcccccgggccgt

SEQ ID NO: 199763 - DNA, 22 bp, Artificial Sequence
  Synthetic oligonucleotide; CTC chr2 60489708 60489729 60489725 60489730 +
ctgagcccccgggccgttctcc

SEQ ID NO: 199764 - DNA, 22 bp, Artificial Sequence
  Synthetic oligonucleotide; CTG chr2 60489711 60489732 60489728 60489733 +
agcccccgggccgttctccttt

SEQ ID NO: 199765 - DNA, 22 bp, Artificial Sequence
  Synthetic oligonucleotide; TTC chr2 60489727 60489748 60489744 60489749 +
tcctttccaactgtctatttac

SEQ ID NO: 199766 - DNA, 22 bp, Artificial Sequence
  Synthetic oligonucleotide; CTC chr2 60489729 60489750 60489746 60489751 +
ctttccaactgtctatttacta

SEQ ID NO: 199767 - DNA, 22 bp, Artificial Sequence
  Synthetic oligonucleotide; CTT chr2 60489732 60489753 60489749 60489754 +
tccaactgtctatttactaacc

SEQ ID NO: 199768 - DNA, 22 bp, Artificial Sequence
  Synthetic oligonucleotide; TTT chr2 60489733 60489754 60489750 60489755 +
ccaactgtctatttactaacca

SEQ ID NO: 199769 - DNA, 22 bp, Artificial Sequence
  Synthetic oligonucleotide; TTC chr2 60489734 60489755 60489751 60489756 +
caactgtctatttactaaccac

SEQ ID NO: 199770 - DNA, 22 bp, Artificial Sequence
  Synthetic oligonucleotide; CTG chr2 60489740 60489761 60489757 60489762 +
tctatttactaaccacttttat

SEQ ID NO: 199771 - DNA, 22 bp, Artificial Sequence
  Synthetic oligonucleotide; CTA chr2 60489744 60489765 60489761 60489766 +
tttactaaccacttttatcagc

SEQ ID NO: 199772 - DNA, 22 bp, Artificial Sequence
  Synthetic oligonucleotide; TTT chr2 60489747 60489768 60489764 60489769 +
actaaccacttttatcagcccc

SEQ ID NO: 199773 - DNA, 22 bp, Artificial Sequence
  Synthetic oligonucleotide; TTA chr2 60489748 60489769 60489765 60489770 +
ctaaccacttttatcagccccc

SEQ ID NO: 199774 - DNA, 22 bp, Artificial Sequence
  Synthetic oligonucleotide; CTA chr2 60489751 60489772 60489768 60489773 +
accacttttatcagcccccctc

SEQ ID NO: 199775 - DNA, 22 bp, Artificial Sequence
  Synthetic oligonucleotide; CTT chr2 60489758 60489779 60489775 60489780 +
ttatcagcccccctctcacccc

SEQ ID NO: 199776 - DNA, 22 bp, Artificial Sequence
  Synthetic oligonucleotide; TTT chr2 60489759 60489780 60489776 60489781 +
tatcagcccccctctcacccca

SEQ ID NO: 199777 - DNA, 22 bp, Artificial Sequence
  Synthetic oligonucleotide; TTT chr2 60489760 60489781 60489777 60489782 +
atcagcccccctctcaccccat

SEQ ID NO: 199778 - DNA, 22 bp, Artificial Sequence
  Synthetic oligonucleotide; TTA chr2 60489761 60489782 60489778 60489783 +
tcagcccccctctcaccccatc

SEQ ID NO: 199779 - DNA, 22 bp, Artificial Sequence
  Synthetic oligonucleotide; CTC chr2 60489773 60489794 60489790 60489795 +
tcaccccatccaaaaatgttta

SEQ ID NO: 199780 - DNA, 22 bp, Artificial Sequence
  Synthetic oligonucleotide; CTC chr2 60489775 60489796 60489792 60489797 +
accccatccaaaaatgtttact

SEQ ID NO: 199781 - DNA, 22 bp, Artificial Sequence
  Synthetic oligonucleotide; TTT chr2 60489794 60489815 60489811 60489816 +
actcaagttcaggctagcttaa

SEQ ID NO: 199782 - DNA, 22 bp, Artificial Sequence
  Synthetic oligonucleotide; TTA chr2 60489795 60489816 60489812 60489817 +
ctcaagttcaggctagcttaat

SEQ ID NO: 199783 - DNA, 22 bp, Artificial Sequence
  Synthetic oligonucleotide; CTC chr2 60489798 60489819 60489815 60489820 +
aagttcaggctagcttaataac

SEQ ID NO: 199784 - DNA, 22 bp, Artificial Sequence
  Synthetic oligonucleotide; TTC chr2 60489804 60489825 60489821 60489826 +
aggctagcttaataacccccaa

SEQ ID NO: 199785 - DNA, 22 bp, Artificial Sequence
  Synthetic oligonucleotide; CTA chr2 60489810 60489831 60489827 60489832 +
gcttaataacccccaaagcagg

SEQ ID NO: 199786 - DNA, 22 bp, Artificial Sequence
  Synthetic oligonucleotide; CTT chr2 60489814 60489835 60489831 60489836 +
aataacccccaaagcaggagga

SEQ ID NO: 199787 - DNA, 22 bp, Artificial Sequence
  Synthetic oligonucleotide; TTA chr2 60489815 60489836 60489832 60489837 +
ataacccccaaagcaggaggac

SEQ ID NO: 199788 - DNA, 22 bp, Artificial Sequence
  Synthetic oligonucleotide; CTA chr2 60489841 60489862 60489858 60489863 +
ttaaagagagatcacagggata

SEQ ID NO: 199789 - DNA, 22 bp, Artificial Sequence
  Synthetic oligonucleotide; TTA chr2 60489844 60489865 60489861 60489866 +
aagagagatcacagggatatga

SEQ ID NO: 199790 - DNA, 22 bp, Artificial Sequence
  Synthetic oligonucleotide; TTT chr2 60489870 60489891 60489887 60489892 +
tgatgcctgccttattttgtca

SEQ ID NO: 199791 - DNA, 22 bp, Artificial Sequence
  Synthetic oligonucleotide; TTT chr2 60489871 60489892 60489888 60489893 +
gatgcctgccttattttgtcac

SEQ ID NO: 199792 - DNA, 22 bp, Artificial Sequence
  Synthetic oligonucleotide; TTG chr2 60489872 60489893 60489889 60489894 +
atgcctgccttattttgtcaca

SEQ ID NO: 199793 - DNA, 22 bp, Artificial Sequence
  Synthetic oligonucleotide; CTG chr2 60489879 60489900 60489896 60489901 +
ccttattttgtcacatatcatc

SEQ ID NO: 199794 - DNA, 22 bp, Artificial Sequence
  Synthetic oligonucleotide; CTT chr2 60489883 60489904 60489900 60489905 +
attttgtcacatatcatcaaaa

SEQ ID NO: 199795 - DNA, 22 bp, Artificial Sequence
  Synthetic oligonucleotide; TTA chr2 60489884 60489905 60489901 60489906 +
ttttgtcacatatcatcaaaat

SEQ ID NO: 199796 - DNA, 22 bp, Artificial Sequence
  Synthetic oligonucleotide; TTT chr2 60489887 60489908 60489904 60489909 +
tgtcacatatcatcaaaatgat

SEQ ID NO: 199797 - DNA, 22 bp, Artificial Sequence
  Synthetic oligonucleotide; TTT chr2 60489888 60489909 60489905 60489910 +
gtcacatatcatcaaaatgata

SEQ ID NO: 199798 - DNA, 22 bp, Artificial Sequence
  Synthetic oligonucleotide; TTG chr2 60489889 60489910 60489906 60489911 +
tcacatatcatcaaaatgataa

SEQ ID NO: 199799 - DNA, 22 bp, Artificial Sequence
  Synthetic oligonucleotide; CTA chr2 60489917 60489938 60489934 60489939 +
tcatgaaacaccatccatgccc

SEQ ID NO: 199800 - DNA, 22 bp, Artificial Sequence
  Synthetic oligonucleotide; CTG chr2 60489941 60489962 60489958 60489963 +
agtatcccaacatggatggact

SEQ ID NO: 199801 - DNA, 22 bp, Artificial Sequence
  Synthetic oligonucleotide; CTG chr2 60489964 60489985 60489981 60489986 +
gaggagagggacaagggaccaa

SEQ ID NO: 199802 - DNA, 22 bp, Artificial Sequence
  Synthetic oligonucleotide; CTG chr2 60489997 60490018 60490014 60490019 +
atgggcccttgattctgaacgt

SEQ ID NO: 199803 - DNA, 22 bp, Artificial Sequence
  Synthetic oligonucleotide; CTT chr2 60490007 60490028 60490024 60490029 +
gattctgaacgtcattcctgcc

SEQ ID NO: 199804 - DNA, 22 bp, Artificial Sequence
  Synthetic oligonucleotide; TTG chr2 60490008 60490029 60490025 60490030 +
attctgaacgtcattcctgccc

SEQ ID NO: 199805 - DNA, 22 bp, Artificial Sequence
  Synthetic oligonucleotide; TTC chr2 60490012 60490033 60490029 60490034 +
tgaacgtcattcctgcccactc

SEQ ID NO: 199806 - DNA, 22 bp, Artificial Sequence
  Synthetic oligonucleotide; CTG chr2 60490014 60490035 60490031 60490036 +
aacgtcattcctgcccactccc

SEQ ID NO: 199807 - DNA, 22 bp, Artificial Sequence
  Synthetic oligonucleotide; TTC chr2 60490024 60490045 60490041 60490046 +
ctgcccactccccatctgcaat

SEQ ID NO: 199808 - DNA, 22 bp, Artificial Sequence
  Synthetic oligonucleotide; CTG chr2 60490027 60490048 60490044 60490049 +
cccactccccatctgcaatggg

SEQ ID NO: 199809 - DNA, 22 bp, Artificial Sequence
  Synthetic oligonucleotide; CTC chr2 60490034 60490055 60490051 60490056 +
cccatctgcaatgggggcaaag

SEQ ID NO: 199810 - DNA, 22 bp, Artificial Sequence
  Synthetic oligonucleotide; CTG chr2 60490042 60490063 60490059 60490064 +
caatgggggcaaaggcaaaagg

SEQ ID NO: 199811 - DNA, 22 bp, Artificial Sequence
  Synthetic oligonucleotide; CTT chr2 60490071 60490092 60490088 60490093 +
tccaagatttaaacagtcctct

SEQ ID NO: 199812 - DNA, 22 bp, Artificial Sequence
  Synthetic oligonucleotide; TTT chr2 60490072 60490093 60490089 60490094 +
ccaagatttaaacagtcctcta

SEQ ID NO: 199813 - DNA, 22 bp, Artificial Sequence
  Synthetic oligonucleotide; TTC chr2 60490073 60490094 60490090 60490095 +
caagatttaaacagtcctctat

SEQ ID NO: 199814 - DNA, 22 bp, Artificial Sequence
  Synthetic oligonucleotide; TTT chr2 60490081 60490102 60490098 60490103 +
aaacagtcctctatattagtaa

SEQ ID NO: 199815 - DNA, 22 bp, Artificial Sequence
  Synthetic oligonucleotide; TTA chr2 60490082 60490103 60490099 60490104 +
aacagtcctctatattagtaac

SEQ ID NO: 199816 - DNA, 22 bp, Artificial Sequence
  Synthetic oligonucleotide; CTC chr2 60490092 60490113 60490109 60490114 +
tatattagtaacagacccatgt

SEQ ID NO: 199817 - DNA, 22 bp, Artificial Sequence
  Synthetic oligonucleotide; CTA chr2 60490094 60490115 60490111 60490116 +
tattagtaacagacccatgtgc

SEQ ID NO: 199818 - DNA, 22 bp, Artificial Sequence
  Synthetic oligonucleotide; TTA chr2 60490099 60490120 60490116 60490121 +
gtaacagacccatgtgctaggc

SEQ ID NO: 199819 - DNA, 22 bp, Artificial Sequence
  Synthetic oligonucleotide; CTA chr2 60490118 60490139 60490135 60490140 +
ggctcctacaatatctggttcc

SEQ ID NO: 199820 - DNA, 22 bp, Artificial Sequence
  Synthetic oligonucleotide; CTC chr2 60490123 60490144 60490140 60490145 +
ctacaatatctggttccattct

SEQ ID NO: 199821 - DNA, 22 bp, Artificial Sequence
  Synthetic oligonucleotide; CTA chr2 60490126 60490147 60490143 60490148 +
caatatctggttccattctgct

SEQ ID NO: 199822 - DNA, 22 bp, Artificial Sequence
  Synthetic oligonucleotide; CTG chr2 60490135 60490156 60490152 60490157 +
gttccattctgctagtgaaagg

SEQ ID NO: 199823 - DNA, 22 bp, Artificial Sequence
  Synthetic oligonucleotide; TTC chr2 60490139 60490160 60490156 60490161 +
cattctgctagtgaaaggaaac

SEQ ID NO: 199824 - DNA, 22 bp, Artificial Sequence
  Synthetic oligonucleotide; TTC chr2 60490144 60490165 60490161 60490166 +
tgctagtgaaaggaaaccctac

SEQ ID NO: 199825 - DNA, 22 bp, Artificial Sequence
  Synthetic oligonucleotide; CTG chr2 60490146 60490167 60490163 60490168 +
ctagtgaaaggaaaccctacgg

SEQ ID NO: 199826 - DNA, 22 bp, Artificial Sequence
  Synthetic oligonucleotide; CTA chr2 60490149 60490170 60490166 60490171 +
gtgaaaggaaaccctacggtca

SEQ ID NO: 199827 - DNA, 22 bp, Artificial Sequence
  Synthetic oligonucleotide; CTA chr2 60490165 60490186 60490182 60490187 +
cggtcaaccaactccatcctct

SEQ ID NO: 199828 - DNA, 22 bp, Artificial Sequence
  Synthetic oligonucleotide; CTC chr2 60490179 60490200 60490196 60490201 +
catcctctagaacatataagtc

SEQ ID NO: 199829 - DNA, 22 bp, Artificial Sequence
  Synthetic oligonucleotide; CTC chr2 60490186 60490207 60490203 60490208 +
tagaacatataagtcaacaggg

SEQ ID NO: 199830 - DNA, 22 bp, Artificial Sequence
  Synthetic oligonucleotide; CTA chr2 60490188 60490209 60490205 60490210 +
gaacatataagtcaacagggga

SEQ ID NO: 199831 - DNA, 22 bp, Artificial Sequence
  Synthetic oligonucleotide; CTC chr2 60490216 60490237 60490233 60490238 +
ggcatgaagggtataacagaga

SEQ ID NO: 199832 - DNA, 22 bp, Artificial Sequence
  Synthetic oligonucleotide; TTT chr2 60490242 60490263 60490259 60490264 +
caacaactcatccacccccttt

SEQ ID NO: 199833 - DNA, 22 bp, Artificial Sequence
  Synthetic oligonucleotide; TTC chr2 60490243 60490264 60490260 60490265 +
aacaactcatccaccccctttg

SEQ ID NO: 199834 - DNA, 22 bp, Artificial Sequence
  Synthetic oligonucleotide; CTC chr2 60490251 60490272 60490268 60490273 +
atccaccccctttgcagagtcc

SEQ ID NO: 199835 - DNA, 22 bp, Artificial Sequence
  Synthetic oligonucleotide; CTT chr2 60490263 60490284 60490280 60490285 +
tgcagagtcctcacttaacatc

SEQ ID NO: 199836 - DNA, 22 bp, Artificial Sequence
  Synthetic oligonucleotide; TTT chr2 60490264 60490285 60490281 60490286 +
gcagagtcctcacttaacatcc

SEQ ID NO: 199837 - DNA, 22 bp, Artificial Sequence
  Synthetic oligonucleotide; TTG chr2 60490265 60490286 60490282 60490287 +
cagagtcctcacttaacatccc

SEQ ID NO: 199838 - DNA, 22 bp, Artificial Sequence
  Synthetic oligonucleotide; CTC chr2 60490275 60490296 60490292 60490297 +
acttaacatcccctagcatgct

SEQ ID NO: 199839 - DNA, 22 bp, Artificial Sequence
  Synthetic oligonucleotide; CTT chr2 60490279 60490300 60490296 60490301 +
aacatcccctagcatgctgcct

SEQ ID NO: 199840 - DNA, 22 bp, Artificial Sequence
  Synthetic oligonucleotide; TTA chr2 60490280 60490301 60490297 60490302 +
acatcccctagcatgctgcctt

SEQ ID NO: 199841 - DNA, 22 bp, Artificial Sequence
  Synthetic oligonucleotide; CTA chr2 60490290 60490311 60490307 60490312 +
gcatgctgcctttgtcttctga

SEQ ID NO: 199842 - DNA, 22 bp, Artificial Sequence
  Synthetic oligonucleotide; CTG chr2 60490298 60490319 60490315 60490320 +
cctttgtcttctgatcagagta

SEQ ID NO: 199843 - DNA, 22 bp, Artificial Sequence
  Synthetic oligonucleotide; CTT chr2 60490302 60490323 60490319 60490324 +
tgtcttctgatcagagtatttc

SEQ ID NO: 199844 - DNA, 22 bp, Artificial Sequence
  Synthetic oligonucleotide; TTT chr2 60490303 60490324 60490320 60490325 +
gtcttctgatcagagtatttca

SEQ ID NO: 199845 - DNA, 22 bp, Artificial Sequence
  Synthetic oligonucleotide; TTG chr2 60490304 60490325 60490321 60490326 +
tcttctgatcagagtatttcag

SEQ ID NO: 199846 - DNA, 22 bp, Artificial Sequence
  Synthetic oligonucleotide; CTT chr2 60490308 60490329 60490325 60490330 +
ctgatcagagtatttcagcagc

SEQ ID NO: 199847 - DNA, 22 bp, Artificial Sequence
  Synthetic oligonucleotide; TTC chr2 60490309 60490330 60490326 60490331 +
tgatcagagtatttcagcagcc

SEQ ID NO: 199848 - DNA, 22 bp, Artificial Sequence
  Synthetic oligonucleotide; CTG chr2 60490311 60490332 60490328 60490333 +
atcagagtatttcagcagccct

SEQ ID NO: 199849 - DNA, 22 bp, Artificial Sequence
  Synthetic oligonucleotide; TTT chr2 60490323 60490344 60490340 60490345 +
cagcagccctctgtgatctata

SEQ ID NO: 199850 - DNA, 22 bp, Artificial Sequence
  Synthetic oligonucleotide; TTC chr2 60490324 60490345 60490341 60490346 +
agcagccctctgtgatctatag

SEQ ID NO: 199851 - DNA, 22 bp, Artificial Sequence
  Synthetic oligonucleotide; CTC chr2 60490334 60490355 60490351 60490356 +
tgtgatctataggatatggtcc

SEQ ID NO: 199852 - DNA, 22 bp, Artificial Sequence
  Synthetic oligonucleotide; CTG chr2 60490336 60490357 60490353 60490358 +
tgatctataggatatggtccaa

SEQ ID NO: 199853 - DNA, 22 bp, Artificial Sequence
  Synthetic oligonucleotide; CTA chr2 60490343 60490364 60490360 60490365 +
taggatatggtccaactcctta

SEQ ID NO: 199854 - DNA, 22 bp, Artificial Sequence
  Synthetic oligonucleotide; CTC chr2 60490361 60490382 60490378 60490383 +
cttaagccatcattccagagct

SEQ ID NO: 199855 - DNA, 22 bp, Artificial Sequence
  Synthetic oligonucleotide; CTT chr2 60490364 60490385 60490381 60490386 +
aagccatcattccagagctcca

SEQ ID NO: 199856 - DNA, 22 bp, Artificial Sequence
  Synthetic oligonucleotide; TTA chr2 60490365 60490386 60490382 60490387 +
agccatcattccagagctccac

SEQ ID NO: 199857 - DNA, 22 bp, Artificial Sequence
  Synthetic oligonucleotide; TTC chr2 60490376 60490397 60490393 60490398 +
cagagctccacaatccaactcc

SEQ ID NO: 199858 - DNA, 22 bp, Artificial Sequence
  Synthetic oligonucleotide; CTC chr2 60490384 60490405 60490401 60490406 +
cacaatccaactccaattttct

SEQ ID NO: 199859 - DNA, 22 bp, Artificial Sequence
  Synthetic oligonucleotide; CTC chr2 60490397 60490418 60490414 60490419 +
caattttctattccagtcttag

SEQ ID NO: 199860 - DNA, 22 bp, Artificial Sequence
  Synthetic oligonucleotide; TTT chr2 60490403 60490424 60490420 60490425 +
tctattccagtcttagttcccc

SEQ ID NO: 199861 - DNA, 22 bp, Artificial Sequence
  Synthetic oligonucleotide; TTT chr2 60490404 60490425 60490421 60490426 +
ctattccagtcttagttccccg

SEQ ID NO: 199862 - DNA, 22 bp, Artificial Sequence
  Synthetic oligonucleotide; TTC chr2 60490405 60490426 60490422 60490427 +
tattccagtcttagttccccgt

SEQ ID NO: 199863 - DNA, 22 bp, Artificial Sequence
  Synthetic oligonucleotide; CTA chr2 60490407 60490428 60490424 60490429 +
ttccagtcttagttccccgtac

SEQ ID NO: 199864 - DNA, 22 bp, Artificial Sequence
  Synthetic oligonucleotide; TTC chr2 60490410 60490431 60490427 60490432 +
cagtcttagttccccgtaccca

SEQ ID NO: 199865 - DNA, 22 bp, Artificial Sequence
  Synthetic oligonucleotide; CTT chr2 60490417 60490438 60490434 60490439 +
agttccccgtacccatcaagga

SEQ ID NO: 199866 - DNA, 22 bp, Artificial Sequence
  Synthetic oligonucleotide; TTA chr2 60490418 60490439 60490435 60490440 +
gttccccgtacccatcaaggaa

SEQ ID NO: 199867 - DNA, 22 bp, Artificial Sequence
  Synthetic oligonucleotide; TTC chr2 60490422 60490443 60490439 60490444 +
cccgtacccatcaaggaaaata

SEQ ID NO: 199868 - DNA, 22 bp, Artificial Sequence
  Synthetic oligonucleotide; TTC chr2 60490447 60490468 60490464 60490469 +
tgcccaagtaaaaatcccttcc

SEQ ID NO: 199869 - DNA, 22 bp, Artificial Sequence
  Synthetic oligonucleotide; CTG chr2 60490449 60490470 60490466 60490471 +
cccaagtaaaaatcccttccgt

SEQ ID NO: 199870 - DNA, 22 bp, Artificial Sequence
  Synthetic oligonucleotide; CTT chr2 60490467 60490488 60490484 60490489 +
ccgttctcatttccttcctggc

SEQ ID NO: 199871 - DNA, 22 bp, Artificial Sequence
  Synthetic oligonucleotide; TTC chr2 60490468 60490489 60490485 60490490 +
cgttctcatttccttcctggct

SEQ ID NO: 199872 - DNA, 22 bp, Artificial Sequence
  Synthetic oligonucleotide; TTC chr2 60490473 60490494 60490490 60490495 +
tcatttccttcctggcttttct

SEQ ID NO: 199873 - DNA, 22 bp, Artificial Sequence
  Synthetic oligonucleotide; CTC chr2 60490475 60490496 60490492 60490497 +
atttccttcctggcttttcttc

SEQ ID NO: 199874 - DNA, 22 bp, Artificial Sequence
  Synthetic oligonucleotide; TTT chr2 60490479 60490500 60490496 60490501 +
ccttcctggcttttcttcttct

SEQ ID NO: 199875 - DNA, 22 bp, Artificial Sequence
  Synthetic oligonucleotide; TTC chr2 60490480 60490501 60490497 60490502 +
cttcctggcttttcttcttctt

SEQ ID NO: 199876 - DNA, 22 bp, Artificial Sequence
  Synthetic oligonucleotide; CTT chr2 60490483 60490504 60490500 60490505 +
cctggcttttcttcttcttctc

SEQ ID NO: 199877 - DNA, 22 bp, Artificial Sequence
  Synthetic oligonucleotide; TTC chr2 60490484 60490505 60490501 60490506 +
ctggcttttcttcttcttctct

SEQ ID NO: 199878 - DNA, 22 bp, Artificial Sequence
  Synthetic oligonucleotide; CTG chr2 60490487 60490508 60490504 60490509 +
gcttttcttcttcttctcttac

SEQ ID NO: 199879 - DNA, 22 bp, Artificial Sequence
  Synthetic oligonucleotide; CTT chr2 60490491 60490512 60490508 60490513 +
ttcttcttcttctcttacctcc

SEQ ID NO: 199880 - DNA, 22 bp, Artificial Sequence
  Synthetic oligonucleotide; TTT chr2 60490492 60490513 60490509 60490514 +
tcttcttcttctcttacctcct

SEQ ID NO: 199881 - DNA, 22 bp, Artificial Sequence
  Synthetic oligonucleotide; TTT chr2 60490493 60490514 60490510 60490515 +
cttcttcttctcttacctcctg

SEQ ID NO: 199882 - DNA, 22 bp, Artificial Sequence
  Synthetic oligonucleotide; TTC chr2 60490494 60490515 60490511 60490516 +
ttcttcttctcttacctcctgg

SEQ ID NO: 199883 - DNA, 22 bp, Artificial Sequence
  Synthetic oligonucleotide; CTT chr2 60490496 60490517 60490513 60490518 +
cttcttctcttacctcctggaa

SEQ ID NO: 199884 - DNA, 22 bp, Artificial Sequence
  Synthetic oligonucleotide; TTC chr2 60490497 60490518 60490514 60490519 +
ttcttctcttacctcctggaat

SEQ ID NO: 199885 - DNA, 22 bp, Artificial Sequence
  Synthetic oligonucleotide; CTT chr2 60490499 60490520 60490516 60490521 +
cttctcttacctcctggaatcc

SEQ ID NO: 199886 - DNA, 22 bp, Artificial Sequence
  Synthetic oligonucleotide; TTC chr2 60490500 60490521 60490517 60490522 +
ttctcttacctcctggaatcct

SEQ ID NO: 199887 - DNA, 22 bp, Artificial Sequence
  Synthetic oligonucleotide; CTT chr2 60490502 60490523 60490519 60490524 +
ctcttacctcctggaatcctgc

SEQ ID NO: 199888 - DNA, 22 bp, Artificial Sequence
  Synthetic oligonucleotide; TTC chr2 60490503 60490524 60490520 60490525 +
tcttacctcctggaatcctgct

SEQ ID NO: 199889 - DNA, 22 bp, Artificial Sequence
  Synthetic oligonucleotide; CTC chr2 60490505 60490526 60490522 60490527 +
ttacctcctggaatcctgctca

SEQ ID NO: 199890 - DNA, 22 bp, Artificial Sequence
  Synthetic oligonucleotide; CTT chr2 60490507 60490528 60490524 60490529 +
acctcctggaatcctgctcata

SEQ ID NO: 199891 - DNA, 22 bp, Artificial Sequence
  Synthetic oligonucleotide; TTA chr2 60490508 60490529 60490525 60490530 +
cctcctggaatcctgctcatac

SEQ ID NO: 199892 - DNA, 22 bp, Artificial Sequence
  Synthetic oligonucleotide; CTC chr2 60490512 60490533 60490529 60490534 +
ctggaatcctgctcatacttca

SEQ ID NO: 199893 - DNA, 22 bp, Artificial Sequence
  Synthetic oligonucleotide; CTG chr2 60490515 60490536 60490532 60490537 +
gaatcctgctcatacttcaagg

SEQ ID NO: 199894 - DNA, 22 bp, Artificial Sequence
  Synthetic oligonucleotide; CTG chr2 60490523 60490544 60490540 60490545 +
ctcatacttcaaggcctcaatg

SEQ ID NO: 199895 - DNA, 22 bp, Artificial Sequence
  Synthetic oligonucleotide; CTC chr2 60490526 60490547 60490543 60490548 +
atacttcaaggcctcaatgaag

SEQ ID NO: 199896 - DNA, 22 bp, Artificial Sequence
  Synthetic oligonucleotide; CTT chr2 60490532 60490553 60490549 60490554 +
caaggcctcaatgaaggtctac

SEQ ID NO: 199897 - DNA, 22 bp, Artificial Sequence
  Synthetic oligonucleotide; TTC chr2 60490533 60490554 60490550 60490555 +
aaggcctcaatgaaggtctacc

SEQ ID NO: 199898 - DNA, 22 bp, Artificial Sequence
  Synthetic oligonucleotide; CTC chr2 60490541 60490562 60490558 60490563 +
aatgaaggtctacctagtcacc

SEQ ID NO: 199899 - DNA, 22 bp, Artificial Sequence
  Synthetic oligonucleotide; CTA chr2 60490553 60490574 60490570 60490575 +
cctagtcaccttagcaagaaga

SEQ ID NO: 199900 - DNA, 22 bp, Artificial Sequence
  Synthetic oligonucleotide; CTA chr2 60490557 60490578 60490574 60490579 +
gtcaccttagcaagaagaatca

SEQ ID NO: 199901 - DNA, 22 bp, Artificial Sequence
  Synthetic oligonucleotide; CTT chr2 60490565 60490586 60490582 60490587 +
agcaagaagaatcaatctcatc

SEQ ID NO: 199902 - DNA, 22 bp, Artificial Sequence
  Synthetic oligonucleotide; TTA chr2 60490566 60490587 60490583 60490588 +
gcaagaagaatcaatctcatcc

SEQ ID NO: 199903 - DNA, 22 bp, Artificial Sequence
  Synthetic oligonucleotide; CTC chr2 60490584 60490605 60490601 60490606 +
atccttctccaacctcatagaa

SEQ ID NO: 199904 - DNA, 22 bp, Artificial Sequence
  Synthetic oligonucleotide; CTT chr2 60490590 60490611 60490607 60490612 +
ctccaacctcatagaacactca

SEQ ID NO: 199905 - DNA, 22 bp, Artificial Sequence
  Synthetic oligonucleotide; TTC chr2 60490591 60490612 60490608 60490613 +
tccaacctcatagaacactcat

SEQ ID NO: 199906 - DNA, 22 bp, Artificial Sequence
  Synthetic oligonucleotide; CTC chr2 60490593 60490614 60490610 60490615 +
caacctcatagaacactcatcc

SEQ ID NO: 199907 - DNA, 22 bp, Artificial Sequence
  Synthetic oligonucleotide; CTC chr2 60490600 60490621 60490617 60490622 +
atagaacactcatcccatgcac

SEQ ID NO: 199908 - DNA, 22 bp, Artificial Sequence
  Synthetic oligonucleotide; CTC chr2 60490611 60490632 60490628 60490633 +
atcccatgcaccactccctgac

SEQ ID NO: 199909 - DNA, 22 bp, Artificial Sequence
  Synthetic oligonucleotide; CTC chr2 60490627 60490648 60490644 60490649 +
cctgactcatatctaggcctta

SEQ ID NO: 199910 - DNA, 22 bp, Artificial Sequence
  Synthetic oligonucleotide; CTG chr2 60490631 60490652 60490648 60490653 +
actcatatctaggccttacatt

SEQ ID NO: 199911 - DNA, 22 bp, Artificial Sequence
  Synthetic oligonucleotide; CTC chr2 60490635 60490656 60490652 60490657 +
atatctaggccttacattgctg

SEQ ID NO: 199912 - DNA, 22 bp, Artificial Sequence
  Synthetic oligonucleotide; CTA chr2 60490642 60490663 60490659 60490664 +
ggccttacattgctggttaacc

SEQ ID NO: 199913 - DNA, 22 bp, Artificial Sequence
  Synthetic oligonucleotide; CTT chr2 60490648 60490669 60490665 60490670 +
acattgctggttaaccctctat

SEQ ID NO: 199914 - DNA, 22 bp, Artificial Sequence
  Synthetic oligonucleotide; TTA chr2 60490649 60490670 60490666 60490671 +
cattgctggttaaccctctatg

SEQ ID NO: 199915 - DNA, 22 bp, Artificial Sequence
  Synthetic oligonucleotide; TTG chr2 60490654 60490675 60490671 60490676 +
ctggttaaccctctatgcctct

SEQ ID NO: 199916 - DNA, 22 bp, Artificial Sequence
  Synthetic oligonucleotide; CTG chr2 60490657 60490678 60490674 60490679 +
gttaaccctctatgcctctaat

SEQ ID NO: 199917 - DNA, 22 bp, Artificial Sequence
  Synthetic oligonucleotide; TTA chr2 60490661 60490682 60490678 60490683 +
accctctatgcctctaattaat

SEQ ID NO: 199918 - DNA, 22 bp, Artificial Sequence
  Synthetic oligonucleotide; CTC chr2 60490667 60490688 60490684 60490689 +
tatgcctctaattaatttcatg

SEQ ID NO: 199919 - DNA, 22 bp, Artificial Sequence
  Synthetic oligonucleotide; CTA chr2 60490669 60490690 60490686 60490691 +
tgcctctaattaatttcatgtg

SEQ ID NO: 199920 - DNA, 22 bp, Artificial Sequence
  Synthetic oligonucleotide; CTC chr2 60490675 60490696 60490692 60490697 +
taattaatttcatgtgttccca

SEQ ID NO: 199921 - DNA, 22 bp, Artificial Sequence
  Synthetic oligonucleotide; CTA chr2 60490677 60490698 60490694 60490699 +
attaatttcatgtgttcccaat

SEQ ID NO: 199922 - DNA, 22 bp, Artificial Sequence
  Synthetic oligonucleotide; TTA chr2 60490681 60490702 60490698 60490703 +
atttcatgtgttcccaatgagt

SEQ ID NO: 199923 - DNA, 22 bp, Artificial Sequence
  Synthetic oligonucleotide; TTT chr2 60490685 60490706 60490702 60490707 +
catgtgttcccaatgagtttct

SEQ ID NO: 199924 - DNA, 22 bp, Artificial Sequence
  Synthetic oligonucleotide; TTC chr2 60490686 60490707 60490703 60490708 +
atgtgttcccaatgagtttctt

SEQ ID NO: 199925 - DNA, 22 bp, Artificial Sequence
  Synthetic oligonucleotide; TTC chr2 60490694 60490715 60490711 60490716 +
ccaatgagtttcttcaatacag

SEQ ID NO: 199926 - DNA, 22 bp, Artificial Sequence
  Synthetic oligonucleotide; TTT chr2 60490705 60490726 60490722 60490727 +
cttcaatacagggactctttct

SEQ ID NO: 199927 - DNA, 22 bp, Artificial Sequence
  Synthetic oligonucleotide; TTC chr2 60490706 60490727 60490723 60490728 +
ttcaatacagggactctttctc

SEQ ID NO: 199928 - DNA, 22 bp, Artificial Sequence
  Synthetic oligonucleotide; CTT chr2 60490708 60490729 60490725 60490730 +
caatacagggactctttctcct

SEQ ID NO: 199929 - DNA, 22 bp, Artificial Sequence
  Synthetic oligonucleotide; TTC chr2 60490709 60490730 60490726 60490731 +
aatacagggactctttctccta

SEQ ID NO: 199930 - DNA, 22 bp, Artificial Sequence
  Synthetic oligonucleotide; CTC chr2 60490722 60490743 60490739 60490744 +
tttctcctacttgcttctatta

SEQ ID NO: 199931 - DNA, 22 bp, Artificial Sequence
  Synthetic oligonucleotide; CTT chr2 60490724 60490745 60490741 60490746 +
tctcctacttgcttctattata

SEQ ID NO: 199932 - DNA, 22 bp, Artificial Sequence
  Synthetic oligonucleotide; TTT chr2 60490725 60490746 60490742 60490747 +
ctcctacttgcttctattatat

SEQ ID NO: 199933 - DNA, 22 bp, Artificial Sequence
  Synthetic oligonucleotide; TTC chr2 60490726 60490747 60490743 60490748 +
tcctacttgcttctattatatt

SEQ ID NO: 199934 - DNA, 22 bp, Artificial Sequence
  Synthetic oligonucleotide; CTC chr2 60490728 60490749 60490745 60490750 +
ctacttgcttctattatatttg

SEQ ID NO: 199935 - DNA, 22 bp, Artificial Sequence
  Synthetic oligonucleotide; CTA chr2 60490731 60490752 60490748 60490753 +
cttgcttctattatatttgaaa

SEQ ID NO: 199936 - DNA, 22 bp, Artificial Sequence
  Synthetic oligonucleotide; CTT chr2 60490734 60490755 60490751 60490756 +
gcttctattatatttgaaagta

SEQ ID NO: 199937 - DNA, 22 bp, Artificial Sequence
  Synthetic oligonucleotide; TTG chr2 60490735 60490756 60490752 60490757 +
cttctattatatttgaaagtac

SEQ ID NO: 199938 - DNA, 22 bp, Artificial Sequence
  Synthetic oligonucleotide; CTT chr2 60490738 60490759 60490755 60490760 +
ctattatatttgaaagtaccag

SEQ ID NO: 199939 - DNA, 22 bp, Artificial Sequence
  Synthetic oligonucleotide; TTC chr2 60490739 60490760 60490756 60490761 +
tattatatttgaaagtaccagc

SEQ ID NO: 199940 - DNA, 22 bp, Artificial Sequence
  Synthetic oligonucleotide; CTA chr2 60490741 60490762 60490758 60490763 +
ttatatttgaaagtaccagcac

SEQ ID NO: 199941 - DNA, 22 bp, Artificial Sequence
  Synthetic oligonucleotide; TTA chr2 60490744 60490765 60490761 60490766 +
tatttgaaagtaccagcacagc

SEQ ID NO: 199942 - DNA, 22 bp, Artificial Sequence
  Synthetic oligonucleotide; TTT chr2 60490749 60490770 60490766 60490771 +
gaaagtaccagcacagcatgtg

SEQ ID NO: 199943 - DNA, 22 bp, Artificial Sequence
  Synthetic oligonucleotide; TTG chr2 60490750 60490771 60490767 60490772 +
aaagtaccagcacagcatgtga

SEQ ID NO: 199944 - DNA, 22 bp, Artificial Sequence
  Synthetic oligonucleotide; TTC chr2 60490782 60490803 60490799 60490804 +
atatattctaggaattcaacaa

SEQ ID NO: 199945 - DNA, 22 bp, Artificial Sequence
  Synthetic oligonucleotide; TTC chr2 60490790 60490811 60490807 60490812 +
taggaattcaacaaatagcata

SEQ ID NO: 199946 - DNA, 22 bp, Artificial Sequence
  Synthetic oligonucleotide; CTA chr2 60490792 60490813 60490809 60490814 +
ggaattcaacaaatagcatata

SEQ ID NO: 199947 - DNA, 22 bp, Artificial Sequence
  Synthetic oligonucleotide; TTC chr2 60490799 60490820 60490816 60490821 +
aacaaatagcatataaatgact

SEQ ID NO: 199948 - DNA, 22 bp, Artificial Sequence
  Synthetic oligonucleotide; CTG chr2 60490822 60490843 60490839 60490844 +
atttaccttcctaaaagggaag

SEQ ID NO: 199949 - DNA, 22 bp, Artificial Sequence
  Synthetic oligonucleotide; TTT chr2 60490826 60490847 60490843 60490848 +
accttcctaaaagggaagttat

SEQ ID NO: 199950 - DNA, 22 bp, Artificial Sequence
  Synthetic oligonucleotide; TTA chr2 60490827 60490848 60490844 60490849 +
ccttcctaaaagggaagttatt

SEQ ID NO: 199951 - DNA, 22 bp, Artificial Sequence
  Synthetic oligonucleotide; CTT chr2 60490831 60490852 60490848 60490853 +
cctaaaagggaagttatttttc

SEQ ID NO: 199952 - DNA, 22 bp, Artificial Sequence
  Synthetic oligonucleotide; TTC chr2 60490832 60490853 60490849 60490854 +
ctaaaagggaagttatttttcc

SEQ ID NO: 199953 - DNA, 22 bp, Artificial Sequence
  Synthetic oligonucleotide; CTA chr2 60490835 60490856 60490852 60490857 +
aaagggaagttatttttccaaa

SEQ ID NO: 199954 - DNA, 22 bp, Artificial Sequence
  Synthetic oligonucleotide; TTA chr2 60490847 60490868 60490864 60490869 +
tttttccaaatatcatttctgt

SEQ ID NO: 199955 - DNA, 22 bp, Artificial Sequence
  Synthetic oligonucleotide; TTT chr2 60490850 60490871 60490867 60490872 +
ttccaaatatcatttctgttca

SEQ ID NO: 199956 - DNA, 22 bp, Artificial Sequence
  Synthetic oligonucleotide; TTT chr2 60490851 60490872 60490868 60490873 +
tccaaatatcatttctgttcaa

SEQ ID NO: 199957 - DNA, 22 bp, Artificial Sequence
  Synthetic oligonucleotide; TTT chr2 60490852 60490873 60490869 60490874 +
ccaaatatcatttctgttcaaa

SEQ ID NO: 199958 - DNA, 22 bp, Artificial Sequence
  Synthetic oligonucleotide; TTC chr2 60490853 60490874 60490870 60490875 +
caaatatcatttctgttcaaaa

SEQ ID NO: 199959 - DNA, 22 bp, Artificial Sequence
  Synthetic oligonucleotide; TTT chr2 60490865 60490886 60490882 60490887 +
ctgttcaaaatggtaattttaa

SEQ ID NO: 199960 - DNA, 22 bp, Artificial Sequence
  Synthetic oligonucleotide; TTC chr2 60490866 60490887 60490883 60490888 +
tgttcaaaatggtaattttaac

SEQ ID NO: 199961 - DNA, 22 bp, Artificial Sequence
  Synthetic oligonucleotide; CTG chr2 60490868 60490889 60490885 60490890 +
ttcaaaatggtaattttaacct

SEQ ID NO: 199962 - DNA, 22 bp, Artificial Sequence
  Synthetic oligonucleotide; TTC chr2 60490871 60490892 60490888 60490893 +
aaaatggtaattttaaccttct

SEQ ID NO: 199963 - DNA, 22 bp, Artificial Sequence
  Synthetic oligonucleotide; TTT chr2 60490884 60490905 60490901 60490906 +
taaccttcttagcacccacaaa

SEQ ID NO: 199964 - DNA, 22 bp, Artificial Sequence
  Synthetic oligonucleotide; TTT chr2 60490885 60490906 60490902 60490907 +
aaccttcttagcacccacaaac

SEQ ID NO: 199965 - DNA, 22 bp, Artificial Sequence
  Synthetic oligonucleotide; TTA chr2 60490886 60490907 60490903 60490908 +
accttcttagcacccacaaaca

SEQ ID NO: 199966 - DNA, 22 bp, Artificial Sequence
  Synthetic oligonucleotide; CTT chr2 60490891 60490912 60490908 60490913 +
cttagcacccacaaacatttcc

SEQ ID NO: 199967 - DNA, 22 bp, Artificial Sequence
  Synthetic oligonucleotide; TTC chr2 60490892 60490913 60490909 60490914 +
ttagcacccacaaacatttccc

SEQ ID NO: 199968 - DNA, 22 bp, Artificial Sequence
  Synthetic oligonucleotide; CTT chr2 60490894 60490915 60490911 60490916 +
agcacccacaaacatttccctt

SEQ ID NO: 199969 - DNA, 22 bp, Artificial Sequence
  Synthetic oligonucleotide; TTA chr2 60490895 60490916 60490912 60490917 +
gcacccacaaacatttcccttc

SEQ ID NO: 199970 - DNA, 22 bp, Artificial Sequence
  Synthetic oligonucleotide; TTT chr2 60490911 60490932 60490928 60490933 +
cccttctgatatctacttgaac

SEQ ID NO: 199971 - DNA, 22 bp, Artificial Sequence
  Synthetic oligonucleotide; TTC chr2 60490912 60490933 60490929 60490934 +
ccttctgatatctacttgaact

SEQ ID NO: 199972 - DNA, 22 bp, Artificial Sequence
  Synthetic oligonucleotide; CTT chr2 60490916 60490937 60490933 60490938 +
ctgatatctacttgaactttca

SEQ ID NO: 199973 - DNA, 22 bp, Artificial Sequence
  Synthetic oligonucleotide; TTC chr2 60490917 60490938 60490934 60490939 +
tgatatctacttgaactttcag

SEQ ID NO: 199974 - DNA, 22 bp, Artificial Sequence
  Synthetic oligonucleotide; CTG chr2 60490919 60490940 60490936 60490941 +
atatctacttgaactttcagat

SEQ ID NO: 199975 - DNA, 22 bp, Artificial Sequence
  Synthetic oligonucleotide; CTA chr2 60490926 60490947 60490943 60490948 +
cttgaactttcagataaaaaaa

SEQ ID NO: 199976 - DNA, 22 bp, Artificial Sequence
  Synthetic oligonucleotide; CTT chr2 60490929 60490950 60490946 60490951 +
gaactttcagataaaaaaaaaa

SEQ ID NO: 199977 - DNA, 22 bp, Artificial Sequence
  Synthetic oligonucleotide; TTG chr2 60490930 60490951 60490947 60490952 +
aactttcagataaaaaaaaaaa

SEQ ID NO: 199978 - DNA, 22 bp, Artificial Sequence
  Synthetic oligonucleotide; CTT chr2 60490935 60490956 60490952 60490957 +
tcagataaaaaaaaaaaagcaa

SEQ ID NO: 199979 - DNA, 22 bp, Artificial Sequence
  Synthetic oligonucleotide; TTT chr2 60490936 60490957 60490953 60490958 +
cagataaaaaaaaaaaagcaag

SEQ ID NO: 199980 - DNA, 22 bp, Artificial Sequence
  Synthetic oligonucleotide; TTC chr2 60490937 60490958 60490954 60490959 +
agataaaaaaaaaaaagcaagt

SEQ ID NO: 199981 - DNA, 22 bp, Artificial Sequence
  Synthetic oligonucleotide; TTG chr2 60490961 60490982 60490978 60490983 +
cagtaacatgttatgctacaca

SEQ ID NO: 199982 - DNA, 22 bp, Artificial Sequence
  Synthetic oligonucleotide; TTA chr2 60490974 60490995 60490991 60490996 +
tgctacacaaagattagcatga

SEQ ID NO: 199983 - DNA, 22 bp, Artificial Sequence
  Synthetic oligonucleotide; CTA chr2 60490979 60491000 60490996 60491001 +
cacaaagattagcatgaatatc

SEQ ID NO: 199984 - DNA, 22 bp, Artificial Sequence
  Synthetic oligonucleotide; TTA chr2 60490990 60491011 60491007 60491012 +
gcatgaatatccaccctcttta

SEQ ID NO: 199985 - DNA, 22 bp, Artificial Sequence
  Synthetic oligonucleotide; CTC chr2 60491008 60491029 60491025 60491030 +
tttaaacagccaccccacaccc

SEQ ID NO: 199986 - DNA, 22 bp, Artificial Sequence
  Synthetic oligonucleotide; CTT chr2 60491010 60491031 60491027 60491032 +
taaacagccaccccacaccctg

SEQ ID NO: 199987 - DNA, 22 bp, Artificial Sequence
  Synthetic oligonucleotide; TTT chr2 60491011 60491032 60491028 60491033 +
aaacagccaccccacaccctgg

SEQ ID NO: 199988 - DNA, 22 bp, Artificial Sequence
  Synthetic oligonucleotide; TTA chr2 60491012 60491033 60491029 60491034 +
aacagccaccccacaccctgga

SEQ ID NO: 199989 - DNA, 22 bp, Artificial Sequence
  Synthetic oligonucleotide; CTG chr2 60491032 60491053 60491049 60491054 +
gagaagagcaaatgtgaagttt

SEQ ID NO: 199990 - DNA, 22 bp, Artificial Sequence
  Synthetic oligonucleotide; TTT chr2 60491054 60491075 60491071 60491076 +
atgtgccaaccagactgtgcgc

SEQ ID NO: 199991 - DNA, 22 bp, Artificial Sequence
  Synthetic oligonucleotide; TTA chr2 60491055 60491076 60491072 60491077 +
tgtgccaaccagactgtgcgcc

SEQ ID NO: 199992 - DNA, 22 bp, Artificial Sequence
  Synthetic oligonucleotide; CTG chr2 60491071 60491092 60491088 60491093 +
tgcgccaggttggtaaagtctg

SEQ ID NO: 199993 - DNA, 22 bp, Artificial Sequence
  Synthetic oligonucleotide; TTG chr2 60491083 60491104 60491100 60491105 +
gtaaagtctgacagagttacca

SEQ ID NO: 199994 - DNA, 22 bp, Artificial Sequence
  Synthetic oligonucleotide; CTG chr2 60491093 60491114 60491110 60491115 +
acagagttaccaaaaaatgaca

SEQ ID NO: 199995 - DNA, 22 bp, Artificial Sequence
  Synthetic oligonucleotide; TTA chr2 60491102 60491123 60491119 60491124 +
ccaaaaaatgacaacatcttct

SEQ ID NO: 199996 - DNA, 22 bp, Artificial Sequence
  Synthetic oligonucleotide; CTT chr2 60491122 60491143 60491139 60491144 +
ctatatgtgaagcccaactacg

SEQ ID NO: 199997 - DNA, 22 bp, Artificial Sequence
  Synthetic oligonucleotide; TTC chr2 60491123 60491144 60491140 60491145 +
tatatgtgaagcccaactacgt

SEQ ID NO: 199998 - DNA, 22 bp, Artificial Sequence
  Synthetic oligonucleotide; CTA chr2 60491125 60491146 60491142 60491147 +
tatgtgaagcccaactacgtgg

SEQ ID NO: 199999 - DNA, 22 bp, Artificial Sequence
  Synthetic oligonucleotide; CTA chr2 60491142 60491163 60491159 60491164 +
cgtggttgtgcaactctatagc

SEQ ID NO: 200000 - DNA, 22 bp, Artificial Sequence
  Synthetic oligonucleotide; TTG chr2 60491150 60491171 60491167 60491172 +
tgcaactctatagctgactttc

SEQ ID NO: 200001 - DNA, 22 bp, Artificial Sequence
  Synthetic oligonucleotide; CTC chr2 60491158 60491179 60491175 60491180 +
tatagctgactttcaaccatgg

SEQ ID NO: 200002 - DNA, 22 bp, Artificial Sequence
  Synthetic oligonucleotide; CTA chr2 60491160 60491181 60491177 60491182 +
tagctgactttcaaccatggtc

SEQ ID NO: 200003 - DNA, 22 bp, Artificial Sequence
  Synthetic oligonucleotide; CTG chr2 60491166 60491187 60491183 60491188 +
actttcaaccatggtcatctgc

SEQ ID NO: 200004 - DNA, 22 bp, Artificial Sequence
  Synthetic oligonucleotide; CTT chr2 60491170 60491191 60491187 60491192 +
tcaaccatggtcatctgcaaag

SEQ ID NO: 200005 - DNA, 22 bp, Artificial Sequence
  Synthetic oligonucleotide; TTT chr2 60491171 60491192 60491188 60491193 +
caaccatggtcatctgcaaaga

SEQ ID NO: 200006 - DNA, 22 bp, Artificial Sequence
  Synthetic oligonucleotide; TTC chr2 60491172 60491193 60491189 60491194 +
aaccatggtcatctgcaaagaa

SEQ ID NO: 200007 - DNA, 22 bp, Artificial Sequence
  Synthetic oligonucleotide; CTG chr2 60491187 60491208 60491204 60491209 +
caaagaagttagtctcagccac

SEQ ID NO: 200008 - DNA, 22 bp, Artificial Sequence
  Synthetic oligonucleotide; TTA chr2 60491198 60491219 60491215 60491220 +
gtctcagccacctgcgcatcct

SEQ ID NO: 200009 - DNA, 22 bp, Artificial Sequence
  Synthetic oligonucleotide; CTC chr2 60491203 60491224 60491220 60491225 +
agccacctgcgcatcctcaatg

SEQ ID NO: 200010 - DNA, 22 bp, Artificial Sequence
  Synthetic oligonucleotide; CTG chr2 60491212 60491233 60491229 60491234 +
cgcatcctcaatgcaaaaagct

SEQ ID NO: 200011 - DNA, 22 bp, Artificial Sequence
  Synthetic oligonucleotide; CTC chr2 60491221 60491242 60491238 60491243 +
aatgcaaaaagctaagttctaa

SEQ ID NO: 200012 - DNA, 22 bp, Artificial Sequence
  Synthetic oligonucleotide; CTA chr2 60491235 60491256 60491252 60491257 +
agttctaaaaacgtattcttaa

SEQ ID NO: 200013 - DNA, 22 bp, Artificial Sequence
  Synthetic oligonucleotide; TTC chr2 60491240 60491261 60491257 60491262 +
taaaaacgtattcttaatgctg

SEQ ID NO: 200014 - DNA, 22 bp, Artificial Sequence
  Synthetic oligonucleotide; CTA chr2 60491242 60491263 60491259 60491264 +
aaaacgtattcttaatgctgtt

SEQ ID NO: 200015 - DNA, 22 bp, Artificial Sequence
  Synthetic oligonucleotide; TTC chr2 60491253 60491274 60491270 60491275 +
ttaatgctgttttaaatgcagc

SEQ ID NO: 200016 - DNA, 22 bp, Artificial Sequence
  Synthetic oligonucleotide; CTT chr2 60491255 60491276 60491272 60491277 +
aatgctgttttaaatgcagcac

SEQ ID NO: 200017 - DNA, 22 bp, Artificial Sequence
  Synthetic oligonucleotide; TTA chr2 60491256 60491277 60491273 60491278 +
atgctgttttaaatgcagcact

SEQ ID NO: 200018 - DNA, 22 bp, Artificial Sequence
  Synthetic oligonucleotide; CTG chr2 60491262 60491283 60491279 60491284 +
ttttaaatgcagcactactaaa

SEQ ID NO: 200019 - DNA, 22 bp, Artificial Sequence
  Synthetic oligonucleotide; TTT chr2 60491265 60491286 60491282 60491287 +
taaatgcagcactactaaaaag

SEQ ID NO: 200020 - DNA, 22 bp, Artificial Sequence
  Synthetic oligonucleotide; TTT chr2 60491266 60491287 60491283 60491288 +
aaatgcagcactactaaaaagg

SEQ ID NO: 200021 - DNA, 22 bp, Artificial Sequence
  Synthetic oligonucleotide; TTA chr2 60491267 60491288 60491284 60491289 +
aatgcagcactactaaaaagga

SEQ ID NO: 200022 - DNA, 22 bp, Artificial Sequence
  Synthetic oligonucleotide; CTA chr2 60491279 60491300 60491296 60491301 +
ctaaaaaggacctcattttgat

SEQ ID NO: 200023 - DNA, 22 bp, Artificial Sequence
  Synthetic oligonucleotide; CTA chr2 60491282 60491303 60491299 60491304 +
aaaaggacctcattttgatgcc

SEQ ID NO: 200024 - DNA, 22 bp, Artificial Sequence
  Synthetic oligonucleotide; CTC chr2 60491293 60491314 60491310 60491315 +
attttgatgccagagggcagca

SEQ ID NO: 200025 - DNA, 22 bp, Artificial Sequence
  Synthetic oligonucleotide; TTT chr2 60491297 60491318 60491314 60491319 +
tgatgccagagggcagcaaaca

SEQ ID NO: 200026 - DNA, 22 bp, Artificial Sequence
  Synthetic oligonucleotide; TTT chr2 60491298 60491319 60491315 60491320 +
gatgccagagggcagcaaacat

SEQ ID NO: 200027 - DNA, 22 bp, Artificial Sequence
  Synthetic oligonucleotide; TTG chr2 60491299 60491320 60491316 60491321 +
atgccagagggcagcaaacatg

SEQ ID NO: 200028 - DNA, 22 bp, Artificial Sequence
  Synthetic oligonucleotide; CTT chr2 60491328 60491349 60491345 60491350 +
ttggcccccttcagctattaag

SEQ ID NO: 200029 - DNA, 22 bp, Artificial Sequence
  Synthetic oligonucleotide; TTT chr2 60491329 60491350 60491346 60491351 +
tggcccccttcagctattaagt

SEQ ID NO: 200030 - DNA, 22 bp, Artificial Sequence
  Synthetic oligonucleotide; TTT chr2 60491330 60491351 60491347 60491352 +
ggcccccttcagctattaagta

SEQ ID NO: 200031 - DNA, 22 bp, Artificial Sequence
  Synthetic oligonucleotide; TTG chr2 60491331 60491352 60491348 60491353 +
gcccccttcagctattaagtac

SEQ ID NO: 200032 - DNA, 22 bp, Artificial Sequence
  Synthetic oligonucleotide; CTT chr2 60491339 60491360 60491356 60491361 +
cagctattaagtacagtaaaag

SEQ ID NO: 200033 - DNA, 22 bp, Artificial Sequence
  Synthetic oligonucleotide; TTC chr2 60491340 60491361 60491357 60491362 +
agctattaagtacagtaaaagg

SEQ ID NO: 200034 - DNA, 22 bp, Artificial Sequence
  Synthetic oligonucleotide; CTA chr2 60491345 60491366 60491362 60491367 +
ttaagtacagtaaaaggaagtc

SEQ ID NO: 200035 - DNA, 22 bp, Artificial Sequence
  Synthetic oligonucleotide; TTA chr2 60491348 60491369 60491365 60491370 +
agtacagtaaaaggaagtccta

SEQ ID NO: 200036 - DNA, 22 bp, Artificial Sequence
  Synthetic oligonucleotide; CTA chr2 60491370 60491391 60491387 60491392 +
actatcatttgaaatgctcccg

SEQ ID NO: 200037 - DNA, 22 bp, Artificial Sequence
  Synthetic oligonucleotide; CTA chr2 60491374 60491395 60491391 60491396 +
tcatttgaaatgctcccggcca

SEQ ID NO: 200038 - DNA, 22 bp, Artificial Sequence
  Synthetic oligonucleotide; TTT chr2 60491380 60491401 60491397 60491402 +
gaaatgctcccggccaggcgct

SEQ ID NO: 200039 - DNA, 22 bp, Artificial Sequence
  Synthetic oligonucleotide; TTG chr2 60491381 60491402 60491398 60491403 +
aaatgctcccggccaggcgctg

SEQ ID NO: 200040 - DNA, 22 bp, Artificial Sequence
  Synthetic oligonucleotide; CTC chr2 60491389 60491410 60491406 60491411 +
ccggccaggcgctgtggctcac

SEQ ID NO: 200041 - DNA, 22 bp, Artificial Sequence
  Synthetic oligonucleotide; CTG chr2 60491403 60491424 60491420 60491425 +
tggctcacacctgtaatcccag

SEQ ID NO: 200042 - DNA, 22 bp, Artificial Sequence
  Synthetic oligonucleotide; CTC chr2 60491409 60491430 60491426 60491431 +
acacctgtaatcccagcacttt

SEQ ID NO: 200043 - DNA, 22 bp, Artificial Sequence
  Synthetic oligonucleotide; CTG chr2 60491416 60491437 60491433 60491438 +
taatcccagcactttgggaggc

SEQ ID NO: 200044 - DNA, 22 bp, Artificial Sequence
  Synthetic oligonucleotide; CTT chr2 60491430 60491451 60491447 60491452 +
tgggaggccggggcaggaggat

SEQ ID NO: 200045 - DNA, 22 bp, Artificial Sequence
  Synthetic oligonucleotide; TTT chr2 60491431 60491452 60491448 60491453 +
gggaggccggggcaggaggatc

SEQ ID NO: 200046 - DNA, 22 bp, Artificial Sequence
  Synthetic oligonucleotide; TTG chr2 60491432 60491453 60491449 60491454 +
ggaggccggggcaggaggatca

SEQ ID NO: 200047 - DNA, 22 bp, Artificial Sequence
  Synthetic oligonucleotide; CTG chr2 60491458 60491479 60491475 60491480 +
aggtcaggagttcaagatcagt

SEQ ID NO: 200048 - DNA, 22 bp, Artificial Sequence
  Synthetic oligonucleotide; TTC chr2 60491471 60491492 60491488 60491493 +
aagatcagtttggacaacacag

SEQ ID NO: 200049 - DNA, 22 bp, Artificial Sequence
  Synthetic oligonucleotide; TTT chr2 60491482 60491503 60491499 60491504 +
ggacaacacagtgaaaccccgt

SEQ ID NO: 200050 - DNA, 22 bp, Artificial Sequence
  Synthetic oligonucleotide; TTG chr2 60491483 60491504 60491500 60491505 +
gacaacacagtgaaaccccgtc

SEQ ID NO: 200051 - DNA, 22 bp, Artificial Sequence
  Synthetic oligonucleotide; CTC chr2 60491507 60491528 60491524 60491529 +
tactaaaaatacaaaattagcc

SEQ ID NO: 200052 - DNA, 22 bp, Artificial Sequence
  Synthetic oligonucleotide; CTA chr2 60491509 60491530 60491526 60491531 +
ctaaaaatacaaaattagccgg

SEQ ID NO: 200053 - DNA, 22 bp, Artificial Sequence
  Synthetic oligonucleotide; CTA chr2 60491512 60491533 60491529 60491534 +
aaaatacaaaattagccgggca

SEQ ID NO: 200054 - DNA, 22 bp, Artificial Sequence
  Synthetic oligonucleotide; TTA chr2 60491526 60491547 60491543 60491548 +
gccgggcatggtaatacatgcc

SEQ ID NO: 200055 - DNA, 22 bp, Artificial Sequence
  Synthetic oligonucleotide; CTG chr2 60491550 60491571 60491567 60491572 +
taatctcagctactcgggaggc

SEQ ID NO: 200056 - DNA, 22 bp, Artificial Sequence
  Synthetic oligonucleotide; CTC chr2 60491557 60491578 60491574 60491579 +
agctactcgggaggctgaggca

SEQ ID NO: 200057 - DNA, 22 bp, Artificial Sequence
  Synthetic oligonucleotide; CTA chr2 60491562 60491583 60491579 60491584 +
ctcgggaggctgaggcaggaga

SEQ ID NO: 200058 - DNA, 22 bp, Artificial Sequence
  Synthetic oligonucleotide; CTC chr2 60491565 60491586 60491582 60491587 +
gggaggctgaggcaggagatcg

SEQ ID NO: 200059 - DNA, 22 bp, Artificial Sequence
  Synthetic oligonucleotide; CTG chr2 60491574 60491595 60491591 60491596 +
aggcaggagatcgcttgaacct

SEQ ID NO: 200060 - DNA, 22 bp, Artificial Sequence
  Synthetic oligonucleotide; CTT chr2 60491590 60491611 60491607 60491612 +
gaacctgggaggcagaagatgc

SEQ ID NO: 200061 - DNA, 22 bp, Artificial Sequence
  Synthetic oligonucleotide; TTG chr2 60491591 60491612 60491608 60491613 +
aacctgggaggcagaagatgca

SEQ ID NO: 200062 - DNA, 22 bp, Artificial Sequence
  Synthetic oligonucleotide; CTG chr2 60491597 60491618 60491614 60491619 +
ggaggcagaagatgcagtgagc

SEQ ID NO: 200063 - DNA, 22 bp, Artificial Sequence
  Synthetic oligonucleotide; TTG chr2 60491635 60491656 60491652 60491657 +
cattccagcccgggcaacaaga

SEQ ID NO: 200064 - DNA, 22 bp, Artificial Sequence
  Synthetic oligonucleotide; TTC chr2 60491640 60491661 60491657 60491662 +
cagcccgggcaacaagagtaaa

SEQ ID NO: 200065 - DNA, 22 bp, Artificial Sequence
  Synthetic oligonucleotide; CTC chr2 60491666 60491687 60491683 60491688 +
cgtctcaccaaaaaaagaaaaa

SEQ ID NO: 200066 - DNA, 22 bp, Artificial Sequence
  Synthetic oligonucleotide; CTC chr2 60491672 60491693 60491689 60491694 +
accaaaaaaagaaaaaagaaaa

SEQ ID NO: 200067 - DNA, 22 bp, Artificial Sequence
  Synthetic oligonucleotide; CTC chr2 60491717 60491738 60491734 60491739 +
ccctcagttctccaggctgggc

SEQ ID NO: 200068 - DNA, 22 bp, Artificial Sequence
  Synthetic oligonucleotide; CTC chr2 60491722 60491743 60491739 60491744 +
agttctccaggctgggctgact

SEQ ID NO: 200069 - DNA, 22 bp, Artificial Sequence
  Synthetic oligonucleotide; TTC chr2 60491727 60491748 60491744 60491749 +
tccaggctgggctgactgccca

SEQ ID NO: 200070 - DNA, 22 bp, Artificial Sequence
  Synthetic oligonucleotide; CTC chr2 60491729 60491750 60491746 60491751 +
caggctgggctgactgcccacg

SEQ ID NO: 200071 - DNA, 22 bp, Artificial Sequence
  Synthetic oligonucleotide; CTG chr2 60491736 60491757 60491753 60491758 +
ggctgactgcccacgtcaaaac

SEQ ID NO: 200072 - DNA, 22 bp, Artificial Sequence
  Synthetic oligonucleotide; CTG chr2 60491741 60491762 60491758 60491763 +
actgcccacgtcaaaacaccct

SEQ ID NO: 200073 - DNA, 22 bp, Artificial Sequence
  Synthetic oligonucleotide; CTG chr2 60491745 60491766 60491762 60491767 +
cccacgtcaaaacaccctaggc

SEQ ID NO: 200074 - DNA, 22 bp, Artificial Sequence
  Synthetic oligonucleotide; CTA chr2 60491764 60491785 60491781 60491786 +
ggcatcatcactccgtgttgag

SEQ ID NO: 200075 - DNA, 22 bp, Artificial Sequence
  Synthetic oligonucleotide; CTC chr2 60491777 60491798 60491794 60491799 +
cgtgttgagagccaagtggcca

SEQ ID NO: 200076 - DNA, 22 bp, Artificial Sequence
  Synthetic oligonucleotide; TTG chr2 60491784 60491805 60491801 60491806 +
agagccaagtggccaggtagga

SEQ ID NO: 200077 - DNA, 22 bp, Artificial Sequence
  Synthetic oligonucleotide; CTA chr2 60491816 60491837 60491833 60491838 +
cgcaggcacagacgttttccat

SEQ ID NO: 200078 - DNA, 22 bp, Artificial Sequence
  Synthetic oligonucleotide; TTT chr2 60491833 60491854 60491850 60491855 +
tccatgttaagaacccaaatcc

SEQ ID NO: 200079 - DNA, 22 bp, Artificial Sequence
  Synthetic oligonucleotide; TTT chr2 60491834 60491855 60491851 60491856 +
ccatgttaagaacccaaatcca

SEQ ID NO: 200080 - DNA, 22 bp, Artificial Sequence
  Synthetic oligonucleotide; TTC chr2 60491835 60491856 60491852 60491857 +
catgttaagaacccaaatccat

SEQ ID NO: 200081 - DNA, 22 bp, Artificial Sequence
  Synthetic oligonucleotide; TTA chr2 60491842 60491863 60491859 60491864 +
agaacccaaatccatacagtcc

SEQ ID NO: 200082 - DNA, 22 bp, Artificial Sequence
  Synthetic oligonucleotide; CTT chr2 60491866 60491887 60491883 60491888 +
agcacccaaataggttcagaaa

SEQ ID NO: 200083 - DNA, 22 bp, Artificial Sequence
  Synthetic oligonucleotide; TTA chr2 60491867 60491888 60491884 60491889 +
gcacccaaataggttcagaaaa

SEQ ID NO: 200084 - DNA, 22 bp, Artificial Sequence
  Synthetic oligonucleotide; TTC chr2 60491883 60491904 60491900 60491905 +
agaaaaggcagtccacacaaat

SEQ ID NO: 200085 - DNA, 22 bp, Artificial Sequence
  Synthetic oligonucleotide; CTG chr2 60491908 60491929 60491925 60491930 +
ccaaataaatgaagttcagata

SEQ ID NO: 200086 - DNA, 22 bp, Artificial Sequence
  Synthetic oligonucleotide; TTC chr2 60491925 60491946 60491942 60491947 +
agatattgcatttacgctaaat

SEQ ID NO: 200087 - DNA, 22 bp, Artificial Sequence
  Synthetic oligonucleotide; TTG chr2 60491933 60491954 60491950 60491955 +
catttacgctaaataccttgga

SEQ ID NO: 200088 - DNA, 22 bp, Artificial Sequence
  Synthetic oligonucleotide; TTT chr2 60491938 60491959 60491955 60491960 +
acgctaaataccttggaaattg

SEQ ID NO: 200089 - DNA, 22 bp, Artificial Sequence
  Synthetic oligonucleotide; TTA chr2 60491939 60491960 60491956 60491961 +
cgctaaataccttggaaattga

SEQ ID NO: 200090 - DNA, 22 bp, Artificial Sequence
  Synthetic oligonucleotide; CTA chr2 60491944 60491965 60491961 60491966 +
aataccttggaaattgagaggg

SEQ ID NO: 200091 - DNA, 22 bp, Artificial Sequence
  Synthetic oligonucleotide; CTT chr2 60491952 60491973 60491969 60491974 +
ggaaattgagagggaatctgga

SEQ ID NO: 200092 - DNA, 22 bp, Artificial Sequence
  Synthetic oligonucleotide; TTG chr2 60491953 60491974 60491970 60491975 +
gaaattgagagggaatctggag

SEQ ID NO: 200093 - DNA, 22 bp, Artificial Sequence
  Synthetic oligonucleotide; TTG chr2 60491960 60491981 60491977 60491982 +
agagggaatctggagaggaaga

SEQ ID NO: 200094 - DNA, 22 bp, Artificial Sequence
  Synthetic oligonucleotide; CTG chr2 60491972 60491993 60491989 60491994 +
gagaggaagatggatgtaggaa

SEQ ID NO: 200095 - DNA, 22 bp, Artificial Sequence
  Synthetic oligonucleotide; CTC chr2 60492008 60492029 60492025 60492030 +
actttacaggaattcagcacag

SEQ ID NO: 200096 - DNA, 22 bp, Artificial Sequence
  Synthetic oligonucleotide; CTT chr2 60492012 60492033 60492029 60492034 +
tacaggaattcagcacaggaga

SEQ ID NO: 200097 - DNA, 22 bp, Artificial Sequence
  Synthetic oligonucleotide; TTT chr2 60492013 60492034 60492030 60492035 +
acaggaattcagcacaggagat

SEQ ID NO: 200098 - DNA, 22 bp, Artificial Sequence
  Synthetic oligonucleotide; TTA chr2 60492014 60492035 60492031 60492036 +
caggaattcagcacaggagatg

SEQ ID NO: 200099 - DNA, 22 bp, Artificial Sequence
  Synthetic oligonucleotide; TTC chr2 60492023 60492044 60492040 60492045 +
agcacaggagatgctacattgt

SEQ ID NO: 200100 - DNA, 22 bp, Artificial Sequence
  Synthetic oligonucleotide; CTA chr2 60492039 60492060 60492056 60492061 +
cattgttagcatctccgcttaa

SEQ ID NO: 200101 - DNA, 22 bp, Artificial Sequence
  Synthetic oligonucleotide; TTG chr2 60492044 60492065 60492061 60492066 +
ttagcatctccgcttaaggaga

SEQ ID NO: 200102 - DNA, 22 bp, Artificial Sequence
  Synthetic oligonucleotide; TTA chr2 60492047 60492068 60492064 60492069 +
gcatctccgcttaaggagaaga

SEQ ID NO: 200103 - DNA, 22 bp, Artificial Sequence
  Synthetic oligonucleotide; CTC chr2 60492054 60492075 60492071 60492076 +
cgcttaaggagaagacatactg

SEQ ID NO: 200104 - DNA, 22 bp, Artificial Sequence
  Synthetic oligonucleotide; CTT chr2 60492059 60492080 60492076 60492081 +
aaggagaagacatactgatgaa

SEQ ID NO: 200105 - DNA, 22 bp, Artificial Sequence
  Synthetic oligonucleotide; TTA chr2 60492060 60492081 60492077 60492082 +
aggagaagacatactgatgaat

SEQ ID NO: 200106 - DNA, 22 bp, Artificial Sequence
  Synthetic oligonucleotide; CTG chr2 60492076 60492097 60492093 60492098 +
atgaataagactgagttggtga

SEQ ID NO: 200107 - DNA, 22 bp, Artificial Sequence
  Synthetic oligonucleotide; CTG chr2 60492089 60492110 60492106 60492111 +
agttggtgacaggcacagtggc

SEQ ID NO: 200108 - DNA, 22 bp, Artificial Sequence
  Synthetic oligonucleotide; TTG chr2 60492094 60492115 60492111 60492116 +
gtgacaggcacagtggctctcg

SEQ ID NO: 200109 - DNA, 22 bp, Artificial Sequence
  Synthetic oligonucleotide; CTC chr2 60492113 60492134 60492130 60492135 +
tcgcctgtaatcccagcacttt

SEQ ID NO: 200110 - DNA, 22 bp, Artificial Sequence
  Synthetic oligonucleotide; CTC chr2 60492115 60492136 60492132 60492137 +
gcctgtaatcccagcactttgg

SEQ ID NO: 200111 - DNA, 22 bp, Artificial Sequence
  Synthetic oligonucleotide; CTG chr2 60492120 60492141 60492137 60492142 +
taatcccagcactttgggaggt

SEQ ID NO: 200112 - DNA, 22 bp, Artificial Sequence
  Synthetic oligonucleotide; CTT chr2 60492134 60492155 60492151 60492156 +
tgggaggtcaaggcaggaggat

SEQ ID NO: 200113 - DNA, 22 bp, Artificial Sequence
  Synthetic oligonucleotide; TTT chr2 60492135 60492156 60492152 60492157 +
gggaggtcaaggcaggaggatc

SEQ ID NO: 200114 - DNA, 22 bp, Artificial Sequence
  Synthetic oligonucleotide; TTG chr2 60492136 60492157 60492153 60492158 +
ggaggtcaaggcaggaggatca

SEQ ID NO: 200115 - DNA, 22 bp, Artificial Sequence
  Synthetic oligonucleotide; CTG chr2 60492161 60492182 60492178 60492183 +
gagcccaggagttcaagaccag

SEQ ID NO: 200116 - DNA, 22 bp, Artificial Sequence
  Synthetic oligonucleotide; TTC chr2 60492175 60492196 60492192 60492197 +
aagaccagcctgggcaacaggg

SEQ ID NO: 200117 - DNA, 22 bp, Artificial Sequence
  Synthetic oligonucleotide; CTG chr2 60492187 60492208 60492204 60492209 +
ggcaacagggagaaactccatc

SEQ ID NO: 200118 - DNA, 22 bp, Artificial Sequence
  Synthetic oligonucleotide; CTC chr2 60492205 60492226 60492222 60492227 +
catctctacaaaattagccagg

SEQ ID NO: 200119 - DNA, 22 bp, Artificial Sequence
  Synthetic oligonucleotide; CTC chr2 60492211 60492232 60492228 60492233 +
tacaaaattagccaggcatggt

SEQ ID NO: 200120 - DNA, 22 bp, Artificial Sequence
  Synthetic oligonucleotide; CTA chr2 60492213 60492234 60492230 60492235 +
caaaattagccaggcatggtgg

SEQ ID NO: 200121 - DNA, 22 bp, Artificial Sequence
  Synthetic oligonucleotide; TTA chr2 60492221 60492242 60492238 60492243 +
gccaggcatggtggcatgcacc

SEQ ID NO: 200122 - DNA, 22 bp, Artificial Sequence
  Synthetic oligonucleotide; CTG chr2 60492245 60492266 60492262 60492267 +
tcgtcccagctactcaggaggc

SEQ ID NO: 200123 - DNA, 22 bp, Artificial Sequence
  Synthetic oligonucleotide; CTA chr2 60492257 60492278 60492274 60492279 +
ctcaggaggctgaggtgacagg

SEQ ID NO: 200124 - DNA, 22 bp, Artificial Sequence
  Synthetic oligonucleotide; CTC chr2 60492260 60492281 60492277 60492282 +
aggaggctgaggtgacaggatg

SEQ ID NO: 200125 - DNA, 22 bp, Artificial Sequence
  Synthetic oligonucleotide; CTG chr2 60492269 60492290 60492286 60492291 +
aggtgacaggatggcttgagcc

SEQ ID NO: 200126 - DNA, 22 bp, Artificial Sequence
  Synthetic oligonucleotide; CTT chr2 60492286 60492307 60492303 60492308 +
gagcctaggagatcaaggctgc

SEQ ID NO: 200127 - DNA, 22 bp, Artificial Sequence
  Synthetic oligonucleotide; TTG chr2 60492287 60492308 60492304 60492309 +
agcctaggagatcaaggctgca

SEQ ID NO: 200128 - DNA, 22 bp, Artificial Sequence
  Synthetic oligonucleotide; CTA chr2 60492293 60492314 60492310 60492315 +
ggagatcaaggctgcagtgagc

SEQ ID NO: 200129 - DNA, 22 bp, Artificial Sequence
  Synthetic oligonucleotide; CTG chr2 60492307 60492328 60492324 60492329 +
cagtgagctatgaacatgccac

SEQ ID NO: 200130 - DNA, 22 bp, Artificial Sequence
  Synthetic oligonucleotide; CTA chr2 60492317 60492338 60492334 60492339 +
tgaacatgccactacactctag

SEQ ID NO: 200131 - DNA, 22 bp, Artificial Sequence
  Synthetic oligonucleotide; CTA chr2 60492331 60492352 60492348 60492353 +
cactctagcctaggcaacacag

SEQ ID NO: 200132 - DNA, 22 bp, Artificial Sequence
  Synthetic oligonucleotide; CTC chr2 60492336 60492357 60492353 60492358 +
tagcctaggcaacacagcgaga

SEQ ID NO: 200133 - DNA, 22 bp, Artificial Sequence
  Synthetic oligonucleotide; CTA chr2 60492338 60492359 60492355 60492360 +
gcctaggcaacacagcgagacc

SEQ ID NO: 200134 - DNA, 22 bp, Artificial Sequence
  Synthetic oligonucleotide; CTA chr2 60492343 60492364 60492360 60492365 +
ggcaacacagcgagaccctgtc

SEQ ID NO: 200135 - DNA, 22 bp, Artificial Sequence
  Synthetic oligonucleotide; CTG chr2 60492363 60492384 60492380 60492385 +
tctcaaaaacaaacaaacaaac

SEQ ID NO: 200136 - DNA, 22 bp, Artificial Sequence
  Synthetic oligonucleotide; CTC chr2 60492367 60492388 60492384 60492389 +
aaaaacaaacaaacaaacaaac

SEQ ID NO: 200137 - DNA, 22 bp, Artificial Sequence
  Synthetic oligonucleotide; CTA chr2 60492401 60492422 60492418 60492423 +
attgggctaatgtttagaataa

SEQ ID NO: 200138 - DNA, 22 bp, Artificial Sequence
  Synthetic oligonucleotide; TTG chr2 60492405 60492426 60492422 60492427 +
ggctaatgtttagaataaatgt

SEQ ID NO: 200139 - DNA, 22 bp, Artificial Sequence
  Synthetic oligonucleotide; CTA chr2 60492410 60492431 60492427 60492432 +
atgtttagaataaatgtatttc

SEQ ID NO: 200140 - DNA, 22 bp, Artificial Sequence
  Synthetic oligonucleotide; TTT chr2 60492416 60492437 60492433 60492438 +
agaataaatgtatttctaggga

SEQ ID NO: 200141 - DNA, 22 bp, Artificial Sequence
  Synthetic oligonucleotide; TTA chr2 60492417 60492438 60492434 60492439 +
gaataaatgtatttctagggaa

SEQ ID NO: 200142 - DNA, 22 bp, Artificial Sequence
  Synthetic oligonucleotide; TTT chr2 60492431 60492452 60492448 60492453 +
ctagggaagaaaaaaacttagt

SEQ ID NO: 200143 - DNA, 22 bp, Artificial Sequence
  Synthetic oligonucleotide; TTC chr2 60492432 60492453 60492449 60492454 +
tagggaagaaaaaaacttagtt

SEQ ID NO: 200144 - DNA, 22 bp, Artificial Sequence
  Synthetic oligonucleotide; CTA chr2 60492434 60492455 60492451 60492456 +
gggaagaaaaaaacttagttgg

SEQ ID NO: 200145 - DNA, 22 bp, Artificial Sequence
  Synthetic oligonucleotide; CTT chr2 60492450 60492471 60492467 60492472 +
agttgggtactccctccccttt

SEQ ID NO: 200146 - DNA, 22 bp, Artificial Sequence
  Synthetic oligonucleotide; TTA chr2 60492451 60492472 60492468 60492473 +
gttgggtactccctcccctttt

SEQ ID NO: 200147 - DNA, 22 bp, Artificial Sequence
  Synthetic oligonucleotide; TTG chr2 60492455 60492476 60492472 60492477 +
ggtactccctcccctttttact

SEQ ID NO: 200148 - DNA, 22 bp, Artificial Sequence
  Synthetic oligonucleotide; CTC chr2 60492462 60492483 60492479 60492484 +
cctcccctttttactttttgaa

SEQ ID NO: 200149 - DNA, 22 bp, Artificial Sequence
  Synthetic oligonucleotide; CTC chr2 60492466 60492487 60492483 60492488 +
ccctttttactttttgaagcct

SEQ ID NO: 200150 - DNA, 22 bp, Artificial Sequence
  Synthetic oligonucleotide; CTT chr2 60492471 60492492 60492488 60492493 +
tttactttttgaagcctgctgg

SEQ ID NO: 200151 - DNA, 22 bp, Artificial Sequence
  Synthetic oligonucleotide; TTT chr2 60492472 60492493 60492489 60492494 +
ttactttttgaagcctgctgga

SEQ ID NO: 200152 - DNA, 22 bp, Artificial Sequence
  Synthetic oligonucleotide; TTT chr2 60492473 60492494 60492490 60492495 +
tactttttgaagcctgctggaa

SEQ ID NO: 200153 - DNA, 22 bp, Artificial Sequence
  Synthetic oligonucleotide; TTT chr2 60492474 60492495 60492491 60492496 +
actttttgaagcctgctggaat

SEQ ID NO: 200154 - DNA, 22 bp, Artificial Sequence
  Synthetic oligonucleotide; TTA chr2 60492475 60492496 60492492 60492497 +
ctttttgaagcctgctggaatt

SEQ ID NO: 200155 - DNA, 22 bp, Artificial Sequence
  Synthetic oligonucleotide; CTT chr2 60492478 60492499 60492495 60492500 +
tttgaagcctgctggaattcta

SEQ ID NO: 200156 - DNA, 22 bp, Artificial Sequence
  Synthetic oligonucleotide; TTT chr2 60492479 60492500 60492496 60492501 +
ttgaagcctgctggaattctag

SEQ ID NO: 200157 - DNA, 22 bp, Artificial Sequence
  Synthetic oligonucleotide; TTT chr2 60492480 60492501 60492497 60492502 +
tgaagcctgctggaattctagg

SEQ ID NO: 200158 - DNA, 22 bp, Artificial Sequence
  Synthetic oligonucleotide; TTT chr2 60492481 60492502 60492498 60492503 +
gaagcctgctggaattctagga

SEQ ID NO: 200159 - DNA, 22 bp, Artificial Sequence
  Synthetic oligonucleotide; TTG chr2 60492482 60492503 60492499 60492504 +
aagcctgctggaattctaggaa

SEQ ID NO: 200160 - DNA, 22 bp, Artificial Sequence
  Synthetic oligonucleotide; CTG chr2 60492489 60492510 60492506 60492511 +
ctggaattctaggaaaacagat

SEQ ID NO: 200161 - DNA, 22 bp, Artificial Sequence
  Synthetic oligonucleotide; CTG chr2 60492492 60492513 60492509 60492514 +
gaattctaggaaaacagatttc

SEQ ID NO: 200162 - DNA, 22 bp, Artificial Sequence
  Synthetic oligonucleotide; TTC chr2 60492498 60492519 60492515 60492520 +
taggaaaacagatttcctcccc

SEQ ID NO: 200163 - DNA, 22 bp, Artificial Sequence
  Synthetic oligonucleotide; CTA chr2 60492500 60492521 60492517 60492522 +
ggaaaacagatttcctcccctt

SEQ ID NO: 200164 - DNA, 22 bp, Artificial Sequence
  Synthetic oligonucleotide; TTT chr2 60492513 60492534 60492530 60492535 +
cctccccttgctctctccttcc

SEQ ID NO: 200165 - DNA, 22 bp, Artificial Sequence
  Synthetic oligonucleotide; TTC chr2 60492514 60492535 60492531 60492536 +
ctccccttgctctctccttcct

SEQ ID NO: 200166 - DNA, 22 bp, Artificial Sequence
  Synthetic oligonucleotide; CTC chr2 60492517 60492538 60492534 60492539 +
cccttgctctctccttcctcac

SEQ ID NO: 200167 - DNA, 22 bp, Artificial Sequence
  Synthetic oligonucleotide; CTT chr2 60492522 60492543 60492539 60492544 +
gctctctccttcctcacatact

SEQ ID NO: 200168 - DNA, 22 bp, Artificial Sequence
  Synthetic oligonucleotide; TTG chr2 60492523 60492544 60492540 60492545 +
ctctctccttcctcacatactc

SEQ ID NO: 200169 - DNA, 22 bp, Artificial Sequence
  Synthetic oligonucleotide; CTC chr2 60492526 60492547 60492543 60492548 +
tctccttcctcacatactcacc

SEQ ID NO: 200170 - DNA, 22 bp, Artificial Sequence
  Synthetic oligonucleotide; CTC chr2 60492528 60492549 60492545 60492550 +
tccttcctcacatactcaccag

SEQ ID NO: 200171 - DNA, 22 bp, Artificial Sequence
  Synthetic oligonucleotide; CTC chr2 60492530 60492551 60492547 60492552 +
cttcctcacatactcaccagta

SEQ ID NO: 200172 - DNA, 22 bp, Artificial Sequence
  Synthetic oligonucleotide; CTT chr2 60492533 60492554 60492550 60492555 +
cctcacatactcaccagtactc

SEQ ID NO: 200173 - DNA, 22 bp, Artificial Sequence
  Synthetic oligonucleotide; TTC chr2 60492534 60492555 60492551 60492556 +
ctcacatactcaccagtactca

SEQ ID NO: 200174 - DNA, 22 bp, Artificial Sequence
  Synthetic oligonucleotide; CTC chr2 60492537 60492558 60492554 60492559 +
acatactcaccagtactcatgc

SEQ ID NO: 200175 - DNA, 22 bp, Artificial Sequence
  Synthetic oligonucleotide; CTC chr2 60492545 60492566 60492562 60492567 +
accagtactcatgcgcttctca

SEQ ID NO: 200176 - DNA, 22 bp, Artificial Sequence
  Synthetic oligonucleotide; CTC chr2 60492555 60492576 60492572 60492577 +
atgcgcttctcagacccaaatg

SEQ ID NO: 200177 - DNA, 22 bp, Artificial Sequence
  Synthetic oligonucleotide; CTT chr2 60492563 60492584 60492580 60492585 +
ctcagacccaaatgctctgctt

SEQ ID NO: 200178 - DNA, 22 bp, Artificial Sequence
  Synthetic oligonucleotide; TTC chr2 60492564 60492585 60492581 60492586 +
tcagacccaaatgctctgctta

SEQ ID NO: 200179 - DNA, 22 bp, Artificial Sequence
  Synthetic oligonucleotide; CTC chr2 60492566 60492587 60492583 60492588 +
agacccaaatgctctgcttatg

SEQ ID NO: 200180 - DNA, 22 bp, Artificial Sequence
  Synthetic oligonucleotide; CTC chr2 60492580 60492601 60492597 60492602 +
tgcttatggtggataaccccat

SEQ ID NO: 200181 - DNA, 22 bp, Artificial Sequence
  Synthetic oligonucleotide; CTG chr2 60492582 60492603 60492599 60492604 +
cttatggtggataaccccatct

SEQ ID NO: 200182 - DNA, 22 bp, Artificial Sequence
  Synthetic oligonucleotide; CTT chr2 60492585 60492606 60492602 60492607 +
atggtggataaccccatctcag

SEQ ID NO: 200183 - DNA, 22 bp, Artificial Sequence
  Synthetic oligonucleotide; TTA chr2 60492586 60492607 60492603 60492608 +
tggtggataaccccatctcagt

SEQ ID NO: 200184 - DNA, 22 bp, Artificial Sequence
  Synthetic oligonucleotide; CTC chr2 60492605 60492626 60492622 60492627 +
agtgggcctccctctctctctc

SEQ ID NO: 200185 - DNA, 22 bp, Artificial Sequence
  Synthetic oligonucleotide; CTC chr2 60492615 60492636 60492632 60492637 +
cctctctctctctctctctctc

SEQ ID NO: 200186 - DNA, 22 bp, Artificial Sequence
  Synthetic oligonucleotide; CTC chr2 60492619 60492640 60492636 60492641 +
tctctctctctctctctctctc

SEQ ID NO: 200187 - DNA, 22 bp, Artificial Sequence
  Synthetic oligonucleotide; CTC chr2 60492621 60492642 60492638 60492643 +
tctctctctctctctctctctc

SEQ ID NO: 200188 - DNA, 22 bp, Artificial Sequence
  Synthetic oligonucleotide; CTC chr2 60492623 60492644 60492640 60492645 +
tctctctctctctctctctctg

SEQ ID NO: 200189 - DNA, 22 bp, Artificial Sequence
  Synthetic oligonucleotide; CTC chr2 60492625 60492646 60492642 60492647 +
tctctctctctctctctctgtc

SEQ ID NO: 200190 - DNA, 22 bp, Artificial Sequence
  Synthetic oligonucleotide; CTC chr2 60492627 60492648 60492644 60492649 +
tctctctctctctctctgtcat

SEQ ID NO: 200191 - DNA, 22 bp, Artificial Sequence
  Synthetic oligonucleotide; CTC chr2 60492629 60492650 60492646 60492651 +
tctctctctctctctgtcatta

SEQ ID NO: 200192 - DNA, 22 bp, Artificial Sequence
  Synthetic oligonucleotide; CTC chr2 60492631 60492652 60492648 60492653 +
tctctctctctctgtcattacc

SEQ ID NO: 200193 - DNA, 22 bp, Artificial Sequence
  Synthetic oligonucleotide; CTC chr2 60492633 60492654 60492650 60492655 +
tctctctctctgtcattaccaa

SEQ ID NO: 200194 - DNA, 22 bp, Artificial Sequence
  Synthetic oligonucleotide; CTC chr2 60492635 60492656 60492652 60492657 +
tctctctctgtcattaccaact

SEQ ID NO: 200195 - DNA, 22 bp, Artificial Sequence
  Synthetic oligonucleotide; CTC chr2 60492637 60492658 60492654 60492659 +
tctctctgtcattaccaacttc

SEQ ID NO: 200196 - DNA, 22 bp, Artificial Sequence
  Synthetic oligonucleotide; CTC chr2 60492639 60492660 60492656 60492661 +
tctctgtcattaccaacttcta

SEQ ID NO: 200197 - DNA, 22 bp, Artificial Sequence
  Synthetic oligonucleotide; CTC chr2 60492641 60492662 60492658 60492663 +
tctgtcattaccaacttctata

SEQ ID NO: 200198 - DNA, 22 bp, Artificial Sequence
  Synthetic oligonucleotide; CTC chr2 60492643 60492664 60492660 60492665 +
tgtcattaccaacttctataaa

SEQ ID NO: 200199 - DNA, 22 bp, Artificial Sequence
  Synthetic oligonucleotide; CTG chr2 60492645 60492666 60492662 60492667 +
tcattaccaacttctataaaat

SEQ ID NO: 200200 - DNA, 22 bp, Artificial Sequence
  Synthetic oligonucleotide; TTA chr2 60492651 60492672 60492668 60492673 +
ccaacttctataaaatctcaga

SEQ ID NO: 200201 - DNA, 22 bp, Artificial Sequence
  Synthetic oligonucleotide; CTT chr2 60492658 60492679 60492675 60492680 +
ctataaaatctcagaatacaaa

SEQ ID NO: 200202 - DNA, 22 bp, Artificial Sequence
  Synthetic oligonucleotide; TTC chr2 60492659 60492680 60492676 60492681 +
tataaaatctcagaatacaaag

SEQ ID NO: 200203 - DNA, 22 bp, Artificial Sequence
  Synthetic oligonucleotide; CTA chr2 60492661 60492682 60492678 60492683 +
taaaatctcagaatacaaaggg

SEQ ID NO: 200204 - DNA, 22 bp, Artificial Sequence
  Synthetic oligonucleotide; CTC chr2 60492670 60492691 60492687 60492692 +
agaatacaaagggcattctcat

SEQ ID NO: 200205 - DNA, 22 bp, Artificial Sequence
  Synthetic oligonucleotide; TTC chr2 60492688 60492709 60492705 60492710 +
tcatttccctgaaatgtacttt

SEQ ID NO: 200206 - DNA, 22 bp, Artificial Sequence
  Synthetic oligonucleotide; CTC chr2 60492690 60492711 60492707 60492712 +
atttccctgaaatgtactttgg

SEQ ID NO: 200207 - DNA, 22 bp, Artificial Sequence
  Synthetic oligonucleotide; TTT chr2 60492694 60492715 60492711 60492716 +
ccctgaaatgtactttggtgct

SEQ ID NO: 200208 - DNA, 22 bp, Artificial Sequence
  Synthetic oligonucleotide; TTC chr2 60492695 60492716 60492712 60492717 +
cctgaaatgtactttggtgcta

SEQ ID NO: 200209 - DNA, 22 bp, Artificial Sequence
  Synthetic oligonucleotide; CTG chr2 60492699 60492720 60492716 60492721 +
aaatgtactttggtgctaccct

SEQ ID NO: 200210 - DNA, 22 bp, Artificial Sequence
  Synthetic oligonucleotide; CTT chr2 60492709 60492730 60492726 60492731 +
tggtgctaccctgaaagacggc

SEQ ID NO: 200211 - DNA, 22 bp, Artificial Sequence
  Synthetic oligonucleotide; TTT chr2 60492710 60492731 60492727 60492732 +
ggtgctaccctgaaagacggct

SEQ ID NO: 200212 - DNA, 22 bp, Artificial Sequence
  Synthetic oligonucleotide; TTG chr2 60492711 60492732 60492728 60492733 +
gtgctaccctgaaagacggcta

SEQ ID NO: 200213 - DNA, 22 bp, Artificial Sequence
  Synthetic oligonucleotide; CTA chr2 60492717 60492738 60492734 60492739 +
ccctgaaagacggctagagtct

SEQ ID NO: 200214 - DNA, 22 bp, Artificial Sequence
  Synthetic oligonucleotide; CTG chr2 60492722 60492743 60492739 60492744 +
aaagacggctagagtcttgagg

SEQ ID NO: 200215 - DNA, 22 bp, Artificial Sequence
  Synthetic oligonucleotide; CTA chr2 60492733 60492754 60492750 60492755 +
gagtcttgaggagacccaaaca

SEQ ID NO: 200216 - DNA, 22 bp, Artificial Sequence
  Synthetic oligonucleotide; CTT chr2 60492740 60492761 60492757 60492762 +
gaggagacccaaacagttaaag

SEQ ID NO: 200217 - DNA, 22 bp, Artificial Sequence
  Synthetic oligonucleotide; TTG chr2 60492741 60492762 60492758 60492763 +
aggagacccaaacagttaaagg

SEQ ID NO: 200218 - DNA, 22 bp, Artificial Sequence
  Synthetic oligonucleotide; TTA chr2 60492759 60492780 60492776 60492781 +
aaggttacagacagacttggtt

SEQ ID NO: 200219 - DNA, 22 bp, Artificial Sequence
  Synthetic oligonucleotide; TTA chr2 60492766 60492787 60492783 60492788 +
cagacagacttggttccactcc

SEQ ID NO: 200220 - DNA, 22 bp, Artificial Sequence
  Synthetic oligonucleotide; CTT chr2 60492777 60492798 60492794 60492799 +
ggttccactccagtggtgggtg

SEQ ID NO: 200221 - DNA, 22 bp, Artificial Sequence
  Synthetic oligonucleotide; TTG chr2 60492778 60492799 60492795 60492800 +
gttccactccagtggtgggtgt

SEQ ID NO: 200222 - DNA, 22 bp, Artificial Sequence
  Synthetic oligonucleotide; TTC chr2 60492782 60492803 60492799 60492804 +
cactccagtggtgggtgttttg

SEQ ID NO: 200223 - DNA, 22 bp, Artificial Sequence
  Synthetic oligonucleotide; CTC chr2 60492787 60492808 60492804 60492809 +
cagtggtgggtgttttgttttg

SEQ ID NO: 200224 - DNA, 22 bp, Artificial Sequence
  Synthetic oligonucleotide; TTT chr2 60492802 60492823 60492819 60492824 +
tgttttgtttcgctttagcttt

SEQ ID NO: 200225 - DNA, 22 bp, Artificial Sequence
  Synthetic oligonucleotide; TTT chr2 60492803 60492824 60492820 60492825 +
gttttgtttcgctttagcttta

SEQ ID NO: 200226 - DNA, 22 bp, Artificial Sequence
  Synthetic oligonucleotide; TTG chr2 60492804 60492825 60492821 60492826 +
ttttgtttcgctttagctttat

SEQ ID NO: 200227 - DNA, 22 bp, Artificial Sequence
  Synthetic oligonucleotide; TTT chr2 60492807 60492828 60492824 60492829 +
tgtttcgctttagctttattaa

SEQ ID NO: 200228 - DNA, 22 bp, Artificial Sequence
  Synthetic oligonucleotide; TTT chr2 60492808 60492829 60492825 60492830 +
gtttcgctttagctttattaag

SEQ ID NO: 200229 - DNA, 22 bp, Artificial Sequence
  Synthetic oligonucleotide; TTG chr2 60492809 60492830 60492826 60492831 +
tttcgctttagctttattaagg

SEQ ID NO: 200230 - DNA, 22 bp, Artificial Sequence
  Synthetic oligonucleotide; TTT chr2 60492812 60492833 60492829 60492834 +
cgctttagctttattaaggtat

SEQ ID NO: 200231 - DNA, 22 bp, Artificial Sequence
  Synthetic oligonucleotide; TTC chr2 60492813 60492834 60492830 60492835 +
gctttagctttattaaggtata

SEQ ID NO: 200232 - DNA, 22 bp, Artificial Sequence
  Synthetic oligonucleotide; CTT chr2 60492817 60492838 60492834 60492839 +
tagctttattaaggtatacttt

SEQ ID NO: 200233 - DNA, 22 bp, Artificial Sequence
  Synthetic oligonucleotide; TTT chr2 60492818 60492839 60492835 60492840 +
agctttattaaggtatacttta

SEQ ID NO: 200234 - DNA, 22 bp, Artificial Sequence
  Synthetic oligonucleotide; TTA chr2 60492819 60492840 60492836 60492841 +
gctttattaaggtatactttac

SEQ ID NO: 200235 - DNA, 22 bp, Artificial Sequence
  Synthetic oligonucleotide; CTT chr2 60492823 60492844 60492840 60492845 +
tattaaggtatactttacatac

SEQ ID NO: 200236 - DNA, 22 bp, Artificial Sequence
  Synthetic oligonucleotide; TTT chr2 60492824 60492845 60492841 60492846 +
attaaggtatactttacataca

SEQ ID NO: 200237 - DNA, 22 bp, Artificial Sequence
  Synthetic oligonucleotide; TTA chr2 60492825 60492846 60492842 60492847 +
ttaaggtatactttacatacaa

SEQ ID NO: 200238 - DNA, 22 bp, Artificial Sequence
  Synthetic oligonucleotide; TTA chr2 60492828 60492849 60492845 60492850 +
aggtatactttacatacaacaa

SEQ ID NO: 200239 - DNA, 22 bp, Artificial Sequence
  Synthetic oligonucleotide; CTT chr2 60492838 60492859 60492855 60492860 +
tacatacaacaaaagtcattca

SEQ ID NO: 200240 - DNA, 22 bp, Artificial Sequence
  Synthetic oligonucleotide; TTT chr2 60492839 60492860 60492856 60492861 +
acatacaacaaaagtcattcat

SEQ ID NO: 200241 - DNA, 22 bp, Artificial Sequence
  Synthetic oligonucleotide; TTA chr2 60492840 60492861 60492857 60492862 +
catacaacaaaagtcattcatt

SEQ ID NO: 200242 - DNA, 22 bp, Artificial Sequence
  Synthetic oligonucleotide; TTC chr2 60492859 60492880 60492876 60492881 +
attttaagtgtacagttggatt

SEQ ID NO: 200243 - DNA, 22 bp, Artificial Sequence
  Synthetic oligonucleotide; TTT chr2 60492863 60492884 60492880 60492885 +
taagtgtacagttggattcaat

SEQ ID NO: 200244 - DNA, 22 bp, Artificial Sequence
  Synthetic oligonucleotide; TTT chr2 60492864 60492885 60492881 60492886 +
aagtgtacagttggattcaatt

SEQ ID NO: 200245 - DNA, 22 bp, Artificial Sequence
  Synthetic oligonucleotide; TTA chr2 60492865 60492886 60492882 60492887 +
agtgtacagttggattcaattt

SEQ ID NO: 200246 - DNA, 22 bp, Artificial Sequence
  Synthetic oligonucleotide; TTG chr2 60492877 60492898 60492894 60492899 +
gattcaatttgccagttgtata

SEQ ID NO: 200247 - DNA, 22 bp, Artificial Sequence
  Synthetic oligonucleotide; TTC chr2 60492882 60492903 60492899 60492904 +
aatttgccagttgtatacagct

SEQ ID NO: 200248 - DNA, 22 bp, Artificial Sequence
  Synthetic oligonucleotide; TTT chr2 60492887 60492908 60492904 60492909 +
gccagttgtatacagctgtgtg

SEQ ID NO: 200249 - DNA, 22 bp, Artificial Sequence
  Synthetic oligonucleotide; TTG chr2 60492888 60492909 60492905 60492910 +
ccagttgtatacagctgtgtgg

SEQ ID NO: 200250 - DNA, 22 bp, Artificial Sequence
  Synthetic oligonucleotide; TTG chr2 60492895 60492916 60492912 60492917 +
tatacagctgtgtggcctccac

SEQ ID NO: 200251 - DNA, 22 bp, Artificial Sequence
  Synthetic oligonucleotide; CTG chr2 60492905 60492926 60492922 60492927 +
tgtggcctccaccaaaatcaag

SEQ ID NO: 200252 - DNA, 22 bp, Artificial Sequence
  Synthetic oligonucleotide; CTC chr2 60492914 60492935 60492931 60492936 +
caccaaaatcaagatacagaac

SEQ ID NO: 200253 - DNA, 22 bp, Artificial Sequence
  Synthetic oligonucleotide; CTA chr2 60492951 60492972 60492968 60492973 +
gaaagccccctcatgccccttt

SEQ ID NO: 200254 - DNA, 22 bp, Artificial Sequence
  Synthetic oligonucleotide; CTC chr2 60492963 60492984 60492980 60492985 +
atgcccctttgctgtcaatccc

SEQ ID NO: 200255 - DNA, 22 bp, Artificial Sequence
  Synthetic oligonucleotide; CTT chr2 60492972 60492993 60492989 60492994 +
tgctgtcaatccccttccctaa

SEQ ID NO: 200256 - DNA, 22 bp, Artificial Sequence
  Synthetic oligonucleotide; TTT chr2 60492973 60492994 60492990 60492995 +
gctgtcaatccccttccctaac

SEQ ID NO: 200257 - DNA, 22 bp, Artificial Sequence
  Synthetic oligonucleotide; TTG chr2 60492974 60492995 60492991 60492996 +
ctgtcaatccccttccctaacc

SEQ ID NO: 200258 - DNA, 22 bp, Artificial Sequence
  Synthetic oligonucleotide; CTG chr2 60492977 60492998 60492994 60492999 +
tcaatccccttccctaaccctc

SEQ ID NO: 200259 - DNA, 22 bp, Artificial Sequence
  Synthetic oligonucleotide; CTT chr2 60492988 60493009 60493005 60493010 +
ccctaaccctctgaccccttcc

SEQ ID NO: 200260 - DNA, 22 bp, Artificial Sequence
  Synthetic oligonucleotide; TTC chr2 60492989 60493010 60493006 60493011 +
cctaaccctctgaccccttcct

SEQ ID NO: 200261 - DNA, 22 bp, Artificial Sequence
  Synthetic oligonucleotide; CTA chr2 60492993 60493014 60493010 60493015 +
accctctgaccccttccttcta

SEQ ID NO: 200262 - DNA, 22 bp, Artificial Sequence
  Synthetic oligonucleotide; CTC chr2 60492999 60493020 60493016 60493021 +
tgaccccttccttctaaccact

SEQ ID NO: 200263 - DNA, 22 bp, Artificial Sequence
  Synthetic oligonucleotide; CTG chr2 60493001 60493022 60493018 60493023 +
accccttccttctaaccactga

SEQ ID NO: 200264 - DNA, 22 bp, Artificial Sequence
  Synthetic oligonucleotide; CTT chr2 60493008 60493029 60493025 60493030 +
ccttctaaccactgaaccccca

SEQ ID NO: 200265 - DNA, 22 bp, Artificial Sequence
  Synthetic oligonucleotide; TTC chr2 60493009 60493030 60493026 60493031 +
cttctaaccactgaacccccac

SEQ ID NO: 200266 - DNA, 22 bp, Artificial Sequence
  Synthetic oligonucleotide; CTT chr2 60493012 60493033 60493029 60493034 +
ctaaccactgaacccccaccta

SEQ ID NO: 200267 - DNA, 22 bp, Artificial Sequence
  Synthetic oligonucleotide; TTC chr2 60493013 60493034 60493030 60493035 +
taaccactgaacccccacctac

SEQ ID NO: 200268 - DNA, 22 bp, Artificial Sequence
  Synthetic oligonucleotide; CTA chr2 60493015 60493036 60493032 60493037 +
accactgaacccccacctacca

SEQ ID NO: 200269 - DNA, 22 bp, Artificial Sequence
  Synthetic oligonucleotide; CTG chr2 60493022 60493043 60493039 60493044 +
aacccccacctaccaccacagt

SEQ ID NO: 200270 - DNA, 22 bp, Artificial Sequence
  Synthetic oligonucleotide; CTA chr2 60493034 60493055 60493051 60493056 +
ccaccacagtgttgagaattct

SEQ ID NO: 200271 - DNA, 22 bp, Artificial Sequence
  Synthetic oligonucleotide; TTG chr2 60493048 60493069 60493065 60493070 +
agaattctagaatttgttacaa

SEQ ID NO: 200272 - DNA, 22 bp, Artificial Sequence
  Synthetic oligonucleotide; TTC chr2 60493055 60493076 60493072 60493077 +
tagaatttgttacaaatggact

SEQ ID NO: 200273 - DNA, 22 bp, Artificial Sequence
  Synthetic oligonucleotide; CTA chr2 60493057 60493078 60493074 60493079 +
gaatttgttacaaatggactca

SEQ ID NO: 200274 - DNA, 22 bp, Artificial Sequence
  Synthetic oligonucleotide; TTT chr2 60493063 60493084 60493080 60493085 +
gttacaaatggactcatacagg

SEQ ID NO: 200275 - DNA, 22 bp, Artificial Sequence
  Synthetic oligonucleotide; TTG chr2 60493064 60493085 60493081 60493086 +
ttacaaatggactcatacagga

SEQ ID NO: 200276 - DNA, 22 bp, Artificial Sequence
  Synthetic oligonucleotide; TTA chr2 60493067 60493088 60493084 60493089 +
caaatggactcatacaggatat

SEQ ID NO: 200277 - DNA, 22 bp, Artificial Sequence
  Synthetic oligonucleotide; CTC chr2 60493078 60493099 60493095 60493100 +
atacaggatatcgtcttttgtg

SEQ ID NO: 200278 - DNA, 22 bp, Artificial Sequence
  Synthetic oligonucleotide; CTT chr2 60493095 60493116 60493112 60493117 +
ttgtgtttaatttcttccacag

SEQ ID NO: 200279 - DNA, 22 bp, Artificial Sequence
  Synthetic oligonucleotide; TTT chr2 60493096 60493117 60493113 60493118 +
tgtgtttaatttcttccacaga

SEQ ID NO: 200280 - DNA, 22 bp, Artificial Sequence
  Synthetic oligonucleotide; TTT chr2 60493097 60493118 60493114 60493119 +
gtgtttaatttcttccacagag

SEQ ID NO: 200281 - DNA, 22 bp, Artificial Sequence
  Synthetic oligonucleotide; TTG chr2 60493098 60493119 60493115 60493120 +
tgtttaatttcttccacagagc

SEQ ID NO: 200282 - DNA, 22 bp, Artificial Sequence
  Synthetic oligonucleotide; TTT chr2 60493103 60493124 60493120 60493125 +
aatttcttccacagagcagaat

SEQ ID NO: 200283 - DNA, 22 bp, Artificial Sequence
  Synthetic oligonucleotide; TTA chr2 60493104 60493125 60493121 60493126 +
atttcttccacagagcagaatg

SEQ ID NO: 200284 - DNA, 22 bp, Artificial Sequence
  Synthetic oligonucleotide; TTT chr2 60493108 60493129 60493125 60493130 +
cttccacagagcagaatgattc

SEQ ID NO: 200285 - DNA, 22 bp, Artificial Sequence
  Synthetic oligonucleotide; TTC chr2 60493109 60493130 60493126 60493131 +
ttccacagagcagaatgattct

SEQ ID NO: 200286 - DNA, 22 bp, Artificial Sequence
  Synthetic oligonucleotide; CTT chr2 60493111 60493132 60493128 60493133 +
ccacagagcagaatgattctgg

SEQ ID NO: 200287 - DNA, 22 bp, Artificial Sequence
  Synthetic oligonucleotide; TTC chr2 60493112 60493133 60493129 60493134 +
cacagagcagaatgattctggg

SEQ ID NO: 200288 - DNA, 22 bp, Artificial Sequence
  Synthetic oligonucleotide; TTC chr2 60493130 60493151 60493147 60493152 +
tgggattcatccatggtgtgga

SEQ ID NO: 200289 - DNA, 22 bp, Artificial Sequence
  Synthetic oligonucleotide; CTG chr2 60493132 60493153 60493149 60493154 +
ggattcatccatggtgtggagt

SEQ ID NO: 200290 - DNA, 22 bp, Artificial Sequence
  Synthetic oligonucleotide; TTC chr2 60493138 60493159 60493155 60493160 +
atccatggtgtggagtgtgtta

SEQ ID NO: 200291 - DNA, 22 bp, Artificial Sequence
  Synthetic oligonucleotide; TTA chr2 60493160 60493181 60493177 60493182 +
ctctttcattcttctactgttg

SEQ ID NO: 200292 - DNA, 22 bp, Artificial Sequence
  Synthetic oligonucleotide; CTC chr2 60493163 60493184 60493180 60493185 +
tttcattcttctactgttgagt

SEQ ID NO: 200293 - DNA, 22 bp, Artificial Sequence
  Synthetic oligonucleotide; CTT chr2 60493165 60493186 60493182 60493187 +
tcattcttctactgttgagttg

SEQ ID NO: 200294 - DNA, 22 bp, Artificial Sequence
  Synthetic oligonucleotide; TTT chr2 60493166 60493187 60493183 60493188 +
cattcttctactgttgagttgt

SEQ ID NO: 200295 - DNA, 22 bp, Artificial Sequence
  Synthetic oligonucleotide; TTC chr2 60493167 60493188 60493184 60493189 +
attcttctactgttgagttgta

SEQ ID NO: 200296 - DNA, 22 bp, Artificial Sequence
  Synthetic oligonucleotide; TTC chr2 60493171 60493192 60493188 60493193 +
ttctactgttgagttgtattcc

SEQ ID NO: 200297 - DNA, 22 bp, Artificial Sequence
  Synthetic oligonucleotide; CTT chr2 60493173 60493194 60493190 60493195 +
ctactgttgagttgtattccac

SEQ ID NO: 200298 - DNA, 22 bp, Artificial Sequence
  Synthetic oligonucleotide; TTC chr2 60493174 60493195 60493191 60493196 +
tactgttgagttgtattccacc

SEQ ID NO: 200299 - DNA, 22 bp, Artificial Sequence
  Synthetic oligonucleotide; CTA chr2 60493176 60493197 60493193 60493198 +
ctgttgagttgtattccaccat

SEQ ID NO: 200300 - DNA, 22 bp, Artificial Sequence
  Synthetic oligonucleotide; CTG chr2 60493179 60493200 60493196 60493201 +
ttgagttgtattccaccatagg

SEQ ID NO: 200301 - DNA, 22 bp, Artificial Sequence
  Synthetic oligonucleotide; TTG chr2 60493182 60493203 60493199 60493204 +
agttgtattccaccatagggcg

SEQ ID NO: 200302 - DNA, 22 bp, Artificial Sequence
  Synthetic oligonucleotide; TTG chr2 60493187 60493208 60493204 60493209 +
tattccaccatagggcgtttat

SEQ ID NO: 200303 - DNA, 22 bp, Artificial Sequence
  Synthetic oligonucleotide; TTC chr2 60493192 60493213 60493209 60493214 +
caccatagggcgtttatccatt

SEQ ID NO: 200304 - DNA, 22 bp, Artificial Sequence
  Synthetic oligonucleotide; TTT chr2 60493207 60493228 60493224 60493229 +
atccattcaacctattggttgc

SEQ ID NO: 200305 - DNA, 22 bp, Artificial Sequence
  Synthetic oligonucleotide; TTA chr2 60493208 60493229 60493225 60493230 +
tccattcaacctattggttgcc

SEQ ID NO: 200306 - DNA, 22 bp, Artificial Sequence
  Synthetic oligonucleotide; TTC chr2 60493215 60493236 60493232 60493237 +
aacctattggttgccatgtggg

SEQ ID NO: 200307 - DNA, 22 bp, Artificial Sequence
  Synthetic oligonucleotide; CTA chr2 60493221 60493242 60493238 60493243 +
ttggttgccatgtgggttgtga

SEQ ID NO: 200308 - DNA, 22 bp, Artificial Sequence
  Synthetic oligonucleotide; TTG chr2 60493224 60493245 60493241 60493246 +
gttgccatgtgggttgtgacca

SEQ ID NO: 200309 - DNA, 22 bp, Artificial Sequence
  Synthetic oligonucleotide; TTG chr2 60493228 60493249 60493245 60493250 +
ccatgtgggttgtgaccacttt

SEQ ID NO: 200310 - DNA, 22 bp, Artificial Sequence
  Synthetic oligonucleotide; TTG chr2 60493240 60493261 60493257 60493262 +
tgaccactttttgaccactatg

SEQ ID NO: 200311 - DNA, 22 bp, Artificial Sequence
  Synthetic oligonucleotide; CTT chr2 60493249 60493270 60493266 60493271 +
tttgaccactatgaacagtgct

SEQ ID NO: 200312 - DNA, 22 bp, Artificial Sequence
  Synthetic oligonucleotide; TTT chr2 60493250 60493271 60493267 60493272 +
ttgaccactatgaacagtgcta

SEQ ID NO: 200313 - DNA, 22 bp, Artificial Sequence
  Synthetic oligonucleotide; TTT chr2 60493251 60493272 60493268 60493273 +
tgaccactatgaacagtgctac

SEQ ID NO: 200314 - DNA, 22 bp, Artificial Sequence
  Synthetic oligonucleotide; TTT chr2 60493252 60493273 60493269 60493274 +
gaccactatgaacagtgctaca

SEQ ID NO: 200315 - DNA, 22 bp, Artificial Sequence
  Synthetic oligonucleotide; TTG chr2 60493253 60493274 60493270 60493275 +
accactatgaacagtgctacaa

SEQ ID NO: 200316 - DNA, 22 bp, Artificial Sequence
  Synthetic oligonucleotide; CTA chr2 60493260 60493281 60493277 60493282 +
tgaacagtgctacaatggacac

SEQ ID NO: 200317 - DNA, 22 bp, Artificial Sequence
  Synthetic oligonucleotide; CTA chr2 60493272 60493293 60493289 60493294 +
caatggacactgtgtagatgtg

SEQ ID NO: 200318 - DNA, 22 bp, Artificial Sequence
  Synthetic oligonucleotide; CTG chr2 60493284 60493305 60493301 60493306 +
tgtagatgtgtttataggaatg

SEQ ID NO: 200319 - DNA, 22 bp, Artificial Sequence
  Synthetic oligonucleotide; TTT chr2 60493297 60493318 60493314 60493319 +
ataggaatgtatgtctacattt

SEQ ID NO: 200320 - DNA, 22 bp, Artificial Sequence
  Synthetic oligonucleotide; TTA chr2 60493298 60493319 60493315 60493320 +
taggaatgtatgtctacatttc

SEQ ID NO: 200321 - DNA, 22 bp, Artificial Sequence
  Synthetic oligonucleotide; CTA chr2 60493314 60493335 60493331 60493336 +
catttctcttaggtaaacatct

SEQ ID NO: 200322 - DNA, 22 bp, Artificial Sequence
  Synthetic oligonucleotide; TTT chr2 60493319 60493340 60493336 60493341 +
ctcttaggtaaacatctaaggc

SEQ ID NO: 200323 - DNA, 22 bp, Artificial Sequence
  Synthetic oligonucleotide; TTC chr2 60493320 60493341 60493337 60493342 +
tcttaggtaaacatctaaggca

SEQ ID NO: 200324 - DNA, 22 bp, Artificial Sequence
  Synthetic oligonucleotide; CTC chr2 60493322 60493343 60493339 60493344 +
ttaggtaaacatctaaggcatt

SEQ ID NO: 200325 - DNA, 22 bp, Artificial Sequence
  Synthetic oligonucleotide; CTT chr2 60493324 60493345 60493341 60493346 +
aggtaaacatctaaggcatttc

SEQ ID NO: 200326 - DNA, 22 bp, Artificial Sequence
  Synthetic oligonucleotide; TTA chr2 60493325 60493346 60493342 60493347 +
ggtaaacatctaaggcatttcg

SEQ ID NO: 200327 - DNA, 22 bp, Artificial Sequence
  Synthetic oligonucleotide; CTA chr2 60493337 60493358 60493354 60493359 +
aggcatttcgagaacacagaaa

SEQ ID NO: 200328 - DNA, 22 bp, Artificial Sequence
  Synthetic oligonucleotide; TTT chr2 60493345 60493366 60493362 60493367 +
cgagaacacagaaaaggttttg

SEQ ID NO: 200329 - DNA, 22 bp, Artificial Sequence
  Synthetic oligonucleotide; TTC chr2 60493346 60493367 60493363 60493368 +
gagaacacagaaaaggttttga

SEQ ID NO: 200330 - DNA, 22 bp, Artificial Sequence
  Synthetic oligonucleotide; TTT chr2 60493365 60493386 60493382 60493387 +
tgagtttgagtccagggagccc

SEQ ID NO: 200331 - DNA, 22 bp, Artificial Sequence
  Synthetic oligonucleotide; TTT chr2 60493366 60493387 60493383 60493388 +
gagtttgagtccagggagccct

SEQ ID NO: 200332 - DNA, 22 bp, Artificial Sequence
  Synthetic oligonucleotide; TTG chr2 60493367 60493388 60493384 60493389 +
agtttgagtccagggagccctc

SEQ ID NO: 200333 - DNA, 22 bp, Artificial Sequence
  Synthetic oligonucleotide; TTT chr2 60493372 60493393 60493389 60493394 +
gagtccagggagccctcatttt

SEQ ID NO: 200334 - DNA, 22 bp, Artificial Sequence
  Synthetic oligonucleotide; TTG chr2 60493373 60493394 60493390 60493395 +
agtccagggagccctcattttg

SEQ ID NO: 200335 - DNA, 22 bp, Artificial Sequence
  Synthetic oligonucleotide; CTC chr2 60493389 60493410 60493406 60493411 +
attttgtcatcctccaggctgc

SEQ ID NO: 200336 - DNA, 22 bp, Artificial Sequence
  Synthetic oligonucleotide; TTT chr2 60493393 60493414 60493410 60493415 +
tgtcatcctccaggctgccccc

SEQ ID NO: 200337 - DNA, 22 bp, Artificial Sequence
  Synthetic oligonucleotide; TTT chr2 60493394 60493415 60493411 60493416 +
gtcatcctccaggctgcccccc

SEQ ID NO: 200338 - DNA, 22 bp, Artificial Sequence
  Synthetic oligonucleotide; TTG chr2 60493395 60493416 60493412 60493417 +
tcatcctccaggctgcccccct

SEQ ID NO: 200339 - DNA, 22 bp, Artificial Sequence
  Synthetic oligonucleotide; CTC chr2 60493403 60493424 60493420 60493425 +
caggctgcccccctcccacccc

SEQ ID NO: 200340 - DNA, 22 bp, Artificial Sequence
  Synthetic oligonucleotide; CTG chr2 60493410 60493431 60493427 60493432 +
cccccctcccaccccattccct

SEQ ID NO: 200341 - DNA, 22 bp, Artificial Sequence
  Synthetic oligonucleotide; CTC chr2 60493418 60493439 60493435 60493440 +
ccaccccattccctggagagtt

SEQ ID NO: 200342 - DNA, 22 bp, Artificial Sequence
  Synthetic oligonucleotide; TTC chr2 60493429 60493450 60493446 60493451 +
cctggagagttcaactccaaac

SEQ ID NO: 200343 - DNA, 22 bp, Artificial Sequence
  Synthetic oligonucleotide; CTG chr2 60493433 60493454 60493450 60493455 +
gagagttcaactccaaacccta

SEQ ID NO: 200344 - DNA, 22 bp, Artificial Sequence
  Synthetic oligonucleotide; TTC chr2 60493441 60493462 60493458 60493463 +
aactccaaaccctatatcccag

SEQ ID NO: 200345 - DNA, 22 bp, Artificial Sequence
  Synthetic oligonucleotide; CTC chr2 60493446 60493467 60493463 60493468 +
caaaccctatatcccagctatc

SEQ ID NO: 200346 - DNA, 22 bp, Artificial Sequence
  Synthetic oligonucleotide; CTA chr2 60493455 60493476 60493472 60493477 +
tatcccagctatctgtttggct

SEQ ID NO: 200347 - DNA, 22 bp, Artificial Sequence
  Synthetic oligonucleotide; CTA chr2 60493466 60493487 60493483 60493488 +
tctgtttggctcagctaccaaa

SEQ ID NO: 200348 - DNA, 22 bp, Artificial Sequence
  Synthetic oligonucleotide; CTG chr2 60493470 60493491 60493487 60493492 +
tttggctcagctaccaaatgtc

SEQ ID NO: 200349 - DNA, 22 bp, Artificial Sequence
  Synthetic oligonucleotide; TTT chr2 60493473 60493494 60493490 60493495 +
ggctcagctaccaaatgtcatc

SEQ ID NO: 200350 - DNA, 22 bp, Artificial Sequence
  Synthetic oligonucleotide; TTG chr2 60493474 60493495 60493491 60493496 +
gctcagctaccaaatgtcatcc

SEQ ID NO: 200351 - DNA, 22 bp, Artificial Sequence
  Synthetic oligonucleotide; CTC chr2 60493478 60493499 60493495 60493500 +
agctaccaaatgtcatcctatt

SEQ ID NO: 200352 - DNA, 22 bp, Artificial Sequence
  Synthetic oligonucleotide; CTA chr2 60493483 60493504 60493500 60493505 +
ccaaatgtcatcctattccgaa

SEQ ID NO: 200353 - DNA, 22 bp, Artificial Sequence
  Synthetic oligonucleotide; CTA chr2 60493498 60493519 60493515 60493520 +
ttccgaatagaaacctctccac

SEQ ID NO: 200354 - DNA, 22 bp, Artificial Sequence
  Synthetic oligonucleotide; TTC chr2 60493501 60493522 60493518 60493523 +
cgaatagaaacctctccactac

SEQ ID NO: 200355 - DNA, 22 bp, Artificial Sequence
  Synthetic oligonucleotide; CTC chr2 60493515 60493536 60493532 60493537 +
tccactacactaaggaaatgat

SEQ ID NO: 200356 - DNA, 22 bp, Artificial Sequence
  Synthetic oligonucleotide; CTC chr2 60493517 60493538 60493534 60493539 +
cactacactaaggaaatgatgg

SEQ ID NO: 200357 - DNA, 22 bp, Artificial Sequence
  Synthetic oligonucleotide; CTA chr2 60493522 60493543 60493539 60493544 +
cactaaggaaatgatgggaaga

SEQ ID NO: 200358 - DNA, 22 bp, Artificial Sequence
  Synthetic oligonucleotide; CTA chr2 60493527 60493548 60493544 60493549 +
aggaaatgatgggaagagaccc

SEQ ID NO: 200359 - DNA, 22 bp, Artificial Sequence
  Synthetic oligonucleotide; TTC chr2 60493559 60493580 60493576 60493581 +
ttaaaatgggcattcatttgaa

SEQ ID NO: 200360 - DNA, 22 bp, Artificial Sequence
  Synthetic oligonucleotide; CTT chr2 60493561 60493582 60493578 60493583 +
aaaatgggcattcatttgaatc

SEQ ID NO: 200361 - DNA, 22 bp, Artificial Sequence
  Synthetic oligonucleotide; TTA chr2 60493562 60493583 60493579 60493584 +
aaatgggcattcatttgaatca

SEQ ID NO: 200362 - DNA, 22 bp, Artificial Sequence
  Synthetic oligonucleotide; TTC chr2 60493574 60493595 60493591 60493596 +
atttgaatcaggccaaataaat

SEQ ID NO: 200363 - DNA, 22 bp, Artificial Sequence
  Synthetic oligonucleotide; TTT chr2 60493578 60493599 60493595 60493600 +
gaatcaggccaaataaattgga

SEQ ID NO: 200364 - DNA, 22 bp, Artificial Sequence
  Synthetic oligonucleotide; TTG chr2 60493579 60493600 60493596 60493601 +
aatcaggccaaataaattggac

SEQ ID NO: 200365 - DNA, 22 bp, Artificial Sequence
  Synthetic oligonucleotide; TTG chr2 60493598 60493619 60493615 60493620 +
gactctgggtcagagataactt

SEQ ID NO: 200366 - DNA, 22 bp, Artificial Sequence
  Synthetic oligonucleotide; CTC chr2 60493603 60493624 60493620 60493625 +
tgggtcagagataacttaagtg

SEQ ID NO: 200367 - DNA, 22 bp, Artificial Sequence
  Synthetic oligonucleotide; CTG chr2 60493605 60493626 60493622 60493627 +
ggtcagagataacttaagtgtg

SEQ ID NO: 200368 - DNA, 22 bp, Artificial Sequence
  Synthetic oligonucleotide; CTT chr2 60493620 60493641 60493637 60493642 +
aagtgtggtgttcggagtccta

SEQ ID NO: 200369 - DNA, 22 bp, Artificial Sequence
  Synthetic oligonucleotide; TTA chr2 60493621 60493642 60493638 60493643 +
agtgtggtgttcggagtcctaa

SEQ ID NO: 200370 - DNA, 22 bp, Artificial Sequence
  Synthetic oligonucleotide; TTC chr2 60493633 60493654 60493650 60493655 +
ggagtcctaagagcccccacta

SEQ ID NO: 200371 - DNA, 22 bp, Artificial Sequence
  Synthetic oligonucleotide; CTA chr2 60493642 60493663 60493659 60493664 +
agagcccccactagctcagaaa

SEQ ID NO: 200372 - DNA, 22 bp, Artificial Sequence
  Synthetic oligonucleotide; CTA chr2 60493655 60493676 60493672 60493677 +
gctcagaaatggacttagttga

SEQ ID NO: 200373 - DNA, 22 bp, Artificial Sequence
  Synthetic oligonucleotide; CTC chr2 60493659 60493680 60493676 60493681 +
agaaatggacttagttgacctc

SEQ ID NO: 200374 - DNA, 22 bp, Artificial Sequence
  Synthetic oligonucleotide; CTT chr2 60493671 60493692 60493688 60493693 +
agttgacctcccccattagcag

SEQ ID NO: 200375 - DNA, 22 bp, Artificial Sequence
  Synthetic oligonucleotide; TTA chr2 60493672 60493693 60493689 60493694 +
gttgacctcccccattagcagc

SEQ ID NO: 200376 - DNA, 22 bp, Artificial Sequence
  Synthetic oligonucleotide; TTG chr2 60493676 60493697 60493693 60493698 +
acctcccccattagcagcatgg

SEQ ID NO: 200377 - DNA, 22 bp, Artificial Sequence
  Synthetic oligonucleotide; CTC chr2 60493681 60493702 60493698 60493703 +
ccccattagcagcatggagagt

SEQ ID NO: 200378 - DNA, 22 bp, Artificial Sequence
  Synthetic oligonucleotide; TTA chr2 60493689 60493710 60493706 60493711 +
gcagcatggagagtcaaggaga

SEQ ID NO: 200379 - DNA, 22 bp, Artificial Sequence
  Synthetic oligonucleotide; CTT chr2 60493717 60493738 60493734 60493739 +
ctaccttgccaaaggccttggg

SEQ ID NO: 200380 - DNA, 22 bp, Artificial Sequence
  Synthetic oligonucleotide; TTC chr2 60493718 60493739 60493735 60493740 +
taccttgccaaaggccttggga

SEQ ID NO: 200381 - DNA, 22 bp, Artificial Sequence
  Synthetic oligonucleotide; CTA chr2 60493720 60493741 60493737 60493742 +
ccttgccaaaggccttgggaag

SEQ ID NO: 200382 - DNA, 22 bp, Artificial Sequence
  Synthetic oligonucleotide; CTT chr2 60493724 60493745 60493741 60493746 +
gccaaaggccttgggaagaaag

SEQ ID NO: 200383 - DNA, 22 bp, Artificial Sequence
  Synthetic oligonucleotide; TTG chr2 60493725 60493746 60493742 60493747 +
ccaaaggccttgggaagaaaga

SEQ ID NO: 200384 - DNA, 22 bp, Artificial Sequence
  Synthetic oligonucleotide; CTT chr2 60493736 60493757 60493753 60493758 +
gggaagaaagacagcatcaagg

SEQ ID NO: 200385 - DNA, 22 bp, Artificial Sequence
  Synthetic oligonucleotide; TTG chr2 60493737 60493758 60493754 60493759 +
ggaagaaagacagcatcaaggt

SEQ ID NO: 200386 - DNA, 22 bp, Artificial Sequence
  Synthetic oligonucleotide; CTC chr2 60493762 60493783 60493779 60493784 +
acacaacactccagggaggcag

SEQ ID NO: 200387 - DNA, 22 bp, Artificial Sequence
  Synthetic oligonucleotide; CTC chr2 60493773 60493794 60493790 60493795 +
cagggaggcagctgctgcccag

SEQ ID NO: 200388 - DNA, 22 bp, Artificial Sequence
  Synthetic oligonucleotide; CTG chr2 60493787 60493808 60493804 60493809 +
ctgcccagtgctgtggacagca

SEQ ID NO: 200389 - DNA, 22 bp, Artificial Sequence
  Synthetic oligonucleotide; CTG chr2 60493790 60493811 60493807 60493812 +
cccagtgctgtggacagcaaag

SEQ ID NO: 200390 - DNA, 22 bp, Artificial Sequence
  Synthetic oligonucleotide; CTG chr2 60493800 60493821 60493817 60493822 +
tggacagcaaagcttcagtgca

SEQ ID NO: 200391 - DNA, 22 bp, Artificial Sequence
  Synthetic oligonucleotide; CTT chr2 60493815 60493836 60493832 60493837 +
cagtgcaggaaattaagattcc

SEQ ID NO: 200392 - DNA, 22 bp, Artificial Sequence
  Synthetic oligonucleotide; TTC chr2 60493816 60493837 60493833 60493838 +
agtgcaggaaattaagattccc

SEQ ID NO: 200393 - DNA, 22 bp, Artificial Sequence
  Synthetic oligonucleotide; TTA chr2 60493830 60493851 60493847 60493852 +
agattccccctgcctccccctc

SEQ ID NO: 200394 - DNA, 22 bp, Artificial Sequence
  Synthetic oligonucleotide; TTC chr2 60493836 60493857 60493853 60493858 +
cccctgcctccccctcccccat

SEQ ID NO: 200395 - DNA, 22 bp, Artificial Sequence
  Synthetic oligonucleotide; CTG chr2 60493842 60493863 60493859 60493864 +
cctccccctcccccatcctcat

SEQ ID NO: 200396 - DNA, 22 bp, Artificial Sequence
  Synthetic oligonucleotide; CTC chr2 60493846 60493867 60493863 60493868 +
cccctcccccatcctcatcagc

SEQ ID NO: 200397 - DNA, 22 bp, Artificial Sequence
  Synthetic oligonucleotide; CTC chr2 60493852 60493873 60493869 60493874 +
ccccatcctcatcagcttggcc

SEQ ID NO: 200398 - DNA, 22 bp, Artificial Sequence
  Synthetic oligonucleotide; CTC chr2 60493862 60493883 60493879 60493884 +
atcagcttggccatggcagggc

SEQ ID NO: 200399 - DNA, 22 bp, Artificial Sequence
  Synthetic oligonucleotide; CTT chr2 60493870 60493891 60493887 60493892 +
ggccatggcagggctgggggat

SEQ ID NO: 200400 - DNA, 22 bp, Artificial Sequence
  Synthetic oligonucleotide; TTG chr2 60493871 60493892 60493888 60493893 +
gccatggcagggctgggggatc

SEQ ID NO: 200401 - DNA, 22 bp, Artificial Sequence
  Synthetic oligonucleotide; CTG chr2 60493886 60493907 60493903 60493908 +
ggggatcagaggtgaacaggaa

SEQ ID NO: 200402 - DNA, 22 bp, Artificial Sequence
  Synthetic oligonucleotide; CTG chr2 60493923 60493944 60493940 60493945 +
ggggagacagggcctccagtgg

SEQ ID NO: 200403 - DNA, 22 bp, Artificial Sequence
  Synthetic oligonucleotide; CTC chr2 60493939 60493960 60493956 60493961 +
cagtgggaccagagctgagtgg

SEQ ID NO: 200404 - DNA, 22 bp, Artificial Sequence
  Synthetic oligonucleotide; CTG chr2 60493956 60493977 60493973 60493978 +
agtggcctcaggcagtggcgga

SEQ ID NO: 200405 - DNA, 22 bp, Artificial Sequence
  Synthetic oligonucleotide; CTC chr2 60493965 60493986 60493982 60493987 +
aggcagtggcggaagctgatta

SEQ ID NO: 200406 - DNA, 22 bp, Artificial Sequence
  Synthetic oligonucleotide; CTG chr2 60493983 60494004 60494000 60494005 +
attaaaggaaggtacggggagt

SEQ ID NO: 200407 - DNA, 22 bp, Artificial Sequence
  Synthetic oligonucleotide; TTA chr2 60493987 60494008 60494004 60494009 +
aaggaaggtacggggagtggag

SEQ ID NO: 200408 - DNA, 22 bp, Artificial Sequence
  Synthetic oligonucleotide; CTT chr2 60494041 60494062 60494058 60494063 +
agacaacaatgcaagggggaga

SEQ ID NO: 200409 - DNA, 22 bp, Artificial Sequence
  Synthetic oligonucleotide; TTA chr2 60494042 60494063 60494059 60494064 +
gacaacaatgcaagggggagaa

SEQ ID NO: 200410 - DNA, 22 bp, Artificial Sequence
  Synthetic oligonucleotide; CTG chr2 60494068 60494089 60494085 60494090 +
aagaaaacagaacagagaccac

SEQ ID NO: 200411 - DNA, 22 bp, Artificial Sequence
  Synthetic oligonucleotide; CTA chr2 60494092 60494113 60494109 60494114 +
ctggcaataaacagagagaaag

SEQ ID NO: 200412 - DNA, 22 bp, Artificial Sequence
  Synthetic oligonucleotide; CTG chr2 60494095 60494116 60494112 60494117 +
gcaataaacagagagaaagtga

SEQ ID NO: 200413 - DNA, 22 bp, Artificial Sequence
  Synthetic oligonucleotide; CTA chr2 60494141 60494162 60494158 60494163 +
cattacttaagaaacctgagca

SEQ ID NO: 200414 - DNA, 22 bp, Artificial Sequence
  Synthetic oligonucleotide; TTA chr2 60494146 60494167 60494163 60494168 +
cttaagaaacctgagcacattc

SEQ ID NO: 200415 - DNA, 22 bp, Artificial Sequence
  Synthetic oligonucleotide; CTT chr2 60494149 60494170 60494166 60494171 +
aagaaacctgagcacattctta

SEQ ID NO: 200416 - DNA, 22 bp, Artificial Sequence
  Synthetic oligonucleotide; TTA chr2 60494150 60494171 60494167 60494172 +
agaaacctgagcacattcttac

SEQ ID NO: 200417 - DNA, 22 bp, Artificial Sequence
  Synthetic oligonucleotide; CTG chr2 60494159 60494180 60494176 60494181 +
agcacattcttacgcctagggc

SEQ ID NO: 200418 - DNA, 22 bp, Artificial Sequence
  Synthetic oligonucleotide; TTC chr2 60494168 60494189 60494185 60494190 +
ttacgcctagggcaataaatac

SEQ ID NO: 200419 - DNA, 22 bp, Artificial Sequence
  Synthetic oligonucleotide; CTT chr2 60494170 60494191 60494187 60494192 +
acgcctagggcaataaatacat

SEQ ID NO: 200420 - DNA, 22 bp, Artificial Sequence
  Synthetic oligonucleotide; TTA chr2 60494171 60494192 60494188 60494193 +
cgcctagggcaataaatacatc

SEQ ID NO: 200421 - DNA, 22 bp, Artificial Sequence
  Synthetic oligonucleotide; CTA chr2 60494177 60494198 60494194 60494199 +
gggcaataaatacatccttgag

SEQ ID NO: 200422 - DNA, 22 bp, Artificial Sequence
  Synthetic oligonucleotide; CTT chr2 60494196 60494217 60494213 60494218 +
gagctacacaggctaagcaaga

SEQ ID NO: 200423 - DNA, 22 bp, Artificial Sequence
  Synthetic oligonucleotide; TTG chr2 60494197 60494218 60494214 60494219 +
agctacacaggctaagcaagag

SEQ ID NO: 200424 - DNA, 22 bp, Artificial Sequence
  Synthetic oligonucleotide; CTA chr2 60494202 60494223 60494219 60494224 +
cacaggctaagcaagagtgaga

SEQ ID NO: 200425 - DNA, 22 bp, Artificial Sequence
  Synthetic oligonucleotide; CTA chr2 60494211 60494232 60494228 60494233 +
agcaagagtgagagagggtgat

SEQ ID NO: 200426 - DNA, 22 bp, Artificial Sequence
  Synthetic oligonucleotide; CTG chr2 60494237 60494258 60494254 60494259 +
acaggccacatgggagagtggg

SEQ ID NO: 200427 - DNA, 22 bp, Artificial Sequence
  Synthetic oligonucleotide; CTG chr2 60494272 60494293 60494289 60494294 +
ggagctgggagtttggcttctc

SEQ ID NO: 200428 - DNA, 22 bp, Artificial Sequence
  Synthetic oligonucleotide; CTG chr2 60494279 60494300 60494296 60494301 +
ggagtttggcttctcatctgtg

SEQ ID NO: 200429 - DNA, 22 bp, Artificial Sequence
  Synthetic oligonucleotide; TTT chr2 60494286 60494307 60494303 60494308 +
ggcttctcatctgtgcatggcc

SEQ ID NO: 200430 - DNA, 22 bp, Artificial Sequence
  Synthetic oligonucleotide; TTG chr2 60494287 60494308 60494304 60494309 +
gcttctcatctgtgcatggcct

SEQ ID NO: 200431 - DNA, 22 bp, Artificial Sequence
  Synthetic oligonucleotide; CTT chr2 60494291 60494312 60494308 60494313 +
ctcatctgtgcatggcctctaa

SEQ ID NO: 200432 - DNA, 22 bp, Artificial Sequence
  Synthetic oligonucleotide; TTC chr2 60494292 60494313 60494309 60494314 +
tcatctgtgcatggcctctaaa

SEQ ID NO: 200433 - DNA, 22 bp, Artificial Sequence
  Synthetic oligonucleotide; CTC chr2 60494294 60494315 60494311 60494316 +
atctgtgcatggcctctaaact

SEQ ID NO: 200434 - DNA, 22 bp, Artificial Sequence
  Synthetic oligonucleotide; CTG chr2 60494299 60494320 60494316 60494321 +
tgcatggcctctaaactgggca

SEQ ID NO: 200435 - DNA, 22 bp, Artificial Sequence
  Synthetic oligonucleotide; CTC chr2 60494310 60494331 60494327 60494332 +
taaactgggcagtgaccatggc

SEQ ID NO: 200436 - DNA, 22 bp, Artificial Sequence
  Synthetic oligonucleotide; CTA chr2 60494312 60494333 60494329 60494334 +
aactgggcagtgaccatggcct

SEQ ID NO: 200437 - DNA, 22 bp, Artificial Sequence
  Synthetic oligonucleotide; CTG chr2 60494317 60494338 60494334 60494339 +
ggcagtgaccatggcctggtca

SEQ ID NO: 200438 - DNA, 22 bp, Artificial Sequence
  Synthetic oligonucleotide; CTG chr2 60494335 60494356 60494352 60494357 +
gtcacctccccactctggacct

SEQ ID NO: 200439 - DNA, 22 bp, Artificial Sequence
  Synthetic oligonucleotide; CTC chr2 60494343 60494364 60494360 60494365 +
cccactctggacctgggttgcc

SEQ ID NO: 200440 - DNA, 22 bp, Artificial Sequence
  Synthetic oligonucleotide; CTC chr2 60494350 60494371 60494367 60494372 +
tggacctgggttgcccctctgt

SEQ ID NO: 200441 - DNA, 22 bp, Artificial Sequence
  Synthetic oligonucleotide; CTG chr2 60494352 60494373 60494369 60494374 +
gacctgggttgcccctctgtaa

SEQ ID NO: 200442 - DNA, 22 bp, Artificial Sequence
  Synthetic oligonucleotide; CTG chr2 60494358 60494379 60494375 60494380 +
ggttgcccctctgtaaacaagg

SEQ ID NO: 200443 - DNA, 22 bp, Artificial Sequence
  Synthetic oligonucleotide; TTG chr2 60494363 60494384 60494380 60494385 +
cccctctgtaaacaaggaggtt

SEQ ID NO: 200444 - DNA, 22 bp, Artificial Sequence
  Synthetic oligonucleotide; CTC chr2 60494369 60494390 60494386 60494391 +
tgtaaacaaggaggttgtaata

SEQ ID NO: 200445 - DNA, 22 bp, Artificial Sequence
  Synthetic oligonucleotide; CTG chr2 60494371 60494392 60494388 60494393 +
taaacaaggaggttgtaataaa

SEQ ID NO: 200446 - DNA, 22 bp, Artificial Sequence
  Synthetic oligonucleotide; TTG chr2 60494386 60494407 60494403 60494408 +
taataaattatctccaataccc

SEQ ID NO: 200447 - DNA, 22 bp, Artificial Sequence
  Synthetic oligonucleotide; TTA chr2 60494396 60494417 60494413 60494418 +
tctccaataccctaatgtctta

SEQ ID NO: 200448 - DNA, 22 bp, Artificial Sequence
  Synthetic oligonucleotide; CTC chr2 60494400 60494421 60494417 60494422 +
caataccctaatgtcttataaa

SEQ ID NO: 200449 - DNA, 22 bp, Artificial Sequence
  Synthetic oligonucleotide; CTA chr2 60494410 60494431 60494427 60494432 +
atgtcttataaatcttatgcaa

SEQ ID NO: 200450 - DNA, 22 bp, Artificial Sequence
  Synthetic oligonucleotide; CTT chr2 60494417 60494438 60494434 60494439 +
ataaatcttatgcaatttttgc

SEQ ID NO: 200451 - DNA, 22 bp, Artificial Sequence
  Synthetic oligonucleotide; TTA chr2 60494418 60494439 60494435 60494440 +
taaatcttatgcaatttttgcc

SEQ ID NO: 200452 - DNA, 22 bp, Artificial Sequence
  Synthetic oligonucleotide; CTT chr2 60494426 60494447 60494443 60494448 +
atgcaatttttgccaagatggg

SEQ ID NO: 200453 - DNA, 22 bp, Artificial Sequence
  Synthetic oligonucleotide; TTA chr2 60494427 60494448 60494444 60494449 +
tgcaatttttgccaagatggga

SEQ ID NO: 200454 - DNA, 22 bp, Artificial Sequence
  Synthetic oligonucleotide; TTT chr2 60494435 60494456 60494452 60494457 +
ttgccaagatgggagtatgggg

SEQ ID NO: 200455 - DNA, 22 bp, Artificial Sequence
  Synthetic oligonucleotide; TTT chr2 60494436 60494457 60494453 60494458 +
tgccaagatgggagtatgggga

SEQ ID NO: 200456 - DNA, 22 bp, Artificial Sequence
  Synthetic oligonucleotide; TTT chr2 60494437 60494458 60494454 60494459 +
gccaagatgggagtatggggag

SEQ ID NO: 200457 - DNA, 22 bp, Artificial Sequence
  Synthetic oligonucleotide; TTG chr2 60494438 60494459 60494455 60494460 +
ccaagatgggagtatggggaga

SEQ ID NO: 200458 - DNA, 22 bp, Artificial Sequence
  Synthetic oligonucleotide; CTC chr2 60494485 60494506 60494502 60494507 +
agtgagatgagatatcaaaggg

SEQ ID NO: 200459 - DNA, 22 bp, Artificial Sequence
  Synthetic oligonucleotide; TTC chr2 60494521 60494542 60494538 60494543 +
attccatctccctaatctccaa

SEQ ID NO: 200460 - DNA, 22 bp, Artificial Sequence
  Synthetic oligonucleotide; TTC chr2 60494525 60494546 60494542 60494547 +
catctccctaatctccaattgg

SEQ ID NO: 200461 - DNA, 22 bp, Artificial Sequence
  Synthetic oligonucleotide; CTC chr2 60494531 60494552 60494548 60494553 +
cctaatctccaattggcaaagc

SEQ ID NO: 200462 - DNA, 22 bp, Artificial Sequence
  Synthetic oligonucleotide; CTA chr2 60494535 60494556 60494552 60494557 +
atctccaattggcaaagccaga

SEQ ID NO: 200463 - DNA, 22 bp, Artificial Sequence
  Synthetic oligonucleotide; CTC chr2 60494540 60494561 60494557 60494562 +
caattggcaaagccagacttgg

SEQ ID NO: 200464 - DNA, 22 bp, Artificial Sequence
  Synthetic oligonucleotide; TTG chr2 60494546 60494567 60494563 60494568 +
gcaaagccagacttggggcaat

SEQ ID NO: 200465 - DNA, 22 bp, Artificial Sequence
  Synthetic oligonucleotide; CTT chr2 60494560 60494581 60494577 60494582 +
ggggcaatacagactggttctg

SEQ ID NO: 200466 - DNA, 22 bp, Artificial Sequence
  Synthetic oligonucleotide; TTG chr2 60494561 60494582 60494578 60494583 +
gggcaatacagactggttctgt

SEQ ID NO: 200467 - DNA, 22 bp, Artificial Sequence
  Synthetic oligonucleotide; CTG chr2 60494576 60494597 60494593 60494598 +
gttctgtgatgacaaataactc

SEQ ID NO: 200468 - DNA, 22 bp, Artificial Sequence
  Synthetic oligonucleotide; TTC chr2 60494580 60494601 60494597 60494602 +
tgtgatgacaaataactcctag

SEQ ID NO: 200469 - DNA, 22 bp, Artificial Sequence
  Synthetic oligonucleotide; CTG chr2 60494582 60494603 60494599 60494604 +
tgatgacaaataactcctagct

SEQ ID NO: 200470 - DNA, 22 bp, Artificial Sequence
  Synthetic oligonucleotide; CTC chr2 60494598 60494619 60494615 60494620 +
ctagctcattcctaatgattta

SEQ ID NO: 200471 - DNA, 22 bp, Artificial Sequence
  Synthetic oligonucleotide; CTA chr2 60494601 60494622 60494618 60494623 +
gctcattcctaatgatttatca

SEQ ID NO: 200472 - DNA, 22 bp, Artificial Sequence
  Synthetic oligonucleotide; CTC chr2 60494605 60494626 60494622 60494627 +
attcctaatgatttatcaccaa

SEQ ID NO: 200473 - DNA, 22 bp, Artificial Sequence
  Synthetic oligonucleotide; TTC chr2 60494609 60494630 60494626 60494631 +
ctaatgatttatcaccaaatgt

SEQ ID NO: 200474 - DNA, 22 bp, Artificial Sequence
  Synthetic oligonucleotide; CTA chr2 60494612 60494633 60494629 60494634 +
atgatttatcaccaaatgttct

SEQ ID NO: 200475 - DNA, 22 bp, Artificial Sequence
  Synthetic oligonucleotide; TTT chr2 60494619 60494640 60494636 60494641 +
atcaccaaatgttctttcttca

SEQ ID NO: 200476 - DNA, 22 bp, Artificial Sequence
  Synthetic oligonucleotide; TTA chr2 60494620 60494641 60494637 60494642 +
tcaccaaatgttctttcttcag

SEQ ID NO: 200477 - DNA, 22 bp, Artificial Sequence
  Synthetic oligonucleotide; TTC chr2 60494633 60494654 60494650 60494655 +
tttcttcagctggaatttaaaa

SEQ ID NO: 200478 - DNA, 22 bp, Artificial Sequence
  Synthetic oligonucleotide; CTT chr2 60494635 60494656 60494652 60494657 +
tcttcagctggaatttaaaata

SEQ ID NO: 200479 - DNA, 22 bp, Artificial Sequence
  Synthetic oligonucleotide; TTT chr2 60494636 60494657 60494653 60494658 +
cttcagctggaatttaaaatat

SEQ ID NO: 200480 - DNA, 22 bp, Artificial Sequence
  Synthetic oligonucleotide; TTC chr2 60494637 60494658 60494654 60494659 +
ttcagctggaatttaaaatatg

SEQ ID NO: 200481 - DNA, 22 bp, Artificial Sequence
  Synthetic oligonucleotide; CTT chr2 60494639 60494660 60494656 60494661 +
cagctggaatttaaaatatgga

SEQ ID NO: 200482 - DNA, 22 bp, Artificial Sequence
  Synthetic oligonucleotide; TTC chr2 60494640 60494661 60494657 60494662 +
agctggaatttaaaatatggac

SEQ ID NO: 200483 - DNA, 22 bp, Artificial Sequence
  Synthetic oligonucleotide; CTG chr2 60494645 60494666 60494662 60494667 +
gaatttaaaatatggactcatc

SEQ ID NO: 200484 - DNA, 22 bp, Artificial Sequence
  Synthetic oligonucleotide; TTT chr2 60494651 60494672 60494668 60494673 +
aaaatatggactcatccgtaaa

SEQ ID NO: 200485 - DNA, 22 bp, Artificial Sequence
  Synthetic oligonucleotide; TTA chr2 60494652 60494673 60494669 60494674 +
aaatatggactcatccgtaaaa

SEQ ID NO: 200486 - DNA, 22 bp, Artificial Sequence
  Synthetic oligonucleotide; CTC chr2 60494664 60494685 60494681 60494686 +
atccgtaaaataggaataataa

SEQ ID NO: 200487 - DNA, 22 bp, Artificial Sequence
  Synthetic oligonucleotide; CTT chr2 60494698 60494719 60494715 60494720 +
catagggtttgtatgaaaataa

SEQ ID NO: 200488 - DNA, 22 bp, Artificial Sequence
  Synthetic oligonucleotide; TTC chr2 60494699 60494720 60494716 60494721 +
atagggtttgtatgaaaataaa

SEQ ID NO: 200489 - DNA, 22 bp, Artificial Sequence
  Synthetic oligonucleotide; TTT chr2 60494708 60494729 60494725 60494730 +
gtatgaaaataaaatgagtgcg

SEQ ID NO: 200490 - DNA, 22 bp, Artificial Sequence
  Synthetic oligonucleotide; TTG chr2 60494709 60494730 60494726 60494731 +
tatgaaaataaaatgagtgcgt

SEQ ID NO: 200491 - DNA, 22 bp, Artificial Sequence
  Synthetic oligonucleotide; TTT chr2 60494735 60494756 60494752 60494757 +
gtaaagttcctagagcagagta

SEQ ID NO: 200492 - DNA, 22 bp, Artificial Sequence
  Synthetic oligonucleotide; TTG chr2 60494736 60494757 60494753 60494758 +
taaagttcctagagcagagtaa

SEQ ID NO: 200493 - DNA, 22 bp, Artificial Sequence
  Synthetic oligonucleotide; TTC chr2 60494744 60494765 60494761 60494766 +
ctagagcagagtaagtgctccg

SEQ ID NO: 200494 - DNA, 22 bp, Artificial Sequence
  Synthetic oligonucleotide; CTA chr2 60494747 60494768 60494764 60494769 +
gagcagagtaagtgctccgagc

SEQ ID NO: 200495 - DNA, 22 bp, Artificial Sequence
  Synthetic oligonucleotide; CTC chr2 60494764 60494785 60494781 60494786 +
cgagcttgtgaactaaaatgct

SEQ ID NO: 200496 - DNA, 22 bp, Artificial Sequence
  Synthetic oligonucleotide; CTT chr2 60494771 60494792 60494788 60494793 +
gtgaactaaaatgctgcctcct

SEQ ID NO: 200497 - DNA, 22 bp, Artificial Sequence
  Synthetic oligonucleotide; TTG chr2 60494772 60494793 60494789 60494794 +
tgaactaaaatgctgcctcctg

SEQ ID NO: 200498 - DNA, 22 bp, Artificial Sequence
  Synthetic oligonucleotide; CTA chr2 60494779 60494800 60494796 60494801 +
aaatgctgcctcctggtattta

SEQ ID NO: 200499 - DNA, 22 bp, Artificial Sequence
  Synthetic oligonucleotide; CTG chr2 60494787 60494808 60494804 60494809 +
cctcctggtatttattagttac

SEQ ID NO: 200500 - DNA, 22 bp, Artificial Sequence
  Synthetic oligonucleotide; CTC chr2 60494791 60494812 60494808 60494813 +
ctggtatttattagttacacct

SEQ ID NO: 200501 - DNA, 22 bp, Artificial Sequence
  Synthetic oligonucleotide; CTG chr2 60494794 60494815 60494811 60494816 +
gtatttattagttacacctcag

SEQ ID NO: 200502 - DNA, 22 bp, Artificial Sequence
  Synthetic oligonucleotide; TTT chr2 60494800 60494821 60494817 60494822 +
attagttacacctcagcagaaa

SEQ ID NO: 200503 - DNA, 22 bp, Artificial Sequence
  Synthetic oligonucleotide; TTA chr2 60494801 60494822 60494818 60494823 +
ttagttacacctcagcagaaac

SEQ ID NO: 200504 - DNA, 22 bp, Artificial Sequence
  Synthetic oligonucleotide; TTA chr2 60494804 60494825 60494821 60494826 +
gttacacctcagcagaaacaaa

SEQ ID NO: 200505 - DNA, 22 bp, Artificial Sequence
  Synthetic oligonucleotide; TTA chr2 60494808 60494829 60494825 60494830 +
cacctcagcagaaacaaagtta

SEQ ID NO: 200506 - DNA, 22 bp, Artificial Sequence
  Synthetic oligonucleotide; CTC chr2 60494814 60494835 60494831 60494836 +
agcagaaacaaagttatcaggc

SEQ ID NO: 200507 - DNA, 22 bp, Artificial Sequence
  Synthetic oligonucleotide; TTA chr2 60494830 60494851 60494847 60494852 +
tcaggccctttccccaattcct

SEQ ID NO: 200508 - DNA, 22 bp, Artificial Sequence
  Synthetic oligonucleotide; CTT chr2 60494840 60494861 60494857 60494862 +
tccccaattcctagtttgggtc

SEQ ID NO: 200509 - DNA, 22 bp, Artificial Sequence
  Synthetic oligonucleotide; TTT chr2 60494841 60494862 60494858 60494863 +
ccccaattcctagtttgggtca

SEQ ID NO: 200510 - DNA, 22 bp, Artificial Sequence
  Synthetic oligonucleotide; TTC chr2 60494842 60494863 60494859 60494864 +
cccaattcctagtttgggtcag

SEQ ID NO: 200511 - DNA, 22 bp, Artificial Sequence
  Synthetic oligonucleotide; TTC chr2 60494850 60494871 60494867 60494872 +
ctagtttgggtcagaagaaaag

SEQ ID NO: 200512 - DNA, 22 bp, Artificial Sequence
  Synthetic oligonucleotide; CTA chr2 60494853 60494874 60494870 60494875 +
gtttgggtcagaagaaaaggga

SEQ ID NO: 200513 - DNA, 22 bp, Artificial Sequence
  Synthetic oligonucleotide; TTT chr2 60494857 60494878 60494874 60494879 +
gggtcagaagaaaagggaaaag

SEQ ID NO: 200514 - DNA, 22 bp, Artificial Sequence
  Synthetic oligonucleotide; TTG chr2 60494858 60494879 60494875 60494880 +
ggtcagaagaaaagggaaaagg

SEQ ID NO: 200515 - DNA, 22 bp, Artificial Sequence
  Synthetic oligonucleotide; TTG chr2 60494929 60494950 60494946 60494951 +
ggaacacagatcctaacacagt

SEQ ID NO: 200516 - DNA, 22 bp, Artificial Sequence
  Synthetic oligonucleotide; CTA chr2 60494944 60494965 60494961 60494966 +
acacagtagctggtacctgata

SEQ ID NO: 200517 - DNA, 22 bp, Artificial Sequence
  Synthetic oligonucleotide; CTG chr2 60494956 60494977 60494973 60494978 +
gtacctgataggtgcctatatg

SEQ ID NO: 200518 - DNA, 22 bp, Artificial Sequence
  Synthetic oligonucleotide; CTG chr2 60494963 60494984 60494980 60494985 +
ataggtgcctatatgtgatgga

SEQ ID NO: 200519 - DNA, 22 bp, Artificial Sequence
  Synthetic oligonucleotide; CTA chr2 60494974 60494995 60494991 60494996 +
tatgtgatggatgggtggacag

SEQ ID NO: 200520 - DNA, 22 bp, Artificial Sequence
  Synthetic oligonucleotide; TTA chr2 60495022 60495043 60495039 60495044 +
tgaggaggggagagtgcagaca

SEQ ID NO: 200521 - DNA, 22 bp, Artificial Sequence
  Synthetic oligonucleotide; CTT chr2 60495054 60495075 60495071 60495076 +
cacctcctttacaattttggga

SEQ ID NO: 200522 - DNA, 22 bp, Artificial Sequence
  Synthetic oligonucleotide; TTC chr2 60495055 60495076 60495072 60495077 +
acctcctttacaattttgggag

SEQ ID NO: 200523 - DNA, 22 bp, Artificial Sequence
  Synthetic oligonucleotide; CTC chr2 60495060 60495081 60495077 60495082 +
ctttacaattttgggagtccac

SEQ ID NO: 200524 - DNA, 22 bp, Artificial Sequence
  Synthetic oligonucleotide; CTT chr2 60495063 60495084 60495080 60495085 +
tacaattttgggagtccacacg

SEQ ID NO: 200525 - DNA, 22 bp, Artificial Sequence
  Synthetic oligonucleotide; TTT chr2 60495064 60495085 60495081 60495086 +
acaattttgggagtccacacgg

SEQ ID NO: 200526 - DNA, 22 bp, Artificial Sequence
  Synthetic oligonucleotide; TTA chr2 60495065 60495086 60495082 60495087 +
caattttgggagtccacacggc

SEQ ID NO: 200527 - DNA, 22 bp, Artificial Sequence
  Synthetic oligonucleotide; TTT chr2 60495071 60495092 60495088 60495093 +
tgggagtccacacggcatggca

SEQ ID NO: 200528 - DNA, 22 bp, Artificial Sequence
  Synthetic oligonucleotide; TTT chr2 60495072 60495093 60495089 60495094 +
gggagtccacacggcatggcat

SEQ ID NO: 200529 - DNA, 22 bp, Artificial Sequence
  Synthetic oligonucleotide; TTG chr2 60495073 60495094 60495090 60495095 +
ggagtccacacggcatggcata

SEQ ID NO: 200530 - DNA, 22 bp, Artificial Sequence
  Synthetic oligonucleotide; TTA chr2 60495102 60495123 60495119 60495124 +
tttcattcccattgagaaataa

SEQ ID NO: 200531 - DNA, 22 bp, Artificial Sequence
  Synthetic oligonucleotide; TTT chr2 60495105 60495126 60495122 60495127 +
cattcccattgagaaataaaat

SEQ ID NO: 200532 - DNA, 22 bp, Artificial Sequence
  Synthetic oligonucleotide; TTC chr2 60495106 60495127 60495123 60495128 +
attcccattgagaaataaaatc

SEQ ID NO: 200533 - DNA, 22 bp, Artificial Sequence
  Synthetic oligonucleotide; TTC chr2 60495110 60495131 60495127 60495132 +
ccattgagaaataaaatccaat

SEQ ID NO: 200534 - DNA, 22 bp, Artificial Sequence
  Synthetic oligonucleotide; TTG chr2 60495116 60495137 60495133 60495138 +
agaaataaaatccaattctcca

SEQ ID NO: 200535 - DNA, 22 bp, Artificial Sequence
  Synthetic oligonucleotide; TTC chr2 60495134 60495155 60495151 60495156 +
tccatcaccaagagagccttcc

SEQ ID NO: 200536 - DNA, 22 bp, Artificial Sequence
  Synthetic oligonucleotide; CTC chr2 60495136 60495157 60495153 60495158 +
catcaccaagagagccttccga

SEQ ID NO: 200537 - DNA, 22 bp, Artificial Sequence
  Synthetic oligonucleotide; CTT chr2 60495154 60495175 60495171 60495176 +
ccgaaagaggcccccctgggca

SEQ ID NO: 200538 - DNA, 22 bp, Artificial Sequence
  Synthetic oligonucleotide; TTC chr2 60495155 60495176 60495172 60495177 +
cgaaagaggcccccctgggcaa

SEQ ID NO: 200539 - DNA, 22 bp, Artificial Sequence
  Synthetic oligonucleotide; CTG chr2 60495172 60495193 60495189 60495194 +
ggcaaacggccaccgatggaga

SEQ ID NO: 200540 - DNA, 22 bp, Artificial Sequence
  Synthetic oligonucleotide; CTG chr2 60495200 60495221 60495217 60495222 +
ccagtcctcttctaccccaccc

SEQ ID NO: 200541 - DNA, 22 bp, Artificial Sequence
  Synthetic oligonucleotide; CTC chr2 60495209 60495230 60495226 60495231 +
ttctaccccacccacgccccca

SEQ ID NO: 200542 - DNA, 22 bp, Artificial Sequence
  Synthetic oligonucleotide; CTT chr2 60495211 60495232 60495228 60495233 +
ctaccccacccacgcccccacc

SEQ ID NO: 200543 - DNA, 22 bp, Artificial Sequence
  Synthetic oligonucleotide; TTC chr2 60495212 60495233 60495229 60495234 +
taccccacccacgcccccaccc

SEQ ID NO: 200544 - DNA, 22 bp, Artificial Sequence
  Synthetic oligonucleotide; CTA chr2 60495214 60495235 60495231 60495236 +
ccccacccacgcccccacccta

SEQ ID NO: 200545 - DNA, 22 bp, Artificial Sequence
  Synthetic oligonucleotide; CTA chr2 60495236 60495257 60495253 60495258 +
atcagaggccaaacccttcctg

SEQ ID NO: 200546 - DNA, 22 bp, Artificial Sequence
  Synthetic oligonucleotide; CTT chr2 60495254 60495275 60495271 60495276 +
cctggagcctgtgataaaagca

SEQ ID NO: 200547 - DNA, 22 bp, Artificial Sequence
  Synthetic oligonucleotide; TTC chr2 60495255 60495276 60495272 60495277 +
ctggagcctgtgataaaagcaa

SEQ ID NO: 200548 - DNA, 22 bp, Artificial Sequence
  Synthetic oligonucleotide; CTG chr2 60495258 60495279 60495275 60495280 +
gagcctgtgataaaagcaactg

SEQ ID NO: 200549 - DNA, 22 bp, Artificial Sequence
  Synthetic oligonucleotide; CTG chr2 60495265 60495286 60495282 60495287 +
tgataaaagcaactgttagctt

SEQ ID NO: 200550 - DNA, 22 bp, Artificial Sequence
  Synthetic oligonucleotide; CTG chr2 60495280 60495301 60495297 60495302 +
ttagcttgcactagactagctt

SEQ ID NO: 200551 - DNA, 22 bp, Artificial Sequence
  Synthetic oligonucleotide; TTA chr2 60495283 60495304 60495300 60495305 +
gcttgcactagactagcttcaa

SEQ ID NO: 200552 - DNA, 22 bp, Artificial Sequence
  Synthetic oligonucleotide; CTT chr2 60495287 60495308 60495304 60495309 +
gcactagactagcttcaaagtt

SEQ ID NO: 200553 - DNA, 22 bp, Artificial Sequence
  Synthetic oligonucleotide; TTG chr2 60495288 60495309 60495305 60495310 +
cactagactagcttcaaagttg

SEQ ID NO: 200554 - DNA, 22 bp, Artificial Sequence
  Synthetic oligonucleotide; CTA chr2 60495293 60495314 60495310 60495315 +
gactagcttcaaagttgtattg

SEQ ID NO: 200555 - DNA, 22 bp, Artificial Sequence
  Synthetic oligonucleotide; CTA chr2 60495298 60495319 60495315 60495320 +
gcttcaaagttgtattgaccct

SEQ ID NO: 200556 - DNA, 22 bp, Artificial Sequence
  Synthetic oligonucleotide; CTT chr2 60495302 60495323 60495319 60495324 +
caaagttgtattgaccctggtg

SEQ ID NO: 200557 - DNA, 22 bp, Artificial Sequence
  Synthetic oligonucleotide; TTC chr2 60495303 60495324 60495320 60495325 +
aaagttgtattgaccctggtgt

SEQ ID NO: 200558 - DNA, 22 bp, Artificial Sequence
  Synthetic oligonucleotide; TTG chr2 60495310 60495331 60495327 60495332 +
tattgaccctggtgtgttatgt

SEQ ID NO: 200559 - DNA, 22 bp, Artificial Sequence
  Synthetic oligonucleotide; TTG chr2 60495315 60495336 60495332 60495337 +
accctggtgtgttatgtctaag

SEQ ID NO: 200560 - DNA, 22 bp, Artificial Sequence
  Synthetic oligonucleotide; CTG chr2 60495321 60495342 60495338 60495343 +
gtgtgttatgtctaagagtaga

SEQ ID NO: 200561 - DNA, 22 bp, Artificial Sequence
  Synthetic oligonucleotide; TTA chr2 60495329 60495350 60495346 60495351 +
tgtctaagagtagatgccatat

SEQ ID NO: 200562 - DNA, 22 bp, Artificial Sequence
  Synthetic oligonucleotide; CTA chr2 60495335 60495356 60495352 60495357 +
agagtagatgccatatctcttt

SEQ ID NO: 200563 - DNA, 22 bp, Artificial Sequence
  Synthetic oligonucleotide; CTC chr2 60495354 60495375 60495371 60495376 +
ttttctggcctatgttattacc

SEQ ID NO: 200564 - DNA, 22 bp, Artificial Sequence
  Synthetic oligonucleotide; CTT chr2 60495356 60495377 60495373 60495378 +
ttctggcctatgttattacctg

SEQ ID NO: 200565 - DNA, 22 bp, Artificial Sequence
  Synthetic oligonucleotide; TTT chr2 60495357 60495378 60495374 60495379 +
tctggcctatgttattacctgt

SEQ ID NO: 200566 - DNA, 22 bp, Artificial Sequence
  Synthetic oligonucleotide; TTT chr2 60495358 60495379 60495375 60495380 +
ctggcctatgttattacctgta

SEQ ID NO: 200567 - DNA, 22 bp, Artificial Sequence
  Synthetic oligonucleotide; TTC chr2 60495359 60495380 60495376 60495381 +
tggcctatgttattacctgtat

SEQ ID NO: 200568 - DNA, 22 bp, Artificial Sequence
  Synthetic oligonucleotide; CTG chr2 60495361 60495382 60495378 60495383 +
gcctatgttattacctgtatgg

SEQ ID NO: 200569 - DNA, 22 bp, Artificial Sequence
  Synthetic oligonucleotide; CTA chr2 60495366 60495387 60495383 60495388 +
tgttattacctgtatggacttt

SEQ ID NO: 200570 - DNA, 22 bp, Artificial Sequence
  Synthetic oligonucleotide; TTA chr2 60495371 60495392 60495388 60495393 +
ttacctgtatggactttgcact

SEQ ID NO: 200571 - DNA, 22 bp, Artificial Sequence
  Synthetic oligonucleotide; TTA chr2 60495374 60495395 60495391 60495396 +
cctgtatggactttgcactgga

SEQ ID NO: 200572 - DNA, 22 bp, Artificial Sequence
  Synthetic oligonucleotide; CTG chr2 60495378 60495399 60495395 60495400 +
tatggactttgcactggaatca

SEQ ID NO: 200573 - DNA, 22 bp, Artificial Sequence
  Synthetic oligonucleotide; CTT chr2 60495387 60495408 60495404 60495409 +
tgcactggaatcagctatctgc

SEQ ID NO: 200574 - DNA, 22 bp, Artificial Sequence
  Synthetic oligonucleotide; TTT chr2 60495388 60495409 60495405 60495410 +
gcactggaatcagctatctgct

SEQ ID NO: 200575 - DNA, 22 bp, Artificial Sequence
  Synthetic oligonucleotide; TTG chr2 60495389 60495410 60495406 60495411 +
cactggaatcagctatctgctc

SEQ ID NO: 200576 - DNA, 22 bp, Artificial Sequence
  Synthetic oligonucleotide; CTG chr2 60495394 60495415 60495411 60495416 +
gaatcagctatctgctcttact

SEQ ID NO: 200577 - DNA, 22 bp, Artificial Sequence
  Synthetic oligonucleotide; CTA chr2 60495404 60495425 60495421 60495426 +
tctgctcttacttatgcacacc

SEQ ID NO: 200578 - DNA, 22 bp, Artificial Sequence
  Synthetic oligonucleotide; CTG chr2 60495408 60495429 60495425 60495430 +
ctcttacttatgcacacctggg

SEQ ID NO: 200579 - DNA, 22 bp, Artificial Sequence
  Synthetic oligonucleotide; CTC chr2 60495411 60495432 60495428 60495433 +
ttacttatgcacacctggggca

SEQ ID NO: 200580 - DNA, 22 bp, Artificial Sequence
  Synthetic oligonucleotide; CTT chr2 60495413 60495434 60495430 60495435 +
acttatgcacacctggggcata

SEQ ID NO: 200581 - DNA, 22 bp, Artificial Sequence
  Synthetic oligonucleotide; TTA chr2 60495414 60495435 60495431 60495436 +
cttatgcacacctggggcatag

SEQ ID NO: 200582 - DNA, 22 bp, Artificial Sequence
  Synthetic oligonucleotide; CTT chr2 60495417 60495438 60495434 60495439 +
atgcacacctggggcatagagc

SEQ ID NO: 200583 - DNA, 22 bp, Artificial Sequence
  Synthetic oligonucleotide; TTA chr2 60495418 60495439 60495435 60495440 +
tgcacacctggggcatagagcc

SEQ ID NO: 200584 - DNA, 22 bp, Artificial Sequence
  Synthetic oligonucleotide; CTG chr2 60495428 60495449 60495445 60495450 +
gggcatagagccagccctgtat

SEQ ID NO: 200585 - DNA, 22 bp, Artificial Sequence
  Synthetic oligonucleotide; CTG chr2 60495447 60495468 60495464 60495469 +
tatcgcttttcagccatctcac

SEQ ID NO: 200586 - DNA, 22 bp, Artificial Sequence
  Synthetic oligonucleotide; CTT chr2 60495455 60495476 60495472 60495477 +
ttcagccatctcactacagata

SEQ ID NO: 200587 - DNA, 22 bp, Artificial Sequence
  Synthetic oligonucleotide; TTT chr2 60495456 60495477 60495473 60495478 +
tcagccatctcactacagataa

SEQ ID NO: 200588 - DNA, 22 bp, Artificial Sequence
  Synthetic oligonucleotide; TTT chr2 60495457 60495478 60495474 60495479 +
cagccatctcactacagataac

SEQ ID NO: 200589 - DNA, 22 bp, Artificial Sequence
  Synthetic oligonucleotide; TTC chr2 60495458 60495479 60495475 60495480 +
agccatctcactacagataact

SEQ ID NO: 200590 - DNA, 22 bp, Artificial Sequence
  Synthetic oligonucleotide; CTC chr2 60495467 60495488 60495484 60495489 +
actacagataactcccaagtcc

SEQ ID NO: 200591 - DNA, 22 bp, Artificial Sequence
  Synthetic oligonucleotide; CTA chr2 60495471 60495492 60495488 60495493 +
cagataactcccaagtcctgtc

SEQ ID NO: 200592 - DNA, 22 bp, Artificial Sequence
  Synthetic oligonucleotide; CTC chr2 60495481 60495502 60495498 60495503 +
ccaagtcctgtctagctgcctt

SEQ ID NO: 200593 - DNA, 22 bp, Artificial Sequence
  Synthetic oligonucleotide; CTG chr2 60495491 60495512 60495508 60495513 +
tctagctgccttccttatcaca

SEQ ID NO: 200594 - DNA, 22 bp, Artificial Sequence
  Synthetic oligonucleotide; CTA chr2 60495495 60495516 60495512 60495517 +
gctgccttccttatcacaggaa

SEQ ID NO: 200595 - DNA, 22 bp, Artificial Sequence
  Synthetic oligonucleotide; CTG chr2 60495499 60495520 60495516 60495521 +
ccttccttatcacaggaatagc

SEQ ID NO: 200596 - DNA, 22 bp, Artificial Sequence
  Synthetic oligonucleotide; CTT chr2 60495503 60495524 60495520 60495525 +
ccttatcacaggaatagcaccc

SEQ ID NO: 200597 - DNA, 22 bp, Artificial Sequence
  Synthetic oligonucleotide; TTC chr2 60495504 60495525 60495521 60495526 +
cttatcacaggaatagcaccca

SEQ ID NO: 200598 - DNA, 22 bp, Artificial Sequence
  Synthetic oligonucleotide; CTT chr2 60495507 60495528 60495524 60495529 +
atcacaggaatagcacccaagg

SEQ ID NO: 200599 - DNA, 22 bp, Artificial Sequence
  Synthetic oligonucleotide; TTA chr2 60495508 60495529 60495525 60495530 +
tcacaggaatagcacccaaggt

SEQ ID NO: 200600 - DNA, 22 bp, Artificial Sequence
  Synthetic oligonucleotide; CTC chr2 60495543 60495564 60495560 60495565 +
agagtagaaccccctataaact

SEQ ID NO: 200601 - DNA, 22 bp, Artificial Sequence
  Synthetic oligonucleotide; CTA chr2 60495559 60495580 60495576 60495581 +
taaactagtctggtttgcccat

SEQ ID NO: 200602 - DNA, 22 bp, Artificial Sequence
  Synthetic oligonucleotide; CTA chr2 60495566 60495587 60495583 60495588 +
gtctggtttgcccatggggcac

SEQ ID NO: 200603 - DNA, 22 bp, Artificial Sequence
  Synthetic oligonucleotide; CTG chr2 60495571 60495592 60495588 60495593 +
gtttgcccatggggcacagtca

SEQ ID NO: 200604 - DNA, 22 bp, Artificial Sequence
  Synthetic oligonucleotide; TTT chr2 60495575 60495596 60495592 60495597 +
gcccatggggcacagtcaggct

SEQ ID NO: 200605 - DNA, 22 bp, Artificial Sequence
  Synthetic oligonucleotide; TTG chr2 60495576 60495597 60495593 60495598 +
cccatggggcacagtcaggctg

SEQ ID NO: 200606 - DNA, 22 bp, Artificial Sequence
  Synthetic oligonucleotide; CTG chr2 60495598 60495619 60495615 60495620 +
ttttccagggtggggtgcagac

SEQ ID NO: 200607 - DNA, 22 bp, Artificial Sequence
  Synthetic oligonucleotide; TTT chr2 60495601 60495622 60495618 60495623 +
tccagggtggggtgcagacatt

SEQ ID NO: 200608 - DNA, 22 bp, Artificial Sequence
  Synthetic oligonucleotide; TTT chr2 60495602 60495623 60495619 60495624 +
ccagggtggggtgcagacattc

SEQ ID NO: 200609 - DNA, 22 bp, Artificial Sequence
  Synthetic oligonucleotide; TTC chr2 60495603 60495624 60495620 60495625 +
cagggtggggtgcagacattct

SEQ ID NO: 200610 - DNA, 22 bp, Artificial Sequence
  Synthetic oligonucleotide; TTC chr2 60495624 60495645 60495641 60495646 +
tctgcctgttgtgatgcttaca

SEQ ID NO: 200611 - DNA, 22 bp, Artificial Sequence
  Synthetic oligonucleotide; CTC chr2 60495626 60495647 60495643 60495648 +
tgcctgttgtgatgcttacata

SEQ ID NO: 200612 - DNA, 22 bp, Artificial Sequence
  Synthetic oligonucleotide; CTG chr2 60495628 60495649 60495645 60495650 +
cctgttgtgatgcttacatata

SEQ ID NO: 200613 - DNA, 22 bp, Artificial Sequence
  Synthetic oligonucleotide; CTG chr2 60495632 60495653 60495649 60495654 +
ttgtgatgcttacatataacgt

SEQ ID NO: 200614 - DNA, 22 bp, Artificial Sequence
  Synthetic oligonucleotide; TTG chr2 60495635 60495656 60495652 60495657 +
tgatgcttacatataacgtcat

SEQ ID NO: 200615 - DNA, 22 bp, Artificial Sequence
  Synthetic oligonucleotide; CTT chr2 60495643 60495664 60495660 60495665 +
acatataacgtcataacagaca

SEQ ID NO: 200616 - DNA, 22 bp, Artificial Sequence
  Synthetic oligonucleotide; TTA chr2 60495644 60495665 60495661 60495666 +
catataacgtcataacagacac

SEQ ID NO: 200617 - DNA, 22 bp, Artificial Sequence
  Synthetic oligonucleotide; TTG chr2 60495678 60495699 60495695 60495700 +
tgatccctgtggtttgagagtt

SEQ ID NO: 200618 - DNA, 22 bp, Artificial Sequence
  Synthetic oligonucleotide; CTG chr2 60495687 60495708 60495704 60495709 +
tggtttgagagtttggagcttc

SEQ ID NO: 200619 - DNA, 22 bp, Artificial Sequence
  Synthetic oligonucleotide; TTT chr2 60495693 60495714 60495710 60495715 +
gagagtttggagcttccctaaa

SEQ ID NO: 200620 - DNA, 22 bp, Artificial Sequence
  Synthetic oligonucleotide; TTG chr2 60495694 60495715 60495711 60495716 +
agagtttggagcttccctaaaa

SEQ ID NO: 200621 - DNA, 22 bp, Artificial Sequence
  Synthetic oligonucleotide; TTT chr2 60495701 60495722 60495718 60495723 +
ggagcttccctaaaagtcaaaa

SEQ ID NO: 200622 - DNA, 22 bp, Artificial Sequence
  Synthetic oligonucleotide; TTG chr2 60495702 60495723 60495719 60495724 +
gagcttccctaaaagtcaaaat

SEQ ID NO: 200623 - DNA, 22 bp, Artificial Sequence
  Synthetic oligonucleotide; CTT chr2 60495708 60495729 60495725 60495730 +
ccctaaaagtcaaaatattctc

SEQ ID NO: 200624 - DNA, 22 bp, Artificial Sequence
  Synthetic oligonucleotide; TTC chr2 60495709 60495730 60495726 60495731 +
cctaaaagtcaaaatattctca

SEQ ID NO: 200625 - DNA, 22 bp, Artificial Sequence
  Synthetic oligonucleotide; CTA chr2 60495713 60495734 60495730 60495735 +
aaagtcaaaatattctcaatgg

SEQ ID NO: 200626 - DNA, 22 bp, Artificial Sequence
  Synthetic oligonucleotide; TTC chr2 60495728 60495749 60495745 60495750 +
tcaatgggccctcaatcagcac

SEQ ID NO: 200627 - DNA, 22 bp, Artificial Sequence
  Synthetic oligonucleotide; CTC chr2 60495730 60495751 60495747 60495752 +
aatgggccctcaatcagcacat

SEQ ID NO: 200628 - DNA, 22 bp, Artificial Sequence
  Synthetic oligonucleotide; CTC chr2 60495741 60495762 60495758 60495763 +
aatcagcacatacacacaaaag

SEQ ID NO: 200629 - DNA, 22 bp, Artificial Sequence
  Synthetic oligonucleotide; CTG chr2 60495770 60495791 60495787 60495792 +
gaaaactgtaattcttttcctg

SEQ ID NO: 200630 - DNA, 22 bp, Artificial Sequence
  Synthetic oligonucleotide; CTG chr2 60495778 60495799 60495795 60495800 +
taattcttttcctgctcaaaga

SEQ ID NO: 200631 - DNA, 22 bp, Artificial Sequence
  Synthetic oligonucleotide; TTC chr2 60495784 60495805 60495801 60495806 +
ttttcctgctcaaagacaggca

SEQ ID NO: 200632 - DNA, 22 bp, Artificial Sequence
  Synthetic oligonucleotide; CTT chr2 60495786 60495807 60495803 60495808 +
ttcctgctcaaagacaggcaat

SEQ ID NO: 200633 - DNA, 22 bp, Artificial Sequence
  Synthetic oligonucleotide; TTT chr2 60495787 60495808 60495804 60495809 +
tcctgctcaaagacaggcaatt

SEQ ID NO: 200634 - DNA, 22 bp, Artificial Sequence
  Synthetic oligonucleotide; TTT chr2 60495788 60495809 60495805 60495810 +
cctgctcaaagacaggcaattc

SEQ ID NO: 200635 - DNA, 22 bp, Artificial Sequence
  Synthetic oligonucleotide; TTC chr2 60495789 60495810 60495806 60495811 +
ctgctcaaagacaggcaattca

SEQ ID NO: 200636 - DNA, 22 bp, Artificial Sequence
  Synthetic oligonucleotide; CTG chr2 60495792 60495813 60495809 60495814 +
ctcaaagacaggcaattcaata

SEQ ID NO: 200637 - DNA, 22 bp, Artificial Sequence
  Synthetic oligonucleotide; CTC chr2 60495795 60495816 60495812 60495817 +
aaagacaggcaattcaataccc

SEQ ID NO: 200638 - DNA, 22 bp, Artificial Sequence
  Synthetic oligonucleotide; TTC chr2 60495810 60495831 60495827 60495832 +
aataccccttcccccaaccaaa

SEQ ID NO: 200639 - DNA, 22 bp, Artificial Sequence
  Synthetic oligonucleotide; CTT chr2 60495820 60495841 60495837 60495842 +
cccccaaccaaaaacccttgcc

SEQ ID NO: 200640 - DNA, 22 bp, Artificial Sequence
  Synthetic oligonucleotide; TTC chr2 60495821 60495842 60495838 60495843 +
ccccaaccaaaaacccttgcca

SEQ ID NO: 200641 - DNA, 22 bp, Artificial Sequence
  Synthetic oligonucleotide; CTT chr2 60495839 60495860 60495856 60495861 +
gccaccatgggagcctggggca

SEQ ID NO: 200642 - DNA, 22 bp, Artificial Sequence
  Synthetic oligonucleotide; TTG chr2 60495840 60495861 60495857 60495862 +
ccaccatgggagcctggggcag

SEQ ID NO: 200643 - DNA, 22 bp, Artificial Sequence
  Synthetic oligonucleotide; CTG chr2 60495856 60495877 60495873 60495878 +
gggcagagaaggcacagtgaag

SEQ ID NO: 200644 - DNA, 22 bp, Artificial Sequence
  Synthetic oligonucleotide; CTG chr2 60495886 60495907 60495903 60495908 +
taattccaggctctaaatggtg

SEQ ID NO: 200645 - DNA, 22 bp, Artificial Sequence
  Synthetic oligonucleotide; TTC chr2 60495892 60495913 60495909 60495914 +
caggctctaaatggtgctgtca

SEQ ID NO: 200646 - DNA, 22 bp, Artificial Sequence
  Synthetic oligonucleotide; CTC chr2 60495899 60495920 60495916 60495921 +
taaatggtgctgtcatttttct

SEQ ID NO: 200647 - DNA, 22 bp, Artificial Sequence
  Synthetic oligonucleotide; CTA chr2 60495901 60495922 60495918 60495923 +
aatggtgctgtcatttttctga

SEQ ID NO: 200648 - DNA, 22 bp, Artificial Sequence
  Synthetic oligonucleotide; CTG chr2 60495911 60495932 60495928 60495933 +
tcatttttctgagagtctctaa

SEQ ID NO: 200649 - DNA, 22 bp, Artificial Sequence
  Synthetic oligonucleotide; TTT chr2 60495917 60495938 60495934 60495939 +
ttctgagagtctctaaattaca

SEQ ID NO: 200650 - DNA, 22 bp, Artificial Sequence
  Synthetic oligonucleotide; TTT chr2 60495918 60495939 60495935 60495940 +
tctgagagtctctaaattacaa

SEQ ID NO: 200651 - DNA, 22 bp, Artificial Sequence
  Synthetic oligonucleotide; TTT chr2 60495919 60495940 60495936 60495941 +
ctgagagtctctaaattacaag

SEQ ID NO: 200652 - DNA, 22 bp, Artificial Sequence
  Synthetic oligonucleotide; TTC chr2 60495920 60495941 60495937 60495942 +
tgagagtctctaaattacaagg

SEQ ID NO: 200653 - DNA, 22 bp, Artificial Sequence
  Synthetic oligonucleotide; CTG chr2 60495922 60495943 60495939 60495944 +
agagtctctaaattacaagggt

SEQ ID NO: 200654 - DNA, 22 bp, Artificial Sequence
  Synthetic oligonucleotide; CTC chr2 60495930 60495951 60495947 60495952 +
taaattacaagggtgttttcac

SEQ ID NO: 200655 - DNA, 22 bp, Artificial Sequence
  Synthetic oligonucleotide; CTA chr2 60495932 60495953 60495949 60495954 +
aattacaagggtgttttcacta

SEQ ID NO: 200656 - DNA, 22 bp, Artificial Sequence
  Synthetic oligonucleotide; TTA chr2 60495937 60495958 60495954 60495959 +
caagggtgttttcactattctt

SEQ ID NO: 200657 - DNA, 22 bp, Artificial Sequence
  Synthetic oligonucleotide; TTT chr2 60495948 60495969 60495965 60495970 +
tcactattcttagctatttttt

SEQ ID NO: 200658 - DNA, 22 bp, Artificial Sequence
  Synthetic oligonucleotide; TTT chr2 60495949 60495970 60495966 60495971 +
cactattcttagctatttttta

SEQ ID NO: 200659 - DNA, 22 bp, Artificial Sequence
  Synthetic oligonucleotide; TTC chr2 60495950 60495971 60495967 60495972 +
actattcttagctattttttaa

SEQ ID NO: 200660 - DNA, 22 bp, Artificial Sequence
  Synthetic oligonucleotide; CTA chr2 60495954 60495975 60495971 60495976 +
ttcttagctattttttaaaaca

SEQ ID NO: 200661 - DNA, 22 bp, Artificial Sequence
  Synthetic oligonucleotide; TTC chr2 60495957 60495978 60495974 60495979 +
ttagctattttttaaaacacct

SEQ ID NO: 200662 - DNA, 22 bp, Artificial Sequence
  Synthetic oligonucleotide; CTT chr2 60495959 60495980 60495976 60495981 +
agctattttttaaaacacctaa

SEQ ID NO: 200663 - DNA, 22 bp, Artificial Sequence
  Synthetic oligonucleotide; TTA chr2 60495960 60495981 60495977 60495982 +
gctattttttaaaacacctaag

SEQ ID NO: 200664 - DNA, 22 bp, Artificial Sequence
  Synthetic oligonucleotide; CTA chr2 60495964 60495985 60495981 60495986 +
ttttttaaaacacctaagaaac

SEQ ID NO: 200665 - DNA, 22 bp, Artificial Sequence
  Synthetic oligonucleotide; TTT chr2 60495967 60495988 60495984 60495989 +
tttaaaacacctaagaaacata

SEQ ID NO: 200666 - DNA, 22 bp, Artificial Sequence
  Synthetic oligonucleotide; TTT chr2 60495968 60495989 60495985 60495990 +
ttaaaacacctaagaaacatac

SEQ ID NO: 200667 - DNA, 22 bp, Artificial Sequence
  Synthetic oligonucleotide; TTT chr2 60495969 60495990 60495986 60495991 +
taaaacacctaagaaacatact

SEQ ID NO: 200668 - DNA, 22 bp, Artificial Sequence
  Synthetic oligonucleotide; TTT chr2 60495970 60495991 60495987 60495992 +
aaaacacctaagaaacatactg

SEQ ID NO: 200669 - DNA, 22 bp, Artificial Sequence
  Synthetic oligonucleotide; TTA chr2 60495971 60495992 60495988 60495993 +
aaacacctaagaaacatactgc

SEQ ID NO: 200670 - DNA, 22 bp, Artificial Sequence
  Synthetic oligonucleotide; CTA chr2 60495980 60496001 60495997 60496002 +
agaaacatactgcagctctgga

SEQ ID NO: 200671 - DNA, 22 bp, Artificial Sequence
  Synthetic oligonucleotide; CTG chr2 60495992 60496013 60496009 60496014 +
cagctctggaaaagagaacaaa

SEQ ID NO: 200672 - DNA, 22 bp, Artificial Sequence
  Synthetic oligonucleotide; CTC chr2 60495998 60496019 60496015 60496020 +
tggaaaagagaacaaacaaacc

SEQ ID NO: 200673 - DNA, 22 bp, Artificial Sequence
  Synthetic oligonucleotide; CTG chr2 60496000 60496021 60496017 60496022 +
gaaaagagaacaaacaaaccaa

SEQ ID NO: 200674 - DNA, 22 bp, Artificial Sequence
  Synthetic oligonucleotide; CTC chr2 60496048 60496069 60496065 60496070 +
atatgtgaaaagtcaattgata

SEQ ID NO: 200675 - DNA, 22 bp, Artificial Sequence
  Synthetic oligonucleotide; TTG chr2 60496067 60496088 60496084 60496089 +
ataatgaaggctttaggataac

SEQ ID NO: 200676 - DNA, 22 bp, Artificial Sequence
  Synthetic oligonucleotide; CTT chr2 60496080 60496101 60496097 60496102 +
taggataaccggaggggagatg

SEQ ID NO: 200677 - DNA, 22 bp, Artificial Sequence
  Synthetic oligonucleotide; TTT chr2 60496081 60496102 60496098 60496103 +
aggataaccggaggggagatga

SEQ ID NO: 200678 - DNA, 22 bp, Artificial Sequence
  Synthetic oligonucleotide; TTA chr2 60496082 60496103 60496099 60496104 +
ggataaccggaggggagatgat

SEQ ID NO: 200679 - DNA, 22 bp, Artificial Sequence
  Synthetic oligonucleotide; TTG chr2 60496106 60496127 60496123 60496128 +
aaagcaatgcacctgtgcagga

SEQ ID NO: 200680 - DNA, 22 bp, Artificial Sequence
  Synthetic oligonucleotide; CTG chr2 60496121 60496142 60496138 60496143 +
tgcaggaaatggattacggaaa

SEQ ID NO: 200681 - DNA, 22 bp, Artificial Sequence
  Synthetic oligonucleotide; TTA chr2 60496137 60496158 60496154 60496159 +
cggaaacagggaattgttcatg

SEQ ID NO: 200682 - DNA, 22 bp, Artificial Sequence
  Synthetic oligonucleotide; TTG chr2 60496153 60496174 60496170 60496175 +
ttcatgaaatcccagaaaacca

SEQ ID NO: 200683 - DNA, 22 bp, Artificial Sequence
  Synthetic oligonucleotide; TTC chr2 60496156 60496177 60496173 60496178 +
atgaaatcccagaaaaccagaa

SEQ ID NO: 200684 - DNA, 22 bp, Artificial Sequence
  Synthetic oligonucleotide; TTC chr2 60496190 60496211 60496207 60496212 +
tggaagtcggaaaaacaaatca

SEQ ID NO: 200685 - DNA, 22 bp, Artificial Sequence
  Synthetic oligonucleotide; CTG chr2 60496192 60496213 60496209 60496214 +
gaagtcggaaaaacaaatcatg

SEQ ID NO: 200686 - DNA, 22 bp, Artificial Sequence
  Synthetic oligonucleotide; CTT chr2 60496218 60496239 60496235 60496240 +
aagcaatggaagtccaatacac

SEQ ID NO: 200687 - DNA, 22 bp, Artificial Sequence
  Synthetic oligonucleotide; TTA chr2 60496219 60496240 60496236 60496241 +
agcaatggaagtccaatacacg

SEQ ID NO: 200688 - DNA, 22 bp, Artificial Sequence
  Synthetic oligonucleotide; TTT chr2 60496244 60496265 60496261 60496266 +
acagaatgccttgtcccacgag

SEQ ID NO: 200689 - DNA, 22 bp, Artificial Sequence
  Synthetic oligonucleotide; TTA chr2 60496245 60496266 60496262 60496267 +
cagaatgccttgtcccacgagg

SEQ ID NO: 200690 - DNA, 22 bp, Artificial Sequence
  Synthetic oligonucleotide; CTT chr2 60496256 60496277 60496273 60496278 +
gtcccacgaggcaacacaggct

SEQ ID NO: 200691 - DNA, 22 bp, Artificial Sequence
  Synthetic oligonucleotide; TTG chr2 60496257 60496278 60496274 60496279 +
tcccacgaggcaacacaggcta

SEQ ID NO: 200692 - DNA, 22 bp, Artificial Sequence
  Synthetic oligonucleotide; CTA chr2 60496279 60496300 60496296 60496301 +
ccacagatgggggacagggtgg

SEQ ID NO: 200693 - DNA, 22 bp, Artificial Sequence
  Synthetic oligonucleotide; TTA chr2 60496325 60496346 60496342 60496347 +
ctgaggggcaaagggatagccc

SEQ ID NO: 200694 - DNA, 22 bp, Artificial Sequence
  Synthetic oligonucleotide; CTG chr2 60496328 60496349 60496345 60496350 +
aggggcaaagggatagccctat

SEQ ID NO: 200695 - DNA, 22 bp, Artificial Sequence
  Synthetic oligonucleotide; CTA chr2 60496349 60496370 60496366 60496371 +
tgaggcaagtgtccagggcaga

SEQ ID NO: 200696 - DNA, 22 bp, Artificial Sequence
  Synthetic oligonucleotide; CTG chr2 60496375 60496396 60496392 60496397 +
gagctttgtgaaaccatttccc

SEQ ID NO: 200697 - DNA, 22 bp, Artificial Sequence
  Synthetic oligonucleotide; CTT chr2 60496381 60496402 60496398 60496403 +
tgtgaaaccatttcccaggcag

SEQ ID NO: 200698 - DNA, 22 bp, Artificial Sequence
  Synthetic oligonucleotide; TTT chr2 60496382 60496403 60496399 60496404 +
gtgaaaccatttcccaggcaga

SEQ ID NO: 200699 - DNA, 22 bp, Artificial Sequence
  Synthetic oligonucleotide; TTG chr2 60496383 60496404 60496400 60496405 +
tgaaaccatttcccaggcagag

SEQ ID NO: 200700 - DNA, 22 bp, Artificial Sequence
  Synthetic oligonucleotide; TTT chr2 60496394 60496415 60496411 60496416 +
cccaggcagagacagagcacta

SEQ ID NO: 200701 - DNA, 22 bp, Artificial Sequence
  Synthetic oligonucleotide; TTC chr2 60496395 60496416 60496412 60496417 +
ccaggcagagacagagcactag

SEQ ID NO: 200702 - DNA, 22 bp, Artificial Sequence
  Synthetic oligonucleotide; CTA chr2 60496416 60496437 60496433 60496438 +
ggctggtgctgccagtctgaca

SEQ ID NO: 200703 - DNA, 22 bp, Artificial Sequence
  Synthetic oligonucleotide; CTG chr2 60496421 60496442 60496438 60496443 +
gtgctgccagtctgacaataag

SEQ ID NO: 200704 - DNA, 22 bp, Artificial Sequence
  Synthetic oligonucleotide; CTG chr2 60496427 60496448 60496444 60496449 +
ccagtctgacaataagtctgcc

SEQ ID NO: 200705 - DNA, 22 bp, Artificial Sequence
  Synthetic oligonucleotide; CTG chr2 60496435 60496456 60496452 60496457 +
acaataagtctgccattgtcct

SEQ ID NO: 200706 - DNA, 22 bp, Artificial Sequence
  Synthetic oligonucleotide; CTG chr2 60496447 60496468 60496464 60496469 +
ccattgtcctctggtcagctct

SEQ ID NO: 200707 - DNA, 22 bp, Artificial Sequence
  Synthetic oligonucleotide; TTG chr2 60496453 60496474 60496470 60496475 +
tcctctggtcagctctggacac

SEQ ID NO: 200708 - DNA, 22 bp, Artificial Sequence
  Synthetic oligonucleotide; CTC chr2 60496458 60496479 60496475 60496480 +
tggtcagctctggacacacagc

SEQ ID NO: 200709 - DNA, 22 bp, Artificial Sequence
  Synthetic oligonucleotide; CTG chr2 60496460 60496481 60496477 60496482 +
gtcagctctggacacacagcaa

SEQ ID NO: 200710 - DNA, 22 bp, Artificial Sequence
  Synthetic oligonucleotide; CTC chr2 60496468 60496489 60496485 60496490 +
tggacacacagcaaaagtgagt

SEQ ID NO: 200711 - DNA, 22 bp, Artificial Sequence
  Synthetic oligonucleotide; CTG chr2 60496470 60496491 60496487 60496492 +
gacacacagcaaaagtgagttc

SEQ ID NO: 200712 - DNA, 22 bp, Artificial Sequence
  Synthetic oligonucleotide; TTC chr2 60496492 60496513 60496509 60496514 +
agagtagcctgaagcaggaaag

SEQ ID NO: 200713 - DNA, 22 bp, Artificial Sequence
  Synthetic oligonucleotide; CTG chr2 60496503 60496524 60496520 60496525 +
aagcaggaaagagggaagagag

SEQ ID NO: 200714 - DNA, 22 bp, Artificial Sequence
  Synthetic oligonucleotide; CTA chr2 60496539 60496560 60496556 60496561 +
tcttccactttgctgcaggttc

SEQ ID NO: 200715 - DNA, 22 bp, Artificial Sequence
  Synthetic oligonucleotide; CTT chr2 60496543 60496564 60496560 60496565 +
ccactttgctgcaggttcaagg

SEQ ID NO: 200716 - DNA, 22 bp, Artificial Sequence
  Synthetic oligonucleotide; TTC chr2 60496544 60496565 60496561 60496566 +
cactttgctgcaggttcaaggc

SEQ ID NO: 200717 - DNA, 22 bp, Artificial Sequence
  Synthetic oligonucleotide; CTT chr2 60496549 60496570 60496566 60496571 +
tgctgcaggttcaaggcaagga

SEQ ID NO: 200718 - DNA, 22 bp, Artificial Sequence
  Synthetic oligonucleotide; TTT chr2 60496550 60496571 60496567 60496572 +
gctgcaggttcaaggcaaggat

SEQ ID NO: 200719 - DNA, 22 bp, Artificial Sequence
  Synthetic oligonucleotide; TTG chr2 60496551 60496572 60496568 60496573 +
ctgcaggttcaaggcaaggatt

SEQ ID NO: 200720 - DNA, 22 bp, Artificial Sequence
  Synthetic oligonucleotide; CTG chr2 60496554 60496575 60496571 60496576 +
caggttcaaggcaaggatttga

SEQ ID NO: 200721 - DNA, 22 bp, Artificial Sequence
  Synthetic oligonucleotide; TTC chr2 60496561 60496582 60496578 60496583 +
aaggcaaggatttgagacagtt

SEQ ID NO: 200722 - DNA, 22 bp, Artificial Sequence
  Synthetic oligonucleotide; TTT chr2 60496574 60496595 60496591 60496596 +
gagacagttaccccttctggaa

SEQ ID NO: 200723 - DNA, 22 bp, Artificial Sequence
  Synthetic oligonucleotide; TTG chr2 60496575 60496596 60496592 60496597 +
agacagttaccccttctggaag

SEQ ID NO: 200724 - DNA, 22 bp, Artificial Sequence
  Synthetic oligonucleotide; TTA chr2 60496584 60496605 60496601 60496606 +
ccccttctggaagagcctggtg

SEQ ID NO: 200725 - DNA, 22 bp, Artificial Sequence
  Synthetic oligonucleotide; CTT chr2 60496590 60496611 60496607 60496612 +
ctggaagagcctggtgagtaca

SEQ ID NO: 200726 - DNA, 22 bp, Artificial Sequence
  Synthetic oligonucleotide; TTC chr2 60496591 60496612 60496608 60496613 +
tggaagagcctggtgagtacat

SEQ ID NO: 200727 - DNA, 22 bp, Artificial Sequence
  Synthetic oligonucleotide; CTG chr2 60496593 60496614 60496610 60496615 +
gaagagcctggtgagtacatct

SEQ ID NO: 200728 - DNA, 22 bp, Artificial Sequence
  Synthetic oligonucleotide; CTG chr2 60496603 60496624 60496620 60496625 +
gtgagtacatctctcctgcctt

SEQ ID NO: 200729 - DNA, 22 bp, Artificial Sequence
  Synthetic oligonucleotide; CTC chr2 60496616 60496637 60496633 60496638 +
tcctgccttgtacaaccctctc

SEQ ID NO: 200730 - DNA, 22 bp, Artificial Sequence
  Synthetic oligonucleotide; CTC chr2 60496618 60496639 60496635 60496640 +
ctgccttgtacaaccctctctc

SEQ ID NO: 200731 - DNA, 22 bp, Artificial Sequence
  Synthetic oligonucleotide; CTG chr2 60496621 60496642 60496638 60496643 +
ccttgtacaaccctctctcctc

SEQ ID NO: 200732 - DNA, 22 bp, Artificial Sequence
  Synthetic oligonucleotide; CTT chr2 60496625 60496646 60496642 60496647 +
gtacaaccctctctcctcaccg

SEQ ID NO: 200733 - DNA, 22 bp, Artificial Sequence
  Synthetic oligonucleotide; TTG chr2 60496626 60496647 60496643 60496648 +
tacaaccctctctcctcaccga

SEQ ID NO: 200734 - DNA, 22 bp, Artificial Sequence
  Synthetic oligonucleotide; CTC chr2 60496636 60496657 60496653 60496658 +
tctcctcaccgactttctctcc

SEQ ID NO: 200735 - DNA, 22 bp, Artificial Sequence
  Synthetic oligonucleotide; CTC chr2 60496638 60496659 60496655 60496660 +
tcctcaccgactttctctccca

SEQ ID NO: 200736 - DNA, 22 bp, Artificial Sequence
  Synthetic oligonucleotide; CTC chr2 60496640 60496661 60496657 60496662 +
ctcaccgactttctctcccagc

SEQ ID NO: 200737 - DNA, 22 bp, Artificial Sequence
  Synthetic oligonucleotide; CTC chr2 60496643 60496664 60496660 60496665 +
accgactttctctcccagcagc

SEQ ID NO: 200738 - DNA, 22 bp, Artificial Sequence
  Synthetic oligonucleotide; CTT chr2 60496651 60496672 60496668 60496673 +
tctctcccagcagccagcaggg

SEQ ID NO: 200739 - DNA, 22 bp, Artificial Sequence
  Synthetic oligonucleotide; TTT chr2 60496652 60496673 60496669 60496674 +
ctctcccagcagccagcagggg

SEQ ID NO: 200740 - DNA, 22 bp, Artificial Sequence
  Synthetic oligonucleotide; TTC chr2 60496653 60496674 60496670 60496675 +
tctcccagcagccagcaggggc

SEQ ID NO: 200741 - DNA, 22 bp, Artificial Sequence
  Synthetic oligonucleotide; CTC chr2 60496655 60496676 60496672 60496677 +
tcccagcagccagcaggggcct

SEQ ID NO: 200742 - DNA, 22 bp, Artificial Sequence
  Synthetic oligonucleotide; CTC chr2 60496657 60496678 60496674 60496679 +
ccagcagccagcaggggcctgg

SEQ ID NO: 200743 - DNA, 22 bp, Artificial Sequence
  Synthetic oligonucleotide; CTG chr2 60496678 60496699 60496695 60496700 +
ggccatttatggaatgcaagcc

SEQ ID NO: 200744 - DNA, 22 bp, Artificial Sequence
  Synthetic oligonucleotide; TTT chr2 60496686 60496707 60496703 60496708 +
atggaatgcaagccctgaccac

SEQ ID NO: 200745 - DNA, 22 bp, Artificial Sequence
  Synthetic oligonucleotide; TTA chr2 60496687 60496708 60496704 60496709 +
tggaatgcaagccctgaccaca

SEQ ID NO: 200746 - DNA, 22 bp, Artificial Sequence
  Synthetic oligonucleotide; CTG chr2 60496703 60496724 60496720 60496725 +
accacacagacttacttacatg

SEQ ID NO: 200747 - DNA, 22 bp, Artificial Sequence
  Synthetic oligonucleotide; CTT chr2 60496716 60496737 60496733 60496738 +
acttacatgccaggacagccac

SEQ ID NO: 200748 - DNA, 22 bp, Artificial Sequence
  Synthetic oligonucleotide; TTA chr2 60496717 60496738 60496734 60496739 +
cttacatgccaggacagccacc

SEQ ID NO: 200749 - DNA, 22 bp, Artificial Sequence
  Synthetic oligonucleotide; CTT chr2 60496720 60496741 60496737 60496742 +
acatgccaggacagccaccagg

SEQ ID NO: 200750 - DNA, 22 bp, Artificial Sequence
  Synthetic oligonucleotide; TTA chr2 60496721 60496742 60496738 60496743 +
catgccaggacagccaccaggt

SEQ ID NO: 200751 - DNA, 22 bp, Artificial Sequence
  Synthetic oligonucleotide; CTT chr2 60496749 60496770 60496766 60496771 +
tcccactctaggttccactgtg

SEQ ID NO: 200752 - DNA, 22 bp, Artificial Sequence
  Synthetic oligonucleotide; TTT chr2 60496750 60496771 60496767 60496772 +
cccactctaggttccactgtga

SEQ ID NO: 200753 - DNA, 22 bp, Artificial Sequence
  Synthetic oligonucleotide; TTC chr2 60496751 60496772 60496768 60496773 +
ccactctaggttccactgtgag

SEQ ID NO: 200754 - DNA, 22 bp, Artificial Sequence
  Synthetic oligonucleotide; CTC chr2 60496757 60496778 60496774 60496779 +
taggttccactgtgagtgctct

SEQ ID NO: 200755 - DNA, 22 bp, Artificial Sequence
  Synthetic oligonucleotide; CTA chr2 60496759 60496780 60496776 60496781 +
ggttccactgtgagtgctctct

SEQ ID NO: 200756 - DNA, 22 bp, Artificial Sequence
  Synthetic oligonucleotide; TTC chr2 60496764 60496785 60496781 60496786 +
cactgtgagtgctctctctctc

SEQ ID NO: 200757 - DNA, 22 bp, Artificial Sequence
  Synthetic oligonucleotide; CTG chr2 60496769 60496790 60496786 60496791 +
tgagtgctctctctctctctct

SEQ ID NO: 200758 - DNA, 22 bp, Artificial Sequence
  Synthetic oligonucleotide; CTC chr2 60496778 60496799 60496795 60496800 +
tctctctctctctctctcacta

SEQ ID NO: 200759 - DNA, 22 bp, Artificial Sequence
  Synthetic oligonucleotide; CTC chr2 60496780 60496801 60496797 60496802 +
tctctctctctctctcactatg

SEQ ID NO: 200760 - DNA, 22 bp, Artificial Sequence
  Synthetic oligonucleotide; CTC chr2 60496782 60496803 60496799 60496804 +
tctctctctctctcactatgct

SEQ ID NO: 200761 - DNA, 22 bp, Artificial Sequence
  Synthetic oligonucleotide; CTC chr2 60496784 60496805 60496801 60496806 +
tctctctctctcactatgctcc

SEQ ID NO: 200762 - DNA, 22 bp, Artificial Sequence
  Synthetic oligonucleotide; CTC chr2 60496786 60496807 60496803 60496808 +
tctctctctcactatgctccca

SEQ ID NO: 200763 - DNA, 22 bp, Artificial Sequence
  Synthetic oligonucleotide; CTC chr2 60496788 60496809 60496805 60496810 +
tctctctcactatgctcccaag

SEQ ID NO: 200764 - DNA, 22 bp, Artificial Sequence
  Synthetic oligonucleotide; CTC chr2 60496790 60496811 60496807 60496812 +
tctctcactatgctcccaagag

SEQ ID NO: 200765 - DNA, 22 bp, Artificial Sequence
  Synthetic oligonucleotide; CTC chr2 60496792 60496813 60496809 60496814 +
tctcactatgctcccaagagga

SEQ ID NO: 200766 - DNA, 22 bp, Artificial Sequence
  Synthetic oligonucleotide; CTC chr2 60496794 60496815 60496811 60496816 +
tcactatgctcccaagaggagt

SEQ ID NO: 200767 - DNA, 22 bp, Artificial Sequence
  Synthetic oligonucleotide; CTC chr2 60496796 60496817 60496813 60496818 +
actatgctcccaagaggagtct

SEQ ID NO: 200768 - DNA, 22 bp, Artificial Sequence
  Synthetic oligonucleotide; CTA chr2 60496800 60496821 60496817 60496822 +
tgctcccaagaggagtcttaca

SEQ ID NO: 200769 - DNA, 22 bp, Artificial Sequence
  Synthetic oligonucleotide; CTC chr2 60496805 60496826 60496822 60496827 +
ccaagaggagtcttacatcaac

SEQ ID NO: 200770 - DNA, 22 bp, Artificial Sequence
  Synthetic oligonucleotide; CTT chr2 60496819 60496840 60496836 60496841 +
acatcaaccccttcctcaaatc

SEQ ID NO: 200771 - DNA, 22 bp, Artificial Sequence
  Synthetic oligonucleotide; TTA chr2 60496820 60496841 60496837 60496842 +
catcaaccccttcctcaaatct

SEQ ID NO: 200772 - DNA, 22 bp, Artificial Sequence
  Synthetic oligonucleotide; CTT chr2 60496832 60496853 60496849 60496854 +
cctcaaatctccctcactggat

SEQ ID NO: 200773 - DNA, 22 bp, Artificial Sequence
  Synthetic oligonucleotide; TTC chr2 60496833 60496854 60496850 60496855 +
ctcaaatctccctcactggatg

SEQ ID NO: 200774 - DNA, 22 bp, Artificial Sequence
  Synthetic oligonucleotide; CTC chr2 60496836 60496857 60496853 60496858 +
aaatctccctcactggatgtca

SEQ ID NO: 200775 - DNA, 22 bp, Artificial Sequence
  Synthetic oligonucleotide; CTC chr2 60496843 60496864 60496860 60496865 +
cctcactggatgtcacagtcat

SEQ ID NO: 200776 - DNA, 22 bp, Artificial Sequence
  Synthetic oligonucleotide; CTC chr2 60496847 60496868 60496864 60496869 +
actggatgtcacagtcataggc

SEQ ID NO: 200777 - DNA, 22 bp, Artificial Sequence
  Synthetic oligonucleotide; CTG chr2 60496851 60496872 60496868 60496873 +
gatgtcacagtcataggcctga

SEQ ID NO: 200778 - DNA, 22 bp, Artificial Sequence
  Synthetic oligonucleotide; CTG chr2 60496872 60496893 60496889 60496894 +
aaaagcagcatgcaaactgaat

SEQ ID NO: 200779 - DNA, 22 bp, Artificial Sequence
  Synthetic oligonucleotide; CTG chr2 60496891 60496912 60496908 60496913 +
aatttttgtaaagcaggaccca

SEQ ID NO: 200780 - DNA, 22 bp, Artificial Sequence
  Synthetic oligonucleotide; TTT chr2 60496896 60496917 60496913 60496918 +
ttgtaaagcaggacccatttcc

SEQ ID NO: 200781 - DNA, 22 bp, Artificial Sequence
  Synthetic oligonucleotide; TTT chr2 60496897 60496918 60496914 60496919 +
tgtaaagcaggacccatttccc

SEQ ID NO: 200782 - DNA, 22 bp, Artificial Sequence
  Synthetic oligonucleotide; TTT chr2 60496898 60496919 60496915 60496920 +
gtaaagcaggacccatttcccc

SEQ ID NO: 200783 - DNA, 22 bp, Artificial Sequence
  Synthetic oligonucleotide; TTG chr2 60496899 60496920 60496916 60496921 +
taaagcaggacccatttcccca

SEQ ID NO: 200784 - DNA, 22 bp, Artificial Sequence
  Synthetic oligonucleotide; TTT chr2 60496916 60496937 60496933 60496938 +
ccccatggacagtcataagaga

SEQ ID NO: 200785 - DNA, 22 bp, Artificial Sequence
  Synthetic oligonucleotide; TTC chr2 60496917 60496938 60496934 60496939 +
cccatggacagtcataagagat

SEQ ID NO: 200786 - DNA, 22 bp, Artificial Sequence
  Synthetic oligonucleotide; CTT chr2 60496961 60496982 60496978 60496983 +
aatttctgtcttcacgattact

SEQ ID NO: 200787 - DNA, 22 bp, Artificial Sequence
  Synthetic oligonucleotide; TTA chr2 60496962 60496983 60496979 60496984 +
atttctgtcttcacgattactt

SEQ ID NO: 200788 - DNA, 22 bp, Artificial Sequence
  Synthetic oligonucleotide; TTT chr2 60496966 60496987 60496983 60496988 +
ctgtcttcacgattacttcacg

SEQ ID NO: 200789 - DNA, 22 bp, Artificial Sequence
  Synthetic oligonucleotide; TTC chr2 60496967 60496988 60496984 60496989 +
tgtcttcacgattacttcacga

SEQ ID NO: 200790 - DNA, 22 bp, Artificial Sequence
  Synthetic oligonucleotide; CTG chr2 60496969 60496990 60496986 60496991 +
tcttcacgattacttcacgata

SEQ ID NO: 200791 - DNA, 22 bp, Artificial Sequence
  Synthetic oligonucleotide; CTT chr2 60496973 60496994 60496990 60496995 +
cacgattacttcacgataaatc

SEQ ID NO: 200792 - DNA, 22 bp, Artificial Sequence
  Synthetic oligonucleotide; TTC chr2 60496974 60496995 60496991 60496996 +
acgattacttcacgataaatct

SEQ ID NO: 200793 - DNA, 22 bp, Artificial Sequence
  Synthetic oligonucleotide; TTA chr2 60496981 60497002 60496998 60497003 +
cttcacgataaatctggattcc

SEQ ID NO: 200794 - DNA, 22 bp, Artificial Sequence
  Synthetic oligonucleotide; CTT chr2 60496984 60497005 60497001 60497006 +
cacgataaatctggattccaaa

SEQ ID NO: 200795 - DNA, 22 bp, Artificial Sequence
  Synthetic oligonucleotide; TTC chr2 60496985 60497006 60497002 60497007 +
acgataaatctggattccaaag

SEQ ID NO: 200796 - DNA, 22 bp, Artificial Sequence
  Synthetic oligonucleotide; CTG chr2 60496997 60497018 60497014 60497019 +
gattccaaagggactataagct

SEQ ID NO: 200797 - DNA, 22 bp, Artificial Sequence
  Synthetic oligonucleotide; TTC chr2 60497002 60497023 60497019 60497024 +
caaagggactataagctctcac

SEQ ID NO: 200798 - DNA, 22 bp, Artificial Sequence
  Synthetic oligonucleotide; CTA chr2 60497013 60497034 60497030 60497035 +
taagctctcacatggaaggaag

SEQ ID NO: 200799 - DNA, 22 bp, Artificial Sequence
  Synthetic oligonucleotide; CTC chr2 60497020 60497041 60497037 60497042 +
tcacatggaaggaagcaagatc

SEQ ID NO: 200800 - DNA, 22 bp, Artificial Sequence
  Synthetic oligonucleotide; CTC chr2 60497022 60497043 60497039 60497044 +
acatggaaggaagcaagatctc

SEQ ID NO: 200801 - DNA, 22 bp, Artificial Sequence
  Synthetic oligonucleotide; CTC chr2 60497044 60497065 60497061 60497066 +
tactcctcccccagtgttgagt

SEQ ID NO: 200802 - DNA, 22 bp, Artificial Sequence
  Synthetic oligonucleotide; CTA chr2 60497046 60497067 60497063 60497068 +
ctcctcccccagtgttgagtgg

SEQ ID NO: 200803 - DNA, 22 bp, Artificial Sequence
  Synthetic oligonucleotide; CTC chr2 60497049 60497070 60497066 60497071 +
ctcccccagtgttgagtggaca

SEQ ID NO: 200804 - DNA, 22 bp, Artificial Sequence
  Synthetic oligonucleotide; CTC chr2 60497052 60497073 60497069 60497074 +
ccccagtgttgagtggacaggg

SEQ ID NO: 200805 - DNA, 22 bp, Artificial Sequence
  Synthetic oligonucleotide; TTG chr2 60497063 60497084 60497080 60497085 +
agtggacagggagtacaccgca

SEQ ID NO: 200806 - DNA, 22 bp, Artificial Sequence
  Synthetic oligonucleotide; CTG chr2 60497093 60497114 60497110 60497115 +
ttggccaaccaattctaattcc

SEQ ID NO: 200807 - DNA, 22 bp, Artificial Sequence
  Synthetic oligonucleotide; TTG chr2 60497096 60497117 60497113 60497118 +
gccaaccaattctaattccctt

SEQ ID NO: 200808 - DNA, 22 bp, Artificial Sequence
  Synthetic oligonucleotide; TTC chr2 60497108 60497129 60497125 60497130 +
taattccctttagctagcatcc

SEQ ID NO: 200809 - DNA, 22 bp, Artificial Sequence
  Synthetic oligonucleotide; CTA chr2 60497110 60497131 60497127 60497132 +
attccctttagctagcatcccc

SEQ ID NO: 200810 - DNA, 22 bp, Artificial Sequence
  Synthetic oligonucleotide; TTC chr2 60497114 60497135 60497131 60497136 +
cctttagctagcatcccctaag

SEQ ID NO: 200811 - DNA, 22 bp, Artificial Sequence
  Synthetic oligonucleotide; CTT chr2 60497118 60497139 60497135 60497140 +
tagctagcatcccctaagctag

SEQ ID NO: 200812 - DNA, 22 bp, Artificial Sequence
  Synthetic oligonucleotide; TTT chr2 60497119 60497140 60497136 60497141 +
agctagcatcccctaagctaga

SEQ ID NO: 200813 - DNA, 22 bp, Artificial Sequence
  Synthetic oligonucleotide; TTA chr2 60497120 60497141 60497137 60497142 +
gctagcatcccctaagctagag

SEQ ID NO: 200814 - DNA, 22 bp, Artificial Sequence
  Synthetic oligonucleotide; CTA chr2 60497124 60497145 60497141 60497146 +
gcatcccctaagctagagctag

SEQ ID NO: 200815 - DNA, 22 bp, Artificial Sequence
  Synthetic oligonucleotide; CTA chr2 60497134 60497155 60497151 60497156 +
agctagagctagagctagagct

SEQ ID NO: 200816 - DNA, 22 bp, Artificial Sequence
  Synthetic oligonucleotide; CTA chr2 60497139 60497160 60497156 60497161 +
gagctagagctagagctatttc

SEQ ID NO: 200817 - DNA, 22 bp, Artificial Sequence
  Synthetic oligonucleotide; CTA chr2 60497145 60497166 60497162 60497167 +
gagctagagctatttccttgca

SEQ ID NO: 200818 - DNA, 22 bp, Artificial Sequence
  Synthetic oligonucleotide; CTA chr2 60497151 60497172 60497168 60497173 +
gagctatttccttgcagccttc

SEQ ID NO: 200819 - DNA, 22 bp, Artificial Sequence
  Synthetic oligonucleotide; CTA chr2 60497157 60497178 60497174 60497179 +
tttccttgcagccttccttttc

SEQ ID NO: 200820 - DNA, 22 bp, Artificial Sequence
  Synthetic oligonucleotide; TTT chr2 60497160 60497181 60497177 60497182 +
ccttgcagccttccttttctct

SEQ ID NO: 200821 - DNA, 22 bp, Artificial Sequence
  Synthetic oligonucleotide; TTC chr2 60497161 60497182 60497178 60497183 +
cttgcagccttccttttctcta

SEQ ID NO: 200822 - DNA, 22 bp, Artificial Sequence
  Synthetic oligonucleotide; CTT chr2 60497164 60497185 60497181 60497186 +
gcagccttccttttctctagca

SEQ ID NO: 200823 - DNA, 22 bp, Artificial Sequence
  Synthetic oligonucleotide; TTG chr2 60497165 60497186 60497182 60497187 +
cagccttccttttctctagcaa

SEQ ID NO: 200824 - DNA, 22 bp, Artificial Sequence
  Synthetic oligonucleotide; CTT chr2 60497172 60497193 60497189 60497194 +
ccttttctctagcaaagtcctt

SEQ ID NO: 200825 - DNA, 22 bp, Artificial Sequence
  Synthetic oligonucleotide; TTC chr2 60497173 60497194 60497190 60497195 +
cttttctctagcaaagtccttc

SEQ ID NO: 200826 - DNA, 22 bp, Artificial Sequence
  Synthetic oligonucleotide; CTT chr2 60497176 60497197 60497193 60497198 +
ttctctagcaaagtccttccat

SEQ ID NO: 200827 - DNA, 22 bp, Artificial Sequence
  Synthetic oligonucleotide; TTT chr2 60497177 60497198 60497194 60497199 +
tctctagcaaagtccttccatg

SEQ ID NO: 200828 - DNA, 22 bp, Artificial Sequence
  Synthetic oligonucleotide; TTT chr2 60497178 60497199 60497195 60497200 +
ctctagcaaagtccttccatgc

SEQ ID NO: 200829 - DNA, 22 bp, Artificial Sequence
  Synthetic oligonucleotide; TTC chr2 60497179 60497200 60497196 60497201 +
tctagcaaagtccttccatgca

SEQ ID NO: 200830 - DNA, 22 bp, Artificial Sequence
  Synthetic oligonucleotide; CTC chr2 60497181 60497202 60497198 60497203 +
tagcaaagtccttccatgcagt

SEQ ID NO: 200831 - DNA, 22 bp, Artificial Sequence
  Synthetic oligonucleotide; CTA chr2 60497183 60497204 60497200 60497205 +
gcaaagtccttccatgcagtag

SEQ ID NO: 200832 - DNA, 22 bp, Artificial Sequence
  Synthetic oligonucleotide; CTT chr2 60497194 60497215 60497211 60497216 +
ccatgcagtagctaatgacctg

SEQ ID NO: 200833 - DNA, 22 bp, Artificial Sequence
  Synthetic oligonucleotide; TTC chr2 60497195 60497216 60497212 60497217 +
catgcagtagctaatgacctgt

SEQ ID NO: 200834 - DNA, 22 bp, Artificial Sequence
  Synthetic oligonucleotide; CTA chr2 60497208 60497229 60497225 60497230 +
atgacctgtaaacacttaatga

SEQ ID NO: 200835 - DNA, 22 bp, Artificial Sequence
  Synthetic oligonucleotide; CTG chr2 60497216 60497237 60497233 60497238 +
taaacacttaatgagctagaga

SEQ ID NO: 200836 - DNA, 22 bp, Artificial Sequence
  Synthetic oligonucleotide; CTT chr2 60497225 60497246 60497242 60497247 +
aatgagctagagaaacattcca

SEQ ID NO: 200837 - DNA, 22 bp, Artificial Sequence
  Synthetic oligonucleotide; TTA chr2 60497226 60497247 60497243 60497248 +
atgagctagagaaacattccat

SEQ ID NO: 200838 - DNA, 22 bp, Artificial Sequence
  Synthetic oligonucleotide; CTA chr2 60497234 60497255 60497251 60497256 +
gagaaacattccattgaaagga

SEQ ID NO: 200839 - DNA, 22 bp, Artificial Sequence
  Synthetic oligonucleotide; TTC chr2 60497245 60497266 60497262 60497267 +
cattgaaaggaataccactgtg

SEQ ID NO: 200840 - DNA, 22 bp, Artificial Sequence
  Synthetic oligonucleotide; TTG chr2 60497250 60497271 60497267 60497272 +
aaaggaataccactgtgcatcc

SEQ ID NO: 200841 - DNA, 22 bp, Artificial Sequence
  Synthetic oligonucleotide; CTG chr2 60497265 60497286 60497282 60497287 +
tgcatccttttgtaaagagggg

SEQ ID NO: 200842 - DNA, 22 bp, Artificial Sequence
  Synthetic oligonucleotide; CTT chr2 60497274 60497295 60497291 60497296 +
ttgtaaagaggggggaaaatct

SEQ ID NO: 200843 - DNA, 22 bp, Artificial Sequence
  Synthetic oligonucleotide; TTT chr2 60497275 60497296 60497292 60497297 +
tgtaaagaggggggaaaatctt

SEQ ID NO: 200844 - DNA, 22 bp, Artificial Sequence
  Synthetic oligonucleotide; TTT chr2 60497276 60497297 60497293 60497298 +
gtaaagaggggggaaaatcttt

SEQ ID NO: 200845 - DNA, 22 bp, Artificial Sequence
  Synthetic oligonucleotide; TTG chr2 60497277 60497298 60497294 60497299 +
taaagaggggggaaaatctttt

SEQ ID NO: 200846 - DNA, 22 bp, Artificial Sequence
  Synthetic oligonucleotide; CTT chr2 60497297 60497318 60497314 60497319 +
ttgtaaaacgaagcatcgcctt

SEQ ID NO: 200847 - DNA, 22 bp, Artificial Sequence
  Synthetic oligonucleotide; TTT chr2 60497298 60497319 60497315 60497320 +
tgtaaaacgaagcatcgccttt

SEQ ID NO: 200848 - DNA, 22 bp, Artificial Sequence
  Synthetic oligonucleotide; TTT chr2 60497299 60497320 60497316 60497321 +
gtaaaacgaagcatcgccttta

SEQ ID NO: 200849 - DNA, 22 bp, Artificial Sequence
  Synthetic oligonucleotide; TTG chr2 60497300 60497321 60497317 60497322 +
taaaacgaagcatcgcctttaa

SEQ ID NO: 200850 - DNA, 22 bp, Artificial Sequence
  Synthetic oligonucleotide; CTT chr2 60497319 60497340 60497336 60497341 +
taactgctctgtttgatcaagt

SEQ ID NO: 200851 - DNA, 22 bp, Artificial Sequence
  Synthetic oligonucleotide; TTT chr2 60497320 60497341 60497337 60497342 +
aactgctctgtttgatcaagtc

SEQ ID NO: 200852 - DNA, 22 bp, Artificial Sequence
  Synthetic oligonucleotide; TTA chr2 60497321 60497342 60497338 60497343 +
actgctctgtttgatcaagtca

SEQ ID NO: 200853 - DNA, 22 bp, Artificial Sequence
  Synthetic oligonucleotide; CTG chr2 60497325 60497346 60497342 60497347 +
ctctgtttgatcaagtcagatt

SEQ ID NO: 200854 - DNA, 22 bp, Artificial Sequence
  Synthetic oligonucleotide; CTC chr2 60497328 60497349 60497345 60497350 +
tgtttgatcaagtcagattttt

SEQ ID NO: 200855 - DNA, 22 bp, Artificial Sequence
  Synthetic oligonucleotide; CTG chr2 60497330 60497351 60497347 60497352 +
tttgatcaagtcagatttttca

SEQ ID NO: 200856 - DNA, 22 bp, Artificial Sequence
  Synthetic oligonucleotide; TTT chr2 60497333 60497354 60497350 60497355 +
gatcaagtcagatttttcagaa

SEQ ID NO: 200857 - DNA, 22 bp, Artificial Sequence
  Synthetic oligonucleotide; TTG chr2 60497334 60497355 60497351 60497356 +
atcaagtcagatttttcagaat

SEQ ID NO: 200858 - DNA, 22 bp, Artificial Sequence
  Synthetic oligonucleotide; TTT chr2 60497348 60497369 60497365 60497370 +
ttcagaatatgaatagctagta

SEQ ID NO: 200859 - DNA, 22 bp, Artificial Sequence
  Synthetic oligonucleotide; TTT chr2 60497349 60497370 60497366 60497371 +
tcagaatatgaatagctagtat

SEQ ID NO: 200860 - DNA, 22 bp, Artificial Sequence
  Synthetic oligonucleotide; TTT chr2 60497350 60497371 60497367 60497372 +
cagaatatgaatagctagtatt

SEQ ID NO: 200861 - DNA, 22 bp, Artificial Sequence
  Synthetic oligonucleotide; TTC chr2 60497351 60497372 60497368 60497373 +
agaatatgaatagctagtattc

SEQ ID NO: 200862 - DNA, 22 bp, Artificial Sequence
  Synthetic oligonucleotide; CTA chr2 60497367 60497388 60497384 60497389 +
gtattcaagcatatatgaactg

SEQ ID NO: 200863 - DNA, 22 bp, Artificial Sequence
  Synthetic oligonucleotide; TTC chr2 60497373 60497394 60497390 60497395 +
aagcatatatgaactgtcttta

SEQ ID NO: 200864 - DNA, 22 bp, Artificial Sequence
  Synthetic oligonucleotide; CTG chr2 60497389 60497410 60497406 60497411 +
tctttaagttaatcaatcccta

SEQ ID NO: 200865 - DNA, 22 bp, Artificial Sequence
  Synthetic oligonucleotide; CTT chr2 60497393 60497414 60497410 60497415 +
taagttaatcaatccctagaaa

SEQ ID NO: 200866 - DNA, 22 bp, Artificial Sequence
  Synthetic oligonucleotide; TTT chr2 60497394 60497415 60497411 60497416 +
aagttaatcaatccctagaaac

SEQ ID NO: 200867 - DNA, 22 bp, Artificial Sequence
  Synthetic oligonucleotide; TTA chr2 60497395 60497416 60497412 60497417 +
agttaatcaatccctagaaact

SEQ ID NO: 200868 - DNA, 22 bp, Artificial Sequence
  Synthetic oligonucleotide; TTA chr2 60497400 60497421 60497417 60497422 +
atcaatccctagaaactagccc

SEQ ID NO: 200869 - DNA, 22 bp, Artificial Sequence
  Synthetic oligonucleotide; CTA chr2 60497411 60497432 60497428 60497433 +
gaaactagccctcaggttagca

SEQ ID NO: 200870 - DNA, 22 bp, Artificial Sequence
  Synthetic oligonucleotide; CTA chr2 60497418 60497439 60497435 60497440 +
gccctcaggttagcaggccaag

SEQ ID NO: 200871 - DNA, 22 bp, Artificial Sequence
  Synthetic oligonucleotide; CTC chr2 60497424 60497445 60497441 60497446 +
aggttagcaggccaaggatata

SEQ ID NO: 200872 - DNA, 22 bp, Artificial Sequence
  Synthetic oligonucleotide; TTA chr2 60497430 60497451 60497447 60497452 +
gcaggccaaggatatatgagag

SEQ ID NO: 200873 - DNA, 22 bp, Artificial Sequence
  Synthetic oligonucleotide; CTT chr2 60497457 60497478 60497474 60497479 +
tgaagtctagacttaaactgcc

SEQ ID NO: 200874 - DNA, 22 bp, Artificial Sequence
  Synthetic oligonucleotide; TTT chr2 60497458 60497479 60497475 60497480 +
gaagtctagacttaaactgccg

SEQ ID NO: 200875 - DNA, 22 bp, Artificial Sequence
  Synthetic oligonucleotide; TTG chr2 60497459 60497480 60497476 60497481 +
aagtctagacttaaactgccgc

SEQ ID NO: 200876 - DNA, 22 bp, Artificial Sequence
  Synthetic oligonucleotide; CTA chr2 60497466 60497487 60497483 60497488 +
gacttaaactgccgctcctgaa

SEQ ID NO: 200877 - DNA, 22 bp, Artificial Sequence
  Synthetic oligonucleotide; CTT chr2 60497471 60497492 60497488 60497493 +
aaactgccgctcctgaattgaa

SEQ ID NO: 200878 - DNA, 22 bp, Artificial Sequence
  Synthetic oligonucleotide; TTA chr2 60497472 60497493 60497489 60497494 +
aactgccgctcctgaattgaat

SEQ ID NO: 200879 - DNA, 22 bp, Artificial Sequence
  Synthetic oligonucleotide; CTG chr2 60497477 60497498 60497494 60497499 +
ccgctcctgaattgaattagaa

SEQ ID NO: 200880 - DNA, 22 bp, Artificial Sequence
  Synthetic oligonucleotide; CTC chr2 60497483 60497504 60497500 60497505 +
ctgaattgaattagaacattcc

SEQ ID NO: 200881 - DNA, 22 bp, Artificial Sequence
  Synthetic oligonucleotide; CTG chr2 60497486 60497507 60497503 60497508 +
aattgaattagaacattccagg

SEQ ID NO: 200882 - DNA, 22 bp, Artificial Sequence
  Synthetic oligonucleotide; TTG chr2 60497491 60497512 60497508 60497513 +
aattagaacattccaggtagac

SEQ ID NO: 200883 - DNA, 22 bp, Artificial Sequence
  Synthetic oligonucleotide; TTA chr2 60497496 60497517 60497513 60497518 +
gaacattccaggtagacagatt

SEQ ID NO: 200884 - DNA, 22 bp, Artificial Sequence
  Synthetic oligonucleotide; TTC chr2 60497504 60497525 60497521 60497526 +
caggtagacagattcatggccc

SEQ ID NO: 200885 - DNA, 22 bp, Artificial Sequence
  Synthetic oligonucleotide; TTC chr2 60497519 60497540 60497536 60497541 +
atggcccctaacatcaggaatc

SEQ ID NO: 200886 - DNA, 22 bp, Artificial Sequence
  Synthetic oligonucleotide; CTA chr2 60497529 60497550 60497546 60497551 +
acatcaggaatcagctagaaac

SEQ ID NO: 200887 - DNA, 22 bp, Artificial Sequence
  Synthetic oligonucleotide; CTA chr2 60497546 60497567 60497563 60497568 +
gaaactcaatcggctcttacca

SEQ ID NO: 200888 - DNA, 22 bp, Artificial Sequence
  Synthetic oligonucleotide; CTC chr2 60497553 60497574 60497570 60497575 +
aatcggctcttaccagtcacta

SEQ ID NO: 200889 - DNA, 22 bp, Artificial Sequence
  Synthetic oligonucleotide; CTC chr2 60497562 60497583 60497579 60497584 +
ttaccagtcactacctacgtca

SEQ ID NO: 200890 - DNA, 22 bp, Artificial Sequence
  Synthetic oligonucleotide; CTT chr2 60497564 60497585 60497581 60497586 +
accagtcactacctacgtcagt

SEQ ID NO: 200891 - DNA, 22 bp, Artificial Sequence
  Synthetic oligonucleotide; TTA chr2 60497565 60497586 60497582 60497587 +
ccagtcactacctacgtcagtg

SEQ ID NO: 200892 - DNA, 22 bp, Artificial Sequence
  Synthetic oligonucleotide; CTA chr2 60497575 60497596 60497592 60497597 +
cctacgtcagtgccatatccta

SEQ ID NO: 200893 - DNA, 22 bp, Artificial Sequence
  Synthetic oligonucleotide; CTA chr2 60497579 60497600 60497596 60497601 +
cgtcagtgccatatcctataat

SEQ ID NO: 200894 - DNA, 22 bp, Artificial Sequence
  Synthetic oligonucleotide; CTA chr2 60497597 60497618 60497614 60497619 +
taatggtgatgataatgaccat

SEQ ID NO: 200895 - DNA, 22 bp, Artificial Sequence
  Synthetic oligonucleotide; TTA chr2 60497621 60497642 60497638 60497643 +
tgatgatgataataataataat

SEQ ID NO: 200896 - DNA, 22 bp, Artificial Sequence
  Synthetic oligonucleotide; CTT chr2 60497648 60497669 60497665 60497670 +
ccactggatggcactttgcacc

SEQ ID NO: 200897 - DNA, 22 bp, Artificial Sequence
  Synthetic oligonucleotide; TTC chr2 60497649 60497670 60497666 60497671 +
cactggatggcactttgcacct

SEQ ID NO: 200898 - DNA, 22 bp, Artificial Sequence
  Synthetic oligonucleotide; CTG chr2 60497654 60497675 60497671 60497676 +
gatggcactttgcaccttccag

SEQ ID NO: 200899 - DNA, 22 bp, Artificial Sequence
  Synthetic oligonucleotide; CTT chr2 60497664 60497685 60497681 60497686 +
tgcaccttccagagcaatttaa

SEQ ID NO: 200900 - DNA, 22 bp, Artificial Sequence
  Synthetic oligonucleotide; TTT chr2 60497665 60497686 60497682 60497687 +
gcaccttccagagcaatttaac

SEQ ID NO: 200901 - DNA, 22 bp, Artificial Sequence
  Synthetic oligonucleotide; TTG chr2 60497666 60497687 60497683 60497688 +
caccttccagagcaatttaaca

SEQ ID NO: 200902 - DNA, 22 bp, Artificial Sequence
  Synthetic oligonucleotide; CTT chr2 60497672 60497693 60497689 60497694 +
ccagagcaatttaacatccttt

SEQ ID NO: 200903 - DNA, 22 bp, Artificial Sequence
  Synthetic oligonucleotide; TTC chr2 60497673 60497694 60497690 60497695 +
cagagcaatttaacatccttta

SEQ ID NO: 200904 - DNA, 22 bp, Artificial Sequence
  Synthetic oligonucleotide; TTT chr2 60497684 60497705 60497701 60497706 +
aacatcctttactttttttgga

SEQ ID NO: 200905 - DNA, 22 bp, Artificial Sequence
  Synthetic oligonucleotide; TTA chr2 60497685 60497706 60497702 60497707 +
acatcctttactttttttggaa

SEQ ID NO: 200906 - DNA, 22 bp, Artificial Sequence
  Synthetic oligonucleotide; CTT chr2 60497693 60497714 60497710 60497715 +
tactttttttggaaggccttca

SEQ ID NO: 200907 - DNA, 22 bp, Artificial Sequence
  Synthetic oligonucleotide; TTT chr2 60497694 60497715 60497711 60497716 +
actttttttggaaggccttcag

SEQ ID NO: 200908 - DNA, 22 bp, Artificial Sequence
  Synthetic oligonucleotide; TTA chr2 60497695 60497716 60497712 60497717 +
ctttttttggaaggccttcagg

SEQ ID NO: 200909 - DNA, 22 bp, Artificial Sequence
  Synthetic oligonucleotide; CTT chr2 60497698 60497719 60497715 60497720 +
tttttggaaggccttcaggtcc

SEQ ID NO: 200910 - DNA, 22 bp, Artificial Sequence
  Synthetic oligonucleotide; TTT chr2 60497699 60497720 60497716 60497721 +
ttttggaaggccttcaggtcca

SEQ ID NO: 200911 - DNA, 22 bp, Artificial Sequence
  Synthetic oligonucleotide; TTT chr2 60497700 60497721 60497717 60497722 +
tttggaaggccttcaggtccag

SEQ ID NO: 200912 - DNA, 22 bp, Artificial Sequence
  Synthetic oligonucleotide; TTT chr2 60497701 60497722 60497718 60497723 +
ttggaaggccttcaggtccagc

SEQ ID NO: 200913 - DNA, 22 bp, Artificial Sequence
  Synthetic oligonucleotide; TTT chr2 60497702 60497723 60497719 60497724 +
tggaaggccttcaggtccagcc

SEQ ID NO: 200914 - DNA, 22 bp, Artificial Sequence
  Synthetic oligonucleotide; TTT chr2 60497703 60497724 60497720 60497725 +
ggaaggccttcaggtccagcct

SEQ ID NO: 200915 - DNA, 22 bp, Artificial Sequence
  Synthetic oligonucleotide; TTG chr2 60497704 60497725 60497721 60497726 +
gaaggccttcaggtccagcctc

SEQ ID NO: 200916 - DNA, 22 bp, Artificial Sequence
  Synthetic oligonucleotide; CTT chr2 60497713 60497734 60497730 60497735 +
caggtccagcctcctactcttc

SEQ ID NO: 200917 - DNA, 22 bp, Artificial Sequence
  Synthetic oligonucleotide; TTC chr2 60497714 60497735 60497731 60497736 +
aggtccagcctcctactcttct

SEQ ID NO: 200918 - DNA, 22 bp, Artificial Sequence
  Synthetic oligonucleotide; CTC chr2 60497726 60497747 60497743 60497748 +
ctactcttctctttctctgaac

SEQ ID NO: 200919 - DNA, 22 bp, Artificial Sequence
  Synthetic oligonucleotide; CTA chr2 60497729 60497750 60497746 60497751 +
ctcttctctttctctgaactat

SEQ ID NO: 200920 - DNA, 22 bp, Artificial Sequence
  Synthetic oligonucleotide; CTC chr2 60497732 60497753 60497749 60497754 +
ttctctttctctgaactatcac

SEQ ID NO: 200921 - DNA, 22 bp, Artificial Sequence
  Synthetic oligonucleotide; CTT chr2 60497734 60497755 60497751 60497756 +
ctctttctctgaactatcacct

SEQ ID NO: 200922 - DNA, 22 bp, Artificial Sequence
  Synthetic oligonucleotide; TTC chr2 60497735 60497756 60497752 60497757 +
tctttctctgaactatcacctt

SEQ ID NO: 200923 - DNA, 22 bp, Artificial Sequence
  Synthetic oligonucleotide; CTC chr2 60497737 60497758 60497754 60497759 +
tttctctgaactatcaccttac

SEQ ID NO: 200924 - DNA, 22 bp, Artificial Sequence
  Synthetic oligonucleotide; CTT chr2 60497739 60497760 60497756 60497761 +
tctctgaactatcaccttacta

SEQ ID NO: 200925 - DNA, 22 bp, Artificial Sequence
  Synthetic oligonucleotide; TTT chr2 60497740 60497761 60497757 60497762 +
ctctgaactatcaccttactat

SEQ ID NO: 200926 - DNA, 22 bp, Artificial Sequence
  Synthetic oligonucleotide; TTC chr2 60497741 60497762 60497758 60497763 +
tctgaactatcaccttactata

SEQ ID NO: 200927 - DNA, 22 bp, Artificial Sequence
  Synthetic oligonucleotide; CTC chr2 60497743 60497764 60497760 60497765 +
tgaactatcaccttactatagg

SEQ ID NO: 200928 - DNA, 22 bp, Artificial Sequence
  Synthetic oligonucleotide; CTG chr2 60497745 60497766 60497762 60497767 +
aactatcaccttactataggca

SEQ ID NO: 200929 - DNA, 22 bp, Artificial Sequence
  Synthetic oligonucleotide; CTA chr2 60497750 60497771 60497767 60497772 +
tcaccttactataggcacatat

SEQ ID NO: 200930 - DNA, 22 bp, Artificial Sequence
  Synthetic oligonucleotide; CTT chr2 60497757 60497778 60497774 60497779 +
actataggcacatatttccccc

SEQ ID NO: 200931 - DNA, 22 bp, Artificial Sequence
  Synthetic oligonucleotide; TTA chr2 60497758 60497779 60497775 60497780 +
ctataggcacatatttccccca

SEQ ID NO: 200932 - DNA, 22 bp, Artificial Sequence
  Synthetic oligonucleotide; CTA chr2 60497761 60497782 60497778 60497783 +
taggcacatatttcccccaaag

SEQ ID NO: 200933 - DNA, 22 bp, Artificial Sequence
  Synthetic oligonucleotide; TTT chr2 60497774 60497795 60497791 60497796 +
cccccaaaggactcagtggcct

SEQ ID NO: 200934 - DNA, 22 bp, Artificial Sequence
  Synthetic oligonucleotide; TTC chr2 60497775 60497796 60497792 60497797 +
ccccaaaggactcagtggcctc

SEQ ID NO: 200935 - DNA, 22 bp, Artificial Sequence
  Synthetic oligonucleotide; CTC chr2 60497788 60497809 60497805 60497810 +
agtggcctcttttgtctcattt

SEQ ID NO: 200936 - DNA, 22 bp, Artificial Sequence
  Synthetic oligonucleotide; CTC chr2 60497797 60497818 60497814 60497819 +
ttttgtctcatttctccctttg

SEQ ID NO: 200937 - DNA, 22 bp, Artificial Sequence
  Synthetic oligonucleotide; CTT chr2 60497799 60497820 60497816 60497821 +
ttgtctcatttctccctttgct

SEQ ID NO: 200938 - DNA, 22 bp, Artificial Sequence
  Synthetic oligonucleotide; TTT chr2 60497800 60497821 60497817 60497822 +
tgtctcatttctccctttgctg

SEQ ID NO: 200939 - DNA, 22 bp, Artificial Sequence
  Synthetic oligonucleotide; TTT chr2 60497801 60497822 60497818 60497823 +
gtctcatttctccctttgctga

SEQ ID NO: 200940 - DNA, 22 bp, Artificial Sequence
  Synthetic oligonucleotide; TTG chr2 60497802 60497823 60497819 60497824 +
tctcatttctccctttgctgat

SEQ ID NO: 200941 - DNA, 22 bp, Artificial Sequence
  Synthetic oligonucleotide; CTC chr2 60497806 60497827 60497823 60497828 +
atttctccctttgctgatgatc

SEQ ID NO: 200942 - DNA, 22 bp, Artificial Sequence
  Synthetic oligonucleotide; TTT chr2 60497810 60497831 60497827 60497832 +
ctccctttgctgatgatccagt

SEQ ID NO: 200943 - DNA, 22 bp, Artificial Sequence
  Synthetic oligonucleotide; TTC chr2 60497811 60497832 60497828 60497833 +
tccctttgctgatgatccagta

SEQ ID NO: 200944 - DNA, 22 bp, Artificial Sequence
  Synthetic oligonucleotide; CTC chr2 60497813 60497834 60497830 60497835 +
cctttgctgatgatccagtaga

SEQ ID NO: 200945 - DNA, 22 bp, Artificial Sequence
  Synthetic oligonucleotide; CTT chr2 60497817 60497838 60497834 60497839 +
tgctgatgatccagtagagaaa

SEQ ID NO: 200946 - DNA, 22 bp, Artificial Sequence
  Synthetic oligonucleotide; TTT chr2 60497818 60497839 60497835 60497840 +
gctgatgatccagtagagaaat

SEQ ID NO: 200947 - DNA, 22 bp, Artificial Sequence
  Synthetic oligonucleotide; TTG chr2 60497819 60497840 60497836 60497841 +
ctgatgatccagtagagaaatg

SEQ ID NO: 200948 - DNA, 22 bp, Artificial Sequence
  Synthetic oligonucleotide; CTG chr2 60497822 60497843 60497839 60497844 +
atgatccagtagagaaatgatc

SEQ ID NO: 200949 - DNA, 22 bp, Artificial Sequence
  Synthetic oligonucleotide; CTG chr2 60497856 60497877 60497873 60497878 +
cacattgtcctaaatgaaacca

SEQ ID NO: 200950 - DNA, 22 bp, Artificial Sequence
  Synthetic oligonucleotide; TTG chr2 60497863 60497884 60497880 60497885 +
tcctaaatgaaaccaagcttcc

SEQ ID NO: 200951 - DNA, 22 bp, Artificial Sequence
  Synthetic oligonucleotide; CTA chr2 60497868 60497889 60497885 60497890 +
aatgaaaccaagcttcctctgc

SEQ ID NO: 200952 - DNA, 22 bp, Artificial Sequence
  Synthetic oligonucleotide; CTT chr2 60497883 60497904 60497900 60497905 +
cctctgcaggatggaagtgagc

SEQ ID NO: 200953 - DNA, 22 bp, Artificial Sequence
  Synthetic oligonucleotide; TTC chr2 60497884 60497905 60497901 60497906 +
ctctgcaggatggaagtgagcc

SEQ ID NO: 200954 - DNA, 22 bp, Artificial Sequence
  Synthetic oligonucleotide; CTC chr2 60497887 60497908 60497904 60497909 +
tgcaggatggaagtgagccagg

SEQ ID NO: 200955 - DNA, 22 bp, Artificial Sequence
  Synthetic oligonucleotide; CTG chr2 60497889 60497910 60497906 60497911 +
caggatggaagtgagccaggtg

SEQ ID NO: 200956 - DNA, 22 bp, Artificial Sequence
  Synthetic oligonucleotide; CTG chr2 60497928 60497949 60497945 60497950 +
gacccaccgcttcattggccga

SEQ ID NO: 200957 - DNA, 22 bp, Artificial Sequence
  Synthetic oligonucleotide; CTT chr2 60497940 60497961 60497957 60497962 +
cattggccgaggatgaccccat

SEQ ID NO: 200958 - DNA, 22 bp, Artificial Sequence
  Synthetic oligonucleotide; TTC chr2 60497941 60497962 60497958 60497963 +
attggccgaggatgaccccata

SEQ ID NO: 200959 - DNA, 22 bp, Artificial Sequence
  Synthetic oligonucleotide; TTG chr2 60497945 60497966 60497962 60497967 +
gccgaggatgaccccataaagg

SEQ ID NO: 200960 - DNA, 22 bp, Artificial Sequence
  Synthetic oligonucleotide; TTG chr2 60497978 60497999 60497995 60498000 +
cagagattgctatgcacaaaat

SEQ ID NO: 200961 - DNA, 22 bp, Artificial Sequence
  Synthetic oligonucleotide; TTG chr2 60497987 60498008 60498004 60498009 +
ctatgcacaaaatccaagaggc

SEQ ID NO: 200962 - DNA, 22 bp, Artificial Sequence
  Synthetic oligonucleotide; CTA chr2 60497990 60498011 60498007 60498012 +
tgcacaaaatccaagaggccca

SEQ ID NO: 200963 - DNA, 22 bp, Artificial Sequence
  Synthetic oligonucleotide; CTG chr2 60498041 60498062 60498058 60498063 +
gcagaccctcaagagcaggggt

SEQ ID NO: 200964 - DNA, 22 bp, Artificial Sequence
  Synthetic oligonucleotide; CTC chr2 60498051 60498072 60498068 60498073 +
aagagcaggggtcttctctttg

SEQ ID NO: 200965 - DNA, 22 bp, Artificial Sequence
  Synthetic oligonucleotide; CTT chr2 60498066 60498087 60498083 60498088 +
ctctttgggggaggacatcact

SEQ ID NO: 200966 - DNA, 22 bp, Artificial Sequence
  Synthetic oligonucleotide; TTC chr2 60498067 60498088 60498084 60498089 +
tctttgggggaggacatcactc

SEQ ID NO: 200967 - DNA, 22 bp, Artificial Sequence
  Synthetic oligonucleotide; CTC chr2 60498069 60498090 60498086 60498091 +
tttgggggaggacatcactctt

SEQ ID NO: 200968 - DNA, 22 bp, Artificial Sequence
  Synthetic oligonucleotide; CTT chr2 60498071 60498092 60498088 60498093 +
tgggggaggacatcactcttag

SEQ ID NO: 200969 - DNA, 22 bp, Artificial Sequence
  Synthetic oligonucleotide; TTT chr2 60498072 60498093 60498089 60498094 +
gggggaggacatcactcttagc

SEQ ID NO: 200970 - DNA, 22 bp, Artificial Sequence
  Synthetic oligonucleotide; TTG chr2 60498073 60498094 60498090 60498095 +
ggggaggacatcactcttagca

SEQ ID NO: 200971 - DNA, 22 bp, Artificial Sequence
  Synthetic oligonucleotide; CTC chr2 60498089 60498110 60498106 60498111 +
ttagcagggctggggtgagtca

SEQ ID NO: 200972 - DNA, 22 bp, Artificial Sequence
  Synthetic oligonucleotide; CTT chr2 60498091 60498112 60498108 60498113 +
agcagggctggggtgagtcaaa

SEQ ID NO: 200973 - DNA, 22 bp, Artificial Sequence
  Synthetic oligonucleotide; TTA chr2 60498092 60498113 60498109 60498114 +
gcagggctggggtgagtcaaaa

SEQ ID NO: 200974 - DNA, 22 bp, Artificial Sequence
  Synthetic oligonucleotide; CTG chr2 60498101 60498122 60498118 60498123 +
gggtgagtcaaaagtctgggag

SEQ ID NO: 200975 - DNA, 22 bp, Artificial Sequence
  Synthetic oligonucleotide; CTG chr2 60498119 60498140 60498136 60498141 +
ggagaatggaggtgtggagggg

SEQ ID NO: 200976 - DNA, 22 bp, Artificial Sequence
  Synthetic oligonucleotide; CTG chr2 60498148 60498169 60498165 60498170 +
ggtcagaccccaagcaggaagg

SEQ ID NO: 200977 - DNA, 22 bp, Artificial Sequence
  Synthetic oligonucleotide; CTC chr2 60498175 60498196 60498192 60498197 +
tatgtagacgggtgtgtggctc

SEQ ID NO: 200978 - DNA, 22 bp, Artificial Sequence
  Synthetic oligonucleotide; CTA chr2 60498177 60498198 60498194 60498199 +
tgtagacgggtgtgtggctcct

SEQ ID NO: 200979 - DNA, 22 bp, Artificial Sequence
  Synthetic oligonucleotide; CTC chr2 60498197 60498218 60498214 60498219 +
cttaaggtgacccagcagccct

SEQ ID NO: 200980 - DNA, 22 bp, Artificial Sequence
  Synthetic oligonucleotide; CTT chr2 60498200 60498221 60498217 60498222 +
aaggtgacccagcagccctggg

SEQ ID NO: 200981 - DNA, 22 bp, Artificial Sequence
  Synthetic oligonucleotide; TTA chr2 60498201 60498222 60498218 60498223 +
aggtgacccagcagccctgggc

SEQ ID NO: 200982 - DNA, 22 bp, Artificial Sequence
  Synthetic oligonucleotide; CTG chr2 60498220 60498241 60498237 60498242 +
ggcacagaagtggtgcgtggag

SEQ ID NO: 200983 - DNA, 22 bp, Artificial Sequence
  Synthetic oligonucleotide; CTG chr2 60498274 60498295 60498291 60498296 +
tcagaagaggccctggacactg

SEQ ID NO: 200984 - DNA, 22 bp, Artificial Sequence
  Synthetic oligonucleotide; CTG chr2 60498289 60498310 60498306 60498311 +
gacactgaaggctgggcacagc

SEQ ID NO: 200985 - DNA, 22 bp, Artificial Sequence
  Synthetic oligonucleotide; CTG chr2 60498296 60498317 60498313 60498318 +
aaggctgggcacagccttgggg

SEQ ID NO: 200986 - DNA, 22 bp, Artificial Sequence
  Synthetic oligonucleotide; CTG chr2 60498303 60498324 60498320 60498325 +
ggcacagccttggggaccgctc

SEQ ID NO: 200987 - DNA, 22 bp, Artificial Sequence
  Synthetic oligonucleotide; CTT chr2 60498314 60498335 60498331 60498336 +
ggggaccgctcacaggacatgc

SEQ ID NO: 200988 - DNA, 22 bp, Artificial Sequence
  Synthetic oligonucleotide; TTG chr2 60498315 60498336 60498332 60498337 +
gggaccgctcacaggacatgca

SEQ ID NO: 200989 - DNA, 22 bp, Artificial Sequence
  Synthetic oligonucleotide; CTC chr2 60498325 60498346 60498342 60498347 +
acaggacatgcagcagtgtgtg

SEQ ID NO: 200990 - DNA, 22 bp, Artificial Sequence
  Synthetic oligonucleotide; CTC chr2 60498357 60498378 60498374 60498379 +
cctaccgcgacccctatcagtg

SEQ ID NO: 200991 - DNA, 22 bp, Artificial Sequence
  Synthetic oligonucleotide; CTA chr2 60498361 60498382 60498378 60498383 +
ccgcgacccctatcagtgccga

SEQ ID NO: 200992 - DNA, 22 bp, Artificial Sequence
  Synthetic oligonucleotide; CTA chr2 60498373 60498394 60498390 60498395 +
tcagtgccgaccaagcacacaa

SEQ ID NO: 200993 - DNA, 22 bp, Artificial Sequence
  Synthetic oligonucleotide; CTG chr2 60498412 60498433 60498429 60498434 +
ggctggacagaggggtcccaca

SEQ ID NO: 200994 - DNA, 22 bp, Artificial Sequence
  Synthetic oligonucleotide; CTG chr2 60498417 60498438 60498434 60498439 +
gacagaggggtcccacaagatc

SEQ ID NO: 200995 - DNA, 22 bp, Artificial Sequence
  Synthetic oligonucleotide; CTG chr2 60498454 60498475 60498471 60498476 +
agaaggtggggagctcacagcc

SEQ ID NO: 200996 - DNA, 22 bp, Artificial Sequence
  Synthetic oligonucleotide; CTC chr2 60498470 60498491 60498487 60498492 +
acagcctccaagcattgcatca

SEQ ID NO: 200997 - DNA, 22 bp, Artificial Sequence
  Synthetic oligonucleotide; CTC chr2 60498478 60498499 60498495 60498500 +
caagcattgcatcatcctggta

SEQ ID NO: 200998 - DNA, 22 bp, Artificial Sequence
  Synthetic oligonucleotide; TTG chr2 60498487 60498508 60498504 60498509 +
catcatcctggtaccaggaagg

SEQ ID NO: 200999 - DNA, 22 bp, Artificial Sequence
  Synthetic oligonucleotide; CTG chr2 60498497 60498518 60498514 60498519 +
gtaccaggaaggcaatgggctg

SEQ ID NO: 201000 - DNA, 22 bp, Artificial Sequence
  Synthetic oligonucleotide; CTG chr2 60498519 60498540 60498536 60498541 +
ccccatacccacttcccttcct

SEQ ID NO: 201001 - DNA, 22 bp, Artificial Sequence
  Synthetic oligonucleotide; CTT chr2 60498533 60498554 60498550 60498555 +
cccttcctagaattggcctggg

SEQ ID NO: 201002 - DNA, 22 bp, Artificial Sequence
  Synthetic oligonucleotide; TTC chr2 60498534 60498555 60498551 60498556 +
ccttcctagaattggcctggga

SEQ ID NO: 201003 - DNA, 22 bp, Artificial Sequence
  Synthetic oligonucleotide; CTT chr2 60498538 60498559 60498555 60498560 +
cctagaattggcctgggacatt

SEQ ID NO: 201004 - DNA, 22 bp, Artificial Sequence
  Synthetic oligonucleotide; TTC chr2 60498539 60498560 60498556 60498561 +
ctagaattggcctgggacattc

SEQ ID NO: 201005 - DNA, 22 bp, Artificial Sequence
  Synthetic oligonucleotide; CTA chr2 60498542 60498563 60498559 60498564 +
gaattggcctgggacattcatt

SEQ ID NO: 201006 - DNA, 22 bp, Artificial Sequence
  Synthetic oligonucleotide; TTG chr2 60498548 60498569 60498565 60498570 +
gcctgggacattcattatttag

SEQ ID NO: 201007 - DNA, 22 bp, Artificial Sequence
  Synthetic oligonucleotide; CTG chr2 60498553 60498574 60498570 60498575 +
ggacattcattatttagccacc

SEQ ID NO: 201008 - DNA, 22 bp, Artificial Sequence
  Synthetic oligonucleotide; TTC chr2 60498561 60498582 60498578 60498583 +
attatttagccacctctggcac

SEQ ID NO: 201009 - DNA, 22 bp, Artificial Sequence
  Synthetic oligonucleotide; TTA chr2 60498565 60498586 60498582 60498587 +
tttagccacctctggcacctgc

SEQ ID NO: 201010 - DNA, 22 bp, Artificial Sequence
  Synthetic oligonucleotide; TTT chr2 60498568 60498589 60498585 60498590 +
agccacctctggcacctgcatt

SEQ ID NO: 201011 - DNA, 22 bp, Artificial Sequence
  Synthetic oligonucleotide; TTA chr2 60498569 60498590 60498586 60498591 +
gccacctctggcacctgcattt

SEQ ID NO: 201012 - DNA, 22 bp, Artificial Sequence
  Synthetic oligonucleotide; CTC chr2 60498577 60498598 60498594 60498599 +
tggcacctgcatttgtttttca

SEQ ID NO: 201013 - DNA, 22 bp, Artificial Sequence
  Synthetic oligonucleotide; CTG chr2 60498579 60498600 60498596 60498601 +
gcacctgcatttgtttttcaaa

SEQ ID NO: 201014 - DNA, 22 bp, Artificial Sequence
  Synthetic oligonucleotide; CTG chr2 60498586 60498607 60498603 60498608 +
catttgtttttcaaattttaat

SEQ ID NO: 201015 - DNA, 22 bp, Artificial Sequence
  Synthetic oligonucleotide; TTT chr2 60498591 60498612 60498608 60498613 +
gtttttcaaattttaatagcaa

SEQ ID NO: 201016 - DNA, 22 bp, Artificial Sequence
  Synthetic oligonucleotide; TTG chr2 60498592 60498613 60498609 60498614 +
tttttcaaattttaatagcaaa

SEQ ID NO: 201017 - DNA, 22 bp, Artificial Sequence
  Synthetic oligonucleotide; TTT chr2 60498595 60498616 60498612 60498617 +
ttcaaattttaatagcaaatag

SEQ ID NO: 201018 - DNA, 22 bp, Artificial Sequence
  Synthetic oligonucleotide; TTT chr2 60498596 60498617 60498613 60498618 +
tcaaattttaatagcaaatagg

SEQ ID NO: 201019 - DNA, 22 bp, Artificial Sequence
  Synthetic oligonucleotide; TTT chr2 60498597 60498618 60498614 60498619 +
caaattttaatagcaaataggc

SEQ ID NO: 201020 - DNA, 22 bp, Artificial Sequence
  Synthetic oligonucleotide; TTC chr2 60498598 60498619 60498615 60498620 +
aaattttaatagcaaataggct

SEQ ID NO: 201021 - DNA, 22 bp, Artificial Sequence
  Synthetic oligonucleotide; TTT chr2 60498604 60498625 60498621 60498626 +
taatagcaaataggcttagtgt

SEQ ID NO: 201022 - DNA, 22 bp, Artificial Sequence
  Synthetic oligonucleotide; TTT chr2 60498605 60498626 60498622 60498627 +
aatagcaaataggcttagtgtg

SEQ ID NO: 201023 - DNA, 22 bp, Artificial Sequence
  Synthetic oligonucleotide; TTA chr2 60498606 60498627 60498623 60498628 +
atagcaaataggcttagtgtgc

SEQ ID NO: 201024 - DNA, 22 bp, Artificial Sequence
  Synthetic oligonucleotide; CTT chr2 60498621 60498642 60498638 60498643 +
agtgtgctgggcagagctgagc

SEQ ID NO: 201025 - DNA, 22 bp, Artificial Sequence
  Synthetic oligonucleotide; TTA chr2 60498622 60498643 60498639 60498644 +
gtgtgctgggcagagctgagca

SEQ ID NO: 201026 - DNA, 22 bp, Artificial Sequence
  Synthetic oligonucleotide; CTG chr2 60498630 60498651 60498647 60498652 +
ggcagagctgagcagaggtgat

SEQ ID NO: 201027 - DNA, 22 bp, Artificial Sequence
  Synthetic oligonucleotide; CTG chr2 60498640 60498661 60498657 60498662 +
agcagaggtgatctgacccctc

SEQ ID NO: 201028 - DNA, 22 bp, Artificial Sequence
  Synthetic oligonucleotide; CTG chr2 60498655 60498676 60498672 60498677 +
acccctctacctactcacataa

SEQ ID NO: 201029 - DNA, 22 bp, Artificial Sequence
  Synthetic oligonucleotide; CTC chr2 60498662 60498683 60498679 60498684 +
tacctactcacataagatcagt

SEQ ID NO: 201030 - DNA, 22 bp, Artificial Sequence
  Synthetic oligonucleotide; CTA chr2 60498664 60498685 60498681 60498686 +
cctactcacataagatcagtaa

SEQ ID NO: 201031 - DNA, 22 bp, Artificial Sequence
  Synthetic oligonucleotide; CTA chr2 60498668 60498689 60498685 60498690 +
ctcacataagatcagtaaagag

SEQ ID NO: 201032 - DNA, 22 bp, Artificial Sequence
  Synthetic oligonucleotide; CTC chr2 60498671 60498692 60498688 60498693 +
acataagatcagtaaagagaag

SEQ ID NO: 201033 - DNA, 22 bp, Artificial Sequence
  Synthetic oligonucleotide; CTA chr2 60498741 60498762 60498758 60498763 +
taggtccaagttcgtacagacc

SEQ ID NO: 201034 - DNA, 22 bp, Artificial Sequence
  Synthetic oligonucleotide; TTC chr2 60498754 60498775 60498771 60498776 +
gtacagacccagccagactgcc

SEQ ID NO: 201035 - DNA, 22 bp, Artificial Sequence
  Synthetic oligonucleotide; CTG chr2 60498774 60498795 60498791 60498796 +
ccagttctctgaggagctagag

SEQ ID NO: 201036 - DNA, 22 bp, Artificial Sequence
  Synthetic oligonucleotide; TTC chr2 60498781 60498802 60498798 60498803 +
tctgaggagctagagacttgtg

SEQ ID NO: 201037 - DNA, 22 bp, Artificial Sequence
  Synthetic oligonucleotide; CTC chr2 60498783 60498804 60498800 60498805 +
tgaggagctagagacttgtggc

SEQ ID NO: 201038 - DNA, 22 bp, Artificial Sequence
  Synthetic oligonucleotide; CTG chr2 60498785 60498806 60498802 60498807 +
aggagctagagacttgtggctt

SEQ ID NO: 201039 - DNA, 22 bp, Artificial Sequence
  Synthetic oligonucleotide; CTA chr2 60498793 60498814 60498810 60498815 +
gagacttgtggcttaaggaagc

SEQ ID NO: 201040 - DNA, 22 bp, Artificial Sequence
  Synthetic oligonucleotide; CTT chr2 60498800 60498821 60498817 60498822 +
gtggcttaaggaagcctctctg

SEQ ID NO: 201041 - DNA, 22 bp, Artificial Sequence
  Synthetic oligonucleotide; TTG chr2 60498801 60498822 60498818 60498823 +
tggcttaaggaagcctctctga

SEQ ID NO: 201042 - DNA, 22 bp, Artificial Sequence
  Synthetic oligonucleotide; CTT chr2 60498807 60498828 60498824 60498829 +
aaggaagcctctctgatggatg

SEQ ID NO: 201043 - DNA, 22 bp, Artificial Sequence
  Synthetic oligonucleotide; TTA chr2 60498808 60498829 60498825 60498830 +
aggaagcctctctgatggatgt

SEQ ID NO: 201044 - DNA, 22 bp, Artificial Sequence
  Synthetic oligonucleotide; CTC chr2 60498818 60498839 60498835 60498840 +
tctgatggatgtactaatatgt

SEQ ID NO: 201045 - DNA, 22 bp, Artificial Sequence
  Synthetic oligonucleotide; CTC chr2 60498820 60498841 60498837 60498842 +
tgatggatgtactaatatgtat

SEQ ID NO: 201046 - DNA, 22 bp, Artificial Sequence
  Synthetic oligonucleotide; CTG chr2 60498822 60498843 60498839 60498844 +
atggatgtactaatatgtatgt

SEQ ID NO: 201047 - DNA, 22 bp, Artificial Sequence
  Synthetic oligonucleotide; CTA chr2 60498834 60498855 60498851 60498856 +
atatgtatgtaccttatacata

SEQ ID NO: 201048 - DNA, 22 bp, Artificial Sequence
  Synthetic oligonucleotide; CTT chr2 60498849 60498870 60498866 60498871 +
atacatacatttgaattacctg

SEQ ID NO: 201049 - DNA, 22 bp, Artificial Sequence
  Synthetic oligonucleotide; TTA chr2 60498850 60498871 60498867 60498872 +
tacatacatttgaattacctgt

SEQ ID NO: 201050 - DNA, 22 bp, Artificial Sequence
  Synthetic oligonucleotide; TTT chr2 60498861 60498882 60498878 60498883 +
gaattacctgtaaatcttgatc

SEQ ID NO: 201051 - DNA, 22 bp, Artificial Sequence
  Synthetic oligonucleotide; TTG chr2 60498862 60498883 60498879 60498884 +
aattacctgtaaatcttgatca

SEQ ID NO: 201052 - DNA, 22 bp, Artificial Sequence
  Synthetic oligonucleotide; TTA chr2 60498867 60498888 60498884 60498889 +
cctgtaaatcttgatcaaactc

SEQ ID NO: 201053 - DNA, 22 bp, Artificial Sequence
  Synthetic oligonucleotide; CTG chr2 60498871 60498892 60498888 60498893 +
taaatcttgatcaaactcagat

SEQ ID NO: 201054 - DNA, 22 bp, Artificial Sequence
  Synthetic oligonucleotide; CTT chr2 60498879 60498900 60498896 60498901 +
gatcaaactcagatgactgtcc

SEQ ID NO: 201055 - DNA, 22 bp, Artificial Sequence
  Synthetic oligonucleotide; TTG chr2 60498880 60498901 60498897 60498902 +
atcaaactcagatgactgtcca

SEQ ID NO: 201056 - DNA, 22 bp, Artificial Sequence
  Synthetic oligonucleotide; CTC chr2 60498889 60498910 60498906 60498911 +
agatgactgtccaactcatcca

SEQ ID NO: 201057 - DNA, 22 bp, Artificial Sequence
  Synthetic oligonucleotide; CTG chr2 60498898 60498919 60498915 60498920 +
tccaactcatccagaaactacg

SEQ ID NO: 201058 - DNA, 22 bp, Artificial Sequence
  Synthetic oligonucleotide; CTC chr2 60498906 60498927 60498923 60498928 +
atccagaaactacgtttgtcta

SEQ ID NO: 201059 - DNA, 22 bp, Artificial Sequence
  Synthetic oligonucleotide; CTA chr2 60498918 60498939 60498935 60498940 +
cgtttgtctaatagaacaggaa

SEQ ID NO: 201060 - DNA, 22 bp, Artificial Sequence
  Synthetic oligonucleotide; TTT chr2 60498923 60498944 60498940 60498945 +
gtctaatagaacaggaagcagg

SEQ ID NO: 201061 - DNA, 22 bp, Artificial Sequence
  Synthetic oligonucleotide; TTG chr2 60498924 60498945 60498941 60498946 +
tctaatagaacaggaagcaggt

SEQ ID NO: 201062 - DNA, 22 bp, Artificial Sequence
  Synthetic oligonucleotide; CTA chr2 60498928 60498949 60498945 60498950 +
atagaacaggaagcaggtggtg

SEQ ID NO: 201063 - DNA, 22 bp, Artificial Sequence
  Synthetic oligonucleotide; TTG chr2 60498974 60498995 60498991 60498996 +
atgagaggcagggccagtgttt

SEQ ID NO: 201064 - DNA, 22 bp, Artificial Sequence
  Synthetic oligonucleotide; TTT chr2 60498996 60499017 60499013 60499018 +
cttcttcattttccattccact

SEQ ID NO: 201065 - DNA, 22 bp, Artificial Sequence
  Synthetic oligonucleotide; TTC chr2 60498997 60499018 60499014 60499019 +
ttcttcattttccattccactg

SEQ ID NO: 201066 - DNA, 22 bp, Artificial Sequence
  Synthetic oligonucleotide; CTT chr2 60498999 60499020 60499016 60499021 +
cttcattttccattccactgat

SEQ ID NO: 201067 - DNA, 22 bp, Artificial Sequence
  Synthetic oligonucleotide; TTC chr2 60499000 60499021 60499017 60499022 +
ttcattttccattccactgatt

SEQ ID NO: 201068 - DNA, 22 bp, Artificial Sequence
  Synthetic oligonucleotide; CTT chr2 60499002 60499023 60499019 60499024 +
cattttccattccactgattct

SEQ ID NO: 201069 - DNA, 22 bp, Artificial Sequence
  Synthetic oligonucleotide; TTC chr2 60499003 60499024 60499020 60499025 +
attttccattccactgattctg

SEQ ID NO: 201070 - DNA, 22 bp, Artificial Sequence
  Synthetic oligonucleotide; TTT chr2 60499007 60499028 60499024 60499029 +
tccattccactgattctgtccc

SEQ ID NO: 201071 - DNA, 22 bp, Artificial Sequence
  Synthetic oligonucleotide; TTT chr2 60499008 60499029 60499025 60499030 +
ccattccactgattctgtcccc

SEQ ID NO: 201072 - DNA, 22 bp, Artificial Sequence
  Synthetic oligonucleotide; TTC chr2 60499009 60499030 60499026 60499031 +
cattccactgattctgtcccca

SEQ ID NO: 201073 - DNA, 22 bp, Artificial Sequence
  Synthetic oligonucleotide; TTC chr2 60499014 60499035 60499031 60499036 +
cactgattctgtccccacacag

SEQ ID NO: 201074 - DNA, 22 bp, Artificial Sequence
  Synthetic oligonucleotide; CTG chr2 60499019 60499040 60499036 60499041 +
attctgtccccacacaggcatc

SEQ ID NO: 201075 - DNA, 22 bp, Artificial Sequence
  Synthetic oligonucleotide; TTC chr2 60499023 60499044 60499040 60499045 +
tgtccccacacaggcatccaaa

SEQ ID NO: 201076 - DNA, 22 bp, Artificial Sequence
  Synthetic oligonucleotide; CTG chr2 60499025 60499046 60499042 60499047 +
tccccacacaggcatccaaagg

SEQ ID NO: 201077 - DNA, 22 bp, Artificial Sequence
  Synthetic oligonucleotide; CTA chr2 60499058 60499079 60499075 60499080 +
cagctacagtccatttctcgct

SEQ ID NO: 201078 - DNA, 22 bp, Artificial Sequence
  Synthetic oligonucleotide; CTA chr2 60499064 60499085 60499081 60499086 +
cagtccatttctcgctggcttt

SEQ ID NO: 201079 - DNA, 22 bp, Artificial Sequence
  Synthetic oligonucleotide; TTT chr2 60499074 60499095 60499091 60499096 +
ctcgctggcttttctgggagat

SEQ ID NO: 201080 - DNA, 22 bp, Artificial Sequence
  Synthetic oligonucleotide; TTC chr2 60499075 60499096 60499092 60499097 +
tcgctggcttttctgggagatc

SEQ ID NO: 201081 - DNA, 22 bp, Artificial Sequence
  Synthetic oligonucleotide; CTC chr2 60499077 60499098 60499094 60499099 +
gctggcttttctgggagatcac

SEQ ID NO: 201082 - DNA, 22 bp, Artificial Sequence
  Synthetic oligonucleotide; CTG chr2 60499081 60499102 60499098 60499103 +
gcttttctgggagatcacccta

SEQ ID NO: 201083 - DNA, 22 bp, Artificial Sequence
  Synthetic oligonucleotide; CTT chr2 60499085 60499106 60499102 60499107 +
ttctgggagatcaccctacaat

SEQ ID NO: 201084 - DNA, 22 bp, Artificial Sequence
  Synthetic oligonucleotide; TTT chr2 60499086 60499107 60499103 60499108 +
tctgggagatcaccctacaatg

SEQ ID NO: 201085 - DNA, 22 bp, Artificial Sequence
  Synthetic oligonucleotide; TTT chr2 60499087 60499108 60499104 60499109 +
ctgggagatcaccctacaatgt

SEQ ID NO: 201086 - DNA, 22 bp, Artificial Sequence
  Synthetic oligonucleotide; TTC chr2 60499088 60499109 60499105 60499110 +
tgggagatcaccctacaatgtg

SEQ ID NO: 201087 - DNA, 22 bp, Artificial Sequence
  Synthetic oligonucleotide; CTG chr2 60499090 60499111 60499107 60499112 +
ggagatcaccctacaatgtgtt

SEQ ID NO: 201088 - DNA, 22 bp, Artificial Sequence
  Synthetic oligonucleotide; CTA chr2 60499103 60499124 60499120 60499125 +
caatgtgttccccagtattcag

SEQ ID NO: 201089 - DNA, 22 bp, Artificial Sequence
  Synthetic oligonucleotide; TTC chr2 60499113 60499134 60499130 60499135 +
cccagtattcaggtttctgggc

SEQ ID NO: 201090 - DNA, 22 bp, Artificial Sequence
  Synthetic oligonucleotide; TTC chr2 60499123 60499144 60499140 60499145 +
aggtttctgggctgccattatc

SEQ ID NO: 201091 - DNA, 22 bp, Artificial Sequence
  Synthetic oligonucleotide; TTT chr2 60499129 60499150 60499146 60499151 +
ctgggctgccattatcttctct

SEQ ID NO: 201092 - DNA, 22 bp, Artificial Sequence
  Synthetic oligonucleotide; TTC chr2 60499130 60499151 60499147 60499152 +
tgggctgccattatcttctctg

SEQ ID NO: 201093 - DNA, 22 bp, Artificial Sequence
  Synthetic oligonucleotide; CTG chr2 60499132 60499153 60499149 60499154 +
ggctgccattatcttctctggt

SEQ ID NO: 201094 - DNA, 22 bp, Artificial Sequence
  Synthetic oligonucleotide; CTG chr2 60499137 60499158 60499154 60499159 +
ccattatcttctctggtctcgg

SEQ ID NO: 201095 - DNA, 22 bp, Artificial Sequence
  Synthetic oligonucleotide; TTA chr2 60499143 60499164 60499160 60499165 +
tcttctctggtctcggggccca

SEQ ID NO: 201096 - DNA, 22 bp, Artificial Sequence
  Synthetic oligonucleotide; CTT chr2 60499147 60499168 60499164 60499169 +
ctctggtctcggggcccaagcc

SEQ ID NO: 201097 - DNA, 22 bp, Artificial Sequence
  Synthetic oligonucleotide; TTC chr2 60499148 60499169 60499165 60499170 +
tctggtctcggggcccaagcca

SEQ ID NO: 201098 - DNA, 22 bp, Artificial Sequence
  Synthetic oligonucleotide; CTC chr2 60499150 60499171 60499167 60499172 +
tggtctcggggcccaagccaaa

SEQ ID NO: 201099 - DNA, 22 bp, Artificial Sequence
  Synthetic oligonucleotide; CTG chr2 60499152 60499173 60499169 60499174 +
gtctcggggcccaagccaaaga

SEQ ID NO: 201100 - DNA, 22 bp, Artificial Sequence
  Synthetic oligonucleotide; CTC chr2 60499157 60499178 60499174 60499179 +
ggggcccaagccaaagagctgg

SEQ ID NO: 201101 - DNA, 22 bp, Artificial Sequence
  Synthetic oligonucleotide; CTG chr2 60499178 60499199 60499195 60499200 +
gagaacagtatctggccacaga

SEQ ID NO: 201102 - DNA, 22 bp, Artificial Sequence
  Synthetic oligonucleotide; CTG chr2 60499192 60499213 60499209 60499214 +
gccacagaacctaaggcctggt

SEQ ID NO: 201103 - DNA, 22 bp, Artificial Sequence
  Synthetic oligonucleotide; CTA chr2 60499205 60499226 60499222 60499227 +
aggcctggtagagcaagacagc

SEQ ID NO: 201104 - DNA, 22 bp, Artificial Sequence
  Synthetic oligonucleotide; CTG chr2 60499212 60499233 60499229 60499234 +
gtagagcaagacagccatgtgc

SEQ ID NO: 201105 - DNA, 22 bp, Artificial Sequence
  Synthetic oligonucleotide; CTT chr2 60499256 60499277 60499273 60499278 +
ccgtcactcccacagagctgca

SEQ ID NO: 201106 - DNA, 22 bp, Artificial Sequence
  Synthetic oligonucleotide; TTC chr2 60499257 60499278 60499274 60499279 +
cgtcactcccacagagctgcag

SEQ ID NO: 201107 - DNA, 22 bp, Artificial Sequence
  Synthetic oligonucleotide; CTC chr2 60499265 60499286 60499282 60499287 +
ccacagagctgcaggggtgtga

SEQ ID NO: 201108 - DNA, 22 bp, Artificial Sequence
  Synthetic oligonucleotide; CTG chr2 60499276 60499297 60499293 60499298 +
caggggtgtgacgcccctgccc

SEQ ID NO: 201109 - DNA, 22 bp, Artificial Sequence
  Synthetic oligonucleotide; CTG chr2 60499295 60499316 60499312 60499317 +
cccagccatacccttctgggcc

SEQ ID NO: 201110 - DNA, 22 bp, Artificial Sequence
  Synthetic oligonucleotide; CTT chr2 60499310 60499331 60499327 60499332 +
ctgggccacagtgctggaggct

SEQ ID NO: 201111 - DNA, 22 bp, Artificial Sequence
  Synthetic oligonucleotide; TTC chr2 60499311 60499332 60499328 60499333 +
tgggccacagtgctggaggctg

SEQ ID NO: 201112 - DNA, 22 bp, Artificial Sequence
  Synthetic oligonucleotide; CTG chr2 60499313 60499334 60499330 60499335 +
ggccacagtgctggaggctgaa

SEQ ID NO: 201113 - DNA, 22 bp, Artificial Sequence
  Synthetic oligonucleotide; CTG chr2 60499326 60499347 60499343 60499348 +
gaggctgaagtcaaagcccatc

SEQ ID NO: 201114 - DNA, 22 bp, Artificial Sequence
  Synthetic oligonucleotide; CTG chr2 60499333 60499354 60499350 60499355 +
aagtcaaagcccatcgtgcctt

SEQ ID NO: 201115 - DNA, 22 bp, Artificial Sequence
  Synthetic oligonucleotide; CTT chr2 60499355 60499376 60499372 60499377 +
attccttcaggagcaatactcc

SEQ ID NO: 201116 - DNA, 22 bp, Artificial Sequence
  Synthetic oligonucleotide; TTA chr2 60499356 60499377 60499373 60499378 +
ttccttcaggagcaatactcct

SEQ ID NO: 201117 - DNA, 22 bp, Artificial Sequence
  Synthetic oligonucleotide; TTC chr2 60499359 60499380 60499376 60499381 +
cttcaggagcaatactcctggg

SEQ ID NO: 201118 - DNA, 22 bp, Artificial Sequence
  Synthetic oligonucleotide; CTT chr2 60499362 60499383 60499379 60499384 +
caggagcaatactcctgggaaa

SEQ ID NO: 201119 - DNA, 22 bp, Artificial Sequence
  Synthetic oligonucleotide; TTC chr2 60499363 60499384 60499380 60499385 +
aggagcaatactcctgggaaag

SEQ ID NO: 201120 - DNA, 22 bp, Artificial Sequence
  Synthetic oligonucleotide; CTC chr2 60499376 60499397 60499393 60499398 +
ctgggaaaggttgcacattctg

SEQ ID NO: 201121 - DNA, 22 bp, Artificial Sequence
  Synthetic oligonucleotide; CTG chr2 60499379 60499400 60499396 60499401 +
ggaaaggttgcacattctgtaa

SEQ ID NO: 201122 - DNA, 22 bp, Artificial Sequence
  Synthetic oligonucleotide; TTG chr2 60499389 60499410 60499406 60499411 +
cacattctgtaactcctctaag

SEQ ID NO: 201123 - DNA, 22 bp, Artificial Sequence
  Synthetic oligonucleotide; TTC chr2 60499396 60499417 60499413 60499418 +
tgtaactcctctaagtgatatt

SEQ ID NO: 201124 - DNA, 22 bp, Artificial Sequence
  Synthetic oligonucleotide; CTG chr2 60499398 60499419 60499415 60499420 +
taactcctctaagtgatatttc

SEQ ID NO: 201125 - DNA, 22 bp, Artificial Sequence
  Synthetic oligonucleotide; CTC chr2 60499404 60499425 60499421 60499426 +
ctctaagtgatatttcttccca

SEQ ID NO: 201126 - DNA, 22 bp, Artificial Sequence
  Synthetic oligonucleotide; CTC chr2 60499407 60499428 60499424 60499429 +
taagtgatatttcttcccaggg

SEQ ID NO: 201127 - DNA, 22 bp, Artificial Sequence
  Synthetic oligonucleotide; CTA chr2 60499409 60499430 60499426 60499431 +
agtgatatttcttcccaggggc

SEQ ID NO: 201128 - DNA, 22 bp, Artificial Sequence
  Synthetic oligonucleotide; TTT chr2 60499419 60499440 60499436 60499441 +
cttcccaggggcaaaaaaggaa

SEQ ID NO: 201129 - DNA, 22 bp, Artificial Sequence
  Synthetic oligonucleotide; TTC chr2 60499420 60499441 60499437 60499442 +
ttcccaggggcaaaaaaggaaa

SEQ ID NO: 201130 - DNA, 22 bp, Artificial Sequence
  Synthetic oligonucleotide; CTT chr2 60499422 60499443 60499439 60499444 +
cccaggggcaaaaaaggaaatt

SEQ ID NO: 201131 - DNA, 22 bp, Artificial Sequence
  Synthetic oligonucleotide; TTC chr2 60499423 60499444 60499440 60499445 +
ccaggggcaaaaaaggaaatta

SEQ ID NO: 201132 - DNA, 22 bp, Artificial Sequence
  Synthetic oligonucleotide; TTA chr2 60499445 60499466 60499462 60499467 +
gccccattttatagataaagag

SEQ ID NO: 201133 - DNA, 22 bp, Artificial Sequence
  Synthetic oligonucleotide; TTT chr2 60499454 60499475 60499471 60499476 +
tatagataaagagcctgaggcc

SEQ ID NO: 201134 - DNA, 22 bp, Artificial Sequence
  Synthetic oligonucleotide; TTT chr2 60499455 60499476 60499472 60499477 +
atagataaagagcctgaggccc

SEQ ID NO: 201135 - DNA, 22 bp, Artificial Sequence
  Synthetic oligonucleotide; TTA chr2 60499456 60499477 60499473 60499478 +
tagataaagagcctgaggccca

SEQ ID NO: 201136 - DNA, 22 bp, Artificial Sequence
  Synthetic oligonucleotide; CTG chr2 60499471 60499492 60499488 60499493 +
aggcccaataggctgattgact

SEQ ID NO: 201137 - DNA, 22 bp, Artificial Sequence
  Synthetic oligonucleotide; CTG chr2 60499486 60499507 60499503 60499508 +
attgacttgtccggggccacct

SEQ ID NO: 201138 - DNA, 22 bp, Artificial Sequence
  Synthetic oligonucleotide; TTG chr2 60499490 60499511 60499507 60499512 +
acttgtccggggccacctagcc

SEQ ID NO: 201139 - DNA, 22 bp, Artificial Sequence
  Synthetic oligonucleotide; CTT chr2 60499494 60499515 60499511 60499516 +
gtccggggccacctagccagca

SEQ ID NO: 201140 - DNA, 22 bp, Artificial Sequence
  Synthetic oligonucleotide; TTG chr2 60499495 60499516 60499512 60499517 +
tccggggccacctagccagcag

SEQ ID NO: 201141 - DNA, 22 bp, Artificial Sequence
  Synthetic oligonucleotide; CTA chr2 60499509 60499530 60499526 60499531 +
gccagcaggtgaaaagactcat

SEQ ID NO: 201142 - DNA, 22 bp, Artificial Sequence
  Synthetic oligonucleotide; CTC chr2 60499529 60499550 60499546 60499551 +
atgtgtagctgactttagagtc

SEQ ID NO: 201143 - DNA, 22 bp, Artificial Sequence
  Synthetic oligonucleotide; CTG chr2 60499540 60499561 60499557 60499562 +
actttagagtccaagctccttc

SEQ ID NO: 201144 - DNA, 22 bp, Artificial Sequence
  Synthetic oligonucleotide; CTT chr2 60499544 60499565 60499561 60499566 +
tagagtccaagctccttcaacg

SEQ ID NO: 201145 - DNA, 22 bp, Artificial Sequence
  Synthetic oligonucleotide; TTT chr2 60499545 60499566 60499562 60499567 +
agagtccaagctccttcaacgt

SEQ ID NO: 201146 - DNA, 22 bp, Artificial Sequence
  Synthetic oligonucleotide; TTA chr2 60499546 60499567 60499563 60499568 +
gagtccaagctccttcaacgtc

SEQ ID NO: 201147 - DNA, 22 bp, Artificial Sequence
  Synthetic oligonucleotide; CTC chr2 60499558 60499579 60499575 60499580 +
cttcaacgtcccactttctcaa

SEQ ID NO: 201148 - DNA, 22 bp, Artificial Sequence
  Synthetic oligonucleotide; CTT chr2 60499561 60499582 60499578 60499583 +
caacgtcccactttctcaagac

SEQ ID NO: 201149 - DNA, 22 bp, Artificial Sequence
  Synthetic oligonucleotide; TTC chr2 60499562 60499583 60499579 60499584 +
aacgtcccactttctcaagaca

SEQ ID NO: 201150 - DNA, 22 bp, Artificial Sequence
  Synthetic oligonucleotide; CTT chr2 60499574 60499595 60499591 60499596 +
tctcaagacagtgtttgccacg

SEQ ID NO: 201151 - DNA, 22 bp, Artificial Sequence
  Synthetic oligonucleotide; TTT chr2 60499575 60499596 60499592 60499597 +
ctcaagacagtgtttgccacgg

SEQ ID NO: 201152 - DNA, 22 bp, Artificial Sequence
  Synthetic oligonucleotide; TTC chr2 60499576 60499597 60499593 60499598 +
tcaagacagtgtttgccacggg

SEQ ID NO: 201153 - DNA, 22 bp, Artificial Sequence
  Synthetic oligonucleotide; CTC chr2 60499578 60499599 60499595 60499600 +
aagacagtgtttgccacgggcc

SEQ ID NO: 201154 - DNA, 22 bp, Artificial Sequence
  Synthetic oligonucleotide; TTT chr2 60499590 60499611 60499607 60499612 +
gccacgggccagggctagcaaa

SEQ ID NO: 201155 - DNA, 22 bp, Artificial Sequence
  Synthetic oligonucleotide; TTG chr2 60499591 60499612 60499608 60499613 +
ccacgggccagggctagcaaaa

SEQ ID NO: 201156 - DNA, 22 bp, Artificial Sequence
  Synthetic oligonucleotide; CTA chr2 60499607 60499628 60499624 60499629 +
gcaaaaagacccctccaacccc

SEQ ID NO: 201157 - DNA, 22 bp, Artificial Sequence
  Synthetic oligonucleotide; CTC chr2 60499622 60499643 60499639 60499644 +
caacccctcatacctccccacc

SEQ ID NO: 201158 - DNA, 22 bp, Artificial Sequence
  Synthetic oligonucleotide; CTC chr2 60499631 60499652 60499648 60499653 +
atacctccccaccaaccccatg

SEQ ID NO: 201159 - DNA, 22 bp, Artificial Sequence
  Synthetic oligonucleotide; CTC chr2 60499638 60499659 60499655 60499660 +
cccaccaaccccatgcaggtgt

SEQ ID NO: 201160 - DNA, 22 bp, Artificial Sequence
  Synthetic oligonucleotide; CTC chr2 60499686 60499707 60499703 60499708 +
cccggaccaaaggggtggacag

SEQ ID NO: 201161 - DNA, 22 bp, Artificial Sequence
  Synthetic oligonucleotide; CTG chr2 60499713 60499734 60499730 60499735 +
aaggaaaccgctcaaccttgag

SEQ ID NO: 201162 - DNA, 22 bp, Artificial Sequence
  Synthetic oligonucleotide; CTC chr2 60499726 60499747 60499743 60499748 +
aaccttgagtggagaggctgct

SEQ ID NO: 201163 - DNA, 22 bp, Artificial Sequence
  Synthetic oligonucleotide; CTT chr2 60499732 60499753 60499749 60499754 +
gagtggagaggctgctgtgaaa

SEQ ID NO: 201164 - DNA, 22 bp, Artificial Sequence
  Synthetic oligonucleotide; TTG chr2 60499733 60499754 60499750 60499755 +
agtggagaggctgctgtgaaac

SEQ ID NO: 201165 - DNA, 22 bp, Artificial Sequence
  Synthetic oligonucleotide; CTG chr2 60499746 60499767 60499763 60499768 +
ctgtgaaacagctctgggcagc

SEQ ID NO: 201166 - DNA, 22 bp, Artificial Sequence
  Synthetic oligonucleotide; CTG chr2 60499749 60499770 60499766 60499771 +
tgaaacagctctgggcagcacc

SEQ ID NO: 201167 - DNA, 22 bp, Artificial Sequence
  Synthetic oligonucleotide; CTC chr2 60499760 60499781 60499777 60499782 +
tgggcagcacctgggccacagc

SEQ ID NO: 201168 - DNA, 22 bp, Artificial Sequence
  Synthetic oligonucleotide; CTG chr2 60499762 60499783 60499779 60499784 +
ggcagcacctgggccacagcat

SEQ ID NO: 201169 - DNA, 22 bp, Artificial Sequence
  Synthetic oligonucleotide; CTG chr2 60499773 60499794 60499790 60499795 +
ggccacagcatgtggaaggaga

SEQ ID NO: 201170 - DNA, 22 bp, Artificial Sequence
  Synthetic oligonucleotide; TTC chr2 60499802 60499823 60499819 60499824 +
ctaagctgcctggtactctgcc

SEQ ID NO: 201171 - DNA, 22 bp, Artificial Sequence
  Synthetic oligonucleotide; CTA chr2 60499805 60499826 60499822 60499827 +
agctgcctggtactctgccatc

SEQ ID NO: 201172 - DNA, 22 bp, Artificial Sequence
  Synthetic oligonucleotide; CTG chr2 60499810 60499831 60499827 60499832 +
cctggtactctgccatctgtct

SEQ ID NO: 201173 - DNA, 22 bp, Artificial Sequence
  Synthetic oligonucleotide; CTG chr2 60499814 60499835 60499831 60499836 +
gtactctgccatctgtcttctc

SEQ ID NO: 201174 - DNA, 22 bp, Artificial Sequence
  Synthetic oligonucleotide; CTC chr2 60499820 60499841 60499837 60499842 +
tgccatctgtcttctcttcctc

SEQ ID NO: 201175 - DNA, 22 bp, Artificial Sequence
  Synthetic oligonucleotide; CTG chr2 60499822 60499843 60499839 60499844 +
ccatctgtcttctcttcctcct

SEQ ID NO: 201176 - DNA, 22 bp, Artificial Sequence
  Synthetic oligonucleotide; CTG chr2 60499829 60499850 60499846 60499851 +
tcttctcttcctcctaatccat

SEQ ID NO: 201177 - DNA, 22 bp, Artificial Sequence
  Synthetic oligonucleotide; CTT chr2 60499833 60499854 60499850 60499855 +
ctcttcctcctaatccataagc

SEQ ID NO: 201178 - DNA, 22 bp, Artificial Sequence
  Synthetic oligonucleotide; TTC chr2 60499834 60499855 60499851 60499856 +
tcttcctcctaatccataagca

SEQ ID NO: 201179 - DNA, 22 bp, Artificial Sequence
  Synthetic oligonucleotide; CTC chr2 60499836 60499857 60499853 60499858 +
ttcctcctaatccataagcacc

SEQ ID NO: 201180 - DNA, 22 bp, Artificial Sequence
  Synthetic oligonucleotide; CTT chr2 60499838 60499859 60499855 60499860 +
cctcctaatccataagcaccag

SEQ ID NO: 201181 - DNA, 22 bp, Artificial Sequence
  Synthetic oligonucleotide; TTC chr2 60499839 60499860 60499856 60499861 +
ctcctaatccataagcaccaga

SEQ ID NO: 201182 - DNA, 22 bp, Artificial Sequence
  Synthetic oligonucleotide; CTC chr2 60499842 60499863 60499859 60499864 +
ctaatccataagcaccagacct

SEQ ID NO: 201183 - DNA, 22 bp, Artificial Sequence
  Synthetic oligonucleotide; CTA chr2 60499845 60499866 60499862 60499867 +
atccataagcaccagacctcaa

SEQ ID NO: 201184 - DNA, 22 bp, Artificial Sequence
  Synthetic oligonucleotide; CTC chr2 60499865 60499886 60499882 60499887 +
aagccccatgtgcagctccgga

SEQ ID NO: 201185 - DNA, 22 bp, Artificial Sequence
  Synthetic oligonucleotide; CTC chr2 60499883 60499904 60499900 60499905 +
cggaagctgctagacctcaagc

SEQ ID NO: 201186 - DNA, 22 bp, Artificial Sequence
  Synthetic oligonucleotide; CTG chr2 60499892 60499913 60499909 60499914 +
ctagacctcaagcaggactaag

SEQ ID NO: 201187 - DNA, 22 bp, Artificial Sequence
  Synthetic oligonucleotide; CTA chr2 60499895 60499916 60499912 60499917 +
gacctcaagcaggactaagatt

SEQ ID NO: 201188 - DNA, 22 bp, Artificial Sequence
  Synthetic oligonucleotide; CTC chr2 60499901 60499922 60499918 60499923 +
aagcaggactaagattcggaga

SEQ ID NO: 201189 - DNA, 22 bp, Artificial Sequence
  Synthetic oligonucleotide; CTA chr2 60499912 60499933 60499929 60499934 +
agattcggagagagcagccacc

SEQ ID NO: 201190 - DNA, 22 bp, Artificial Sequence
  Synthetic oligonucleotide; TTC chr2 60499918 60499939 60499935 60499940 +
ggagagagcagccaccgacctg

SEQ ID NO: 201191 - DNA, 22 bp, Artificial Sequence
  Synthetic oligonucleotide; CTG chr2 60499940 60499961 60499957 60499962 +
gctcctcccaggcaggccagcc

SEQ ID NO: 201192 - DNA, 22 bp, Artificial Sequence
  Synthetic oligonucleotide; CTC chr2 60499944 60499965 60499961 60499966 +
ctcccaggcaggccagcccagg

SEQ ID NO: 201193 - DNA, 22 bp, Artificial Sequence
  Synthetic oligonucleotide; CTC chr2 60499947 60499968 60499964 60499969 +
ccaggcaggccagcccaggtga

SEQ ID NO: 201194 - DNA, 22 bp, Artificial Sequence
  Synthetic oligonucleotide; CTC chr2 60499976 60499997 60499993 60499998 +
cagccaggcactcaccccactg

SEQ ID NO: 201195 - DNA, 22 bp, Artificial Sequence
  Synthetic oligonucleotide; CTC chr2 60499989 60500010 60500006 60500011 +
accccactgccaggctgtttac

SEQ ID NO: 201196 - DNA, 22 bp, Artificial Sequence
  Synthetic oligonucleotide; CTG chr2 60499998 60500019 60500015 60500020 +
ccaggctgtttactcttagctg

SEQ ID NO: 201197 - DNA, 22 bp, Artificial Sequence
  Synthetic oligonucleotide; CTG chr2 60500006 60500027 60500023 60500028 +
tttactcttagctggtgtttgt

SEQ ID NO: 201198 - DNA, 22 bp, Artificial Sequence
  Synthetic oligonucleotide; TTT chr2 60500009 60500030 60500026 60500031 +
actcttagctggtgtttgtctc

SEQ ID NO: 201199 - DNA, 22 bp, Artificial Sequence
  Synthetic oligonucleotide; TTA chr2 60500010 60500031 60500027 60500032 +
ctcttagctggtgtttgtctcc

SEQ ID NO: 201200 - DNA, 22 bp, Artificial Sequence
  Synthetic oligonucleotide; CTC chr2 60500013 60500034 60500030 60500035 +
ttagctggtgtttgtctcctgt

SEQ ID NO: 201201 - DNA, 22 bp, Artificial Sequence
  Synthetic oligonucleotide; CTT chr2 60500015 60500036 60500032 60500037 +
agctggtgtttgtctcctgtct

SEQ ID NO: 201202 - DNA, 22 bp, Artificial Sequence
  Synthetic oligonucleotide; TTA chr2 60500016 60500037 60500033 60500038 +
gctggtgtttgtctcctgtctg

SEQ ID NO: 201203 - DNA, 22 bp, Artificial Sequence
  Synthetic oligonucleotide; CTG chr2 60500020 60500041 60500037 60500042 +
gtgtttgtctcctgtctgctct

SEQ ID NO: 201204 - DNA, 22 bp, Artificial Sequence
  Synthetic oligonucleotide; TTT chr2 60500026 60500047 60500043 60500048 +
gtctcctgtctgctctactgta

SEQ ID NO: 201205 - DNA, 22 bp, Artificial Sequence
  Synthetic oligonucleotide; TTG chr2 60500027 60500048 60500044 60500049 +
tctcctgtctgctctactgtag

SEQ ID NO: 201206 - DNA, 22 bp, Artificial Sequence
  Synthetic oligonucleotide; CTC chr2 60500031 60500052 60500048 60500053 +
ctgtctgctctactgtagctcc

SEQ ID NO: 201207 - DNA, 22 bp, Artificial Sequence
  Synthetic oligonucleotide; CTG chr2 60500034 60500055 60500051 60500056 +
tctgctctactgtagctccctc

SEQ ID NO: 201208 - DNA, 22 bp, Artificial Sequence
  Synthetic oligonucleotide; CTG chr2 60500038 60500059 60500055 60500060 +
ctctactgtagctccctccctc

SEQ ID NO: 201209 - DNA, 22 bp, Artificial Sequence
  Synthetic oligonucleotide; CTC chr2 60500041 60500062 60500058 60500063 +
tactgtagctccctccctcctc

SEQ ID NO: 201210 - DNA, 22 bp, Artificial Sequence
  Synthetic oligonucleotide; CTA chr2 60500043 60500064 60500060 60500065 +
ctgtagctccctccctcctctc

SEQ ID NO: 201211 - DNA, 22 bp, Artificial Sequence
  Synthetic oligonucleotide; CTG chr2 60500046 60500067 60500063 60500068 +
tagctccctccctcctctcctc

SEQ ID NO: 201212 - DNA, 22 bp, Artificial Sequence
  Synthetic oligonucleotide; CTC chr2 60500052 60500073 60500069 60500074 +
cctccctcctctcctcctttcg

SEQ ID NO: 201213 - DNA, 22 bp, Artificial Sequence
  Synthetic oligonucleotide; CTC chr2 60500056 60500077 60500073 60500078 +
cctcctctcctcctttcggtcc

SEQ ID NO: 201214 - DNA, 22 bp, Artificial Sequence
  Synthetic oligonucleotide; CTC chr2 60500060 60500081 60500077 60500082 +
ctctcctcctttcggtcctctg

SEQ ID NO: 201215 - DNA, 22 bp, Artificial Sequence
  Synthetic oligonucleotide; CTC chr2 60500063 60500084 60500080 60500085 +
tcctcctttcggtcctctgccc

SEQ ID NO: 201216 - DNA, 22 bp, Artificial Sequence
  Synthetic oligonucleotide; CTC chr2 60500065 60500086 60500082 60500087 +
ctcctttcggtcctctgcccag

SEQ ID NO: 201217 - DNA, 22 bp, Artificial Sequence
  Synthetic oligonucleotide; CTC chr2 60500068 60500089 60500085 60500090 +
ctttcggtcctctgcccaggcc

SEQ ID NO: 201218 - DNA, 22 bp, Artificial Sequence
  Synthetic oligonucleotide; CTT chr2 60500071 60500092 60500088 60500093 +
tcggtcctctgcccaggcctgc

SEQ ID NO: 201219 - DNA, 22 bp, Artificial Sequence
  Synthetic oligonucleotide; TTT chr2 60500072 60500093 60500089 60500094 +
cggtcctctgcccaggcctgcc

SEQ ID NO: 201220 - DNA, 22 bp, Artificial Sequence
  Synthetic oligonucleotide; TTC chr2 60500073 60500094 60500090 60500095 +
ggtcctctgcccaggcctgcct

SEQ ID NO: 201221 - DNA, 22 bp, Artificial Sequence
  Synthetic oligonucleotide; CTC chr2 60500080 60500101 60500097 60500102 +
tgcccaggcctgcctgaggctg

SEQ ID NO: 201222 - DNA, 22 bp, Artificial Sequence
  Synthetic oligonucleotide; CTG chr2 60500082 60500103 60500099 60500104 +
cccaggcctgcctgaggctgcc

SEQ ID NO: 201223 - DNA, 22 bp, Artificial Sequence
  Synthetic oligonucleotide; CTG chr2 60500092 60500113 60500109 60500114 +
cctgaggctgcctgccagtgag

SEQ ID NO: 201224 - DNA, 22 bp, Artificial Sequence
  Synthetic oligonucleotide; CTG chr2 60500096 60500117 60500113 60500118 +
aggctgcctgccagtgagattg

SEQ ID NO: 201225 - DNA, 22 bp, Artificial Sequence
  Synthetic oligonucleotide; CTG chr2 60500102 60500123 60500119 60500124 +
cctgccagtgagattgcatgtc

SEQ ID NO: 201226 - DNA, 22 bp, Artificial Sequence
  Synthetic oligonucleotide; CTG chr2 60500106 60500127 60500123 60500128 +
ccagtgagattgcatgtcaggg

SEQ ID NO: 201227 - DNA, 22 bp, Artificial Sequence
  Synthetic oligonucleotide; TTG chr2 60500118 60500139 60500135 60500140 +
catgtcagggctttgccctggg

SEQ ID NO: 201228 - DNA, 22 bp, Artificial Sequence
  Synthetic oligonucleotide; CTT chr2 60500131 60500152 60500148 60500153 +
tgccctgggcactgagggctag

SEQ ID NO: 201229 - DNA, 22 bp, Artificial Sequence
  Synthetic oligonucleotide; TTT chr2 60500132 60500153 60500149 60500154 +
gccctgggcactgagggctagg

SEQ ID NO: 201230 - DNA, 22 bp, Artificial Sequence
  Synthetic oligonucleotide; TTG chr2 60500133 60500154 60500150 60500155 +
ccctgggcactgagggctaggg

SEQ ID NO: 201231 - DNA, 22 bp, Artificial Sequence
  Synthetic oligonucleotide; CTG chr2 60500138 60500159 60500155 60500160 +
ggcactgagggctagggtgccc

SEQ ID NO: 201232 - DNA, 22 bp, Artificial Sequence
  Synthetic oligonucleotide; CTG chr2 60500145 60500166 60500162 60500167 +
agggctagggtgcccagaggcc

SEQ ID NO: 201233 - DNA, 22 bp, Artificial Sequence
  Synthetic oligonucleotide; CTA chr2 60500152 60500173 60500169 60500174 +
gggtgcccagaggcctgcggct

SEQ ID NO: 201234 - DNA, 22 bp, Artificial Sequence
  Synthetic oligonucleotide; CTG chr2 60500169 60500190 60500186 60500191 +
cggctgtgccctggatggaaaa

SEQ ID NO: 201235 - DNA, 22 bp, Artificial Sequence
  Synthetic oligonucleotide; CTG chr2 60500175 60500196 60500192 60500197 +
tgccctggatggaaaaccagca

SEQ ID NO: 201236 - DNA, 22 bp, Artificial Sequence
  Synthetic oligonucleotide; CTG chr2 60500182 60500203 60500199 60500204 +
gatggaaaaccagcagcctgca

SEQ ID NO: 201237 - DNA, 22 bp, Artificial Sequence
  Synthetic oligonucleotide; CTG chr2 60500202 60500223 60500219 60500224 +
caaagctgtgggggcagcacag

SEQ ID NO: 201238 - DNA, 22 bp, Artificial Sequence
  Synthetic oligonucleotide; CTG chr2 60500210 60500231 60500227 60500232 +
tgggggcagcacaggacctgtg

SEQ ID NO: 201239 - DNA, 22 bp, Artificial Sequence
  Synthetic oligonucleotide; CTG chr2 60500230 60500251 60500247 60500252 +
tgtgtgagagcggtggtcttga

SEQ ID NO: 201240 - DNA, 22 bp, Artificial Sequence
  Synthetic oligonucleotide; CTT chr2 60500250 60500271 60500267 60500272 +
gagagtgaaagtggacaagtca

SEQ ID NO: 201241 - DNA, 22 bp, Artificial Sequence
  Synthetic oligonucleotide; TTG chr2 60500251 60500272 60500268 60500273 +
agagtgaaagtggacaagtcaa

SEQ ID NO: 201242 - DNA, 22 bp, Artificial Sequence
  Synthetic oligonucleotide; TTC chr2 60500325 60500346 60500342 60500347 +
ccggggccagttcccccattat

SEQ ID NO: 201243 - DNA, 22 bp, Artificial Sequence
  Synthetic oligonucleotide; TTC chr2 60500338 60500359 60500355 60500360 +
ccccattatgcactgcctctgc

SEQ ID NO: 201244 - DNA, 22 bp, Artificial Sequence
  Synthetic oligonucleotide; TTA chr2 60500346 60500367 60500363 60500368 +
tgcactgcctctgcttccccgc

SEQ ID NO: 201245 - DNA, 22 bp, Artificial Sequence
  Synthetic oligonucleotide; CTG chr2 60500353 60500374 60500370 60500375 +
cctctgcttccccgccaccatt

SEQ ID NO: 201246 - DNA, 22 bp, Artificial Sequence
  Synthetic oligonucleotide; CTC chr2 60500357 60500378 60500374 60500379 +
tgcttccccgccaccattaacc

SEQ ID NO: 201247 - DNA, 22 bp, Artificial Sequence
  Synthetic oligonucleotide; CTG chr2 60500359 60500380 60500376 60500381 +
cttccccgccaccattaaccgt

SEQ ID NO: 201248 - DNA, 22 bp, Artificial Sequence
  Synthetic oligonucleotide; CTT chr2 60500362 60500383 60500379 60500384 +
ccccgccaccattaaccgtgcc

SEQ ID NO: 201249 - DNA, 22 bp, Artificial Sequence
  Synthetic oligonucleotide; TTC chr2 60500363 60500384 60500380 60500385 +
cccgccaccattaaccgtgcct

SEQ ID NO: 201250 - DNA, 22 bp, Artificial Sequence
  Synthetic oligonucleotide; TTA chr2 60500376 60500397 60500393 60500398 +
accgtgcctctgtgggctgaca

SEQ ID NO: 201251 - DNA, 22 bp, Artificial Sequence
  Synthetic oligonucleotide; CTC chr2 60500386 60500407 60500403 60500408 +
tgtgggctgacagatgtgcctt

SEQ ID NO: 201252 - DNA, 22 bp, Artificial Sequence
  Synthetic oligonucleotide; CTG chr2 60500388 60500409 60500405 60500410 +
tgggctgacagatgtgccttca

SEQ ID NO: 201253 - DNA, 22 bp, Artificial Sequence
  Synthetic oligonucleotide; CTG chr2 60500395 60500416 60500412 60500417 +
acagatgtgccttcagagaagg

SEQ ID NO: 201254 - DNA, 22 bp, Artificial Sequence
  Synthetic oligonucleotide; CTT chr2 60500408 60500429 60500425 60500430 +
cagagaagggcagggagcagct

SEQ ID NO: 201255 - DNA, 22 bp, Artificial Sequence
  Synthetic oligonucleotide; TTC chr2 60500409 60500430 60500426 60500431 +
agagaagggcagggagcagctg

SEQ ID NO: 201256 - DNA, 22 bp, Artificial Sequence
  Synthetic oligonucleotide; CTG chr2 60500431 60500452 60500448 60500453 +
ggggcctggccagagcaatcat

SEQ ID NO: 201257 - DNA, 22 bp, Artificial Sequence
  Synthetic oligonucleotide; CTG chr2 60500439 60500460 60500456 60500461 +
gccagagcaatcatcccagcag

SEQ ID NO: 201258 - DNA, 22 bp, Artificial Sequence
  Synthetic oligonucleotide; CTT chr2 60500467 60500488 60500484 60500489 +
acatcagagcaggcagcctacc

SEQ ID NO: 201259 - DNA, 22 bp, Artificial Sequence
  Synthetic oligonucleotide; TTA chr2 60500468 60500489 60500485 60500490 +
catcagagcaggcagcctaccc

SEQ ID NO: 201260 - DNA, 22 bp, Artificial Sequence
  Synthetic oligonucleotide; CTA chr2 60500487 60500508 60500504 60500509 +
cccaagagccagggaaggaagg

SEQ ID NO: 201261 - DNA, 22 bp, Artificial Sequence
  Synthetic oligonucleotide; CTG chr2 60500519 60500540 60500536 60500541 +
agaaaaaatggcagaagaatgg

SEQ ID NO: 201262 - DNA, 22 bp, Artificial Sequence
  Synthetic oligonucleotide; CTA chr2 60500550 60500571 60500567 60500572 +
cgtgtattgatggaataaacca

SEQ ID NO: 201263 - DNA, 22 bp, Artificial Sequence
  Synthetic oligonucleotide; TTG chr2 60500559 60500580 60500576 60500581 +
atggaataaaccagacacccca

SEQ ID NO: 201264 - DNA, 22 bp, Artificial Sequence
  Synthetic oligonucleotide; CTT chr2 60500586 60500607 60500603 60500608 +
cccaactcctcaggacagggtt

SEQ ID NO: 201265 - DNA, 22 bp, Artificial Sequence
  Synthetic oligonucleotide; TTC chr2 60500587 60500608 60500604 60500609 +
ccaactcctcaggacagggttc

SEQ ID NO: 201266 - DNA, 22 bp, Artificial Sequence
  Synthetic oligonucleotide; CTC chr2 60500594 60500615 60500611 60500616 +
ctcaggacagggttcagagcta

SEQ ID NO: 201267 - DNA, 22 bp, Artificial Sequence
  Synthetic oligonucleotide; CTC chr2 60500597 60500618 60500614 60500619 +
aggacagggttcagagctaggc

SEQ ID NO: 201268 - DNA, 22 bp, Artificial Sequence
  Synthetic oligonucleotide; TTC chr2 60500609 60500630 60500626 60500631 +
agagctaggctggtggctgcta

SEQ ID NO: 201269 - DNA, 22 bp, Artificial Sequence
  Synthetic oligonucleotide; CTA chr2 60500616 60500637 60500633 60500638 +
ggctggtggctgctacacagag

SEQ ID NO: 201270 - DNA, 22 bp, Artificial Sequence
  Synthetic oligonucleotide; CTG chr2 60500621 60500642 60500638 60500643 +
gtggctgctacacagagacagc

SEQ ID NO: 201271 - DNA, 22 bp, Artificial Sequence
  Synthetic oligonucleotide; CTG chr2 60500628 60500649 60500645 60500650 +
ctacacagagacagcaccctcc

SEQ ID NO: 201272 - DNA, 22 bp, Artificial Sequence
  Synthetic oligonucleotide; CTA chr2 60500631 60500652 60500648 60500653 +
cacagagacagcaccctccacc

SEQ ID NO: 201273 - DNA, 22 bp, Artificial Sequence
  Synthetic oligonucleotide; CTC chr2 60500649 60500670 60500666 60500671 +
caccagttaaggtataagacaa

SEQ ID NO: 201274 - DNA, 22 bp, Artificial Sequence
  Synthetic oligonucleotide; TTA chr2 60500658 60500679 60500675 60500680 +
aggtataagacaaggtataagg

SEQ ID NO: 201275 - DNA, 22 bp, Artificial Sequence
  Synthetic oligonucleotide; CTG chr2 60500683 60500704 60500700 60500705 +
atgggctgtaggcatcaaacct

SEQ ID NO: 201276 - DNA, 22 bp, Artificial Sequence
  Synthetic oligonucleotide; CTG chr2 60500691 60500712 60500708 60500713 +
taggcatcaaacctggaactca

SEQ ID NO: 201277 - DNA, 22 bp, Artificial Sequence
  Synthetic oligonucleotide; CTG chr2 60500706 60500727 60500723 60500728 +
gaactcacagtcggggcacctc

SEQ ID NO: 201278 - DNA, 22 bp, Artificial Sequence
  Synthetic oligonucleotide; CTC chr2 60500712 60500733 60500729 60500734 +
acagtcggggcacctcacttca

SEQ ID NO: 201279 - DNA, 22 bp, Artificial Sequence
  Synthetic oligonucleotide; CTC chr2 60500728 60500749 60500745 60500750 +
acttcaagccttggtggatagg

SEQ ID NO: 201280 - DNA, 22 bp, Artificial Sequence
  Synthetic oligonucleotide; CTT chr2 60500732 60500753 60500749 60500754 +
caagccttggtggataggtaag

SEQ ID NO: 201281 - DNA, 22 bp, Artificial Sequence
  Synthetic oligonucleotide; TTC chr2 60500733 60500754 60500750 60500755 +
aagccttggtggataggtaaga

SEQ ID NO: 201282 - DNA, 22 bp, Artificial Sequence
  Synthetic oligonucleotide; CTT chr2 60500740 60500761 60500757 60500762 +
ggtggataggtaagatgaacac

SEQ ID NO: 201283 - DNA, 22 bp, Artificial Sequence
  Synthetic oligonucleotide; TTG chr2 60500741 60500762 60500758 60500763 +
gtggataggtaagatgaacact

SEQ ID NO: 201284 - DNA, 22 bp, Artificial Sequence
  Synthetic oligonucleotide; CTC chr2 60500764 60500785 60500781 60500786 +
aggctcccaagttagacagatg

SEQ ID NO: 201285 - DNA, 22 bp, Artificial Sequence
  Synthetic oligonucleotide; CTC chr2 60500770 60500791 60500787 60500792 +
ccaagttagacagatgagctgg

SEQ ID NO: 201286 - DNA, 22 bp, Artificial Sequence
  Synthetic oligonucleotide; TTA chr2 60500778 60500799 60500795 60500800 +
gacagatgagctggatccttca

SEQ ID NO: 201287 - DNA, 22 bp, Artificial Sequence
  Synthetic oligonucleotide; CTG chr2 60500791 60500812 60500808 60500813 +
gatccttcatctaccaccaatt

SEQ ID NO: 201288 - DNA, 22 bp, Artificial Sequence
  Synthetic oligonucleotide; CTT chr2 60500798 60500819 60500815 60500820 +
catctaccaccaatttcctggc

SEQ ID NO: 201289 - DNA, 22 bp, Artificial Sequence
  Synthetic oligonucleotide; TTC chr2 60500799 60500820 60500816 60500821 +
atctaccaccaatttcctggct

SEQ ID NO: 201290 - DNA, 22 bp, Artificial Sequence
  Synthetic oligonucleotide; CTA chr2 60500804 60500825 60500821 60500826 +
ccaccaatttcctggctgtgtg

SEQ ID NO: 201291 - DNA, 22 bp, Artificial Sequence
  Synthetic oligonucleotide; TTT chr2 60500814 60500835 60500831 60500836 +
cctggctgtgtgtctgggagca

SEQ ID NO: 201292 - DNA, 22 bp, Artificial Sequence
  Synthetic oligonucleotide; TTC chr2 60500815 60500836 60500832 60500837 +
ctggctgtgtgtctgggagcag

SEQ ID NO: 201293 - DNA, 22 bp, Artificial Sequence
  Synthetic oligonucleotide; CTG chr2 60500818 60500839 60500835 60500840 +
gctgtgtgtctgggagcagctc

SEQ ID NO: 201294 - DNA, 22 bp, Artificial Sequence
  Synthetic oligonucleotide; CTG chr2 60500822 60500843 60500839 60500844 +
tgtgtctgggagcagctcttta

SEQ ID NO: 201295 - DNA, 22 bp, Artificial Sequence
  Synthetic oligonucleotide; CTG chr2 60500830 60500851 60500847 60500852 +
ggagcagctctttaacctctcc

SEQ ID NO: 201296 - DNA, 22 bp, Artificial Sequence
  Synthetic oligonucleotide; CTC chr2 60500840 60500861 60500857 60500862 +
tttaacctctccaagcctcagt

SEQ ID NO: 201297 - DNA, 22 bp, Artificial Sequence
  Synthetic oligonucleotide; CTT chr2 60500842 60500863 60500859 60500864 +
taacctctccaagcctcagttt

SEQ ID NO: 201298 - DNA, 22 bp, Artificial Sequence
  Synthetic oligonucleotide; TTT chr2 60500843 60500864 60500860 60500865 +
aacctctccaagcctcagtttc

SEQ ID NO: 201299 - DNA, 22 bp, Artificial Sequence
  Synthetic oligonucleotide; TTA chr2 60500844 60500865 60500861 60500866 +
acctctccaagcctcagtttct

SEQ ID NO: 201300 - DNA, 22 bp, Artificial Sequence
  Synthetic oligonucleotide; CTC chr2 60500849 60500870 60500866 60500871 +
tccaagcctcagtttcttcact

SEQ ID NO: 201301 - DNA, 22 bp, Artificial Sequence
  Synthetic oligonucleotide; CTC chr2 60500851 60500872 60500868 60500873 +
caagcctcagtttcttcactgg

SEQ ID NO: 201302 - DNA, 22 bp, Artificial Sequence
  Synthetic oligonucleotide; CTC chr2 60500859 60500880 60500876 60500881 +
agtttcttcactggtaaaatgt

SEQ ID NO: 201303 - DNA, 22 bp, Artificial Sequence
  Synthetic oligonucleotide; TTT chr2 60500864 60500885 60500881 60500886 +
cttcactggtaaaatgtgtatg

SEQ ID NO: 201304 - DNA, 22 bp, Artificial Sequence
  Synthetic oligonucleotide; TTC chr2 60500865 60500886 60500882 60500887 +
ttcactggtaaaatgtgtatga

SEQ ID NO: 201305 - DNA, 22 bp, Artificial Sequence
  Synthetic oligonucleotide; CTT chr2 60500867 60500888 60500884 60500889 +
cactggtaaaatgtgtatgatg

SEQ ID NO: 201306 - DNA, 22 bp, Artificial Sequence
  Synthetic oligonucleotide; TTC chr2 60500868 60500889 60500885 60500890 +
actggtaaaatgtgtatgatga

SEQ ID NO: 201307 - DNA, 22 bp, Artificial Sequence
  Synthetic oligonucleotide; CTG chr2 60500872 60500893 60500889 60500894 +
gtaaaatgtgtatgatgacatt

SEQ ID NO: 201308 - DNA, 22 bp, Artificial Sequence
  Synthetic oligonucleotide; TTG chr2 60500895 60500916 60500912 60500917 +
tatggccaacctggggttgctg

SEQ ID NO: 201309 - DNA, 22 bp, Artificial Sequence
  Synthetic oligonucleotide; CTG chr2 60500908 60500929 60500925 60500930 +
gggttgctgatggaactagtta

SEQ ID NO: 201310 - DNA, 22 bp, Artificial Sequence
  Synthetic oligonucleotide; TTG chr2 60500914 60500935 60500931 60500936 +
ctgatggaactagttaaaagag

SEQ ID NO: 201311 - DNA, 22 bp, Artificial Sequence
  Synthetic oligonucleotide; CTG chr2 60500917 60500938 60500934 60500939 +
atggaactagttaaaagagtgt

SEQ ID NO: 201312 - DNA, 22 bp, Artificial Sequence
  Synthetic oligonucleotide; CTA chr2 60500926 60500947 60500943 60500948 +
gttaaaagagtgtctgtgaagc

SEQ ID NO: 201313 - DNA, 22 bp, Artificial Sequence
  Synthetic oligonucleotide; TTA chr2 60500930 60500951 60500947 60500952 +
aaagagtgtctgtgaagcaagc

SEQ ID NO: 201314 - DNA, 22 bp, Artificial Sequence
  Synthetic oligonucleotide; CTG chr2 60500942 60500963 60500959 60500964 +
tgaagcaagcctagctgggtgg

SEQ ID NO: 201315 - DNA, 22 bp, Artificial Sequence
  Synthetic oligonucleotide; CTA chr2 60500955 60500976 60500972 60500977 +
gctgggtgggcttgcaagcatt

SEQ ID NO: 201316 - DNA, 22 bp, Artificial Sequence
  Synthetic oligonucleotide; CTG chr2 60500959 60500980 60500976 60500981 +
ggtgggcttgcaagcatttctg

SEQ ID NO: 201317 - DNA, 22 bp, Artificial Sequence
  Synthetic oligonucleotide; CTT chr2 60500968 60500989 60500985 60500990 +
gcaagcatttctgggtcgctgc

SEQ ID NO: 201318 - DNA, 22 bp, Artificial Sequence
  Synthetic oligonucleotide; TTG chr2 60500969 60500990 60500986 60500991 +
caagcatttctgggtcgctgca

SEQ ID NO: 201319 - DNA, 22 bp, Artificial Sequence
  Synthetic oligonucleotide; TTT chr2 60500978 60500999 60500995 60501000 +
ctgggtcgctgcatcctcctct

SEQ ID NO: 201320 - DNA, 22 bp, Artificial Sequence
  Synthetic oligonucleotide; TTC chr2 60500979 60501000 60500996 60501001 +
tgggtcgctgcatcctcctctg

SEQ ID NO: 201321 - DNA, 22 bp, Artificial Sequence
  Synthetic oligonucleotide; CTG chr2 60500981 60501002 60500998 60501003 +
ggtcgctgcatcctcctctgta

SEQ ID NO: 201322 - DNA, 22 bp, Artificial Sequence
  Synthetic oligonucleotide; CTG chr2 60500989 60501010 60501006 60501011 +
catcctcctctgtaaaatggga

SEQ ID NO: 201323 - DNA, 22 bp, Artificial Sequence
  Synthetic oligonucleotide; CTC chr2 60500996 60501017 60501013 60501018 +
ctctgtaaaatgggagaaccct

SEQ ID NO: 201324 - DNA, 22 bp, Artificial Sequence
  Synthetic oligonucleotide; CTC chr2 60500999 60501020 60501016 60501021 +
tgtaaaatgggagaaccctgaa

SEQ ID NO: 201325 - DNA, 22 bp, Artificial Sequence
  Synthetic oligonucleotide; CTG chr2 60501001 60501022 60501018 60501023 +
taaaatgggagaaccctgaact

SEQ ID NO: 201326 - DNA, 22 bp, Artificial Sequence
  Synthetic oligonucleotide; CTG chr2 60501019 60501040 60501036 60501041 +
aactgctcagccgacctcatgg

SEQ ID NO: 201327 - DNA, 22 bp, Artificial Sequence
  Synthetic oligonucleotide; CTG chr2 60501024 60501045 60501041 60501046 +
ctcagccgacctcatggttgac

SEQ ID NO: 201328 - DNA, 22 bp, Artificial Sequence
  Synthetic oligonucleotide; CTC chr2 60501027 60501048 60501044 60501049 +
agccgacctcatggttgactca

SEQ ID NO: 201329 - DNA, 22 bp, Artificial Sequence
  Synthetic oligonucleotide; CTC chr2 60501037 60501058 60501054 60501059 +
atggttgactcactcagcaaca

SEQ ID NO: 201330 - DNA, 22 bp, Artificial Sequence
  Synthetic oligonucleotide; TTG chr2 60501044 60501065 60501061 60501066 +
actcactcagcaacagaggtct

SEQ ID NO: 201331 - DNA, 22 bp, Artificial Sequence
  Synthetic oligonucleotide; CTC chr2 60501048 60501069 60501065 60501070 +
actcagcaacagaggtctccac

SEQ ID NO: 201332 - DNA, 22 bp, Artificial Sequence
  Synthetic oligonucleotide; CTC chr2 60501052 60501073 60501069 60501074 +
agcaacagaggtctccacagga

SEQ ID NO: 201333 - DNA, 22 bp, Artificial Sequence
  Synthetic oligonucleotide; CTC chr2 60501067 60501088 60501084 60501089 +
cacaggagccctgcccacatga

SEQ ID NO: 201334 - DNA, 22 bp, Artificial Sequence
  Synthetic oligonucleotide; CTG chr2 60501080 60501101 60501097 60501102 +
cccacatgagacatctttggca

SEQ ID NO: 201335 - DNA, 22 bp, Artificial Sequence
  Synthetic oligonucleotide; CTT chr2 60501097 60501118 60501114 60501119 +
tggcacatcttctgaaacaaga

SEQ ID NO: 201336 - DNA, 22 bp, Artificial Sequence
  Synthetic oligonucleotide; TTT chr2 60501098 60501119 60501115 60501120 +
ggcacatcttctgaaacaagac

SEQ ID NO: 201337 - DNA, 22 bp, Artificial Sequence
  Synthetic oligonucleotide; TTG chr2 60501099 60501120 60501116 60501121 +
gcacatcttctgaaacaagacc

SEQ ID NO: 201338 - DNA, 22 bp, Artificial Sequence
  Synthetic oligonucleotide; CTT chr2 60501108 60501129 60501125 60501130 +
ctgaaacaagacctgtttctgg

SEQ ID NO: 201339 - DNA, 22 bp, Artificial Sequence
  Synthetic oligonucleotide; TTC chr2 60501109 60501130 60501126 60501131 +
tgaaacaagacctgtttctgga

SEQ ID NO: 201340 - DNA, 22 bp, Artificial Sequence
  Synthetic oligonucleotide; CTG chr2 60501111 60501132 60501128 60501133 +
aaacaagacctgtttctggaaa

SEQ ID NO: 201341 - DNA, 22 bp, Artificial Sequence
  Synthetic oligonucleotide; CTG chr2 60501123 60501144 60501140 60501145 +
tttctggaaagttgttggtaaa

SEQ ID NO: 201342 - DNA, 22 bp, Artificial Sequence
  Synthetic oligonucleotide; TTT chr2 60501126 60501147 60501143 60501148 +
ctggaaagttgttggtaaacat

SEQ ID NO: 201343 - DNA, 22 bp, Artificial Sequence
  Synthetic oligonucleotide; TTC chr2 60501127 60501148 60501144 60501149 +
tggaaagttgttggtaaacatc

SEQ ID NO: 201344 - DNA, 22 bp, Artificial Sequence
  Synthetic oligonucleotide; CTG chr2 60501129 60501150 60501146 60501151 +
gaaagttgttggtaaacatcca

SEQ ID NO: 201345 - DNA, 22 bp, Artificial Sequence
  Synthetic oligonucleotide; TTG chr2 60501137 60501158 60501154 60501159 +
ttggtaaacatccaattttgca

SEQ ID NO: 201346 - DNA, 22 bp, Artificial Sequence
  Synthetic oligonucleotide; TTG chr2 60501140 60501161 60501157 60501162 +
gtaaacatccaattttgcactt

SEQ ID NO: 201347 - DNA, 22 bp, Artificial Sequence
  Synthetic oligonucleotide; TTT chr2 60501155 60501176 60501172 60501177 +
tgcacttatttatattattgtt

SEQ ID NO: 201348 - DNA, 22 bp, Artificial Sequence
  Synthetic oligonucleotide; TTT chr2 60501156 60501177 60501173 60501178 +
gcacttatttatattattgttt

SEQ ID NO: 201349 - DNA, 22 bp, Artificial Sequence
  Synthetic oligonucleotide; TTG chr2 60501157 60501178 60501174 60501179 +
cacttatttatattattgtttc

SEQ ID NO: 201350 - DNA, 22 bp, Artificial Sequence
  Synthetic oligonucleotide; CTT chr2 60501162 60501183 60501179 60501184 +
atttatattattgtttcagaaa

SEQ ID NO: 201351 - DNA, 22 bp, Artificial Sequence
  Synthetic oligonucleotide; TTA chr2 60501163 60501184 60501180 60501185 +
tttatattattgtttcagaaac

SEQ ID NO: 201352 - DNA, 22 bp, Artificial Sequence
  Synthetic oligonucleotide; TTT chr2 60501166 60501187 60501183 60501188 +
atattattgtttcagaaacact

SEQ ID NO: 201353 - DNA, 22 bp, Artificial Sequence
  Synthetic oligonucleotide; TTA chr2 60501167 60501188 60501184 60501189 +
tattattgtttcagaaacacta

SEQ ID NO: 201354 - DNA, 22 bp, Artificial Sequence
  Synthetic oligonucleotide; TTA chr2 60501172 60501193 60501189 60501194 +
ttgtttcagaaacactaccttc

SEQ ID NO: 201355 - DNA, 22 bp, Artificial Sequence
  Synthetic oligonucleotide; TTG chr2 60501175 60501196 60501192 60501197 +
tttcagaaacactaccttcatt

SEQ ID NO: 201356 - DNA, 22 bp, Artificial Sequence
  Synthetic oligonucleotide; TTT chr2 60501178 60501199 60501195 60501200 +
cagaaacactaccttcattctg

SEQ ID NO: 201357 - DNA, 22 bp, Artificial Sequence
  Synthetic oligonucleotide; TTC chr2 60501179 60501200 60501196 60501201 +
agaaacactaccttcattctgc

SEQ ID NO: 201358 - DNA, 22 bp, Artificial Sequence
  Synthetic oligonucleotide; CTA chr2 60501189 60501210 60501206 60501211 +
ccttcattctgctttgattcaa

SEQ ID NO: 201359 - DNA, 22 bp, Artificial Sequence
  Synthetic oligonucleotide; CTT chr2 60501193 60501214 60501210 60501215 +
cattctgctttgattcaatggc

SEQ ID NO: 201360 - DNA, 22 bp, Artificial Sequence
  Synthetic oligonucleotide; TTC chr2 60501194 60501215 60501211 60501216 +
attctgctttgattcaatggca

SEQ ID NO: 201361 - DNA, 22 bp, Artificial Sequence
  Synthetic oligonucleotide; TTC chr2 60501198 60501219 60501215 60501220 +
tgctttgattcaatggcagcca

SEQ ID NO: 201362 - DNA, 22 bp, Artificial Sequence
  Synthetic oligonucleotide; CTG chr2 60501200 60501221 60501217 60501222 +
ctttgattcaatggcagccaat

SEQ ID NO: 201363 - DNA, 22 bp, Artificial Sequence
  Synthetic oligonucleotide; CTT chr2 60501203 60501224 60501220 60501225 +
tgattcaatggcagccaattta

SEQ ID NO: 201364 - DNA, 22 bp, Artificial Sequence
  Synthetic oligonucleotide; TTT chr2 60501204 60501225 60501221 60501226 +
gattcaatggcagccaatttaa

SEQ ID NO: 201365 - DNA, 22 bp, Artificial Sequence
  Synthetic oligonucleotide; TTG chr2 60501205 60501226 60501222 60501227 +
attcaatggcagccaatttaat

SEQ ID NO: 201366 - DNA, 22 bp, Artificial Sequence
  Synthetic oligonucleotide; TTC chr2 60501209 60501230 60501226 60501231 +
aatggcagccaatttaattcat

SEQ ID NO: 201367 - DNA, 22 bp, Artificial Sequence
  Synthetic oligonucleotide; TTT chr2 60501224 60501245 60501241 60501246 +
aattcatttggtccaaacctgt

SEQ ID NO: 201368 - DNA, 22 bp, Artificial Sequence
  Synthetic oligonucleotide; TTA chr2 60501225 60501246 60501242 60501247 +
attcatttggtccaaacctgta

SEQ ID NO: 201369 - DNA, 22 bp, Artificial Sequence
  Synthetic oligonucleotide; TTC chr2 60501229 60501250 60501246 60501251 +
atttggtccaaacctgtagtgc

SEQ ID NO: 201370 - DNA, 22 bp, Artificial Sequence
  Synthetic oligonucleotide; TTT chr2 60501233 60501254 60501250 60501255 +
ggtccaaacctgtagtgctact

SEQ ID NO: 201371 - DNA, 22 bp, Artificial Sequence
  Synthetic oligonucleotide; TTG chr2 60501234 60501255 60501251 60501256 +
gtccaaacctgtagtgctactt

SEQ ID NO: 201372 - DNA, 22 bp, Artificial Sequence
  Synthetic oligonucleotide; CTG chr2 60501245 60501266 60501262 60501267 +
tagtgctacttgccagaacaaa

SEQ ID NO: 201373 - DNA, 22 bp, Artificial Sequence
  Synthetic oligonucleotide; CTA chr2 60501253 60501274 60501270 60501275 +
cttgccagaacaaaatggaatg

SEQ ID NO: 201374 - DNA, 22 bp, Artificial Sequence
  Synthetic oligonucleotide; CTT chr2 60501256 60501277 60501273 60501278 +
gccagaacaaaatggaatgagc

SEQ ID NO: 201375 - DNA, 22 bp, Artificial Sequence
  Synthetic oligonucleotide; TTG chr2 60501257 60501278 60501274 60501279 +
ccagaacaaaatggaatgagcc

SEQ ID NO: 201376 - DNA, 22 bp, Artificial Sequence
  Synthetic oligonucleotide; CTC chr2 60501281 60501302 60501298 60501303 +
attccctgccctcaaggagctc

SEQ ID NO: 201377 - DNA, 22 bp, Artificial Sequence
  Synthetic oligonucleotide; TTC chr2 60501285 60501306 60501302 60501307 +
cctgccctcaaggagctcacag

SEQ ID NO: 201378 - DNA, 22 bp, Artificial Sequence
  Synthetic oligonucleotide; CTG chr2 60501289 60501310 60501306 60501311 +
ccctcaaggagctcacagtcca

SEQ ID NO: 201379 - DNA, 22 bp, Artificial Sequence
  Synthetic oligonucleotide; CTC chr2 60501294 60501315 60501311 60501316 +
aaggagctcacagtccagtggc

SEQ ID NO: 201380 - DNA, 22 bp, Artificial Sequence
  Synthetic oligonucleotide; CTC chr2 60501303 60501324 60501320 60501325 +
acagtccagtggctctgtcttt

SEQ ID NO: 201381 - DNA, 22 bp, Artificial Sequence
  Synthetic oligonucleotide; CTC chr2 60501318 60501339 60501335 60501340 +
tgtctttaatatctataagagc

SEQ ID NO: 201382 - DNA, 22 bp, Artificial Sequence
  Synthetic oligonucleotide; CTG chr2 60501320 60501341 60501337 60501342 +
tctttaatatctataagagcac

SEQ ID NO: 201383 - DNA, 22 bp, Artificial Sequence
  Synthetic oligonucleotide; CTT chr2 60501324 60501345 60501341 60501346 +
taatatctataagagcacaggt

SEQ ID NO: 201384 - DNA, 22 bp, Artificial Sequence
  Synthetic oligonucleotide; TTT chr2 60501325 60501346 60501342 60501347 +
aatatctataagagcacaggta

SEQ ID NO: 201385 - DNA, 22 bp, Artificial Sequence
  Synthetic oligonucleotide; TTA chr2 60501326 60501347 60501343 60501348 +
atatctataagagcacaggtaa

SEQ ID NO: 201386 - DNA, 22 bp, Artificial Sequence
  Synthetic oligonucleotide; CTA chr2 60501333 60501354 60501350 60501355 +
taagagcacaggtaagtgtcac

SEQ ID NO: 201387 - DNA, 22 bp, Artificial Sequence
  Synthetic oligonucleotide; CTT chr2 60501372 60501393 60501389 60501394 +
tgggggaaatgaagaacactct

SEQ ID NO: 201388 - DNA, 22 bp, Artificial Sequence
  Synthetic oligonucleotide; TTT chr2 60501373 60501394 60501390 60501395 +
gggggaaatgaagaacactctt

SEQ ID NO: 201389 - DNA, 22 bp, Artificial Sequence
  Synthetic oligonucleotide; TTG chr2 60501374 60501395 60501391 60501396 +
ggggaaatgaagaacactcttg

SEQ ID NO: 201390 - DNA, 22 bp, Artificial Sequence
  Synthetic oligonucleotide; CTC chr2 60501393 60501414 60501410 60501415 +
ttgtaatatgattaatcacttc

SEQ ID NO: 201391 - DNA, 22 bp, Artificial Sequence
  Synthetic oligonucleotide; CTT chr2 60501395 60501416 60501412 60501417 +
gtaatatgattaatcacttcca

SEQ ID NO: 201392 - DNA, 22 bp, Artificial Sequence
  Synthetic oligonucleotide; TTG chr2 60501396 60501417 60501413 60501418 +
taatatgattaatcacttccaa

SEQ ID NO: 201393 - DNA, 22 bp, Artificial Sequence
  Synthetic oligonucleotide; TTA chr2 60501407 60501428 60501424 60501429 +
atcacttccaaatactttacct

SEQ ID NO: 201394 - DNA, 22 bp, Artificial Sequence
  Synthetic oligonucleotide; CTT chr2 60501414 60501435 60501431 60501436 +
ccaaatactttacctggtttgt

SEQ ID NO: 201395 - DNA, 22 bp, Artificial Sequence
  Synthetic oligonucleotide; TTC chr2 60501415 60501436 60501432 60501437 +
caaatactttacctggtttgta

SEQ ID NO: 201396 - DNA, 22 bp, Artificial Sequence
  Synthetic oligonucleotide; CTT chr2 60501424 60501445 60501441 60501446 +
tacctggtttgtaagttctctt

SEQ ID NO: 201397 - DNA, 22 bp, Artificial Sequence
  Synthetic oligonucleotide; TTT chr2 60501425 60501446 60501442 60501447 +
acctggtttgtaagttctcttt

SEQ ID NO: 201398 - DNA, 22 bp, Artificial Sequence
  Synthetic oligonucleotide; TTA chr2 60501426 60501447 60501443 60501448 +
cctggtttgtaagttctctttc

SEQ ID NO: 201399 - DNA, 22 bp, Artificial Sequence
  Synthetic oligonucleotide; CTG chr2 60501430 60501451 60501447 60501452 +
gtttgtaagttctctttcgggt

SEQ ID NO: 201400 - DNA, 22 bp, Artificial Sequence
  Synthetic oligonucleotide; TTT chr2 60501434 60501455 60501451 60501456 +
gtaagttctctttcgggtgctt

SEQ ID NO: 201401 - DNA, 22 bp, Artificial Sequence
  Synthetic oligonucleotide; TTG chr2 60501435 60501456 60501452 60501457 +
taagttctctttcgggtgcttc

SEQ ID NO: 201402 - DNA, 22 bp, Artificial Sequence
  Synthetic oligonucleotide; TTC chr2 60501442 60501463 60501459 60501464 +
tctttcgggtgcttccctgagt

SEQ ID NO: 201403 - DNA, 22 bp, Artificial Sequence
  Synthetic oligonucleotide; CTC chr2 60501444 60501465 60501461 60501466 +
tttcgggtgcttccctgagtgg

SEQ ID NO: 201404 - DNA, 22 bp, Artificial Sequence
  Synthetic oligonucleotide; CTT chr2 60501446 60501467 60501463 60501468 +
tcgggtgcttccctgagtggca

SEQ ID NO: 201405 - DNA, 22 bp, Artificial Sequence
  Synthetic oligonucleotide; TTT chr2 60501447 60501468 60501464 60501469 +
cgggtgcttccctgagtggcaa

SEQ ID NO: 201406 - DNA, 22 bp, Artificial Sequence
  Synthetic oligonucleotide; TTC chr2 60501448 60501469 60501465 60501470 +
gggtgcttccctgagtggcaag

SEQ ID NO: 201407 - DNA, 22 bp, Artificial Sequence
  Synthetic oligonucleotide; CTT chr2 60501456 60501477 60501473 60501478 +
ccctgagtggcaagagggaaag

SEQ ID NO: 201408 - DNA, 22 bp, Artificial Sequence
  Synthetic oligonucleotide; TTC chr2 60501457 60501478 60501474 60501479 +
cctgagtggcaagagggaaagg

SEQ ID NO: 201409 - DNA, 22 bp, Artificial Sequence
  Synthetic oligonucleotide; CTG chr2 60501461 60501482 60501478 60501483 +
agtggcaagagggaaaggcctt

SEQ ID NO: 201410 - DNA, 22 bp, Artificial Sequence
  Synthetic oligonucleotide; CTT chr2 60501483 60501504 60501500 60501505 +
ttgcaagtactgacaccgcttt

SEQ ID NO: 201411 - DNA, 22 bp, Artificial Sequence
  Synthetic oligonucleotide; TTT chr2 60501484 60501505 60501501 60501506 +
tgcaagtactgacaccgctttc

SEQ ID NO: 201412 - DNA, 22 bp, Artificial Sequence
  Synthetic oligonucleotide; TTT chr2 60501485 60501506 60501502 60501507 +
gcaagtactgacaccgctttct

SEQ ID NO: 201413 - DNA, 22 bp, Artificial Sequence
  Synthetic oligonucleotide; TTG chr2 60501486 60501507 60501503 60501508 +
caagtactgacaccgctttctt

SEQ ID NO: 201414 - DNA, 22 bp, Artificial Sequence
  Synthetic oligonucleotide; CTG chr2 60501495 60501516 60501512 60501517 +
acaccgctttcttttttttttt

SEQ ID NO: 201415 - DNA, 22 bp, Artificial Sequence
  Synthetic oligonucleotide; CTT chr2 60501504 60501525 60501521 60501526 +
tctttttttttttttttttttt

SEQ ID NO: 201416 - DNA, 22 bp, Artificial Sequence
  Synthetic oligonucleotide; TTT chr2 60501505 60501526 60501522 60501527 +
cttttttttttttttttttttt

SEQ ID NO: 201417 - DNA, 22 bp, Artificial Sequence
  Synthetic oligonucleotide; TTC chr2 60501506 60501527 60501523 60501528 +
tttttttttttttttttttttg

SEQ ID NO: 201418 - DNA, 22 bp, Artificial Sequence
  Synthetic oligonucleotide; CTT chr2 60501508 60501529 60501525 60501530 +
tttttttttttttttttttgag

SEQ ID NO: 201419 - DNA, 22 bp, Artificial Sequence
  Synthetic oligonucleotide; TTT chr2 60501509 60501530 60501526 60501531 +
ttttttttttttttttttgaga

SEQ ID NO: 201420 - DNA, 22 bp, Artificial Sequence
  Synthetic oligonucleotide; TTT chr2 60501510 60501531 60501527 60501532 +
tttttttttttttttttgagac

SEQ ID NO: 201421 - DNA, 22 bp, Artificial Sequence
  Synthetic oligonucleotide; TTT chr2 60501511 60501532 60501528 60501533 +
ttttttttttttttttgagaca

SEQ ID NO: 201422 - DNA, 22 bp, Artificial Sequence
  Synthetic oligonucleotide; TTT chr2 60501512 60501533 60501529 60501534 +
tttttttttttttttgagacag

SEQ ID NO: 201423 - DNA, 22 bp, Artificial Sequence
  Synthetic oligonucleotide; TTT chr2 60501513 60501534 60501530 60501535 +
ttttttttttttttgagacaga

SEQ ID NO: 201424 - DNA, 22 bp, Artificial Sequence
  Synthetic oligonucleotide; TTT chr2 60501514 60501535 60501531 60501536 +
tttttttttttttgagacagag

SEQ ID NO: 201425 - DNA, 22 bp, Artificial Sequence
  Synthetic oligonucleotide; TTT chr2 60501515 60501536 60501532 60501537 +
ttttttttttttgagacagagt

SEQ ID NO: 201426 - DNA, 22 bp, Artificial Sequence
  Synthetic oligonucleotide; TTT chr2 60501516 60501537 60501533 60501538 +
tttttttttttgagacagagtt

SEQ ID NO: 201427 - DNA, 22 bp, Artificial Sequence
  Synthetic oligonucleotide; TTT chr2 60501517 60501538 60501534 60501539 +
ttttttttttgagacagagttt

SEQ ID NO: 201428 - DNA, 22 bp, Artificial Sequence
  Synthetic oligonucleotide; TTT chr2 60501518 60501539 60501535 60501540 +
tttttttttgagacagagtttc

SEQ ID NO: 201429 - DNA, 22 bp, Artificial Sequence
  Synthetic oligonucleotide; TTT chr2 60501519 60501540 60501536 60501541 +
ttttttttgagacagagtttcg

SEQ ID NO: 201430 - DNA, 22 bp, Artificial Sequence
  Synthetic oligonucleotide; TTT chr2 60501520 60501541 60501537 60501542 +
tttttttgagacagagtttcgc

SEQ ID NO: 201431 - DNA, 22 bp, Artificial Sequence
  Synthetic oligonucleotide; TTT chr2 60501521 60501542 60501538 60501543 +
ttttttgagacagagtttcgct

SEQ ID NO: 201432 - DNA, 22 bp, Artificial Sequence
  Synthetic oligonucleotide; TTT chr2 60501522 60501543 60501539 60501544 +
tttttgagacagagtttcgctc

SEQ ID NO: 201433 - DNA, 22 bp, Artificial Sequence
  Synthetic oligonucleotide; TTT chr2 60501523 60501544 60501540 60501545 +
ttttgagacagagtttcgctct

SEQ ID NO: 201434 - DNA, 22 bp, Artificial Sequence
  Synthetic oligonucleotide; TTT chr2 60501524 60501545 60501541 60501546 +
tttgagacagagtttcgctctt

SEQ ID NO: 201435 - DNA, 22 bp, Artificial Sequence
  Synthetic oligonucleotide; TTT chr2 60501525 60501546 60501542 60501547 +
ttgagacagagtttcgctcttg

SEQ ID NO: 201436 - DNA, 22 bp, Artificial Sequence
  Synthetic oligonucleotide; TTT chr2 60501526 60501547 60501543 60501548 +
tgagacagagtttcgctcttgt

SEQ ID NO: 201437 - DNA, 22 bp, Artificial Sequence
  Synthetic oligonucleotide; TTT chr2 60501527 60501548 60501544 60501549 +
gagacagagtttcgctcttgtt

SEQ ID NO: 201438 - DNA, 22 bp, Artificial Sequence
  Synthetic oligonucleotide; TTG chr2 60501528 60501549 60501545 60501550 +
agacagagtttcgctcttgttg

SEQ ID NO: 201439 - DNA, 22 bp, Artificial Sequence
  Synthetic oligonucleotide; TTT chr2 60501539 60501560 60501556 60501561 +
cgctcttgttgcccaggctggg

SEQ ID NO: 201440 - DNA, 22 bp, Artificial Sequence
  Synthetic oligonucleotide; TTC chr2 60501540 60501561 60501557 60501562 +
gctcttgttgcccaggctgggg

SEQ ID NO: 201441 - DNA, 22 bp, Artificial Sequence
  Synthetic oligonucleotide; CTC chr2 60501544 60501565 60501561 60501566 +
ttgttgcccaggctggggtgca

SEQ ID NO: 201442 - DNA, 22 bp, Artificial Sequence
  Synthetic oligonucleotide; CTT chr2 60501546 60501567 60501563 60501568 +
gttgcccaggctggggtgcaat

SEQ ID NO: 201443 - DNA, 22 bp, Artificial Sequence
  Synthetic oligonucleotide; TTG chr2 60501547 60501568 60501564 60501569 +
ttgcccaggctggggtgcaatg

SEQ ID NO: 201444 - DNA, 22 bp, Artificial Sequence
  Synthetic oligonucleotide; TTG chr2 60501550 60501571 60501567 60501572 +
cccaggctggggtgcaatggtg

SEQ ID NO: 201445 - DNA, 22 bp, Artificial Sequence
  Synthetic oligonucleotide; CTG chr2 60501559 60501580 60501576 60501581 +
gggtgcaatggtgtgatctcgg

SEQ ID NO: 201446 - DNA, 22 bp, Artificial Sequence
  Synthetic oligonucleotide; CTC chr2 60501579 60501600 60501596 60501601 +
ggctcaccacctctgcctcctg

SEQ ID NO: 201447 - DNA, 22 bp, Artificial Sequence
  Synthetic oligonucleotide; CTC chr2 60501584 60501605 60501601 60501606 +
accacctctgcctcctgggttc

SEQ ID NO: 201448 - DNA, 22 bp, Artificial Sequence
  Synthetic oligonucleotide; CTC chr2 60501592 60501613 60501609 60501614 +
tgcctcctgggttcaagcaatt

SEQ ID NO: 201449 - DNA, 22 bp, Artificial Sequence
  Synthetic oligonucleotide; CTG chr2 60501594 60501615 60501611 60501616 +
cctcctgggttcaagcaattct

SEQ ID NO: 201450 - DNA, 22 bp, Artificial Sequence
  Synthetic oligonucleotide; CTC chr2 60501598 60501619 60501615 60501620 +
ctgggttcaagcaattctcctc

SEQ ID NO: 201451 - DNA, 22 bp, Artificial Sequence
  Synthetic oligonucleotide; CTG chr2 60501601 60501622 60501618 60501623 +
ggttcaagcaattctcctccct

SEQ ID NO: 201452 - DNA, 22 bp, Artificial Sequence
  Synthetic oligonucleotide; TTC chr2 60501606 60501627 60501623 60501628 +
aagcaattctcctccctcagcc

SEQ ID NO: 201453 - DNA, 22 bp, Artificial Sequence
  Synthetic oligonucleotide; TTC chr2 60501615 60501636 60501632 60501637 +
tcctccctcagcctcctgagta

SEQ ID NO: 201454 - DNA, 22 bp, Artificial Sequence
  Synthetic oligonucleotide; CTC chr2 60501617 60501638 60501634 60501639 +
ctccctcagcctcctgagtagc

SEQ ID NO: 201455 - DNA, 22 bp, Artificial Sequence
  Synthetic oligonucleotide; CTC chr2 60501620 60501641 60501637 60501642 +
cctcagcctcctgagtagctgg

SEQ ID NO: 201456 - DNA, 22 bp, Artificial Sequence
  Synthetic oligonucleotide; CTC chr2 60501624 60501645 60501641 60501646 +
agcctcctgagtagctgggatt

SEQ ID NO: 201457 - DNA, 22 bp, Artificial Sequence
  Synthetic oligonucleotide; CTC chr2 60501630 60501651 60501647 60501652 +
ctgagtagctgggattacaggc

SEQ ID NO: 201458 - DNA, 22 bp, Artificial Sequence
  Synthetic oligonucleotide; CTG chr2 60501633 60501654 60501650 60501655 +
agtagctgggattacaggcatg

SEQ ID NO: 201459 - DNA, 22 bp, Artificial Sequence
  Synthetic oligonucleotide; CTG chr2 60501641 60501662 60501658 60501663 +
ggattacaggcatgtgcgacca

SEQ ID NO: 201460 - DNA, 22 bp, Artificial Sequence
  Synthetic oligonucleotide; TTA chr2 60501647 60501668 60501664 60501669 +
caggcatgtgcgaccatgcctg

SEQ ID NO: 201461 - DNA, 22 bp, Artificial Sequence
  Synthetic oligonucleotide; CTG chr2 60501669 60501690 60501686 60501691 +
gctaagtttatatttttaatag

SEQ ID NO: 201462 - DNA, 22 bp, Artificial Sequence
  Synthetic oligonucleotide; CTA chr2 60501673 60501694 60501690 60501695 +
agtttatatttttaatagagat

SEQ ID NO: 201463 - DNA, 22 bp, Artificial Sequence
  Synthetic oligonucleotide; TTT chr2 60501678 60501699 60501695 60501700 +
atatttttaatagagatgaggt

SEQ ID NO: 201464 - DNA, 22 bp, Artificial Sequence
  Synthetic oligonucleotide; TTA chr2 60501679 60501700 60501696 60501701 +
tatttttaatagagatgaggtt

SEQ ID NO: 201465 - DNA, 22 bp, Artificial Sequence
  Synthetic oligonucleotide; TTT chr2 60501684 60501705 60501701 60501706 +
ttaatagagatgaggtttctcc

SEQ ID NO: 201466 - DNA, 22 bp, Artificial Sequence
  Synthetic oligonucleotide; TTT chr2 60501685 60501706 60501702 60501707 +
taatagagatgaggtttctcca

SEQ ID NO: 201467 - DNA, 22 bp, Artificial Sequence
  Synthetic oligonucleotide; TTT chr2 60501686 60501707 60501703 60501708 +
aatagagatgaggtttctccat

SEQ ID NO: 201468 - DNA, 22 bp, Artificial Sequence
  Synthetic oligonucleotide; TTA chr2 60501687 60501708 60501704 60501709 +
atagagatgaggtttctccatg

SEQ ID NO: 201469 - DNA, 22 bp, Artificial Sequence
  Synthetic oligonucleotide; TTT chr2 60501702 60501723 60501719 60501724 +
ctccatgttggtcaggctggtc

SEQ ID NO: 201470 - DNA, 22 bp, Artificial Sequence
  Synthetic oligonucleotide; TTC chr2 60501703 60501724 60501720 60501725 +
tccatgttggtcaggctggtct

SEQ ID NO: 201471 - DNA, 22 bp, Artificial Sequence
  Synthetic oligonucleotide; CTC chr2 60501705 60501726 60501722 60501727 +
catgttggtcaggctggtctca

SEQ ID NO: 201472 - DNA, 22 bp, Artificial Sequence
  Synthetic oligonucleotide; TTG chr2 60501712 60501733 60501729 60501734 +
gtcaggctggtctcaaactctt

SEQ ID NO: 201473 - DNA, 22 bp, Artificial Sequence
  Synthetic oligonucleotide; CTG chr2 60501721 60501742 60501738 60501743 +
gtctcaaactcttgacctcagg

SEQ ID NO: 201474 - DNA, 22 bp, Artificial Sequence
  Synthetic oligonucleotide; CTC chr2 60501726 60501747 60501743 60501748 +
aaactcttgacctcaggtgatc

SEQ ID NO: 201475 - DNA, 22 bp, Artificial Sequence
  Synthetic oligonucleotide; CTC chr2 60501732 60501753 60501749 60501754 +
ttgacctcaggtgatctaccca

SEQ ID NO: 201476 - DNA, 22 bp, Artificial Sequence
  Synthetic oligonucleotide; CTT chr2 60501734 60501755 60501751 60501756 +
gacctcaggtgatctacccacc

SEQ ID NO: 201477 - DNA, 22 bp, Artificial Sequence
  Synthetic oligonucleotide; TTG chr2 60501735 60501756 60501752 60501757 +
acctcaggtgatctacccacct

SEQ ID NO: 201478 - DNA, 22 bp, Artificial Sequence
  Synthetic oligonucleotide; CTC chr2 60501740 60501761 60501757 60501762 +
aggtgatctacccacctcggcc

SEQ ID NO: 201479 - DNA, 22 bp, Artificial Sequence
  Synthetic oligonucleotide; CTA chr2 60501750 60501771 60501767 60501772 +
cccacctcggcctcccaaagtg

SEQ ID NO: 201480 - DNA, 22 bp, Artificial Sequence
  Synthetic oligonucleotide; CTC chr2 60501758 60501779 60501775 60501780 +
ggcctcccaaagtgctggaatt

SEQ ID NO: 201481 - DNA, 22 bp, Artificial Sequence
  Synthetic oligonucleotide; CTC chr2 60501764 60501785 60501781 60501786 +
ccaaagtgctggaattacagac

SEQ ID NO: 201482 - DNA, 22 bp, Artificial Sequence
  Synthetic oligonucleotide; CTG chr2 60501775 60501796 60501792 60501797 +
gaattacagacgtgagccactg

SEQ ID NO: 201483 - DNA, 22 bp, Artificial Sequence
  Synthetic oligonucleotide; TTA chr2 60501781 60501802 60501798 60501803 +
cagacgtgagccactgcgccca

SEQ ID NO: 201484 - DNA, 22 bp, Artificial Sequence
  Synthetic oligonucleotide; CTG chr2 60501797 60501818 60501814 60501819 +
cgcccagccttacactgctttc

SEQ ID NO: 201485 - DNA, 22 bp, Artificial Sequence
  Synthetic oligonucleotide; CTT chr2 60501808 60501829 60501825 60501830 +
acactgctttcttaattacagc

SEQ ID NO: 201486 - DNA, 22 bp, Artificial Sequence
  Synthetic oligonucleotide; TTA chr2 60501809 60501830 60501826 60501831 +
cactgctttcttaattacagca

SEQ ID NO: 201487 - DNA, 22 bp, Artificial Sequence
  Synthetic oligonucleotide; CTG chr2 60501814 60501835 60501831 60501836 +
ctttcttaattacagcagtgtg

SEQ ID NO: 201488 - DNA, 22 bp, Artificial Sequence
  Synthetic oligonucleotide; CTT chr2 60501817 60501838 60501834 60501839 +
tcttaattacagcagtgtgctc

SEQ ID NO: 201489 - DNA, 22 bp, Artificial Sequence
  Synthetic oligonucleotide; TTT chr2 60501818 60501839 60501835 60501840 +
cttaattacagcagtgtgctca
